United States Patent 9,719,064 (GENOMICS OF ACTINOPLANES UTAHENSIS) - sequence listing, part 3

SEQ ID NO: 5266 - DNA, 186 bp, Actinoplanes utahensis
gtgaccgacctgaacgcgctgctcaccctgtacacgacctggtccaaggctctggaagccgccgaaaaggacggccctgaacagtcggcgatccgggcagagatcgcggactacgaggcggcgaaagcagcccggcagatcgccgacctgctcgccgccgaaatcctcgagccggcctcggtctga

SEQ ID NO: 5267 - DNA, 225 bp, Actinoplanes utahensis
gtgagtaccgtctacgtggctgagattgagggccaggacctgcgcctaatcaaggacgggaatccgaacgtcccgtacgaccttgaggtgtacccgatctacgggcacgacgacgccgatcggtggcttgccaagcatggctacaccgatcacgacaactggggctggcgcaaggccaacagttcgaagccggcgatctggctgaagaacgtggtggcgccgtga

SEQ ID NO: 5268 - DNA, 174 bp, Actinoplanes utahensis
atgaccggccatgatctggaactgtcggcgccgtccacgtggccgcaggacgaacacgcgttctgtgggtgtggccggctgatgcggcgagacgacgccggccggcttgtgtgcgacgactgcgagacggcggcggacgacgctgcggtgatcgtggctgaggtgatgtcgtga

SEQ ID NO: 5269 - DNA, 252 bp, Actinoplanes utahensis
atgaacgtcttctcttaccggcttgtctaccgcggcaaggtcgaagccgagggtgtgaacagcgacttccagcatgacaacgctgaggacttcggccgcgcttacgccgctaccatcgacgccaaccgcccgcctcggccgtatccgctgcacttgctcgtgtgggaaggcgaagacaccagccgggatccggacttcaagcatcgctgtcgccggcacgtcgaccatgttctgaccggggtggcgtcatga

SEQ ID NO: 5270 - DNA, 195 bp, Actinoplanes utahensis
atgtccaccaccacctacgccccgcccgctggcgccgacaacccggacgacttcgaccgctgggagaaggagctggtcggcgacacccggcaccacttccggccgtcgaaggcggcgctgcgccgcgaggaccagcacgccatcgacgaagccctcggctaccaccggcaccgcaccaacgagcgcagggactga

SEQ ID NO: 5271 - DNA, 216 bp, Actinoplanes utahensis
gtgacagtgcggaccacccatccgctcactgctgaccgcgccgccctggccgccgctggcccgcaggctttcgctctgactcccgacgacgagcgcgagatcggcaacttcctgatcgaagtcgacagccttcccgacgaagacgccgcgctgaggctgcgcatcccgatcgacatggtcccgcaattccggcagctcatggcgacgggccgctga

SEQ ID NO: 5272 - DNA, 276 bp, Actinoplanes utahensis
gtgcacaccgcacccgccacctacccgtacagcaccgcccaggacatgctcctgggcgcggggctcaccgagaagcagactgtttccgtcatcagcaggctgagcgaggacggcgtacgtgttctggccgccagcgccagcgagccggcccggcaggttgttcacgctctcgctcacgaaacgattgcgggtctcgccgaaaccctgcacatgcaggccgatccggacgttgctgtggtccgtgagctgctgcgtcacgcggttggagcgtggtga

SEQ ID NO: 5273 - DNA, 228 bp, Actinoplanes utahensis
atgcaagatttcaacatcgagttcctctggaaggacgtggcttccggcggcaacggatgccacgccatcctcaagacagacggcggttactacgttcagggccgggtggttaccggcgacgaacgggcggcagtcctcagtcactccgaagccaacaggtctgggcttctcgacgatgaggatgtcatcttcgtccatggcaacgtcctggaccggctcaacagctag

SEQ ID NO: 5274 - DNA, 870 bp, Actinoplanes utahensis
atgcaggaccgcgaactcaagaaatggctgcttcagcccggaggcgtcgtcgaacgcctccgtcagctacaaagcacgggtaccaccaagacctccaacaacgatcttgccgctcgcgccggctggatcccgtcgaaggtgtccaagcttcgtctgggacagcaaacgcccacggcggatgacatccggagttgggttgctgctaccggcggtagcgaacaggatgagcatgaactcttggtcatgttggcagatgccgaacggcataccaccagcttccaaaaggcgctcaagaagggtcaggccgcccaccagcagacctacaacgaactcgttgaacaggccgatgttgttcgcatgatcgaacggtcctttgtgccgagcgtcatgcaaacgcgcgaatacgcgaccgcagtgctcaccggctcgatgaagctgcataagaccgctgacgacgttgcagaagctgtcgccgcgcgcatgcagcgtcgcaagttccttctcgacgagaagtaccggttcgagttcatcatcgacgaaacagtgctcacccggcgagtggcgccacccgaagttatgtattcccaggttgaccgcatcctggaatacatggacctgccaaacgtccggctcggcatcctgcccgtttacggcaccttccatgatgtcgtccgcaacagtttcgagctctacggcaagattggtgtcgttgaaacctactacgacgatgacgagctcgatgcagatggatggaccgcccatgccaacgcaatgcgtgacgtctggcaggacgcggtcgaaggcgacgaggcgcgaaagctgctccgcgccgccatgaagtaccacgcatccgacatgaacaagtcgtag

SEQ ID NO: 5275 - DNA, 555 bp, Actinoplanes utahensis
atgcggaaagtcctcaccgacggcggacctggaaccgagttttggcgagcgttcgaaacttttaagcggtcagcttggcgctgggagcagcagcctgcttatcacttgggctacgagcaggcacagttcgatcagttccttgctggccatccggagtcgccgcttgaaaatgaagagcttggctcgtggatgaagcaagttgccgcgcacgtcaaccacggcagaacgatcgggcgcgtgcgaatcgtagaaaccccgcctaccgactaccagcggtggatgcgctggatggacaagttcaaccgcggcgcgggcgaaaccatccagtacttgaccaggcatggagcacaaaaggcgggaatcatccctggcatcggcgccgaggactggtggcttttcgatgatcgaaggctcctcctaatgcgccacgatgacaagggccgcagggtaagggtggaagctgtcgaggatgaaccagaagtagaaaaggcgatctggtggcgagcgcaagcaatcgctgcagcgaatcgcgaagctgcgagtctagaagtttga

SEQ ID NO: 5276 - DNA, 159 bp, Actinoplanes utahensis
gtgatcaccgtcaacgaactccgccggctgttccacgctctggtcatcgaacccggcagacgcgtcgtcgacgtcattgcctggtcaatctatcgccgccgtcatcaatccgccgccaggaccagccactacgcccgccaagcactcacggaaccctga

SEQ ID NO: 5277 - DNA, 648 bp, Actinoplanes utahensis
gtgcttgaccacctgggccagctgcgtgccttcacctacacccggcccggaatcggcagtgcagacccgcggtcagcaccgaatccgcccttaccgcacagccggttcgccgacgagctggcagccctactcgacagcgcagggctgtcggagccagcggtgatcgtcgggcattcgttcggcgggaacatcgcccgcatgtacgccgcccgatacccgcaccgggttgtcggcctggtcttcgttgacgcatctatcccccggcagcgcatcaaccccgcagacagccggctcgtcgacggggacggcccggacgccaccgaaattgacttcctcaccggcgaagtagagatcttgaacgccaccctgccagacgtccccgccgtagtgctgcaaggtgacgcccggctgtggcctgacctcgtcagcccggtccatgccgacctgtgggacacctaccagcggatccttgcccggcaactcggttgcccactgatcctcgctgacagcgtcggccaccaggtacccacagacgccccagcgcttaccgcgatcgtgatcgccgccgttgcaaaggctgcggccaacggcagtgcagtgcacctggacgcgacgaagttcggccaggccggtggggtcatgctgtaa

SEQ ID NO: 5278 - DNA, 423 bp, Actinoplanes utahensis
atggatcttgacgagttgtcggctgcggtgatgccctacgtgtcggccgcggtcgctgcgtacggcggtgcgatggcacagcgggccacggatgccgccgtcgacagtggcagcaccgcgaccgtcgcctggggccgccagctcctggctcggctcgttgcctcgaggcgcggccgccaggtcaccgaggcagtggaggagctagctcgcgacccagctgacgatgcgtctcgcgtgctcctgcaggcccaagtgctgaaggcggtgtctatcgatgctcacctggcggccgaactcgagcacatcgtgcaggaagcccgggctgacggcgatcattacacggtctcggtgcaccacagcagcgggttccagatcggctcaaacaatcagcagaacgtcttcatgagaccgtccaccgaatga

SEQ ID NO: 5279 - DNA, 4032 bp, Actinoplanes utahensis
atgaacggcaacatttcctcaagcagccacttccagcagggcgacgacaatactcaaaacttttattacttcatctcctacggtgccgacggcgaggccgtacgcccagaggcgatgctcgggcacgtacgcgagctgacgccggccacgctcgaggaccgcgatgaggaattggctgagttggcggagttttgctttggagacgagccttacatgcggtgggaaggcgagccgtgggccggcaagaccgcactgctcggcttcttcgtgttgcacccgcccgagcgggtcgacgtgctgcacttcttcattcggggcggccaagcgtcttggaacgacagtttcgcgttcgaacaggtactccgcgcacaactgcaggcctatctggcaacgaccgaccccgggacggtgaaccccagccttctgcacctcgaccggacggatctgcttgaccgcgcggtgaagcacgcggccgcgacgggccggcgcttggccctggtggtcgacggcatcgacgaggatcagagccggagccgggccacgcggctgccgagcatcctcagcctgctcccggccgacccgtctccggtcctgcgtgtcattctggccagccgtcaccagctcgatcagccgaccgatgtagtagaccatcccgcgctcagctgccgagtccgccgtttgtccggctcggctcgggccgctcgcctgcagcgcgcggcgcggctggagctcgacaccctgctcggtatggggtcattggcgacggatgtgctcggtttcgctgtcgcctcggagggaggcctcagcattgcggaagtcgccgagctcagcggggcggaagcagagaaggtgcgtgagacgctggtcaacggcgccggccgcacactcgtgctcactgcgttcccggacggcggtaccggtttcgcgttcagccacgactccctgcgcctgggggccagcgaggtgctcggcgcatccaagatgagacagtatcgcgcacggattgacgactgggcccgcgcgtaccggtccctgcgatggccggccgagacaccgttttttctgctcgcccggtacggcaagcgtctcgctgacgctggtgaggtgggtccgcttaccgagcttgcacgggacaccagccggcacgcccgtatgcgagacgaactgggtggcgacggcccggcgttgacggaggtcgtttccgcccaggccttgtggcaacttcagcgagatcccgatttgcgcagcgccgcgcagctggccaggatccgctgggaattgacgtcacccaacctgcatatgccgccggagttgcccgcggtctgggcgctgctgggccagcccggacgggggctgaacctgatcgacgccctggaacggagtccgcaacggacggaactccagcagtcaatgatcgacgcgttgctgcatgccggccggccggatatagcagcctacgtggcctcggacctgccggacccggagcgcgaggtggcgttgcactcggtggccaccgccctgctcgccgccgggcaaacggacgaagctgacggcgtcatcggcttcgccgccgagaagtgcgcgaacggcattgaggtagtgatccggtatgcccggctacgcggcgcgacctacgcccggcagttccggcaccccggcgtccgtgaagctgcgttttaccaggtcatcgaggggctgtgcgaggacggccggatttcggaagcccaggaagtggccgccgagatacgagacgcccaggtacgcgggctcgccgatttgacgatcgctgacgccgccggccacccgatcagcccgacccttcaccggcgcgtgctggaactagccgcggagaatccacacctgagcgaaaccatcctggcaacccttgctcgctgtttagcccgggctgggagctaccaggaggccgaaacagccctgttgcgcacggccgacccggccgacgccggtcgacccgtgctggcgatctgcgttgaggcggggtcattcgccgacgccgaagcgctggccgcacggctggcccgcgccgcgcaccggctgagtcccgtcaacgacctctgcgacctgctcgtcgatgccgaccgcccggaccgggcgctggcgctggcgcgcaccctgccgacagccgccgagcaggtgggcagggtcgcggccgttggagcccggctcatgtcgcgcggtgaccctcgtggcccgggcgtgctcgaggaggcggaacggctcgccagcgaaaccggcccgaaagggtacgcccacctggcgatcctggctgcccgtatggccgacgacgctttgatgacgcggagcctgcgacgcgtgcccgacgacgccctcgtttcggtcgcctccgcgatcgccgagggcggttgggagagtgccgccatgcaggccgtcgacctccttgatgatccggtccaggaggcctacgtcgcccttcaactcgccgaggccgccatcgaacagaaccggccacaggtggcccggcgagccgcgttgttcgcagttgagcgccggctgaccggcaccgatttcgacgtcgacgagcctgacttcgatgccacagaggtcgatccgctcgaccttgacgaggctggcgtgatacttgcaagggccgcgcggattctggccacagtgggtgacgttagggcggcgttgcgggtggccacggccgccgacaccgcgtcacgccagaccaccgatccggagcgggcggacgaggacctggcgttagttgcgtgcgccgaggcggagttgggtgatctcgagggggccgagaagcggatccggcgcatcggtgacaaagagactcgcagggaagcgctcagccagctcgcccggcttgccaccggaaagccgcgcgccgacacagaggcgagtgatgaggatgggacgggagagctcgcagcccggctcgccgaggagctgcagggtgacatcctgcaggaggtcaccgcagcgctcgtggcgagccagcgcctacggctggcctcccggctggctggccgggccgcggagcctggcgagcgtgcccacgccctcgccgtcgtagctcagggctacctcgaggttcgggacgccgaccatgccgatctacttgccatacacgcactgagaatcctgcccacgggagaaagcgtcgagcactccgagacggcggcatgcatcgccaccgtcttcctagcggccgggcatgccgatcggatcccggccgtcgagcagcagctgcgactcgcctggcagcgggccgtctttcacgcggagctggcggtgcagacgattgccggcggcacgctgacccccgatgccgctgtccgctatatccgccgagcagagcagatcgccgaggcactggtggatccatgggaacggtgctgcgccttcagccggctgatcaccgcttggagcgcggtcggcgacgccccgagcgtcacgcggatgatcgccgctgccacggaggccgccgtcggctgcgacggttcgtggatgcttcccgaaccggtcgttctaggcatcgacgcattgctgcggttggaccggccggaggaggccgctcggctgctccaagacgacgccgagcacaccccggcgatggaggtctacttggccgaggcgctcgccgagcacggccacctagatgccgcgctgcattttgcccgctcgttggcgccggagcgtgcgttcacgcaacgctggaacgtgttcacctcgggaccgggcggtgacgacgtccgcgaccaagctctcgcccgcatagtcgctgtcatggcgcgggacggcggacgccccgacgatgcgctgcggatcgtcgaggagataaccagcccgtgggcgaaggccggagccatgaccgatcttgcggtaggcctggcccgcgggcgacggcccatccgcgcgaagcaggtcatggcggccgcactggcgctgggagagtggacgatcccgttgcgcggtctcgttgtggttgaacccgacgccatccgggccgctgtctcccagcgcgtcattgacctgtaa

SEQ ID NO: 5280 - DNA, 3291 bp, Actinoplanes utahensis
gtggtcgtgttcaccgtcgtcttgacgacggtggtcagcgtacgagccaccttgaacaccgccagcacgctctggggcgtgatcagtgcgttggttgccttcggctccactgtggcgggtatgaaactgctcaagcccgatgtcacgccgtcggatggagcggagcttgaagctgcgctggtggccgacgtgcgccgccaattgcaggaggaggagcgtcggcaacggctgaatgatccttggccgataccggtgcaactaaggccagcggatgcggcgatcaccgatcattggcaggtgatccgtgcgggagacggtgatggcaccccgctgccgctaaccggcaacctgtcgcaaatcgacacccttttttcggccataccttccggccgaatggtgctgatcggcccggctggctgcggaaagactgtcgccgcgcgcaggctggcggtgctgcgagccgacgcctggcaatccggccagcccgtacccgtgttgctgtccctggcggcatggaacgtcacccgccagccgttgccgcaatggctagtgcagcaaatcgccgacgatcatccggcggtgccgcaggcgcgaactgtggcgaggacgctgctggtggctggtcggctgttggtgattctggacgggttcgacgaactgctgccacaggcgcgtcggcaagccttacacgaaatcaaccagagcctgtcggccccgcagcttctggtaatcaccagtcgcgcggacgaatacaccgccgaggttaccgccagcgacgtgttgacagcggctgctgtgctgcgattgcagccggtgcctttggcgaccgccttcaccttcctgcaggaggccgggccgccaacaaccgcggcccgctggcgcgacgtgcaggcacgggtgactgagcgggacccgcttgccctggtattgcggactccgctgttcgtgaccatggcccgtgccctgtacgacactgcagcggccaatcccgccgagctccttgaccgtgcccgactgcccgaccgtgctgcgctggagcgaaccttgctcggccaatacgttgatcaggctgcccgcagcatcgcagcagacagcgggggcgtcatctcgccccggcgagtggccacagtgcatcggcatctgcgaacgctggccgcgatagtccgtacgggccggacgggtgacctcagctggtggcaaaccccccacgttgtacctgccgtagcggcggctgcgccgatttccatgacactcggcctgctaggtgcggtgagttttgcggtggtgctcggcggcaagtggcaggtggcctgcacctccttgttcgccaccctggccggggtcttcgtggccgtgaccgtgggggctatcactcttcctccgcggcctaccgcaggcggccggtacgtcgagaagccgcactggatgcgggccattccggtgccggcactcgttgccggggcaggtgccgtaagccttctggctgctgccgttggcggggtcgccgcggtgtatggcgcgcgtacgctcgtcgtggatctcacggggctgctcttcgtcgttttcgccacggtctggttgttgtcgccctcgtgggccgatcttcgctacaccgactgggatcggcgtcgggaaaggtggctgggcaccgcgctagctttcacctgcggaggcgcggtgttcgtggccggcgcggtggagggacaggtgagccccgggcgggtctatcagttcgccgtgctggccgggtttgctgtcgccgcggccgtgagcggcatcattgccggccgacgccctcgtgtgcgatcacgtcacaggcggcatcgcgcgtcgcgccgccgcgtgatgctgagctggctggttgcggtgaccgtggcggcgctgctgaccgcagtagatccgtttctgtggtggggtgcggtccaggccgcggtggtggccttggctctgcggctgcttggagaaacgttggtgagcatcggacccggctaccgaactccgcgccgggtcgcccctcggctcggtgacgcagctccggtcatcgtgccacgtgtcggtctgggcgcaattgcgggagcgattgccgtgaccgttatgacgttactgttccctgcactttcctggccggtgtggtgggcggcggggatcagtacaggcgaccttccggtgccggcgttgccggcgttggcggacatggcaccgttcgtgttcgtcggcgctttgacaggattgctggtcggtgtgctgcattgggtcttggcccccatcgaccatggccggatggcgggcccccgacaggcactacacaccgacgccacagtgttagggctgctgctggccgtgccggctgctgttgccggcacattggcggccgtcctggtcggtcagcacccgcatcggcccgcactcgtgttcgtctgcgcggtcctgctgatcatgctgccggtactggtcgcagtcgtacgtacgtcggcatggttgcaataccgcacggcacatctgtggctggctgggaccggccggctgccatggcggttcctgcgcctgctcgagcaggcccgagacgccggcgtgctgcgacagactggaagcacccatcggttccggcacgtacgcctgctccatcaactgcacgtacctgcgacgaatgtgaccggttcccgccgtcgcgcctggccgccggaggagtggcctgcggcctggcgttggtcggccggcgcggcagtgtgcttgctcatcgccggcggcgccgtccgccaggccgacatcgttgcagccgctgaacagactcaaccgacgctagccacgccgacctggcaggacctgcagcggcacggcgcatgcttacccgggtgtcgggtgaccggacacgtcgccgtcaatcacaagtcctgggggcctgtcacattgcttagcacgttggacgaaagcggagatgagccgatcgctggcgtcgtcgtcaccgaccggaccgggaaggtacgttggcagcaagagttggacacgtggactgaactcacgatcgcgggccgggaccgtaccggtaatgttttcctcattttcagtatgggcggggacaaaggggtggtggtgcttcatccagtccgccgcggcttcgccgaactcggcccctcgccggaagatccgtacttcttctcaagcaatctcatcgatgccggggacggctcgtacgccattgaccaaagcatcaacgactgtagtccaccttgcgccgacggcgcggtaacgcatactcgctactactggaccggcaaaagttaccgtccttga

SEQ ID NO: 5281 - DNA, 399 bp, Actinoplanes utahensis
gtgacgcactctccccgcgtcctggacgcgtccgcgctgattgcgatgttcggcgggcatccggacctcatggagatgctcgatgacgccgagcgcggcaatgtgttcctgctactgccgacggtggcggtcgcggaggccgaagcggcgctgaacgtgggactcgccttgtggaccccgttcctgatgtcccggggcgtcaccacgcttgatctgaccatgcataccgcggtggaggccgcgcgactggctgatccgcagttgcccggcgcggtggcgggcccgctgatggccggtcaggtggcgttcgaggcgcaggcacttaacgcggtggtcgtcactcagatgccgagcatgtatgccggctacgaggtggcaatcatgccggtggaagcgtag

SEQ ID NO: 5282 - DNA, 126 bp, Actinoplanes utahensis
gtgcactgccaggacatcggctgcatcacccacccgcaggatgcgctgttcgagcagtggccggccgcacctcaccaccaccccggcgcgtcgtttacgactcaggccggcgaagctacgaactag

SEQ ID NO: 5283 - DNA, 588 bp, Actinoplanes utahensis
atgaccttccgtgacaagtccgtgatccgacaccaatcgggtagccgcatcgatacgctacgaagtgccgggagttcagcaaaccccgtccggaaggtgccagactcgacgacttcgacccgcgcagatgtgcggaatccatcacctggcgagggtctaccccctacccccatgacggcatacgttgcggcgatgagcaccgcgaccgacatcgctgccgccctacgcgaacaagcacaggcgcagatcccatacgggctaagcagcaacctcaccgatgtccagtacgacgcagcccggtttgctgttgcctccttcggcgcgctgagcgccatggacctggaggcgctggtccgagggcagggcccctggacggctacacccaccggcaaggccatcgacatcacagtcattcgcgacaccgtccgcgcccagcaggagatcccggagggcaacgtctccggctatccccagtccctgcgccaggcgatgctgcgccctgcagaccagcgtccgccgagagccgccacgcccgactctcccgaagagatcgaggcgttcatcgccgacgttaaggcgagaatgtga

SEQ ID NO: 5284 - DNA, 342 bp, Actinoplanes utahensis
ttggagttcgccgaggcctggggcgggcgatacccggccatcgtccggctctgggagaacgcctgggccgagttcgtgccgttcctggcgttcgacgccgagatccgcaaggttgtctgctcgacgaacgccatcgagagcgtgaacgcccggatccgccgggcggtccgggcccgcgggcacttcccgaatgagcaggccgccctgaaatgcgtctacctcgccgtgatgtccctcgacccgaccggcaccggccgccgccgctgggcgatccgctggaaacccgccctcaacgccttcgacctcgccttcgaaggacgactcaccgcaggccgcaactga

SEQ ID NO: 5285 - DNA, 1476 bp, Actinoplanes utahensis
gtgacggtgttcctcgccaagcccgacaacggccccgccctgcccaccggacacccggccgcagcacgaagctggatcgacgctgtctcggcgcaggtcaccgccgtcacgcactccacctggctcatctacggggtatgcggcgtcctcgccggactgctgaccatgtccctgtacggacggaaccggcgcaccaagaacaccgacaaagctgagctcaccggcaccgaccgggccgtcacccgcatcaccggcatcctcgccaccgccgtcgtcgccctcggcgcctggaaagtgttcggtgacgtgctgcacctgcactggttcttccgcatggtgctgttcttcttcgccgaagcacagatcgtcgccgcctggcgacgggtacgccgccacatccaccggcacgccaccctcggccccggcattcgcaccatctacggcatcgccctcggctccgccctggtcgccgccatggacgccgaccggatggtcgaggtagtcctgcgcttcttcgccgcactcgtcgccgcctacatgatctccgaggagttggcggaagaactcgacatccacctccaggcccaccccgccctcgccggcaccgcgaagaaggtccgcggccggatcaaatgggcgctcacccccgaacggatccttgtctggctgcgcctcgccgaaccctccgaacgcaccgtcgaagaagtcgagcggcagcggcgcatcgcccgattcgcccgcaccgcataccggctgcacctgctccgcgagaacaacgccaagaagtggcgcatcaacctcgcgcagtggtcgctgcgcaggcagaccgaagccgcgaacgaacacctgcgcctcgccaccgaccaagcactactcagcgacatgcgcgcccaactcgccctgctgtaccaagtcgaggacaccaccactcgggccgcggtcgccgacctgaacccgctccgccccacccaccccgacacccagcccggctcgcagacggtacgcaccagaactcgcagcagcgagactcgcagcgaaaccgaacgcacccagccgcccacccagaccgcgaaccaggctgcgaaacccagcgagaacccagccgagggcaccgttgagaagccggccgagaaggccactgcgaactcgggtgcgaaccccaaaacggtcgctgcgaaacccagccacccgctcgccgaccaccccgtcgacagcgtccgcaaactcgcccgagccttcgcacgcaaccgggctctcaccaacgctgacctgggaagaaaggccggagtgagtaccggcactgcgaaccggtacatgcccgatgtgcgggccgcgttcaacgccgctgagaaccagacgacccggccagagcgaacccagcaggttcgcatcccggtacccattccgcagccttcgcagcccgtccttgcgggcgtcaacggctaccaccaaacccccgaggagaacctccgatga

SEQ ID NO: 5286 - DNA, 189 bp, Actinoplanes utahensis
atgaccgacacgatgaccaccaccgccgaagccacggtgaccctcaccgtcaacggcgtcaccaagacgttcaccgcaactgtgaacagcgacggtgaccccagcaacgccgctttgtccgccctctccgctgcgaggggcgacgccgccgactggaccggccgaccgctgcgggaggccctgcgatga

SEQ ID NO: 5287 - DNA, 300 bp, Actinoplanes utahensis
atgaccaccgacctgaccccgtaccgcgccctcgacctaggcaccgtaggggagccggccgccctggtcgacaagcccatcggcccggtcactctgccgccgcagccgccgaaacccagcaaaaggcaggccgtcgacaccgcgggcagcctcaccctcatcgccggcgccctcaccgggctcgcgttccacgccggcagcagccccgagctggtcatctacccggtcggggcgtcgatcgccgcgatggtgatcgccgccgtcgtgcacctgcgcagcatgcccaaggtcgcacggtga

SEQ ID NO: 5288 - DNA, 240 bp, Actinoplanes utahensis
atgttgaaggccgtccgtggcactaccgccgagcagcgtgcgaaagcccgtcgcctcgttcgcggccaacgccgcctcgcgttcttcaaagagaagatcaaagacgccatcgagggtaaaagccgggtcgagcaggcctgctactacgtccaggccgtcgccgctgaccttgacgagcgcggacgcaacgaactggctctggcagtcgcggaaatagccgatcggcggaacccgcgatga

SEQ ID NO: 5289 - DNA, 426 bp, Actinoplanes utahensis
atgaccatcgctgacgcgttcgacggggtgttcccggaagccccgtcgaacgcggctaccaccaccgcgacccggccggcccggccgacggtggtgcccctgcgccccgccgataccacccgggcgaaagcccggcagcgtccccacgccgtgatccggctggcccgcatcgtctatctcgacgccgccgactcgtggatcaccgaggaacgctccccgtccgcgaaaaccgtgtggcgcaccgactacaccgccggcctcgacaccgtctggaccccgtaccggtactggacgtacgcgtggcggcccatcgccgtgctcgccgccctgttcttagacgccctgaaatttctgttcatccacccgttccgcggcccggtcagcaccgccatcatcgccgcgctgatcctgcttgccacccactga

SEQ ID NO: 5290 - DNA, 396 bp, Actinoplanes utahensis
atgctcaacatgttcagcagcctgctcgccaccgtcgggggactcatcgtcttcgccggggcctggtacatccaccagaaggtgcgactcactcgcaccgcctgcgtcatggccgccgtcggcggcttcgtcacctactccggtgtcgtcggctcctgggccaaccagtacgccaggcagctcggcatcgtctgcgccgttgccgtgttcgtcggcgtgtgcatcatcgtcgctgacatcaagggcaagaagaagggcgccgaccggcccgccttgattgcgttcttcctcgtcccgatcttcctggcgtctgggatcggtgtcctgcccacgatcaccaagggtttgcgtgacggcgtgcagaagaacaccacccagatgcagaagatgggctga

SEQ ID NO: 5291 - DNA, 1521 bp, Actinoplanes utahensis
gtgggcctcgagttcctggtctgcctgctgctggcggccttgttcaccggtggccggttcgtgcaggacaccatcgccaccgccaaaggcaccacgccaccgcatgtggaacgggcccggatccgcgccgagggacgcgcccgggcccgggaggcagctaaaccggagaaggaacggtcaccgtacgcggccggcaaacccggcctgaaggacgttgctgccgtctactggggtgacgccctgcaggacgtgatcgacgcccacgagcagcgccgcgccgagaagaaggcgcagcggcaggagaaccaggccgcgaaagcggagaaccgtccggcccggcactttcgtccgtcgctggccgagcgggtcgaacgcctcgcgaagttgctgtgggaaggcccgcaacgccccgccgaggacgaactggtgcccagcgttgacgaagtactcatcgccgaaccggcggccggtgccgacaccagcccgccgccgggtgggcccggcggatcccgggtactcatgcgatgggactgcgagcgctgcggcaccggctgcggcggctatgactccgacgacgcagccgctcaagacgcgcaactgcatctcaacaaggtgcatgggggctgcggcaaagtcgttgccggtcgcatcgagtttctccccggcgacccggacggggaaagcccggcccgccactgtgatacctgcggcaccacggtcggcatgacccgcaatgtgacccgttgcatcccgtgtattgctatcaacgcgacgcgggagcagccccacggaacgcgcccgacccggcacacgcaggggcactggggcaacggcacgtttgttcgtgcctccgcccgggattcgcagacgggggatgcctacaactgggcatgccagcactgcggtcaaacaacgcgccgggagttccccagccctgccgctgcggacgccgactactacagcacccacatgccgtgcccgatagctggcgacctgaagccgggcagcggcggcctctgcttcttcacctgcgggcagtgtgggttcgacagcgggcaaatctatcccgaccaggatgccgcccacgccgccctgaaagcccaccgatgctccaaccccaacaaccaggaggacgccatgaccacaccggcaaccagcggatccgccaccggcgacgcccacgacctcgaatcggccagcaacgagtgcgacctgctcgacggcgacctcacggcggttgacaccgccctggacctgatcgacgaacggatcacctcggctggtgctgctgccgagcggctcaaggggtttctggactcgaagagcatgccggacagcatcaccgccggaatggccaccgctctggagatgctgtctccggagcacatcaaagcgctcatcgatgccatcgccgcggccaagaccggcgtgcgcgcctccaaggaggcgatcgacacgatgaacgagcaggccaccgaggcgctgcagggcgccgacggatccgccgtcaacggacgctga

SEQ ID NO: 5292 - DNA, 2376 bp, Actinoplanes utahensis
atgagtgttgaccaacgccccgccccgacccgtgacatgccgcccggcggcagcccgccgacccgcccccgcacggcgtcccgcggcccggacggtcaactcaccgtgcccagcggcgccgcattcctgtcctggcactaccgggccgcggacggcaaaacggtgaaagcccgcaagcagccggtaccggtcagcgacggcggggaactcacccattacgagatggaatgccccgcctgcccggacagtggacagtgggtcagcgtcaaatccaaggtccaccggccgctgtgcgcggtgtgctgcaccgaactacgccggcccggccagcgtcagtggaggctgtcgagaatcccggtgcggcaactgctgcaggaacgccgcgcgcacgtcaacgccaccgctacaaccgccgcggtgggagccgccgggctggttctcgacgccgctgacttcccgtggtggggcgaaatcgcgcaggccgccgccgtcccggcgtgcgtcgccgggtcgtggtggttcacccgcgcctggctgacccggtacagcaacaccgccgacttcccggacccgaccgtggaaccgacgaacgctgtgatcgcccagcgggcccggaccgccgcatacctggccgccgcagccggcgtgtggtgcgagcttgccgacgccatcaacctgaacatcaccactggagacggcggactcgccgtggcggcgctgctcgggctcggtgtgatcggttcccgcccctacctccgctgggcgcaggcgcggcgggttcctgcaccgcagcctgctatcgacgaggacgacgagccggtcgacgatacgccgcagccgactgaagctgagctgctgcgcgcctacgtgctggagcggtgggagaaagtgtcggtgaagggccgggtgttgcacggcacccggctggaggacatcatgccgtcggtgggtggctggtctgggcggatcatcgcccatgaggactccgacttggacccggagaagttcgacaccgccgagcctctgcggaagatcgcccgcgcgtactcggtgggcacgagcatggtgtcgatcgtcgcggacccgttcgacgcgaaccaggccaccatccttgtgcagcggaccagcccgctcaccaagggaaacgactggtccggcaacggcatcgacctgaaaaccgggtttgcggagacgatgaccctggaggacggcacccgcggacggcacccgttttggcgcccgggatggggtgcggtcatggagctcattgctggcgcgacaggtgccggtaagagcgagtacctgaacctgctggccgcgctggagcggcagtccggtgttgtggtgtcgtggatcggtgacccgcagatgggtcaaagcctgggtgacctgcgcgacggggtggactggttcgcgccgtcggtcgaggaaatcctggtgatgctccgtgtcgccgccatggtcatgatcgcccggaatttggtgacgacccgcatgcggcgcgaagagacccgccccgatggccgggtggtgcagcgccgcgtcaagtaccgggaggtgtccccggacttcccgctgctggcgatcaccatcgacgaggcgcacattccgatgaacgaccccgaccatggcaaggagatcaccaagctgctggcgctgctgtcgaaatccggccgcaaggccaacatcaaggtcaggttgctgtcccagtcggtcctgctgtcggagatcaaagactcggtgctgcgcggccagctcgcatccggattcgttgcggtgttccgcaccgccgacaaactcaccggcaccgccgcctggccgggtggccggatgccgggcgacccggcgaacctgcctgccgcgtgggaagacggcttctccaccgccggactcggctacgcgtcatcgaccaagcggatgcggatgcgcaccgactatgccggcgacctctacgacctgatcaccaccggtgacacgctgggcctcgaagcatcagtgctcggcgtagccgggccgttgtacgccgaccggtggaagcgcctcgaagccttcgacagcatggacccggccgaactgctgggggccggcatcccggcgaacctgctcgacagcgcccccggcgacacagcaccgccgaccggcggccgagaggccgtgctgcggttcttcgccgaacggtggctggacggcgaccgcgaccccgtgccgttcggggagctcgcgggtgcggtccgcaccgtcatcaagacccgcgcatgcaccaacgccgtcaacaagctcgtcgacgagcagatcctggccaccgacaagggcgcctactggctgaccgagtcgggcgccgagcagatgggcgttctcgaagaggtgccagcgtga

SEQ ID NO: 5293 - DNA, 201 bp, Actinoplanes utahensis
atgaccgacgccgacaccatgcgcgcccttactcgctacctggacgacgccagcaggcgggaacgtgccgccgacgaacggaacaaagccatcgtcggcgccatcgaaaagggcttcgcgtcgctggtcaaagagctccacgatggcatcaccctcatccagcacactctcatcgacgagctgcgcgacatgcggcgctga

SEQ ID NO: 5294 - DNA, 432 bp, Actinoplanes utahensis
atgatgggtaagtctcatgccctgtccggcgccgtcggctggcttgctggctgtgcggtactcgcggctgccggttcggaaccttcacctctgaccgtggcgatcggggcggccgtagctaccggcatggccctcgctcccgacgtcgaccacccgcagtccacgatcgcgcactcgctgggctggctcacctgcttgatcgctgggggagtcgagcgcgccgccgcagtcctgcgcacctcgtcctgccggcactgctcgaccggccccgatcggggcgggcatcgcgggatcacccataccgcgctctgtgctgttctggccggggccatcaccacgaccgcatgcctggccgccggccgggtcgccgccctcatcgtggtcggagtggcggtgtggctgccgcgcacgccgccctgtcgtcgcggctga

SEQ ID NO: 5295 - DNA, 729 bp, Actinoplanes utahensis
gtggaagattcgttccggcgcaccgtggcgcgatgtgcccgcccggtacggctcctggaagtcgatctacacccgtttccgcaggtgggcactcaacggcacgttcaccaagatgctcaccgccgcccacgccgcagcagacgccaacgccgacatcgactggttggtctcggtcgactccacgatcgtgcgggcccaccagcacgccgccggcgcaaaaaggggcgctcggaaacggataaaccggatcacgccttcggacgatcccgtggtggactgaccaccaaaatccacctggcctgcgacggcgccgggcgggtactggcattcgtactgtccggtggcaacgtcaacgactgcacccgcttcgagcaggtcatggcggccatccgcgtcgaacgcatcggaccgggacgcccccgcacacgaccggatcatgtcatcgccgacaaggggtacagcagccgcgcgatccgccgctacctgagccgccgcggcatcgcgcacaccatcccagagcgctcggaccagcagaaaggccgccgcaaccgtgggcctcgcggcggccgtccaccgacgttcaacaagctgatctaccggcaccgcaacgtggtggaacgctgctccaaccgacttaagcaatgccggtccgtggccactcgctacgacaaaaccggcagctcgttccaggccaccgtcaccatcgccgcactgctgcagtggctatga

SEQ ID NO: 5296 - DNA, 429 bp, Actinoplanes utahensis
gtggccgctccggatccggggctgccggtggacaccggtcggcacgcctcggtggatgcggttccggaccggctccgggatagaaacggttgtcgtgtggatgctcgccgtaaccggcgctgcttccctactggcgctcggactcgcgcaatgaccgaagctaacgagcacccgccgtggtgcacccgggaggaaaccctgcagtcgctgacccggcaccgctccaacgaggtgcgtgtcgggacgtggcgacggcccgcgaacggcggacaagtttcggcccggctcacctccgcctacgacggaccacccgccatcgcagtcaacgtgtggatcggcgtcggcgtgaccgcgtcgatcagtctggagcaggccgaagcattccgggacgggctcacccaactactcaacctcgctggccgcgggtag

SEQ ID NO: 5297 - DNA, 234 bp, Actinoplanes utahensis
atgcccacccagtacgaacgcgccgtcatctcggccggcactcgctacgaggccggggtgattactgacgcgcaggccgtccacgaaatccggcaagcggcctacacggcaggcagtgatgccaccgtggccaccgccacccacacgccgacgaactggcgggagcttgccggcctcaaccagagtgccgtcgatgggccgtctaacggcgaaacggtgagaatgctggcatga

SEQ ID NO: 5298 - DNA, 378 bp, Actinoplanes utahensis
atgacaacgcggaaaacggtgcccgtccccgaggacgtcctgatgcacctcacccacgctctggtcactgataccgcccgactcaccctcgacgcctggtcgcccggcgatgtggttcgcatgggtgacccgttcggcaaagtgctgtcgtggttgtgggtgaccgaccccgatcgtgctgtcgagctgtacaacaccaccttggaccacgtgcgccggctagcgccgggcgccaccaagcagatcacgttggatttggcgctgcagggactcccgcaagacctgccgccatcggatggcagcaacgcccgcctgatcgagcgcctgcgccaggacattccgcagcttgccttcggagaccctaactcagaaagctaa

SEQ ID NO: 5299 - DNA, 126 bp, Actinoplanes utahensis
gtgtcgagctatcctgccgtacgcggcggttgccgggtttccctgggccgcatgtcggtgatgctgttcacggcagccgcagctgatctccacggtggtgaccgcccgcaagttttcacttcttga

SEQ ID NO: 5300 - DNA, 1803 bp, Actinoplanes utahensis
atgaccgccgaacagccctaccaacccatcaacgcgctgccgccgccacccacattcggcgtggtcccaccggacccgcttcaccccgcaagcccgcccagacactcacaccgccgttggtggatcatcggcatcgccgccgctgccgtccttctgatcgcggtcggcgccaccatctggtttctccgcgaccggcccaaagccgaccggggccccttcgaccgagccgtcgcgaacctcgccgcagcacccatgctgcgatacacgacgactatcgccggcgttaccgccgacctcaccgtcaccggtaacggcgacagtttcggcgcgatatccatcgccggacagcacgtagatctgctcaccatcaacaagcgaaactatgtgaaattcacgaccggcctactcgggacaaaattccaaaaccggtgggtgaccgggccggcctccacagcagcacccctgtccggcacatggccagcaccagccgacctggctgacaccctattcaccgccctcgaccaggccgggcccttccccaaagacggcggccccaccagcaatatcaacggcgtggccgcccgaaaagtagccacccccaacgtcacgatctacatcaccgacacggcaccgttccgcgtcctgcggctcgacccggccagcagcggcaaaaccctgcccaccatgccgtcgctgccagccgtccccaccctgccgtccctacccgccttgccggatctgccgtcactacccggcctgcccgctctgccgaccggagtgctacgccagcaactgctgcaccaccagcagccggaacgagccccgccgccggccgccggtaaaccaatccccgggcagatggatctgttctcgctggactcggccgccaccgacaaagccttcggcactcttgccggcaacacggctcaactgacggacgccgtcgacacgagcgtgcagttcagcgcacagggcaccggcaccatctcctgcggtgtctccggctgccggatcaccacgcaagtcagcaacaaactcgccaccaccagccccgggaaaatcgccgacagcagcgtgtctgcggtcctcaacgccgacatccgcattgacggccagcccgccggtagctgcgaggccgggcccatcccgatgaaaccgaacggcgccacgtcgatctcctgcacctcaccagaagccggcgcaacctttgccgccatcaaagcagagaaagaagcagccgccaaagccgccggcggcggcaccgtcacggtcagctcgacggccagcgcgcaggtatacgccaccgcacagaccgaggtcgaggtcaccaagaagaccaaagagttggccgccgaacagcagcaggcgcaggcctaccagtgcccggtaaccgggaaggcatgcaccggcgacccgttcaacgacctcgccgcattccgtaagcgccagggcatgccggaagcgggcaccgacgcagacaaggacaccgcggcccggctcgacgtcggcggacaaatcttctacgggcgcaacggcaaaggcaaagtcaccgacatcccggtgaacgcctacacccgcgaccatgccgaaggcgacgttttccagcaggccaagaacgcgaaaatcactgccgaccgggcggtcatgtatgtcgatcggccgctgtgcgacggctgcggcgcctatggaggagtaggcagccttctccgcggcaccggcatcaaagaggtcgtagtcgttgcgcccaacggccgctttttgatcaccgcagcgcggccatccaccccgcagccgctggattga

SEQ ID NO: 5301 - DNA, 264 bp, Actinoplanes utahensis
atgggggcagacgaggtgacatggcgccgggcctggcagtcgaagcgcggcctgatccggctcggtgagcatgcggacggccggtggctggtgtggcgcagcaccggcaaacaccgcgagttctgggatgaacgggccgcctgcgagtacctgcaaaaggccatgagccgatctcggtgggaggaagtgaccaccgctggtaccagtcatcggccggatggcgccgtcgtgttttctagcgatcgagtagctcagccagactag

SEQ ID NO: 5302 - DNA, 1290 bp, Actinoplanes utahensis
atgccggcgagccccgtctccccggcccggcccgcgcaggtcaccccgcccccaccagcggccgaggaccagccagcacaaccttcggtgactcagccgatggcgccggtgaacgctgccgccccggcgctggcggcgggatcgcatcagcagcggcctacggcgccagtaacgccggacgagatgctcaagatgacgacgccggaaacctcagccgaagtgccgaccgatcggacatcagcctgggccgccataccgacaaccagcgtccatcacgccgccaccatcgtcggctccccctggtggcggctcgccgtcgaacgcctcgcgtggatcatccaccgcgagatcacaccagacgacctgccgcgcatgacctactcccggctggctgaacagatcacctcgaccaccctacgtgtccccgaactgggcagaggcgtggtcgaggcgttcgtcaacgactacatccgcgcgatgaacggcgaacccggcaaggccacctacccgtggcgcgacctgctgccgcagccggtcaccacgccggtcggctccgaactatggaagcaacagatcggggacctgcgcgtcgcgctgatcaatgagctagacggcagcgacgagaccgacccgcgcgaactggcgatgacgctcgcgccaaccgtcccgcggctcgacgacgcaacgctctacgcgttcgtcaacgactacgtctgcgcgctcggtggtcacccggtcagcggggacccggcgtggcagcacctactacctcaccagaagcagtcgcaacgagcgagcccgcgcattcccttacctcatcgcggtgcagagggcgccggtgccggcgctcagcgacaggcggtcattgcgccagaggggcacggccagcgacgggccgctcgccggcaggacgtcgtccgggagaaagcctcgatcgctgccgccaccccccggcccgcggcggtcacgcatcgtgttccgcagccgcggccggctggcgatccccaagagcagaagctggcaagttcgccccgtgagctacgggagcaattggctgacatgatggcgtctgggcagatggagacgtgcacggaaaagtggaagcgcgaaaccgcccggcagctgtaccgcgatatcaccgccgctggcgagcggatcaccgggactgacctcgcggcgttgttcggccgcgacccgcggtggggtcagcggcgcaaggaagatgtggaccgggggcgccgcactcaggatgtagctcgcgcccgaaatcggtcggcaaccaaggagtag

SEQ ID NO: 5303 - DNA, 630 bp, Actinoplanes utahensis
atgccagctcgtatgagcgccacccaaccgttgaccatcgacctgcgcggtcacactcgacgccgccgaccctgcgcccccttcggagcccgtgatcacgatgagccctcacctttacagcctcgacacctcgcggctcttcaccacgattacgcccggacgcggcctggcgtggttcttgctgatcgtcctcggcatgctggccgtcttgctgacgatcgtttacatcggaacccggccggccgtacgcgcatttttcccgcgcggcgcggcggcgcggcggcacgcgatcaccgcagacgctcgacggatgctcgcgctgtgcgttggcggcgacctactccccgcgaagcaagacggcatcgcacccgcaaaaccagcatcgcgcggacctgggctgaccacctgcggccgaagctggagcgctacctgcgctcctaccctgctgcgcccgaccgggcggcaatcgctcggatcatcgacgacatcaactacgccttggagcaccagttcttcaccgacctggatgccactgcgatgacgacgatcgcgggcgacctcgaccatctcgtgttactgacggaccgagaccccgccgaccagcgaccgacccgaaaggacaagcggtga

SEQ ID NO: 5304 - DNA, 429 bp, Actinoplanes utahensis
gtgggcggtgtggatgacgacacgaccgggaaagtgcgtggccgggaccggcggcacctgtatccgggtaggccgggacggctggcgccgcggtttaccgcagcggagctggccgatctcaccgaggcggcagcagcggcggggatgaccccgacgggcttcctggccgaggccgggctggcattcgcccgccaggcacgcccggcccggctggatccactgcgcgagcagctgcggcagctgcaagtagacctgctgcaagcgcggactgcagtagccgggatcggcgagaacctcgaacgggcggtcaccgcagccgatcgcactggtgtcgtcccgccctggttggtggacgcggtcgccgtctgccggcggcgcctcgacgcgctcgacgcggtggtggagcgggtcgacgggcgtctgccgtga

SEQ ID NO: 5305 - DNA, 1428 bp, Actinoplanes utahensis
gtgattacgaagatcgcggcgcaggggcagcgggtcggggggctgctgcgctacctgtacggcccgggccggtgcgaggagcacgtcaatccgcacctagtagcggtgtgggatcccagccggtcaccgggcgacctggaacccgtggccggtgtcggaggtcgaccggacgtcagcatgctggcccggctgctggagcagccggtacgggcggggcggaacccgccgcggcagccggtgtggcactgctcgatccgtaaccacggctcggaccgggtgctgtcggacgccgagtggggccagatcgcccgggagatggtcgccggtgtcggcctggcagcagccgacggccggcccggagtccgctggctcgcggtgcgtcacgccgccgatcacatccacgtggtggcgaccctggtccggcaggacggggagacggtgtggccgggcaacgaacgttggcgctgccaggccaccgcacgccggttggagcgacgctacgggctgtaccaggtggctccggcggactggacggcgcaccggcgcccgcacacccctgaggtgcacaaggcgatccgggccgggcgcagtagcaccgcgcgggacgagctgcgccgccgcgtgcgggccgtggcggcgaccgctacttcggaatcggagttcgtggcgctgctgcgcgagtccgggctgctggtgcggctgcgggccagcaccgtcgatccggctcagatcaccggatacgcggtagcgctgcccggccggggcggcggcagcccgccggtgtacttcggcggcgggaagcttgccgccgacctgacgctgccccggctccgggtccgctggggcatgcccacgccggatgccgggccgccgcggccgccggtggaccgggctgctcgagtggcggcgctgcatcaggcggcggccgcggcgcagcaggctacgcaggtcgtccgggatgggctgggtgccgggcaagcggcgacgcaggcgacggtggcggccgctgcggacctgctcaccgtgctagcgcaggccagcgaaggtgaccggcccggtccgctgcaccgtgccgccgagcattttgaccgcgccgcgcgccttcgctgcggccggacggttcccgccgacggccggtcgcaggacctgcgggcactgtcccggctgatcgccctgatgggccagatctccggcaacccggaccggtccgcagcgctggccctgactctgaaactggcgctactggccgacgcggtcgaacaactccgcggcgcgcagcaccggctgcaccaggcgcgggacgcgcgcactgccgcccgggcgctacgggctctcgcccctgccggggccggccgggtagcggcaccggcaacggtgcgccttacaccgatgcggacagtcaacgatggctggcggacacccggctga

SEQ ID NO: 5306 - DNA, 1044 bp, Actinoplanes utahensis
atgacggatctgacgcagcaagtacacgaggatccgttcgcggaaggccggcagagcatgctgcaggcgatgagtgcgctggtgacggtcttcgaggcggcggcccgctacgcggcggtcggcgtccaggaccgtgctgccgaggctgagcggcaggcccagcgtgaggaccaggccgcgcggatgcagcagcaagccaaccggctgcgggcagcagaacagcgcgagacggaccgctacgcccggcagatcgctgaggccaaccggccgctgcgcgagcgcggcacgttgttcgaagcggccgaggcgtggcggtgggggaccgtgcacggggacaccccggtcggccggcagaccgccgcggacgcgctgcaccggctgcggcacctggcgccggacctcgtcgacggatacgagcgccgatgccgggccggcgtcgctccgcacgaggcgatggcggacgcggccgtcgactggtgggagcagcagcatgccgccgagccgcagccgggccgcccgtcccgtcgccagctgacccacgttccggacgctgtcgacgagttcgaccaggcggtccgggcgcaggtcgccgtgctggcccgcgacgtcgacccggccgcggtagcggcgtttcaggcggatttgcggcggcagaacatggtcgccgctgacgggctcgacctgctgctgcagttcaccgtcgagcaggcgaagaccatgcccgccgataccgagctcctcgtgggacgggcgatcgaaagggcctatcgtgccgacggccggaccgctgccggtgcgctggaccggccagcaacggccgccgacgagcacaccgaagggcaggtggccgcgaaagtgctcgacgccgacgcggatcaggtcgccgcgagcatcggccgccaccacaacgccagcggatccccgcgagcggtcagcgcgcaagcgttcccgccgctgcggctggccgccccgggcgcccagctgcggccgacgcccgccggcgggccgggacgagcccctcaccggacaggaccacgccgatga

SEQ ID NO: 5307 - DNA, 528 bp, Actinoplanes utahensis
atgaccaccacgaaccgggcccaccccgccaccctgtttgacccggtgacccccgaggagccgatcaggctgcccagcgaaccggctggcccggcgcgcgatatggaaccggcgccggccgcctcggccgccgcggcggctgtgccagccggggaggagggcgcggagccgctgtactccacggtcgaggagtgggtgaacacgtacctgctgccgaccttcccccgcccggtgggcgcggtcgggatgacccgctggtactggtgccggcagtggtggcgccacgaagaggccgtcaccaggctgaccgcgctctggtacgcgtgggaaagcgcccggctggaggtgaccggcatggtcgggtggcttccgttgctggatcacaacctgccgctgctgtgcggcgaggacggcccgttccgcggctgcaccgtgggcaagaccgccgacaccgcccggcacgaactaccagcgatcgccgccaccgagacggctcccgacggctggtggaactggtgggataactga

SEQ ID NO: 5308 - DNA, 1068 bp, Actinoplanes utahensis
atgcgctggtggcaaaggaaacctaaagatcgcgccacgtggtctttcgacccgctggaaggcgtgggacccctacggttcgggatgacgtcacagcaggtcaaagcagttctaggcgctgagtctttggaatcgtatcgaggctacgaaggtaaggagtcatggcagcggtacagcgatggcggcgtaaccgcgatctatgaccagggaggcctcgtcgcggtggcgatcgacgcgctggccggccccatggtccggctgcgggaactggacctcgtcggcggcaagccgtccgcggtggcagccggcatccagcaactcgcgggccgcgacgacgctgtcgtcaccgtgaactggagcggtgatcctgaggtggcggcctgggggctttccctgggcgctacgccgcagtggggactttcgccgtccggagcgttggaacgcaccggcatgatggtcaccgacgcgctgttcgtcggtgccgagttggcggaggatccgtattcgtccgagccgatcatcagatggcgcgatgtccgcggatgggaatgtgatcccggggcatggctcgtgatccccgaggagagccgtgcgcgctgggactggacgccgttgaaggcagtgggaccgctcgagttcgggatgaccccgttgcaggtgtcggccgcgttgggcggcgaagcgccggctgcccgccgcggttactacccctcgccgctgctggagaaggccggacagtggtttcccagcgaggagcgattcgacgttaccggggtcaccgcccactaccagggctgggacatcccctcgctggcggccgtcaccgtgcacgggcgtaccggcccacaggtcgcctacgacggcatcgatctgatcggcaagagcattcctgctctcgaagccaccctctaccagcatgcgggcaacgaaggtgtaaccctggcctttggctgcaacggagacgtagggccgctcgatctgagtatgttggtccgggcggcacgggccggcgacgtcgtgatcagcgaagcccgattcggcgtcgaagattgggaagaccacggctaa

SEQ ID NO: 5309 - DNA, 1227 bp, Actinoplanes utahensis
gtgaccaccgccggtccagcttccgccgccgatccggtccggctgcgggtcgcggtccgcgcagcggtcgacttctaccgccgtcagctgaccggcccggccggcggcccggcccgcacctacctgcggcagcgtggcctgcagccggtcgtcgaccgggccgggccgtggcagatcggctacgccccgcccggctggcagaacctggcccggcacctgcaggccagcgggtacaccgccgaggagctggtcgccgccggcctgtgccggcgtcagcacgccgatcccggccggctgctggacgtgttccgggaccggctgatgttcccggtccgcgaccagcacggcccggtcggcttcaccggccgggccgcccccggcgccggacccgacaccccgaaatacctcaacaccgcgcagaccccgctgtacgacaagagccagctgctgttcggcctggccgaacaacaggaccggctgcaggccggctggcagccggcactggtcgaaggccccaccgatgtgctggcggtctggctgtcctacagccgtgacggcgaccgcggcatcgcggcggtggccgcctgcggcaccgcgctgaccccggcccaggccgagcaggtcagcgccgtgctcggcgcccagcagcacggtgtggtcaccgcctacgacaacgaccccgccggacgcgccgccaccgaccgcgcctggtccctgctgcacgcccggctgccgtcccggctgctgcaccatgccgtactgcccgccggcgccgacccggccaccctactgacccggcccgacggccgcgtcgacctgcgggatacgctgcaggcacacacccagccgctgctggaaaccgtcgtcaaccaccgcctggacaccctcctcgaccgcaatccacggctgctggacgacgtcggcggccgcgtcgaaaccgcccggcacctggtcacgctgatgttcgacgccgacgacaaggccgaagcgatccgcatcggcgcactcatcacccagcgcaccggcatcagcgtccaggccctcgtcgagatcgccgtggactatgtcgaagcgtcctggtccgaagccgccggaacgctgaacagcgccggtccggcacctccggcttcccaaagcgcctttccacccttacgtccgcgcggcatggtcgcgtcgcagccgtctcccgcaacggcccgtgcaacgcacccgacgcgccgccggtaa

SEQ ID NO: 5310 - DNA, 1917 bp, Actinoplanes utahensis
atgcgcccggtcgagccgcgcggtaacgccggtggggcgaccacaccgtgggtggttctcgggttgtgcgcggccggctgggtggtggtgtggctgggctggctggccgggcgcctggtcgcggtgttcaccggccggccggccgggccagggttcggggctgatttcacccagggtgtggtgcatgccggttgggcgcggctgtggccgggggtgtccccgacggtagtagcggtcgtctacgcggtgctgctactggcgctggttgtgctggtcagcgtgggggtagcggtctggcagcggttccggcccgatgcggaggatccgctgcccgcgctcgccagccgggcggaggttgctccgatgagtctggcgcagacggcggccaaggcccgccggctgcgtccgtcgctgcagcagactccggtcaaagaggtggccgaggaagcggccggggtgctgctcggcgagcaccgccgccggcacggtcgcggtgaccgcgtgtacgggtcgtgggaagacgtggtgctggcggtgatggcgccccgctcgggtaagacgaccgcgctggcggtcacggcggtcctgtcggcgcccggcccggcgttggccacctcgaacaaggccgacctgtgggcgaccacggccaccgcccgcgccggacggggcagggtgtggacgttcgacccgcagcacatcacccacgtcgagcagacctggtggtggaatcccctcgccgcggttgaaacggtcgaggacgcgcagcggctcgccgaccacttcattcaggagatccgcgcggagaacggttccgacgacttctgggccaaaggtgccctggacctgctgacctcgctgatcctggccgccgcggtcagcggggccggactggacgcggtgcaggagtggctgtcggactcgatcacccgggtgcccgggcaactcctggagcaggccgggttcgccgcgtccgcccgggccctggccggccggcaggccggcgccccggaaacccgcgagggcatttacgaaaccgcccggaccgcggccgcgtgcctggccaacccggagatcatgcagtgggtcaccgcccccggcgaccggcggctgcgctctctggacgttgacgctttcgccggctcccccgacacgctctacctgctgtccaaggatggtgccgcggcggccgcgccgctggtcgccggcctcaccgaccaggtgctgcgcgccgcggtcaccctggccgaagccaccggtggccggctcgacccgccgctgctggccgtgctggacgaggcggcgaacatctgcaagatccgggacctgccggacctgtactcgcacttcgggtcccgggggatctgcccgatcacgatcctgcagtcgtaccggcagggcgcccgggtgtggggtgagcgcggcatggacgctctgtggtcggcggccaccgtcaaactcgtcggcgccggcatcgacgacgcccggttcgccgaagacctgtcccggctcgtcggtgagcacgaggtgaccgtcgcttcgcgcacccgcgacggctccggcaccacctcccaccaggtgtccacccgccggcagcggatcctggaagccgcccagatccgggcgctgcccaagggcacggcgctgctgctggccaccggtgtccgggtcgcgatgctgaccctgctgccctggtacgaaggcccgcaagcgcaacagctgtcgacggcggtcgccgcgaacaccgcggacatgacccggcgggccgggcaggcacgcgccgcacgccgcgcccggtacgccgaccgcgccgggcacaccggccaccgcactggccgcagcccggacgacgacggcgcgggcggggccgccgagcacgaccacgaccgggcccgccgcgcgggccgaacccgggggtga

SEQ ID NO: 5311 - DNA, 2934 bp, Actinoplanes utahensis
atgccgtccaaccctgtccgcatcgccccgtcgtggggacaccgcggcccccacgccggccgcgcctcacacgtcgctcccggcatggagtaccagggcaccacccatcagatgtgcgggctgttcccgttcaccgccggcagcggcgcccccactctcggcgtgccgatcggccggcacatgctctggggcgaggtcgtctgcctcgacccgctcgaatggctgcgcgcgggtctggtcaccaacccaggtgttttcgttctcggacagcccggtgtcggcaaggcgttggacgtcgacacgccggtgccgactccgcacggtgtggcccggctgggtgacctgaagccgggcgacgcggtgttcgacgagcacggccggccgaccacggtggtggcggtgtccgaggtgtggaccggccggacgtgttcccggctgcggttctccgacgccaccacggtggtcgctgacgacgaacatctgtgggtcacccaaacccaggcgcagcggcaggcccgggtagtggcccggctccggccgccggcgcgtcggccgctgggcaccgcggcggaacaggcccgggtcgccgagttgctggccgcggccacgcccgggcaggacacgacgctgccggaccttgccgcgcaggtgggctgggatcagccgtcggtccgggaccggctgtaccggtgggccaccggctggccggtcaccggccgcgccggcaacgcccgcttgttcgaccggtacagcaccctgcagcagaccgcgctgatgctcgccgcccccgtcaacgatcagcgtgaagacaccgggacggtgaccacgaggcagatccggcagacgctgacgcacgccgggaagaccaaccatgcggtgccggttgcgccgccggtatcaggccatgatcggccgctgcctgtcccggcgcggctgctcgggctgtggctgggcgacggcgccaccgaccgggcgatgttcaccaccgccgacccggccctggccgccgagttctcggccgccggctaccgggtgctcgccgggcgccgctaccggtacagcatcagcagccagcgccttcccgcaccaccagccggaattgtctgccggcgctgccggaagccgttcgacgccacctacaccgggcagcagtactgttcccggccgtgcgcggcccgcgccccgcagaccggccaccggcaggcccggacgtgtcagcactgccggcagcccctgcgccgctcgagcaccgggcagcggcaccgggcgtgcgctcacgcgcagactctggtggggcagctgcgcgcgctcggcgtcctgggcgacaagcacattcccgctgaatacctgcgggccagcgttgagcagcggcgacagctgctgtccgggctgctcgacaccgacggcacggtcagccccggcgggcaggtccaatacaccagctgtgaccagcggctcgccgaggacgtcttcgacctgatcgcgtcgctgggctaccgaccggcgatgaaccgccgggcaaccggcagcaccgtcaccgcacaccggtacgcctatcagatcggcttcaccaccaccgacgaggttttcggactcgcccgcaaacgtgacgcccaccggcagcgacgccgggccgcgacactccggaccgcggtgcgttacatcgtggccgtcgagccggtgccctcacggccggtgcgctgcatccaggtcgccaacccctccggccagttcctggtcacccgggccttcatcgccacccacaactccaccatcgtcaagcgcctggtcaccggcatgtccgggtgcggcacacacaccctgatcctgggcgacaccaaaccggactacaccccgctggtccggcatctggagggtcaggtgatccgggtcggccgcggcctggaccggatcaaccccctggactcggggccgttgggcgccgtcctgagccggatgggtgccgaggagtcgcggcagctgcgcctggaggtccgcggccggcgcatgtcgctgctgctcgcgctgtgcgcgctggtgcgcggcggtccgctgtcgaacaccgaggaggtgatcctgggccgggcgatcgacgtcctcgccgaacgcctgccgcatgatccgacggtgccggacgtgctgcacctggtggagtccggcgccgacgagctgcgggcggcggcgcgggcccggactgagggtgagtaccggcgccgcgtcgaccagctggtacccaccttggcgttgctgtgcgaggggtcgctgcgcggggtgttcgacgggccgaccagcactgccctcgacctggacgcgccggcggtcagcgtggacatctcgcaggtcgccgccgccggggaccagctggtggcggctgcgatgctgtgcacctggagctacgggtacgcgatggtcgacgccgccgccgccctcgctgatcatggcttggcgccgcgccggcagtacctcggggtgatggatgagctgtggcgggcgctgcgcggcgcgtccggcctggtcgagcacgccgacgcgctaaccaggttgaatcggcagaaggggatggcgtcggtgatggtcacgcattccctggccgacctggacgcgctgcctaccgaagcggaccgggctaaggcgcaggggttcatcgagcgggccgcgatcaaaatcctggccgggctgccgccgcgggagctggcccgggtcaacgacgtggtccggctatcgggccgtgagcaggacctggtcgcctcgtgggccgcgccggaagcctggttcaccggggcagcgcatcccggccgcggcaaatatttgatcaaaaccggtgagcggccgggcctgccggtcgccatgacgctggtcgacgaggagataccgctctacgacaccgacgccgcgatccgtgacgttcgcccggccgtggccgggcggatctga

SEQ ID NO: 5312 - DNA, 1203 bp, Actinoplanes utahensis
gtggacgctcaccgtccacccggccgccggccgctggatggcgtccctgcgcccctacccggacgacggcgtggcccgcccgcaattcgtgctggtcgccgccgccgagcccggcccggtccgggccgccgcccggcagtggcagatctccgcgaacaccctggccctgcaccacgaccggatccgcaccggcacccggagtccggcggccacggcgttcccgccgctggccccgacaccgcaccgggcaccgcaagcaccggccgccgccagccagcacccgctcgggaggacccgatgatcggctcgtacaccatcaccgacgacggcccccaccacggctggcgattcgagacagactcgcactcgttccagttcgaaaccaccagccgaaccgtcgcgttcggcaacccgccccggcaggccgaggtcctcaacgcccacttcaccctcgccgtcaccgtgccgcgcggcgacccgcagtgggagctgttcaccgccgccgacaacagccgcaaccggcaactacgcgccaccctgcccgcgctggtcctaccccgcctgcacgccgccttgctcgaccccgccgtgacctggaagaccggcgaccgccaggtcaccgataacccgggcggccacgccaccctgcccgacaggtcatgggtggagatcaccgcctggatgccgccgccgtaccggtacaccgaccgggaccaagccgacgcccgccggctgctgcatccgtcgctgagcctgccgcaacgccgcgacgccgcgttcgcctggatccgcgagcacgtgccccgcatcccgggcctgcccggccccgattacgacccgggcgccgccgacaccctgctgcgccagatcgaagcctccaaggtcggccggatcgaagtggacttcgccaacgcgattagcgaacgcggccgggaaacctacaccgtggccaccgtcgaggaagcccgcaagttggccgccgagcaccggccgtacaacaacacccgggtcagcgcatcgcggatcgtcggctggcgcaacggaaccacctacaccgaaaccgtcgacctgaccagtcggcccacgtccagcgcggccgccgcgttcccggcccgcgccgtccccttccccgcgccggccagcatgcccgccgggttgccgccggcaaccggcccgggccagcagcggcaccgcgcccggtag

SEQ ID NO: 5313 - DNA, 927 bp, Actinoplanes utahensis
atgagcgagctgcggttccggatcgacgacgggccgctgcgcggctggtccggcacccactacagcgcggccatcggcctgcgactgctgtcgcagacgatcaccgtgcatccgccgaacctgcccgacagcgcgccgggcagtccccgggtgtccctgagcctgcacctggagccgggtgacccgcagtgggaggtcatgcggatcttcggccgcacccagcaaaacacccccaccgcccggcagatccgggagatcgccctgggcctgctactaccccgtgtacaggcgcaactggcggtccgggacggctggctgatgagccgggcatcgtcgatcactgcgggcatcagcggccagctggccgacctgaccggaccggcgagcaccgtgcaggtggccgcggccgattcgtttcgccgccaccggtccggcatatcgctcggggaccggatgaaccgcgatgggctgaccgctaccttcgcctggctgctgcaacagtcctggcggcaggcgctgccggccgggcaagaccgcacggcgtggaccgccgccaccgacacgttcctgcgcaccccgctacccggccagccgcacgtcgggcagatcgtgctgaccttccgcaacggcaccggcgacggccttcgtcaccgggtcgccgacacgctccacgaggcgaccatcatggcgggctcgtaccggccgttcaacaacaccgcggtcaccgccgagcaggtcgtcgccatcgaccacggcctgccgatcatccggcccatcaccctggatccggccgacagccccaagcgggcgcaacccaccgcgaccgcgttccctcgccccgccgtcatcgtcccggggacccccgggacacggccagcggtcgcgccgccgtcccggcccgcacccacaccgggaccccggcgatga

SEQ ID NO: 5314 - DNA, 582 bp, Actinoplanes utahensis
gtgagccgcgcccccagcggctaccgggccggcggccgcaacggcatggtgcacgtcctcaaccagcgcactaccacgacccttcagcagctggccggcgcgggcaccgacctgaaccgggcgctggccctggccgaactcgcccacatccatcggcgactggccgttgcgcagcctaagcgagccgccgcccgcaccctgcaggccgacctgctgcagacgctcgccgagctgtactacgcgcgcaacgagccgcccctggtccccgacggctggccggtcggctacgcaccggatgtgctgatggcgggcctgcgcgacatggtgcagaccgacaacctgggctttcaccgcaccagcctgctgctgatccgcgactcgctcagccggcgtgatccgcggtccgcggtgctcgcgacggtggccgacgccctggctccgagtggcccggccgatcccgtgccgggtcaggcctaccacagcgggcaggcattccctcggctgcggccggcacccgggacggcaccggccgtgataccgagcccggcggccggctgcatcccgcagcggcgcgcccgatga

SEQ ID NO: 5315 - DNA, 609 bp, Actinoplanes utahensis
atgggcgtcctgtcgagcttcacccagcgcctgcgggcgcgtttcgcgccagccacacccacccacaccgatcggggtgccgcgctactgccgggcgccggccgcgccgagccgcacgacaccaccctggccgacctgctggcccgatctgcccgcaccaccgaaagactgaccgacctcgaccccgacaacgccggccgctcggaccggcagatcgcgatgctgcgctccctgtcgcacgtctattacacccgcgccggatactttctgcccggcccgggcccggctaccgccttcaccccaccggtccgcaggctgctgcaggccatgacgatcgccgcagaccggcgggaacaggcagcgctgctggcccagaccgccagcacgctggcggctgccgacccgcacgaccccgcgctgaccgcagtagcacagctacgcgcccacctgcccgcaccgaacgcggccccgttggccgggacggtacgtccgcagctacgccccgccgggcagggtttcccgccgctgcacccgcgggcctcgttcgcggccgccggtgtcgcgctcggccgggccgcgacccgcccggccatgggacggtcccggtga

SEQ ID NO: 5316 - DNA, 1458 bp, Actinoplanes utahensis
gtgcgcacgtatgcggggtggcgccggtccaggggcatgggccttttcgggctcggatcggtgcagaccgtggtggtgctcggcgcggtcgtcacgatggtgatttccgggtcgctgagcctgggtctgctggcggtgaccgcaccacccgccctgatcgtggtcatcgtgatggtcgcccgctgggatggggtttcactggcggccgggatcgcgcagcgggtgcggtggcaggccgggtcccggcgcggctacacccgctaccacagcggcccggccgttaccggggaccacggatggcagctgcctggggtgctggctgccacccggctcttggcggtcgacgatcccggcggtgacttcggggtcgtgcaccatcagcggctgggcaccatggccgtcacgctgcgctgcgcggccacctcgacctggctggcggacgcgtcgacgaccgacacgtgggtggcctcatggggtggctggctcgccaacctcggctacctgccgatgatcgaccacgtcgcggtcaccgtagacacctgccccgaccagggttcccggctcgccgagcacgtcgggcggcggatcatgccgcacagcccggcctccgcccagcgggtcctgcgccgcctggtggaggtgtccccggccgcggccgccgacgtcgaaacccgggtgacgatcacgttccggccggccgcgtccccggcccggccgcgcaccatcgacgaggcactgcaggagatcgcccggaccctgccaggtctgcaggacgcgctcggcagttgcgggctgaccgtgctgggccgggccaccacggcgcaactggccgcgaccgtgcgcggcgcgttcgacccggccgcccgcgccgacctggcccggctgtccccgctggatctggaccggtgggtcgactggagcagctgcgggccggtgttcgccgaggagcacatcgaccggtacgtccacgactccggcgtcagcgtctcttgggcgtggcatgaggctccccgccagtcggtgcacgccgacgtcctggcccggctgatggccccgggcgcctacccgcgccgggtcaccctgctgtatcggccgctgccggccggggaagccgcccgggccgtcgagtccgaggtcaacgcggctgtgttccgggccgcctacaaccgggcgaagcgccgcgacgaaaccgcccgggacctggccgaccgggaacgggcgcagcagaccgcccgggaggaagccgtcggcgccggcgtgggcctgctgagcctgtgggtcaccaccaccgtcctggatccggacgacctgggccgggccgtcgccgacgtcgagtcccgcgccgacatcgccaagatccggctccgccggcagcgggccgcgcagtccaccggcttcgccgccactctgccgtgcggcatttgcccgccgcagctggcccggcaatggccgcgctga

SEQ ID NO: 5317 - DNA, 1041 bp, Actinoplanes utahensis
atggatttcgtgctcgactacttgatgggtgaggccgctaagggcctggcctatctcgccgggtcgctggccgcctggatcctgaccacctccgcgaatatctgccccaccaacggcgccgatccggccagctgggatccgaactgggcgcagaactgcaacagcaccgcatcggccgcccagagcatccagcatctgatgctgccgctgaccgggctgacgctcactattggcctgatctggcaggcaatcatgatggtggtgacccgtaagggcgaaccgctgctgcaggccggccgcgggctgatcagcaccgtgctgtggggcggcctgagcttggccgtcgcgcatctgctgctcaaggccagcgacggattctgcgtctgggtgatcgacgaaagcattcccggcgacggggcaccgaacgagaagctgcagcacctgctgacctcgatggttgccgattcacctgaggtgacgggcatggccggcttcttcatttccgtgatcatgattctgttcctgatcgcgctggtcgtcatgatgactttccgcaccgccggggtgatcctgttggccgggacgacccagttcgccgcggccgggaagaccaccgggatcaccagcggctggttgaaccgcaacctcagctggtcggcggcgttgatcgcctacaagcctgccgtcgtgctgatcttcgctgcggacgcgaagctgctgcagagcgactcgggccgggacaggttcaccggcctggccatgctgatcgtcagcatcgtcgcgatgcctgcgctgatgaagttctttacccacttcaccgggcagatgtccagcggtggcggcggcctggccaccgcggcctccggcggcgcgtccgcgttgcacgccgcggcgtcgatgcgcagcctgggcggtggtagcgccgccgaacacgcccgctacctggacagcaacggcccgggcaaacccgcgccgagcggtgccgcgcccgcgccgagcccgatgcccatgtccgccgggccggcggccggggctagctag

SEQ ID NO: 5318 - DNA, 306 bp, Actinoplanes utahensis
ttgcaggagttgaaagtgaacgctcagttggtgctcgaccacgtcctggccgccggcaatgtcccggacaccccggtgaagccggtccccggcctggagaccctcggaccgcagatcgtcggctacatgaagtggatcctgatcctttgcggggtcggtggcctggtggcctgcgggatcatgatgaccgtcggccggcgtaaccggtccgcgatggcctctgacggcgccgccggcattccgtgggtcatcggcgggctgatgctcggcggcatgtccgccgtcatcgtcggcgccttcctgtag

SEQ ID NO: 5319 - DNA, 1122 bp, Actinoplanes utahensis
gtgccgcaccgggtcggcattgccgtcgactgctgccggctgttccgccccgtcgggatccctgattcccggcccgctcgcaaggtcggcaggcccgcgatgagcagccgatcctcaatgtgggttgccgccgccggagccgccctgctgctggccccgtgcatgctgctcggcattgggatagctggcgtcgccgctaccggcgcctcctgcatggtgagtctgccaaccggagccagctcgtccaccaccgcgaccgcgagcactgcgtgggacaacgagcaggtaggcaacgcgagcacgatcgtggccgtcggcagccggctgcggataccccgctacggctgggtgatcgcggtcgccaccgccatgcaggaatcgagcctgcgcaacctcggcgacctcggcgcccacaacgaccacgactcgctcgggctgttccagcaacgcccgagccagggctggggaacccccgcgcagatcatgcagccggagtacgcggccacccagttctaccagcacctgctgcgggtcgacggctggcagacgatgaccctgacccgcgccgcgcaggcggtgcagcgcagcgcctacccggacgcgtacgccaaatggcagcccgacgccgaacggctcgtcaccacggtcaccggcagcagcggcgccgggttcggctgcgccgccgccggcggcaccgccgatgcagtgttccgcaatcccgacggctcctatccgccggaaccctgcagcatccggcccgatccgaccaccggccgcggctgcctgacgccccgcaccctgcacctggtccaacagacccgcgctgccggcttcccggcacccagctgctgggatcagcgcagcgaaggcgagcacccgctcggtcgggcctgtgacttcatgatgacctccggcggtgaagccaccggagccgagaaagcccggggcgacgcgatggcggcctgggccgtcgccaacgccgaccggctcggtctcaaatacgtgatctggttccggcggatctggacccggcggaccggcagctggcagccctaccagacgatcgccggcaacgatcccagcggctggcacaccaaccacgtgcatatctccgtcgaatga

SEQ ID NO: 5320 - DNA, 270 bp, Actinoplanes utahensis
gtgaaccaatacggtcgacagatcgagcagcactggcagaagtacctgccgatccagtacgcacagctcagcgccccggagaccttcttcgccgagcaaggagagagcgcggcggcacagattcagaacttgacggattcgctggccgggcaggatccgccgggggagagcttcatggccaagctgggccggatcaacatggcacggacgaacgccgaggacgcggtgatgcgggacatgctgccgccgcaggagaccaccacgacctga

SEQ ID NO: 5321 - DNA, 726 bp, Actinoplanes utahensis
atgaccagcaccctcgccgaggtccgcatgagcgacgcggtccgccgcctgctcggcccggacctgaccgcgcgcgttgccgccaccccgctggccggcggccgctgccaggactgccacctgccgttgccgcagcacagcgtcgtcaacgtcgtggtcttccaggaccaggacagctgcgtggtcggctgcctgcacccggactgcggcacctcccagatcaggctgctgcccgccggagcgctcgctcgcaccggcccggcctcggtgccgatgcggctggtcgccggggtgatgccgcacggcggccggccgctgccggtgctcaccctccaaccgatcatgcaggttgtggatgtcgcccggccggtggccgtcgatgcgttcctcgacgtcctggtgcaggccgggatgaccaccgagctcgactttctccgggcgcctgagccgctgctgggctggccggtggcgatcagccaggccagtgccggccaggcagccatccaaatccggatgcccggcggcgcgctgctggtcgacggggtcaccgcggtgtcaccggcgtggcgcgacgccgccagccggtacgggtggtgcgtgctgtacgccggccggaacctcggggacattccggccgggcagccgcacaacgggtcgcttccccaggccgggctggtggctggggcccggctgcgactgttcggcgccagccgcaacctcggatga

SEQ ID NO: 5322 - DNA, 519 bp, Actinoplanes utahensis
atgagcccccatcaccaccctgcgacgccaccagagctcgccgtgccggcccgcaacgacatccgggtggcggccctgctgacctctcaagccggtcggcaggtaccgactgtggccatcgaacaccagccgccgaccaccaccgcacccaccagccgcagccagcacggcagcacactgctatccaccctcgtcgcctacggcatgaccaccgaggtgaacctccatcagacggcccggccactgctgaactggccggtcagcatcgggccgtccggcccgatgcgcgctcgcatccggatcgttctgcccggaaacctagcgccgatcgacggtgtaaccgcctacaccccactctggcgaacggcggctacccgcacggggtggctgctgctctacgccggataccaactgtgggaccccaccgaggccgcacctacctcggcatcgatcgccgctgcctggcgggccggaacgctagcggccgccaggctgcagattcgccgacctcgatgctga

SEQ ID NO: 5323 - DNA, 609 bp, Actinoplanes utahensis
ttgcacgagaaggcggggcaggagagattcttggatgcggacgaagcctttctcattccgcgtctggccgatctcgcaggccggtacgcaccggcggaccgcgataacgttctgatgcttgcgggcaggattgccgcggatcttgatgaggctaactggccgcggtatgccgaagcgttcgcgaccatgcaccggctggcggacgactggcttgtcacaccgatcgatccgggctcgttcgtctatcgtctgcaggcggtgctggcgctggagggcgatgaagtctggggcgcggagctcgatcggatcgggaacgatgaggtcgaagtcgagtgcccgcagtgcacaacgtcgctgtttgtggcgttcgggaaagacggctgcttcgccacccacgaggactacgcgacaaagccggacgtcgagcagacgccgttgctgccagccgaaccggccgagttgaccggcgtcggtcaacggttgcatctgatgagcctggcggccgggcagcaatccgtcgccgctgcccttacatacctgttcggccgtgccacctgcacccagtgcggcaccacgttccgcgtgtccgagcaggttttccgccggtaa

SEQ ID NO: 5324 - DNA, 477 bp, Actinoplanes utahensis
atgaccgacgtgccgccgctgcggatccgtgtctaccagccggccgacctcctggtggtccacgaactcaaccgggccggcctggccgccgccggggtacctgctgacgccgacgtgtacgccggtgacctcgacgacccggcggcgacatacctccggggccgggccatcctgctagtgggggaagccgacggccgcgtagtcgcgatgggggcgctgcaggaggtcgaccgcgactcctgcgagatcacccggatgcgggtcgcggctcccgtgcaagggcgtggctacggtcgcagcatgctgcacgcactggaggatcacgccgtcagactcggctaccgccgggccgtgctcctgaccggccccgaccagcatcccgccatcgacttgtaccgcagcgcgggatacaccgtcaccagctgggaacagcacggcctgatcccgggcatccggatgaccaagtccctgccctaa

SEQ ID NO: 5325 - DNA, 1674 bp, Actinoplanes utahensis
atgcatcgcggattcgctccggggtcgggccgcgggcggctggcggggccagggccacggcggctgggcggactgtgcgagatggttcccgccgacgtgaggcctcacggggagaggactcgtgatcggcgggatctgccaggcagaatcccgcatctcgcagcaggcggcaatcggtgcccgcgcacggtgcgcgcatgttgtcgtccgtgcgggcgtggcggcggcggaacgtgcggataccgcaatttcagccggcaccgtgcgggtgattcacggtcggctgcgagtgtgacggcgtggttgggtggagtcgtgaacacattgaccgggcagatgtcgatgccgcactcgccccggtgccggtgcaccgcggcgctgcgggcgcaggccaccaccgacgggtggccgctgaccgcgctggtcgacacgatcatccagcggtgcgggcacagcaggctgcgggcccagcggctggcgcgcggctggaccagcagtgacctggtcggcaggttgcggcaggtcctcggcgccggcagtcggctggcggcgaccacggtttcgcggtgggaaaccggcaaggagcgcccgagccctgcttcgctgcaggcgctgttcacgatctatgacaccgatctggcggggatcgactgcgacatccggccgattgccgcaacgtcactgacgccggccgggcctacggccgacaatgccgacgtgcttgccgcggccgatgagttgcgccgcaatgtcgatgccacgctgtcggccacgaccgtcagcgatgccaccatcgaccacctgctgcaggtcgccgaccagcacggccggctctacaaaaccgacaaccatcggccggttttcctcgccgacttgttcgccgacctggaggaggcgtggcggctcgccgaccggaaactaccgaccgggcagcgccgggacctgtgtgtggtgatcgcgaagttggccgggctggtgtcgatggtggcggtaaaccagggccgctaccggcaggcccggcagtggttgcacaccgcccgcctcgcggccgacgagaccgctcagccggtgctgcgggcatgggtcgcgacccgggccgcggtgaccgcgctgcatctgggagatccggtcaccgcgacgaccgtggccgccgaagcggagatgctgacccgccgccacccgtcccggctgtccgccatggcgtgggccatcatggcccgcaccgccgccgtcactggcgacgcggataccgcccgtcatgctctccagcaggcgcagcacacgtttcctgcctgcccggacgggcccgagatggggaacaccgcgaacacgttcactctcggccagctgcacttttacgcctccgacgcctacaccaacctgggcgacacccgggccgcgatgcaggcccaggaccaggcgctcgccgcgttcggcccgggagagatgcttgacccggccttggtgcagctggatcgggcccggtgcatggtcgtcgccggtgacatcggcggtggcgtcacgcacgcgcagaccgtgctgctggacttgcccgccgactatcgcccggcgatcatcttgcgccgggccgccacggtggtcgcatccgttccggcccagcggcggacggtgacagccgcccgggacctgcacgcggtcatcgccggccgatag

SEQ ID NO: 5326 - DNA, 696 bp, Actinoplanes utahensis
atgcatcccagcctgccgcctcccgcagaccgcgccgtcacgccggccgccgcgagccgcacgctgccccctgcccggttcgcccaggccatcctgctcaaccccggaccggccatccgcgccctcaaccgcagcacactgccggcaggccagcggctggccctgctggccgaggcccttttgaggctgggccggaccgagccggccatcaccgccgcgatccaagccgtcacggttgtcggcgcccaacgcccgatgccggccactgacctgctcgccgcgagcacggtctgcaccgacattgccgtctgggtcggtgacctcggcgccgcccgagcctgcaccaccctcgaacagctggcgctcgactgggacgaccatccgcgccggttcctggcggtcgccctgcgggccgtcgcgctgtaccagcacacgtcctgccggaccgggctagcgttgctggaccggctgaccggcttctaccaagcccgtaacagcagcgaccccatcggccagacgctcactagcaccgtccgcctgatgactgacatctgcgccagctcgcaccgcccgcccgcgcctttgcgtgccgacccggtacccggcggcctgctgcaccccgacatcacgcacccgaatgccggctacctgcaatcgcggctgctgcgccacccgggccggcacacctgccaatga

SEQ ID NO: 5327 - DNA, 960 bp, Actinoplanes utahensis
atgaagtgggatggtttccggaccatcatctggcgaaacgctgatggtgtgcgcgtccagtcgcgccacggcacagacctcactgcgtactttcctgatcttgttggtccgctgaccgcagcattaccgccgagggctgtcctcgacggcgagctcctggtctgggatcccgatcgcggccggtgcagcttcgggttgctccaacgccgcctcgtggccggccggcggatcgctgaggtatcccgcaaacatcccgctcacctggtcgcctttgaccttctgcgcgacgggcgcggcaccgagctgctggatcagccgctgtcggtgcgccgggcgaagctggagcggatgctgcggaccgccccgccgcagctggtgttgtgtccccagactgcggtgccggcggtggcacgcggctggatgcaggacctcggtaccgccggaattgaaggcgtcgtcatcaagaagattgatgaacggtaccgtcccggcacccggtcgtggacgaaggtccgcactcgggacaccgccgaatacgtggtgggtggggtgaccgggaccgtggatcatccggtgacccttcttctcgggcgttacgaccggacggggacgctgcggtataccggccaaacgcatccggtccggcccgagcatcgcgctgacctcgccgcggtcctgcacgctctggtattccgcggcccgcaggccgggcatccgtggccaataccgttgccaacggcatggaccgcccggttcaacgaccggcggccgttaacctacacgccggtggaaccgacagccgttgtcgaggtcgaggtcgacacggccatcgacgggccgttcggccgagcccgacacggggcgcgcctgatcagggtccggatggatctgcgcccagctgacatcaccctcgaacagaccgccagcggtgatcgggttggatccgcggccggacggtga

SEQ ID NO: 5328 - DNA, 612 bp, Actinoplanes utahensis
ttggcaccgtcagcgcagatcgttaccttgcccgccatgacccttcgtattgagcaaccgcatcactatgacccggtaggtgctgtccatcgaagtgccttcggtggacagcacggcagcacggtggccgagcttgtggacgcgttgcggcgcgatgatccggcagcactctcactggtgtctgagcaggcgggcgaggtcgtggggcacatcatgttcagcagggcgctgctggacgcaccacggcagctcgtggcggttcagtctctgagcccgctcacggtcgcgccgcagtggcaacgccgaggaatcggttctgagctcatccgcggtggtctgcaacgactcgacgagggcggtatcccgttggtgttcctggagggagatcccggctactactcccgtctggggttcagccccgcagtggagcagggcttccgtaagccctcgttgcggattcccgatgaggcgttccaggtcgtaaagctgtcggcctacgagccctggatggtcgggacgttcgtctactcgaacatcttttgggagcatgactgcgtcggcctgcgtgaggcaacgcatagcgatatgggcgtcttgtcaggcactgagtag

SEQ ID NO: 5329 - DNA, 120 bp, Actinoplanes utahensis
ttgccccacagctccggtcccgtcgagggcaacgtcaaccgaatcaagatgatcaaacgacagatgtacggccgcgctggattcgacctgctccgcaaacgagtcctactcagtgcctga

SEQ ID NO: 5330 - DNA, 474 bp, Actinoplanes utahensis
atgatcgtcgggcagaaaccacgcccgagcagcctcgacccgttcaaggctcatctcctccggcgcatcagcgaaggctgttccaaagccacagtcctgcaccgcgagatcaccgcacagggcttcaacggcggctacggcatcgtccgcgccttcgtcgaacagcaccgcgcccgcccggatctgagcgtgatggtcaaactcccgtcggtccgcgaagtaaccggctggatctgccgccatcccgatcaccttgtcgagcgggacagcgaccggctccgagcccttcttgaccgctgcccggaactggccaccgctgccgacctcgtgcgctcgttcgccggcatgctgactaacctgcgcggaaaccagctcagcgtctggattaccgccgctcagcaggcagcactgcccggcctcacgggattcgctaccggcctgaccaacgacctcgacgccgtcacggcggcctga

SEQ ID NO: 5331 - DNA, 423 bp, Actinoplanes utahensis
ttgacctgctgcctggccgtgacgccgccccgctcgcccagtggctcaccgaacacgcaaagccgcaggtcatctgccgggcaccgggccagcgcctacgtcgaaggagcccgcaccggtgcaccggacgccgtgcaggtcgcggaccggttccatctgtggcagaacctcgccaaggtcgtcgagcggtgcgtcgcccgacacaaggactgcctgcgggaaccagtcaccacaccgggcggtgatcgggccgctgcagctgaggtaccggaaccccgcggggcgatggcacagcgccgccgtgaacaccaccagctcgttcatggcctgctcgccgagggtgccggaattcggcagatcgcccggcacctcggctggggccggcacaccgtgcagcgctacgcccgtgccgctacctggtaa

SEQ ID NO: 5332 - DNA, 249 bp, Actinoplanes utahensis
gtggctgtcggcctcaccggtgccctgctgatcgccgtgaaccggtcggtgctgctggccggcgtgatgatggccctgagcttggtaccggccgcggcgctcggcgggtacgcgctggtcgtcggtgacccggccacggccggcggcgcggccctgcgttgggttcacgacgcgctcatcgtctttgcctgcgcgtatctcgtcgtcggcattcaccgcaaacgccagcgccgcaccacacaagcctga

SEQ ID NO: 5333 - DNA, 156 bp, Actinoplanes utahensis
atggtcaccgggctggtgctgcggctgatcggtgtcgacgcgatcgccggcggggagcgcttcctgcctgccggtttctgctgcactattggggcggcatcacccggacggaagctgtcgccacggtggctgtcggcctcaccggtgccctgctga

SEQ ID NO: 5334 - DNA, 618 bp, Actinoplanes utahensis
atggctttgcaagaacttcaggcgatgcagactgcgttcgagttgttgtctccgctcgacgcgagtgctcaacagcgtgtcttggtgtggttgtcagcggcgcttgcggacaccaatggcggtcccgtgtccgcggacaatccgggcgctggcatgccgtcgaatatcgcctctgaggatgttgttgcgggaacgcctacgcagtatccggggactttgccaggccaccagaccctggcaccggtagcggccgctggggagcggggagctgaggcggagcctcaggtcgccgccgagccgggttcgggtccggtagacgaaccggtgtcggctgcccggccggcgcgcactcgggcggcgaagtccaccggtcggcgtgccggcaagaccggcaaggcttcggccgctgcgacgtcagcaccggttgtccgcacggcgtcgggacgccggagtgagcggccgagcggtgagcagttcctcaccgaccttaataccctgggctcgttcaaggcgctcgctgaggagtacggcaagtcgatcggcacgatcggcaactgggctaaccagcttcgtgagcaggggttcgccatccctgtcggccggcagaagaaggcctga

SEQ ID NO: 5335 - DNA, 285 bp, Actinoplanes utahensis
gtggaatcggcaggcgcgctatggctccaggacggtcccgcaatagcgcctgaactactgaaggccttgccgaagtacctggccgacgacctgtacgcgccccaggcgctgcgcgtcctcgcactgatggggccgcatgcgcggccgatacttccctacctggatcggttcttggcctcgcggcagcgggtggacctcaccctcggcgacctcgacgccgatatgcgtgcggacgacatgctgctcgccgctatgagcgccacccgcgagcagatcaccaggtga

SEQ ID NO: 5336 - DNA, 672 bp, Actinoplanes utahensis
gtggcagtgaccgctcatgatgttgctggaagcctgccggatatcgcgactctgcgggagcgctgtcgcgcgttggcggtgcttgaggcgatcctgagcccggaagaggagtctcggtactactcgttcacgtcggcctggtcggagggcgaggagctagcgtctatggacaacggctccggggacgcctggtcgatcgtgttctcccctgcaggcgcctttctttggggattcgatcatgaatcttcgatgagcccggccgtgaacaatgaggagttgtggccgggactggtcgacacggtgccggacgtcttctctgccgcggtgaacgaaccggcgttcagttacgaaggcacgctggaagcgacggtctgtctgtggcggcaaacggacgacgaccgttggcatgccggcgacatcgactttcccgaccgtcccgatcctgacggcgccgaacggctgttttccgtgctgctcgatccgaccggcctggcctaccaccgcttcgccgaggactactacggcaaggccgtagatcttgatgccgtccgcgagatcctcgcgttgtccccgctgaccacgagcctggtgcggcgcctgaacgctgaccgatcgacagccgctctcatcgccgacttgtcttatatcggctatccctcgcagctggcatag

SEQ ID NO: 5337 - DNA, 177 bp, Actinoplanes utahensis
atgctcgtgcaccagtacgcctacttcgcgctctcctcgaaccaggtgtcggccgctgagaccaccgcgcggttgctgattgatcctgatgaggtcgtgatccggggcagccgtcatgtggaaccggtgcgacccgcttccacagctggaagattgtttgccgcaagccaggactga

SEQ ID NO: 5338 - DNA, 294 bp, Actinoplanes utahensis
atgttcatcgtcttgctccggttcaccgaaaacaaagccgccgccggcgagcacatgcccggccaccagcagtggatcaagcaaggtctggaagatcaggtattcctgctcgtgggcggcatccagccacaactcgggggcgcggtgctggcgcacaacacgtccctaccgcagttgcaacaacgggtcgacgccgacccgttcgtcatccaccgggtcgtcgacgccgagatcctggaaatcacgccgggcgcgaccgacccgcggctggacttcctgatgccggtgggatga

SEQ ID NO: 5339 - DNA, 1074 bp, Actinoplanes utahensis
ttgtcaaccggccttttcgagccgttccctctgggagatctgaccctcgcgaaccgcatggtcatggcaccgctgacccgcaatcgcgccgaccatgacggggtcgtcacgccgatgatggtcacccactaccgtcagcgtgctaccacaggcctgatcatcagcgagtccactcccgtctcggccgagggcgtcggctaccccaacacccccggcattcacaccgaggcccaggcggccggctggctccgcctcaccgaggcggtccacgcagaatcaggtcgcgtcttcgtccaactgcagcactgtgggcggatctcgcacccgagcctgctgccggacggcagcaccccggtggcgccatcggcgctacggccgtcgggccagacttttacgccttcggggcttcaggagttcgtcatgccacgcgaactcgaagcccacgaggtgccggagatcgtcgctcaattcgagcatgccgccaaacgggcgctcgacgccggattcgacggcgtcgaagtacatgcaggcaacggctacctcgtcgaccagttcctgcgcgatgcgacaaacatccgcaccgacgcgtacggaggcagtccccgcaaccggatgcgcctgctcaacgagatcctcgacgcggtgtgtgcagtgtggccggcacaccgggtgggagtgcggttcacccccgagaacagcttcaactcgatggcggataccaacccacaggcgcacttccggtacttcctcgaacagctccggacccgcgacctcgcctatgtccacatgctcgaaggtgacatgacgacgaaaaccagcgccctcgactaccgcgctcttcgcgacgcgttcaccggcacctacatcgccaacaacggatatgacctcccccgtgcccagacagcgatccgggacggcgccgccgacctcatcgccttcggtgtcccgttcctggccaaccccgatctggtccgccgctaccgcgacggcctccccctcaacaccgccgacccgtccacctactacacaggcggcccactcggatacattgactaccccacgtacgacgcctga

SEQ ID NO: 5340 - DNA, 567 bp, Actinoplanes utahensis
atgggcggcgtcaaggcgacccgagagcagatcatcgaggcggccgatcggctgttttatcagcaggggtacgagcacacctcgttcgccgcgatcgccgaggccgtccagatatcgcgagggaacttttactaccacttcaagacgaaggacgacatcctggcggccgtgatcgatgcccgtctcgccgagaggcggcggatgctcgagcgatgggagaccgaggagcccacacctgccgggcggatccgcaggtacatcgagattccgctgaccaatcgggctgatgtccagatgtacgggtgcccggtaggcactttgaccaccgaactggcgaagttgaatcatgcgtcgttcgctgaagccaacagcgtgttcaccctgttccgcacctggttgcgtgaacagttcgcgttgctcgggcacgaatcggaggccgatgcactcgccatgcacgtcatagcgttcagtcaaggcgttgcgaccttggcgaacgccttccacgacgaagggttcatctggcgcgaggtcaagcagatgtccgactggctaaccgcctacgagtag

SEQ ID NO: 5341 - DNA, 1617 bp, Actinoplanes utahensis
atggcccgtactgatggtgtcgtgcgccgtaccgggaacccggccggccgttggttcgctgatcttccggtggcggtgaagattttcaccgcggtgggtgtcgtcgcggccgcggcggttgctgcgggcttgctggcgatcgccagtttggccgccgtgtaccgcagcggtgaggccatccagcagaagagcctggtcccggcggtgcagctggcccagttgcgtcagcaggcgttgaccgcccggatcgcggtgcgtgacgtggcgctgctggcggacaagaaggccgcgcaggccaagctggatgcggccgacaaggctgtcgccgcggcggcggccgcctaccgggccgacgcgaacgacccggccggcgtcgacgagttcacccagctgtggcagcagtacgtcaatgtgcgggacacacagcagcttccggcggcgcttgccggcgattacccgacgttcgagaaggtggccaccaccaccgccaacccgatcatgaccaaggtgatggccgcgctcgacaccgccggcgccgccgagcaggcgcagggcgtcgcgcgggtgacggaggccgctgacacctaccaccacgcccgcaccaacctgatcattctgctcagcgtgggtgtgctggtcggcgcgatcgttgccgcgtacacggtgcggtgcatcgtgcggccgctgcgcgaggtcggcacagtgctgaccgggatggccgggggtgacttgaccggtatcgccgaggtgggctcccgggatgagatcggccggatggccgccgtgctgacgcaggccaccacgggtgtgcgggagacggtgcgggcagtcgccgaaacggctgacggcgtcgcgagctcggccactcagctggcggccaccagcaccgcgatcgccgggaccgccgaggacacctccggccggtcgcagtcagtcgcggccgcggccagccaggtgtcggccagtgtgcagtcggttgtcgcgggcgccgaggagatgtccgcggcgatccgggagatcgccgagtctgcctcggatgcggcccgggtcgccgcgtcggccgttgatgcggcggccagcgcctcgggcacggtcacccggcttgatgcctccagcgccgagatcggcaacgtgctccagctgatcaccgcgatcgccgagcagaccaacctgctcgccctcaacgccaccatcgaggccgcccgcgccggcgacgccggtaagggtttcgccgtggtcgccagcgaggtcaaggacctggcccaggaaaccgcccgcgctaccgaagacatcgccgcccgcgtctcggcgatccagtccgacgcccgcgccgccgccggctcgatcggcgagatttcccgggtgatcgagcagatcaaccagtaccagaccacgatcgccgcggcggtcgaggaacagaccgccaccaccgcagagatcggccgcaacatcgctcaggcagcgatcggggccggtgacatcgccggcaccatcggcggcgtcgccgacggtgccgccagcaccagcgccgggatgaccgaggctcgcaccgcgaccgcggaactgtcccgggccgcgaccggcctgcaggacctcgtccagcgcttccactactga

SEQ ID NO: 5342 - DNA, 264 bp, Actinoplanes utahensis
atgaccatccccggctacgactatgcgcaacctaccgagaaaagcctgctcaccgcgctcaccgcatccgtcggcgccgacgcggccagggctctcaccgacctcgcggtcaagaaggccggccgccgaacctcggccagcaccgacgacctggtcaagatgaccgagtacctcatggagctcggcgacctggtacgcgtcactgcccgatccgagaagatccgcgccgtcacctaccgggcgttgcacgacacggtgaagtaa

SEQ ID NO: 5343 - DNA, 513 bp, Actinoplanes utahensis
atgtccgccgctcccgccgctcacaccctgaccgatcctgcccggatgcgtgtcctggccgcaatcgacttcgacaaccccgccctgcgcgccgggctcaaccacgttgccgaagacaccgcacaagccaccggcatgccgatcagcctggtcaccttggtcctcgacacctcacagctgttcgccggttccaccagccttgacggctgctggatcgccgcggccggcggcaccccgatcgagtggtcgttctgcgtcaacaccgtcaccaccggacagccctacgtgatccccgacatggccgcgtccacacacgccgccaacccgctggtgaccgtcgacaacgtagccagctacgccggcgtgccgatcgtcctcgccgggcagaccgtcggcgcccactgcatcatcggcgtcaccgcccagcagttcaccgccgaccagctccaacagctgcacaccggagcacaacaggccggcgctctcctgcagcagttcagcaacctcacctga

SEQ ID NO: 5344 - DNA, 1026 bp, Actinoplanes utahensis
gtgcgccgggcgttgatcatcatggcgtccgcgtccgggacaccagtgccggcgatcgcgagcctgatcgccgggcatgaggacaccgtccgcgacgtgatccactcgttcaacgagatcggcttacgtgcgctggaccctcagtgggcgggaggccgtccccgccggatcagtgacgacgatgaagcgttcatcgtcgcgacggccacggcccgcccgagcacgctcgggcggcccttcacctgctggagcctgcgcaaactcgccgatttcctggccaccgacgccactcgcgaagtcatcatcggccgggaacggctgcggcagatcctgcgccgtaaccaggtcagctggcagcggacccggacctggaaggagtcgaaggacccggacttcgacgccaaactcgaccggatcgaggaagtcaccacccgattcccggcccgcagctttgcgttcaaccagttcgggccgttgtcgatccgcccgcaccacggccgcggctgggccccgcgatcgcatccggaccggctgccggcggcctaccatcgcacgcacggcatccgctacttccacggctgctacagcctcggcgacgaccagctctggggcgtgaaccggcgacgtaaaggcgcagaccacaccctgtccgcgctgaaatcgatccggaaagcgcggccggacggcgcgccgatctacgtgatcatggacaacctgtcggcgaacaaaacgccgaccatccgggcctgggcagttcgtaacaaggtcgagctgtgcctgacgccgaccagcgcgtcctgggccaacccgatcgaggcgcagttcgggccgctgcgcatgttcaccatggcgaactcgaaccacccgaaccacaccgtcttagctcgcaagctgcagaaatacttgcgctggcgcaacgccaacgcccgccaccccgacgtcctggccgcgcaacgccgcgaacgagcccgagtccgcagcgaacgccaacaacgctggggccgaccccgaaccaaggccgcctga

SEQ ID NO: 5345 - DNA, 654 bp, Actinoplanes utahensis
atgggggcgatcgccgaatcgtcgggcgcagttgaggtgtgcctccagcagatcttcgtggccctcatgggcacccggcgagcctcggttgtcgcgtccggacagaatgctggttggctcgtcgacaactgcctcgcggtattgcgtgagccgagcttttcccacaccgaggacacccgcgagctaatcaaggtgcttgtgcgggcgccggacgtgctgcgcagccgtaatgatctcctccacgccttctgggtgcggcacgagggtggggatgcccgagtcaacacgcggtaccgcaaggcgccgaccctcaagtcggtggaaacgaccgagcctgcctcggcggcggaacggctccagatcctcgagaagctgctagccgacctcggctatcggatcttcggcgacaagatgtcttggcattccgtggccgtcggctgccccgaatcggtcacttacaccgtggacgacctcgatcccgacgcagccttccggcgtccggtgccgggttcgtcccggcctgcgcgcgaacccaccgtattggagctgaagcggcgggccgcgcaaatccgggagatcgtggaggccagcaaaattccctaccgcttggatctaccggatcggcacgaggaaaagtgcttctggattctttga

SEQ ID NO: 5346 - DNA, 480 bp, Actinoplanes utahensis
gtggggaacgtacgacccgaacgggagatcccgctggcgcgggctacatatgttgccgctgcgggccgttacctcaacgcggtcagaaacgtagcggcccgcggcgttccgatcgatccgggggatccggtgcgggagtggacggccgccgacgccgccgcacgagagatccgcgaagaactcggacttgatctgagccccggccggctgctggttgtcgactgggtgcccgcccagccggacggacggccaccgctggccaactacatcttcgacggcggccaactcaccgccgaccaactgcacaacctgcggctgcccgccgacgaactgaccgcatggcagctgaccaccgccgctgaatggccccgcctgctagccgagcacctggttcgccgactgcacgcctgcgcccacgcgctggccaccaacaccaccgcctacctgaaccacggatggcaccccaccgacccgacctga

SEQ ID NO: 5347 - DNA, 507 bp, Actinoplanes utahensis
ttggcgcgcacggtaatgtcgcggctcgtgcgaactgtgaagatcatcgttgccctgttgctgctggtggccgggtcggccggctgcagccttttcggtgacgacgcacccacgcgggacgagcagattcaaaagatcctcgatgagaacgctgaattcaccgtgttcctgcgtgacgacgccaccgacgcccagcgcaacgatgtcgaggcggcgctgcgggctctaccgggggtcaccgaggtcagctacgtgaatcgtgacgaggcctaccagcagatgaccaagctcttctcggcggatccggcatccgtggccgacgtcagcagggacgcgctgccggaaagcttcaaggtgaagatgagcgacatcgccgcggtccgccagatccgcgacgaaggcacggtcggcaagctgcccggcgtggaaagggcggtctttacctgccttgacgtgcaagagtgcaaaaagatgtccacgcccggtccgacgggatcaccgagctga

SEQ ID NO: 5348 - DNA, 534 bp, Actinoplanes utahensis
gtgggaccggcggcatggtggctggaagccggcacgctcgtcgccgccggcctcgtgctgttcggagcccgatctgacctggaacggaccgcctatctgtggttcgccgtcctcggcgtcgtcctggcctgcgtcgacatcgccgtgcgccgtctcccgaaccttctcaccgcgttctggggtgccgggctactggctgggcttctgattccggctctcgcgcagcaccggttcacctcgtggcttcaggcgctggccttgggaattgtgttgaccgttctgttcggattggttgcgctggttcggccaggccagctgggctggggtgacgttcgggcgatcggtgtcgccggcatcgcactcggctggctcggctgggcggcggcgtatgcagggatcttcctgtcattcactttcgccctgatattcgtcatcctccgcggccgcgcacaccggaagcaggccgtccggttcggaccatttctggttgctggtgccgtggtcgtctgcgccctgatgcccacggtgcagtag

SEQ ID NO: 5349 - DNA, 555 bp, Actinoplanes utahensis
atgcgcgcactctatgcactgcgtgtggcggcagctgcgacagtccttgctggacttgcaggctgtacgcacaagtcggcggctgcgccgattccgccgcccgcgccgacttcagccagcccatcgaccgaccctgcggtagcggctgccagcgcggagatccttgatcgctttcggtcgttccggcaggcctacgacacggctgggctgaccgccgactacaagagcgaagatctcacccgctacttggaggatccgcttcaaaaagacgtcgttgcgttcatgctcaacaccaaaatccacggcgcggtctaccggggagaagcgcagtcgactcccacgatcagcaagatcgacctcaaggcgaagaccgccaccatcaccgagtgctacgacacgacgaagttcaagctgtacttcaccaagaacaattcgccggtgccggtgcctagtggccctcggcgaggaatcatcgaaaccctggccaaagactacggcggcaaaaaaggctggatgttctacaagtcccaagccttgacggatcccacatgctag

SEQ ID NO: 5350 - DNA, 876 bp, Actinoplanes utahensis
atgctagcccggctggtgcaggtaacagtcctcgttgcggctttggtagctggcacgctggccgcgccggctttagccgacgacggtggcggcgcctgttccggctgggactgcggatcctggggcgatcaacccggtgcgagtggcggcaccggtagcagcactggtggtggcgggggcggcgacggcggttgtaactggctcggcatgccggtgccctgcgacggcggaagtctgggctggtacgacggcaaaagctgctacctcaaaccggtggcggaagggcccgccggcgattcgcacggcgggactgggttctggtactgggccacctgctttaccggcgtggtgctcggtggcggtttgggcgcgccggtcctgcggtggtacccgaccgcgcagggacccagcccggaagaacttgcccgccgcgccctggcgacgatcacgctgaagccgccgacgatgggtgttgacaccgccggcctcgtgttcaccccggtctggctgtggaccgccaagaccccgaacacgtggggtccgatcagcgcgtcggcgtccgcggccgggctcacggtgacgattaccgcccgcgcgagccagatcgtctggcagatgggcaacggtgacagcgtcacctgcaccaacccgggcaccgcgcagaaggcgggggaggccgatcgccggtcgccgacctgcggctacgacggttacccgcagccgagccggacccggcccggcggcaagtacacgatcaccgcgacgacctcgtggcgcgtcgactgggcgggcggcggccagaccggcgtcatcgaccagacccgggtcgccaccaccaccgtcgcggtcaaggaagcccaggtggtcaaccaatga

SEQ ID NO: 5351 - DNA, 693 bp, Actinoplanes utahensis
atgagcctgaccgacacccgcaccagccctgccccggccgggccgctgccgttgaccggcgccccggccgcgcggatgccccgccggcgtcggcccggcctgctggccgccggcatcgtggtgatggtcgtggcgaccttgggcgcctacacctacgcccggaccgccggtgacacggtgccggtacttgccgtcgcgaccaccgtcaccgccggccaccagatcgccgccggcgacctgaaaaccgtgcaggttaaccgcggttccgggctggccccgatcccggctgaccagcagtccacggtgatcggcaaatacgccgcggtggaactggtcgacggcaccctgctcaccgcagggcagctcaccgacaaagcggtccccggcgccggcaagcagctgatcggcctggaactgaccccggcgcaactgccggcccggccgctgcaccccggtgacaccgtgcaattggtggtcacctcggatccgcacaacgtcaccgtggaccccaaggccgcggcccaggatgcgctgccccggccggtgaccgtgcccgcgacggtggccggggtcggggacaaggcgaccgacggcaacaccgtcgtcgacgtggtcgtcgccgaagccttcggcccgggcctggtcgaccgcgcgcagcagggccgggtcgcgatcaccgtggtcgcggggtag

SEQ ID NO: 5352 - DNA, 807 bp, Actinoplanes utahensis
gtgtcgttgatcgccgtggtcgccggcaaaggatcgccgggcgccaccgtcaccagccttgccctcaccctgacctggccgcgggatgtgctgctggccgaatgcgatgcgtcgggcggcagcgttctgaccggctacctcggcgggcaggtccccgctgatcggggaatcgcgcagctcagcgtcgccgactaccacaaccggctctacgacgccttctcccagcagttgcggtcgctcaccgagaccgccccgtaccggctgctgctgcccggcaccaccgagccggggcaggctgccggcctgagccggctgtgggaccagctcggccagtatctacgcgacctcgagcgctccgacccgcccgtcgacgtgatcgccgactgcggacgggtccccgccccgcacgcgccgctgccgctgctgcggcatgccgatgccacgctgatgatcgtcggccggaccctgaccgcggtcgccgctgcgcgcacccggttgccgcagttgcaggccgaggtcggcaagggtggtggcgtgctgcggctgctggtcaccggcgccggcgactacgacgccccggagatcgccaaacacctcggcgtcgagctgctggcggagctgcccgaggacggcaggacggccggcatgttcaccaacggcaccggcgtcccccggccgagcgccaccctgctgcgcgccgcgaactccgccgcggctggcctgcgcacgctgatcgagcagcgacgggccgcggccgcgccgacgccggtcaccccgagtgcctcccgggaggacagttatgcctga

SEQ ID NO: 5353 - DNA, 1524 bp, Actinoplanes utahensis
atgcctgaccggccgcccttgaacctgtaccggccggtggagccgcgccgtccgagcccgcgccccggtgccggggcaccggccgcgccggcgcggaccctgccgtcgctgccgtcgatcgtgacccagttgcccccgccgccgccgcttcccgctcagggccgccgccggccgccggtcgagctcgactacgaggtggtcctggctctgcactccctggtcagcgatcgcgtcagcgacaacctgcggggccgacaggtcggcccggacagccagcggcagctgaccatcgaaaccacgcgcgaggtcgtgcgggaacacatcgacaaccggatccaagccggcgaccagatcccgctcggctacgaggatgcgctgaccgatgcggtcgccgcccagctgctggggctgggccggctgcagccgctgctcgacgacccgcaggtcaaaaacattcacgtgtcaggccatgaccgggtacgggttgaatacgccgacggccgcgtcgacgagcagactttcaccgcggcgggcagcgacgccgagctcctcgagctattgcagcggcgcgccgcccgcgacggcctctccgagcggtcgctgtcgacgtcgcagccgatcctgcacctgcggctggcggacggctcccggatggtcgccgcgatcgccgtcaccccacgcccggtcgtggtcatccgccggcaccgcatcaccaaggtcaccctcgacgacatggtcaagctcgggtcgatcaccccgctgctcgccgactttctcaaggcgatcgtcgccggcaaggtcaacacgatcgtcgccgggctggccggctccgggaagacgaccctgctgcgcgcgctcgcgtccgagattgaccgcgaggagtggttcgcggtcatggagaccgagcgggagctggccctggacccgcagcggcacccgtgggcggtcgagttcgaagaacggcagggccacggtgagcgtgacgctcagggccggcccgaaggtgaactgcggctggtggacctgtttccggcgatgctgcggatgaacatgcagcgggtcgtggtcggtgaggtccgggccgcggagatcgtgtcgatgctcgacgccggcgcgaccacgcagggcaccctgtcgaccatccacgcccgcagcgctgatgccgccctgacccggctggcggagctgctgctgcgctacggcgcgacgccgaccccgaccggcgcctacatgcagatcaccggcgccatcgacctgttgatcttccagcgggtcgataagcgccccggccagccggaccggcactacgtgtccgacgtgatcgaactcaacgggctggccgacaacggcctcagcgtcgcccgcagccacctgttccgggcccaggaaccgggcgggctggcgatgccgacgggagtgcggcccaacgaccacatcctgcaggccctcagctacggcggcttcgatgtgcagcgcctgttccccgagaccgcggccgccgctggcacgccgtggggacggtga

SEQ ID NO: 5354 - DNA, 882 bp, Actinoplanes utahensis
atgccaccgttgatgtttgccctgctggccgccgcaggcgtggccgggatcatgctgatcgtcgccggtgcggtcgggacccggccggctccggcccgcccggacggccggctccagcgggcccgccgatactggcgcggcgcgaacctgtcgcgccgtgaccgactgacccgccagatcatcctggtcgcggcggccgcgatcaccgtactggtgtggctgctcgtcaagattccgctgctggcgctgctcgccgggctcatcgtgctcggcgtgcgatggttgttcggcgccggcgccggcgagcaacgcgcgatcgcgcagctggaggccctcgagagctggacgcggcggctgtccgacgtcgtgcgcaccgggctcggacttggcgaggcgatcctggtcagcacccgcgacgcgccgcaggcgctcgccgaggatctgcagctgctcgccgcgcacctgcgcggcggggtcaccatcgtgaccgctctcgaccggctcgctgaccggctgtccgatgccaccagcgacgaggtgatcgtggcgctgcggctgcacgccaccgaccgtgggcagcggctgtccgacatcctcgacgagctgaccgccagcgtggcccgggagatcaccgtgcggcgcgaggtgtgggccagccgcgccgacccgcggctgaccaccaagatcatgacctgtctgggcatcggcacctacgtgctgctggtgaccaacccgacctacatccgcccctacgccaccttgatggggcaggccgtcatcgcggtctgcaccggagtgttcctcgccctgctcatctggatccgcaagctgagcaccacccgcaaggcgccgcggctgctgagcacgcaggagagccgatga

SEQ ID NO: 5355 - DNA, 867 bp, Actinoplanes utahensis
atgagcgtcaccatcgccgcggtgttcggcgtgctcttcggcgccggcgtctatctgctgctgcgcggcgccgtgcccgccgcgcctcgcctcgacctggccctgcaacggctgtatgccacaccgatgccggccgccggcgagaaggacagcccgattgcccggtggctgaccacccggatcggcccgcgcctgcgcatcccgacccgggagctgcggctgctgggcaaaagcaccgagcgctatgtgctggagaaggtggggctgccggtcgtcgggctgctgttcgtgcccgtggtgaccgtcgcggtcgacaccatgggcctgcacctgcccgtcgtcgtgccggtagccgggtccctgctgctggccgccctgttctttctgctggtcgacatcgccatcaagcagcaagccgaagaagcccgggagcagttcgtccgggcggtcgcggtctacctgagcctggttgcgctggaacgctccgccgcgcacggaccggtcgaatccctcgagcgggcggcgcaggtcggcacctcctgggtgttcgtccgcatccgggaaaccctggcggcggcccgaatcgccggcatcccgccgtgggacgggctcagccaggtcgccgacgagataggggtgcccgcactcggcgacgtcggcgacatcatgcgtctgtcgggcaacgaaggcgcccaggtgtcgcagacgctgatcagccgcgcccagtcgctgcggatcgcgctgcagaccaaggaccacgaccgggccaacaccggcaccaccctgctctacggcacgggcagcctgatggtcatggtcctgttcgttctcgtcggctatccgttcttgatccggctgctcgcatga

SEQ ID NO: 5356 - DNA, 633 bp, Actinoplanes utahensis
atgaacagtccccgtcccacccgtcaaggagttgtccatgtcagaactcgctgtttacgccctgacctgggtgaaggcccgcgccgcggagtcgcgccgcgacgacggggcgctgtcggtcgaacaggtcgtcctgaccgtctgcgtgctggcggcggccctgctggtcgccgccgcgatcaccgcggcggtccagggccggatcggcaacatcacctgagctgcgaggccgccgcgaaccgccgccgatcgtggtggtccgcggcggcccgcgacgacggcgccgcgtccctcgagatggtggtcatcatcccgacggcgctactgctgctgtttctgagcctgcaggtggccatgtggtcgtacgcacggtcgatcgcgctgaccgccgcgcaggaaggcctcaccgcggcccgcggctacaacagcagcgccgcggcgggcaccgcccgcgcgcaagacttcatcacccgggccggcggcgactcgctgaccggcgcccgggtcagcgtcacccgcaccgccacccaagcctcggtgaccgtcaccggcagcagcctgtccctggtccctggcctgcggttccgggtctcgcagaccgcgaccgggcccgtcgaaagatttgtccgatga

SEQ ID NO: 5357 - DNA, 420 bp, Actinoplanes utahensis
atgaccggctggtggcaccagattcgccgtgacgacggcaccatcggcctgttcgtggccgtcgccgcgttcgggatcctcgccgcgatcggcctggccgtcgacggcggcggccggatgcgcaccctgcagcacgccgacgacatcgccgccgaagccgcccgggccgccggccaagccgtcgacctgaaccgggccgccgcgaccggagagaccgtcgtcgacccgcagcaggccatcaccgccggcgagcagtacctgagcgccgccggggtcagcggcaccgtcaccatctccgccgaccggcagcagatcaccgtggtcgtcaccgaccactacgacacgatcttcctcgggatcctcggctacggccggttgcccgtggacggtcacggcagcgcgcagctgctcaccggctga

SEQ ID NO: 5358 - DNA, 3312 bp, Actinoplanes utahensis
atggcatctcgcgcgttgcgccgcacccggcagatcatcaccggcgtcggggcgctgctgctgctcctggcgatcattgccggggccccggccgcgctggtctggctcggcggcaacccgctgcccgaccacctaccggcgctcggccagttcagcgatgcgctgctacgccccgatgacggcaccctgttcctgcaggcgctgaccgtggccggctgggccgcgtgggcgtggttcaccatcccgctgctcgtggaaagcgtcgcccggctgcggggtgtgcggactccgaggctgcccgcgttcaccggcgcgcagaaggtcgccgccggcctgctgtccgcaatcggcctgctggtcgcttccccggcggtcgccgccagcggccccgcctacgccgcccccctcaccaccaccagcacggctgcgaccaccacagcggtggccgaccagccgggcagcagcccgctgactacgtccacgccaacggcgcaccacgctgccacagcccgcccgcagaccgcgccgctggtctaccgggtcgcccacggtgaccagctgtccgcaatcgccgcgcggttcctgggcaacgccgaccgctatcccgagatcgcccgggccaacccccggctggagcaccgcgaccaccgattcccggaccacatcgagggcaactggcgaatcaccctgcccgccggcgcccacgaccgcggcgcccgcgaacacgcccacggcagcgtcgtgcagcccggccatcccgaacacacacccacccccgctacgccgcccagcagcgcacccgccccgtctcgtcccgcggtcccgcagtccggcacggcatcgcaacctgcaaccgcgccctcggataccagcggggcaggcaccacccgcaccgcaacacctaccaccagcacctccgctactggccgtccttccaccgccccggcgacaccgccagcggccagcacaacggccggtcaccacaccagtcctacactgtccgcatcaacgccctccgccgagcaggcccccaccaggccggaccaggcacccgccgccggcacggacgagtccgtcgacagttcccagatcgtcaccggcgccagcctggctggcgccggcatcctgaccgcactactgctgaccggcctctaccggcgtcgccgtacccagcgccagcaccgccgcaccggccgccggctgccgcaccccgccgacggcacgaccgaacgggccatgcgtgccgccgaacaacccgctgacgtcgaccgactcgacgccgccctgcgcagcctcgccaccggcctcaccggccgccccgagcacgaactgccggacatcgccggagcgtggatcaccaccggccccggcgccgggcacccgctcaccaaacccgtcgtcagcctcatcctgacccggccgtgcccgaacccgccggcaccctggatcgccgacggcaccgcatggacgctgcccgcagacgccgaccccggcgaaccagacgacctcctagccccgctgcccaccctggtcaccatcggctcccaacccggccagcacctgctgctcgacctggaacgcctcggccaactcaccatcgtcggcgccagcgacaacaccgcggcgctgctgcgctacctgatcaccgaactggcgtgcaaccaatggtccgacgacgccgaaatcatcatcgccggattcgagcccgatgaggccgaactcctcgccgccctcaaccccgaccggatccaggccagcaccgcggtccctaccgccaccagccggctgcgccgccgctgcgcggcggtcaccacggcgctgcacgccgccggcgttgctgacaccctgactgggcggctgaccgacattggtgaggcctgggctccgcacgtcctggtcgccgccgaccccagcgagcacgaccgcaccgaactcgacgaactcggccagcaactcaccacgctcggccggtgctcagtcgccagcgtggtcgcaaccaccacgctcggcgccgccaccgacaacggacacgtcctgaccctgctcgataatggggtcttgcagatcaccctcgccgacggcggcgccccgttcctggccgcgacgatccgggcagctgccctgccccgcaccgagctcgcacccctcgccgacatcatgacgcaggcccggtcgaccagcgacgaaccagtgccggccgcccccgaacccgagccgtgggcgcagggcaccgacgcggccggcagcctcctgccgcaccacctgttcgccgccgagcccagtcccaccccgccgacgccagccgtcgacccggcacccccgcagcccgagccggagcaaccggccgactcgctgaccgagcccggcacagccgtcgacgatccgatcaccagtatcgtcctggtcgacacccggcagccggcccgccacgagccgccgacgattccccggcagcagcgtccaccagtcgacggtgacctcgacgccgacctgcgggcctggcacaaccaggacccgacccgcccgctgatcagcatcctcgggccggtcgccgtcaccgcgccgggcaccgaacccgaccgccgccgcttctacgccgaaatcgtcgtgttgctggccggccggggcacccgcgggatcaccggcgaccagatgagcgacgcgctgtggcccgaccagcagatctcgccgtcctcccgccgggtcgcgatcgcccgggtccgccgctggctcggggacaccccgaccggcgagctgtggctacccgacatgggccccgaccggctgtaccggctcacccccggctacctgctggactggcacctattccgccgcgcccgcgcccgcggcgaaagccagggcgccgccggcatcaagtacctgcgggccgccctggaactcgtgcgaggagttccgttcgacggcgccgaccgggcatacgcggtcggcgcccgcaacccgtacgcgtggctgcccgagtcagacctgtaccccgggcacatcgtgtccgccgtggtcgacaccgcccaccggctggcgcagctctacctggacatcggcgactacaccaacgcccggtggaccgtccagcaagcctgggccgccgacccagaccgcggtgacgacggcccctggcaggacctgatgcgcatcgagcacgccgagaacaacatggccgagctgcgcaccctggtcggcgagctgatgcgcgcccgagaagccgaataccccgaggacctcgcgccgagcacctacacctggctgcgcaccctcgtaccggaactgctcagcagcggaacgttcgccggatga

SEQ ID NO: 5359 - DNA, 399 bp, Actinoplanes utahensis
atgcgctatctcacccggcagttcgcgatcggcgccctgcgccgaggcaacggcatcgaacagttcctcggcggtgtccagatcgaggacgagcccgccatccggtgggtagagattagccccatgaacaggcaataccgggtctcacttcacaccgtgcaagaccttgatgacgaccgagtaggcgacctgcccaacctcatctcgctcgacccggccgaagaggagtatgtcggcgaaggccgggagttgggcgtcaccgacgacggggccgaagcgatgtcgctcgccgagcgcctcaccgacgcccgccccgaccgctgggtcaaccacgctgtagccggcgaggaatacatggactacgtccgaagccgacgaggccctacccaagcgccatag

SEQ ID NO: 5360 - DNA, 543 bp, Actinoplanes utahensis
gtggctacgtgggtcaacgtctacgacagcgacgatccctgggacgaagacccgccgatactcggatccttcgactacgaccgggtgctccgcttcgaccggctgcccacaccggtcggcagcagccgtgctggtatcggcacgaccggcgacaacgcctacgagatcatcaatacggaatacctgctccggaccgcatgcggccgttgggtgtgtgagcacttctttcaacagccaccgggcgagcccaagatcaaccgctggttctacaacgatgagatggctgcgacctggctacggagccgcaacctgcaaaacgtcgtcgagcactacttcggtacacccccgccgatgccgccgggcagccagccttcgcccgacggtgacccgatcttcttccagccggacgcggagacctcgagcagaatcgacgcgtacgccactgcctcaggatttgaccgacgatacggaatgtactggctactacttcaaggcctcaacgccgccgaggctgcggctggacccgaaaatcctcacacgtag

SEQ ID NO: 5361 - DNA, 627 bp, Actinoplanes utahensis
atgggatcgggcggcgaacacccgtacgatgggcggcatgacgcagcccgacacccgtgccaccctcgccgaggacatggccgcgcacggccggccggtccctccggctgggctggccagggcccgccgcaccctcgaagcggcagcgcagcgccgcgagccggatgcccgcaaggccgcgctcgagcaactgcggtccggtttgcccgccacgtgaccgagtccgaaacaccggtcgtcagcctggtcctggacacctcggcgatcgctgcctgggtacgcggatctgctgccgtcggagagctgctggcagaaatcgatgccgaaggcggcaaggtcgttatcccgctgacttgcctgcttgccgcagcgtcccagatcaccacagaccgcgaatggctgtacctgctgctcgaccatcccacaacggtcttgatctcggacgaccccgaggattgggaaatgttgtcgagcaccatcagcctgctcggcaccgctgatctagcatcggcagcctggatcgctctggattggaacaccgaagtcctcacccagcacagcgaccgatacgccaagctggctggcggaaacctcgccctccagattcacgactacttcgacggctga

SEQ ID NO: 5362 - DNA, 345 bp, Actinoplanes utahensis
ttgacggttagcatcgtcgtcgtgagtagtgacgtggcgttctggaagatcgccgagggcgatcctggtgacatcttcgatggattggccgacgggatcaccgagcggcttgagccgcactcggacgtagcgtggtttcgtggagagttgctgtcacggtggccggacctggtcaacgtgctcgagccgaccgaagacgatctgctcgacgtgcccgaagacagcgcaaagtacgttctgctcaccttgccggtgcgcatgctcgaccggcttgacagcatcttcgatttggcccagaagtatgggttgagcggctacagcggcgttgccggccaagcgttctga

SEQ ID NO: 5363 - DNA, 567 bp, Actinoplanes utahensis
gtgcggttgaccgccggactgcaccgcgacgccctcgctgagcacgctggtgaggtcgtcagcctctaccgggcgcccgacggccggctcaccgccgagatcggcaccaccaccagcgatacccgccgccacctggccatcgaatggcccaccgggctgcccgacggatggaccgacgacacccgcatcgccgccgacgaccccggcaccggtcccgccctcgtggtcgccctcaccccggaccccgacgccggcggattgcgtaccgacctgctgcccaaccccgggcacgagccccgctacacctggggttatgacggcggcaacccccggatgctctatgccgccctggtgcgctgtgccaccgggcgatgggatcacccgcttgccagcggaaccatggtggcccggatctccagacacccggagaccagcccgctctaccagacgatcagcacccatcgcggaccgcttcgtctgcgctggcatgacatccgcagccagatccaccagcagctgcaggccctgcgcaacccggcacccgccgacgatgaggacccgcggtga

SEQ ID NO: 5364 - DNA, 378 bp, Actinoplanes utahensis
gtgacgatctacgggatcatcgtggtcatactgctactggcctacaccggcatcgtctggtgggcagtcgacgcggtcaccgcggaggcaatcctcgttcagactctgatcgccggggcaggactgtgcgcgctcatcggcgtcgtgcagatcctgcttcacgctggcgacggcccggtacccaacttcggcgccgtgtggatcaccgctgccgtgttgatcggcggggcgttggtcatctttggcatcgcgctgcgcatccaaagacacaaggacagggcgattgaactgccccgatacgatcacgatgtcacatgggaaaacgcgaccgcctccgacatcgagggcatgcgagacacttcatatccaccgcgctga

SEQ ID NO: 5365 - DNA, 456 bp, Actinoplanes utahensis
atgggaaaacgcgaccgcctccgacatcgagggcatgcgagacacttcatatccaccgcgctgaccgattccccacagaaagcgaccatgaaccttttcaccgtaacctcgggcatcctgctcggagcgccgacggcctacacaggcgcccttgcgctgtcgcgtgccgtagcgaccctcgccgagatcacggcgacccggcacgaggtgagcggtctgcctactgaaccgttcgccgcccgggtgcacgccgaccgccgacgcggggtggccgtggccgggaccagcctggctttggtcgctggcatcgcccttggggtggtcctcgccgtgaccgtcgcagacctgttctgggtcggcatctcgggcgcggcgctgtgcgcgatcgcctactgggcggcggtccggccacggcagacggccctgaggcaaccgatgtcgggcgcagacggctga

SEQ ID NO: 5366 - DNA, 477 bp, Actinoplanes utahensis
gtggctccggagccgggccggtggagcggccacgactacgccggcccggtcgagcctgactgtatcgggcacttcgacctggcaccgtggaacatcgtcttcgacggcgagcaggtcaccggcatcatcgactgggacttcgccgctcccacgagccgcgcctgggacctggcctatgcggcccaccagttcgtcccgttccatcccaccgaggctctggccgcctggggctgggacagcgaacccgaccgggccggccggctgcgcctgttcacgcaagcgtatggggcgccggtcaccgccgccgaactcgtcgacctggctgcgatgcggctgctgagtatcggcgcgcacatcgaggaccgcatccgcgccgacgacccggccttcgccgtgcaccaggccgaggaccacggcagcggctaccgcgccgcggccgcctggatcctcacccaccgcgcccagctgctcggctga

SEQ ID NO: 5367 - DNA, 360 bp, Actinoplanes utahensis
atgaccgacgcggtgcagcgcggcagattcgccgcaccggtacgccgcggcgaggccgtggaccgggccgcgggcccgggcgcggtcgacattcacgccttgctgacccatctgcacgaccacgggttcgacctgtccccgcaggtgctcgaggtcagcgacgacggtgcccgcgagaccctgtcgttcttgcccggcgacaccggctacccgccgcttgccgccgcgctgcgcttggagcaggcgctgaccggcgtggcgggggcggtcccggcggctgcacgacgcgacgcagggcttcgtggctccggagccgggccggtggagcggccacgactacgccggcccggtcgagcctga

SEQ ID NO: 5368 - DNA, 393 bp, Actinoplanes utahensis
gtgaggtcgtcgcccagggcttcagcggcggttacggcattgtcagggccttcatcgaacagcaccggattaagcggccggacctacgaaaggcgtcccggccactgtcacctcgccagatcaccggctggatctgccggcaccccgacaccatcaccgagcacgacatcagccggctgcagaccgtcctcgatcgctgtccggaactacgcaccgctgcagacctcgtccgcttccttcggcgagatcatgacccaccggcacggccatcgcctcgccgactggatcaacaccgcagaacaagcagagctgcccggcatcacccgtttcgtcaacggtgtgaaatccgacctcgccgccgtcaccgccggcctcaaagcaacgtgttcctag

SEQ ID NO: 5369 - DNA, 693 bp, Actinoplanes utahensis
atgtatgtccggtgcaatcgccgtcggctacacctcggcgggactaagtttcctgacgatcggctatcatgtggcgcaatgggatcgacataccagacattactggtcgccgctgatttcgacgcgaccgtggatgcgctgtgcgacgccggggtcgtcggagtcgtagtgccgctggccgagcatcgggtggcggtactgcccaaggagagtgagtgggaccaagctcccgtccgctcgatcggcgaggggctaagcgtaagcctgagctgtccggcattggccatgtcggtcttcgattccgatctcctctgctgctacgtgattcgcgacggcggaatcgtccacacatacatcaacgacgtggagatgacggtcgagtgggtcccggaagaagacggccagtttcacccaatgatcgatggtgtcgtccactcggtcgacttcaaaatccccaagggccctgccggcgatgatccggccgctttcgcctcgttcgcggtcggtgtgcccgatttaaacgcgatcgccgctgccctgcgtaacgagggcacctccgcgcacgtgatggccgaggttcagcacgaggagctccttgcggcgctcggcctgccctcaagggccctgaccacggcatatcgacactgcgaaccagccgtcttcccggacgctatcgtcttggagctggagtag

SEQ ID NO: 5370 - DNA, 588 bp, Actinoplanes utahensis
gtggatgtggcagatttctggcgcttcgtggaacggtcggccgacgccgaatctgatccaaaccggcgagcgctttggctggaagatcggctgagccgcatcgccctcactcacgtcgtcgacttccagatccacctggatgccgctcggcgccctatcgacacctacgacatgtgggccgccgcaaaccagatcatggacggcctgtgcagcggcgacagcttctggtacttccaaacctggctcatcggtcaaggccggcgctggtggcagcacgctgcccgacacccggacaacctggtcgagctccccgctatgcaggcactcgctggcagccagcccggagaatgggaagacgccgcgtggccccattgggagcagttggcatgcgttgcttccaacgcttacgaccgcgtcaccggggaggaggaaggcatcgacgacgccctgctcgaccgcggccacatccgccccttcgaccctcgaccggatggcgtgccgtgggattccgacagcctggccgcgatcagccagcgcctgccgcggctcagccgcgtgttcccacgccgacgctacaccaagccgtga

SEQ ID NO: 5371 - DNA, 396 bp, Actinoplanes utahensis
atggtctgggacgaccacgacccggctgccaccatcaccctcaccgcctacgtggacgtcgactcgctctggaaacccgaccgtgaccccgaggcactctggtatcccgaagacgatccggccgacgcgctctacgccgccaagatgatggcgccgctgaaccggtcaggatcgcgccttggcagcgagatgctcgactgggcagccgggcgcgcctgggacgccggactcacctggctccgattcgacgcctggaccaccaacccccgcctacacgcctactacgtaggcctcgggttccggcacgtccgtaccatcgcaagccgcgtctccggcgcctgcttccggcgcccgagccagccttaccacggctatctcaagaccgacggcgaatag

SEQ ID NO: 5372 - DNA, 390 bp, Actinoplanes utahensis
gtgcgctgctactcagcaggggaccagctgctcccgtgtggtgctcgcgaagggcgctcgccgaccacccgaaagccgtcgaacagagggccgccgcgtacgagagttggacctaccgttggggaccggcgtctcgcgaaaatccgggtagcccagctatacgcccgcgacctcgaggcggccatcggcctgctgctcaccgcacccgaagcccagcccctgctgccacccgagcgcgcaccacatgccgacgacctcatcgcccaccagcagctcaccgcccgactcaccacctacctggcccaccggcggggcatccgagtcaccctgtggaccacgctggtcgtcgtaccgaccatcgccttggccctgatcctgctgctgcgttga

SEQ ID NO: 5373 - DNA, 414 bp, Actinoplanes utahensis
atgagcgaggttgatccgtcagccctgatgagcttggctcaggagttgcggcgttcgttaggggatgcggcggagacgcagcggcgggtgttgagcgtcaccgggtctgcgacgtcgccggatgggctggtgacggtggtggtgggtccgcggggccagttggtggatttgcggattgatccgcgggtgtatcggcggccgaatgcgggtgcgttggcggcgacgattctggcgacggcgcgggccgcggtggagcaggcggtggagcagacgcgggagttggtggatgcgcggctgccgaagatcggcggtctgctggcatcgggtgcacagcgtccgctgggggtgcgggacttgatgcgggcccatgacggtgatctgagtcgggtgctggatgccggtgaatggtcgtga

SEQ ID NO: 5374 - DNA, 1071 bp, Actinoplanes utahensis
atgccggtgaatggtcgtgagcggccggtgatgccgggtgcgtggcaggcgatgacggtgatccatcccgggtcggcaggtctgcgggtgcggtatcggcagggtgtgctgatcgatgccgccgggtttccggattgggtgttgtatgcgcgtacggtggtcgagttgccggcgccgatcgccgagttgaccggtgatgagcaccgggttttcgatgtgctcgcggcgaatcgggtgatgctgggtgctgatccgctgtggccggacctgcgggtgggtttgcctcacgcgacggcgacgccgccgggctggtgctgggcgcggctgccggtgagtggtgagcgggcacggcgggtggcgttggtgccggtcgagttgcacggcgcgttccggcatggcggcggcagccgtacgctgccggtgggccggccgggctccggagtacggaccggcgtggcgccggtcgagcgtggtaacggcgaagtggtttccgagccgatcattgctgaggtggaggcgttgctcgggtacggcctgccgccggcgtatcggcgttttctggcggcgggtaatggtgtgggcccggccgagccggcagtgtcggcggtcgcggggatggtggtcgatcagccgctgttcggtttgggccgcgacgacatgctgcaggatctggggtatgcgccgcggtggctgggggaccggttcacgggcgaattcctgccggtcgggtttgtgcagggcgggatcctcgcgatacgggtggctggtccggatgcgggcagtgtgtggttcttcgacgacgacgatccgcgtgatgacgacagtctggggccagcggagatctgcgggcggttgttgcggcgctgcgccggggacttcgacgagttctgggcggggttgcggcggccggctgcggtgctgctggaggtggtcgaggatctggtggccggcgggctggtccgtgaggtgcggccggagcttgccggtgcggcgcttcctgaacggatgcgtgccgagtggcaggccgtcccgcagcagcgttcgatatctgtcgatgatctgatgttgtag

SEQ ID NO: 5375 - DNA, 1176 bp, Actinoplanes utahensis
gtgggcggggcagcgtgggcagcggcgaacagtgctgagcggcggctggcgcgagcatgggcggatgacgacgcggacaggttcgccgacgtactgctccatgctgacctgtttttgccgggcttcgccgatgacggtgcgagcgggcagcggctgctgacccgtgagcggggtggccggacgtttctgctggtctacacctcggtggaagccttgcaggaggcgattccggcggtgggcgtcggctggcggcgcacgacgttcgccgagctggccgggtcgtggccgaacccggcgtggggactcgccgtcagcccgaacaccccgatcggcgcctacctggacgcggagcaggtgcgtctgctgggcgaggaggtggccgcggagcctccgttcgcgccgggtggtgagcgggagcgggcgatgcgtgccgcgcagcgcgccggtgatgccgaggtctatctcgatctgctggtcaccgcggacgtgttgctgccgctggccggtccggccggtgcggatgatctcgggaagccgggctttccgtggctggtgcagcgcgccgcgggtgtggccacggtgccgctgttcacctcgcggcagcggttacgggatgtgtggcccgattcggcggacaggcccgcggttgtcgaggtgccgctgctgtcggtggtgcgtgcctggcccggcgccgcgtaccggatggtggtcaacccgggctcgccgatgatcgccgagttcaccggggcccaagtgccggatctgtggcgctgggcgcaggaactggtgctccgtcggacctcagcctcgcagagcggttctgagaacgagccgctcgctgagcagccggtagtggccgggccgcggatgcgccgggtgcaggcgctggtcgaccctagcgtggcgttgggctggttggccgccggtggcgggcggatcagtgcttcggtcgggccggctggtgcggtcgggatccttgacgggtatctggtgcgctggcacgaggacgagactctcggtgcggcaacgcgcccggtggtggagctggagctgccgtacggcgcgcagctggtccggctggtagccgggcaggagatcgtggttgccacctacgatgccgagctgtcgtggtggcggccgtcgatcatgagtgtgttgcgtggtgaagcgcggtga

SEQ ID NO: 5376 - DNA, 246 bp, Actinoplanes utahensis
atgagttcgtatctggagttgccggagggcacggaagcggtcgcgcagatcggtgcccggttgcgggcgcaagcgcaggatttcaaggagcaggcgcggcagatcctcggtgacatccaaggcctcgaccagggtcagccgtggggcaatgatcaggcgggtaaggcgttcgctgagcagtaccacaagccggtggaaggcgccggctcgctcgcgctggccatgcaggatcggctgcctagctag

SEQ ID NO: 5377 - DNA, 3498 bp, Actinoplanes utahensis
atgcgcggaggaatccgtgacgccggcgccgacctgcggctacgcctcggcgagaacaacgctctgggagaactgggcacgccgggtgccgaggcgggcgtggggtcggccggcgacatcgggtcgcaagctgggacacgggctgctggcgagcccgggttcgaagctggcccgcggcccgcagccgatcacggcaccggcggcagcgagcagacgtcgaccagtggcggatcagagcactctactggcagttcgggcgccgaccagcaggcgcgcggcgaatcaggcgatcgtgcgagcaccgagccgggccagcgcagcgagtcgaccgggggcgtgcagcaggcggagccaggcggcggtccgcagcgggccgaaccaggcaccggtgagcagcggtccggcttcggtgacacggcgcgggacgagtctccgcaggcgagtggcaagccagagcagacttctgccggccagagcggcacggcggatcgcggcgaccagcgcgtggtcgaacccgatgggggaggccgccaggagaccggccacccggaccggttccccgaggcggccaacgacagcgacaccggccgcggcgacatgtctgcaggttcggatcgggccgtgccggagcgcgcagcggatggttctgacggcgtagctgacccaggccgggaggcgcagcggctggccggcgctgacaacagtcacgctcgggaagtgcacggcgacagccgtgaaggcacggcgggggccggacgcggtgcgccggccctccatggagcgcgattcgagggcgccgatggtggcaggccagctgaagccggggtgccggcgtatgggcggcacgccgagatcggcggcccccgcattcccgaaccagccgcagtccgatccgcagtcccagagaccgcattttccggtggcgagccggcacggccggttgcaccggaaccgatcgcggcccggaccgcggagatcggccggtccgacctgtctaccccccgacctgccgatctcgcacccggcgaaaccacgagcccccgcacggaaggcccgacgccgcgaatcgccggtccggaccggccacccggcgaaccggcctcatcggcgccgggccgggatccgcgcggcgacacagccggcacgaaaccggacggcagcggcccggaacgaccggcgcgcgacaacggcaacagccgtaccgcgaccggcgatgaatcccgtgaccagggagaccggccgtcgcagcgagacgacggccacgatgatccccgtcggcgggcgtcggatccggacgggcggcgttggcgcgactacgcgcggcggatccaacgctggtcggagaaccgggccgctgaccaggcggcgatggaccgtgcgctgttccgccggttcaagccggagcaggacggcaccgcgcggctacggccggagacagtgcagcgggtcctggacaccccggccgaccggttggacggcaccgggcagcggttcaagcagatggtggaacagcatttcaccgatccggcgttcaaggacggccagccggtccggcgctctgcctcgcccgacgacatcgccgcccggctcggcgagctgcgcacttcccgtccgcccagcctgactggccggctgctgcacatcgacaaactgcgtgacgcgctgccggattggccgcgccggcttccggagctggatccgatccactccgagcatgtcatcggcggcgagtatcacggcttcggccggccggcggacaccgtgtcggtgggccgggagatccgtgaagcggtgccggaagtcctcgaccggctgttcaagaacgtcgacttccaccggcccgaagacggcggccctgacgtgctccggaccggcgacggccgtgacatcaaggtcgacttcggcgccgaatcgatggaccgcaagcacgtcggcacctccgagcgcgacagacgcggcggcatgtggcgggtccgggcgaactcggggaccaaacccgaacacatctccaccgtgaccagccacgaactcgccgagatcctgcagaaagagcgcttgcgagcggccggcgaacggtttccacccaagaagaacatgctcagccccaaggacaccggcgcgcgggaactgagcccggatgaccacggccggatcgccgagatgctcgactggcacgaacgctcgctgacgggagaagcaggagcgcgcgaccggctgggtgagctcctcgaccacctcggactgcgtggagacgagtcgcgcgctgttgcgagccgccaggctgtcaccgatcttctcggcgatccgtcggcgcaccatttcagcgatggtgccgcagcccggttcaacgacctgcttaacggtccggcacgcgatttgccgcccgcacccagtgtgcggactttcaccgaagctgatctgaagcttccgcctaccgacgttcctcgtccgccatggatggacgagtccaagaccatcctggtggaggcccaccagcagacgggccagtcgctgcgataccacgtcgtgggggacgccgcggataccttccgcactaccgacggcacactgcagaagtacgggcacggccgacccgagttcctcgacgacccgttccgtaaagcgaagggctgggacgtcaccgcggagaaggacaagttgccggaacttcgacatgatccggccgctgagcacaccgggcagatcgccggtgacagcaagcagtaccacgatctagcagatccactcgaccgtgcggctcgcgatcgtgcggcgaagatggacgatctgaatgccgtcctggaccgcattgaagcgcagaccgggcagccggccggcagcctgcgacacgtcaccgccgacgatctcggacgtagatcatttgccaagaccagatcgagcctggctccgctggccatcgagcatcccgagttgcgctcccgtatcgaggcgctgcaggatgcggtggacgactacgccgacctgcatcgcgaccgcgggatggcctccaaccgcgtcggtatgatcgccggccgcgagtatgccaagtcgctgggggtgccggagggcgacatccacggcgaggtccacgacgatccgaaatcaggggaactcgacgtctggggtgtggcccgcgacgaacacggcaacgccaccagactcgttgtcgtcgaagccaaaggtggcagtgccggcctcgacggccgggaacgcctccagcaaggcagcggaccctacctggaacgcgtcatgcagctggacaagaaattccagctgttcctccgcgcccattcggacatcgcggcgggacttcgttccggtgcgatccgcgtcgagtattacctggtcagtcagccgcacatgcccagccgcggcactgtcgtgccacccgccaaggtatcgcaattccggttccactaccgagacgtcgaccaggacttcggcgacgaccttaacgtgttcgacccgcgcaacatcgggccagaactgcccgaatga

SEQ ID NO: 5378 - DNA, 465 bp, Actinoplanes utahensis
atggcagcatggcaagccctcgatgaggagcaggtgctccgagcggcacaggaacttctgtctgcctccaggctactggcaactcctgcgcaggaggctgcggccgcgctcggctggacagtcaccgatttcacccgccgatcggggcttctcgactcgggatacggcctcgggccttacagcgcgtatttcgccatcgaccggcagggacgtcttgaggaggtgatcctcaatatctgtgaacgtatcccgggcagcagccctgagatcgacgccttcaaacaggacacttttgctgcggccgccagcgtcatgaccggtgtttatggcaagccgaccgatctgcagcccggcaaggaacccgagctgtggtgggatcagggcgaggtcacgctccgtctgattaccacccaggacaccgtcgccctgcagatcacccccaccgagctgctccaggaaatctga

SEQ ID NO: 5379 - DNA, 459 bp, Actinoplanes utahensis
atggcgggcgaggactgggaggcgtttcgcaacggactggcgcgcagcttggcggtcttgcccgacggtggtgcgttgatcgtccgcgatcaacaacgcaccgtgtgcttcgtgcaattcctgttcaactacgaccacatccgcgctgaagtagcaagcggctgggatctgacacatcaaccgaacctgacgccggaagagttcgcggcgatcgaacgcatcggctggttgtcaccggtacacgaccacactcttaaccatggcctcaacatcgcttggccggcaccgtcagcggagtatcgccgggtggccgatatatcggtggtcacgttgcgcgacgtttttctggtgccctcacccgctagcctttgctaccaatcgttcatctctccgggtaacaggccactattgatgcacagtctggggatcccgctgcaggaagggaaatcgggtcgctga

SEQ ID NO: 5380 - DNA, 486 bp, Actinoplanes utahensis
gtggctgactggcaggcactcgacgaagccgggatactgcagacggcgcagaggttgttgtctgccgagccgtggctgatgacgacctccctcacggacatggcggccaggttcggctggacggtgtcgaatttcaatcccgactatccgaccctgggcgcgttcatcgatgacggccgggggctaggcccggaaagcggcttcgtgcgcctcgacgagcagagccgggtgcagcacattttgctcagccttactgaatcggtggccgaggaaggccctgacgtcgatgcgttcctgcaggacgtattcgccgatgcgaccgcagccctgacgggcgagttcgggcgtcccacgccaaccgtgtacggcgaggaaccgcagctgtggtggcagcgcccggccacgatgttcgggctgctcaccgagatcgacgcggtcagcctgcagttgtcgccgaacgagctgatgggcggtgagtgggagtga

SEQ ID NO: 5381 - DNA, 453 bp, Actinoplanes utahensis
gtggattggccggcgtttcgcgatgctttggcacgtagcatcgcgaccttgcccaacggtgccgcgttgatcgtcagcgacgcggaacggacggtgtgctacgtccagttcctgctcgaccggaacaccgtcaccgccgaggtggccagcggcctggatcggtgggaccgcccgttcctcaccgaggaggagacggcgacagtggaacagatcggctggctgcccccggacaatccggtggtcaaccatggagtgaagctgacctggccgacccgttcagccgagtgccgccgggtggccgacatgtcggtggccgccctccgcgacgtcttcgagatcccgtcgcccgccaaccttcggtacaaggccttcaaggtcgcgggcggcgccggcgtgccgatgccgaagctcggcatccccgcccgcaaagaccaaccgccagcgacacggtga

SEQ ID NO: 5382 - DNA, 132 bp, Actinoplanes utahensis
gtgatccgtccgggcaagatcagctatctggtggtgcaagcctcggaaaccggcggtatcgaggttaccggctacctgactgatgaaaccgtgttggaccgggcgaccattcagatggccggatcgcagtga

SEQ ID NO: 5383 - DNA, 474 bp, Actinoplanes utahensis
gtgacctaccgggtgatcgacggccaggcgctgaaagacatgctggttgtcatccgcgagaccgactgggactggtcggccacggccacgcccggcctgcttgcgcagctaggctgggatgtcatcgaggaacttcctggcaaagggttggaagcagagacccatctgggagttgagcccagcaccgtggtgctgggattcgtcgacgggaaagtggacaccctgatggtgtcgctgaccgatctgcttcccgcgcaggaaactgccctgcggcaggatgcgttcgccggctgtgtctcgcaggccaccggcatcctcggcgcaccgacggatcgccgcccgggtgtatcgccttcggccagctggcgaggtccgatcgccaccgtcgaaatccgaaaggtcgacagcggcgtctacctgacctggacccataacgccttcgccgacctcgtacggtctgtcgaggaggactaa

SEQ ID NO: 5384 - DNA, 393 bp, Actinoplanes utahensis
gtggagacgaccgactggggcaccctcaccgatgagctcgtgcagcacatgttcgagatggctgaaggtgatgtgctgatcctcagctacggtgcgcactacgtgcagatgaagcagggaccgcggtggctgtccatcgaagcggtcgccaacgaattcttgcccgatgaagtcagattggacgaggcggggcagcgacggttgaccgaactcggctgggcagcccccgacccgcctgccagttacaactggcaccaggacaccgcattccctatccgctcggacgaagcacgccggctcgctacgatgatggccgtcacgctggatgaagtctttcgggtaacccatcccgccgaactgagccgcgacgaatttaacgtccgcaccgtttga

SEQ ID NO: 5385 - DNA, 318 bp, Actinoplanes utahensis
gtggtaaaggccaagggtggcatcgtcggcaccggcggccgcggccgcctgcagcagggcagcgcactgtacctggaactgaccatgcgactcgacgcgaagttccaggcgtttctccgggacaacccggtgatcgccgaaaatatccgcatcggtgtcattaaggtcgagtactacctggtgagccaaggttatgcggaggcgagcggtgtcccggacgccaaggtataccggttcatgttcgacggcgtcgacccgggcaatgtcttcgaacctggcaaccccgacgttccccgggcacggtcaatgcgtcggtag

SEQ ID NO: 5386 - DNA, 501 bp, Actinoplanes utahensis
atgacggaggtaggaatggttcagtggcgggaggttgacgaagccacggtgttgcgggtggcacagacgctgctgtcgttggaaccgctactgctatccgcttcggtccaggaggtggcggccaaggccggctggacggtgacccgtttcgacccggaacggccgaacaggagcgcgttcctggacaccggatacggcttcggttccagaagtgccttcttcaagactgacgccagcggcaaggtgacatccatcctggtgagcgtgaccgaggaagtggccgggggcggcatggcagccgacgagtacaagctggacgccttcgccgtcgcagcctccgcactgaccagtgctttcgggaaaccggaccgaccccggcccggcgaagaaccacagctgtggtggcaacgggacacgacgtggttcggtctgatcaccgaacacgacggcgtcagcctgcaactgacccccgccgaacggatggtgggtgagtggtcgtga

SEQ ID NO: 5387 - DNA, 462 bp, Actinoplanes utahensis
gtgaccggtctcgactggcagacgttccgggacggcctggtacgcagcatcgcgtctctgcccaacagtggtgcgctgatcgtcggtgacgaggaacgtacggagtgtttcgtgcagttcatgctcgactacgaccatgtcgtcgctgaggtagccagcggcatggacccgtgggaccggccgaaccttacggagcatgaggcggccgcgttggagaagctcggttggttaccgcccccggagctgcaggagcattgcaaccacggggtgaagatcgcctggccggcgccttcggcggagtaccggcgggttgctgacatgtccgtggctgccctgcgggacgtcttcgggattccttcaccggactcgctggtctacaaagcgttcgtcgtcagtgcaacaggcgaccccctgcaaatgccccgcctcggaatcccataccggcccgactggcgttcctga

SEQ ID NO: 5388 - DNA, 486 bp, Actinoplanes utahensis
atgtcgaaccagcagccgcccgccataaaccgggacttggtgacgaccctgaccgcggccgcgctggccgccgccgcaccggaagagctgacgatcctcaatgagatcgccgaggagtacttcgccgacccggacgcggtcctcaatcctcgccgacgggatgaagcagtaggcttcggcgtcgatctggcactacttgctccttatgctctggccatcgcgacacccgtggtgcacttcctcatcgagacggcctccagtgagatgcagaacgccgcgaggccgttggtcgcccagacggtgcgccgtctgttgcgccgttccgcaggcgaaatggacgcacccagcgcgacgcccttgaactctcaacaggcccgacgggtacgggagatcgcatacgaccgggcacggcagctcgacctaccggaagcccagtgtgtcgtgctggccgacgcgatcgccggtgccatcctggtgtccgcgtga

SEQ ID NO: 5389 - DNA, 2298 bp, Actinoplanes utahensis
gtgagcgatccagacgcgccctcgtcgaccggcgatagcccgacccggcccaacgggccccgtcccaacgtgctcgcctgcccttcgcccaccaccgcacgtttcatcctgctcgtggtggcgacgttggcgaccggcctattcgtcggggtgttcgtacacaacatggtgctcggcgaccggtggcaacgcgaggttgttgcttgcgcctccgggctgccctatgccgaggccgagggagccgatgtcctaaccacctggcaggcttgggccgaatgcacggccgacgccgagcatcgacgcgcgatcttcgccttcgccggcttggccgtcgccgcagtcgctgcctttgtaatcttcaaacgctctccccgccgcctggagcgccgccgccggctgcgcccggccgacgagaggttcgccgcggcgcggcaacgattcaccgagctgtcccacgccgctgggctgacccggccgccgacgctgatgatcggccccgcgacgcagcgggacgctttcagttacggacttcccggcagccagcgggtggttatgccggtggccgcgctcatccgaccccagtgtcccgagttcactgccctggcggcacatgaactcgcccatgtggcccgccgggacgtcaccgtggcgtgggctgccaagtcgatcggatacgccgttgccccgctgctactggtccccgctctccttgccgtattgacgggtgagctgtcgctactaaccgactacgtctggcgcgctgtcctgctgggtgcggtagttacgctcacccgtgcagcaattctgcggtcccgcgaacacgacgccgacctacttgccgcccgtatgggaagcagcgtccccgaactttcggccgtgctggcccagatgcccgacatgagaagccggcacctgcgccacctgatcgccaaccacccgtacgcccaccgccggatcgccgtgctcgacaacccggccagcatcgctcgggcaagcttcgtggacgccgcagcggccgccttcctcgccggtctgatgccttacctcatcgaccttgtcgtcgtcccgctcttgaccggcacagccggcgtcggcgttactgacctggtcgccgccgcggtaatgggaccgttggtcggcgcgacgatagggctcgcgtcctggcgtgcttgcctggtaagccgagtctccggtgctgctgtccatcggggaccggtggccgccggcgtccttgtcggctttctgctcggcgaagcggcatcgctcgcacagtacggtccgggcgggtaccacccacatcccagcccgctactcctgtccgtgacagcgctgtccgccgtgggggcgacggtggccacagttggcttgggagagctgtgggcggacgccgccggccggttacccagcgcccgcagtttttggctgaccgcggtcctggtgccgggcctactcttcacggcaacgctctgggcggcgatgaaggtgcaaaagagtcttgagtggggtggctggggcatggcgagcctcacgctgacagactattttgcacgccccaccatggtcgtagggacactggtactcgctctggccgctgcctggccgatatggttggcacggcgcgacacggtgaccccggcatggttgctggagtccggcacagggcgctcctggcccgctaccgaccgcccggccgcccgcttcaccgtcatagccgggttgctggctgggacctgtggcgcggccgtcatcgccgtgttccgggcgctggcgggcgcggccgcagacgacgctcaggcggcccaacgcctatacagctacgtctttctcgcgggcgccgtcgcagccgccgcgacgatcacagtggagtgcttctggccgggccggggtgccggagctgcgctgatctccgctccggtcgcagcggttactgcgatggctggcctcgtcgtgatcaacacacttctcggtggcaccttgacatggaccttcgcgtacgacatcggcagacaaccgatcggtcttgcactgttgagtcagacattcgcgctcagcatcgtggcgttcctgcccagaggacgccgcacttcgcgcagaatcgggctggccgccattgtcgtggtggccacactcgccattctcgcagcatcagctgtgattaccgcgcgcgacgtgctcgtaccgatagccgcgaaatctatcgcaagcggcgaaccccgccctttagacgaggacgtggcatgtgggtcgtgccgggtcatcggtccagtgaccggccacgccaatcggcagtactggtga

SEQ ID NO: 5390 - DNA, 1203 bp, Actinoplanes utahensis
ttgcccaaaagatcgagcaagctgactcgatcgggttctttccccgccctcgcacccacacaagccgccaagcctactaccgttgttcaggtggtgggccatcaacatgccgcagcaatcccgcagtggatctccccggaccggttcgagccatacctgcgccacgccggccacgaccgcgacaaagcgtgcgaactctacgaatgggccgcagagctcaactccgccgcgttccaggccatccactacgtcgaggtcatcctgcggaacgccatcgacctgcagctgcagaaacgccgcaatgaagatgccgccaagattccctggttcctgaccccgctaggcagcgacaacaaaagccagcaagagatcgactacgcggtagcgcaagtccgagaacgactccgcaaggtagacaagcgcaaagacacccgcgcccagatcgtcgccggcctgaccttcggattctgggccaacctgctgcagacccgccacgaagacctctggcgctcaacgatccgccacgccttcccgcgctcctccggcaaccgctccgacgtcgcacccatcgtgttcaagctgcgcaccttccgcaaccggctcgcccaccacgattccctgctcgccgtcgacgtgccgttccagatcaaccaaatgatcaccctgctcgattggatcgacgaagacgccgcccactggctgcgctccaccgaaaaggccaccgcggtgcacgcccaacgaccgttcgcccgcaacgacaccgtggtcgtcgccggcgccgacgcttggccgctctaccagaaagtccacgcctacgtctgccagcccggccgtgccttccaacctgtcgaacacctcgccttctatacggcccgagccatccagccagaaatccccgtcatccgcgagcgcatcgacaacgtcgactggaccaccgccgagagccgccgacggcgcgccaccggcgaccccaaagaccagcgcctcgccgacatcatcgaccaaagcatcgccgacggctggaccggcggccgataccaagtcttcctgctctccgcccccggcgacacaggccaccacacccgccgatcgaccatcccccacactgccccgcccggccgtgggcaggcctacacccaaggccagcgctacgcagtccggcaaaagctgatcagcgcccgcaccaccagcgacctcacctag

SEQ ID NO: 5391 - DNA, 738 bp, Actinoplanes utahensis
atgcctcgacggtcccctcggctgtggttgctcaccataaccaccgctgccgtttccctgctggccagccttccggctgccgtctccgtgcaggcagccgcagctaccgcgtacggccaggatgtctccgactatcaaggcaacgtcaactgggccgcacagtggaacgccggctcgcgctttgcctacatcaaggccagcgaaggcaactactacgccgcttcctacttcgccagccagtacaacggcgcctacaaccaaggcatgatccgcggcgcctaccacttcgccatcccgaacgcctccagcggcatcagccaggccgattacttcatcgcacacggcggcggctggtcaaaagacggccggaccctgcccggagcgctggacatcgaatacaacccatacggcgccacctgttacggcctgtcccaagccagcatgcgcacctggatcacgaagttcctgaaccgctaccacgatcggaccggccgctgggccgtcatctacaccaccaccgactggtggagcacctgcaccggcaactacaacgggttctgggcgaactcgccgctctggctcgcccattacgcgagcacaccgggaacgctgccggccggcgcatcgacgtggtcgttctggcagtactcggacagcggcccgttcgccggcgactcgaaccaatggaacggcagcctcgaccggctcagggccctcgcctgcaacggctcctgctga

SEQ ID NO: 5392 - DNA, 804 bp, Actinoplanes utahensis
atgggcactttcggcgccggtccgttctctagtgacggcgccatggatttcctcggcgagctcgccggccaccctccggccgagcggcaggccgtcctcagacgcaccttcttgctggtcaaggagaaccccgacctcctcgggagggagttcttcccggacgagatcgtcgcagttgcagccgtcgtcgcggctgctctgcccggcgggcagcagttcgacgaggagctcgctaggctcgaggaactcgacctcatccccaacatccgactgatttcgcccctgcaagacctggtcggccacacccgggaagctctgctctccgttgcagacccctggctgcagggatggacgaccgaattggccaacgccgaggcacgcgacaccttcgccaccctgtcccaggtgctcgcccatggttgcgacagcccggacgacctcgacctcatctgggaagaagccaacgactacggcatcgagggcggggtgcccgacggcaccccgcccggtatcgagcacctgactcacctgatgcgcgtctacaactcggcgatgggcggcggcctgtacttcgccctggaggccaacgagccgtcccgcgtcaggcgcgcgatcatcgccctgcgctacttcgggatggccgaggctgccaccttgctcgatgaggccctaaacagtgaatcccacgactcggtgccggccgacgtcgacttctacgccctcgtcgacggcggacctgatctgctgggcaaggcgttcagagcgaaggccgtcgaaaccccggacgacttcaaccgtggatag

SEQ ID NO: 5393 - DNA, 1032 bp, Actinoplanes utahensis
atgggagaagtcacccgccgcgcggtcctcgcatggcccgtcgccgcggcggcgaaattccgcaccaccggcgccccgcggcatcagcccggcatcgtcagcctgcccccgaacgccaccgtgctggccgcccttgacctacgcggtgccgggctcgacgtcgtgacgcgcctgttcgcgatgctggaccggggcattcgtgccctcggcgggcaggtggagacgacggtgagcgtcggcgcgtcgctgttcgacgccaggttcggcttggctacggcacgcccacccgagctcgtgccaatgcctgccttccgcaacgacctgcttgatccagcgcaatgccatggagatctgctgctgcaggtcggcgcggacctgcccggtacggcccagcgggctctgcggtcactactgacaccggatatccggctccggtggcggattaccggattccgggccgggaacggcaccgacgcgcacggccggccgaccagccgcaacctgttcggcttttcggagggtgcgggcaaccccgagggggacgatcggctctgggtgcggccggtcggtgccggagacgcgtgggcggccgggggtacatacctggtggtgcgcacaatccggctggcactcgcccggtggaactatgatccggtcagtcggcaggagttgatcatcgggcggcgtaagagcgacggcgcgccgctcggccggacaccgctcgacgcgcacgtccgccgggctgatccgggcactgccggacctcccggcggcggcatcctgcgccggggatactcgttccggcggggccttgaccccaccggccaacctgacgagggccatctcttcatctgttaccagaacagcatcgagcgcgggttcgccgccgtgcagcgccggctcgccggcgaaccactcgagcggtacgtgttgccagtcggcggcggctacttcttcgtactgccggccgcggatcgtctcggccagccgctgctggacgctggccggtcaggggcagacgcccgcccctga

SEQ ID NO: 5394 - DNA, 4056 bp, Actinoplanes utahensis
ttgcccacagccggcacctacacgatcgtcgtcgatcctcgcgaccagcacaccggcaccctgcaggtggcgctgacggcagcgtccggcggagcgcgtccggcggagcgcccccggctggccgcgccgaccacgtcgctgacgggcagggtagcccggctgaacggcgccggcctggccaaggtgacgctgcgggtcggtaatcgggccgcggtcgctgatccagccggaaacttcaccatcaccggcctgccgtccgggcggcataagctgcacatcgacggccacgccgccaaccgtgccggccgccggtacggcgtgttcgaagcgacggtggacctggtggcggacaccgccaacgtgctgccgttcaccgtctggatgcctgaactggacaccgcccacgaagtccgcgtcgcgtcgcccacgacccgcgaagtcgtactgaccaacccgaaggtgcctggcctggaggtgcacatcccggccggcaccgtgatccgggacgagaacggcgcggtggtacgccggctcggcatcaccgcgatcccgccccaccggccaccgttcccgctgccgcacctgggcgtccacgcgcccgtctacttcacggtgcagcccggtggggcctacctgtggccgcgcggcgcccgcatcatctaccccaaccacagccggctgccggcgcgccagaaagtcgagttctggagctatgaaccgggcggccgcggctggcacgtctacggccacggccaggtgtcaccggaccggcggcaggtggagcccgcgcccggcgtcggcgtgtacgagttcaccggcgccatgttcaacgccggcaacctgccgccggacgtcgggcccccgccgggtggctgcagccaggccggcgacccggtggactgcgccaccggcctcttcctgcactcagagaccgacctgcgcctcgacgacgtgctgccgatcggcctggaacgcacgtatcggcccggcgacccaaggtcccgggcgttcggcatcggcaccacgctgacctacgacatgttcctgtggtcggccgagcagtaccgccaggtcgacctggtgctgccagacggcggccgggtccactacgtgcgcacctcggcgggcacgggctggtccgacgccgtgttcgaacacaccggcagccccggcgagttctaccgttcgcggatcagttggggcgccgcgggcggctggctgctgacactgcgcgatggcacggtgctggagttcccgcagtaccggccgctggcggcggtacgcgaccggttcggcaaccggatcacgatcacccgggacggcgacggtcggatcacccaggtcacgtcgccgagcggccggtggatcagcttcgccgacgacaccaacggtcgaatcacgcaggcccgcgacaatctcggccgcaccgtccggtacgcgtacgacacggcgggacgcctgacacaggtgactgatccgaccggtgggatcaccgcctacacgtacgacagcgcccaccgcatgctatcggtcaccaccccggcgggcatcgtcaaggttcgcaacacctacgacagccacggccgggtcgccacccagaccctggccgacggcggaacctggcgatttgcgtacgagaccggggctggcggccggatcacccggactgtggccaccgaccctcgcggcgtgcagcggagcacgacgttcaacgcggccggttacgccaccgtggaaactcgtgctgcgggcacgccggtcggccgaagcgtgactctaagccgggatgccgccaaccgcgtcatcggcgtggtcgacccgttgaaccgacggactggctacacctacgacgaccgcggcaacctcacctcggtgacccggttggccggcacgtccgggcaggtgacctggcgcttctcctacgaaccccggttcgggcagatcacttccgtggtcgatccactcggccgggccaccgccttggcctacgacgaccgcggcgccctgagctcggtcacggacgcggccggcgaccggaccacgttccgctccgacgccgcgggccggccgaccgaggtcaccgacccggtgaacgccacgacgcgcctgacctaccgggcgggcctgctggcgaccgtcaccgacccgctcggccgtaccggcggccagtgggtggatccgggaggtcgccccgtcttcgttaccgacgccgtcggcgccgtgcagacccgcacctacgatccgctcgaccggatcgtgcaggtcaccgacgctcacggcggggtgagccggatggcctacgatcccggcggcaacctggtgtccctgaccggcccgcgcggcggcgtcacccggtggtcctacgacgccaagggacgggtggcgagccgcaccgacccgctggccaagaccgagcgctacacctacgaccgcggcgacaacctcaccggttacaccgaccggcgcggcgtcaccagcaccgtcaccttcgacgccctggaccggcccaccgccgtggcgcacggcggcagcggtgtcgacacctacgcctacgacgctggcgaccggctcctgcaagtcagcaccgccccggccaccgccgccggcgtcatcagccgtgcctacgacccgctcgaccggctggtcaccgagcagacaccacaggggcgcgtcgactacagctacgacagcgccgaccgtcgcaccggcatgacggtgcagggccagcccgccgtcggctacgcctacgacgccgccgaccggctgaccagcgtcacccgcggcggtgcggcggtgcggctgggctgggacaccgccggccgacgcacctcggtcagcctgccggacggggtcaccaccagttacgcgtacgacacgaccggtcaggcgaccgccgtcgactaccggcgcggcaccgccacgctcggcggcatcacctaccgctacgacacagcggggcgtcgccagggcgtcgacggcagcctgacccaggtcgacctaccacccgccgtcaccggcgccacctacgacgccgcagatcgtctcactcggtggggcaacgccgccctggcctacgacagcaacggcaacctcacctccgacggcacccgcaactaccgctggaacgaccgcgaccagctcacggccgtcggcaacgccgccttccgctatgaccagttcggtcggcgcaccagcgtcacggtcggcgccgtcaccagcaactacttgtacgacggaaaaaacgccgtccaggagcagaccactgcacgaccgaccgccacgctcctcggcggactcgacctggacgaccacttcggacgcatcgagggcaacaccgccacataccacctcaccgacgcgctcggcagcaccgtcgctctgaccgacgccaacggcatcgccacccgctacagctacgaaccgtacggtgccaccaccacgaccggcacgccgagcaccaaccgctaccagtacaccggccgggagaacgacggcaccggcctctactactaccgagcccggtactactcgcccgccatcggcagattcatcagcgaggacccggccggcacaggcgggagtctctacgcctacgcagctggagagcccatcagccgagcggacccgaccggcatggtgtggaaggaggtcgcgctcgtcagcggcgcggggttccgagtcatccgcgaggtggcgagggccgaggctatgcgcctctaccaagccggtctgcatgttgccaccaacagcgccaagggcgcgcgaaagctggccaaagacgttagtacggccgccggtggcggcggtcgggcatgccatcgcgaagcgcatggcaccggagccaatcactaccacggtctggatgagcgaggccgtcacctgcccggcggtcacgtcttctacgacacgtcactcaagggcatttttatgtcgatcgtagatgtcgatgggaacggctacctcgacgaacgcgactggaccgaactcctgaatcccttcccgttcctgatcatgccgccggcggcggacagtttcaactcgccgatggaggtgtag

SEQ ID NO: 5395 - DNA, 906 bp, Actinoplanes utahensis
atggttatctggggctttcgaggtaagcatggcttcggttcagcgttcatatatctgatcatcgttgcactgctggcaccgtctgccgtgattgtcgacgcgttaccggcgacggcccgcgctgtgggcagcggcgcggacttcgtctacgacgagctcggccgcctcgttaccgttgtcagaggcgccggtggcgccgacggcgtagcccgatacgagtacgacacggccggcaacatcaccgccgtccggcgggagaaccccaccacggccggggttatcgattttgacccgcgcctgggccgggccggcaccgacgtgaccatcctgggccgcggcttcgccgcgacggcggcacagaactcagtgcagttcggctccgctcccgccgccgtgttgtccgcctccacgacccggctggtagttcgggtgcccagcgacgggacgtcgggcccgatccgggtggccacgccgaccggtgcgtacaccagcgcccagccgttccggtttccaccgcctggaccagcggtcaccggcatcagtccagtgaccgtcgcggccggatcgaccgtgcggatcgagggtggcaacttctcaccccgcctcgcagagaacgcggtcgacttcaacggccagctcggcgaggtggtcgctgccacagcgagcacgctgactgttcgggcgccggcgggcgtcacctctgggccgatcggcgtgtctacccccttcgggcagacacgcagttcgggatacgcgtacgtgccgccgtcatcgttcggggtggctgacgtcgacttcaccacgtcgctggccacgggagccgccaccacggtccgggtgtcgaaaccagagaagatcgcgatggttgtcctcgccggctatgcgggtcagcgactagctagctag

SEQ ID NO: 5396 - DNA, 114 bp, Actinoplanes utahensis
gtgctggcggattgcggcggtgcggccgctggtggtcgggacgccaagttcggggatcagtggcgacggggtgcgcgcctggagcggttggccggcgcggcggccgggaaatag

SEQ ID NO: 5397 - DNA, 2757 bp, Actinoplanes utahensis
gtggtgcgggagcacggcgacgtccagccgggcgcgcaggcggccggtgacggcggtgtcacggtctcccatgctcagggtctgcaagtaggtgatcgcaacgtccagcacaaccatttccctgccgccgctgtgtcgccggtgtcggtgcggccggctgcggtgccggcgccggacgggttggtcaacgtggcggtggcgccgggtgtgttcgtcggccgtggcacgcagctccgccagctcgatgaggtgctggccgagccgggggccgcggtggttcaggctgtccacgggttgggtggggtcggtaagagcacactggcggcacagtgggcgtggcagcaccgtgaccggtaccggccggtgtggtggatcgacgcggacacgacagccggtatcgacgccgggttggccacgttggcgaccgctttgcagaccgacctgcccgatggcctatcgctggaggtgctgcgggaacgggcgctgcagtggctcgcctcgcacgacgggtggctgctggtcctggacaacgtcaacgacccgggcgatgtcgcccgcttgtcggctcgtgtcggcaccggccgggtgctggtcaccagccggcgggccaccggctgggcgggcattgccaccgcgatcgcgttggatgtgctcgacctcgatgacgctgtcgaggcgatgcggcaggtcttggccggcagtggccgtgaccgcgacgccgacgggctggtgcaagtggcccgggagctgggctgtctgccgctggcggtggaccaggccgcggcatacctcgccgaaacaggcctgtccagctccgcctaccttcagctgttgaagcaatatcccgccaacatgttcgcccacggcggtgaaggtgccggtgagcgcaccatcgcccgggtctggcgggtcaccctcgaccggctcgctgacacacctctggcgggcaagattctgcgggtcgtggcctggtacgccccagacgccatttatcgtgccctgcttgccggattggctgacccgccgacgatcgcccgggcgctcggccgactcgccgcctacagcatgatcactctcgacgagcacacgctgactgtgcatcggctggttcaggcggtcgctcgtactccggatcctgaggacccgcaccggcagcctgatgacatcgacaccgcccgtacccaggcgatcgctgagttgcgggcggctatgcccgatgactggcgcctgccgaagcattggcctcgctggcgtgcattggtgtcccaagtagaagccctcgccgagcacagcagcaatcgcatcgacaacgacaccgcggccagttcgctctacaaccaagcagcagtatttctccacgaccaaggcgtcgtagctcgaaccatcccgctgtttaagcaggcgctctcggatcggcgtcggttgctcagtgatgaccaccccgacactctgacctcggtgaacaacttagccagcgcctataaggcggcgggggacttaggccgcgctattccgctgtttaagcaggcgctctcggatcggcgtcggttgctcggtgacgaccacccaggcactctgaccttgatgctcaacctcgccggcgcctacgaacaggcgggtgatgtgggccgagctgtgccgctgcttgagcggacactcagcgcctacaagcggatactcggagatgatcacgcggacactctgaacgcgatgaatggtcttgcctcggcctgcgcctcaacgggtgatctgggccgggctgttccgttgttcgagcagtcgcttaccgactgccgtcgagtgctcggcgaggaccacccgcaaactctgattgtggcgagcaaccttgcctccgcctatacctcagcgggtgatgtaggcccggctgttccgtcctgcgagcagtcgctcaccgactgccgtcgtgtatttggcgacgatcacccgcaaactctaagcgcggtccgcagtctggcccatgcttacgaggttgcgggtgatgtagcccgagctattccgttgctcgagcagtcgctcaccgactaccgtcgaacactcggcgacgaccacccagataccttgagcgcggtgaatagccttgccttcgcctgggcttcggcgggtgatgtgggccgtgctgttccgttgttcgagcagtcgctcaccgactgccgtcgagtgctcggcgacgaccacccgcataccctgaccttgatgaacaaccttgccagcgcctacgagcatgccggtgatgtgggccgggctattcccttgttcgagcagtcgctgacgggacgtcgtcgagtgctcggcgaccgccatccggacacactggcatcgatgaacaaccttgccaacgcctacgagcaggccggtgatatgggtcgggctgttcctttgttcgaacaggcgttcacgggacgtcgtcgagtgctcggcgaccaccatcccgatactgtgctttcgttgaacaaccttgccaccgcgtactggacggtgggtgatgtggacaaggcggttccgttgctcgagcagtcgatcacctactgccgtcgggtctttggtgacgatgcccccggtaccgtgctctcattgaataatctcgcctttgcataccgagcgagaggcgacgtgagccgtgctgttcccttgttcgaacaggcgcttgctggctgccggcgcgtctttggcgacgatgatcctcgcaccaagctcgtggaggagagtctgacgctgctttgtggcagcaacgaatag

SEQ ID NO: 5398 - DNA, 309 bp, Actinoplanes utahensis
gtgaacatcatcgtcagtacggacgccggcactgtgtatctgaacgtggccggtgaactggacatggacacggctgacgacctgcataaacctctgcaccaagcggtcactcggcccggcaccaccacgatcgtgatcgacttcgcccaggtcagcttctgcgactcctccggtatcgcagtcctcgaccgcgcctacggtgaggcccgggatgcaggcatcaccctgcgactggtgaacccgcagccgacagtccgccgggtcctgagcctgctccgcatgttgcagaccctcaccggcgcggattga

SEQ ID NO: 5399 - DNA, 306 bp, Actinoplanes utahensis
atggccgtcatgcgccgtcgcgaccacctcaccggctacgagctgaccgtgctcggctcgctgacggaccccgttgaggcgctcagcgcaaagatcacctgcgaattggccgccggtcacgacgaacagcacacggcattcctcatcgccacccagcacggcgaccactggtggatccgctgggacgccggtcagcgcgcgctgaccctcgcggacttctgcgaccaccacaaccagcagagcgacgacgactgcctgcttcccaaagcgcaccccggccgatacagcttcgagttcgagtcgtag

SEQ ID NO: 5400 - DNA, 1398 bp, Actinoplanes utahensis
atgccgggcgggctcgatgtgagcaggtgttcgcggcacatcatgacgtgttcagcgatggggagtggcagcagctcgccaccctgctgggccggctgcacgccgtcgcgagcacagccgtgccgcaggcgggtgaccgggcagtcgatgccggcgcccgagcggcggtggcagcacagcatcgcgacggcgttgctggtccgcgtcggggtggcgatgttcctgccgatcagcatcgccacggtgtggctgctgatcgacccgcagggccggcaactgctgcagatcgacctgtcgcggcgcatgttgtacgtgatggcgctgctgctgacgctgctgttcgccgaggccgtcatcgacatgcggcgccggttcgcgcgggtgcgcaccctgctggcggcgatggagtcgctggccgccggtgacgtcgacgtgcgcgtcgacgaccggggccgtgacgagatcacgctggccgcggcgtgcgtcaaccggggcgcgaaaggcctcgccatgctgctgggccaggtggccgatcacgcccgggagttgcatgccgccagcgatgggctgtcggagcacgcgggggcggtgacccggcacaccgccgagaccgcgcagcaggcgatgctgctgtcgcagtccatcggcgaggtcaacaccaccctgcaccagctgcgcgacggcgccggcgaagtgcgttccagcatcgacgcgatcgccgcccgggccgccaccgccgggcaggccgccaccgacggagtgacggccgcggcgaccacccgcgacagcgtgacccggctggaaacctccagcacccagatcagcggcgtcgtcgcgttcatcaacagcgtcgccgcgcaaaccaacctgctggccctcaacgccaccatcgaagccgcccgcgccggcgacgcgggtaaggggttcgcggtggtggccggtgaggtgaagggcttggcgcagcagaccgagcaggccaccggcagcatcgacgcccaagtcgacgcgatccgcgaggacgccgcggccaccgtcaccgcgttgcagggcatcgccggtgccatcgcgcagatcaacaccgagcaggaatacatcggcgcggccgtcgacgcgcaacgggccagcaccaccgcgatgacccaacgcgtcaacgacaccgccgacaccgcgctcgcgctgaccgccaccatcaccgacctcgcgcacaccgccagccgatcgaccgaaggcacccgcgaagtcgccgacgagatcgccaccctggcctgcatcgccgccggcctcgaccagctcaccgcccgctacagcaccagtacgcctcgaacgcagcccgtcccggcggccccgcgcaccgcgcggcccgccccggtcgagcaagccgcgatcgaactgttctga

SEQ ID NO: 5401 - DNA, 264 bp, Actinoplanes utahensis
gtgcccaccgtccccggctacgacctcgaccagcccacccaggcgtccctgaccgccgccctcagcgcccaactcgggcccgaaaccgcccgcgcgctggtcgacctcaccgccaagaaactgcgcctgacccgatccggcaccaccgacgacctggtccgcctcaccgaggaactcatgaccatcggcgacgtcctgcgcgtaaccgcccgctccgagaaaatccgggccgtcacctaccgcgccctgcaccagaacgtctga

SEQ ID NO: 5402 - DNA, 513 bp, Actinoplanes utahensis
atgatcaacaaccagcagtccaccacactggccgcccctgaacgcatgcgcgtgctggccagcatcgacttcgacaacctcgacctacggacggcgctcaaccggatcaccgcgcgcaccgccgaacgcaccggcctgccgatcagcctggccaccctggtgttcaacacctcccagatgaccgtcggcgccaccggcctcgacgacacctggatcgccgccgcggacggcaccccggtggaatggtccttctgcgccaacatgatcaccaccggccggccgtacgtcatccccgatgcccaccactccgaacaagccaccaaccccctggtcaccatcgacggcatcggcagctacgccggtgtgcccctgaccgtcggcggccagatcgtcggcgcccactgcattctcggcacccaggctcaccagttcactcccgagcagctggcggaactggcctgcgctgcgcaggaaatcaccgcgctgctgcaggagttcagcgacctggactga

SEQ ID NO: 5403 - DNA, 567 bp, Actinoplanes utahensis
atgcaactcgtccacgccggcggctggcggctgctgcagatccccgacatcaccgacccgggcctgtgctaccggctgtgccgcgaccggatctgggccggcgactgccacaccaccgaactgcacgaccgcctggccttgctcggcctgagcctggacgacttcaccaccgccggcatcgactgctgcatcatggtcgaccccagctcccacatcgcctgcctgcgtcccgccgaacccgtcgacggacaagcccacctgcccttgtgcagcctgtgccggcacaacctgacccagatgcgcggcttcccccgccaccgcgacatccaccagccggcagccgccataccgcacctgagcaccctgtggcagcatctggacaccgaccacgatcggcgggaactgtcccaccacctgcgccatcccatcgccaagatcctcggctgggccgaagtcctgcacgacgacaccaccatgcgccccgcccaggcacaccagatcaacgtcatctaccaatcagcctgcgacctgcagcaactgctcgacaacgcagcctcaccgctctaa

SEQ ID NO: 5404 - DNA, 453 bp, Actinoplanes utahensis
ttgccatcgctgacgcctgctgcgccagcaccgccgcatcaccgacgttgctgcacttgttcgcactgtcgatcagttcgagagcgtcctgccgaatcttttccgcttcacgaagccgcataccccatcctcaaccaggcatcgatcactgcgcatcttcggtcatcatgtcgacgaagacctatcgcacgccgcaagacgttcaccgacggcgcctggttcgtcggggcgaccttcaccggcttcgcgtggttcgatgaggcgacgttcaccggtgatgccgagctcggcaaagcgatcttggaacccggcagcagcctgtccctggccggcgcgcgagtgatgcggcgcgcaaaccggaaggacacctggccatctggctggcgcatccaagacgaccccagtagcaattgtgaccttctggtgccggagggaccggctgcggccgcttga

SEQ ID NO: 5405 - DNA, 1056 bp, Actinoplanes utahensis
gtgccgacggcggcgaatgccggctactacgcgcggatcgtgcagcggcgggccgtgtcacggcgcttggtcgaagccgggatacggatcgcacagctcggctacggctcggccaacggtgacggcctcgaacttggcgccgttgttgatctggcgcagcaggccgtctacgacatcaccattgaccgcggcgccggagagacggcacaggtcggtgacgtgttccagccggtcatggatgacatcgagtcggcgggcagccgcgacgggtcgatgctgggagtcccgaccgggttcaaagacctcgaccggctactgaacggactgcaaccaggccaggtcatcatcgtggccggccgaccagggctcggtaaatccacggtcggcctcgacattgcccggcatgctgcgatccgggcagggatgccgtccgggtttttcaccttggagatgtcgaaggtggagatggtgacccggctactgtcggccgaagcgcgggtgcccctgcacgtgctgcggtccgggcagttgtccgacgatgactgggcgcggatggctcgctgcatgggtcagatcgccgacgcaccgatttttgtggatgacacgccgagcatgggcatgtcggagatccggtcgaaggcgcgcagcttgaagaagaagcacaacctgcggctactggtgatcgactacctgcagttgatgtcgtcgccgaagaagacggaaagccggcagcaggaagtttctgagctgtcccgcggcctgaagctgctgagcaaggagatcggctgcccgatcatcgtgatctctcagctgaaccgcggcccggagcagcggcaggacaaacgcccccaactgtccgacctgcgcgagtccgggtcgatcgagcaggacgccgatgtggtgatcctgctgcaccgcgacgactactacgacaaagagtccgcgcgggccggcgaggcggatttcatcgtggccaagcatcggaacgggccgacagacacgatcaccgtggcggcgcaactacacctgtcccggttcgtggacatggccctttaa

SEQ ID NO: 5406 - DNA, 216 bp, Actinoplanes utahensis
gtgagtgacagggtgcccccacacgacgttgaggcggagcaggccgttctgggcggcatgctgctgtcggctgcggcagtcgacgaagtcaccgagatcatcaccggtactgacttctaccggccggttcatcgcaccgtgttcgagacgatcctgacgctgcacggtaaaggggaaccggctgacgcgctcaccgtggccgccgcccctagctag

SEQ ID NO: 5407 - DNA, 636 bp, Actinoplanes utahensis
gtgaacgatggaacgacgagatggacatgggggacgcccagccgaggaacgcagctgcccacgaccttcaaggccgcggaagctccgaacttgctcgtcgcgcccccattccgcgctcccccgcagatcagcgggttgccgacaaccaagacctgtatcagaggtaccgcaagcttgaggaggctcagcatggataaggccgaggtggtgctgctgctgaccctggcagccaccttcgactaccggcgcatcggtgaggccgacgtcgaagcctggtacctggcgctcgacgacatcgacttggacgacgcgaaagccgcggtggtacggcattaccgggatcagaccgaccggttgatgcccgcgcacgtccgggccggcgtgaaggcgatccgtgcggagcggcgccgtttggagccgtcggaggcgctgcagttgccgtcgaagtttgaggacgacatgaaccggcaggtgcgtatgcaggccggcggggcgcatgtgcgggaggtgctggcggcggtcggccatcacctcgaagcgcagtcaccgccttcggtatcggccatggaccagttgagggcgctcactgcgggccctaactgggacgctgacgcctcggaggtgtccggtgagtga

SEQ ID NO: 5408 - DNA, 786 bp, Actinoplanes utahensis
atggcacgcatctccgtcggccgcgccgagctcgaaaaccggccccacatcctctaccggttctacgaccgcaccggcgtcctgctctacgtcggcatcaccgtcgacttcgccgaccgcatggcaacccacgccaaagaaaaagactggtgggtacgtgtcgaccgcagcgccacccaggtcgactactacgacagccggcgcgcagccctagacgccgagcgggaagcgatcaaagcagagaagccgctggaaaatgaccagcacaacgtcttcatggaagcttctgccgcaacactaggcagccagtcaccctgtggagatagatgcacgaccgcttgtcgtagccatcatgaagataagtggtggcaagggcgcgatgatcttgccgttatggtcatcgacgaggtacgaggagtcctgggcgaagaccagcgccttcttgatgcggcgaagttcgccgcagcgcatctggaacttccggtgccggagcggacttatccagacgacaacgctgtggtcctcactgcgctttcacttgtcgagcgggttgctgatgacactgcccggcttcgcttgattgcccggtacgtcttcgatgcagtacctgccggcatgctggcagccgcaaccgaagcggcggagcgcgactggtcctgcgcgggagaaccagaggcgccctgggaagacaaaatggtcgacgtacttcgacacctgagctacctactcgccaaatctttcaatcagccacggccgggccgtagccggaagcaggtacaggtctaa

SEQ ID NO: 5409 - DNA, 375 bp, Actinoplanes utahensis
gtgagcggcatcaacatcgacaacctgccgcccacccagcagctcatcctggatgtacttgccgcccgctaccggctcggcgagcaggtgtggccgctccacaccaccgtgcagaagccgctgcgcgagctcgccgatcgcggcctcgtcacactcctcaacggcatcgtcgagaaaagcatccgggcacggcttaccgacgccggccaggcgctcaccctccacgagcagtaccagccgccgaatggcgggatcggaaggtatcggcaagcactcgaagacatccgcgcgttcgccgtggcccggtcggagcggcccggcatggacggcattgcggaactcgcgggacaggccctcaaagtgggaccgcggtga

SEQ ID NO: 5410 - DNA, 237 bp, Actinoplanes utahensis
atgacgatccccggatacctcgacaaacacgaaggccgctggcggctcatctggcgcgacgacgacggtacccttcgccagttcaccgcccacaacatcgacgtcgtcacggcgtacgccaccaagcacggcatccgcgtgacaacaccgcggcccatcctgaccctgcagccacacgccgacgagcccgaccggatcatgccggacgggccactgaacatgaggttcagcgggtga

SEQ ID NO: 5411 - DNA, 216 bp, Actinoplanes utahensis
gtgaccgcgcccgccgcggcccggccgctcaccccacgccaacaagaaacgctgcgctacatcgccgccggccacaccaacaccgacacggcaaagctgatgggtgtcggcatcaccacgatcaaagccaacatcaaggcgatcctcgcacggctcggcgcccgcaacgccgccaacgccgtctacctagcgttcaagacgggggaactgacatga

SEQ ID NO: 5412 - DNA, 303 bp, Actinoplanes utahensis
atgaccatcttccccgactggcgtgcaatcggcgctgtcatgcactgggccagaaccgtcggagccgacgtcaaggtcaccaaataccggcagtacagccctgcatacatctgccaccagtggaccctgccgaccggggcgcgtatcaccgtcggctcgtacgcaggtagtaccaacccggacatgaccgtcgtcaacggcgccgcccgctacgacggcgaaccgacgtccgcagccgatgccctcaacactctcggcgttctcggtgtcattccggccgcgctgatggagctagcccagtga

SEQ ID NO: 5413 - DNA, 99 bp, Actinoplanes utahensis
atgatcacgtggatcgacactcttaccgaccggctgtgggccaacaagcccgatgccgaattccgagacctgttcacaccggtgacggtgactgcatga

SEQ ID NO: 5414 - DNA, 309 bp, Actinoplanes utahensis
atgaccgatcaggcccagccgatcgagcacattgaggacatccctccagaactacgcggtctgttcctcgaacacttgaaggcggctcggcacgtgcaggaagaggagatcaaggccctgcacgccaagcttcgtgaggctactcgccgcgggtacgacttggccctaaccaccctcaaagacgaaagcctgtacatgcagtggtggaactcgtcgcactgcagcccagacggcccggcccgtgagcactacctgcgctacctgaccgacactgcgcccggcggtgttttctgggaggtggcccgatga

SEQ ID NO: 5415 - DNA, 231 bp, Actinoplanes utahensis
atgctgaccgctcagaccctgcacgaaaccctcgtgcgcgccaccctggaccaggctgctgccggcggctgcaacaagtgcgtgcccaacgtgtgcagcgaccacttcacccccgggatcgaggaagccggctggagcgcggtcgctgagcgcatggaccggtgggccgcgagcggctacagcggcgactggcaggacgcggaatacgacgatccggaggcggcatcatga

SEQ ID NO: 5416 - DNA, 243 bp, Actinoplanes utahensis
gtgagctacgactctcgtgcatacgacaatgagcacggcgacccggtggtcgtcctggtcgccgaaggcacccacgacgtatcccggctgatcaacctgctgaccgtcggcaactgcgaacagatcagcctcggtcggaaggtcctgcagcaggtacgccgacacaatggcggccgggctgctctgcaactgctggccgcgcacggcggcccggactttctccacgacgatgaggtggcctga

SEQ ID NO: 5417 - DNA, 417 bp, Actinoplanes utahensis
atgaccccgatcgaccgcctgaaccgtgccaacgagctcgccgcgacgcccggcgagcacggcacccgcgaggagtggatccggcactacgccgcgcaggccatggccgcgtttgccggcttctacgacgtgacccacgagccgaggaccgggaacgaccgcccagagatcggctacctggcgctcatcggccaaacctcggtcgccgcggttctcggcctcgacgcgtcccctcgtgacctgccgtccttgctgtggcattacgacccggacggcgacgccctcaacggcgaaaggatcgaagaatacatcgtctccgttctcgaccgggcaggcattaacccggccgacctcaacgagcgatacgagaccagccacttccgcagccccagccgtgcggcggaggtagcccggtga

SEQ ID NO: 5418 - DNA, 486 bp, Actinoplanes utahensis
atgaccacgaagatcccgtcctttccggcctgcaccgtcgtcacctcgaacgggcccgtgactgtgccctgcgagccgatcagtgacgaccttgccatcacccccgttttcggcatgaccgaagacttccgcgcggtcctcggcggagacttcctcatcacccaccgggcaaccggactgcacgtttctgacgggccgggctgcatcgagtgctgccggtcggccgggaaggctctggtggcgactggggtcgactggtcggcgatcaccgctggaggtggggccgagttcatgcgagcactgccggacgagacccggcgggcggtagccgaggcgcgcaccgtgagctggtcctgcgacatcgagtactgcaatccgtggcccgaaggcgctactgccgagcgcgcccagtcaaagacgaaccacctgaggcagatcgtcgagcagaacgcgcgaattgtggcagctcaggaggccgggcgatga

SEQ ID NO: 5419 - DNA, 210 bp, Actinoplanes utahensis
atgaccgacttggacctcgatgcagtccgtgaccgcgtcgacaaggcccaccgctgggctgactggcagtcgctggccgtgcccgcagcggtacgcctccacttcaccgacgacgtgcccgccctgatcagctacatccagcatctcaccactgagcttgctgccacgcggcagatgctcgacgtcctcacccgggaggaaacccgatga

SEQ ID NO: 5420 - DNA, 246 bp, Actinoplanes utahensis
atgagcatctctgttcgctaccacgtcgacccccacgagccgctggccatctaccgcggtaacgagtggatcggctccatgttctccccgatcgacgccgcagccgcggtgatccacctcaaccgcggcctgcgcgagtgcctgtgcgagatggacgggcccgcctcacgcaacgaggactgcgacggccagtgctgcggcgtgggcatgtgctcttgctcggccactgcggaggttgaccgatga

SEQ ID NO: 5421 - DNA, 327 bp, Actinoplanes utahensis
gtgaccctcacccgtttccacaccaccgagccgttcgacggcggcgaaggcggcttcttccactggtgggtttctaacggccctcacatgctcgccttgaccgttattgagtccagcaccaaggcccgcttcaacgagatctacatgcaccagccgtccaacgacggtggctgccggttccacgacggctgcgagccgtccgccctgtcgaacccggtcatccgcgacaccctggaccggatcgtcgcggccggcaccaccgacgacgccgtgtatgccgagttggagcggctacacggcgagatcttcgcagaggtggcccgatga

SEQ ID NO: 5422 - DNA, 351 bp, Actinoplanes utahensis
atgggaagacgtcgagtacgacgaggccaagatccgctgggtgcaggttcaggccatggttgccggcctcaacgcggcaggtacggcgtgaccgctcagaccgatcacgatgacctggtcgctcagatcgtcaccgcatcgttcagcctgacccgcgacaccgccacccgcctgatcgactcgcttaccgagcagttggccgactcgcaggccgaggttgatgcgatccgccaccgggtgcaggccctgctcgatagcgactacacgccaaacgcagatgcaatcctgcgggcgttgtggcctgacgccagcacacgagatgcgttccgccgcgacaaggaggcccagtga

SEQ ID NO: 5423 - DNA, 360 bp, Actinoplanes utahensis
atgaatgctcctccgtctgcggtattggatgccacctcagtgtggcctacagttggtggcatgacaagtcagctttcagtgccacccggtgttggccaccttcgtgtctgccagtatttgtctgtgacggacaaacagcttgccgacgtactcgccgcttaccgccgcgccgagaaggcgctcgacacccgccgggatgagctgttcaaggccatcggtgaagccgtcaccaccggtcgcgtccgccagtctgacgtggtaaagcagatgggctacacccgcgagcacgtccgccgcatctgccgggcgtacgaagactggcgagacggcaagaccaccgaactgaagcttgcgcggtag

SEQ ID NO: 5424 - DNA, 357 bp, Actinoplanes utahensis
atggtccggctggctgacggcttcgagtgggcaacgacgggcgagcaccgggacgagtggtgtgtgcgccgcactgggttgccgcagatgttgtgcgggcggtcgttcaacggcacgggtcggcgtggaggttgggcgcccgcgcagcagccggccgcaaccccggaaggcgcccacccgttgtgcgtcgttctggccgaggcgcagcacggcctgtgcccggtgtgcggttgggacattgcgaccgaggacgggttgatcgtcgggcacggccggtggcaggtcacgcgggacggggtggagagcagcgacgagccgtgtgcgggtgccggtcaggtgccggaggtcggcgggtga

SEQ ID NO: 5425 - DNA, 243 bp, Actinoplanes utahensis
gtgagcgccaaggtggtgcctctgttgtctggcacgcagcagcggatcctcacgttcatccagtcctacgctgcagagaaacagttcccgcccaccatgaaggagatcggggccggtgtgcacctgtccccgtctgcggtcgcccaccagctgatccggttgcagggcgccgggtggattagccgggtgcctaatacgccgcgggcgatccgggtgctggacccggagacgggcggcgactga

SEQ ID NO: 5426 - DNA, 195 bp, Actinoplanes utahensis
atgactagagcgtcagagctggtgcaggcactcgccgaagcgatgcatgaggtgcagtgcctgcccggcaccaagggctaccacaagtactccgcaaatcatcgcgagccggagcagcggcgggccgccctgaacctcaacccgcttgctgcggccggtcacatcctgtcccccgtgcctgtggaggcgtcatga

SEQ ID NO: 5427 - DNA, 495 bp, Actinoplanes utahensis
atggccggagaaacagtgatcaccgttgttggcaacatcgtcgcggatccggagctgaggtacacgcagtccggtgccgcggtctgctcgttccgcattgcttctaccccacgcgtttttgacaagcagacgcaggactaccgcgacggtgagccactgtacctgtcctgcagcgtgtggcgggagcccgccgagcatgtcgccgagtcgctgcagcgcggcgcccgggtaatcgtgcagggccggctgaagcagcggtcatatgagaaggacggcgagaagcgcaccgtcgtcgagctggacgtggacgagatcgggccatcgctgaggtacgcgacggtgaaggtgcagaaggcgcagcggtccggtggtgacggcggactacggccgcagcaagcgcctcgcggtggcggtgatccgtgggcaacgcagggcgctcgatcggcagcaagctcaggcggtcagcgttcgttcgacgacgagccacctttttga

SEQ ID NO: 5428 - DNA, 621 bp, Actinoplanes utahensis
atgaccaaaactgagacccgcacgtggactctccggatcccggcgccggcaaagatgctatcggccaacgaccgtccccaccaccaggccgccagccggatccggaaggcgtggcgtgaggcaacgttcacgctggcgcggcaggcgaagcttccgaccgggctggagcgggtccggattgatgtgtgcctgcatcacacggtagctaggaaccgcgacgacgcgaactggcatccgtacgtactcaaaccgattgcggatgggctcggcccgacgaagacctctcggcagcgtaacggcgagatcagggtggatgtcgggtacgggctgatcccggacgacaacccggcgcacctggatgggccatttccagtgctgggcgaaaaggtgtcgcgcaaggagtacccgcttggcctggccgtggtcacgatcgtcgacctgaccgggcagccgacgggcggtttcgagaccgagcgccggctgatgtcggcgacgacggcatggacgttccggtgcccggctcggcatcagatcgtggtgacggttcgcaggctagaagactccggcccgtatcggaatttgttcatggagcagcatgccggctgcgaggcgcagccatga

SEQ ID NO: 5429 - DNA, 204 bp, Actinoplanes utahensis
atgctgcggccgtcgcaggctggcggctatccgatcggccggctggctcacatcagtcagccccgtgtgcatgcggcgctggaccggctgcaggcggcgggtgttgtggcgtccgagtgggagccgggcccagtctccgagttccggccgcggcggcgcctgtacaggatcgccggatcgcggctggtggaggtaggccggtga

SEQ ID NO: 5430 - DNA, 168 bp, Actinoplanes utahensis
gtgatggatctgatcgccgatgactacctgcagcatttcgaccgtgacccgtgggctgacgcccgggtgctgatcgccgggcagggcgacgtactgcgggcaccgtccgacaccgaccgacccgcttgggatcggtccgacgatgacgactactgggatgcgtcgtga

SEQ ID NO: 5431 - DNA, 381 bp, Actinoplanes utahensis
atgaattcctggaatcacgccgtatcggccgcccggaagtggggcggcgaacccgatcactacatcgccgtcgaggagtttctggactcctctaaagagatcttcggcgacgtacgtcatcgctccatgtaccaccacaccgcaggcgtttggctgtgccagcgcatcttcggccgcactatcaccgtgccgaaaatcaacgggcacggcagcgtcgacatccccgtccgtctgatcgcggaacggcacgtcatcgaagatctcggctggcttccctcccccgccgactacatcgccggcatgccgatcaagccgtggatgtcgggatcacagcgcaaagaacttcccctctctcacctactgcaaggagaacccgcatga

SEQ ID NO: 5432 - DNA, 465 bp, Actinoplanes utahensis
gtgagcactctgcgcgcgatcacacttcgagctccctggtctgaggctgtggcggtcggggcgaagctcgtcgagaaccgggccgtcaatatcaagtggcggggcgaaatcgccatccacgccggcatgcaggcggatccggctgccgacagtgactcccggatcatcggcctgctgggcgagaacgccagccacgccgcgacccgcggcgcgatcgttgctgtcgcccggctggtcggctgccatcaagcccgtcagccggacgacccgtcgctgacctgctgcggccggtggggcatgcgcctgtaccgcggtaaaccggcctggcacctcgttctagccgacgtgcgccggctgcccaagccggtgccgtgccgcggctatctgcacatcggctggtgggcgaaggacgccgttgaggcggaggtccgcgcccagcttgattcttccctctccgctgcctaa

SEQ ID NO: 5433 - DNA, 381 bp, Actinoplanes utahensis
gtgaccgacctagaaagcggcagtgccaccgaggagatttacaacccggtgacggtggaacaagccatccagaactgcgcggaccgcatcgcaaaaggtgtgcgaatcgtcgccagccggtacaagacctaccaggccgcgaaacggaccttggaccgcgctagagcgcaggcgttccttcactatcccggcacacaggccgagaagaagcatgcggcggagctggcgacaatcgaggaacgggatgcccgggactcggcgtacgaggagtacaagtacgcgcgtgagttggctgcggctcttgaggatgagctgcgtgctcttcagtcgatcaacaagtcggtaacgtcggcgtacaacgcggtcggggtgaaccggtga

SEQ ID NO: 5434 - DNA, 1173 bp, Actinoplanes utahensis
atggccataaagaccctgcagcagcgtctgacccaggtcggtgtgatccggctcggtcagaaggtaccgaccagcaacggcaacacccgaccgggaaagctggagacgctgcgcttcaccagcccctcacgtcccctcatcgatgctgtcgcaaagctgtacggcggcgaggtgaaggcgtggcaggccaacaccggcccgcagtgggaagtcatcaccggcgtcaaagagatcccggtactggtgccgccgcagcggatcgacccgaacatggagcactggggtaacggctaccgcgatcgcatgtgcgacggggaaaccgaaaccatccggcagcgtccgtgtctgtgcgcgcagatgcagcagggcggccggcgtatcgactcccgggagttgtgcaagccgacgacgcgcatgtcggtgatgctcgccgatgttccgtcactcggcacctggaagatcgaaagccacggctggaacgctgccgccgagctgccgaccctcgctgcgtcgatcgagtcggcgccgcagccgatcccggcccgcctcgaggtgcaggtacgggagaagaaggacttcgacccgtccaagccgcagggcaagcagatcgagtcgaaggtgttcatggtgccggtcctgcacttcgactggctgaccccggcacaggcgttcggcggcgagttgggtgcggcggcgcgggctgcgttgggtgcggcagccgtgcagcggcacgccatcgagtcggcgcaggccgagcgggcgcggccgaagttgactgccgaggacgttcagacgcttgccgacgaggcggagacggtcaagcaggtgcaggacttgtggcgggatgccgcgaaggacggcgtgctgaccgagaagctgcaggcggttctgaaagcgcgtgccgccgagctgacgccggcacccgcagccgagaaggacagccatacgtcccctggctcgcaggtggaagtggatgaggtggttgacgccgagttcgctgatgacgctgatgcagtgttcgtccagatccaatcggtggccggcgagttgcgctggagtgccgccgagttggaacagcgggtgcagcagttcttgaacaagtcatcggacgatgcggacgcattcgacctgacccgccttcttgaggcgatcaaggccggtgaggtgcggtga

SEQ ID NO: 5435 - DNA, 1068 bp, Actinoplanes utahensis
atgccgatcactgagggtgccgaacagacactaacggtccgcgagttcccgttccactcggtggaggaatcggacgacggccgctggtacatcatcgacgggcagcggctcatgtctgtcaccacagcgttcaacgcgatcgcgaaacgcggcctgatcccctgggccgccgggcttgccgcggagcaggcgtttgctgatctgccaacgttggtgtctgcctcgcggcgccggttgtgcgacaacacgtggtcgcggtgccgccacgaaccggctgagtcatgcgagaagtgcccgtgccgggtgtgccggctctgcgtgcagaagtggatcgccgaccgacacgtgcgggagaccgcccgccgcgccgatgagggcacccgtgttcatgacgttgcggagtggtggtcgttccacggaaccatccgcgaccacgacccggacatcgccccgtacgtgaagacgttccaggaattcgtcaccgattacggcgtcgtgcccgatgatgtgctgctcgctgaggcgctgctggtgcaccgggacatcggcgccgcaggcacgaccgacgggatcatccggttcagagccgagcgatccgaggctgcggcgaagctcatctcgcggatgctgacctatgcgggcacgccggtgaaatggcggcaggcgcagaagcagaaactcaccctggacctgctgatcgactacaaaacccgtgagggcgacgacccgcacatctacccggagtacgcgctgcaggaagccggctaccgccatttccccgtcgtccggatcaaaaactcggaccatgaggagccgctgcagcccaccgacggcggcgtcatcatccagctccggcccgacggatacacagtccgcccggtcgtctgtgaccgcaacacctatgagcaggggtttttacctgccctgaacttgtaccgctggctgaccgagtccggtcatgccgcggtgtccagccgcacctttgtcctcccggagacggtggccgcccgcgcccgcaaggccgcgcaggaacaggccatctcccccgccaccgcgtccgaagcctga

SEQ ID NO: 5436 - DNA, 378 bp, Actinoplanes utahensis
gtgagcggcccgatcccggtgcgggtgacccggtacaaggacccgcactgcgggcatacccactcgtcccggcagcgcgcggtcgagcacatggctcgctgctggtggaaccccgacgcccgtggctgcaagacgtgccggcacttcgttggcccgtggcagtccatgggcgaggaacgctgcgaggtgggcgtcaacctcggtgggcggcctgcgtgccgcggctgcggaggtcacggctggcgcgacaacagcgcgggtggcgaggtgaagcgcacctcggagacgacggtggggcacatcgacgacggctgcgagatcaagcccggcccggtcgttggctgcgagatgtgggaggccgcagatgccgatcactga

SEQ ID NO: 5437 - DNA, 531 bp, Actinoplanes utahensis
atgaccgccgctgccagcttcgaccgggcctactacgaggttcctcgtaccgctgcctgcccgttctgccggtcaccgcgcggctcggactgccgcagcatcggtggctacacggtcggcttccatgcagctcggatcaaggctgtcgcgcacctgaacaggcagcagcgggacgacgctgtccagaagcttcgggctgaggagaaggctcgacgcgacaagacggaagcgatcctggcgaaacccctgaccgcggatcagttggcgacccgtgcggctatcgacgcgggctttcagcagatcaaagaggcggctcgggcgcgggagaagcagatgtacgcgcgctgccgtgacccgtggctgcacaacgaggcctgcgagtgccggctgggccggccgtatgcgcatccggagccgaagccgcgtgtcatccgggacgtcaccgacctggccgaagtccgtgctcggctgagtgaggccggcgagcaggcgcttgctgacgcgctggccgaactggcaggtgcgcggtga

SEQ ID NO: 5438 - DNA, 462 bp, Actinoplanes utahensis
gtgaggcaacgactgtggcgacaggtcacttccgtgtctggttcgcaggatcccttgagtcatgacacaagtgtggctacagttgtggctacagcgcaaggcgtgagcccatccgaaccctcaccgaaggagccccctgtgcgcaccaagacccgtaccaccgtcaacctcaagcccggcatggtcatcaagaccgtcgcgtccgacagcaccgaaactctcctgcccgccacctaccgggtggtcgcgagtaacacgaagacgactccgtacgccgagcgctgcatcaagttcactgacggcacgcacatcatgaccgctctcacgtgggagtactcggtcgctcgcggcaaggccgcccgcaacgccgcgaagcagcgggccgcgctcattccgagcttcgcgctcgccgacgcgctgaacctgctcagcgcttacacggctggcgcggtgaccgcatga

SEQ ID NO: 5439 - DNA, 1740 bp, Actinoplanes utahensis
atgctgcgcctctacgacgagttcgccggcgtgggcggtactagccacggcgcatcctacgtgcccgggattgaggtgtatgcggcagcaaaccatgaccggcacgccgttgactcgcacaacctgaactttcccggtgctcggcatttccaggccgacatcacgaagctgccggtcgagaagatgccatacgcggagttgttttcggcgagcccggcttgcccggcctggacagatgcgaacggggtgaagcgggacttcgaccgggccaacgcagaagcgcagacactgtttgacctggccgaggcggaacctgatcccgcgctgaagaagcggctcgaggagtacaaacgctctcggctgctgatgaaggaaatcccccgttacctgcgcgccatgaacggccgcggaacaccagtgctggccgggatgatggaaaacgtcatccagtgccgcaagtggcatgagtgggatgccttcctccgcgagatccgcaacatcggccgcggctaccacctgtggtttttcgctctgaatgccatgcacatggagccagttcgttcgctgaagactccgcagtcccgcaaccggctgatcatcgcctacgtccacaagagcatcgggcggctgccggactgggacaagtggctgcgtccgcacgcccactgcccgtcgtgcgacatgagggttcaggcaatccaggtgttcaagaagcccggcgcggatatgggcgcctacggctcgcagtgggtgtatcagtgcccgagggtttcctgccggggtcgcgaggtgttcccagcgacgctggccgcgttggctgcgatcgacccgagcgttcctggcatccggatccgcgatcgggccgcgcatggtcttcccgacctgaaggacgccaccttggggcggttgcgggccggggtgcgccgatactgggcgccgctgatggttccgggcgagggccgcgacggcaaaacggccgcgccagcatcggccccgttgcggacgcagacgtgccgcaacgagaccgggtacgcgtacgcgccgttcctgtcgcctgctggcgatacctggcgtaacgctccttcatcggcactcgatccgatgccgaccaggacaacacgggaatgtgatggggtggcttcgttgccgcttccgccgttcatcaccccgctgcgcggcggaggcgacaaggagaacgcccggcgcatctccgagccgctatcgacggtcactgcctccggtaaccatcacggcttggcgttgcctccgctgatcacgcgccagaattcgggtcacgaagagtccgggaccacgccggccaccgaggcgatcaggatggtgacggcgagcggtaagcagtccgtagcgttcgcccggccactgctggtcccgtattacggggcgtcgacttcggcgttgccgtcgtcgcagccgatcggcacgctgactactaaggacaagtacgcgctggtcacctcggatgcggacaggattgctaatagtttcgacctggacgacgtgctgttccgcatgctggagccgcacgagatcgctcgcgctcagtcattcgcgccaacgtatcgaacctcgacaaccacgaagcggatcaacgttcgtcttttcgggaatgccgtacctgcttcgatcgccgaggtcgtcttctcggcgctgaccgaatgcattagcggcgaagagttggatcggttcatcgagccgcgggatctggcggtggcagcatga

SEQ ID NO: 5440 - DNA, 207 bp, Actinoplanes utahensis
atgaccactaccgcagatgcccgtgtcgccggctggatgcagctaacccgcgtgccgggcagcatccacaagttgcacacggctggctatgtggtcgaggtcggggacggaatccccacgtactgccacaccgaagacgaggcccgcgctttcctgcgtgcccttcgcctgcccgacgacgtgccggtgcagtcgccgccgtcctga

SEQ ID NO: 5441 - DNA, 561 bp, Actinoplanes utahensis
atgagcagcggtttcctttacgccatcaagttctccaacggcgtcatcaaagtcggctctacccggacgccgcaggcacgtttgcgcacccacgccggtgaagcggccggcttcggacaccaagtcctcgatcagtggttgtccgacgagcacgacggctatcagagcactgagcagaccctcatcgctcagatgacgtttctcgcctgccagcgtcatcggcgcgagtacttccagcacgtcaactgggaccaggtgttacgggtcgccaagacagtcgtggccaaccatgttgcgggccgttggacgacggtcccgctggaacacggccggttcaccatggccgacgttgcagccatgcatccccagttcgagcggagctacctgcatcagggctgcatctacgaccaattcgctcggtcgattgaccgccgggagttcgtcatgagccctgcccagatcaagaccttgctggacatgcatgccgacttgcctggcccctttaccggcacgcccagcgcttctctccgacaccgtatggaacggcgggccgccgcatga

SEQ ID NO: 5442 - DNA, 333 bp, Actinoplanes utahensis
atgttgcgtcactttcgcgtcggcccttgcgccacagctggcgcgaggcctacgctcgatgccatgagtgacgcagccaagcccactcggcgcgccgcaatcgacacaagccgagttgcggtcaacaaagacctgttcctcaacgccttcgccgacaaaggatgcgccaccggccaggagcgagccgacctgattggcacgtcccgccgtctcaccgagcgctacctggccggcgaagtagtccctaccctgcctaccgcccgccggatcgccaagcgtctcgggcgcaacatcgacgacctgtggccggacaatctggaggcagcggcatga

SEQ ID NO: 5443 - DNA, 429 bp, Actinoplanes utahensis
atgcgaaccgttctgaccgacacccgctatggttgcgccatgagcggcgcaactccggggccgaccttcggcaaactcctcacgcaaggacgcactgccaaaacctggtcacaggaccgcctagccgctgaaaccggcatcagccgaaccaccatcagccgctacgagcgagagatcaccagcacacccgaagccgaacacgtccgcgctctttgcgcagctctcgacatcgatccgcggcgggcagccgtgagccttggctacctcaccgcagatgagatccaacctgccgtaccggtgccggccaaacttaaagagatccttgatgtcctggaggaccccaatatcccggccgccgacaagcaaagctggattgactacctgctctacctcaaagcgaaggcacaggactcggccagcgcgagctag

SEQ ID NO: 5444 - DNA, 645 bp, Actinoplanes utahensis
atgacagagatcgactggtcagacgtccggccccgcatcgccgtcttggcgggactcgccggtgccgcggaggtcttcggcgcgatctcgcacggctggcggctagcacctgcgttgaccgccgatgaactcgccgagctggagggccagctgggtgtcgagcttccggttgattacggttcgttcctaaccgatgtgagccgcggcggcgccggcccggcatacggactcttccctgtgcgccgcgtagaaggacgttgggcatgggagggcgacggcgcctctctcaatgaccgcgagacactcacccgaccgttcggccacatccgagccttcaatcccgccgacgacttggacaacccgccgcagatcggacggaatgatgacgccttgtgggagctgcacgacgaggttctctccgatccggcccacgtgacaggcctgctctacctctgccacctcggctgcgccctacgtgaggctctggtggtaactggcccctctcgcggtcagatgtgggccgatgacacagcagatggagagggcttccgtccccttcacaacccggacagcagccgcatgaccttcgctgcctggtaccgcacctggctccgccagtcagaacggacatcgtctgaacgataa

SEQ ID NO: 5445 - DNA, 792 bp, Actinoplanes utahensis
atgttcagcgtggcgcagttcgaggccgtgatcgcagagatcaaccaagggaagcagacctacgacgccaagatcgcccaggtcatccccgcagccgatcacttggcaagccaatggtgggttgccgacgtcatcgccgaggcaatccactacctcgccaaggagaccgtagacctagccacggagatcgggaacttcatcctcgacctgctgaaaggctgcggcgctccgatcttcatgttccgcgactcatggacctggacggacatcaagagcggtttcagcgccgtctccacccagctgaccacccagaatctcgtcgtcgatgactcgaagtgggccggcgacgccaaggacgcctacctcaccgtcgccgaagcgcagtccgctgccgccggccgcctcagctcgatcgccggcaacaccagtaattccctgctggagtgcgccatcgccggctccgccttctacctcacggtggcggcagtcctcgcgaaattgatcgtcgcggcggccgcttcggtggccgcgttcagcagcgccatcttctcggagatcggcgccatgatcttcctggaagaaggcggcgtcaacatcaccgcgctcgccacagcggccggcctgctttccggtttccttggcgaccaggcccgagtcatgatctcgctgcacagcgactccagcgacccggccaacttcccgggcggcatgtggccacgaacgaacgccagcgcgttcagcgacgcgaccgtcaaggacggcgacgccgactggagtctgaagaaggactag

SEQ ID NO: 5446 - DNA, 315 bp, Actinoplanes utahensis
atgagccagcccacccccgacgaggtgcgagtggccaccgacgcgctgcgcacggagtccggcacctggaacaaccagagcgacaccacgaaggcgctgagcgccaagacggcaaccttggagttcggccggctagaggccgggctcttccagatgatggtcggtccgtacaacgacgtcatccacgccgtcacggcccgcgccaacgagggggtgacggcgatgaaggagatcgccgacacgctgcaccaggccgcggacacctacgaacaagaggaccgggccggggcccaccgcatcaagaacgtctactga

SEQ ID NO: 5447 - DNA, 723 bp, Actinoplanes utahensis
atggaaccggacatggcgcgccgccttcagcagctgcagcagcgggcgcagcagctcgggaaggtcgcgagcgacctggcggccgccgccccgcagcacgtggagggcagcgatgccaccggctgcgtcgtggcgacgctcggcccggacaacctgccggccgacttccgcatccaggaccggtggcatcagcgcctggaggctgagaagctcgcccctgctgtgctggccgcctacgccgacgcggtgaagacgaagcagcgccagtgggttggccgtctcgaccagtccggctggtgggcgcagcgccgcgacgctgaggcaggctggctagtgacggagcccgcgccggcgccgaaaggtggtcgtccgcagccggacgatcccgagttcgccgagcagatcatgaagaccttgcgcaacgcccgcgagcaggcttcccagcagccgccggcgtccgcgcagggcaccgacgcccagcgcaacgtcaccgtacgcctcggccagggtgggtttgtcggctgcgacatcgacacgcggtgggcgcgcagcagttcgggcaccgcgatcagcggcgctctgcggacggcgttgcagcaggccaagcgcgagctgaagccgtcctccacgaccttcggcgaggtcgatgcgttggtggctgatgccctggccaccttgtcagcccttacccggactcagcagcaccgaggtgatcaccgatga

SEQ ID NO: 5448 - DNA, 414 bp, Actinoplanes utahensis
gtggcaagggcgtcagcaagaacggcgaggaccagcgggttcgcgctgttcctcatggccatgatcacagcggcggaactgctggggaccgcatacgcagtgctcattggcctggaggaactcgtacaagcctcgccatacggccacaccggcaccgtcatcgtcaccctggccgccgccgtcatcgccgtggccgccgccgtcattgcgtggcgtggcatcggcggcaccacgcgaatcgtcgccgccaccctcacgttcctcgcggccgggctcgtcctcatgctcactatctcgctgctgacctcgtcgaagggtcacgcgatgggattctcgatcgttctggcgcccggcaccgtgttcctcttctggatcggccgagccgttctgcaggccccggcgggtggccggtga

SEQ ID NO: 5449 - DNA, 105 bp, Actinoplanes utahensis
gtggccgcctggctccagccgctcgcggacctctaccaggcgtgcggcgccaaccttgaggtggccaagcggcagcgggtctggcgggcaactcagccctggtga

SEQ ID NO: 5450 - DNA, 213 bp, Actinoplanes utahensis
gtgagccggccaccccgacctacctggtacacctggacggcgctgctcgcatcgtcgctggcgaccggcactgcggcggtcgcaatctcgctgcacgctcaggccgaatcgaaccgcaagctgtgcggcatcgtcagcacgcaagatgacgcctggtcggagacgacaccgaccacggttaccggtagccgcgtggccaaggcgatgcggtag

SEQ ID NO: 5451 - DNA, 1257 bp, Actinoplanes utahensis
gtgatcgatgccatccgtgacggcgacgtcgaggaggcccggcggttcctgacggtgatttcctcgggtgaccggtgggaggccgacattcgggcgttcggcgccgcagtgttgcgccatggcgggccgggtatggcggagatgcttttccaggacgaggtcctgccctcgggactgtgggacgatgtcgacccggtggtctgggccgccgatcacggcacgtgcggattcctggacaacctgctgcaccggcattctgtcgacgaaacgcagcttcggcgggcgctcgaggccgcgcggctgtggcttgaggccactcccgagctggagctgcgccgccgggcggggataggcgtgggcgagccggtcgtcatcgagcgggatcgggtggtcatcgacgacctgagcccgcggacaccgcggctccggctgtccgcgctcgacggccgtagagctgaggttttgctcgcccaccgtggcgtggtaaccacgttggaaacgacactaagcctgccggtgtctccggacgaactgctggcgcgggcgctgcggtcagccgatccggaagccccggactggtcgaacgtccgccgggccctgcagcaaaggttctcgatggcggacaacgtccggtggtcgatcgaccggctcggtgacccgcgggtggcggtgcggcgattcaccgccgagctgatgcaccatctgaccctcgacggtgacggaccggacgagccctacgccccgcaagcgctgaacgcacttcacgaccggatcaccgtcgaaccggagcccctagtactggactcgctgatgggcgcctacgcgggtttccggcatatcggcgacatcctcgtcgaactcctgcccttcgccggtcacccgcacccgggcgtgcgcacccgagtggccatggagctgctgaacggtacgggagggccggctgacgacccgccaccgcacgtgctcggggtcatgtttggactcacccgggacccgagcgcacaggtacgcggtgcggcgacggccgaactcgtctactcacgcatcgacacgcccgaattgcgcgaccacctcgccgctcttctcgccggctccgaccgccgcattcggatccaggccgcgaccgggctcgccatgcgaggcgacccggacgctctcgttcaactgcgcgatctcagtgccgaggacggttacgagtcgcacgcctggtacgacctcgacatggtcgagcgcatgctcggcttgagtggcttgtaa

SEQ ID NO: 5452 - DNA, 1443 bp, Actinoplanes utahensis
gtgatcgtggcagataggggctggggagccgatgtcctggcggctttccgggatgagttctaccgttgcttgactgccaggtcggacgcgctgttcgagctgtccgacgcggtgttgtgcgcggacgggccggtcaagacgttggtcgatctgacgttgacggccgagcaccggcgcggacacggcgcgttgtatgacgcgctcaaccacggccgcatcgatctgggacggctgcgacgggcgttgactgcgcagccgctgccacgcttcgccgacggtcggatcgtgctggcggtcgacgtgtcaccgtggctgcgatccgacgccgcgtgcagcccagagcggctgttctgccacgtgtacgggcgcgccaagagcgccgcgcagttcattcccggctggccgtactccttcgttgcggcgctggaacctggccggacgtcgtggacggcgatgctggacgtggtgcgtctcggccctgccgacgacgccaccgcggtcaccgcgacccagttgcgtggggtggttgaccggctgattgcctgcggccagcagcaggccggcgacccgcacatcctgatcgtctgcgatgccggctacgacgtgacgcggctggcctgggtcctgcgtgatctgccggtcgaggtggccgggcgtatccgcgccgaccgggtcctgcggctccctgccccgccgtatgagcacagcccgtccggcggtcgtccgcccaagcacggcggcgagttcgacctgaaagactccgccacctggcccgagccggccgcgaccacgatcaacgaaacgatcagctatggaaaagccgaagcccgggcctgggaccggttgcatccgcggctgacccaccgcgccgcctggctcgatcatcagggcacgctcccgatcgtcgagggcaccctcatccgactgcaggtcgagtacctgcccggtgaccgcgccgcgcaaccgatgtggctgtggtggtccggcaccggcgccgaccccggggatgtggaccggatctggcaggcctaccttcggcgcttcgatctggagcacacgttccggcttttcaagcagacgctcggctggaccaggccgaaaatacgcgacccgcgggcagccgaccggtggacgttgatcatgatcgccgcccacacccaactacgactggcccgacctatcgccatcgatctacgccggccctgggaacaaccggtcccgcccgaggcactcaccccagcccgggtccggcgagggtttcgaaacctccgcacgagatcggctctaccagccgcagcaccgaaacccacccgccccggccccggacgaccgcggggatcgaagaaccacagccgcgcggcccgctacgacgtgggcaaaaccgtcaaacgcgaaacctcgctgggtggcccgcctcgccgtaagcccaaggccagaggttaa

SEQ ID NO: 5453 - DNA, 381 bp, Actinoplanes utahensis
atgacgcgacgattcggtgaccgagccagattcgctgtcgaggtgggcgaggtctggccaccgccacccgccccggccaccggagagctacgcaccgtcgatctttgggccgccggcacgcggatgaccacagacgacaacacggtcttccttcccaccttcatcggtttcctccgatccacggcagccaaggtgcggcgccgtcaggtcagtccgtgcccgtttccggaacattcaccagaagaagttttccagctcctctacacggacgacgagaccgacttccgtgagcagttttggctgatgcactggggcgagaccgtcgacaacgtgacaagctacgcctacctggacgacgacgacctagtgatcgtcttctga

SEQ ID NO: 5454 - DNA, 1503 bp, Actinoplanes utahensis
atgctgcggcccgcggaaccgtgtccgctcctatcgatgctcgttgtggcggtcgtgacggacagggcgaaagcgatcgatgtattggcggagttccgtgaggagctctaccagtgcatgacccggcgggcggacgccttgttcgaattgaccgaggcgctgttgtgcaccgaagggccggtcaagaccttggtcgggttgtctctggcgccggagcaccggcgtggccacggcgccctgtatgacgcgctgaaccacggccgtatcgatgtcgaggtgctgcgccggcagctggccggcttgccgttgccgcgggcggcggacggccgcctggtcctcgcggtggacgtctcgccgtggctgcgcccggacggcaactgcagtccgcagcgctcgttctgccacacctacggacgcggcaaggacgaacaccggatgatcccgggctggcggtactcgatcatcgccgccctggagaccggccggacctcctggaccgccctgctcgacgccgtccggctactgcccggcgcggacgtcaccacggtcacctgtgcgcagatccgccagttcgtcgaccggctgaccgacgccggccagtggcaggccggcgaccccgacatcctgatcgtgctggatgcgggctacgaggccccgcgcatcgcctggctgctgcgcgacctgccggtggagatcctcggccggatgcgctccgaccgggtgctgcgccgagcgaccccggcccgcgtctataagccattgggtggtcggccgaccaggcacggcggcgagttcgtcttcggcaaccccgccacctgggatatcgagcacgcggtcacgcacaccgatacccggctctacggccaggtccgggcgcaagcctgggaccgactgcacccacgactgacccaccgcgcggcctggaccgaccatgacggcccgttgccaatcatcgaaggcacggtcatccggctcaccgtcgagcacctgcccagccgcggcgagccgaagccgctctggctgtggtggtccaagctcgacgccaccgccgccgatgtcgaccggtgctggcaggcgttcctgcgccgcttcgacatcgagcacaccttccgcctgctcaaacagaccctcggctggaccgccccgcaactccgcgagcccgccgccgcggaccggtggacgtggctggtgctggccgcacatactcagctgcgtctcgcccggcccctcgcacaagacctgcgccggccttgggaacgcccgatggcgccggagcggctcacgccagcccgggtgcggcgcgggtttcggaacctccgagcgaccaccccttcgccagcgcatgcgcctaaacccagccgcccaggccccggacagccgcccggctcccggaaccggcagcccgctgcccgtcacgacgtcggactcatcctggtcaccggccaggctcaccagcgaccggcccatcacaagaagggcaccaagccccgccgaactggttaa

SEQ ID NO: 5455 - DNA, 1566 bp, Actinoplanes utahensis
atgcccgcaaccagtcggatcccgcaccagcacacgccgcctcaccaccaggtggacagcccgccggtatctgatctgtacgcccgcaaaagcaccaaagatgccggccggtccgtggcccgccaggaacgcgcctggcgggccgactgcgctacggagggcctcacccccggccgggtgtttgtcgaccccgaactgtccgccagccggtatgccaagaaggcacgaccggactttgcagcactgctggaccacattaggcaggacggctgccaggtcatatcgctatgggagccatcccgcggctcccggcagatgggcgagtgggtcaacttcatcgacctgtgccgcctcaagggcatcctgatccgcatcttcggggatgatgacccgcaaacctacgatcctcgacggcagcgcgaccgggaccacctgttcaaggaaggcatggccgccgaaggcgagtcagagcgcctgagcacccggtcgcgggcggggattgctgatgccgccgtgaatggtcggccgcacggcaagatcccggacggctacaagcggatctacaccaccccggatgaagacgcggacggcagtttgttgaacgcgcgcaagcttcatgtcgagcaggtcatcgatgaggatcgggcggcgatctaccgggcagcggcggaaggcattctcaacggagtccccgtcaactacatcgcccgggtgctgactgcctggcaggtgccgaccccccgcggtgcgacccgctggtcaggtggcgccctgtacaacagtctgctgcggcccagcttggaaggccaccgcgaacttaacggcatcatcattactcgtgatgcgtggccgcccatcctggatgcagacacggttgcccgtcttcggcagttgcgggaagcgccgcgaacatcgcggagccacaatgacacccggttgaagtacatgctgtccgggctggtgcagtgcgggttgtgccgccggcctctgtcggggctgtacgacaggaagaccgcaggtactcggtatgaatgcatgatcactcgtggtggatgctgtcgggtcagcacggagatggagccggtggactcgctggtgtcggcgatggttacggaccggctgcgggagcctgatgcgcttgcggtgtttgagccgtctgcggatgcgaaccttcaggcgcaacaggcgcaggctgagctggatgcgttgatggatcgcaagaaggagttgtactcctcggctgcgcgccctggcgggccgagcatggcgttggtggcggctgcggagcaggagttgttgccgaggattgaggaggcgtcacggcggttgaaagcggtgaagacgccgccggcgttgcgtggctacgatccgatcgatctggccgataactggctgtcgtactcccctggtgaacgtcgcacagtggtgtcgttgttggcggaggtagtggtggcgccggtggggcgtggcggtaggtggtcgccgtggcggctggcggattctcgctggcggggtcagcatcggacatggggtgacctgtggcgcgaacagggtctagtgcggtga

SEQ ID NO: 5456 - DNA, 963 bp, Actinoplanes utahensis
atgcatgatgacgacgatccgcgggtacgccgtggcatggccaccttcttcggacagccgcgcccactggccaacctgttcggcgtggagctgtgggaacgcttctcgttctacggcatgcagggcatcctgctgatctacctgtactacgaggccgcggacggcgggctcggcatcgacaagagcacggccaccagcatcgtcggcgcgtacggcggggcggtctatctctccacggtgctcggtgcctgggtcgccgatcggctgctcggctcggaacgggtgcttttcctcagcgcgatcctggtcatgtgcgggcacatcgcgctggcgctgctgccgggcctggtcggcgtcggcgtcggactggtgctgatcgcggtcggcagcggcggggtcaaggcgaacgcgacctcgctggtcggcaccctctacgacgcgcacgacgagcggcgcgacgccggcttctcgctgttctacctggggatcaacctgggggcactggccggcccgctgctcaccgggctgctgcagaagaacctgggcttccactacgggttcggcctggcggcggtcggcatggcgatcggcctgacccagtacgcgctgggccgccgcaacctgccggacgccggccgcgcggtgccgaacccgctgccgccgggccgctggccggtcgtcgccgcggtggtgctggccggggtcgcggtcatcgtggtgtccgcgctgacctggctcaccgccgaccggttgtccaccgtcgtggtggtgctcagcatcctggccgcggccgcctacttcacggtgatcctcagcagccgccggctcgacgggcgggaacggcggaaggtctgggcgttcctgccgatgttcctggccagcgccgcgttctggtcgctctatcaacagcagttcacggttgacaacttccacaacactggtatgcctagtacggtgcggtaa

SEQ ID NO: 5457 - DNA, 147 bp, Actinoplanes utahensis
gtgtccattcagggagtcttctacctcatcgccgtcatcctcctggtggtggcggcgctgccgatcaccacccgtggattcaaccttgccctgctcggggcggctttcgcgctcctcggctactcctggaacacgatcaccggctga

SEQ ID NO: 5458 - DNA, 2160 bp, Actinoplanes utahensis
atgagctcccgcatccggcgatccgccctgttcggcgcggccgtgctgctggccaccccggccgccgcgcacgccgctccggccaccgccacgaccaccggcgtgctccagcagaccgtggccgacacgttcggcgccggcccggaccgcgtccggaccacggtccgcaccgacggcggcgccaccgtcgacgtgccgggcggtctggccgaggggatcaccccgggcgtcggggtcaccctgacccggcgggccgacggcaccgtcagcgggctggcacggcgtaccggcatcgccgccggcacctccccggtgtccggaactcatcacctggttttcgtcccggtccacgggtcggccggcaccgacccggcgaccctgccgaccgccgccgacttcaccacggtcaccgcgagcgtcgaccggtactacgacacggtgaccggcggcgcggtccggttcaccgtcgaccgggtcctcgccccgcagaagctcaccgccaccggctgtgacaccgccgccctggagaacgcggcccgcgacgcggccggcgcggtcacccaggaccggttccaccacctggtcgtctactacccctacgacgcgacctgcggcttcgccggcctcgcctacgtgggcgggcagttcgtctggctcaacgggtacaagaccacccaggtgctcggccacgaactcgggcacaacctgggactgtggcacagcgacggctaccactgctacgccgagccggcccggcagaccccggtgccgctctccgcgaactgcacggtcgagggctatgccgacccgtgggacatcatgggcagtcgggccaccggcgaactgaccgccgcccacctcgaccagctcggcctgctcggcgacggcggcacccagccggccgccgccggccgacgggtcgtgctcgcgccgctctccggcggaaccgggctgcggcagctcaccgtcaccgccggcacccgcacctactacctggagtaccgcgacggcggacggctcgaccagccgtacgcgcggtccggcaccggcctcgccgtccggttcaccgacaccacgctggacagcggctacgcccacgaccaccagctggtgagctaccacccggaggacggcacgatcaccctcaagccgggggagggctggaacgacccgggcggcgcgctcagcatccgcaccggggtggctaccgccgacggcctgccggtcaccgtcggcggggtcgccgacaccaccgcgccgaccgcgttcaccctcaccggcccggccgccggggcctcgctgaccagcaccaccagcacggtcacctggaccccggtcaccgacgacagcacggtcgcggcgatcaccgtcctcgtcgacggccgggtcgcggcgaccgcgtccggcaccgcgaccgcgaccccggtcgccgtcccggacgggcggcacaccctgcaggcggtggcaaccgacccgtacggcaacgccagccgcaccccggcgatcacggtgaccgtggacggcaccgccccggccggcaccccggcaccggccgcgatcccgcgggtcggcgcggaggtcaccaccggcggcatcccggtgcgggtcgcctgggggctgaccgacgccaacggggtggcgcggcagcggatcgcgcaggacggggcgacgtacagcaccctgggcacctcggtgcggcagatcgacgcgacggcgaagccgggcgtcaagacccggtggcagctggcggtcgccgaccggatcgggcacaccgggacggtgtccggggcgtggacgacggccagcctgaacaccaggggcggcacgttcagtggtgcgtggcggaccgtcagcggcaggtcgctgctcggcggcagcgagcagacgagcacggcgaagggggcggccgtgtcgtacacgttcaccggtcgggcggtcgggctgatcggcacccgggacagcgggagcggggcggtggacgtctacgtggacggggcgaagttcgggtcgatcacgctgtacaacggggtggtcagcagccggcggctcgtttacacgctggtgtggtcgggggcggggaagcacaccgtcacgttcgtgaaccaggcgacggcgaagcatccgaagatgagcgtggacgggatcgtgagtttgtcctga

SEQ ID NO: 5459 - DNA, 1311 bp, Actinoplanes utahensis
gtgaacgacagccggtgcgcggaggaaacgaccggctgcggctgttcagtcacggtccggacgagccgatgccttcgccgaatgggtgctcgacgacaccgaggcgttggccgaccaaccggtgcgcggctggtcctgtgtcgggctgctcatgttccacgacacgacgaccggcatcgagccgcacgacgtggcggcgctggcggccggggcgcatgggatcagccggaccaccggggcggttctcgggcagggcggcttcaccgatgtgacgatgcaccaccagaacgatcacctgacggtgtacgggatcggggagccggcgccgctggtggtgatcggcgagggcggcctgaacatcgcccggttgcacctggaggcgcggccggtcacgaatcggctgtccgagattctgcagatttgcccggcacaccacaggtgacatcgacttgcgccatcatggtgaccgtgattcatcaggcggcggtgaacataccggatctcgatgacgggttccggctcaaggcccgcaccatgctcacggtggcgatcccgatgatgtacgagcagttcaccgcgcatctcgacgtggcctcgatgcgggccgacgggttcggttcggtgatcacgtatgccgggttccgccgattcccggtgccgctgccggtcagcgccacgctgtccgtggacgtgctgacccggcaggtggagctgtccggcagggggctggggcaacggtccagccggctgggcttcgagtgcgaatacacgttccgctgccggccgggcaccggcgacccgtcccgctatcgggagtcaatttcggacaccgaggtggtatgtgggcaggtgcggctgctgctcacgacgatccgccgggacggtgcgccgggcagccgcgtggtcggtgcgccgctgccgcagacccggcacatggacgtgcacgtcctgccggatccgcacccgtcggtggcggacctggcgccggtcgacggtgagatgatcgccgagggcgagcggagcggggtgttcggccgccagcacaccgacaccggtcagatcgtcttcaccggtgagtacctggcactgctggaggatcacctgtccgggctggccgccgatgccgggctgccgatctccgcgggtgacgccgggcggatcgcggtcgtcttccgggaggcgttccgggccggtgaccggttcacgctgcgcgggcagctgtggcgcgacggcgaccggcacaccgcgctgatcggcattcacgcggcaggcgccgagcgcccgcacatcttcggccgcctccacacctaa

SEQ ID NO: 5460 - DNA, 2274 bp, Actinoplanes utahensis
atgcaacacgattgctcaaccaacgcgacgaacctcaacgccaatcaggcttgccgaacagcttccctacaacgcctgaccatagtcacaagaccacctgcggaaagacaagttggcgtaagtccactagtaaaaacaataaagtccgaccatgatacggggcaggacgatcgacagcaccggattcaacaagacatcaggctccccgagggaaagcttcaggccccggctgcaacagttcatgtcgcagcccgaccgggaacattcattcagctcagagaacggtcgatcagcgacgtctttcccggttgccgacgcggcgacagaaaaggcgggcaaacaatgactgccggtggcgcatgggcaccgctggaagtatatcggaccgctgacgatctggtgcgacgccgcaataagctgatcaaggaagtcgaggattgctacaagagagcccacccgaacggctcgggcccctcgagaagcgaagtccagtcctggcgcgagagcctctacgaagtcgccaccacccttgtcgattcgggcctggggcaggtctggatgttcatcgagtaccgcgtcgccccggacatgaatcccatcgatgttgttcttgccggaagtcacccggtggacggcctgagctatgccgccctggaattgaaacaatggggttccgtcgaacgacccactctgtcacatccggccggcctctgcgcctcctgcaaggcggccggaaatactgcgctttgtgagcggtgcgccgtcgagtgcgtctacgcccctttttacagtaaacacaaaaagcatcccgcgattcaggtgcgcgacaatctgatcgcactgaaaaagtatcacagcatgttcgacgatcgctacgtcaaccttgtcggagcggcctacctgcacaacctcaaggacgaacaacaccaatggataagtaacgtcgccccgtgcggcgacatcccgaccttcacagcccggcaacccgactccctccgagagttccttaccagaaacttcggatccggagccggcaccagggccgcgcaatcactgcttgaacgccgccgcacgaatcttccgatcaccagcgagctgggcgccgtggtggacgggcacacgcggttcagcctgatcgagaatcaactgcacgccgtaacgagcgtgatggactcgctgcgcgcgacgacatcgtccggcgcaaagaaggtgtttgtcgtaagcggtcgcgcagggaccgggaaatcactgatcgcgctcactctgctcggaaaggcgatcgagaaccagtacaaggttcgctacgtctccggaggaatcgcgtcacgcgagactttcaaacgcgcctcaatcggccaccgcccggctttcaccaccttgaacaatgtcgccgacaacattggcgtgaacgagcaggatctgatcctttgcgatgaggcgcaccggcttaccaggcaaccgatgagagggtcctactcggtacgccccggcgaaacgtctgtcgccgtggtcgtcacacgcgccaaggtgcccgtcttcttcatcgacggtgaccagcgcctgttcgctgacgaagtctggagcccggaagccctcaaacgagaaatccagcgcttgggtgccgaagtcgtaccgatcgccttggacaggccgttgcgcgcggtgggcagcgcgacgtacgacacgtggatccaacggctcttgaccggtgatcccgtcccatggaacgccgacgctgactctgaccccgagcccttcgaactttattacgccaccagcgcagcgcggatggagtcctttctgcatagcaaggaagcctcgggtgccagtgccaggatcagcgccggcatgtgttggaactggaccgacgacaccggaacgttcccggatgtcgcccctgacgccggctgggcccgcccctggaacgcaggcgacaaccacaagacacccggcgtgccgaaacggcgattctgggcgaccgagcctgggggcttcgggcagatcgggtgtgtacacaccgcgcaaggtctggagtacgagtggggcggagtgatcatgggaccggacctgaccaccgacggccgcaggtggcgggtccaccgcgagcatgtgctcagcaaggcgaacagaatcggtgacgacgaggagctgctacgggcgatctgcaacgcctacggcgtcctcatgactcgttcgatccgcggcaccgtgctgtattcggtcgacccggccacccgacaactcttcgctgatctgggcctcagccggatttga

SEQ ID NO: 5461 - DNA, 1710 bp, Actinoplanes utahensis
atggacgaagacctcgcgaacagcaccgacggaggcttcgccggcctgggactgcgccccgagctgctgcgtgcgctcaccgacctcggctatgaggagcccaccccgattcagcgggaggcgatcaccccgctggtcgccggccacgacctggtcggccaggccgcgaccggtaccggcaagaccgccgctttcgctctgccgctgctgcagagcctcacccccggttcggccgacactcccaccgcgctggtcctggtccccacccgggagctggccgagcaggtctcccaggcggtgcaccggtacggccgtgatctgaacgtgcgggtgctgccggtctacggcggccagccgatcagccgccagctgcaggtgttgcgccgcggcgtcgacgtggtcgtcggcaccccgggccgcgtcctcgaccacatcgagcgggagacgctgcggctcgacgcgatccgcaccgtcgtcctggacgaggccgacgagatgctcgacatgggtttcgccgaggacatcgaggccattctggccgagaccccggcggagcggcagaccgtcctgttctccgccacgatgccgccgcgcatcgacgccatcgcccgccggcacctgcgtgacccgctgcgcatccggatgggccgcgacaccgcggccgccgacgcgctgccctcggtccgccagagcacgtacatggtcgcccgcccgcacaaggccgccgccctgggccgcattctggacgtcgagatgccgggcgccgccatcgtcttctgccgcacccgcgaggaggtggaggaggtcaccgagtcgctgaacggccggggctaccgcgcggaagccctgcacggcggcctcagccaggatcagcgtgaccgggtgatgagccgcctgcgggccggcaccaccgagctgctggtcgccaccgacgtcgccgcccggggcttggacgtcgacctgctcacccacgtcatcaacttcacggtgccgtcggcccccgaggcgtacgtccaccgcatcggccgcgtcggccgggccggccgcaccggcgccgccatcaccctggccgagccgcgcgagcagcgcctcctgaaagccatcgagcgtctgacgggccagcgcatcgtcgtcgagaagctcccctcggtgacggacctgcgggcccgccgcctggaactggtccgctccaccgtccaggaggccatggacgccgacgacctggaccgtttccgctcggttctggcctcgctcaccgcggacgccgacctggagacggtcgccctggccggcctcagactgctccacgaggccaacggcggcgacgtcgacgagccggagatcccgtcgctgtccccgggccgcgatccggaccgccgcccccgcgacacggaccgctcccgcgactccgaccgccacccccgcgacgaccgctacaccgaccgccgttccgcccgcaaccgcggctccttcacccagatcttcgtcggcctcggccgccgggccggcctacgcccccaggacctggtcggcgccatcgccggcgaggccggcctcccggcccgcgacgtcggctccatccagatcaccgaccgtttcgccctggtcgaggtccccgaaaccgacgccgaccgcgtcatccgagccctctcccacagcaccatccgaggccgccgcccgaccgtccgccgagaccgcccccaccgctga

SEQ ID NO: 5462 - DNA, 459 bp, Actinoplanes utahensis
atggctaccgaatacatcgtgcagagcgacgccgacgtccgttccgacgaactgaccgggttcttcgagtcgacactcggcgagctcgccacggaccggacgatcgtccttcccggcctgttcgtgacgccggaccggccgccggaggacgagcgcgacgagacaacgcgccgcctgggtttcgatcaccgggtgaccgccacgttccggttccacaatctggccgatccgcagacccgtgatcacaatgtcgccgtcatggtcggcgctgtcctggcgttctacgaccgtttcgggggaagcggcgcgctgttctacaacgacgacgtgctgaccgtccaatggacgccgcgggagatcgtcgtcaaccgggactggacggagttcttcgagatcgatgcggtcgtcgcggtgatcggtgaccgcccggtccgccacctggggcagcccctgctgtga

SEQ ID NO: 5463 - DNA, 684 bp, Actinoplanes utahensis
atgggcggcgcggatcgtggggtacacgacggcgttgacgaccagcctgaccaacctgtcgcatctgatcgacggctgagcgggatgcctcacccgaaggaccacgacggcccggggcccggccaccgcccgcaccaccaggggaccgggtccgcccgcagcatcggcggcggccacgcggacgccacccggatcgccggtctggggcgcacgcacgggccggtcccgcccttcaccgccgggccgccgctgacccgcccttcacggacgcccgaccctggtctgcgccccaccggcaaccgcaccggcgcgcatccgttccgcccggaggatctggggcggcgccgcgaggacgaggccgccgccaccctggcgcggaacggttaccaggtcgaacagaacccgcctaccagagcgaacggaaggaatcccgactaccgcgtcgagggtgaatacgtcgattgttacgccccgaagagcgacaatcccgaaaaggtccgcaacagcctcagcaagaaattgcgtgacggacaggccaagcgcttcgtcctcaagatggaggacacgtcgtgctcgctggaggagatagccgcggtgttgcgccggaagccgatccgcggcctggaggagataatcgtggtgagggacgacaagatcatgcccttctacccctttggtgagtga

SEQ ID NO: 5464 - DNA, 702 bp, Actinoplanes utahensis
gtgaccagcccctccctcgtcgccgtggcggactccggcggcgatgccgccctcgacgccaccatggtcggcgacctcgacggactcatcgccaccatccgcggtggcgactggatcgacacgctcctggccggcgccaccaccggagtcgacgtggcgtccaccgcgatcgacccgtgcggcgccctgctcgccaacggcctcggctgggcgatggaatacttccagcccctgcgccacatgctggacatgctcaccggcgcgcccggccgggtcgccgcccacgccgccacctggcagcacatcgccgccgacctggacggcaccgcggccgacctgaagcggtccctgcacggcgacctgcccgactggcagggcgccgcggccggggcgtacgccgcgatgatgtcccacaatgtcgccgcactctccacgctgagcgggacggcggccgcgatgtccgccgcgaccgaggccgccggaaacctggtggccttcacccgggacctggtgcgcgggctgatcgccgacctggtgtcacggttggcggtgtgggcggccgaagccctcgcggtggtgaccattccggtggtggcgacgcagatcgtggccgcggtggcgacatgggcggcgcggatcgtggggtacacgacggcgttgacgaccagcctgaccaacctgtcgcatctgatcgacggctga

SEQ ID NO: 5465 - DNA, 324 bp, Actinoplanes utahensis
atgaccgccgggccggacggcctgctcgtcgacgccggccagctgcgccggcacgccgcgaatctgcgggcgctgcacgaccggttcgccgccgtgcgcgccgcgagtgggttcatcacccacgatccgcacgcgtacgggctgctgtgcagctggctgccggcgctgctcgcggcccgccaccggcgccaggacgagctggtggcgtacgtcgcggagaacctcgacatcctcgccgggcacctgcacgcggcagccaccgactacgaggccagcgacgaccggtcggccgcgacgatccgtaccgccggccgcttgatctga

SEQ ID NO: 5466 - DNA, 390 bp, Actinoplanes utahensis
atggcttcgaacacggaacccctgctggaccccgacgcggcgctcgatcaggtgcgcgcctggcagggcgagatcgaccggatgctcgcccgcaccaggacgatgagcctccggatgcgcgagctgcgggtcaccgcgagcgacccccgccacctggtcgaggtcaccatcaactcgtccggtgcgctgctcgacatccgcttcggcccgcgcctgccgcagtacgaccccgtccacgtggcgcgcatcgtgatggcgaccgtgcagaccgcgcggcggcaggcgctccggctcacccgggaaatcatcgacgagaccgtcggacccgactcgaccgccgcccgcgagatgatcatcagcacggcggagagcctgggcgagccggcatga

SEQ ID NO: 5467 - DNA, 2238 bp, Actinoplanes utahensis
atgggttcggcgcacgacgaggacgagcgggggcagtacccggggccgtgggacacgccgccgcgcagaaatgcgggagctccgccgccgtcgacttcgccttcgcgttcgccttcgcctgagccggatccgccgcccgtgcccgatcctccgcggcgatccagtccctgggcctcgcccgcgcccccgcggaaaccgcccaccgtcacgcccccgccgcccgacccgcagatcttcgtgccgccgccggccaccactccggttcccacccggtccgttccggccgccccgccgcccgctttcgccccgccgaccttcattccaccggcccgtgtcgagccgccgcgcatcgggccggagccgcgccatccgacccctctgcaggcgccaccccgcgctcccgaaccggtcgctcccgcgcccttcgtgccgcaccagcgcaccgctgcgccggcgcacctgccggcccctcccccgccggtcgcacccgccgttgcggcgccctcccggcccccgtcccgcttgcactccctgctgatcttcctggccctgctgatcgccgcgaccgccgccggcggactccttttcctgcgcaaggaaccggaccgcgcccccgacccgaaactggccgccacgcaggccgccaccgcgctgcgcgagcaggacgccgccgccctgaaagtgagcttcttcgaccagtccgggctcgatgtcaccggcgatctgacgatcgccagaggcggtgccaccgccggcacgctgaccgattccggcggcggcagggccgactatctcgcctccggctcggaggccgcggtccgcggcgaccaggattggtgggcacgtcgcgatccggcccggatcggcgttctgaaagacgcttgggtacgccctgagcactacgcgtttcctctcgacggggccgggctggacccgggagcgctggccgggctggtcgactgggtgcgcgccgccggcgcgtcagccccggacgccgactcggtggccggcaaaccggccgtcggactgcgccgcgacggctggaccgtgctgttcagccggtccaggccgtaccgcctgctgtggttcggcggaccgctgcagaacggcacgccgctcgccccgaccatcaacggatcgccgagcgcgcccaccccgccctacgtgagcgtgctggtcgacccgaaagccccggccgttccgcaggtcaccgtcccggacgcccgggaggagcagaagacgccggcccggctgcccgccttcgacgtgacggtgaacgcggcgacctgccgcacggtcacctgctcgtggacggtgaccgccaccaatgtcggaaaggtcgcctgcgacgcctcggtgatcgcctcggtcaccccgggcatgccggagacccgggtggcggcactcggcacggtgccgcccggcgcgagccggacgaccgcccggatgacgttcccgaacccggcgccgaccaaccggaacgtgtccgccgactaccgggcacaggcgtactgcccggagatctacgggccgaacctgaaactgatgcgccggctgcaggagagggggctggtgcccgggcggtcaccgacgctgagccggctcgaccccagccagatgccggccatgctgttcaccctcgacgcgatggccggcgccgggagattcgacgccgaccgggccaccgaggagatggagaaggcgatcaccgcgggcgcgctgccggagatcggggaactggtgcagtcgcggcgactggcgaacccggaggttctctacggcaaactggcgaacctcatcttcgaatacgacacggcggcgcccggcacgccggtcagagagaagaccggatatcgtcgcgaactgcagatcgcggcggggatcctgcgccaggaccgggacgcgacggtgaccctggacgggggcggcatcgacatcgtcgtccggacggcggggtccccgacgtacgccatccaggcgaagtcggtgagcagcgagtcgatcgcggagaacctgcgccgcgccgccgaggacctgcgcgcccacgcgccggccggcgcgtcgaaggtcgcgctgctctatgtggaggccccggccggctacgcccacgccgccggccgcgaccgcttcgaacgggagttcaccgcggtgaacgccgacacgtgcgccgccgggctcgaccggatcgaaatcgtcaaccagggtggtgaccagcgctttcccggctgcacccgatag

SEQ ID NO: 5468 - DNA, 570 bp, Actinoplanes utahensis
atgggcgttcgcacctggatcgagggctggccggtctaccggcagctcaccggcaccgacccgctgggtcgcggcgccgccgtccagagcccgcgctcgaagagtctcaccgcgcgcaccgagaccgccgactcgatggcccgctccgtctgtccgtattgcgcggtcggctgcggtcagcggatctacgtcaaggacggcgcggtcacccagatcgagggcgacccggacagcccgatctcccagggccgcctctgtccgaagggctcggccagcaagagcctggtcaccagcgaccgccgccagcagaaggtgctctaccgccggccgttcggcacggactgggaggagctcgacctcgacaccgcgatggacatgatcgcggaccggctgctcaaggcgcgcgaggacacctgggaggacaccgacgacgagggccgcccgctgcaccggacgctgggcttttccagcctcggcggcgcgaccctcgacaacgaagagaactacctgatcaagaaactgttcaccgcgatgggcgcattgcagatcgagaatcaggcgcgtatttga

SEQ ID NO: 5469 - DNA, 2523 bp, Actinoplanes utahensis
atggcggaggcccacccggtgggattccagtacgtggtggaggcgaagaaccgcggcgccaaggtcattcacatcgacccgcgcttcacccggaccagcgcgctggcgcacacctatgtgccggtgcgggccggggcggacatcgccttcctgggcggcgtcatcaactacatcctgagcaacgagaaggacttccgggagtacgtcgtcgcgtacaccaacgcgtccatgatcgtgagcgaggatttccgcgacaccgaggatctggatggtctgttctccggtttcgacccggagaccaaggcctatcaccagggcagctgggcctatgagggccagcaggacgacgactcggtgcaggaccacggcgagtcgcacaccgatcgggagacggcgtccggtctggagcaggaatcgcacggcccgccgatcccggccgacgtgccccgcgatccgacgctgcagcatccgcggtgcgtctatcagattctgaagcgtcattacgcccgctacacccctgaggtggtcgagcgggtctgcggcgtgtcgccggagcagttccgcgaggtctgcgaggcgtggacggcgaattccggccgggaacgcaccaccgcgctggtctattcggtcggctggacccagcacagcgtcggcgtgcagtacatccgcaccggcgcgatcatccagttgctgctgggcaacatgggccggcccggcggcggggtgatggcgctgcgcgggcacgccagcattcagggatcgaccgacatcccgacgctgttcaacctgctgcccggttatctgccgatgccgcaccaccagcagcacgagacgttccggcaatgggtggacgccatccgtcacccggagcagaagggtttctgggcggacgcggaggcctatgcggtcagtctgctcaaggcctattggggcgacgccgccacggccgagaacgattgggggtacgactggctgccccgtctcaccggcgaccacggcacctaccagcaggtcctcgacatgatcgacggcaagatcaagggatatttcctgctcgggcagaaccccgcggtcggctccgcgcacggcagggcgcagcgcctcggcatggccaatctcgactggctggtggtccgcgacctgttcatgatcgagtcggccaccttctggaaggacgggcccgaggtggccaccggcgagatcgtccccggtgaatgcaaaaccgaggtcttcttcctgccggccgcctcgcacgccgagaaggagggcaccttcacccagacccagcgcctcctgcagtggcgggagaaggccctcgacccgccgggcgactgccgctccgagctgtggttcttctaccacctcggccggctcgtccgggagcgactggccggctcgacactgccccgcgaccagggcatcctcaatctcgcctgggattacgacccggacgacggcgagggcgtgctcaaggagatcaacggtttcgacgtcgcgaccggcgagccgctgcccggtttctcggcgctcaaggccgacggttccaccgcctgtggctgctggatctattccggcgtgttcaaggacggggtgaaccaggccgcccgccgcaaatcccggaaagagcaggactgggtggccgccgagtggggctgggcgtggccgatggaccggcgcacgctctacaaccgggcctccgccgacccggacggcaaaccgtggtcggaacgcaagaaatacgtctggtgggatgccgaggccggcgagtggaccggttacgacgtgcccgacttcgagaagacgaaggcgcccgactaccgcccgccggagggtgccaccggcgtcgcggcgatcgccggcgacgacgccttcatcatgcagggcgacggcaaaggctggctgtatgcgccgagcggcctgatcgacggcccgatgcccacgcattacgagccggccgagtcgacggtccacaatccgctctacgcccagcaggccaacccgacccggaaaacgtacgatcggccggacaatcagctcaatcccgtttccgagaccttcccgtacgttttcagcaccagccgcctgaccgagcaccacaccgccggtgggatgagccgccagctggcctacctgtccgagctgcaaccggagatgttcgtcgaggtctccccgcagctcgccgccgagcgtgggctggaccacctgggctgggcgcacatcgtcacggcacgcgccgcgatcgaggcccgggtgctggtcaccgaccggatccggccgctgcgggtggacggccgggtgctgcaccagatctggatgccgtaccactggggcggctccggcctggtcaccggcgactcggcgaacgacctgatcggcatcgtgctggacccgaacgtgctgatccaggagagcaaggtcggcacctgtgacatccagcccggccgccggcccgtcgggcgggaactgctggactacgtcgccgactaccgcaagcgggccgggctgcgaacggagggtcactga

SEQ ID NO: 5470 - DNA, 918 bp, Actinoplanes utahensis
gtggcgggcaacagcctctacgggccgctcgacccggcgccggacgccggctatccggacgcgccgccgcggatggggttcttcaccgacaccagcgtgtgcatcggctgcaaggcgtgcgaggtggcctgcaaggagtggaacggggttccggacgacgggttcaacctgctcgggcactcctacgacaacaccggcgggctgagcgcgaactcgtggcggcacgtggccttcgtcgagcagccggtcgaccaccggaatgtcgacgtcttcgccgaggcggccggcccgcaattcctgggcatgccgagccgggatctgccgggccggaccatggatgcgccgcgcaccgatttccgctggctgatgatgtccaacgtgtgcaagcactgcacccacgccggctgtctggacgtgtgcccgaccggctcgctgttccgcaccgaattcggcaccgtggtggtccaggaggacatctgcaacgggtgcggctactgcgttccggcctgcccgtacggggtgatcgaccagcgccacgacgacggccgcgcgtggaagtgcacgatgtgttacgaccggatcggtgacgggctgaccccggcctgtgccaaggcgtgcccgaccgagtccattcagtacggtgagctggaggaactgcgcggccgggcccgccagcgggtggcgacactgcacgagcagggagtcgccgaggcccggctctacgggcacgatccggacgacggggtcggcggggacggggccttcttcctgcttctcgacgagcccgaggtgtacggtctgccaccggacccgatcgtgcccacccgcgacctgccgaaaatgtggaaacgcgcgggactcgccggtctcgcgatggccgccgccgtcgtcgtgtcattcctggggggacgcccgtga

SEQ ID NO: 5471 - DNA, 195 bp, Actinoplanes utahensis
atggtgccgaaggccgagttccggtcctactacggccgaccgatcgtgcggccggcggtgtggcggcacgacatcgcggcctacctgttcaccggcgggctcgccgccggatcggcgatgctggccgccggcggcgacgccaccggccgccccgccctgcgccgcgccggccgggcgaccgcgctcgctagctag

SEQ ID NO: 5472 - DNA, 1593 bp, Actinoplanes utahensis
ttggcccgccccgcaacagggcggctggcagccccccgcccgccccagcccggctggccgcagcagccggtcccgctacagggttggccgcagcagccggtcccgccacagggttggccgcagcagccggtcccgccgcaggccggctggccgcagcagccggtcccgcagcccggtggctggcagccgcccgccgtcctgctcggtcccccggccccgccccgcgagccggccaaaaccgaccgcctggccgccgccctgggcaacgcctcgttcctgagcctcggctacttcctgatgcgccgcaccgtcctcggcgtactcaccctgctggccagcctgatcctgctgctcgggatcgtcccggccgtccacaccggatggatcgagatcgtcgccgtcctctggtggatcgcgatgatcgtgcatggctggttcctggcccgcggtccggtcgaaccggccacccgcacccgccagcggatcgtcgggatcgccgccgcggcggtcgtcctgctgctcctgggcgggctccgggtgcaggccgccaccatcggctcggcggtcgacgacgcgaaagccgccggtgactgcggcggtgcggtcagcaaactcgacaagctgtggttcggtctgcgcgtcgccgacggcccgatggccgccgagggtgacgacacggtcgaagcgtgccggcagctcaacgaggccgacgaaaccctgaccgggatgctcaccgccccgagcgccaccggcctgaccgccggattcgaccagatcaacacggtgctgacccggttcccggggcacgagaagatggccgacgcggtgctcgacgggttcctcggcaagctgccgctgtcggacgcgtgcggcaccgccacgatcaccagctggctggccaagcggccgaagacgaacaacaccctggaccgctcggccgaggtggtcgccaagcacgagccggccgccctggccggctgcggcgacacctacctcaacggccagcagtgggagtcggcgaaggtcgtctaccagcagctgatcgacacgtacccgaccgacgtgaacaagccgaaggccgaggaggggatcgccaaggcggacctggccatcgagttcgacgcgttcaaggacgcgaccgacagcgtctccgggaactactgcgacaccccggtcaagtacagcgccgccaaggcgtacggcaaaggtgtcaaccgggccatggtcttcggcaacgacaccgaggcgaagcggctgccgggcggctggaagaccaccgacccgaccgtcgccaacctggtcctctgcgtcagcggcgactcgcagggtgcggcggtgcgcagctgcgactacggctcggccggccagcaccgggtgaccttccacaaggtcaaggtcacggtgcggggttacgaggtgcgcagcggcaagcagatcttcagcaagaccctgcagttcagcggtacgtcatgcccgcaccggatcgagtacatgaccacgctcggggtcgacctcggcccgccgcggcacatggatgtcaaggtcgacgccaacgacgtacaggcgcaattcaagcccttgatcgtgaagtag

SEQ ID NO: 5473 - DNA, 993 bp, Actinoplanes utahensis
atgactgttcggttgacgcagtacgcgcacggtggtggctgtgcctgcaagatcccgcccggcgagctggagcagatcgtggccgggctgaccggtcccgatcagcaggcgggcggcgacctgctggtcggtctggacgacggtgacgacgccgcggtggtgcggatcgcggccgggaccgcggtggtggcgacggccgacttcttcacgccggtggtcgacgacgcgtacgactggggccggatcgccgcggcgaacgcgctgtccgacgtctatgcgatgggtggccgcccggtcgtggcggtgaatctgctgggctggccgcgggacgtgctgccgctggagctggtcaccgaggtgctgcggggcggcctggacgtggcccggcaggccggctgtcacgtggccggcgggcacagcgtcgacgatccggagccgaagtacggcatggcggtgaccggggtcgccgacccggaccggctgatgcgcaacgacgcggggcggcccggcatcccgctgacgttgacgaagccgctcggggtgggtgtgctcaactcccggcacaagcagaccggtgaggtcttcccgcaggcggtcgccgcgatgaccaccctgaatcgggcggcgtcggaggcggcgctggccgccggggtggtgtgcgccaccgatgtgaccggtttcggactcctcggtcacctgcacaagctggcccgggccagcggcgtgaccgcgcggatcgacccggcggcggtcccctatctggacggggcgcgggaggcgctggccggcggattcgtcagcggcggcacccggcgcaacctggactgggtgcggccgcacgcggacaccgcgggggtctccgaggacgagttgctgctgctcgccgacgcgcagacctcgggcgggctgctggtcgccggcgagctgcccggttggccgatcatcggtgagctgctgccgcccgaggacggggtcaccgtggtcgtccgatga

SEQ ID NO: 5474 - DNA, 2589 bp, Actinoplanes utahensis
atgctcgacttcggtctccacgtcgtcgacttcgcctcgcaaccgctggtcttcgagggggcccacggcccggcctggatggggcaggttctcctcaacccggtcaagccactgccgaaggtccttgccggtcaaccgcagccaatcgaaaggcatgcatgtccggcatctctcaatccggtccgaaccgtcgtgaccggcgtcgcaacgccaagctcaccccggcgcatggtcgccgccgcggtgcttccgatgatcgcggtgccggccttcaggagccaggtggcgttcgccgccggttcgacccctccggtctactcgctggccgccaccgtcgcccccgccccgatgaccctcgcggactgcaacgaccccacctgcatcgtcgcgccggccccgagcggcaacgacgactaccccacgctcaacaacctcctcctgcttgcggccagccggacggtccccgccgtgctggacgccgacaacaacgtcgtgacgccggcgacgaccgccacggtgttcctcggcgagggcacctaccgcgtcggcaaggtcctgaaactgccggcgaacgtcaacctgcgcggccggggcatcaccgcgaccacggtctcgatgatcaccgcgaacaacgtcaacttcacctacgcgtccatcatcagctgggacttcaaccaccagatcgccggagccaccagcaacctggtctccgacctgaccgtcaacggcaactgccgggagggcgccggccagccggtgccgtcggacatgccgggccgccccggcgagttctgtgacttccgcggagcggacggcaaggccgcctcgacgaactcgggcggcggtgtctcggtcggcgacaactggaccgtccgccaggtgcggttcaccaacctcgagtacttcaaggtctgggtcggtaacggcgtcacgaatgtgcgcatcgtcgacaaccggttcgacaactggggcggcgccgagtcgggcgacgaggacaacgtcggcggcggcagccggaacgacggcgtgatcgtcgagtacaaccagttcgacaagacgatccgcggcaacagcttcgacttcaccaacgccatccgtacgaccgtgcgcaacaatgtcgtccgctcggacggcacgatcgccacggcgcgtaaggacacgtcgctctacggcaacatgtacttcgagggcatccagcaggccaccgtcaccgacaacgtgctgtggggcgcgcagatcgccctcaaatccaacagcctgtacgcgcacagcggcgagaacagggacatcaccgacccgcgtgactcgatcgtctcgggcaaccggatcagctactccggcgagaccggcatcagcgtcacctacgacgactacaaggacggcccgaacgcgtccaacctcggacagcccggctcctggaccgacaagagcgcgcccacggacgcgttccatgtcgtgcgcccgggcggtaacaacgtcgtccgcgacaacgtgatcgagtacacgggccggtccggcatcatggtcaacggctcgtatgccagcgccaagaacgcggccgacaccatcaccggcaacgtcatccacaacgccggctggggcggctccaccgtctacgacagcggcgcgggctacttcgacaccgcgggcatcggcctgtcgatcggtgtcggcgaccaggtctacggcaacacgatcgaggactaccccgccaagaagaccacgtggtacgggatcgacctcggcgcccgtcgcgcgtcgaccagcccgaccggtaccgtcctgacggggccggccggcgaggtcaacaccgtcaccaacgtcatcggcaccgcttaccacgaccagaccaggatctccgaggcggtcaccaacctgtcggccggcggcaaggtcctcaactgggatgaggcgtacccgctggacgggcgcccgatccggggctaccggatctaccgggacggcaacgtcgtcggtgacctgccgatcggcagcgtctccatcccgaacaacatcatgaccgccgacgagtccaacttcgagaacgcgtccgccggcacggccggctgggtcgccggcacccgcacgacgctcgcccgggtcgccggcaacagctcgcgcggcaccgcctcgatgacgctgacctccagcggcacgggtgaggtcagcttctccggccgcaagatcaacgtgacgcccggtcaggtctacacctcggtcctgtcggcccgggcgatgtccaccgcggccgccggcaagcaggtccgcgccggcgtgaagatcaccttcgcgaacggcacgacccagaaatgggcgaccaacaacaagaccgccatcgactcctacgccaactggatcaccagttactacacgttctccgtgccggccgacgcggtgtcggtggagccctggtacctgatcgagggcacggtcgccggcgacgcccacatggtcgaccgtctcggcctggtcgcgggcacccgcaccgagcagttcaccgaggccaacggcccggccaacgcggtctaccacgtcgtctcgtacaccgcggacgacaactccatgccgcagtcggtggtcgtcccctga

SEQ ID NO: 5475 - DNA, 1209 bp, Actinoplanes utahensis
atgacccaagccgtcacggcccccgacccggtccgtgccccggcgcggcccgggccgaaccgggcgctcaacgcgctccgcgccgtcgcggcggttctcgtggtcgtctaccacctgcgccagctgctgttcgtcgacgcggccgacgcgggtgacggcctgtccacccggctgctgtacgccgtcacgaacatgggtcccgcggctgtcgtggtcttcttcgtgctcagcggttactgggtgggcggcagcgtcttctccgggttccggcgcgaccgcttccggtgggcgtcctacgcgaccgcccggctcagccgactgtggatcgtgctgatcccggccgtcgccctcaccacgatcctggaccgggtgggcctcgccctgctctccgggacctccatctacctcggcgacccggcctatcaccacacggttcccgccgatggactcgccgaacggctgaccgccggcaccgcgctgggcaacgtgttcttcctccagacgatggcggtgcccacctatggcaccaacgcctcgctgtggtcgttggcctatgaggcggtcttctacgccgtgctgccgctcgcgttgtatgcctggcgtggccgcggcggcatcggcaaacgggcgctcagcctggtgctgctgctcgggctctgcgccctcgccgggccggccgtcctcaagtatctcccggtgtggttgatgggagcggtcgtcgccctctaccgcgagccggtccggaactggttgcaggcccgctcggcacactggctggcctggtcgcgggccggcgcgtcggccgggctgacggccggcctgtggctggcgcaggccagctaccgcagcgtgaacgtgttgctgctggccaccgcgacgaccgtgctgctggcgctgctcgtcgaggacgtcggctggaccggagtgcccggccgggtgctcggcggcctgtccgattacgcggactcgtcctactccctctatgccatccatcttccggtcgccgcgatgacggctgcgctgctcaccccccacgtggccgcccgttgggcgcccactgcgacacactggctggccctggccggcatctgcgcggtgctgaccgcgatcggctgggccttcgcacacgccaccgaacggcacaccgaccgggtgcgccgcatcgcggacacgctcatcgcgtcggtcgcggcgcgtacccgtacctga

SEQ ID NO: 5476 - DNA, 774 bp, Actinoplanes utahensis
atggatggtgtgccgctgatcgtggaacccgaccgggacgagcccggctgcgccgccgtcctggtcgacggcacgatcgccggccggccgtatcggttcatcctggacaccggtgcggggcggacgtccatcgtcgccgatgcggagctggcccggctgccgcggcggggcagtcagcagtcgtccggcctggtcggcacgagcaccgcggatctcctgatcctgcccgagctgaccgtcgggccgctgtcctggaccggcctggaggtgagcagcaccgacaccggtcatcccgacctgcggaacctgctcggcatggacgcgatcggcgcatacccgggccggttcgacttcgaccgcgggagctggcagccggcaccgaccggcaccctgccgacccgccggccgctcgaccgcggcgcccggggtcacattctcgtggatgtcgagtggcccggcgtcaccgcgcgggcgtgctgggacagcggggccgggatcaccgttgtcggcaagaccttcgtggcccgccatcccgagctgttccgctccgccggtacctcgtccggcatcgacgccaccggcgccacggtcgagggggcggcatactggatggcggcggcccggatcggtggccgcatgttcgcgccgcatcgcgccgtcgcctatgacatgccggcgggtctggaccgggtcgatctggtcctcggctatccggcgctgcggcaggccgtctgggtgttcgacttcccggcgcgccgatggtccgtcgagtga

SEQ ID NO: 5477 - DNA, 1287 bp, Actinoplanes utahensis
gtggatccgcggcggcagataccccgtaccgacgccgtgctcgaagatcctcgcctggtggccgcggccgtccggctcggccgggagccggtgaaagcggcggtccgggcggcccagcagcgggtgcgggacggcgaactggacgcggcggacgtcgccggggccgcggtggcggcgctgccggagaccgcgggcgggctgcggacggtcctcaacgcgaccggcgtcgtgctgcacaccaacctggggcgggcgccgctgtccgcggcggcggtcgaggcggtcgtcgcggccagcggacacaccgatgtcgagctggatctggccaccgggcggcgggcacggcgcggacggggtgcgctggcgtcgctggcggcggcggtgccgcgggccggggcggtgcacgtggtcaacaacggggcggcggcgctggtgctggcggcgacggcgctggccgcgtgccgggagatcgtggtcagccggggggagatggtggagatcggggacggcttccggctgccggatctcctggagtcgaccggggcgcggctgcgggaggtgggcaccaccaaccggacctcggccgccgactatgcggcggtggtcgggccgcagaccgggttcatcctcaaggtgcatccgtcgaatttcgtggtgcgcggcttcaccagcgccgtcgcggtcggtgcgctgaccgggttcggggtgccggtggtggcggacatcgggtcggggctgctcgcgccggatccgctgctgcccgacgagccggatgcggacggcacgctgcgcgccggcgccgatctggtgatcgccagcggggacaaactgctcggcggcccgcaggccgggctgctgctcggcgacgctgacctcgtcgaacgcctgcgccggcacccgctggcacgcgccctgcgagtggacaaactgacgctggccgccctgcgggcgaccgtcgccggtccggtcacaccgacctgggccgcgctccgctacgacccggacgaactgcgggaccgcaccggacgcctggcggcggccctggacggcatcccggtccgggtggtcccgtcggtcgcggtcgtcggcggcggcggcgccccggagcttcaggtcccgtcgtggtcactgtcgttgccgatttcgtacgcggtgagcctgcgtgtcgccacccctgcgatcgtcggacgggtggagcacggccgcctcctgctcgacctgcggtgcgtgccacccgctgcggacccgcaggtcgccgccgcgatcagagccgtgtcatgcgagtaa

SEQ ID NO: 5478 - DNA, 330 bp, Actinoplanes utahensis
atgtcccgcggtcgcgactacccgcacgccaccactccgctcaccacgaccacccgcacccacccacccaccaggccacccgcaccgcaacatcggccacggccacggccacggccacccgaacccgcacccaccacgccgcccgcaccgcaccatcggccacggccgcggtcaccacggccacccgaacccgcacccaccacgccgcccgcaccgcaccggccgacggccgcggtcaccacgatcaccggcgaagcggtcaccgcgacggcggtcacccgctcggcgcggccggtgtgtgccccggatccggggcggttactcgcatga

SEQ ID NO: 5479 - DNA, 261 bp, Actinoplanes utahensis
gtgaccgccgtcgcggtgaccgcttcgccggtgatcgtggtgaccgcggccgtcggccggtgcggtgcgggcggcgtggtgggtgcgggttcgggtggccgtggtgaccgcggccgtggccgatggtgcggtgcgggcggcgtggtgggtgcgggttcgggtggccgtggccgtggccgtggccgatgttgcggtgcgggtggcctggtgggtgggtgggtgcgggtggtcgtggtgagcggagtggtggcgtgcgggtag

SEQ ID NO: 5480 - DNA, 927 bp, Actinoplanes utahensis
gtgcgggtagtcgcgaccgcgggacatgtggatcacggaaagtcgacgctggtgcgggcgttgaccgggatggaaccggaccggtgggccgaggagcggcgccgggggatgacgatcgacctggggttcgcctggacgatgctgggttccgggacggtcgtggcgttcgtggacgtgccggggcatgagcggttcgtgccgaacatgctggccggggtggggccggtgccggccgcgatgatcgtggtggccgccgacgaggggtggcggcagcagtcggcggagcacctggccgctctggacgcgctcggggtgcgccacgggctgctcgtggtgacccggtcggacctggccgacccgggtgcggcgacggcggtggcacgggccgagatcgcggcgacctcgctgggcgcggtggaggcggtgccggtcagcgcggtgaccggtgccgggcttcccgagctgcgggcggccctggaccggctggtgggcgggctgccggagccggatgccgacgcggcggtgcggctgtggatcgaccggtcgttcacgatccgcggggcggggaccgtggtgaccggcacgctcggcgcgggcaccctgcgggccggggacgagctcgcgctgaccggtatggatcggccggtgcgggtgcgcgggctgcagagcctgggtgagccgcgcgccgcggtcgccgcggtcgcccgggtggcggtcaacctgcgcggcgtggagaaggacgcggtggcgcgcggggcggcgctgctgaccccgggccggttccgcctgaccgacctgatcgacgtccgactgcacggtgcggcattcccgacgagagcgatgccacaaccggtcccgggagagccgccggcgagcgtgacgccgccggtggacgcgcaggcgggccggacaggtttgtcggcctag

SEQ ID NO: 5481 - DNA, 852 bp, Actinoplanes utahensis
gtgcgggtgcgcccgctcggggtggacaccgtgcggctgcgactcgggcgggcgctgccgttgcggatcggggatcgggcgctgctgcgggatccggggcggcatctggtgatcgccggggtgaccgtgctggacgtggcgccgccggcggtgcggcggcgggcggcccgggtggccgagctggccaccatggacggtcgtcccgacctggccggggagctgcggcggcggttgctggtccgcgggtccgtgctgctgggcatgggtgtcccgccgcggtcaccggtggcgggggactggtatgcggacccggcgcactgggcggcgctgcgggcgcggctgcgggacgaggtcggtgactacgtcgcggggaatccgctggagccgggcatcccgatcgacgatctgcggcaccggctcgggctgcccgaccgggtcctggtcgaggccctggtggagccgccgctgacgatccgcggcggccgggtgggcgccgggccgcgggaactgccggccgcgctgctggcggccctggagaaggctttcgaccgggagcggccgttcaccgccccggaggcccaccggctgagcgacctcgggctgggcgcccggcagctggccgccgcggtccgcctcgggctgctggtccagttggcgccggccgtggtgctgccggccggcgcgccggaacgggccgcggacgtgctgacggcgatcccgcagccgttcacgctcagcgaggcgcggcgggcgctggacaccagccgccgggtcgcggtgccgctgctcgaactgctggaccggaccggtgtgacgcggcggctggcggacgaccgtcgtacggtcaattga

SEQ ID NO: 5482 - DNA, 453 bp, Actinoplanes utahensis
atgaacgacgggttccacgcggaccgtacgcaggagatgttcctcgcggtggcgccgccggtgccgccgcagaccggcggggccgacgtcatcgaggtggcggcgtatcgcggcgacaccgtcttcgagcgcgaggtgatcgagaagctggcggcggcggccgcgcggtcggtgccgggcgtggccgagctcggcggagacgtcgcgcggttcttcaacgcggtgctcgacagggtgggcctggacaaggtgggtgacgccacccgcggggtgcacgcccgggtggacggcatcgacgtcgacatcaccgtggtgctctgcctgcgggccggcgaggtggtgtcggaggtgaccagcgaggtgcgcgcccgggtgatcgaggcggtggagaagtacggggtgcaggtcaacaactgcacggtcaaagtggacgacatcctgatgccggagtga

SEQ ID NO: 5483 - DNA, 102 bp, Actinoplanes utahensis
atgccgttcgtgcgggacgacctgtgcgaggcggcggcgatggcggcgttcggcccgcgggccgggcggcgatcttccgggccggtgtcggatccggggtga

SEQ ID NO: 5484 - DNA, 375 bp, Actinoplanes utahensis
atgacgcggtatctgatctcgttcaacgacggtgcgatggaccacatcgcccgcgcggagctcggcgacgtggccgaggccacccacgcggtggcgcaggaggcgatggacgccggggtctgggtgttcggcgccgggctggagcgccagcgggccagcgtggtggccaccgacggggtcgtcaccgacgggccgtacccggagacgaaagaggtgatcggcggcttcgctgtcgtcgaggtggcgacgcgggaggaggcgctggcgtgggcggcgcgcatcgcggctgcctgccggtgcgcgcaggaggtgcgggaagtgctgccggacgcggtgcaggacgagatgttccgccgggccggccggaaccggtga

SEQ ID NO: 5485 - DNA, 423 bp, Actinoplanes utahensis
atgtctcgcacgcttgccatcgccgccgccctcgccgccgcctgtctcgccgccggatgctccggtggatccggcgacgacaccgacaagacggtcgcgccggccgcgcagaactcccagccggccgtgcactcgcagccggacctgcgggccagcatggaggcgcagctgggtttcccgccgaagccggacacgaaggccgccgaggcctacgtcgccgacctgaagagcatcgacccgaagctggtcgccgcccacgacccggaggtcctggtgaaccgtggccgtgaccagtgccgcgacctcaagacccgcccgcagaaggactgggccaccgtggccagccagcggttcaccaccccgcaggccaacgctgcccggatcatcaaggtggtccgcgagcgcctctgccccacctactga

SEQ ID NO: 5486 - DNA, 1152 bp, Actinoplanes utahensis
atgtacgccgatccgttcgagactccggaacgcggcacgctgcgcgaggcgatggcgacgttcgtacgacgggaggtcgtgcctttcctcgatgcctgggagcgggccggcgagatcccccgggagctgcacgccggcgccgcgaaagccggcctgtacggcgtcgggttccccgaggaggccggcggggacggtggcgacaccgtcgacatggtggtggcgaccgaggcgttcctcgaggcgggcggctcgtccggcgcgcacgcggcgctgttcacgcacggcatcgcgctcccccacatgatcgcggccggcgatccttcgctgatcgaccgtttcgtccggccggcgctggccgggcagaagatcggctcgctgggcgtgaccgagccggacgccggttccgacgtcggcgcgttgcggaccaccgcggtccgcgacggcgacgactatgtggtcaacggggccaagatgttcatcacctcgggcacccgggccgatttcgtgaccaccgcggtccgcaccggtggccccggcgccgccgggatcagcctgctggtcgtcgaacgcggcacacccggtttcacggtgtcccgcaagctcgacaagatgggctggcactgctccgacacggccgagctgtccttcgccgactgccgcgtcccggccgccaacctgatcggcgccgagcacggcggtttcccgctgatcgcccaggtcttcgtcccggaacggatcatcacggcggtgcacgcgtactcggtggcgcagcgctgcctggatctcacgctcgtccaggtgcgcgcccgggagacgttcggacggccgttgatcagccgccaggtggtccgccacaaactggtcgagatgcgccagcggatcgaactggcccgcaccttcacccgccgggtcgccgcccgccacgccgccggcgactgggttcccggcgaggcgtgcctggccaagaacgccgccgtcgacgccggcaagtacgtcgtcgacgaggcggtccagctgcacggcggcatgggttacctgcgcgagtccgaggtcgaacgtcactaccgcgacatccggatcctcggcatcggcgccggcgccaccgaggtgatggccgacctcgccgcgaagatcttcgagtacgaccgctga

SEQ ID NO: 5487 - DNA, 597 bp, Actinoplanes utahensis
gtgaggcgtacccaggcccagcgcagcgcggccacccggacccggatcctggaggccacctgccagtccctggtcgagcggggctacgcggagacgaccacggccgaggtccaggcccgggccggagtgccccgcggcaccctgctgcaccacttcccgaccaaggtggacctgctggtcgcgtcggtccagcacgtggcccggcgccggctcgacgcgctgaccgccgagctggccgaggtcaccggcgacgggctggacgcctacatcgacgcggtgtggcactccttctcggcgccgatgttctgggccgcgctcgaactgtgggccgcggcccgcaccgacgaggagttgcgggccgcgctgctgccggtggagaaggagatcttcggggtgctgcacgagcgggcggtcgcggtgctcggcgacgacccgcgggtgccgggcgtgacgcagatgaccttcgaggtgatgaccgggctgctgatgaccgggatcgtcagcggcgacccggtcgccggtgagctgccgatccggcggtggaaacgggccgcggcgactctcctcggccgtgcttcgtccacgagaggacagtga

SEQ ID NO: 5488 - DNA, 2640 bp, Actinoplanes utahensis
atgcgcttccgccgccgttccgtgcccgagaccttgcccgtcgtcgtcccgccgcgccggctgagccgtccctgggcactgtccgtgacggtcccggccaccccggagcgcgtccacgcctacctgacgcacgccgccacgatggccgactggatggtcatgcacaccggctggccggccgatccgcccggcgtggtccacggcgggagccgcttccgtcagcgggtcaggctgatgggcacaccggtcgaggtgcgctggacggtgcgggacgccgagcgtccgcggacgctgtggctggacggcaccggtccgatggggatcgaggtcggcgtctatctctcgctggcggcgggggagggcggcacggtggtgcggctcgacggtggggtgcagggcggccccacggacgggccgctgggcgcgatggtcgcccgcagcctcaccgacgccctgcgcacctcactgcggcgactgaccgccgtcgacctcaccgcgaccggcccggtcatcggcggcccggacgatgccgcgtccgggcgcgtccgcccaccggagaaatccggaaaaatccgacatgagcgtacggggatcgacctcgacccgtggaccccggtcatcgtcggcgccggccaggtcagcgaccgttccagcaccgacgacccggtcaccctcgcggtccgcgccctgcgcgaggccgccaccgacgccggccgaccaggcctgctgccgatggccgacaccatcggctgggtcgccagcgtctcctggcagtacctctccgccggcgccctgatcgccgaagccgtcggcgccacccccacccacaccgtccagaccagcctgttcggcggtgacggcccgctgcgcctgctcaacgacatcgccgccgccatcacccgcggcgagaccagcatcgccctgctcgccggcgccgaatccgccgccaccgcggccgccgccgatcgcgccggccacccgctgaactggccccgacagccggacggcaccgcgcccacccgcatcctcggctccgaccgggagcccaacaacaccccggagaccgacgccggcctggtctccccgctgcacctgtacgccctgatcgagaacgccctgcgcgcccgccacggccgcaccccgcagcagcaccaggcggtgatcaccgagttgtggtcccgcttcgccgacgtcgccgccaccaacccgtacgcctggcttcccgggccccgcaccccggccgacctcgccacccccggccccgtgaaccgcccggtgtgccatccctacaccaagctgctcaccgcgaatttgcaggtcaaccaggcgagcggcctgatcgtgtgttccgtgcgggcagcgaccgaggcgggcatcccgcaggaccggtgggtcttcccgcacgccggcgcccacgcgagcgacgcatggttcgtcaccgaacgcgacgacctcaccgcctccccggcgatcggcgcgatcggccgggccatcctggcccacaccgggacgacgatcaacgacatcaggcacatcgacctgtacgcgtgtttcccgtccgccgtgcagatcgccgccgccgagctcggcctgccgctcgacgacccggcccgcccgctgaccgtgacgggtgggctgaccttcgcgggcggcccgggcaacaactatgccgggcactcggtcgccaccctggtgtcccggctgcgcgccgacccggacgggttcggcctggccaccgcgctcggctggtatctcaccaagcacgccgccaccatcctgtccgcgcatccgccgcgcgccgggttccgggacatcgacgcgggcctgcgcctgccccgggcactgcgcccggccgcgtcctcggggtcgggcggcaccctggaggcctacaccgtcacctatcaccgggacggcaccccggccaccggcatcgtcacggagctcggcccggacgggacgcgcatcgtccgtaccgccgatcccgcctctcttctcgacggtgacccgctgcgacccttcccccgaccggccgccctgaccccggtcgaggtggcctggcacggcccggtgacggtgatccggctcaaccgccccgaggcccgcaacgtcgtcgatccgctcaccgcccgggccctgcaacgcgcgatcggcgacttcgaagccgatccggacgcccgggtcgcggtgctcaccggcaccggcccgacgttctgcgccggcacggacccggagacggcggccctcgggccgatcggcaagccgctgatcgccgcggtcgagggggtcgccgtggccggcgggttcgccctcgccctggccgccgacctgatcgtggccgccgacgacgcgctgttcggcctccccgaggtgaccgaggggctggtcgcggccggactgacccggctggcccgccggttgccccgggccgtcgcactggagttggcgctgaccggtgagccgatgccggcccggcgcctgcacgacctcgggctggtcaaccggatcaccgcgcccggcaaggcgtacggccaagcaatcgatctagcggtctcgatcgccgcccacccggcggcggcggtgctgctctcccagcgtgccgtcgccgagtgcggcggcgacgacctgcggcggaagggctga

SEQ ID NO: 5489 - DNA, 1587 bp, Actinoplanes utahensis
gtgagcgtcctggagaatgtgcacgcggtgctgcggatgcaccagatcggcatcgtgaacctgctccgccccgatcgtctggccggcgccgcggtccgcaacgcccggctcggcccgcaagccgccctgatcatgaaggccgccgccgagcacccgcacgccccggcgctcaccgacgagcgcggcaccctgaactaccggcagctggacgagcagtccaatgcgctggcccgcgccctgaccgagctgcgcctgccgccccgctcggtgatcggcgtcgtcgcccgtgaccaccgcggcctggtcctgacgatcagcgccgcggcccgggccggcctgcgcctcgcgctgatgaacaccgggctcgccccgcagcagttcgccgaggtggtggcccgggagaacgtccgcgccgtgctctacgacagcgagttcgcggccctcgccgacgccgtgccggacaccgtcccgcgctatctgacctgggccgacgagggcgccgcggaccggaccatcgacatgctgatcgccgggcagccgaccaccccgctgccgctgccggaccgcccggccggcttcatcatcctgaccagcggcaccaccggcctgcccaagggcgccccgcggaccagggtgtcgccgctggccagcgcgctgatcgcggaccggatcccgttcccgcggcagggcgcgatcgtggtcgcctcgccgctgttccacagcaccggcttcggcgcctggaccgtcgggctcgccctcgccgaccacgccgtcctgctgcgccgcttcgacgccgaacgcatcctgcgcgcgatcgccgaccaccgggcgtcgatgctggtcgcggtcccgacgatgctcacccggattctcgctctgggtccggagacgatcgcccggtacgacacgacgtcgctgcgcacggtcttcgtcgcggggtcaccgctcgcgccggagctgaccaaccgcttccaggacacgttcggggaggtggtctacaacgtgtacggctccaccgaggtggccgtggcgtcggtcgcccagcccgccgagtcgcgccgcgcgccgggcacggtgggccggccgccggtcaccgtgcgcgtcgccctctacgacgacgaggggacgcgggtcacccgcccgcacgtcaccgcgcgggtgttcgtgcggaccgggatcccgttcgagggctacaccgacgggcggcacaagcaggtcatcgacggccacatggccaccggcgaccgcgggcacctcgacgagaacgggctgctctacatcgacggccgggacgacgacatgatcatctcgggtggcgagaacgtctacccggtcgaggtggagaacctgctcaccgaacgcgacgacgtgatcgaggccgcagtgatcggcgtggacgatccggagttcggcacgcggctgcgcgcctacatcgtccccgccgagcactccgcgcgcgacccccaggagatccgcgactacgtcaaggcgctgctcgcccggtacaaggtgccccgggacgtcgtcttcatcgacgaactgccccgcaacgccaccggaaaggtgctgcgccgcctactgcagtag

SEQ ID NO: 5490 - DNA, 1653 bp, Actinoplanes utahensis
atggggccggtcacggcgtaccgcggcaagcaggttttgatcttgggggttttggggcatgcgggacgcatgagtgatgacggctcctcggcggacaaggccagcgcggcggacagtgcgcacgcgccggagaggacggatgcggcggcgaccggaaagacggacgcgacgggcgcggcggcgaccggaaagacggacgcggcggacgcgacggacgcgggggcggtgaccgagaaggcggacgcggcggcggcggagaaagctggaccggcggcacccgagaaagcgggcccggtggacaagggcgcgcagacgctggtgatcctcggggcatccggcgacctgaccggacgcctcctgctgccgggtctcggcgcactggtcgcggccggtgaggcgccgccgctgacgctgatcggtgccgggatggacgactgggacgcgcagaagtggcgggagcgggtgaccggagcgttcccggagagcccggccggtaagacggtcatcgacgggacccggtatgtgcgggccgacgtgacccggtccgaggatctgcggggtctgctggagggcgccgaccgcccggtgatcttcttcgcgctgccgcccgcggtgaccgcgaaggcgtgcgaggcgctgctcgacgtggaccttccggacggcacccggctggtgctggagaagccgttcgggaccggtgcgaactcggcggcggcgctgaaccggctgctgacccggctggttccggaggagcggatccaccgggtggaccacttcctcggcaagtcgaccgtgctgaacattctcggtctgcgattcgcgaaccggatcttcgagccgctgctcggctcggagcacgtggagagcgtcgacatcatcttcgacgagaatctgggcctggagaaccgcgccggttactacgaccgggcgggcgcgctcgctgacatgatccagagtcatctgctgcagattctggcgctgctcagcatggagccgccgacgtcgctggatccgcaggatttccgggaccggaccgcggaggcgctgcgggcgacccggctgtggggcggcgatccgaagacggcgagcctgcgggcccggtacacggccggggatctggacggccggcagcttccggcgtacgccgacgaggccggggtggatccgtcgcgggagaccgagacgctggccgagctggtgctggcggtggacacctggcggtgggccggggtgccgttccgcctgcggtcgggcaaggcggtgggcagcagccgcaaggaggcgatcatcaccttcaaggagccgccgcggctgccgaccgggctgcacggaccggagcggccgaaccggctgcggatcggtttcggaccggaccggttcgcgctggacttcaccgtgaacgggcccggcgacccgttcgaactggacccggtgacgctggagaccgacttcggcccgggcgacctgccaccgtacggcgaggtgctgcacggcgttttcgacgacgacccgctgctgtcggtgcgcggtgacacggccgagcagtgctggcggatcgtcgagccggtgaccgcggcatggcgggacggtcaggtgccgctggtggagtatccggccgggagcgccgggccggccgagacgctactgcagtag

SEQ ID NO: 5491 - DNA, 432 bp, Actinoplanes utahensis
gtgccatcagacttcgcgctcaagtccatgaacgccgtgcatcgagctctcctgcgggtcagtggagggcggttcggttaccgggtcatcggcatgcccgtcctcgaactggtcaccgtcggccgccgcagcggcgtaccccgcgcggtgatgctcacctcgccgatccgcgacggcgaggcgcatgtcgtcgtcgcctcccgcggcggcgacgaccgtcacccggcctggttcctcaacctccgagaccggccgcaggtggaggtcgccttccagggcgggccacgccggccgatgatcgccgccgtcgcgacgcccgaggagcgggcccggctgtggccggagatcatcgcgggcttccccaactacgccggctaccagcggcgcaccgaacgtgagattccgctggtcctgctccatcccgtgcgctga

SEQ ID NO: 5492 - DNA, 786 bp, Actinoplanes utahensis
ttgccgccagacacgtacgcacgtgacgacgacagtgtggacatggcagaaaatcttgacggcagagtggcgttggtgatcggcgggagccggggcatcggcgccggcgtggcggcgcggctggccgaggacggcgctgatgtggtgctgacgttccagcatcgtgacgatcaggccgcggtcgtggtgaaacagatcgagggattcggccgccgcggtatggcgctgcaggtgaacagcgccgacccggaggcggtgaccagtgcggtcgaccgggcggccgagcagttcgggcggctggatgttctggtcaacaacgcggcggtgttcttcgtcgggccggtggaggatttcggtcgcgaggagttcgaccgcatgatcgcggtcaacgtgcgggcgccgttcctcgcggcgaaggccgcggccaggcatatgggtgacggcggacggatcatcacgatcggaagcaacatggtggagcgcacggtcttcccgggcttctcgctgtactcgatgagcaagaccgcactggtaggactgacgaagggcctcagccgggacctcggcccccgcggtatcaccgtcaacctgctcaatcccggccccatcgacaccgacatgaaccccgctgacgggccggcctcggccacgatcatcggtttcaccgccctgggccgttatggaacacccgccgagatcgcgacggcggtcgcctatctcgcaggtgacggtgctcggtacgtcaccggtgcggtgatcaacgtcgacggcggtttctcggtctga

SEQ ID NO: 5493 - DNA, 480 bp, Actinoplanes utahensis
atgtccggggaactgcaggtcgactacgccaccttccgccgcatggagttcaccgacccgagattcggtctccggatgctcgccgcctggatcttcgcgctgatcctcctgggctccggggtgtggcacgtgctgaccgagccgatcagcgtccagcacgcctacctgttcctgttcgccctgggcttggcggcgattcccgatgcgctcatcggattgtcgtggctgacgcagcgcaagcgctatgccgtgccggcccgctatcagataaccgcgcagggcgctgccgagcacaccgcggccggcacccggcaggtggcgtggtcggaggtcgcccgggtgaaccgcgggcggcacgcgtggacgatcaagaaggcgttcggggccgaggcgttcgtgatcccgcgggcagcgttcactccggcggcgagcaagaccatcaacgacttcttcctcgcccacccggaattcgcgggatag

SEQ ID NO: 5494 - DNA, 1743 bp, Actinoplanes utahensis
atgagccgacgatccagacgtggtcgccgggctggaggaacagcggtcgaggaagctcgacagcccaatcgccggcctccaccttggtcaccatggtcagccgcgccaccggcacgggttcggttcggacaaacccggcggggtcatcacctggccccagctgcaactgcatgcatcaaggctaccgggaacgctgcttcaccatgcaataccggccggcgccgccggcgtacccaggccagaatggccggaacagccggcgtgttcgtggcggtgatcgcggtcgcggccggagtggccgtcttcgcctcgccctccgctcggcagccggacctggcacagtcatccggtccggcaccgctgcccaccggagcattgcccaccgtcgccttgtcgctgtccaagccgtaccacgacttgtggccggacgcgctcgtcgcgttgccgctgcggctgccggacgggcggcggtactccgtcaaggcggaattgggcgctgaccggtacctcttggaaccgcgggacgatcagagacgctacctgccggtggtgttcaatgcccggaccggcgtgacgcgggaactgggcacggttccgacgtccggcttcaccgtgtacgacccggctggtacgtacctgaccgatcactacatcgcgtgggtggtgtcggcgcaggaaaccagaggcgcgaagtattacgaggtgtggagcgcgcccagagacgggggcacagccgtgcgccgggcgacgttcggcccggacgagatgaccgtgtcggtcgccgaggtcggcggggtcttctacgccggcaccgagcccgccgaaggagccggggcgatctaccggatcctcggaggcgcagtgcgatacgcccggcgccgtgcccgtcggatcctgccggtctactgggctgccctcgccaccagcgcactgatcgccgccatcgtgccgtccctgccgctcagcgccccgcccaccctccggtcgaccatcgtctacgccctgctgttgcaagacgccctcgccgcacccgcccccaacggcgccttctggtcgatcgcggttgaagccggcctgtacctcgccttcccgctcgtgctggtggcccgtcgacgatgcggcgcgacggtcaccctcgccgccgtcaccgtgccggtgatcaccgcaggcctgctcctgcctgagctgtccctcaggcctcgagcgatcggttacacgctggagctggcacccctgttcaccatgggtgtgctggcggccggcatcgtgtcggcaagcgaccgggtccggcgcctgccctggctcgccctcgccgggatgacgggcgcaccggtactgatggtgatcgtgcttcgcggttcagcatgggcagtcgttcactactactggctcgacctcgccgtcgggccggccatcggcttgttcctcgcggccctggccacccgccggcccctccggctcacccggctgttgaacggcgcgccgctgcgaaaagtcggcgggttctcctacagcctctacctgatccacatgccgatcgtcgccctgatcagcaccctgctcgtggggccccgcaccggtccgcacctgacgaccttcatcgtcaccacggtgctggttgttccgatctgcctggcgacggtacgattgttcgcagccgtcttcgaaatcccgttccagcgctgccaccgacggcgagagagtggaccggtacacatctcgaacgcctctgcctgttcgtag

SEQ ID NO: 5495 - DNA, 594 bp, Actinoplanes utahensis
atgatcacggttgcggccgggagcaccctcacgctgcgctgcccggacatggagacgatcccgctggtctgcctcgcgcaggtgcgggcgccgttcatcgccgacctgccgccgctgccggtgctcagtctcgacgagccgggcgtccggcggtacgggatcctggagctggtcagcagcgccggcgtcgcctgggtggaggcggaactgcgcggcggcctgatcaccgtcctcggcgactcgccgaccggggtggtgcagcgacgggactcgccgcggatcgccgggacgtatccggcgttcggcaccgcccaggtcgacaccggtcccggccagcggctgatcgccctgagcggccacgtgcgcgacgtctcgaccagcggtctgctgctgcgggccaccgccggcgacgacagcccacacctgcccaccgcgatcctgcgcaccctgctgcacgtgaccatgccgtggggcgagatgaccgcgtcggtcaccaccgtcgaccagcgcgccgaccagctccgcggcaccttcgactggatcgatccgggcgacgcgaaagcgctcgccgcgttcgtcggcgcccgccgctga

SEQ ID NO: 5496 - DNA, 783 bp, Actinoplanes utahensis
atgagcatcggggccaacgagagcgccgcgcggcttgcggtgctggtcgacgcggacaacgcgcagccggcgatcgtcgaggggctgctcgccgaggtggcgaaatacgggaccgcgcacgtcaagcgggcctacggcgactggacgggcaccaacctgcgagggtggaaggagcacctgctggcgtacagcatccagccgatccagcagttcgcgtacaccaccgggaagaacgccaccgacgccgccatggtgatcgacgcgatggacctgctctactccgggcggctcgacgggttctgcatcgtgtccagcgacagcgacttcacccggctcgccgcgcggatccgggagagcggcctgatcgtctacggcttcggcgagcggaagaccccgaaaccgttcgtggccgcctgcgacaagttcatctacaccgagaacctgaccgcgccgcacagccccgcggaaccggccgacgcccccgcggccccgcagccgccgatcccggccgcccggctcaagtcggacagcgcgctggtcaacaagctgcgcaacgcggtcgaggcggcttccgacgacgacggctgggccaccctcgcctcggtcgggcacatcctgaccaagcagagtcccgacttcgacgcccgcaactggggttacaccaagctgagcgacctgctcgcggccaccgccctgttcgagtcggaacgccgcaccacggagaagggcaagaccgcggtcatctacgtccgcgaccgccgccgccgcaaggagaccgcctga

SEQ ID NO: 5497 - DNA, 1092 bp, Actinoplanes utahensis
gtgagccgcctgatcctcgacgagaccgctgagatcggggtcgacagccgcggcctggtgcggggcgaggacaccgtcgccgagtggcgcgaccccgacggtccgctgccctgggccgtcgaggactggcagcccgagcccgagatcgtggcgtgcgcgcagctgggcgagtgggcggcggtcctggcccgggtcggccggcacgcccagctcggggtccggcgcgacggccgccgccccgactggcacggcctgagcaaatcgcccgaggacatgaaccgggggatggtcggcgccaccctgctgggcccgctgcgactggccgaggtcaccgcggtcacccgccgtgaggacctgatcggcgtgcaggtgcagggcgcccgccgggtgcagcagatcgtcgtgccgcggcatgtggagaatccgcccggcgacgcgctcgacccggccttggcccggcacgcggtcaccgccatcgccgcgcaggcccccggcgccccgctcgacctgcccgacgagctgacccgcgacctgcagcggctgctgcaccgcaaaccgttccgcaccacgtggatcgcggtcggcctgcgggtcgccgagacgtgggagctgcccggcgggtttcaggtgccggtggtctacgacgtggagccgggccaggtccaggggttcgtggtggacgaggcgaccggcgcgccgcacagcaccctgcaggcctgccgcaaccatcacctgtccggccggcccgcctggtgctcgtactgcctgagtcccacctgcggggcgtgcgccgaggcggtccggccgtgccggctgtgccagggcgcggtctgcggcgactgtgtggcgaccgcggacggccgctgcccggcctgcgcccggctgaccagggtcggcatgctggcccgcggccgctacggggtgtccggcggcggctcggtctggcacggcgaggttcccaacgttcaggtcaccatccgtgagcagcgcaattattggacgctggagcgctgggaccgctatgaccgggtcaccttcccgctcgatccgcccaccatccatgcgttgcgcgagtgggtcaaaacctcatga

SEQ ID NO: 5498 - DNA, 732 bp, Actinoplanes utahensis
gtgcggaaagcgccgatcggaggacccccgccgagcgattaccgacagagccgaagcgatctatcttctttctcgaccgtttccgcacgacggcaaggagccaccgccatcgccacctcagccgagttcgccgccacccgtcaccgcgtcgccgtcgtcgggcaggaccgcgccggcctggccctcgcccgggccgcggtcaccgccgggcacaccgtcgtcggattcgaccacgacgccggcctcgtcgcggaactgcgcgccggccggtcaccgctcggcgacgacctggtgcggatgcacgagaccgggcggtaccacgtcaccgacgacccggcctggctgtccggctgcaccgtgcacctgatcgccgtcccggccccgccgcaccgcgggcggcccgacctgagcctggtgctggccgccgcggacacggtcgccgggcatctgcgcgaccaggacctggtcgtcctcgagtcacgcgtcgcacccggcaccacccgcggcgtcttccaggacgcgctcgccgcccgcagcagcgcccgctatctgctggccttcgcgccggaccgcaacggccacgccaagctggcgggcggcgtcgaccgccgctcgacgctggccgccgcggcgttctaccgcacgatgtacgacgtggtcgtcgcctgcgccacggcggaagaggcggaggccgcgaatctcacggattccgccggtcgacggtccgcctga

SEQ ID NO: 5499 - DNA, 336 bp, Actinoplanes utahensis
gtggatctacatccgcaggactatgacgacctggtgcacgggcagtcgatggtcgagcagtggcggcgcagtgaccacgcggtcgcggtggccgccgagctgatgaagctgcacggcggcacggtgccgatgagcgagctgctctgggccggtgccgaggccttcctgccgcgtcagtggaacgccggccgggccgccgagcccgccgacgccgcggccgaggtctacgaccggtggcgccggctcaccgaccgccgcctgcagcggcagcggcaggccgaggcggcccgggccgagcaggcccgccaggagcaggccgacggcaacaagagctga

SEQ ID NO: 5500 - DNA, 774 bp, Actinoplanes utahensis
atggccgacttcgacatgcgcaccgccgacctcaccgcgctgaactcactgaccaagtacccgtcgatcccgacctatcacgagctggacccgcgcaacggcgggctgaccgagacggtgaccgtcctgcccggcccggtgtacgcctcggagaagatcgacggcacgaactcgcgcctgatcatgctgcccgacggcaatcacctgatcggctcgcgcgaggagctgctgtacgcgcgcggcgacctgatcggcaacccgtcgcagggcatcgtcgcgagcctgcgcaccgtcgccgagaacctgcccgaccagcacctgccggcggacaccctgcgggtgtactacctggagctgtacggcggcaggatcggcgcccaggcgaagaactacagcacccggggcgcgatcggctggcggctcttcgacgtcgccgaggtgagcggtctcgccgagctgctgacctggccggcgccacggatcgccgcctggcgcgaggacggcggccagacctgggccaccgaggacgagctgcgcgcggtgaccgccttcgacctggccccgcagctgttcaccatggacggcgccgacctgccggccgacgtggccgggatgcacgcgttcctcggcgagcggctgccgcggaccctggtcgctctggacgacagcggccagggacggcccgagggcatcgtgctgcgcaccgcggaccggtccgtgatcgccaaggcgcgcttccaggactacgagcgcaccctgaagcggcgccgctga

SEQ ID NO: 5501 - DNA, 660 bp, Actinoplanes utahensis
atgcacaagtcccgcatcatcgccgcggccctgaccggcgtcaccgccaccctgctgctcaccgccgccccggccctggccgacgacaccgcggtattgacgaccgacgccctggccggcccggccgtcgcggtcggtgacaccatctcggccgggatcgtcagcggcagcctggcccggttcgccaccgcaccgggcggcagcaacggcatgaagtgcagcacgtcgagcttcagcgccacggtcaacgacaacccggccgcgcccggcgccgccgcgctcggcgccaccctggccgtcgccggctgcacggtcagcggcgtccccggggtcaccggcgtcaacagcgtcacgatcaacaagcagccgtacgccacgacggtcgccagcgacggcaccgtcacggtctccggcaccgacgccgcgccgatctccgccactctcgacctcaagtccctgctgggctcggtcacctgcaacttcgtcgcggcgaacaacacgatcagcgcggtggccgacaacaccgacaactcgatcaccttcaccgaccagcacttcaccaagtccagcggcccggcggcgtgcgtcgccgacggctacttcaccgcccggtacaccccggtggtcacctccgccgcggccccggtgttcgtgaactga

SEQ ID NO: 5502 - DNA, 1014 bp, Actinoplanes utahensis
atggtgcccgtggcgggtccccccagtatcacccgccactggaagccccggaacgctgcggaaacggccgggacgcacccaccgtccatcgcgatcccctcgaaggagtggcgcatgaccgcgtcacggctgacattcatcctcgccatgatcgccgccagcgtggcgaccgtggcactcacccccggggcggcccgggccgcgacgtacagcggaatggagaactgcccgctcagcgcgccggccatgaaggatccgtcgaacctgcaggtcggctgcgtgtactcggtcacccacggcggcagcgtcacgatcggatcgaccaccgtggccctgaacaacccgatcaccctgcagttcggggtgtactggccggcctcggcgccgacccggaccttccccgacggctccgaggccaacgtgtactccaccgtgcccgcggccgggggcaggacgctggtcgccaaaccgctgcaggtcgccatccccggcattgccaacatcatccccggagtgaccagcgtcttcgcccaggtcgagctggccggcccgatcaccggcttcgtcccgctggccaccggcgaggacaccccggtgttcgtcatgccgatcaaactgcacctgtacaacgcgctgttcggcgccaggtgctacatcggatcggacaccgacccgatccgcttcagcccgaccaccggaaccaccagcccgccggcaccgaacaagccggccaccggcgacgccggcacgatcagcatcgaccctgacccgaacggcttccagaccctcggcgtcggcttcaccggggccacgctggtcgacaacgcgtacgccgtgccgaaggcgagcggctgcggcctgatcccgggcagcctcgacccgctgatcgacctggccttcggcccgctgccctcggcggccggcaggaacgcggtcgtgttcagcggcaacgacacctcgttcgccgtctcccccagcctggacgacctgacccgggccctcgcagcatcctga

SEQ ID NO: 5503 - DNA, 732 bp, Actinoplanes utahensis
atgacgaacacagcaatcgggcccctcccgggcgcccgcgccggacgtgatcccgcgcgggcgatcaaacgcggcccgcggtcgatgacgcccgaggcggtcgccgcgacccagcgggagcgcctcttcgacgcgctggtgcacacggtcgccgagaagggctacgcgaacgcccgggtcagcgacatctgcacggcggccggggtgacccgcccggcgttctacgcgctgttcgccggcaaggaggacgcgttcctggacacctaccggcacggtacgggtgtcgtgctgcgactgatggacgacgcgtacgcgaacgccggtgactggcacgacggcgcccgggccgcgctgaaggtgctgctggacgtgctggccagcgtgcccgccttcgccgcgatggcgatcgtggagatcgacgcggccggcccgctggcccgccgggagcgcaccgagctgctcggccggttcgcccggttcttcgccgaggcgccgggcgtgccggacggcctggtcggtgcgatcgtcggcggcgtctacgcggccatctacggtcatgtctcgaccgggcgggtggcggagttgccggacctgctgccgatgctcagctatttcatgatggcgccgttcctggggcgcgacggcgcggccgcggagctggcgtgccagcccgccggggagcgggtcgtcgcaccgtgcgccacgtcagataccgacgaggtttttcactga

SEQ ID NO: 5504 - DNA, 606 bp, Actinoplanes utahensis
atgtcctccacccgatacggccacacccgctggcgccggttcaccgcgatgctgctgggcggtctggccatcaccgtcggcctcgtgttgctgaccggcaggggggtgctggccgcctccttctcgatctccggcatgccgttcaccgtcaccagccccaagctgcacggctacggcttcgagcagtacgccgagctcgatcagatggccccgggcagcccgaacgagggtgacaccggcggccaggtcgtggtgatcgtctccgcgatcaaggacgcccagctcgacgggctgtgccagagcatcgcgctgggcggcatcaacctcaagatctcggccggcagtgccaccaacaaggtcaccgccgacacgctcgtcgtcgactccgacctgatcaccggcaacgccgacttcaaggcgatcgacatcggccgggacgccagcaccctggaccgggtcaagggcaagaccggcgcgatcggcgtgttcggccagcaggccgaagaggtgaccatcaccaacctcaagcagaacaactacgccaccacggcggccaccttccacctgcccagcctgcacatgtcgttcacctcggacggctgctga

SEQ ID NO: 5505 - DNA, 453 bp, Actinoplanes utahensis
atgtccggatccgccggagccgaccaccgggtctcgccgggcgcgcgcgtctggcgggccttccggcactggcagctggcccggccgttctggggcggcctgctggtgctgctcggtgggctggagatcctgatgacggtgtgggcgccgctgggcgtcgtgctgcacgtcggcatgcagaacttcatcggctacctgctcccgctggtcatcgtcctgctcgggctgctgatcctgttcaacccggcgcaacggatcttctactcgctgatcgcgatggtctgcgcgctggcctcctggatcacctcgaacatgggtggcttcctgatcggcctgctgctcgccctggtcggggcggcgctgaccttcgcctgggcgctgcccgcaccggtcccggtcgtcgccgaggcgccggaaccgcgatcccccgacaatccggagccgtcggcgtag

SEQ ID NO: 5506 - DNA, 339 bp, Actinoplanes utahensis
atgacgatgagcagcaagtggagtgctgttaccgcgaccctgctgtttctcggcgggatcgggatcgttcagggcgttgccgtgtcgcccgccacggccgcgcccgtgccggccggcgtggttgccggcggcgcgcacggcggagccgcggtcggagaccgggatttccgtcagggataccgggacggctacagcgacggctggcggcaggccaagcaggactgccgtgagccgctgaccgccttccgcgggttgcgcaaccgtgacgacgactatgcccgcggcttcgaccggggcttcgggcgcggtttcgcggcgggcttccgcgagtactgctga

SEQ ID NO: 5507 - DNA, 1017 bp, Actinoplanes utahensis
gtggttgactgtcggatcaggtgggaaagccctttcctggaggtcgcgatgcgtcggcgtaccctgttgaaaattcccgcactcggtgccggagcggccgtcacggtcccgcaccgaccggacctgatcatcgagccgggggacagcgtgcaggccgcgatcgacgccgtcgcgaccggggtgatcggcctgcgccccggtgtctaccgcggccgggtcatcgtgccggccgatcggatcggcctggaactgcgcggcctcgggcgccggccggacgatgtggtgatcgccgacgaccgggccaacggcacgctcaaacccgacggcaccccctggggcacctccggcagcgcctcggtcaccgtcgacggcgccggcttccgggcggtcaacctgaccttcgccaacctgttcgacgaggcggcccacccggagatcaccaaccggcaggcggtcgccgtgctgacccgcgccgaccggctcaccttcgaccgggtccggttcctggccaaccaggacaccctctacgtgaacagcaccgcggccggggtggcggcccgcgcgtacttccgcgactgctacgtcgaaggcgacgtcgacttcatcttcggccgcgccaccgcggtgttcgatcgctgccacctccactcgctcgaccgcgggaccagtccggacggctacgtgaccgcgcccagcaccgacgccgccaacccgcacgggctgctgttcgcgcactgccggttcacctcgaacgcgccgcccggcacggtgttcctgggccggccctggcatcccggcaacgacccgggcgcgaccgggcagacgatcatccgggagtcgtggatcggcgcccacatcggcgcgaccggctggagcgacttcggctcctggccctggcgggccgcccgcttcgccgaatatcgcaacttcgggccgggcgcgcggtgcggacccgaccggccacaactcagcagagccgaggccacgtcgtacgacatcgaggattttctgtggtga

SEQ ID NO: 5508 - DNA, 2817 bp, Actinoplanes utahensis
gtggtgaagtttctcctcgccctactcctggccctgggtggcgccgccgtgccggccgccgccaccgccgccaccgagcacaccgtcaccttcgacaggtattcgctgatgctcgacgggcggcgcaccttcgtctggtccggcgaattccacccctaccggctgcccagccccgacctgtggcgtgacgtgctgcagaagatgaaggccaacggctacaccgcgaccagcgtctacttcgactggggctaccactcgccggcgcccggcgtctacgacttccgcggcgtgcgcgacatggaccggctgctcgacatcgccgccgaggtcgggctgtacgtgatcgcgcgacccggcccgtacatcaacgccgaggtcgacgccggcggctttcccggctggctgaccacacaggccggcaaggcccgcaccgacgcccccgactacctcgcggcgagcgacgagtggctcgggcggatcgacgcgatcatccggcgacaccagtacaccgacgggcacggaccggtcatcctctaccagatcgagaacgagctggcggcggtcggcgacagccagaaacgctacatgcggcatctgtacgaccgggtccgcgccgacggcatcacggtgccgatcttccacaacgacaagggccgcaacggctactggacaccacccgcggccgacctgtacgccttcgacggctaccccggcggcacctgccgcaccgacggcacggtcggcgcgcccgcggtcgctccggactggggcatgtacggacccggcggcccgaagggcggcgccaccgcgtcccccgacaccccgggtttcgtcgccgaattcggcggcggctggttcgactactggggcagcgccggcacctacccgtgcaccgcgcaacgcgaaggccccggctacgaacgcgtcttctacggcaccaacatcgccaaccggctcagcatccagaacttctacatgaccttcggcggtacgtcgtggggctggctgccggcgccggtcgtctacacgtcctacgactacggggccgcgatcgccgaggaccggtcgctgcgaccgaaagtgaacaccatgcgggagctcggctacttcctgcagagcactccgccgatcaccaaactggaacgcggcccggacctcgtcccgtcctccggcgcgatcaaggtctatcacccggtcaacccggacgacggcacccagttcctgatcgccgtgcacaacccgtcgaacgcccgcaccgacgacacggccaccgtcccgctcaccgtcgacggccgcgcctacaccgtgccgctgcggatcaacggccaggacgcgaaaatcctgaccgcggcgtacgacgtgagcggccagcgcctcgtgtactccacctccgagttgatgacgcacaccgcggacaccctgctgctgtacgggcgggacggggagaccggcgagacggtcctcaactatccggccgcgccggtggtcagcggggcggtggacagcagctacgacccggccaccggcgacctccggctgagctacccgcatgtcgggctgacgtcggtgcggatcagcggcggtgggcggcccgcggtcaccctgctgatcgccgaccagtcgactgcggacaccttctggaagtccggggacgtcctggtgcagggtcccgcgctgctccgggacgcccgcttcgccggcgacgagctgcggctgaccggcgacaccgcggcggccaccccgctgcgggtctggtcgccgcgcccctaccggacgctgacctggaacggccgccgcgtcgccgcaccgggccggcccaccgtttcccgctccggtccgctcacggccctgcttcccgggccggagccggtcaccctgccggccctcgaccggtggcgctggtccgccgaacccgaggagtccgacgacacctggacgccggccacgctgaccggcaccaacagcaccaccgaaccgcccgccggccagcccgtgttgaccgccgacgactacggcttccaccatggcgacgtctggtaccgcggccactacaccggttcgctcccggacacggtcaccttcgactacggcgccggcggcgccggcatgctgcaggcctggctcgacggcacctacctgggccagcacaccctgcccaccgccctggcgtcgccaccgacccgcggcaccgcgaccttcaccgtcccggaagcccggcgtgccaccggcgaccacgtcctgtccatcatggtccggaacaacggccacaacgaggacggcggcgtcaacgacgcccacaaggagggccgcggcctgatctccaccagcgtccccgccacctggaggatccagggcgaaaccccggacccggtccgcggcgtcaccaacaacggcggcctctacggcgaacgccacggctggagcctgcccggctacccggaccgcacctggtccgccccgccggccaccaccccgaccggcacctcctggtaccgcaccaccgtcgacctgcacgtcccgcgggtcgacgacgcgtcgatcgccctgaccatcggcgaacccggggtcaagggcggccactaccgggcgctgatcttcgtgaacggctggaacatgggccagtacatcgccgacgtcggcccgcagcacaccttcaccctgcccgccggcatcctcgacccgcacggccacaacaccctggccctggcggtgaccggcgacggcggcaccctggagccgctccacctgaccaccaccaccgtggtccgcggcggcgtcccggtccgccgggtcgcctccccgccctatcgtcactag

SEQ ID NO: 5509 - DNA, 477 bp, Actinoplanes utahensis
ttgcgagggcggtcaccgcaggaagaggttgagcagtacggtcagtgcgaccgacagcaggatcgacaccacgatcatgccgaggcagccggccgggccaccgaggaaccggacttgcatgtttccgatacgcatggacatccgcctacccgcacagggcacggatacaccgacggaggaggcgggcgggcatggtcgtgcattctgaatgcgctgctcgcggttccgatcttcgcaccgggcactcccgcctgggccgcatcgaagctcggcggtcggtatctgcaccattgttgcgcggcgatcggcgtcggtcacgcgaagcggtggggcgccaccgatcacgactggttctgggtggacggcgatcgtaaggtcgccatcaatacgacgtcggcttgctggcagacctacggcacgggcgtcgtcgaccggctgagcagctaccccaccggcgggtgggagtgctggggctga

SEQ ID NO: 5510 - DNA, 156 bp, Actinoplanes utahensis
gtgctgattttcgggctcatccttctgctgttgggcatcttcctgcacgtgtcgatcctctacacggtcggcctcgtcctcctggtggtcggtgccgcgctctggatcctcggtgccgtcggccgcccggtcggtggacgaaaagtctggttctag

SEQ ID NO: 5511 - DNA, 426 bp, Actinoplanes utahensis
atgggtgcgggacgaggttcgcggaacagggcggtcgggacgcgccttctcggggcggcgctgctgtgctcactgctgacggcatgtggcgacgccgaggtcgccgcccccgctgccgacccgggcgccgcggccggggtcaccgactgcgggacgttcaccctggggcagggggagagcctgccggcgtccgccgcccgctgcctgatcgaggcggtccatgccgggcggccggcgcggctggcggtgacccggccgacggtcgagggtgacccgattccggtcacctacacggccggtgctgacggccgggtggaggtggtcaccgatgcgcgccgggacaggttcggtgggcggacggtgacccgggacttctgcaccgggccgtctgctacgccggagctggagttcgctcgatgctcgtga

SEQ ID NO: 5512 - DNA, 1206 bp, Actinoplanes utahensis
atggacggtatgaccgtcctcctcctggccaccctggtgaacgcgatcggcaacggcgcctacgtcaccatcagcgtgctctacctgaccacggtcgccggcctcagccccgccatgatcgctatcggactcagcgccggggccgccgccggggtgctggcgatgacgccgctcggctacctcgccgaccggcacggcccgaaacgactgtccatcctggccctgatcgtgctcgccggcgcgtacaccgccctgctcgcggtccgctccccgctggcgttcgggctgctgtcctgcgtcatcgcggtcgccaccgccctggtcaaaggcgccaacggcgcgcttgccgccggctccgtcgcggcctccggccggctccggatgcgcgccagaatgcgcaccatgaccaacgccgggatcggtctcggcactctcggcggcagcatcccgctgttgctgcagaccgatcgggcgtacgtcgtgatcctgctcgtcaacgccgcgaccttcgtggtcgcggccgccctgctcacccgggccccggccgttcccccgcaggtcaccccgcccggcggcccccgcctcgtcgccctgcgcgaccgcccgttcctggtcttcgccgccgtcgacggactgctctccgccgtctacaacgacctgctcggcatcggcctcccgctgtggctggccgccggcgcccacgccccgctctggttgatctcggtcaccctcgtcatcaacaccgccggctgcgtcctgctccaggtccggaccgcccgcgacgtgcacgacctgcccggcgcccggcgcgccgccgtccgcggctgcctgatcctcgccctgtcctgcgccgtcctcgccgccaccgccggccaccccccatggctggccggcaccctgatcacgctggccgcgatcatccacgtcgtcggcgaactgtggctctccaccggcagctggggcatcgtcttcgcgatcaccccaccctgggcccaggggcagtaccagggcacctacttcgccggccgcggcgtcggcgacatgctcgccccgcccctggtcaccgcctgcgtcctgggcctgcacagcgccggctggctggtcctcgccgccctgttcgccgcgggcggcgccatctatccacccgtcacccgctgggccgccgccaggatcacgagcatcgagcgaactccagctccggcgtag

SEQ ID NO: 5513 - DNA, 120 bp, Actinoplanes utahensis
gtgcccagcggcgcgatgggcgcgggccggcgcccggcgccttcggtgatgatcaggcgggccgcggcgatggcggtcggctgtctgatgcgcctgccttctcccggcactccccgttga

SEQ ID NO: 5514 - DNA, 597 bp, Actinoplanes utahensis
atgttgaagatccgtaccgcggtgttcatggctaccggcgcactcgccgctctcggcgtggcgggcaccgcgctcgcggcggacggggcagacgacacctcggcttcgccctcggcgtcgatggcggcgtcgtacgaccggggcggtgccgccgtgggcgtcgcggaagccaaggcgatcgcgatccgggtcgccgggggcgggtacgtgcgctccgtcgagcgggagaccgagcacggccgtccggtgtgggacgtcgacctgatcgtcggcggcgtggagcacgacgtggacgtggaccgggccagcggcgaggtgctgcgccaccggatcgagggggcgaacggtccggccgcgtcgggcggcgccaccgcggcggcgtctgcgtcggcggacgaccacggccggcaggccgagccgggcgacgacaggggcggcgcgagcacgcggtcgcggcgcgtcgagcccggggacgacaacggtggtgcgggcacgcggcacgccgagcccggcgacgacaagggtggccacgggcgtggcggcgacgaccggggcggcgacgaccggggtggccgggggcgcggctcggacgactga

SEQ ID NO: 5515 - DNA, 195 bp, Actinoplanes utahensis
gtgatcatcgatgattcgtcgccgttctccgatctggacgcctacacggcgctgcctcgcctcggcgggctccgcctctccccggacggccgccgcctggtcgtcggcgtcgccaccccggaccggaagaagaaccggtatgtcagcgccctgtgggagatcgacccggacggcgggcgaccggcccctagctag

SEQ ID NO: 5516 - DNA, 1650 bp, Actinoplanes utahensis
gtggccggcccggacggcacggtggtgaccggcgcgtcggtgctgacctccgccgccgacctggacgccgaccggaagctgcgcgaggggcgccgggacgccggggtctccgcgatcctctacgaggaatatccgatccgccactgggaccacttcatcggggccgaccgcacccgcctgatcgccctcgacctcggcgccgacgctgccgggcagcccgtgccgcgcgatctcaccgggcacgccggacgggccctcggcgaggagccggcctgggacctcagcccggacgggcgcaccctggtggcgctctgggtcgtcgccgagccggccggatcccagcggaccaccctggtcgcgatcgacgtggccaccggcacgcggcgcaccctggccgacgacgaggactacgagtacgacgggccccggatctcgccggacggcacccgggtcgccgtcgtggcgtaccgccgctccaccgcgaccgaccccggtgaccggaagctgatgctcgtcccgctggccggcggcccgcagcggtcgctgaccgaggcgtgggaccgctggccggagacgatccgctgggcgccggacggcgccgcggtcttcgtgaccgccgacgaccaggggcgctgcccgctgtggcgggtgggcgccgacagcggcgaggtgacccggctgaccgacgacgacggcgcctacaccgagttcgaggtggccccggacggctcggcgatctacgcgctgcgctcggcggtcgacgccccgccggccgtggtgcgggtcgccctggacggcggcggggtcgccgagcttccggggccggccgggcggccggtgatccccggacggctgaccgaggtgaccgcgaccgccgaggacgggaccccgctgcgcgcctggctggcgctgccctccacggccaccgcggcggatcccgcgccactgctgctgtggatccacggcggtccgctcgcctcgtggaactcctggcagtggcggtggaacccgtggctcgcggtggcccggggctacgcggtgctgctgcccgacccggcgctgtccaccggttacggcgtcgcgttcatcaggcgcggctggggatcgtggggcgccgccccgtacaccgatctgatggccctgaccgacgccgccgagcagcgccccgacgtcgacgagacgcgcaccgcggcgatgggcggcagtttcggcggctacatgaccaactggatcgccgggcacaccgaccggttcaccgccctggtcacgcacgcctcactgtgggcgctggaccagatgtggggcaccaccgacgcgtcgttctactggatccgggagatgaccggcgaggccgtcccggccaactccccgcacctgtccgccgaccggatcaccaccccgatgctggtcatccacggtgaccgggactaccgcgtcccgatcggcgaaggtttgcgcctctggtgggacctgctctcccggtccaccgccgcggacggctcgtcgccgcacaagttcctgttcttcccggacgagaaccactggatcctgaaaccggcccacacccgggtctggtacgaaaccgtcctcgccttcctcgcccaccacgtccacaaggagccctggagccgccccgaactgctcggctga

SEQ ID NO: 5517 - DNA, 783 bp, Actinoplanes utahensis
gtgcttgcccccggaatcgtgctcaacggccgttatcagctgacccaccggatcgcggccggcgggatgggtgaggtgtggcgcggcggcgaccggctgctgcaccgcgaggtggcggtcaaggtgctgctgccggcgctgatgaacgaccgggacttcatcacccgcttccgttccgaggcccggatgatggcccagctgcggcacccgggcatcgtgcaggtctacgactacggcgagaacgcggtggtcgacggtgagcgcttcgactacctggtgatggagtacatcgacggcacctcactgtcgaagaaggtgcagcaggccggccggctcagcccggccgagacgatggcgatcaccgccggggtcgccgacgcgctgcatgccgcccaccaggccggcatcatccatcgcgacgtcaaacccagcaatctgctcgtgcgacccggcggggcgatcgtcctggtcgacttcggggtcgcccggtcggtggggatcaccgggatcaccggcaccaacgtggtgatgggctcggcgcactacatggcgccggagcaggccgaggggcagccggtgacggcggccaccgacgtgtacgcgctgggcgcggtcgcgttcacctgcctgaccgggcggccgccctacgtcggcgacaacccgctcgcggtgctggcgcagctggtgcacgggcaaccgccggtgctgccgccggacgtgccgcggccggtggcggcggtggtgctgcgggccctcgccaaggatccggcacagcggttctag

SEQ ID NO: 5518 - DNA, 540 bp, Actinoplanes utahensis
gtgatcctggggcgatgttcacacttcgacatgtccgaaatggtacgactgtctggtaccgaccggcgacacctatggatggtcatgaaacgtggagcatggacagtggtcacgctcggcctcgccgccgcgacggtcttcggggctgtgcccgcccgggccgacgagagcaaatccgcggacaagagcgcgacctactgccggctccgggtgcacggtggcatcctgagccactaccgcacgctcggctcggacaaggggcggctcggctgtccgatgggcatcgagcagtccgcggccggcggcgggcggatgcagcagttcgacggtggctcgatctactggtcggcgcagaccggcgcgcacgcggtcgccggccggatcctgcaactgtggcagggcaaccggggcgaggccggctgcgtcggctacccggtcgacgaggagtcggacacgcccgatcaccggggtcgctaccagcatttccagcggggcacgatctggcactggaacgacggccgggtcagcgcggtctgctga

SEQ ID NO: 5519 - DNA, 357 bp, Actinoplanes utahensis
atgggcagccgggtgctcgccgtgcgcgggcgcaccagcggcgaggtgcggaccacgatcgtcaacatgttcacccacgacggcgagcgctacctgctggcgccgcgcggacacacccagtgggtgcgcaacctgcgggtggccggcgagggtgagctgcggctcgggcggcgcagcgagcggttcgtcgcgacggaggtggcggacgcggacaagagcgagctgatccggctctacctgcgcaagtgggcgtgggagaccggcgcgttcttcgacggcctgacagcggattcgccggaggccgacatctcggccgcggctcccggcttcccggtcttccgaatcacggccggctga

SEQ ID NO: 5520 - DNA, 123 bp, Actinoplanes utahensis
gtgactggtgttcactgcttgcaagagagagcactgctctcaaccgaggagactccggaggacgtcatgcgctacctggccccgaaatccgcgacgaacgtcttcaacgacttcgccaagtag

SEQ ID NO: 5521 - DNA, 597 bp, Actinoplanes utahensis
atgcgagtaaacgagacggccgcgacgagagcccgacgggcccagatcgtcacggccgcgatcgacacgatcgccgagctgggatatgccaacgcgtccttcgcccggatcgccagccgggccgggatcagcagcacccggctgatctcgtaccacttcgacgacaaggccgacctggtccgggcggtggtcggcgcggtgctcggcgaggcggccgccttcatgggcgagcggatgcgctcggcgcgcgaccggacgggcctgctcaccgcgtacatccaagcgaatctgatcttcattgcggagcatcccgcggcgatccgggcggtcatcgagatcgccgccgcggcccgcaccggggagggcgccccgctggttgacccggcggacgccgacgacccgggggcccgcctcgccaccatgttccgcgaggggcaggaggccggcgagttccgcaccttcgacccgcacgtcatggcggtcaccctgcgcgccgccatcgacgcggcggccgtccagcccgatctcgacccgcacgcctacgccgcggagctggtcgccctgttcacccgagccatccggaaggacgagctgtga

SEQ ID NO: 5522 - DNA, 642 bp, Actinoplanes utahensis
atggtgaagaccccgtcccgcccgagccggttcgcgccggccctcccgatactgatcgatttcggcctgccgctcgtcgtctactacggactgcgcgcggccggggtcgaccagtggtgggcgttgctgctctccggcgtgatcccggcggtcctggtgatcgtccggttcgcccgcacccgaaccgtcgactacccggccctgttcgtcctcaccatcgtggcgctcagcctgggcgtctcggcgatgaccggtgacgcccgcaccatgctgatccgggatgcctggggtggcctgttcggcggcctgatcggcgtctggctgctggcctcggtgtgggtcggccgccccgcgctgatgtatctggtccgcgccttcgtcctggccaaggtgggcgagccgggcctgcgcgggtgggagaaccgctggcacaccgaccccgggttccggcacggtctgcggacgatcaccttcgtctggggctgcgccagcctgctcaacatgctggtcaccgtgctggcggccgtcctgctgccgctcgacctggcacccgccgtgctcaacgccggctggccggcgatcgccgtgcccaccttcctcttccatctctactacaccaggaagaaggacctgcgagcatga

SEQ ID NO: 5523 - DNA, 1245 bp, Actinoplanes utahensis
atgacgtacgacgtgatcgtcgccggtgccgggccgacggggctgatgctggccggggagctcgcgctgggcggcgcccgggtcgccgtgctggagcggctggcggcccgcaccgggcagtccaaggcgctgaacctgcagccccgctcggccgaggtgctcgcctcccgcgggctgctcgacgacatcctggtgcaggcgccggcgctgttgccgcacgggcacttcgccgggatcccgctggactacagcacgctggacaccccgtacccctttcaggtcggcatcccgcaggcgcgggtcgaggagcggctcgccgcgtgggcgacgtcgctcggggccgagctgcggtacggcaccgcggtcaccaccttcgcgcaggacgacgggggagtgacggtcgacggcgaacgcgcagcgtacctcgtcggctgcgacggggcgcgcagtgtcgtccgcaagcaggccggggtggacttcgtcggtcgcgacgcccgcgtctgtgcactcgtcgcggatgtgaccctggccggtgacggcccggcgggctgggaactgccggcaccgaagggcgacggcatgctgaccgtgctgccgctgggcgacggggtgttccggatgctggccgccgggccggtgcaggcggccgccgggcgcgacgatccgatcccggacagcgagctggccgacgcgctggcccgggacgggctgacgctcgatgcggtccgctgggcgagccggttcaccgacgccacccggcaggccgcacggtatcgacggggccggatcctcctggccggggacgccgcgcacatccactcgccggccggtgggcaggggctgaacctgggcctgcaggacgccttcaacctgggctggaagctcgccgaggtgatccgcggggaatcgggcgacgcgctgctcgacacctaccacgcggagcggcacccggtcgccgcccgggtgttgcaggcgagccgggcgcagggcgtcctgtacatcgcggacgacgacgtgctcgccctgcgcgcgatggtcaccgagttcgtggacacgcaggcgctggcccggcgggtggccggactggaccacggcgaccgcatccccggcctcgacctgacccggctgcacgacggtcgccgccacgtgatcgacggcgtcccggtccgccccgacggcttccgctggtccgcgcccgcctccgccgcggtctccgctcaggcggccgcgaactgggtgcggtag

SEQ ID NO: 5524 - DNA, 1833 bp, Actinoplanes utahensis
atgtaccacgcgatgaaccagcaggacgagaaacgcccgttctccctggccacgttacgcaggatcgcgcgtttcgcccggccgcaccgaagggcgctgaccgggttcctgacgctcagcgtggtcgccgcggtgctcgcggtggccggcccggtgctggccgggcgggtggtggacgcgatcgtcggcggcgccgacaccggcctggtcgtccggctcgcggcggcgatcgcgctggtggcgctcggcgagtccgggctggggctggcgcagcggtggttctcggcccggatcggcgaggggctgatcctggacctgcgcaccacggtcttcgaccacgtgcagcggatgccggtcgcgttcttcacccgcacccggaccggcgcgctggtcagccggctgaacaacgacgtgctgggcgcgcagcgggcgttcagcgacacgctgtccggggtggccggcaacctggtcacgctgatcctcacgctgatcgtgatgatcggcatctcgtggcagatcaccgtgctggcgctgctcctgctgccgatcttcgtctggccggcccggcggatgggcgggcggctggcccggctggagcgggcggcggccgagcacaacgcggcgatgaacacgcagatgaccgagcggttctcggcgccgggcgcgacgctggtgaagctgtacgggcggccggaggcggagtccgccgagttcgcggcccgggcacggcgggagcgggacatcggcgtacgcaccgccatggcgcagtggaccttcatgaccgccctggtgtccgtgtccgggctggcgatcgccctggtctacggcctcggcggctactacgcgctgcgcggcagcctgccggcgggcgacgtggtggcgctggccatcctgctcacccggctgtatgcgccgctcacctcgctggccggcgcccgggtcgagatgatgagcgcgctggtcagcttcgagcgggtgttcgaggtgctcgacctggagccgctgatccgggagaagcccgacgcccgggaggtgccggacggcccggtgtcggtggagttcgacggggtccggttcgcctacccgtcggccgacaaggtttcgctggcctccctggaggaggtggcgacgctggacacccggggcggcagcgaggtgctgcacgacgtcagcttcaccgccgagccgggtcagatggtggcgctggtcggctcgtcgggggccggcaagtcgacgatggccggtctgctcccccggctctacgacgccggggcgggcgcggtgcggctggccggggtggacgtgcgcgacctgtccgcggcgtcgctgcgcgccacgctcggcatggtgacccaggacgggcatctgttccacgattcggtccgggccaatctgcggctcgcccggcccgaggcgaccgaggcggagatgtgggcggtgctgcgccgggcgcatgtcgccgacctggtagccgcgctgccggatgggctggacacggtgatcggcgagcgcggctaccggctctccggcggggaacgccagcggctgaccatcgcccggctgctgctggcccggccgcgggtggtggtcctcgacgaggccaccgcgcacctcgacgcgacttccgagcaggcggtacaggcggcgctcggcgaggccctggccggccggaccgcggtggtgatcgcccaccggttgtccacggtccgggccgccgaccagatcctggtgatcgagcagggccgggtggtggagcgcggcacgcacgagtcgctgctctcctccggcggacgctacgaggagctctaccgcacccagttcgcggccgcctga

SEQ ID NO: 5525 - DNA, 1779 bp, Actinoplanes utahensis
atgccgcgttcgacgtgcccggcggcgatccggatgtcgccgttgccgctgtccggcaggtcgatgtcgcagtgtgcgcgaccttcgtggtcgaaggcgcggtcccagttccaggagaagttcgcgcgggagttcgaggtggtgccgtggatcagcaggatcggggtccggccgttcgccgggtcgccggtgcagtgcagatccgcgggctgccggtgtgccggtgccggcacgagcagcagggcggtggacagcaagatcgcgaggctcacgtggacggcaacgatccgcccgcgccttcggttgccggatccgctccacgaacccgaaattgcccaccagggcggcgcaaccgtggcgaggtgcccgtcccgcgccggaatccggcccggtggggatgaccccaccggaatccgggggccggcccggtgtcggtccgcgcgcgaccgccgtaacttctctgctgtggacaagggattcgccgtcgtgcgcggcctctaccggtgcctgcggctggcggcgctgaccgcggtgctgccgctggtcggcgtgaccgtcgccgggggcggtgcgctgttcgccggcacctggacgcacggcaggcacctgtcctggccgctgcgcaccctgatcggcgccggacaggtgctgatcgtggtcgtctgggtggccgccgccctgtggatcacccacctgctgaccagccgtccgctcgccgggtccgcccggcgtctggccgcccgctggctggaccgcgacctggcggtcacctaccacccgccggccccggtcacccggatggccaccggcttctggtgggacggcagggagtatcacaagacggagcgcgaggcccgccgccgctccgccatgcacgcccgcttccacgatccgcaggtcaccggggacggcatctgggcgctggccgccggcgtgaccgtcttcccggtcaccgtcctgccgccactggccggcacggccggcctgctcgcggccctcgtccggcccgcgtcgtggggcgccgtcgcgatcccgctgggtgtcgtgctgatcctcgccggtggcgcggccgccccgttcgcctggcggatcttccggccggtcgccgaccgcttcctcggccccggcgcccgcatccgcctcggccgccgtgtcgccgagctggagactctgcaggccgacctgaccgagacccaggccgccgagctggaccgcatcgaacgcggcctgcacgacggcgcccaggcccgcctggtcgccatgggcatgtccatgcaggccgccgagcgcatggtcgacaccgacccggcggccgccaaggccctgctcgccgagacccgggccgcctcccgggccgccctggccgagctgcgcctcctggttcgcggcatcaacccgcccgtcctggtcgagcgaggtctcgtcgacgccctgcgcgccctggcgctggatctcccggtcgcgacggaggtgaccgccgccgtcccggcccgccccgaacgccccctggagtcggccctctacttcgccgtcgccgagctgctcaccaacgtcgccaaacacgcccacgcccggcgggtcacggtcgacctggcacatgccggccggacgctcaccgcaaccgtcaccgacgacggcaccggtggcgccgcacccgcgcccggttccggtctgcacggcatccagcggcggctggcggccttcggcggcacgctggagatcgacagccccatcggcgggccgacccgcgctaccgtgtcggtgccatgcgtgttgtga

SEQ ID NO: 5526 - DNA, 663 bp, Actinoplanes utahensis
atgcgtgttgtgatcgccgaagacctgttcctgctccgtgacggcctggtccgcctcgtccaggcctacggccacgaggtgacggccgccgtcgacagcggaccggccgccctcgaagccctgctcaccgagcgtcccgacgtcgccatcctcgacgtccgcctcccgcccaccttctccgacgagggcctgcaggcggccctggcggcccgccgcgagatccccggcctgccggtcctgatcctgtcccagcacgtcgagcagctctacgcccgcgagctgctcgccgacgcgcggggcggcgtgggttaccagctcaaggaccgggtgctcgacgccgacgacttcatcgacgcgctgacccgcgtcgccgccggcggcaccgccctggacccggccgtcgtcgccaagctgctcggccacccccgccgcgccgaccccctggccaccctgaccgagcgggaacgctccgtcctggccctgatggccgagggcatctccaacaccgccatcgccacccgcctgttcctgagcgagggcgccatcagcaaatacaccacgaccatcttcgccaaactccacctgcgccccgacgacaacgacaccaaccgccgcgtccgggccgtcctcacctacctcgccgcggaccgcccggacgactga

SEQ ID NO: 5527 - DNA, 1026 bp, Actinoplanes utahensis
atgaccgatctggaacgccgttacgcccggctgatccactggtgctacccggccgcctaccgccgggcgcgcggcaccgagatcctgggcacctacctggactcggtctccccggaccgccgtcgtcccactctcgccgacaccgtcgacctggtcaccggcggcctccgcgagcgggtccgcgcctgcggcctcgccgacctggcacccggcttccgcctggccggcaccttcgccatgatcaccgccaccgccctggccgccggctggtccgtcgtcgaactcgtccgccgtttcgcctgggacgacccccggccgggcacattcacctcgatcggcatcctggtctgggcgtcgtggctgctcgcgtccgtcgtgcacgtcgccgccccggccagatgggcacgtccggcggtcatcgcggccctgctgatcacggtcgggatcgcgccgctcgccgaccttctcgcccgactccggccgccgctcttcgtcctgcttccgcaagccgcactcggcctgctcgccctggccggtgccggtcgcggccggctcgccgtccgcctgctcccggccgctgccgccgccgcgatcaccgccaccgccctggccgccggggtgctcgccggcccgtacctcgaccctttcatgatctactacagggccgccgaccacgaacttcccgcggccggcacgatcctgctgacggccgccctggccaccgccttcaccctgtcggcccggggcgaccaccggggcgcccaggccctgctggcgctgcccgccccgatcgccctgctggccattcatccgctgaccgcggccatcaccggcaccgccgcgaacgtccccaaccccacctggagttccatggccgcggtggcggtcctcgtcatcgtcgccgccctgaccgtcctgctcatcgcagccaccgcgttgcggcaccgcaccaccgcggctccccccgcccgtccccgatgcccgacgtgtggcgccaaccgcccggccggggcgggccgacgctga

SEQ ID NO: 5528 - DNA, 414 bp, Actinoplanes utahensis
gtggaaacgcctctgcgcgaaccgacgttcctgatcctgaccgccctggccggcgagcccctgcacggctacggcctggtcgccgaggtcagccgcctctccgagggccgcatcacgctgcgccccggcaccctgtacggcgccctggaccgcctcaccgacgccggcctgatcaccgtcgaccgcgaggagaccgtcgacggccggctgcgccgctattaccgcctcaccgaccggggcaccaccctgctcaccgaggagaccgaccgcatgcgccgcaacgtcgaagccgccaccacccgcctccgactcgccccgtcgcccgcccgccggggccgccgcacgccgggcaccaccttcggccggagcctcgcttcgcccggcaccgctctgcgcctcggaggctgggcatga

SEQ ID NO: 5529 - DNA, 1380 bp, Actinoplanes utahensis
gtggcaggtgccgtacggcggggcggacaagaccgtcgacgtacacctgtcgtggttgcgccgcaagctcggcgagaccgcgaccgaaccgcgctacctgcacaccgtccgcggggtcggggtcaagctgagcgagccggcgtgagggcccggctgaccctgctggtcgcggcgaccacggtgctggtgctgctggcctttctggtgccgatcgcgctgctgctgcgtcaggtcgcccaggaccgcgcgctgagccaggccaacacggtggtccgcacgatcgtgccgttcgccgtgggggacgtcccggcgttgcggaccgcggtcaccgggcaggccgtgccggtcaccgtcttccactgggacggcaccgtggtcggcgccccggccacggtcacccccgcggtccggctggccgccgccaaaggccaatcgttcacggtcagcacccccgccggccgcgaggtcgtcgtccccgtggtcggcgcccgcggcaccagcgtcatccggaccgtcgtcgccgatgccgacctgacccgcggcgtctcccgctcctggctcaccctggccggcctcggcgccgccctgctgctgctcggcctgctggtcgccgaccgcctggcgcgcaccatcatcgccccgatcacccagctcagcgcggtctcgcaccgcctggccggcgccgaactcacagcccgcgccgcccccgccggcccacccgagctgcgcgaggtcgccggcgccctgaaccacctggcgacccgcatccaggacctgctcgccgccgaacgggaacggatcgccgacctctcacaccgtctgcgcaccccgctgaccgccctccgcctggaagccgaatccctgcaggatccgaccgaatccgcccgggtcgcggccgccgccgacggcgtcgcccgggccgtcaccgcggccatccagcaggcccggcgcgaggtcacccaccagccggccggttgcgacgccaccgcggtggtcagcgaccgggtcgccttctggcaggtcctcgccgaggacaccggccgcccggtgacccgatcacttccggacactcccctgccggtcgcggtcgccgccgacgacctggccgcggccctggacgcgttgctcggcaacgtcttcgcgcacaccccggacgagaccccgttcgcggtgaccctcaccgcccgcccgggcggcggcgcgaccctgacggtcgccgacgagggccccggcttcccggcctccgccaccacccgcggcgcctcgggcggcgactcgaccggcctcggcctggacatcgcccgccagatcgccaccggcttccacaccgagggcggccccggcggcgccgtcgtccgcctggagctgcccgccccctga

SEQ ID NO: 5530 - DNA, 528 bp, Actinoplanes utahensis
gtgccaggaccatcgctcgccgccgtcgcccgacccgcgaccgacatggacgccgaccggatagcggagatctgcacggccgcgtatcgggctgcctaccgtgagctgctcccgcccggctacatcgagcggaccgccggcatctgtttcggcgcggcccgggtcgcgcgtcaggtgccggccgacccgccgcgctggttcggctaccaggtcgccgaggagggtgaccggctggtcggcgcggccggcggcggcctgacccggcccgggatcggcgagctgcacctgatctatctggatccggcggagcgcggccgcggactgggcacgctgctgctggaccgggtgatcgcgcagatccgggaggccggcggcaccgaggtgtggctgtcggtgttcctcggtgacggccccgggatcggcttctaccgctcacgcggcttccagccgatggcgaccgtgcaggccgatctgtcccgagaggacgatcacatccgcagcctgcggatgcggcgcgcgctgcgataa

SEQ ID NO: 5531 - DNA, 990 bp, Actinoplanes utahensis
gtgcgacggggacccgggcgttatctgtggtggctggccgggcaggtcagggggcggctggcgctcggcatgacgttcggctcgctgtggttcttcagcctggccgcgatgccctggctgatccagcaggcgatcgaccagggggtcacgccgcgccgacccgggccgctggtcgcctggtcgttcggggtgctcgcggtcggcctggcgaatgcgatcctcggcatcctgcgccaccgcaacatgacccggctgcgggtcgacgccgcgctgcgcaccgccgacctggtgctcacccacgcggtccggctcggtgccgcgctgccccgtcggatcaccgcgggcgaggtggtcaccatcggcatctccgacgtgtggcagatcggccgggggatgaacgtgggcggtgtcggcgtcggctcggtgctggcctgcatcacgatcggcgtgctgctcggccacaccgccccgatcctgtccctggtcgtgctggccggggtgccgctgctcgcgctgctggtcatcccgctgctggccggcactcagcgggccggctcgcgataccgggagcgacagggcgcgctgaacgcccggctggtcgacgtgatcggcggcctgcgggtgctgggcgggctcggcggcagtgccacccacctggagcgctatgtgcgcgagtcggcccggctgcgcgatcagggctaccgggtgggccgcccgtccagctgggtgaacgcgctcggcgacgggctgccgatgatcttcctggccggggtggtctgggtcgccgcccggatggcggtgaccggcgagatcaccgtcggcgagctgaccgcggtctacggctacaccgcgctgctggtcatcccggccagtgtgctgatcttctgcggcttcgatctggcgtacggggtggtcggcgcccgccgggtcaccgccttcctgcgcctgccgctggacgacccggccggcgacccgcccctagctagctag

SEQ ID NO: 5532 - DNA, 372 bp, Actinoplanes utahensis
gtggcgcacgacgtggccgacgacctgggccggcacgtcgaaggggacggacgcaacctctccggcggccagcggcagcggctccggctggcccgggcggtgcacgccgacccggagatgctgctgctggccgagcccacctcggcggtcgacgcgcacaccgagtcggccatcgccgaacgcctggccgccgcccgccggggccgcggcaccgtggtcgccaccacctcgccggtgctgctcgaccgcgccgacacggtgcactacctggtcgccggccgggtcgccgccagcggcacacaccgcgagctgctcgacaccgaccccggctaccgcgccctggtcacccgcgtgttcggcgacgaccggtga

SEQ ID NO: 5533 - DNA, 1722 bp, Actinoplanes utahensis
gtgagcgccgccctgccgatcgccgaccagcggcaggtggcccgggccgcgctcgctctgatcgccgccgacaagcgctcggtcgccgcgatgaccctgctgaactcgctggccgcgctcgccggcctcggctcgccgtggctgctcggccgggtgatcgacacggtcgccaccggcggcggggtgcacgcggtcgaccggctggccctggccgtgctcggctgcgcgatcgcccaggtcctgctgtcccggttcgccctcgcactggccttccggttcggcgagcgcacctcggcccggatccgggagacgttcctgcgccgcgcgctgagcctgcccgcctcggtggtcgagcgggtcccggccggcgacctcgcggcccgcggcaccaccgacgtcgacgcggtcgccaccaccctgcgcgacgtgctgcccaggatcctgatcggcctggccgagatggtcttcatcgtggtcgccgtggtgctgctcgacccgctgctcggcatcgtcggcgtgctcggcctctccggcatctggttcgccacccggtggtatctgcgccgcgcccgggacgcctacctgcgcgagggcgagtcgaactcgtggctggccgacgagctggccgcgaccacctccggcgcccgcaccgtcgaggcgttcgggctggccgaccggcggctcgcggccgggcacgcggcgatcgacgagacccgccgcacccgcctgttcacactccgcctgcgcagcgtgttcttcccggtcaccgagaccttctacgcggtgccggtgatgctggtcctgctgctcggcggctacctctacctgcaccaccgggtcagcctcggcaccgtcggcgcggccgtgctctacctgcggcagctgatcaacccactggacacgctgctgatccggatcgagcagctgcagtcggccgcggcgtcgttcgcccgggtcgagggcctggtccggatcgaggcgccgccggtgatccgggaccgcacgccggacggcgaccggatcgaggtccgcgacgtgcggttcgcctacgactccggccgcgacgttctgcacgacatccacttgaccgtacgaccgggggagcggctcgccgtcgtcggcctgtccggggccggcaagtccactctcggccggctgctcgccggcgtcgaccggcccaccgcgggcaccgtcaccgtcggcggggtgccgatcgccggcctgccgcccgagctgctgcgccgccaggtggtcctggtcacccaggatcaccacgtgttccgcgagtcgctgcgggacaacctgatggtcgccgcgccggacgacgagctgcgccgggcactcgccacggtcggcgccacctgggccgacgacctcgaccgtgacctcggcgcgcagccgctggacggggcgcaggcacagcagctggcgctggcccgggtgctgctagccggcccgcacacggtgatcctggacgaggcgaccgcgctgctcgacccgaccgccgcccgcgacgcggaacgggcgctcgcggcggtcctgcacggccgtaccgtgatcgccatcgcccaccgcctgcagaccgcacacgacgcggaccgggtcgcggtgctggacgacggccggatcatcgaactcggcacgcacgacgagctgatcgccgccggcggctcctacgccgcgctgtggcggtcctggcaccgcgccgatcagatgcggtag

SEQ ID NO: 5534 - DNA, 834 bp, Actinoplanes utahensis
atggcctgcagggtggcgcggtccgggtcgccggggaggtcgccggcgagcagttcgcgttcgacggcggcgctgcggcggggcatgatctcccagccggccggggcccggagcatcagctgggccgggaaacggcggtggagggcgtcggcgagcacgtcgccgcaggccgggcagagcaactgcttgcgcaccgtccatcccatgggcccagcctgcaccagttgccccggcggtgccagtcgggttgcgagacggacggatcgggtatccgcatccgtagctgctgatcttcccgcgacgacgcgatcggggggacgacgcgatgcggagcgacgaggcggggggcgccgacggcgaggcgatggcggccgacgacgcgatggcgagcgacgaagggtggcggggatgacgacgccgaacaccgggatcgagctggtgaggctgagcgacagcgaccagatggtcggcgacccggccgaggacgtccgcggccggcaggtgcgggaccgggacgggcacgagctcggccgggtcgacgacctgctgatcgacccggccgagcaccgggtgcggatgctgtgcgtggcgcacggcgggattctcggcttcggcgcgacctcgtcgttcgtgccgatcgaggcgatccgggcgatcgacgacgacgtggtgcacgtgagcgagccgaagcagatcgtggccgaggcgccgcggtacgacccggcgctgatcgacgcgagcgagtactacaacgagttgtaccggcactacgggtacgcgccgttctggagtggcggctacctgtaccccggatatccgtactaccgcatctga

SEQ ID NO: 5535 - DNA, 351 bp, Actinoplanes utahensis
atggaagccgccggcgtcgccaaggccggccacctgaacgcggcgccggtcgcggtgatccgcggcatcagcgacttcgccaacgggacgaaggccgccagcgacggcgcatcctggcagccgcgggccgctgagcacgccgccgccttcgccgccgccctggccgccgagatcaggccgaggcggacggccgcaccgtcggctgcccggcaggcggagccggtgacggtggagaaccacaacaccgtcaccggcaacgcgcgggtcggcatgcaaggcggcaccatcgccggggacgtccacttcggcgccggattctgggacgacgcgacggggagcggccggcgatga

SEQ ID NO: 5536 - DNA, 1251 bp, Actinoplanes utahensis
atgaagtcctcggacaacaggcccccgaccacgaccaccaacaaccatgcgggtgacaacgcccgggtgggattccagggcgtcgttcacggcgacctgaaactcgtggtgccgccggatgccagcccggccgagaagttccaggcggccaaggcgcatctcgacagccggtcgatcaccacggccaggaaactgatggaggaggtcgtgcatgccgggcacacctccgcggagatctggttctactggcttctggcgtacctgagcaggcgtacgctccgcgaactgtcccccaccgagcgggaccgcctggagaaggcgcgcgagaccgccgccggcgtgcccggagccgaccggtggacccgggggatccgggtcatcggccaggtcctggatgccgccgagtcgggggccggccagtccacgtcgatcacggaatgcctgatcggcctggacgacaagccacaggacgagatccatcggcacctcggcctgctgttgcgcgacgcggtccgcaacgacgtgtggcgccaggacatcgcctcggcgatccgcaggcagcgagccgcgaaccgggagaagcgggtatggaagttcttcgagccggatccgcgggcagctcgggtgtatcccctcgcagaccggcccagcgacgctcagatggccgagtggctggactgcgatgttcaggtcctcctggaccagacgatgagccggtaccagctccgcagggacgagatccagacgtatgcctcgctggaggcgcccgggccgaactgccggaatgcccggatacccaacgggccatggcgctattcgacgtaccggatcgtagtttttctactgacccgtgaaggcgtccggcagatcgaggtggatctgagattcgcgcaggggaccttccacagttggaatcgcatgaactaccggttcgaggcggtcgcggcggtccgggtggaggagggcgacgacggcgcccgggacttcgatctctcgctgatcagcggcgagaacgtcgaggtgcgggcgaccgattccacccaggcggacccggcagtcgaggatccgcggatcgtggcggacgcgtcgatggacgcggcgggcctgcgttccacgctgttcatgctggagggtgtcgccgcggaggggcgggcctggtggcatgcgcgtcatccacgctcgtcggatccggacgacgacccggtccgcaggatgggtgggaagagggagaccgccgagccgcgccggtag

SEQ ID NO: 5537 - DNA, 219 bp, Actinoplanes utahensis
atgccggagaagaaatcctggagcgacctcagccgcggccagcaacgcgcgatcatggcgctggccgccgccgagctcgtggtcaccaccgtcgccctcgccgacctgatccgccgccccggcgtccaggtccgcggccgcaaactcgcctggctcccggcccccgccgtgcagccgttcggccccctcgcctacctgcgctggggtcgccgccggtga

SEQ ID NO: 5538 - DNA, 2001 bp, Actinoplanes utahensis
gtgagcagcgtggatcgtcgaagcttcctgcagatgctgggcatgccggcggtggccgccgcgatgcccgcggggctggagaaggccctcgccattccggcgaacaaccgcaccgggtcgatcgaggacgtggagcacgtcatcttcctgatgcaggagaaccgttccttcgaccactatttcggcacgctgcgcggggtgcgtgggttcgccgatccgcatccggcgaccctgccgagcgggaagagcgtgtggcatcagcgcaacggggacggtgaactgctgccgttccggccggatgtgccggacctgggcggctcgttcctcccggacccaccgcacggctgggacgacacgcacggcgcgtggaacggcgggcggtacgacggctgggtgccgaacaagggtgtcgagacgatgacccatcacacccgagccgacctgccgtaccacttcgcgctggccgacgccttcacggtgtgcgacaactaccactgttcgctgctcgggccgaccgacccgaaccggtaccacatgtggaccggctgggtcggcaacgacggcacgggcggcggcccggtgatcaccaacgccgaggcggggtacgactggaccacctacccggagcgcctggagaaggccggcgtctcgtggaaggtctaccaggacgtggggctcgggctgaccgcggccggctcctgggggtggacgtcggacccgttcatcggcaactacggtgacaacgccctgctctacttccaccggtatcagaacgcgcagcccggtgacccgctggcggaccgggcgaagaccggcaccgaggtgaaccgactcggccgcgccccggagcgactgctgaccgatttccgcacagacgtggagaatggcacgctgccgcgggtcacctggatcgtggcgccggaggcgtacaccgagcacccgaactgggagccgcacaacggcgcctggtacatctcgcaggtgatcgacatcctggcgtcgaacccggcgatctggtcgaagatggcgctgttcgtcacgtacgacgaggagggtggcttcttcgaccacctgatcccgccgacccccgacccggcccgttcgaccgtctccacggtcaacgagatcttcaccggggccgggcatccggccgggccgtacgggctgggcatccgggtcccgatgatcgtcgtctcaccgtggacccgcggcggctgggtcaactcgcagaccttcgaccacacctcgctgatccggttcctggagcgccgcttcggcgtcaccgaaccgaacatcacgccctggcggcgggccgtggccggcgacctgaccggtgctttcgacttccgcacgccgaaccggcggccggtggacctgccggacaccgcggcgctgaaaccgtccgacctgacccggcagcccgacctggtcccggtcccaccgaccgaggcgagactgccccggcaggagcgcggtgtacgtcccgcccgggccctgccctacgccctgcacgccgatctcaccggcgacacgctggtgctgcgcaacgtcggccgggccacggcggtcttccacgtccggccctcgggcgccgacccggtgtccttcaccgtcgaaccgggcaagcacctgaccggcgacttcaccgccgccgaggtggaggtgcacggtccgaacggcttctaccgccgcttccggcgcggcacctccccgatcgaaacccgggcgcggtacgtcgaacaccacgacacggtcctcctggagatccggaacaccggccgggaccgcgccgaggtgaccgtttcggatcggtacaccgggcacgcgtcgacgctcaccctgcgcggcggcaccacccgcacctcgcagatcaacaccacgagaacccgcggctggtacgacgtgaccatcaccgtgggtgacaccgtccagcagtacgccgggcacctggagaacggtcgggacagcatcaccgacccgggcatgggcggactgctctga

SEQ ID NO: 5539 - DNA, 231 bp, Actinoplanes utahensis
gtggcgggggctccgaccactcctgatgatctattcgccgtcgccgtcgccgtcgccgtcgccgtcgccgtcgccgccggccaggccgtctcggcggtcgcgggccaggcgatcccgtcactcgcggccggtctcctggtcgccaccgcgacgattgcccggtacgcgtacctcgcccgctgcccggagcaacgcgaaaccaccgatgtgccacgcgccggccgattctga

SEQ ID NO: 5540 - DNA, 3684 bp, Actinoplanes utahensis
gtgagcgagcgcggagagcgtgccgggcggttacgggtggagctgttcggtggtttgcgggtctgccgggatgaagcggatctggcggtgcctggcgcgcggcttcgggggttggtcgtgcggctcgcgctggcagccgggcggccggtcggggccgggacgctggtggactcgctgtggccccgggagcggccggcggatccggcgaacgcgctgcaatcgctggtctcgcggctgcggcgggtgctgggggacgccgaggcggtggcgcaggacgagggcggatatcggcttcgggtcggcgacgacgatgtggacgtggtgcggttcgagcgactggccgggcaggggcggcagcggctgcgggccggggacgcggtcggggcggcggagctgctcggggcggcggtggcgctggtccggggtgggatcgcggccgaggtcggggtggtggccgcggcggtcgggctgcggctggagcggtcggtgggggcggcgttcgccgatgtggcggagagcgatctgctgctcgggcggttcgacgcggcggaggggcggctggtgcggctgctggcggaacatccgctggacgagcgtgtcaccgcgctgctgatggacacgctggcggcgcaggggcggcaggcggatgcgctggcgctctacgagcgggtgcgcgaggaggtggccgagcggctcggggccgatcccggtgcggcgctgcgcgagcggcacctgcgcctgctgcgtggtgagtacggcgacggcacgcgcacgaccggcccggtgggtgcgggccgggccggggtcggacgtggcggctcagcggaagccgaggctgccggccaggcggggagaggtggcggagtctcggccggaccacgaggagccggcgaggcaggggcggggagcgccgacccggtggcaggtgggggtgcccgcggtgtcgggcgggccggcggtggcgccgggcgcgatgcggcggttgacggtgccgctgggcgggcgggtggcctcggcgtaccgggcgatggcggaccggaagaagagagggaacagggcggtagcaaccttccggaaccgttgacgagcttcatcggccgtgaggccgatctggcgcggctcgatgacctgctcgcggccgggcggctcgtcaccgtgctcgggcccggtggggcggggaagactcggctggctacgcaggcggcgcggcggcggcggggggagttccgggacggggtgtggctgatcgatctggcttcggtgacggcgtccggggagttgccggcggcggtgctgacggctaccgggctgcgggcggcggcgatcttcgagggtgggttgcggctggaggggcgcggggacgtcgatgtgctggtggatcagttcgcggggcgggaatgcctgttcgtggtggacaactgcgagcatctgatcgatgcggtggcgcatctgacgacggcgctgctggtgcggtgtccggggttgcggatcctggcgaccagccgggagccgctggcggtcgacggcgaggcgctggtgccgctcggaccgctcggcctgcccgaacagacgccgccgggacatgcggcggccgggcaatcgccgtcgggacatgcggcggccgggcaatcgccgtcgggacatgcggcggccgggcaatcgccgtcgggacatgcggcggccgggcgatcggtgcctcagccgccggcggcggtcgagggcatggacggtgcggtggagcgggcccggcgggcacccgcggtgcgcctgttcgcggagcgcgcggcggcggtgctgcccggtttcgcggtggaccggtcgacggtggcggatgtggtgcagatcgtgcggcgcctcgacgggctgccgctggcgctggagctggccgccgcccggctgcggacgctgggtctgcgggagttggccgacggcctcgatgaccggttccgcctgctgacgacggggagcaggacggcgctgccccggcaccggacgttgcgcgcggtgatcgcctggagctgggagttgctggccgaggacgagcggatcctggccgagcgggtgtcggtgctgcccggtggggtgacggccggttcggcggcggcggtgtgcccgcaggtgcgggcggcgctgatcccggatctgctggccgcgctggtggacaagtcgctgttgcagcgggcgccggacggccgttaccggatgctggagacgttgcgggagtacgggatcgaccggctggcccagcagcacgcgctggtggcgacgcgggggttggcggcgcgtcacctggccggcgtggtggccgagcacgatccgcggttgcggaccgccgagcaactggacgcgttgcgggtgctgcgggccgagtatgacaatgcgctggccgcgctgcggcatctgtgtgacgagcgggatgcggacggcgcgacccggctggcgttgagtctggtctggtactggcagatgttcggccggcatgcggatgcggcgttctggctgcacgaggcgctgagcctgccgggggagcgggatccgctggtcaccgacaccgcggaggcggtgctggcgctgaaccgggtcagtgcggaccgggtgatggtgacggagacggcgcagcagcggcaggatcggctgcgaagtctggcggtgcggctgaaccggcatgccgagctgcccgggatggtcggcgcactgtccacggtggtgctgttcatggcgcaggaggaggcggcggcgcaggagcggatggcgcagctggtgtccggtccggatcagtgggtggcggcgctggcccgattgttccgggcccaggtggcggagaacaacggggatgtggcgcaggtccgggtggatgtgacggatgcgctggccgggttccgggcggccggggaccggtgggggcaggcgaccacgttgccgctgcgggccctgctgcggcagtacgagggtgatctggacggcgcgctggccgacctgaccctggcgaaggcgctggccggcgagttcggttcgctcgacctcggcgatgagatcttcatcgatctacgtcgggccgacctgcacatgcgtcgcggggagccgcaggaggcgctgatcgcggtgcaggcggcgcggctccgggcggcccgggcgatgacgccggagatgatgctgctgatcgatgccctggaggccggcacgatggtcggcatgggggatttcgcccgggccgaggagctggtggcccgggccgagggtggcctgtccggcgggccgggcggcttcttcgacggcgatcacggcacggcgatcgttcagacggtgcgggcgtcgctggcgttgcaccacggtgatccggtgcgggccgaaaaggcgttgatcgcggcgtacgcggcggcacagcagacgcgtgacatgccgatcctgtcgatggtggcggtgggcgccgccgggctggccgatctgctgggccggcatcgggaggcggcgcagctgctgggggcggcggcccggttgcgcgggtcgcacgatccgaccgagttgcaggtggccgagttgacccggcgctgccgggcggcgctgggcgaggacgggttcagcgaggcgtacgcggtgggctggacgatggatccgcacacggcgctggcccgggcggacccgggccagctgcgtgcactggaaggtcaggcgcgcttgttgtag

SEQ ID NO: 5541 - DNA, 822 bp, Actinoplanes utahensis
atgaccgcggcggtcctggacgaagtgacctacaccgatcacgcgcggggcggccccttcctcgccctgatccggcacagcgccgccctggcccagcgcagcctgatcaagaccatccgcacccccgaagccctgatcgacgtgaccatccagccggtcatcttcctgctgatgttcacctacctgttcggcggcgccatcgccggcgtcggcggccggcacacctacctgcagttcctgctgcccggcatgctcgcccagtcgctggcgatgggcgggatcgcgctcggccagaacctcaacgccgacatcgagaagggcgtcttcgaccggttccggtcactgccggtctcccggtccgcacccctggtcggcgcggtcatggcggacatcatccggtacgtcacggtctgcgtggtcaccctgggcatcggcacggtgatgggcttccggatcgagaccgacgccgaagccaccctggccgcggtcgccctcgccatcggcttcggcctctgcttcggctggatctcggtcttcgtcggcatgctcgtgcgcacctcgggcgccgtgcagggcgtgatgttcctgctcgtcttcccgctctcgttcggcagcaacgtgttcgtcaagaccgagaccctgcccggctggctgcaggccttcgtcaaggtcaacccgatcacccacctggtcggcgcggaacgcggcctgctcaccggcggccccgtcgcccaccacctgatcgccaccctggcctggatggcgtgcctgctggtggtcttcgtcccactggcactgcgcgcctacaacaagcgcgcctga

SEQ ID NO: 5542 - DNA, 975 bp, Actinoplanes utahensis
gtggacgatctcgtagtgcgggccgaagggctgcgcaaacgcttcggcaagacacaggcgctcgacggggtggacctggccatgcgccgcggcacggtgctcggcgtgctcggacccaacggggccggcaagaccaccgcggtccgggtgctggccaccctgctgcgcccggacgagggcaccgcgtacgtggccggcatcgacgtgttgcgcgaaccgcagaaggtgcgccgccggatcgggctgaccggccagtacgcgtcggtcgacgaggatctgaccggcacccagaacctggtgctgatcggccggctgctcgacctgaccacccgcgacgccaagaagcgcgccaccgaactgctcgcctggttcgacctgacccaggccgccggccgccccgccaaaacgtactccggtggcatgcgccgccgcctcgacctggccgccagcctcgtcggccaccccgaggtgatcttcctggacgagccgaccaccggcctcgacccggccaagcgcgaagacatgtggggtgtcgtgcgcacccaggtcgcgcagggctccagcgtgctgctcaccacccagtacctggaagaggccgacgcactcgccgacgagatcgtggtcgtcgaccacggtcgggtgatcgcgcaggacaccccggacgggctcaaacgccgggtcggcgggcagaccctacggatccggccggccgacccgggccggctgcccgacgtgctgcgcatcctcgacgcggtcgcctcgcccggcaccaccgccgcgccggacgccacggccggctcccggcccggagccgcctcggtcccggtgaccaccgacaccgcgctcgacgacgtgctgcccgcactgcgccgggccggcatcgaggtcaacgagctcggcctgcacctgcccagcctcgacgaggtgttccacaccctgaccggtggcgagaagaaggatgaggtcctggtatga

SEQ ID NO: 5543 - DNA, 2271 bp, Actinoplanes utahensis
atgcggcgaccgccggggtgggccgcctggctgctcggcggctcggccgccgtggtcgggtacaccctgctgccgtacggctggccgcagttcgtgctgtcctggctggtcgcggtgagcgcgtgcgtgacgctggtggtcggcgcctggcggcaccaccgggagcagctggcggcctggcacgtgttcgccggcggcgcgctgctctggctgggcggcgacctgtattacgcgctgcgcgccgatggcggctatccgacctgggcggacgcgttctacctgggggcgtatccgctgctgctgacggcgctgttccagctgacccgacggcgcgggcccctctggtcgggcaacctgatcgactcggcgatcgtggcgatcagcgtcggcatcgtctactggacgttcgtgatcgagccggtgctggtgaacccggcggtgccgctgctgacccgggcggtgaccgccggctatccggcgatgggggtgctgctctgcgcgctgctggtgccgatgctgttgcgccgcggaccgcggaccgccgcgatgtggctgctcaccgccggcggggtggtgaccatggcggccaacgtggtgtacacgctgctgcccgaggtgttcgccgcgcacgcgacgctggtctacgccggatatctgttcgctgacgtgtgctgggcggcggcggccgcgcatccgggcaaggcggcgggcgtcgtcgaggaggacgacagcctgggctggggccggctgctggtgctgaccgcctcgatgctgctggtgccggcgatcctgttggtgcagggtgagctcggcgtgggccggatgagctggctgaccgtcgggatcgggtcgatggcgttgttcgtgctggtggtgacccggatgtccgggtacatcgcgcgggtccgcagtcaggcccgccggctgcacgacctggcgatgcgtgacgacctgacggggctaccgaaccggcgggcgttcgaggaggaggcggcccgggtggtggccggtggcccgtgccggctcatcatggtcgacctggccgggttcaagcacgtcaacgaccggttgggccgggccgccggcgatcaggcgctggctgcggtcggccggctgctgcgcatgtcgctgcgcgagggtgacgcggtggcccggatgggcgccgacgagttcgccgtgctggcctgcgacacgcagcccggcgacggcgagtcggtggtcgcccggctgctcgacgcgctgcgccgcccgatcgtctccggcgagcaggagctgctgctcaacccacggttcggggtggccgacagcgaggactgcggcgcggtgccggtgcccgagctggtgcgccgcgcggacaccgcccggtatgcggcgaagtcgtccggcgcccagttgatggtctacaccccggagctggacgagcgggccgacgcggccgcctcgctcggcgctgagctgcggcacagcctcgacgacggtgacttccgggtggtctaccagccgatcgtcgacctgcgcagcggccggttcgaggcggtcgaggcgctggtccgctggcagcatccggtgcgcgggttcgtcagcccggccgacttcgtgccggtcgccgaggacaacgggctgatcgtcgagctgggcgagttcgtgatgcggaccgcctgccacaagttcgccggctggcggcgggacctgggggcggacgggcccagctacgtcagcgtgaacgtgtccgcccggcagctgagcgagcccggcttccccgaggtggtcgccgcgatcctcgacgagtgcgggctggccccggccgagttgctggccgaggtgaccgagaccgcgctgttcgggggcggcaccgcggtgcaggcggtggagaccctgcacgcggccggggtgcggatcgccctggacgacttcggcaccgggcactcgtcgctgggcctgctgcgcaccgtcccggtcgacgtgctgaaggtcgacaagtcgttcgtcgacgagatcatcgcgggcgccggccgggcggtgatcgtcgacgcgctgatccacgtcagcaaggggttgcggctgcgggcggtggccgagggggtggagaccgcggagcaggcccggtatctgcgccggctcggctacgagtatgcgcagggttattttttcggccggccggtgccggatccggagttccggccggagttgcgtgacccgctcccggactacgagttcggcggcgagctcggtacgggcgaccgcccggcgttcgccgtcgaccaggtgtag

SEQ ID NO: 5544 - DNA, 828 bp, Actinoplanes utahensis
ttgattcccgccgtcgtgtacgccattccggcgttcctgctgctgatcgtcatggaggtgctgtcgtaccggttcctgcccgatgaccaggagcgcggatacgagacccgggacaccgccaccagcctgtcgatgggcgccgggagccaggtgatcggcattccgtggaaactggtgaccgccttcgcgttcgccggtctctacgtgctcagcccggtcaagctcgacccgcacgactggtgggtctgggtgctgctgttcttcgccgacgatctcgcctattactggttccaccggctgcaccacgaggtacgggtgctctgggccagccacgtggtgcaccattccagccagttctacaacctctccaccgcactgcggcagagctggacgccgatgacctcgaccccgttctggctgggtctggcgctgctcggcattccgccgtggatgatcttcctgcagcagtcgatcagcctggcgtaccagttcttcctgcacaccgagcgggtcgaccggatgtggcggccgatcgagtggttcttcaacaccccgtcgcaccaccgcgtgcaccacggttcgaacgacccctatctggatcgcaactacggcggcatcctgatcgtctgggaccggctgttccgcagtttcgagccggagggcgagcgggtcacctacggcctgaccacgaacatcaccacgttcaacccgttgcgggtggcgacacacgaatacgccgcgatctggcgtgacctgcgctcggcgacctcctggcgggcccgtctcggctacgttttcgggcgccccggctggcagcccgccgcatga

SEQ ID NO: 5545 - DNA, 621 bp, Actinoplanes utahensis
atgagactcaccctcttcgccgccgtcgcgaccaccgagatcatcgcggtggcggcggatctgactccgctgcaatgggcgacgaaaccgctgctcgcgccattgctgatcggatacgtcggcagggcgaaccggctgagcgcggggctggctttcgccttcctcggggacgtcgccctgctgatccccggccagccggccttcctcgccgggatggcctgtttcctcggtgcccagctctgtttcctcacctggttcctgcgcctggcccggccgaagccggccgcctgcatcggctacgcggtcgtctgggccgcggcgaacgccctgctcgggacgcggctcggcgcactgcgcctcccggtcctgatctacagcctggcgctggccgcgatggccgccgccgcgaccggcgtctcccggcgcaccgcgatcggcggcgccctgttcctgctctccgacctgacgatcggggccggcgccgcgggcgtgcacctgccggccgccggggtgctggtgatgaccacctatgcggcggctctcgcgctgatggtcaccggctcggttccggccgggagccaccggcgcgaacggtacgggatggcacgttccggccggtag

SEQ ID NO: 5546 - DNA, 561 bp, Actinoplanes utahensis
gtgccagacgttccggtcgccaaccgccgcccgacccgggccgacgcgcggcgcaactacgacgcgctgctcgccgccgcccgcgagatcttcgccgagagcagcgcggacgcgtcgctggaggagatcgcccgccgcgccggagtgggcatcggcacgctgtaccgcaacttccccacccggcgggatctcttcgaggcggtgtacgtcgaggagatcgagcagttgagcgccgcggccgccgccgccgccgagctgcccccgtgggcggcgctgcgcgcctggctcgatcgtttcgtgggctacgtggtgaccaagcgcgccgtggtcgacgcgctcaaccgcgagtccgatctgttcgcggcgtgccgggtcgccatgtacgcggcgggtgagcccctgatggcgcgggcccgggcggccggcgaggtgcgcgccgacgccagcttcgacgacgtcctgcggatgatctccggtctggtgtccggcgcgttcgtcgacgacgagcagcgcaaccgggtgctgaccttcgccctggacggcatccgcgcgggccgctga

SEQ ID NO: 5547 - DNA, 1434 bp, Actinoplanes utahensis
atgcctcgactttaccaggcgaccccgcgcgtcaccttcacggtgctggccgcggccgccgcggcgttcgccctcatgcagtccctggtcaccccggtcctgcccaccatccagcgggacctgcacaccaccaccggcacggtcacctgggtgctcaccgcctggctgctggccgcctcggtggccaccccgctgatgggccggatcgccgacatgatcggcaaggaccgcaccctcctggtcgccctcgccgccatcgccgcgggctgcctgatcgccgcgctcgctccgaacgtcaccgtcctgatcgccgcccgcgtcgtgcagggcctgggtgccgccgtcttcccggtctcgttcggcatcatccgcgacatctacccaccgcagcgcgtcacctcggcgatcggcatcctggccgccgtcatcgccagcggcagcggcgtcggcatcgtgctggccggcccgatcgtcggcgtcctcgactggcgctggctgttctggatcccgatgatcgcggtcaccctggtcggcctggtcgcctggcgcgtcgtcccgccgtccccggccggcggccgcggccggatcaactggctctccgccgtcctgctcgccggttggctggtcgccctgctgctgccgctgagcaagggcaccgcctggggctgggcctccggccgcacgctgggcctgctcaccgccgccgcggtgctcctggccggctggatgctcagcgagctgcgctccgccgagcccctgatcgacatgcggatgatgcgcctgcccgcggtctggaccaccaacctggtctcgctgctgttcggcgccgccatgttcggtgtcttcgccttcctgccgcagctcatgcaggtcccggccagcagcggctacggcttcggcgccagcgtcaccggggccggcctgctgatgctgccgatgatggtgaccatggcggtgtccggctcgctcagcggcccgctcacccgatgggtcggcaacaaggcccagctgctgatcggcgcggccctcggcgcggtcgccgccctcaccctggcgctcgcgcacagctcgccgtcggtcgtggcggtcaccggcggcgtcttcgggatcggcctcggcctgctctactcctcgatgatcaacctgatcgtgcagagcgtgccgcgcacccagaccggcgtcgccagcggcatgaacaccaacatccgcaccatcggggcgtcgatcggcaccgcgctggtcagcaccgtggtcaccagccaccccgggccgcgcgggctgcccgccgaagccggctacaccgaggcgttcctgctgctcgccgtggccagcgcagccgccttcctggtggcgctgctggtcccggccggccgcaagccggccgtccggccgacgccggtcacggtgcccgagctcaccccggtcgaggtctga

SEQ ID NO: 5548 - DNA, 171 bp, Actinoplanes utahensis
atgagtgatcttgatcctgagggcttcgccgagttcgtgaccaccgacggcccgggttcggcggatgtcgagcagcaggccgaggacgccgagctgatcggggagccgcagccggtgaacgacctcatccagcgctccgccgaggagccggacgagggttcctaccgatag

SEQ ID NO: 5549 - DNA, 1011 bp, Actinoplanes utahensis
gtgtccagcatcagggaattggcacgtcggtgcggcgtatccgtcgccaccgtgtcccgggtcttcaactcaccggaggtggtcagccggcagacccgccagcacgtcctcggcatggccgccgagatcggctacctaccgaacgagtcggcgcgcaccctggccaccaagaagtcccacatggtgggcctggtgtgggacaccgaccaccgccggcccggctggcggcacccgtttctgcaggacatcctggtcgccctcaagggcgcgctcagcgcgcagggcctgcacctgctcatgctcgcgcccgaccagagcgccggaccggtcggccggcagcgcttcctgcgcgcggtgcagcggcacagcgtcgacggcgtggtgatcatcgacaacggcagccgcgatccggccgtgctcgcgctggtcgacgccgaggtgccgtgcgtcgccctggatctgcgcttcaccgggccgacctgcacctacatcacctccgacaatgccggcggcggtcggctggccgcggcgcacctgctcgaacgcggccatcagcggatcgccaccatcaccggtccggagcggaactggccggccggggaacggctcgcggggttccgggcggccctcgccgcggcgggtcgccccctgcccgacgacctcgtggtggccggcgacttctatctcgacagcggtgacgccgccatgaccgcgctgctcagccgggatccgcggcccaccgcggtgttcgccgccggcgacgagatggcggtcggcgcgctgcgcgcggcacaccgggccggcttgcgggtgccgcaggacgtggcgatcgtcggcttcgacgacatcgaactggcggcgctgatccctcccggactcaccaccgtcgcccaggacaagaccggcatcggcacgtccgccgcggaggcgatcgtcgcgatgctctccggcgcgccgacgccggcgccgaccacgctccccaccacgctcatcacgcgcggctccacctga

SEQ ID NO: 5550 - DNA, 1269 bp, Actinoplanes utahensis
atgcgcctgtctcgattcctgcagatggcggcggcggcctcggccgtcgcgatgctggccaccgcctgcggctccgacggcggttccggcggcggtgccggcgacaacgtcacgctgaacgtcagcctgttcggcaacttcgggtaccaggagctctaccagcagtacgagcaggcccacccgaacatcaggatccaggagcggaccgccgactacaacgcgcaccaccgggacctggccacccacctggccaccggctccggcgccgccgacatcgaggcggtcgacaccggcttcatcgcccagatgcgcgcggtcggcaaccagttcaccgacctcgggaccgaccgggcgggcgagtacctgccgtggaagtggcaggcgtcgctgaccaaggacggcaagcagatcggttacggcaccgacgtcggcggcctggccatctgctaccgccgcgacctgttccagcaggccggcctgcccgccgaccgggagcaggtctccgcggcctgggccggcggctgggacaggttcatcgaggtcggcaagaagttcgccgagaaggccccggagggcagcgcgttcttcgacggtggcggcgcgctctacaacgcgatcatcgggcaggcgccggtcggtttctacgactcgaacgacgcgatcgtggtcaactccaaccccgaggtcaagaaggcctgggacctcagcgtgcaggcgatccaggcgaacctctcggccaagctggtggagagctcgccggagtgggacaacggcttcgcgaagagccggttcgccgccatcgcctgccccgcctggatgatggccaagatcaaggaccagtccaaggcgttcgccggcaagtgggacgtcgcgtccgtgcccggcggcggcggcaactggggcgggtcgtacctgaccgttccgaggcagggcaagcacgtcgacgaggccaagaagctggccgcctggctcaccgcccccgagcagcagtccaaggtcttcaccaccaagggcctgctgccctcgatcccgtcgctgtacgacaggccggagatcggcgcgctccaggacccgttcttcaacaacgccccgatcggcaagatcttcaccaccgccgccaagcagctccagccgcagcaccagggcccgcgcgcaggtgacatccagaccgcgattcgcgacggcctgacccgcgtcgagcagggcaaccagacccccgaccagtcctgggcgcagaccctcaaggacgtcgaccgtctcgccaagtag

SEQ ID NO: 5551 - DNA, 915 bp, Actinoplanes utahensis
atggccatcaacgcccgactgacccggctcgacccacaaggctcgccctacctgtacgtactgccgttcttcctgctcttcggggtgttcgggctgttcccgctgatctacacgggctacgtgtcgttcaacgactggaatctgctcgacggcggcgcgcaccagtgggtgggcctggcgaactaccgggagatgctgcaggactcgtacttctggaactcgctcggcaacaccctgagcatctgggtgctctccacggtcccgcagctgctcgccgcgctcgggatcgcgcacctgctcaaccacaagctgcgggcccgcaccagcctgcggatgggggtgctgctgcccaacatcacctcgatcgtggcggtgacgatcgtcttcagccagatcttcggtcgcgacttcggcatggtgaactgggtgctcgggctgctgcacgtcggcccggtcgactggcaggcccactcctggacctcgcacctggccatctccagcatcgtgatctggcgctggaccgggtacaacgcactgatctacctggcctcgatgcaggccatcccgcacgacctgtacgaggcggcggagctcgacggcgcctcctccggccagcagttccggcggatcaccgtgccgatgctgcggcccaccatcatcttcaccacggtcatctccaccatcggcggcctgcagatcatggccgagccgctgctgttcggcggcgactacagccccaccggcggctccgaccggcagttccagaccatcgcgctgttcatgtacgaacaggggttccgcgaattccggttcggctacgcgtcggcgatcgcctggaccctgtgcctgctcatcgcgatcttcgcggtcgccaacttcctgctgacccggcgcatcgccaccgacgaggagtga

SEQ ID NO: 5552 - DNA, 897 bp, Actinoplanes utahensis
gtgaccgcactcgctgacccgccggccacccgcgccacgccgcccgccgttgcgaaacgccggtcccgccgcggtttcggcttcccacggcgcggctccgcctggacgtacgccgcgctgctggccgtcgtggccggctcgctgttcccgctctactggtctttcgtggtggcctcgcagacccgcgaggccgtctcccggacgccaccggccctgatccccggcggccacctgttcgacaacatcgcccgggtcttcgacagcaccgacttcggcacggcgctgctcaactcgttcatcgtcagcggctcgatcaccgtctcggtggtgttcttctcgacgttggccgggttcgccttcgccaagctgaagttccgcggccgtcaggtgctgctggtgctggcgatcgccacctcgatggtgccgcagcagctcggcatcatcccgctctacatgctgatggccaagctgggctggaccgaccagctggccgcggtgatcgtgcccggcctggtcaccgcgttcggcgtcttcttcatgacccagtacctgggccgtgcggtgccggacgagctgctcgaagccggccggatcgacggctgcaccaccttcggcctgtactggcacgtggtgctgccggccgcccgcccggccgccgccgtgctcggcctgttcaccttcatgcaggcctggaacgacttcttctggccgctggtggtgctgcagaacaacgccaccgtccaggtcgcgctctcctcgctggccagcggatacaccaccgactacacgctcaccctgaccggcacgctgctggccacgatgccgatcctggtcgtcttcctggtcctcgggcggcagatcgtcggcgggatcatgcagggggcgatcaagggatga

SEQ ID NO: 5553 - DNA, 1368 bp, Actinoplanes utahensis
atgaccgatccgctggcactgccggactttccggacgggttcctctggggggcggcgaccgccgcgtaccagatcgagggagcggtggccgaggacggccgcggcgactccatctgggacaccttcacccggcggccggaggcgatcgcctccggcgaggtggcctgcgacagctaccaccgctggcgggacgacgtggcgctgctcgacgacctgggcgtggacgcgtaccggttctcgatcgcctggccccgggtgctgccggcgggcaccggtcgggtcaaccggcccggtctggactattacgaccggctggtcgacgcgctgtgcgagcgcggcatccggccgttcgtcacgctgtaccactgggacctgccgcaggcgctggaggacgccggcggctggcgggtccgcgacaccgcggaccgcttcgccgactacgccaccgtggtcgcggaacggctcggtgaccgggtccaggactggatgactctgaacgagccgtactgctcgtcgatcgtcggatacgccgagggccggcatgcccccggcgcggtcgaggggcacggcgcgctcgcggcggcgcaccacctgctggtcgggcacggcacggcggtcgccgcgctgcgggccgccagtccccgggcgcgggtgggcatcacgctgaacctgtcgccgtccgtcccggcgaccggttcagcggccgaccgggccgcggccgaccggatggacctgctgatcaaccggcagttcaccgacccggtgctgggccggcggtaccccgaggggttcgcggcgatgtacgccggggtcagtgacctgtcgttccgccgggacggggatctggagctgatcggggcgccactggacttcctcggcgtcaactactactaccggatccacgccgccgacgcgccgcacacgcaggcggatccggcgctgcgcagcgcctgcgacatcggcgtgcggtcggtggcccgggacggcgtcccggtcaccgacctcgggtggccgatcgaaccgcaggggttgtacgacaccctcgccgggctggccggccggtatgcgggcctgccgccggtctacgtgaccgagaacggggtggcgcaactgcgcgaggggctgggggaggacccggaacggatcgccttcgtggccgggcacctggaggcggcggccaaggcggcggcggaggccgacgtcgacctgcgcggctacttctactggtcgctgatcgacaacttcgagtgggcgcgagggtacgggccgcggttcggcctggtgcacgtcgactatccgaccggggaacggacgccccgggcgagctaccactggctgcgcgagcggctggccgggcgcagcggatag

SEQ ID NO: 5554 - DNA, 462 bp, Actinoplanes utahensis
ttggcccgtttcccggtgcggcgcggtcgtacattggatgccatggagctgcactggtggtcgatcgaggtgctcgacgggccgcggctctccgccgcccgctggcaggattcgtatgggaacgcgctggtcgaggccgccgtcacgcacggggccttcgagtggcagtggcaccggcacacctggggtgtgctgttcgagatcgcgttccggaccgaggaacgcttcgccgactaccgcgatctgccggccgtgcgggccgccctggacgcggtgcccgacccggtcaacggcctgctgatctatccgggccgcggcggcagctccggccgggtccagccgcgccgcccgctgcccagagccggggccggcgccgcgccgatcccggtcgagccgccccgcaccgacgtgcggctcggccccaccgagccgccggtgaccaccgcgggcgtcaccggctga

SEQ ID NO: 5555 - DNA, 666 bp, Actinoplanes utahensis
atgtctgacgctgcccaggagcggcccatccgcgtcgtcatcgccgacgaccagcgcatggtccgcgacggtgtccagctaatgctggagttgatcgacggtgtcgaggtggtcgcgctggccaccgacggcaacgaggcgatcgccgcggtcgccgcgcacgatcccgacgtggtgctgatggacctgcgcatgccgcactgcgacggaaccaccgccacccggcggatccgggccgagcacccgcgcacccaggtgatcgtgctgaccacgttcgccgacgacagcgacgtgctggccgcgctgcgggccggcgcccggggttacctgaccaaggacgccgcggccgaggaggtgcaccgcgccgtgcaccgggtcgccgccgggcacgccgacctggacccgtcggtgcagcggcgcctgctcacctggctgcccgccgggtcacccggcccggccggcgcgggcgcgcagggtctcaccgaacgggagctggacgtgctgcgcctgatcgggtccgggctcaccaacggcgagatcgccgcctacctcaaggtgtcggagtccacggtgaagacgcacgtgaaccacgtgttcgcgaagatcagggtgcgggaccgcgcgcaggccgtcaccttcgccttccgtaacggcatcgcctcgtga

SEQ ID NO: 5556 - DNA, 1005 bp, Actinoplanes utahensis
atgcgtcgcctgtcgccggtcttcgcactgttcttcctcagccccctggtcggggagttctttctgggagacttcgcgatcacgctgttaccgctgatcttcgtgttcgccccgatgtacggcggtgccgcggtgctgatccgcgaggtgacccgccgcaccggccgcggctggccgaccatcgtcaccctggccctcgcctacggggtgctggaggagggcctgatcacccagtccctgttcaacaaggactatctggaccagcatctgctcgaccccggctacatcccggcgatcggcaccgcgctgccctgggtggtgttcgtgctgaccctgcacaccgtatggagcatcagcgtgccgatctccctggtcgaggagagcagcacccggcgcacccggccctggctcggccggatcggactcaccgtgatcacggtgctgatgctgggcggcggcttcgccgtcttcaacgccacgcggaccgaccccagcctcagccacggtttcctggagtcgtcgccgcaggcgctgagcatcgtcgggatcgccgtcgtgctgatcgtggtcgcgttcctgctgccccgcccggccgccaccgaaccggcggcccgcccggtgcccggcaccgcgcccggcccgtgggtggtgttggccaccggcatcctggccggtctcctgttcatgagcgtgacctggtcgatcgtgcccacggtgccgggcgtcgtgctgatgctggtggccacgctcggcaccgccgtggtcgtgtcgcggtgggcacggcgggccggctggggaccgtggcaccggttcgcgatcacggcggcggcgctgttgacgtacacctggcacacgttcttcgcgcacagcgcgggtttcgtgctcgatctgatcagccacctcgtctacgcggccgcggcgctggccatcctctggtacgtggcgcggcggatccgggcgaaggcgccgctcggggagacggaccggctgcacgcggtcggctga

SEQ ID NO: 5557 - DNA, 1917 bp, Actinoplanes utahensis
atgcgtgtccgtaatctcggcatcctcgcccacgtcgacgccggcaagaccaccctgaccgagcgcatcctgttcaccaccggcgccacgcacaagcgcggtgaggtccacgacggcaccaccgtcaccgacttcgacccgcaggagcgcgatcgcggcatcaccatcttcgcggccgcggtcagctgtgactgggccggtcaccggctcaacctgatcgacaccccgggccacgccgacttctccgacgaggtggagcgcgcgctgcgggtcctcgacggcgcaatcgccgtattcgacggggtcgccggcgtggagccgcagtccgaggcggtctggcgcaccgccgaccgctaccgggtgccgcggatcgccttcgtcaacaaactggaccgggccggcgcctcgctgaccgcggtggccgagtcgatgcgcgtccgcctcggcgtggtgccgctgctggtccagttcccgctgggtgcggagggcgccttccgcggcgtcgtcgacctggtcggccggcgcacgctgacctgggccgacggggtgctctcggtgcacgacgggatgccgccggaggcgctgccggcccgccgggagctggaggagcaggtggccgggctgcatccggccgcgttgcaggagtggggcgacatgtcggacgccacgctgcgcgacgccctgcgggacctgacccggtccggcgaggcggtcgtcgtgctgtgcggctccgcctaccgcaaccggggcatcgagccgctgctcgacgccgtcaccgactaccttccggcgccggccgtcccggccggtgccgaccccgtggcgctggtcttcaaggtgcacaccgcgcgggccggccgcctcacctatctgcgcgtctaccagggcacgatcgtgaagggggacaccgtgtgggacgcgggcgccggccgcaccgaacgcatcgcccgcatcctgcgggtgcaggccgaccggcacaccgagatcgaccgggccgccgccggggacatcgtcgcggtcaccggggtcaagcacgctccggtcggcgccaccctgtccagccgggcgcacccggtgcggctggaggcgccgcggatcaccgagccgctggtgtcggtggccgtcgaggcgcgcacccgggcggacgccgagcggttgccgccggcgctcgccgcgctggccgaggaggatccctcgctcagtgtccgggtccatcccgagaccgcccagaccatcctgtccggcctgggggaactgcacctggaggtggccctggagaagctgcggcagcgcaccggcctgcgggtcacggtgggccgcccgcaggtcgcctatcgggagacggtccggcggggcgtgcgggatctcctctaccgccacgtcaagcaggacggtggcgccggtcagttcgcgcacgtcgtgctgaccgtcgccccggccggggacaccggtttcgccttcgagtcggcggtgaccggcggccgggtgccggcggagtacatccgcgcggtcgaggccggctgccgggaggccctcggcgacggcccgctcggcggccacccggtcaccgggctgcgggtcacgctgaccgacggccggacgcatccgaaggactcgtccgagctggccttccgcacggccggcaagctggcgctgcgcgaggcgctgcgggcctgcgtgatggagctgctggaaccggtggccgaggtgacggtgaccgcgcccgcggacacgctgggtgcggtgctcagtgacctggccgcgcgccgggcccaggtgaccgactcgggcgagcggacggtcaccgcgaccgtgccgctggccgggctgtccgggtacgcgacccggctgctcagctgcacccacggccgcggcaccttcaccagccgcccggccggctaccggcccgcggcctga

SEQ ID NO: 5558 - DNA, 612 bp, Actinoplanes utahensis
ttgaccgtcgtcgcggtcgtcgggatcatcggcctggtccggctctggaccaggttcgggcccggctgggcgcaaccggtcaccgggccgctggccgcggccttgttgatcacggtctccggccgcaccgcacggcaggcgggactcaccgtctccggttggcggtacgcggcggcagccgtcgtgctgatcggcgtcggatacgccgtggcggtgcgactgcccgccgcgcggcggttgttccggacgacgtacgaccgcccgtggctgaccgccctgatcgaggtgccgctggccaccgtggtcttcgaggaggtcgccttccgcggggtgctgtggagcctgctcgaccgcgatcacggcgcggtcgcggcgaccgcggtgaccgccgtgctgttcgggctctggcacctcgccccggaacgcccgtggaccgacgcggtggtgaccggggtggccggtgtgctgctcggcgtgctccgggcggtcggcggcggactgctcgccccggcgctggtgcactgggcggtcgacgggatcggcgtgctcgccgcggcccacgtgacgagaaccggggttcagtggggcaggccacaggccggtgccggataa

SEQ ID NO: 5559 - DNA, 1569 bp, Actinoplanes utahensis
ttgacaagccgaaccgaggctgcgccggccaagctcgacgccgccgtcctcaagatcgccggggtcgtcgtcctcggtgcgatcatgtcgatcctcgacgtgaccgtggtcagcgtcgcgctgcccaccttccaacgcgagttcaacgcgacgtacgcgcaggtcgcctggaccatgaccggatacacgttggctctggccacggtcatcccgctgaccggctgggcggccgaccggttcggcaccaaacggctctacatgaccgcgctgctgctgttcaccctcggctcggtgctctgctcgaccgccgacggcatcggccagctcgtcgcctaccgcgtgctgcagggcctcggcggcggcatgctgatgccgctcggcatgacgatcctgacccgcgccgccggcccggagcggatcggccggctgatggccgtgctcggcatcccgatgctgctcggcccgatcggcggaccgatcctcggcggctggctgatcgaggccgccaactggcactggatctttctgatcaacctgccgatcggcgcgatcgccctggtctactcgtggttcgcgctggccaaggacagccccgagccgtccgagtcgttcgacttcctcggcatgctgatgctctcgcccggcctcgccgccttcctgtacggcgtctcctcgctgcccggcgagggcagcttcacggccaccagggtgtgggcgccgatgctggtcggcgggctgctggtgatcgccttcgtgatctactcgttcaagccgaagcacccgctgctcgacctgcgcctgctgcgcaaccggaacctgagcgtcgccaccatcacgctcgccgtgttcaccatcgcgttcatgggcgccggcctgctgttcccgagctacttcctgcaggtgcgcggcgaatccacgctgcacgccggtctgctgatggccccgcagggcatcggcgccatggtcaccatgccgatcgccggcatgctcgccgacaagatcccggtcggccgcacggtgccgttcgcgctgcttctgatcgcggccgggttcttcacgttcacccaggtcggcacggacacgtcgtacgtgctgctgtgcggttcgctcttcgtgatgggcctcggcatgggcggcaccatgatgccgatcatgacctccgcgctgaagacgctcaccagccacgaggtggcccgcggatccacgctgctcaacatcctgcagcagatcgccggctcggtcggcaccgcgatgatgtcggtgatcctgaccaaccagctcaacgactcggcggtggtccccgggatgaccgccccggacggctccccggtcaccgaggccggcgtcgccatcgcctcctggagcgacccgaagatcgcccaggcggttccggccgacctgctgcaccgcggtctggcgttcgttgccgactcgttcgcgacgacgttctgggtcggtttcgcgctgaccctgtcgacgctgatcccggcgttcttcctgccacgcaagcgccaggagtcgcagctcgccgcggacggtgcgccggccgccccggtcatcgtgcactga

SEQ ID NO: 5560 - DNA, 606 bp, Actinoplanes utahensis
atgatccgggtcgtggtggtcagagacgagggatatttcggtgtcccggtgcgcacgttcctggaacccgaaccggacatgcactacgtgaccacgctgccgatcaacggcgagctggcggcacgcgccgcgcagctgtggccggcggtgatcgtcatcgacacggagtacatggtgagtcaggtgctgccgatcgcggacgcgctgcacaccgcgatcccgtcctgcgcgatgctgctgctctgcgacccgtcgaaacggggcatgctgccgccgcggcggtggaacggcgggatgaactttctgaccaagagcgcggcgggggcggcgctggcggattcggtgcggcggctcgcggcgggggagcgggtggtgtcgccgatgctgcaggccgcctcgctgaacaccgatcgggggctgagcacccgggagctcgaggtgctggggctggcggcggagggcgagtcggtcaaggagatcgccgggcggctctatctttccgggggtacggtgcggaactacctgtccgcggtcatctccaagaccggggcgcgcaaccgcctggacgcgatccggatcgcccgcaaagagggctggctgcgatag

SEQ ID NO: 5561 - DNA, 564 bp, Actinoplanes utahensis
atgcttgttgaccgcctggagattccggcacttcccgtcctgctgccgctgggcgccgtcctgatggtgctctcctggtggtggttgcgccggcagggacggctgaccacccgacgcctggtcgtggcatgggcgctgtgctggtatgcggtggccgtcctcggcgccaccatgctgccggcccacctgtcgtgggggccgggcgccgggccgccggccacctaccgcatcctgctggtcccgacgctgagcatgcgccgccgcgacttcgtgctgaacatgatgatgacgctgccgttggccgccctgctgcacctgaacttcggcatcgtcgacagactgtgggtggtccggaccggtttcctgctgagcctgagcatcgagacgacccagctcgtgatgatcctgacggtgcacggcacccgctgggccgacgtcaacgacctgctctccaacacgatcgggacgattgtcggcttcgtggtgtggcaccgcctcatgcgggtggagcgtctccgtgccgcagtgaccggagtggccccgcagacggtgcggcccgggtga

SEQ ID NO: 5562 - DNA, 1122 bp, Actinoplanes utahensis
atgagggtgctgcacgtgatcagcactgcgtccgagggcagcgccgcacatcagctcaggctgctgctgccgcggctgccgcacgacagcgaggtggtgagtctcggccccggcggcctgatcagcggggtgccggtgcatcagctgggtaccgcccgcgatcgggacccggccgcgatcgtccggctgcgcgcactgatccgtcgcggtcactacgatctggtgcacacccacctgtaccgggcctgcgtgcagggacggatcgcggcccggctggccggggtgccgcacatcgtcgccaccgaacaccacctgggccggcccggcgccacccggctcggcccgttctacctgctcagcgaacgcctcggcgagatgaccatcgcggccaccgcgtcgatcgccggacggctgcgcgggtggggcgtgcccgaccggcggatcaccgtcgtcccgcgtgccatcgatcccggcgagtaccggttcgatccggccctgcgcgccgccgcccgccgccgcctcggcgtacccggcggcacggcggtgatcggcgtgaccggccggctgcacccggccaaacgtcacgacctgctgatccgcgcgctcaccgaggtgcccggcgcggtgctgctgctggccggcgacggtccggcccggcccgccctgcaccagttggcgatcatcgagggggtggccgaccgggtgatcttcgcgggcgcggtgcggcatcctcgggagatgctctgcgcgatggacatctacgccagcaccgacccgcacacctggggcctgtccgtgctggaggccatcgcggccgggctgcccgcggtctacgccgcgtgcccgccactggaggaacgccgagccgcccgggcgccggtgcgcggcacctaccggctgtcaccacacgaccgggaatccctgccccgggcgttacgcgcggaggtgctctgcctggcggagcggcgcggcacccggatgccggcacgcacggccgggctccggtacgacgcggatcatctcgccgcgaccgtgggccagatctacgaccggctcacccgggccgcaccgtctgcggggccactccggtcactgcggcacggagacgctccacccgcatga

SEQ ID NO: 5563 - DNA, 1743 bp, Actinoplanes utahensis
atggagttgtccctggtcgcggctgtggtgcacacggtcgccgggctgtggaccgggctgtacaccgggcggtggtcgtacggctgcttcgaagagattctcgctcttgccaagaccgcggcgatcaccacgcccgcggtgttcgtgctggacacgctgctcggccggctggtcccgcggtccgcgatcatcggcgccgggctgaccgggctggtcctcgcggccggtgtccggtatgccgtccgcctgctgcacgaccagcggctgcgcccgcaccaggccggcacccgggtggtggtgatgggcgccggcgagggcgccacccaggtgatccgggccatgctgcgcagcccgtccagtccgtacgtgccggtggcgctgctcgacgacgatccggccaaacgcacccggcagatcatgggcgtcccggtggccggcaaccggcacgcgatggccgaggtggtccgcaacctgcgcgccgacaccgtggtgatcgccatcccgagcgccggcgccgagctgatccgctcgctcaccgacctggccgcgccgctggatgtggacgtcaaggtggtgccccgggtggtcgagctgttcggccgcaccgtgcgggtcgaggacatccgcccggtcagccacgccgatctgctcggccgccgcgagatcagcatcgacctggccgcggtcgccggctacctgcagggccgccgggtgctggtcaccggggccggcggctcgatcggctcggagctgtgccggcaggtcgcccagttcaacccggcgaccctggtgatgctggaccgcgacgagtccggcctgcacgcggtgcagctgtcgctggacggcaagggcatgctcgacgaccgcaacctggtggtcgccgacatccgcgaccagcagcgcctcgacgaggtgttcgccgagcacaagccgcacgtggtgttccacgccgcggcgctcaagcacctgccgctgctggagatgcacccgtccgaggcgctcaagaccaacatcctgggcacctaccagatcctgcagaccgccatccggcacaacgtggaccggctggtcaacatctccaccgacaaggccgccgacccgtgcagcgtgctcggctactccaagcggatcaccgaacggctgaccgcggcggccgacgcggccgcgcccggcacgtacaccagcgtccggttcggcaacgtgctcggcagccgcgggtcggtgctgaccgcgttcgccgcgcaggtcgaggccggcgggccgatcaccgtcaccgatcccgaggtgaaccggtacttcatgaccgtgcaggaggcggtcaagctcgtcgtgcaggccggcgcggtggccagccggggtgaggtgctggtcctcgacatgggcgagccggtgcggatcgcggacgtggccaagcggatcgcggagagtgccggcgggcacatccggatcgtctacaccggtctgcggcccggcgagaagctcgccgaggtgctgctcggaccggacgagccggatcaccggccgaaccatccgctgatctcgcaggcgccggtgccaccgctggacggggcggtgctgtcgctgctcgacccgcgctcgccgcgcgaggacctgatcgcggtgctgcgctggctggccgagagtccggcgctgcccggccgggtcgagaagccgccggcgccgcggtccggtggcagcagacgtcacgccgagttcaccatgcgcctggggcggcacccgtga

SEQ ID NO: 5564 - DNA, 1257 bp, Actinoplanes utahensis
atgcgggtggtcatcgcgggtcagggttatgtcgggctgccgctggccgtccgggcggccgaggccggccaccacgtcgtcggctacgacgtcgacgaggaccggatcaaacgcctggccgccggcgagtcgtacgtcgacgacatcacctccggacagctccagcaggtcctttccggcggcaacttccacccctcggccgacccccggacgtgcgccggcttcgacgtcgccgtgatcgccgtgccgaccccgctccgtgacggcacccccgacctgcgccacatcgaggagtcggcccgcaccctggcccgctacctgcgccccggcgccaccgtcgcgctggagtccaccacctaccccggcaccaccaccgagctggtcggcccgctgctggaggagggttccggcctgatcgccggcgaggacttccacctcggatacagcccggagcggatcgacccgggcaatcggcagtggcacctggccaccaccccgaaggtggtctccgggatcaacccggagtcgctggccagggtgcaggccttctacgcctcggtggtggagaccaccgtgccggtctccgaccccaaggtcgccgagctggccaaactcctggagaacacgttccggcacgtcaacatcgcgctggtcaacgagctcgcggtgtacgcgcacgacctcggcatcgacgtctgggaggcgatcgacgccgcgtcgtcgaagccgttcggctacatgcggttcgtgcccggccccggggtcggcgggcactgcctgccgatcgacccgtcgtacctgtcctggcgggtgcagcggaccctcggccagagtttccgtttcgtcgagctggccaacgacatcaacaaccacatgcccgattacgtcgtacgacggctcgtggtcgccatgaaccgccgccgtcgagcggtcaacgggtccaccgtgctgctgctcggcctggcctacaagaagaacagcggcgacgcccgggagtcgccggcccgccgggtcgccgcgctgctgctggagatgggcgccgaggtgctcgccgccgacccgcacgtggtcgaggacgcgcacgtcgaccagcgggtcacccgggtccgcgccacgcgagaggtgatcgccgcggccgacgccgtggtgctgctcgccgatcacgacgcgttcgacctcgacgaggtggtcgagcacgccacctacgtgctggacacccggcaccggatcaccggaaccaacgtggaatcgatctga

SEQ ID NO: 5565 - DNA, 660 bp, Actinoplanes utahensis
gtggacctcgtacgcccgatctggaatgtcctcaaccaactcgtcgccctggtcgctctccttctgctgtcgccactgatcctcgccgtcgcgctctgggtgcggatcgccgacggcaagggcgtgcttttcgtgcaggcccgggccggaaaggacggccggccgttccggatgctcaaattccggtcgatggtgcacaacagtgtcgcgatgagcgcgcaactcggcatggccgacccgttcggcctgctgcaggacgacccacggatcacccgctgcggccggatcctgcgccgcaccagcctcgacgagctgccccagctgatcaacgtgctgaccggccggatgaacctggtcggcccccggccggacgtgctgccgcaggtggccaactactcggccgaggacgcccggcgcctcgaggtgcggcccgggatcaccggatgggcgcaggtcaacggccgcgacgacatcgactggccggcccggttcgtgctggaccgctggtacatcgaccactggacgccgctgctcgacctgaagatcctcgcgcggacggtgaccgggctgcgccgcgccgagccgccggtgcacgtcgacacgctcaacatcgcccgctccgccgtggacgctacccaggagctgggccgtgccgcctga

SEQ ID NO: 5566 - DNA, 1101 bp, Actinoplanes utahensis
gtgccgcctgaccgggagatcggctccgaattccactgggacccgctcgccctggtcggcgaggaccgcggcggcctgcccggctgggtgccggcgcggcgggaactcttcgccaccggctgcggggcgatccgcgcggtgctgcgcgtgctggccccggccggacggttgcacgtgccgtcgtacttctgcaccggggtcgccgaggcgctcaccgaatgcctgccggtcaccttctaccggcacctgccggacgggcacgggccgcactgggagacgctgcgggtccgcggcggcgacgtggtcctcgcgcagaacctgttcgggtgggacgacaaggcgccctgggacgcctggatccgggcccaccccgggatcgcggtggtcgaggaccactcgcacgatccgttcagcgggtgggcgcgcaacagcatcgcggcgtacgtcgtggcctccctccgcaagaccctgccgctcccggacggcgggctggtgtggtcaccggccggtcgcccgctgcccgcgccggccggtgcggagagccccggcgccgcccagaaactcgccgcgatgctgctcaaggccggctggctggacgggcagccggtacccaaggaggcgttccgggcgctgcagcgacagggtgagggggcgctgctgggcagcgacgggccggccagcacggtgacccgggcggtgctgccgctgctggatgtgctggggatccgcgcggcgagcagccggaacgcgcatgcgctgcggacggcgctgcacggccgttcggccgatgagatcctgggattcgcccggggagcggcggacgtcgcgccgttccgcgtacaactcgcgctgcggtccgaaaaggatcgtgacacgctgctcgcgctgctggccgcggagcggatctacgccccggtgcactggcggcaggaccgcgcccggtggtggagcggcgaccccgaagcggccggcctcgccgaccggatgctcaccctgccggttgatcatcgttgcagctcggacgatgtctcccggatggccgaagtggtcacgtcgcaggcctcgcgcgaatcgaggagcggccatatcatcagggcgtga

SEQ ID NO: 5567 - DNA, 1224 bp, Actinoplanes utahensis
atgaccgccgggggctggatcgcgctgggcatcgccgtcttcggctcgctctgctacgcggccggctcgatcctgcaggccgtcggcgcccggcgcagcaccagcgcggtcaccaccctcggccacccgttgtacctcgtcggcatcggcctcgacatgaccgcgtggctcggctccatggtcgcgctccgccaactcgccgtctacctggtcgaatcggtgctggccggctcgctcgccctgaccgccttcgccgcctgggccttcctcggctccccactgcgcaaacgcgacgtcgcggcgatcggggtgacgatcggcgcgctcgccgggctggccatgtcggccggccagcagcacgtcgtcgccgcctcattcacgctgcggctgagcttcatcggcgcgctgatcgtggtcctcggtctcggcttcgcggccaccaggatcggatcgccgggcctgatcgccaccatcggcggcctctcggtcggcgccgccgccctcggcggacgcgccctgcacctgcccgacgaacagatgcgcaccgtcggctcggccgcgatggcgatcctcggcgagccgttgacgtacgtgctgctgctgttcgccgccaacggcatggtcatgtatgccaacgccctgcagagcggcgaggtcggccgggtcaccgcgatccactggacggccgaggtgatcgccccgtcggtgatcgcgctgaccctgctcggcgacacgttccggcccggctggtggccggtcgccctggccgccgcggtgatcaccgtgggctgcgcggtcgtcctggccagcgccccggcgaccgccaccctcgacgagacggccgcgctgcccgccggcgccgaaccccacgccctcccggccccgcccctcccggtgctgcccggcgcgcccggccatccggtgaccgcgctggtgccgctgcaggcgtggcggctggcgatcccgatcgaggcccgctggccggcgctgcagccgccgctggtccgcggctacggcacggtcgtatggtggggaccgtcgtgggcgccgctgccgatctgggtgccgccggatcgcaccctcgtgccccgcgaccggcccaaactcgccgaccggccgcaacggatctggcccgcccgggtgggcccgcagttgcccgagtcgcgccggccggctcggcatcgcgagatcatcatcccgggccgcgaccgcgacgccgcctga

SEQ ID NO: 5568 - DNA, 711 bp, Actinoplanes utahensis
atggcccatcggtgccaagcccccggccatgtcgaaggggaactcgacgaacggatcgtcggcttctatgagcggctgcgcgcacgattccccgaccatccgccgtacccggacccggatgactgcccgtggatgtcgatgccactggacgtcggcatcgatcacgtgttcatgtgcctgagcttcagtgaacgcagccaccctgcgaccacgctgatcgcggagttggcgaccgagtacgaactgacgctctgggacccgcaggacgggtcggctcaccgtccggtgacagcaccttcccgccaggacgtcgaggcctggtggcgtgatctgctcgacggccggtgcagccgagaggaaacgttcgaccgcgtccgtccgtgggtcgaagacccgcccgatgccgtcgaggatccgatcaccatgatgggtctgcagcaactgcacggcttcgccctgaccgtcgacgggcgtgcgggccatcttcacgacgaccaggaggtccgagccgggttcgagcaatggctcacccacgggacacgattcgacgccgaccccgccggctggcggcgagaccgctatcgccaggcgctcctggcagtcctgcgcgaccaaggccggcagcacgcccggactctcgcgaagcgcatggtggcggcagactggctgtccacggaagacgccgaacagatcctgcgctcacagcactga

SEQ ID NO: 5569 - DNA, 639 bp, Actinoplanes utahensis
atgaccgactgggaccggttccgccacgagatctcgtggttcctcgacgatgggcagaccgcgaccgtgggcgatccgcagccctgggaccgcgagccggtcgacggcctgcccgtcctgtccgcgttgctggcgacggcgacccgcacgccggtcaccgtggacgacgaccacttcgagttgctggcctggggcccgcccgccgagcggcgcggctggctgtgccggcccccgcgcgccgaggcggacctcacggtgccgcgcgtccaccgggacttctgggcggtctgcggcggcctcgtcgagcggttcggcgagccctcgtcctggtgggagaaccagaacgaggtgctcaccgcgcaggccgccgcggagccggtggaggggccgttcgacgcctacgcgtggatctgggagggtgccacgccccttgagccgcgggaccactatccggtcgcggtcgaggccaacggcaacctgacgctggcccggcggaccgacggccggctgctgctcttcgcgccggaccacgccttcgacggggtcaccgcgatcgccgacggactgctcaccatcgacggcgtgccggatctcgccacctggatcgaggtgtgcgccacggcctggctgccggagtag

SEQ ID NO: 5570 - DNA, 423 bp, Actinoplanes utahensis
atggcggagatcctcaccaaggtcggtaaggccgacccttccctcaaccgggtgctcagcgacgaactggacaggttcaatgcggccgcgacgccggaggtcgctccggccgaggaactcacggtccgggtcgagcaggagggcgagctggtcgccggggtctccgggtggacctggggccaggcggccggcatcgggatgacctgggtgcgcgaggatcaccggggcaccggggtcgggacgggggcgatgaccgccttcgagagcgaggcgcgaagccgggggtgcacgcacgtgttcgtcacgtccttcacctttcaggcgccggccttctaccagcggctcggctaccgggagatcttccgctgggagtcggtcccgacgaccggccgggacgacgtccacctgcgcaaggaactctga

SEQ ID NO: 5571 - DNA, 987 bp, Actinoplanes utahensis
gtgggtggacccgccccggatgccctaatgccgtggccggaaatgagccctgggtcatgtcggggcgcgtcggaaaacgcattgtgcccgttcgatggcatcatccgggtcatgatcaccgatgcgcggctgttgacgacgctgacgctggacggcaccgacatgctggtctccgcggacaccggcacggtccgggtcaccgacccgcgcaccggccggccggtcagcgaggcggcgatcggtgggatcaccgcgatcgtggcgtgcccgaccggctggcgggacccggtgatcgcggtcggcgcggacagcgggctgtactgggtcgaggcgcgcaccgggaccgtccggcacgaggagggcggaatcgcggcgatgtccgcgtgggccggcacgctgctggccgccgccgggcacgcgccgggcacgctgctgcgctgggatgccggcaccggcgcccggctggagccgctcggcagccaccaggagccgatcaccgcggtcaccgtcctgcacggcccggtcgtctgcaccggcgaccgcaccggcacgatccagcgctggaacccgcgcaccggcgcccggaccgcgcccgcgctgaccgtcggcgacgaggcggtgctggcgctggccccggccccgctgccggacggccggctgctgatcgccgccgccaccgccgacctgcaccgctgggacgcggtcaccggcgaaccggtgggcgtgccggtggtggtcgacagcaccgcggtgaccacgctgaccgcgaccgtggtcaacgggcgcaccgagctgatcaccgcggggcacgacgaggtggtgcggcgctgggacgcggagaccggcctgccggtgggcgaggcggtgcccggccgctcagccaccgtgctgcgccggcacggggtgctcaccctggcggtcggcaccctggacggccgcctcgacctgcgctcgctcggccagccccatccggaccgtcgcatctga

SEQ ID NO: 5572 - DNA, 3057 bp, Actinoplanes utahensis
gtgcccgcgctgcggaagctcgcgctgggcgccgcggcccgcgccggccgtctccccctcccgatcaccggcctcgcggccgccgaccgccggcacgtctaccgggtgctgcgccgcgatccggtgccggcgctcgccgaccggctgatcggcacggtgcgcgaccacttcggcgacgatgaggccggtgcgctgctggtggcctgcggcccggagaccgtgcgggcgctgctcccccagctggcgcacgccgtccggctggagagcctgaaccgccgccatcccggtgcgctcgccgagcacctcaccgcgacgctggccgcggtcccgccggagcatcggcgtcacgagtgggcacggtcgtccggcgcggtgctcgcgctcgccccggcgcaggctctcgacctgctggagcgatgcgcgccggagaccgagctgcccggccgcctcaccgggtacggcgttctcgccgcccacgaccccgggcgggtggcccgtctcctggccgctccggcacgggccggatggctgcggcaccgcaggctgtcgccgaagctgctgcgccgcctcgccaccctccccgacgatgacgtgatccccctgttccggcacgtccgggagtccgcccccggcttcgccgccctgctgcgagcctttgcgccggcccgccggggcgcgctctacgacgcggcgctcgccgaggtcgacaccacgacgctgatcccggccgacgaggtgatggaggcgctgcccgccaccgtccggatccgcgaggccacccgggtcctcggcctggaccggatccgcgaacaggaatccctggtcctgcactggagcgcgtatctggcctggccgcaggcggccacggcgcaggaggcggcgctgcgctccggggacgccaccgagcgcgcccggggttacacccgcctgatcgccgcggccagccgcgcccgcgaccccgaggcggtggcggcggtggtcgcccgcctgacccggatgcgcaacgaacaggacccggtccgggccaccgcgctgaccgaactcgcccaggtggccgggctgctcaccgccgggtccgcggccgacctcaccacgatcaccaccgacgccgtcgaggcgcgggacgcgtcggcggccaccaccacggccctgagccggctggccaccggaaccctgcagcatcatgtcgatgtgccggccctgcgcgactggtcgctgctcgcgatcgacctggtcagcaccgcggccacggtgccggtgctgcgccgtttcgaccgggtgctgcgccgcggccaggagaccatggtcttcgaccggctccgcccgtgggtcgaggccgccatcgcccggggccgctacgcccccctgttcgcgctcaccgacgcgctcggccgccgcgcccatcacctgccggagctgcagcggatgctgcgcgacacgatcccgggcaccacggcccggatcgcggagacggccatcgcccgctggctcgacgacccgcggcaccgtgccgcgcgggtcgccgaggtgctcgccgcggatccgtcggcggtgctgctcggcccggtctggcggatcgtcgccggcacccgcaccgacctgctggaccgggtactggcccgccgtccgaccggccgcttcgccaacagccgcggccactgggcgccgggcgggccggcccgcccggaccggtggctgccgcgccagcacgcggcgttcgtcgacctgcaggcggcgatcgtggccgatccgggcggcccggtctggtcccggatcgccgcgctgcacatcgcggctccggccggcgatcccggccgcgacctggtcctgcgccatgtggacgcgcccgaggttccgctggccgaggccgcgctcggtgcgctggtctggtcggcccggcccgatctggccctgccggtgctgctccggcacgccgcggacgaccgcgcccgggtcgctctctacgccgccgcccgggcggcgaagcacctgccgcccgccgtcctggcgccaccgctcgaggccctgctgagcacctcggcggtggcgaaggtgaccagccgcaaggaggcggtgcggatcctggcccgctacgggccgccggactcggtgggccggctgctcgccgtcttccaggatccggcgacccatcgcgacatccgcgcggcgatcatcggagccgcccgtcagcgcctggacaccgaaccgagctggaccgtcctcgatctggccgtcgcggcgggccggccccgggaggagcgtcgggcggtcctggccgccgacccgtacctgatcgcggcccggcaccgcccgcggtacgcggccctggtcgtggccgcctgccgcgccgacgatcccgagatccggcgcgaggctttcgcccggttgccgggctggtcgcgctgggcgccggcggccaccgacctgatcgtcgaacgtctcaccgacctggtcgtcgccaccggggacgccgtgacgcccggcctgctgcgggccgccgggccggaggcgctggcccgggccctgtccaccctggtcacccgggaggacgcggagaccggtcccggtgcccccggtggtgaccatccggcccgccgccggatcggcgcactgctgcgcaccgtgggcgcactcgcccgcgccctcccggccgacgccgaccggaccggtctgcgggagccggtccgcgctctcgccgagcatcccggccatctggccgccgccgtcgccaccctggtcacgctgggccggctggacaacctggcggagatcgccgaccgctgcgccgaccggccggtgctcgccgcacgcatcgccgagcgggtcggcgccaggctccgcgaactcccggagtggccggcagtcccggtcctgcaggacctgatcgccaccctggcggcccgcggcgacctgcccggcggcctgttcgcggtcgccctggtccgggccggggactcgttcagctgggccggccgctggcgggacctgctgctgtcgctgcgtgcccaccccgagccggaggtacgcgacgacgcctggtccatcgacatgacgtga

SEQ ID NO: 5573 - DNA, 309 bp, Actinoplanes utahensis
atgaacatcggtacccccgaggatctgcccggtctcgacgagggcacggatcaaaaccggtcggcggtacgtcgacggcccgccacaatgagcgtcatgccgttcaccgcccgcgccgtgcggagcctcctggccaccctcgacccgctccctcaccacgcgcggatgcggcatctggcgcaatgggcccgcacctccccccgggccccggaagtctgcgccgcgctgcgcgccgggaccgaccacgagcgccgcctcgccctgatcgcggacctggcccggggcgacaccgcgggcctagctagctag

SEQ ID NO: 5574 - DNA, 822 bp, Actinoplanes utahensis
atgggggaagtggtgtggctcggccggtacccggtcaagtcgatgtgcggcgaggacctcaccgaagcccacctggacgcctcgggcttcgagggcgaccgccgacatgccgtgctcgacgaggagaccggcctggtcgccagcgcgaagaaccctcgccggtggcgcgccctgctctcgatggccgcccggcacgagccggccggccgggtggtcatcacctgccccgacggcgaacagatccacaccgacgcacccaccgccgaccgcgcactgtcgcgggtcctgggccgccccgtgcgactgaccgccaccctcccgcaggacgcgagcatggagcggctgaccccgccgacagagcccggcgccggcacgatgacccacagcagcctggcggccggcacccccggcaacaccttcgtcgactacgctgccgtccacgtgatcaccaccgccaccctcgacgccctggcccggcggcaccccggcggccgcatggacccgcgacggttccgcccgaacctcgtggtgcacctggacgacgccgcacccttcgcggagaacacctggcaggaccggaccatcaccgtcgcgggccacgccgagatccgcatcgtcacacccaccccgcgctgcgcggtgcccaccctcgcccagggagccgacctgcccgacgacccggatgtgctccgcaccgccgcccggctcaaccgggtcccggtcttcgacctcggcgaactgacctgcgtcggcgcctacggcgcggtccagcgtcacggcccactgcggatcggcgaccgcatcacgatcacccgcaggtga

SEQ ID NO: 5575 - DNA, 2076 bp, Actinoplanes utahensis
atgcaccccggagacgtgggccggcctcggcttcgaccggatggacccggcggccggcaacacccgcctggaagagatcttcgccgggcatctcgacgggcagccgctcgacgacgccggccgcggctggctgaacttccggcgggtcaccacccggcgctgggaccacggcaacgtggtgctgatgggcgacgccgcgcacaccacccacttcgccatcggctccggcacgaaactggcgatgcaggacgcgatggcgctcgccgacgccctggacaccgcgccgcagggtctgccggccgcgctggagcagtacgagcatcggcgcaagaccgcgctggccccgctgcagcgggccgcgcacgccagcagcggatggttcgagcggatgccggactacgccgggctgccggcgaaacggttctcctacgccctgtccaaccggcgcggcgagtacccggcctggcgatacctgttgcacatggcgacccagggcgcactcccgcgcaccatgctgcgctggacgctgtccgcccggcggtggaaccgggcccggcgccgcccgctgcagctcacctaaccctaaggtcggcgaccgccggtccgatggttgcggacatggtgcggaagcgacggacagcgggcttggcggccatcctgttcgtcgccctgtacgtgctgctggtccgggtgctgccgatcccgccggtggtcgccggccggatcagccagtccaccctggccggcatcggggccctggtgtcggtgctctgggcccgcgccgcggcacggtcccgcggccggatccgggccgggctgatcacctggagtgtggccggggccggctgggcgatcggcgaactgttctggctcgccgacggctggcggaccggcaccgccgccatcggggtcgccgccaacctcggcttcagcgccaccatcgtggccgcaccggccgccgcggtgctgctggtcggccgcccgtcggccagcatccgcaccctgttcgacgcgctgatgatcggcatgtcgctgttcttcgtggtgtgggcgctcacgctggggccgcagcatcgatccggcgcggccggggtcggcacggtcgcctacgccaccgctgacgtggtgatcatcagcctggtcctgctgctgctcgccgagagcagcgccacgctgcgggtcccgctggagatcgccgccctcggcatgatcgtccagttcaccgcggacagtgtgtacacctaccagaccatcgccggcacctaccgtttcggcagcctgcccgacctgctctggctactggcctgggtcgccttcgcggtcggcgccccgcaccgcgacgagctgcacggggtcacccggatcggcgacggtggacggccccgcgcctatctcccgtacgtcccgttcctgctcgccttcggcaccggcgtcaccatcctggccaccggcggccacctcgaccgggtcctggccaccctcagcatggccctgaccgccctcgtcgtcctccgccagatgctgatcatcagtgacaaccgccgcctcacccgccaactgtccgccctcgtcgacgacctgcgttaccgcgccgaacacgacgcgctgaccggcctggccaaccgggtccgcttcgaggagtgcaccgaacaggcgctgctgcccggcgcccccggccgggtcgccatcctgctcatcgacctggacggcttcaaaccgatcaacgacacctacggccacccgcgcggcgaccgggtcctcgccgaagtcgccgaacgcctgctgaccgccgccggcccgcacgacgtggtggcccgcctcggcggcgacgaattcgcggtgctgaccaccaccgatccgcagccgctcgccgcccgcctgctggcggcggtggccaccccgttcgacgtcggcccggagacgacgacgatcggcgccagcatcggcgtggcctcctgccgcccgggcacccagggcttcggccaactggtccgtgacgccgacgccgccatgtacgaggccaaacgcaacggccgcaatcgggtggtcatgcagcagccgtccgcggtcggctag

SEQ ID NO: 5576 - DNA, 1023 bp, Actinoplanes utahensis
atgacggcatcgctgctggatccggcggcccgggagtggaaggagacgttgcagcaggtccggcacgacatgtaccacgttcccgactacgtcgtgctggacgcccggctgtacggcggcacgccggccgcgttccacttcgaacgcggcgcccgacggctgctgatcccgctgatcctgcgcgacatcccggatgcggaccggcgcgacgcgctctcgccgtacggctatcccggcccggtcagcgatgccgcgccgcacgagaccgagttctggcgggccgcctgcgcggcgctgtccgagacgctgcgcgaggccggcatcgtctcgctgttcgtccggatgcacccgctgctcgacccgccgtcgccggtgctcggcgaggccggcgcgctggtccggcacggcgagacggtgtcgatggacctgacggtcagcgtcgaggagatgtggcggcagacccgcagcgaccaccgcaaccacatcaaccgggcgaaacgcgccggcacccggatcgtcttcgacgactggagccggctcgccgactgggtcgaggtctaccacgacaacatgcgccgggtcggcgcggccgactactacttcttcacgtacgagcacctcgccgccctgcacgacgcggtcggcgaccggatgcacctcgccgtcgcgctggagggtgacgaggtggtggggggcaacaccttcttcgagtacgacgggatcgccaccggatacgtgtcctccacccgccgcgcgcggggacggtacgccgacgagctgctgtacgactcggtgcggcggtggtgctccgagcgcggcgcacggatcttccacctgggcgggggcaaaggcggcggggaggactcgctgttctcgtacaaggcggggttctcacccagccgccacccgttccacacctggcgcgtggtcaccgaccctacggcgtaccaccgactggtccttcggaagcggcccggcgccgaccccgcggacctgaccggcaccttcccctcttaccgctag

SEQ ID NO: 5577 - DNA, 1137 bp, Actinoplanes utahensis
gtgaataggattccccggcgcaccctgttgctggccggtgccggcatcgcggtcgccgccacggtggccgagagctccgcccggccgtgcaacgccatgccgatcaccgcccagccgccggccgcggcgcccgccgcgaggcgcgccctgaaaccggtcagccactgggccgcggtcttccagcagagttgggactacgagtcggcgaccgcccagccgctgagcctttcccgggacagccaggatcactacgacctggcgtacacgctggacggcaacgtcgcgatgttccgggccaccggcgccacccgctacctggatcgggcgctggcctacgtcgagaacgtggtcgcctcggcggccccgtccacgtcgctgacgcgcagcacgttccgggaccggtaccgcggctgggcgtcgagcaagtccgggcaggacggcgacgaggtgccgctctacgagagctacttctggcggtacggcacccagttgctgaccgcgatgcggcagagtgccgcggtgtggggcgaccccggctaccgcgcccggcacgctcggctgctctcgttcgccgaggtggacgtgttcgagaagtggtacaaccggggcgccgccgacaccatctaccgcgaccgcacccacatggccgcgcactgggcgctgatcgcgctgaacctgggccggctcaccggggacaccgcccgtgccacccggtatcggcaggtgtacaccacgatcggcgggcggatccgcaaccagatgatccgcaacccggtcgagccgaccgcgtacttctggaacgacgtgtggggctccacccgccggcccgggcaggacgtggggcacggcaacggggtgatggcgtacgtggtggaggcccgtgaccagggcaccacctggaacgcggccgacatgaccgcgttcggcaacctgctcaccaaggtgatctggccgggcggcaccacgtaccacggatacgtggacggcacggggatggacaacggctggatcgccgacggcttcgtcaaactcggccgctacgacgcggacgtccagcaccgcctggagtcgtacggcgtggtcaacgaccagttcgccgcgaacatggcgctgaatgcgaagatcctgcgcgcgtga

SEQ ID NO: 5578 - DNA, 1212 bp, Actinoplanes utahensis
atgaggcggatcttcctggcccccggcctgctgctcgtgctgatcggcatcggcggccgcttcaccctggaccgggccggcttccccgatctggcgtgggtcgacctgcgggtcatcggcgtggcggtggccctcgtcgtactcctcatcgatcttgcccggcgccggccgcaaccgcgcgtcggccgggaaggctggctggtcgcggcctcgatcttcctcctgttccagatcgcctcggcgctctggtccccaccggccgcgcgcatcggcccgcagaccgtcgacctgatcctgctcgccgtcctcatcctggccttctattactggacgctgggcgacccggagcgtgccatcctgttcaccttccagctgttctggctcgccgcgatcgtcttcgccctcgccgcgatcttcatcaacggccccggcgagcagggccgctactccgcgttcggcggcggcccgaacgtcttcgtccgcatcgagatcctcggggtgatcagcgcgatcgccatgttcctgtccacccgccggctgctcccgctcctggtcacgccgctgttcctgctggccgcggtgctctccggctcccgcgccgggctgatggccggcggcgcggtcggcctggtcgcgctcgcgaagatccgcggccggctcagggccggcccggtcctggcctgcggcgccttcctgctcaccgccggcctggtcatctggttcgccgcgccgcccgagttcaccagcctgttccaggaacggttcgtccagcagacggtccaggagcagtatctgtccgaccggaccgacatctgggcggccgcgatccggatgttcaccgaccatccgctggccggtgccgggttggacggcttctacggcctgatcggcgtcaatcagatggtggagtatccgcacaactacgtgctggcggtcgccgccgagggcgggctgatcggcctcggcctgctcaccggcgcgctcatactgtggacgaggaccgtacgcggcggcggagcccttccccgtgccaccgggctcgccgtggcggcggccgttttcgtggcgctgagcagccttttctccggggattactacgacgcccggctggcctggacgttcgccgcgatggccgccgcggccgcggtgtcgcgggcccggacggtcccgtccgccgagcccgcccgtgtgaaagaggcggtaggtacgtga

SEQ ID NO: 5579 - DNA, 1251 bp, Actinoplanes utahensis
gtgagtgagctcgccgccgacgtcacccggcaaaaagcgatagtccgcgagcccgccgtccagctgctggcgtcccaggtgctgaccggtgccgtggcgctggccgcgaacatcctgatggtccgctcgatgaccccgacccaccggggcgaggtcgcgctgatgctgcaggtggtctatctggccacccaggtggtgctgctgggcaccgagcgcagcttcgtcgccggctatcacaatgtggcaccggggccggcggtccgcgcgtacgcgaaactgttgctcctgccgtcggcgatcggcctggccgtggcggtgctcttcaccgccacggcggcgcaccaccgcagccccggcccgatgatcgtcacgctgctcgcggtgtacaccgtcgtggaggcgtcggcgctggccagccggtcggtggcgatcgcggtcggccgggtccgggatttcatgatctgccgggtgctcgagtcggtgctgctgctggcgatgctgatcgggctctacgtccaccacacctcgcacccggagatctggttcctggcgtacgtcttcgccggcgccgcacccaccctggcctacctgatcatctggctgcgcctgccgcccgacccggacgccgccccggcccgtcgcgacctgaaccgtcaggtccgccgggagggcctggcgctgttcccggcggccatctcgaacatggcgatgctgcgggtggaccgtctggtcatcccggcgctggcgtcgaccgcggcactcggcctctacaccagtgtcgcgaccatgaccgagctgctggcctggccgatccgggcgtacgccgattcccggctgggccactggcgcgccgcgcaccgggacggctcgctgcggccccggccgatcgtgctggccgtcgcggtgtattcactggtggtggtcccgttcgtggccggcgcgctgtacctgctgatcgtcccggtgttcgggcaccagtacgcggcggcccgggacgtggtgctgccgctggtggtcgccgccggcctgtacgcggtgtcccgggtcagcctcgggctgctgatcgccaaggggcacagcaagctggtgtcggtcgccgagatcgtcgggttcgtcgtcagcttcgcggtgtacctgctgctgatcccgcggcggggcatcctcggggcggcctacggctcgctggccgggtacggcgcctgcctgctcttcgccctgctcagcacctacgccgtgcgggaccgccgatga

SEQ ID NO: 5580 - DNA, 1455 bp, Actinoplanes utahensis
atggaactgcgtgcgtacgcccgcgcctgccgccgccggtggctctggctgctgatcccggtcctgctgtccgccggcatcgcggccggtctggcgttgagcgcgccggccgcctaccggtcgtcgatgatcctgttcgcctcggccggcggcggtgacccggacgccgaggcgcgccggctcaactcgtacatcgccctgctcaccggcccccgggtggcccagggcgtggtcgcccggctgggctccgggcagatcaccgccgacgaggtgcggcagagcctgtccgcgcaggtcagcgagggcaccgacctgctggagatcgcggccgtcgacccgtccgcggcgcggagccgggagatcgtcaccaccgccgcgaccgtgctggtcaccctggccaagcagatcaccccggcgaacccggacggcacaccggccgcggccatctccatcctgcaggacgccgaaaccacccgtcagcccggcaacctggcccgcaacaccggcttcgccgcggtgctcggcctgctgctcggggcgatcgcggtggcgatccgggaggccgccggccggaccgtggccgaggaggacgacctgcgccggctcggcctgggcacggtgggggtgatctcgctggacgggcggcacgggcgcggcgatcatccggaccagacgctcgccgaggcgttccggcggctgcgcagcgtgctgccggggatcaccgacggcgcccgcggcaacccgcgcggccgggcactgttgctggccgggccgggccgcaaggagggcaccacagcggtctcctgcgggctggcgatcgcgctggccgagaccggggcccgggtcgtcctggtcgacgccaacctgcgcacgcccggaatcggccgttatctgtcgctcgacccggcgccggggctggccgaggtgctggccggctcggcccgggtgccggacgtgctgcacgagtcgctgaacgggcggctcaccgtgctgccggccggggagcaggtgcccgacccgggtggcctgctcgcctcgccccggctgccggccaccgtgcgctccctgaccgagcagttcgacgtggtgctgctcgacgcgccgccgctgaacgggccggccgacgccgcggtgctcggccgggtgaccgacagcgcgctgctggtggtccgggccggccgtacccgcaccgccgacgtggagaagtcggtggagttgctcacccggatcggcgcgaagctggccggagcggtactcaacgccctgccgcgcaagctgccgaccggtgagcactgggcgacggcggcccgggtggccccggccgacgagctgatcccgctggaggaaccggagccggccatcgcgaaaggcgtggtccgcggccgcgcccgggtggtgaaggcggcgctggccggcgagacgtcggagccagaggagccgacggacggtgagtga

SEQ ID NO: 5581 - DNA, 1248 bp, Actinoplanes utahensis
atgcgcgtcgtctacatccaccagtattactgcaacccccggatggccgggggcatccgctcctacgagcaggcgagacggctggtggcccgggggcacacggtcgacgtgatcaccaccgacatcaccccgggcgagcgtgggctcggctggaaggtcacccacgacgacggggtgaccgtgcactggttccgggtcccctacaacaaccacatgtcgtacgcgcggcggctgcgcgctttcgccgagttcatggtcctcgccacggcgcgggccacccggctcagcgcggacctggtcttcgcgaccagcacgccgctcaccgtcgcggtacccggcgtactcgccgctcggctgcgccgggtgccgttcgtcttcgaggtccgtgacctgtggccggaggtgccgatcgagatgggcgcgctgcgcaacccggtggcccgcgggctggccggggcgctggcgaacttcgcgtaccgcaacgcgtccgaggtgatcgccctgtcccccgggatggcgatgggggtgaaccggcgccggcccagcgccccggtcaccgtggtgcccaacgccgccgacatggacctgttcgcggtggacccggccgcggtgcgccggttccgggaggaccaccgctggctcggggaccggccgctgatcgtctacaccggtgcgctgggcgcggtcaacggggtcgactacctggtccgggcgaccgcccggatgtgtgaacgggatccggacatccaggtgctgatcgtcgggcacggccgggagtgggagagcaccggacggctcgccgccgacctcgggctgctcgaccgcaacgtccggatgtgggagaaggtgccgaagtcggagctgccggtgatcctgggcgccgcgaccatgtcgaccagcatggtccggccgatccgcgggctgtgggacaactcggccaacaagttcttcgacgcgctcgcggccggtcggccgatcgccatcaactacggcggctggcaggccgacctgctccgggacaccggcgccgggctggtgctcgaccccggcaatccggccgccgccggagatctgatggcttcccgggtacgcgatgaggactggctggatcgggcccgctccgccgcgcatcggctggccgtcgagcggttctcccgggatctgctcttcgaccgtttcgaggcggtgctggagcggtccacgcgccgcgcggcggccggccgggccgtgctgtccgggcagtcctag

SEQ ID NO: 5582 - DNA, 1134 bp, Actinoplanes utahensis
atgactgagccgcggatctacctcagcccgccggacgtcaccgacgtcgagcgcaaactgttgctggacgcgttcgactcgaactgggtggccccggtcggcccggatctggacgcgttcgagcagaagtgcgcggagctggtcggcgtccggcacgcggtggcgctcagcagcggcaccgcggccctgcatctggcgttgatcgcggccggggtacgccgtggcgacaccgtcctgatcccgtcgttcacgttcgcggccaccgccaacgcggtgatgtatctcggcgcccgcccggtcttcctggacagcacccgggagagctggaacgtcgacccgcagatcctcgccgacgagttgcgcggccggtcggtccgcggtcagctgccccgcgcggtgatcgccgtcgacatgtacgggcagtgcgccgactaccggccgatcctggaggcctgcgaccggtacggggtgccgctgatcgaggatgccgccgaggcgctgggcgcgacctaccggggccgcccggccgggtcgttcgggctggccggggtgctgtccttcaacggcaacaagatcgtcaccaccggcggcggcggggtgctggtcaccgacgacggttcggtggcccggcaggcccggcacctgtccacccaggcccgggagccggtggcgcactacgagcaccgggtggtcggctacaactaccggctcagcaacctgctggccgcggtcggccggggtcagctgcagcggctgccggcgatgatcgaggctcgccgggtcaccttcgagcactatcgggccgccctcggcgacctgcccggggtgagcttccagccggtcgccggctacggcgtgccgaactggtggctgagctgcctgctggtggcgaccaccgggctgcgcgaccggatcgtcgccgcgctcgccgcgcagcacatcgaggcacggcccacctggaagccgatgcacctgcagccggtctaccgcgactgtgtgatgcgcggtggcgaggtcagcgccgatcttttccaccgcgggctgtgcctgcccagcggttccgccctctccgggcacgaccgggaacgtgtcgtggccgccgtccgctcggttgccgccgagcagaagggatga

SEQ ID NO: 5583 - DNA, 771 bp, Actinoplanes utahensis
atggagccgccgacggcgatcaagcgacgtctcaacgagttgggcatacgcagccgcctccgggcgcggccgcgggcacagggccgggtgctcgccccggccggactgttccgccgcctgcccagcgcccccggcctctacttccccttctaccacgacgtgctgcccgagtacgccgacgatctccgccaccacctgcgcaccctgcgccggctcggcccgatggtcggctgggaggaggcgctcgcggtgctggccggcgaccgcccgctgaccggtccgatgttctgcctgtccttcgacgacggtcacctgagctggcgggacgtggtcgtcccggtgctccgggagctgtccgtgccggccatgttcttcctcaccaccgggctggtcggccagcccgggaacctgtcctgggcggactgccgggagatccggcaggccggattcggcttcggttcgcacaccctgacccaccaccggctggccgaccaggacgagcgggaggcgcgccgggagatcgccgactcgaagcgggagatggaggacgagttgggcgtaccggtgctggacttcgccgcgccgtacggcaatccggcggtcgactacaccgagcgcgacgtgcgggtggcccgggaggcgggctaccgcagtttcgccagcacccggcggccggccatgcacaccggcgactccccgatgtggatccaccggcaggggctgcatccggcctggccgatcatggcggtgcggacccgggtccatgactga

SEQ ID NO: 5584 - DNA, 1011 bp, Actinoplanes utahensis
atgcttcgtctgcagcgggtcgagccggctccggccgtccacgccgaccgtgcgacctacccggaccgccttctcttccacacacccgagtggctcgccttcgtcgccgaatgccagggcgccgagccggtgcttgccaccgtcagcgatggtggggtgacggtgggtcacttcaccgggcttctcgtccgccgctacggtctccgcatcctgggcagcccgatggccggctggaccacgtcctacctgggtttcaacctcaaacccggagtgtcgcgccgggacgcgctgggcgcgctgacccgattcgccttcgacgacctcggctgcgcccacctcgaagtccgtgaccggggcgccaccgaggccgatctggccggcaccagcctgcgctgggacgccgcgcccaccgcggtgatcgacctgcggccgggcgaggacgccctcttcggcgcgatggccagcgcctgccggcgcaatatccgcaaagccgccaagtccggggtgaccgtcgaggaagcggacgccgacccggcattcgccgacgaattctacgaccaattgcgggacgttttcgcgaaacagaatctggttcccacctattccgtggaacgggtcaagtcgttgatccgacacctcgccccggccggccggatcagcctgctgcgcgcccgtgacccggccggccggtgcgtcgcgacggcggtcctgccgtgggcgcaccggaccatgtacttctggggtggggccagctatcgggaacaccagcacctgcggcccaacgaggcgctgatctggtacgcgctgcggtgggccaaggcgcgcggggtgaccgaattcgacttcgtgggaggcaacccgtacaaggccaagtacgggaccaccgaggtggcggtgccctgggcacgtcagtcgcggtcgccgctggtggccacactgcgggacaccgccaagcaggcgtacgcctggaaacagcgaaccgccgcgcggctgacccacctgccccgctag

SEQ ID NO: 5585 - DNA, 480 bp, Actinoplanes utahensis
ttgctgctgggggccggagggccggtaatgcgcaagcgtgtcgacttcgctgtgatcgcactggtggcggtcgccgggctggccgccggctgcggtgacacgggaagcagcggatcgaagtccccggtgacgcggagtccgaccgtgacggtcacggtgggtgattgggcgtccccgacggtcgagtcggtgacgtcctcgacgcccccggtgcggatgtcttccgccaccgcggtcgggaccccggcggatggaccgcccagcgcaacggtgagctcgacgctgccgaacctgccgccctaccggccgccgacgaccgggaagccgctgcgcccgaccggtccgatcaccccgccgccgccgatcatcgccgaggatccggccgacggcgggcgcagccagcggcaccggaccccggaggcgcaccatcagcgccccgtgaccgacgaaccagccacggaccgtccgggaagctcctga

SEQ ID NO: 5586 - DNA, 666 bp, Actinoplanes utahensis
atgacgacgatcggactcatcggcagtgggaacatcggtggcaccgtggcgcggcttgcggtggccgccgggtatgacgtggtgctcagcaactcgcgcgggccggagacgctgcagggcctggtgagcgagctcgggccgaaggcgcgggcggctacggcggcggaggcggccgcggcgggcgacatcgtggtggtcacggtgccgctgaaggcttacccgcaggttccggtggagccgctcgcgggcaaggtcgtgatcgacacgaacaactactacccggagcgggacgggcagatcgcggccctggacagcgatgagagcaccaccggggagctgctgcagcgccaccttcccgagagcaaggtggtgaagggcttcaacaacatctggttcgggcacctggctcagctcgggcgcccctccggcgcggcggaccggaccgcgctgccgatcgccggtgacgattccgcggcgaagctcgtggtcatcgagttcctcgaccagatcggctacgacgcggtggacgtcggcccgctcgccgagaactggcgcacccagcgggacaccccggtctacgtcaccccgtacggcccgttcggcggcgccccgacgcccgccggcaccgacgtcgtccgcaaggcggtcgccgaagccaagcgctga

SEQ ID NO: 5587 - DNA, 1557 bp, Actinoplanes utahensis
gtggacgcgccgctgcccggtggggtggtctttgccgcgacctcgccggggtctgccgcaccgagcggtcgtgccaccaggccggggctgcgggcgctcctcgacgcgtacttcgcggcgccggatgcgatcgcccggctgcagcagttccacgacgcgctggccgcgcagcaaccgccggccggcgagctgcgtcccaccctgcgccggctgctgctgaccggcgacgacgggatgcgcgagcggatccgactgaccggccggtgcctgatcggcgccgccaccgagctgttcccggcccaggccgggctggccatgctcgccgaggccggcgagccgatcgacgccgcgccgatccgcctcctcggccgcctagacccactcagccacgccgccatcgcggccctcgaagcgctgggcgcctccaccgacctgatctggctcgccgaccgctcctcccgggtccaccgccacttcatcgcccgcgccctctgccgcctcgccgacccaccggccgtcgcctggctccgcgcccgcgccgccgccgacgaacgcggcgtcacccccctggcccgcgacgccatcgacgtcatcgacctggccgccgaactcaccaccaccccacccttgcgagcggtgccgcctccgcccacccccgctccgccggccgccgatcccacgctcgccggtcccgcaccaccacccgccgcgcccacggccccggcctcgctgtctccggctgccctgtccgcggcttcgctatcggctgagacctgggaacgggccgcgcgtctggttcttcggctcggccggccgcatgactacagccgggggttcgacgagttccaccagctcgtgcggctggcccgcgcggtcgcccggcatgccccgcacctgccgggcaccccggcgcgctggtccctgatcgcccagctggccaccgaactcagcaccggccggatagcgtgcgccgactggtccaccggggacccggcggctgagggaatcgccgataccggcagcccagccgtccacggtgccggcagtgacagcactccgggcccggacaggttcgcgggcgaccggcaaagtctggtcgccgcgctgaccggtcgtctcccggtgggtcacggacctgggccgtccaccttcgatgtccggcgggagccggtgccgcccaccggctttcacatccgggtggtcgccgccgatccggacgagggtctgccggccgaaacccggatcgtcgtcgacggccgtccggtgatccccgccgccttccaccgggggccaccgaacccgccgaagttcctcctggcccagggccagttacgcgccgaccccgagccacaggaggtgcagcttgccgaggcctggtgcaccgaaggctgctgcggtgccctctacgtcaccatcgtccgcgacccggagtccgatcaggtcacctggcatgactggcgtggccacaccaccccggaacctccgccgagcctccacttccccggcgaggaatacgacgccgagctggcccgcgccacccaccgcctgtttccgtaa

SEQ ID NO: 5588 - DNA, 702 bp, Actinoplanes utahensis
atgcgcgaagtggcggagttcggccgccggctggcggccgccggctgggcaagcgacctgctggtggccggctcgctcgcgaccggcgattacctcaccggggtcagcgacctcgacctggtggcgatcgtgccgaccgagcccgatccggatcagatcgcggcggtgcacgcagggtgcgacccggcgctgaaactgggctgtgtctacgtccccgcggaccggctggccgacccgaccgcggaccatcccacgtggacgcacgggcggttggtgcggcgcatcctgtccggcgttacccgggctgagctggtccgacatggatatgccgtgttcggccgggcaccgggtgagctgctggcggcgatgagcgacgacgacgtacgggccgccgcccacgccgaactcaccggatactgggcgtgggccgggcatcgaccgtggatcttcctggacccggcgatggccgatctcgccctcacctcgatggcccgggggcggcattcgctcatccacggaacgctgctgaccaagagcgcggcggtggcggccgcggccgggccgccatggctgatcgcccagctgcgcgcccgccgccaggggcagcgggtggcctccccgcgcctgcggacggcctggctggcctggcgcgacacccggcggacggtgcgcggcgtcctgccgccccggcggggcaggtga

SEQ ID NO: 5589 - DNA, 1497 bp, Actinoplanes utahensis
gtgaccgaacggtacgtggtcgccatcgaccaggggaccacctcgacccggtgcatcgtcttcgaccggcgcggccagctggtctccctggcccagcaggagcacaagcagcacttcccgcggccgggctgggtggaacacgacgccatggaaatctggcgcaacgtggaacggctcgcgccgcgggcgctgcgccgggccgggatcacgctcgaccaggtggcggcggtggggatcgccaaccagcgggagacgacggtgatctgggaccggctcaccgggatcccggtggggcgggcgatcatctggcaggacacgcggacggacgctctggtgcactcgttgtcctcgtcgccgctctccccccatgtctccgacatctcaggtctgccgctggcgacgtatttctccgcgccacggctgcggtggatgctggaccatacgcccggattgcaggatcgtgcggaacgcggcgaggtgctctgcggcaccatggagacctggctgatctggaacctgacccgcggcgcgcacgtcaccgacgtcaccaacgccagccgcaccatgctgatggacgtccacaccctcgactggtcggacaaggcgctcgacttcttcggcataccgcgcgcgatgctgcccgaggtcagggcctcgatcggcgccttcggcaccgcttgcgaggcatttcccggcgtacgcatcggggccgcgctgggtgaccagcaggcagccctgttcgggcagacgtgcttcacccccggcgaggcgaaatgcacgtacggcaccgggagcttcctgctcctgaacaccggcaccgaactggtgcggccgggacacggcctgctcagcacggtggcctaccaggtggccgggtcgccggcctgctacgccctggaaggctcgatcgcgatcaccggatcactcgtgcaatggttccgcgaccagctcgaactcatctccagcgcacccgagatcgaaacgctggcacggaccgtggccgacaacggcggctgctacatcgtgccggcgttctccgggctgtacgcgccgcactggcgctccgaggcgcgcggcgtgatcgtggggctgacctcgtacatcaccaagggtcatctggcccgggcggtgctcgaagcgaccgcgtggcagacccgggaggtcgtcgacgcgatgaacgccacctccggcctcgcgctgaccaccctcaaagtggacggcgggatgaccgccgacaacctgctcatgcagatgatcgcggacgtgctcgacgtgccggtggtgcggcccctcgccgcggagacggtgtcgctgggcgcggcgtacgcggccgggctcgccgtcggatactggcccgacctggacggactgcggcgcaactggcacatcgccggacagtggatgccggcgatggacccggcggtgcgcaacgccgaatacgtcaactggcagcgcgcggtgcaacggaccttcgactggatccagcccactccatga

SEQ ID NO: 5590 - DNA, 891 bp, Actinoplanes utahensis
gtgcggccatgctccctccttcgtccgatgcccttggacgctaggaagaccggtggccgggagcaacgaacagcggtcggcattgtcgaacatcaattacggcgggtcgtggctcaaccgcatagagtgcgaaccatgccgggccccgtgcagtccatcgagcgagcggccgcgatcctgcggatgctcgccggcgggccgggccggctcgggctcaccgagatcgcccggtccctggacctggccaaaggcaccacccacgggatcctgcggacgctgcagggggtgggcttcgtcgagcaggaccggacctccgggcagtaccagctcggcgcggccctgctgcacctgggcaccagctatctggacatcaacgagctgcggtcccgatcgatcaactgggccgatccgctcgcggcgcgcagcggggaggcggtccggatcgggaccgtctgcgagggtcaggtgctggtcgtgcaccacgtgttccggccggatgacacgttccagacgctggacgtcgggagcctcctgccgttgcacgcgacggcgctcgggaaggtgctcatcgcgtaccgcgcaggcgtcctcgactctgcaccgtcgccttacacccggaagacgatcgtcacgccgcgggagctcgccgcggcgctggagcaggtgcgggagtgcggctgggcggccgacgtcgaggagttcaccctcgggctggccgccgtcgccgcaccgatccgcggttacggcgggctggtgatcggcgcgatcggcgtgtccgggccggtcgaacggatctgcgacagccactacaccccacggccgcacctggtcaccagtgtgcgggacgcggcgcgggcgatctcccgggaaatgggagcggcccgccgatga

SEQ ID NO: 5591 - DNA, 837 bp, Actinoplanes utahensis
atggccgcacgactcaaagttcccggactgctcggtgagcttctcgcggagttcgccggcacgttgattctgatcctgttcggctgcggggtggtggcccaggtggtggccgccggcatcggtgaccacgacagcatcgcctgggcctggggcctgggcgtcaccctcggcgtgtacgtggcggcgcggatcagcggcgcccatctcaacccggcggtgaccatcgcgctcgccgtcttcaagggcttctcctggcgcaaggtggccccgtacgcactggcccagttcctcggcgcgttcgtcgccgcgctgctggtgcgctggaactacaccgaggtgctcaacgccaaggaccccgggctgaccatcaagacccagggtgtcttctccacgctgcccggcaacggcagcctgccggtcgggcactggggcgcgttccgtgaccagatcatcggcaccgcgatcctgctgttcgtcatcctcgcgctgaccgacatggccaacaccgcgcccggtgcgaacctgggaccgttcgtggtcggcctgctggtggtcgcgatcgggatggcctggggcaccgacgccggatacgcgatcaacccggcccgcgacttcgggccgcgcctggcgagtttcttcaccgggtactcgaccgcgttccgagatcagacaggctatctctacttctggataccgatcgtcgccccgatcatcggtggtgtgctgggcgccggtctgtaccagtatctgatcggacgattcctgccgacggacgagccccaggaggtgggcgagatcccgacggcgcgtgagagcttggaggcgaaccgtggctga

SEQ ID NO: 5592 - DNA, 1518 bp, Actinoplanes utahensis
gtggctgacttcgtcggggccgtggaccagggcaccaccagcacccgtttcatgatcttcgaccatggcggcaacgaggtggcccgccaccagctcgagcacgagcagatcctgccgcaggccggctgggtcgagcacaacccgatcgagatctgggagcgcaccgtcgcggtggtccgcaccgcgatgcagaaggccaacctgagcgcgagtgacctggccgcggtcgggatcaccaaccagcgggagaccgcggtgatgtgggaccggcggaccggccggccctactacaatgcgatcgtctggcaggacacccgtaccgaccggatcgcctccgcgctggaccgcgacggccgcggcgacgtcatccgccgcaaggccgggctgccgccggccacctacttctccggcggcaagatccagtggatcctggagaacgtcgacggggtccgcgaggcggccgagcgcggcgacgcgatcttcggcaacaccgacagctggctgctgtggaacatgaccggcggggcggacggcggcaaccacgtcaccgacgtgaccaacgccagccgcaccatgctgatgaacctggagaccctgcagtgggacgacgagctgctgtcgttcttcaacatcccgcggcagatgctgccggagatccggccgtcgtccgacccgaccgggtacggcgtggcccgggtcgccggcccgctcggcggcgaagtcccgatcaccggcgacctcggcgaccagcaggcggccaccgtcgggcaggtgtgtttcgcgcccggcgaggccaagaacacgtacggcaccggcaatttcatgctgctgaacaccgggacgaacctggtgcggtcggagcacgggctgctcaccacggtctgctacaaactgggtgacgcggcaccggtctacgcactggagggctccatcgcggtcaccggatcggccgtgcagtggctgcgcgaccagctgcacctgatcacgtcggcggaccagagcgaggcgttggccgcgcaggtcccggacagcggcggggtgtacttcgtacccgcgttctccggtctgttcgctccctactggcggtccgacgcccgcggcgcgatcgtcgggctgtcccggttcaacaccgacgcgcacatcgcccgcgccaccctcgagtcgatctgctaccagacccgggacgtggtcgacgcgatggcccaggactccggcgtgaccctggacgtgctcaaggtcgacggcgggatcaccgccaacaacctgtgcatgcagatccaggcggacgtgctgggcgtgccggtcagccggccggtggtcgccgagaccacggcactcggcgcggcgtacgcggccgggttggcggtcggcttctggaagtccaccgacgagctgcgggagaactggaacgagtcgcagcgctggcagccgacctggtcggccgagcggcgcgaccagggtcacggccgctggaagaaggcggtgcagcggaccctcgactgggtggacgtggactga

SEQ ID NO: 5593 - DNA, 1692 bp, Actinoplanes utahensis
atgacagtgctctcacctgagcgtcgggacgccgccctggccgccctcgcagcggccgaggtcgacgtgctggtcatcggtgggggagtggtcggggcgggttgcgccctcgacgcggtcacgcgggggctctccgtgggactcgtcgaggcgcgcgacttcgcctcgggcacgtccagccggtccagcaaactgatccacggcggcctgcgctatctggagatgctcgacttcgggctggtccacgaggcgctgcgggaacgcgggctgatcctgtcccggctcgccccgcacctggcccgcccggtccggttcctgtacccgctgcagcaccgcggctgggagcggctgtacaccggggccggtgtcgccctgtacgacacgatggcctggtcgggcagcctgccgaaccaccggcacctgacccggcgcggtgcgctgcgggcctgcccggcgctgcgcaaggagtcgctggtcggggcgctgcagtactacgacgcgcaggtcgacgacgcccggcacacgatgttcctggcccgcaccgcggcggcgtacggcgcgcacgtcgccaaccgggtcgaggtcgtcggattcctgcgcgagggcgaacgcgtcaccggggtgaccgttcgtgacctggaatacgaccgcaccttcgagatccgcgcccagcaggtgatcaacgcgaccggggtgtggaccgacgagacccagtcgctcgtgggtgagcgcggccagttccacgtgcgggcgtcgaaggggatccacctcgtcgtaccgcgggaccggatccagtcgaccaccgggctcatcctgcggacggccagcagcgtgctgttcgtgatcccgtgggggcggcactggatcgtcggcaccaccgacaccgactgggcgctggacaaggcgcacccggcggcgtccgcgaaggacatcgactacctgctcaccgaggtcaacaaggtgctggcccggccgttggaacgggccgacgtgcaaggggtgtacgccggattgcggccgctgctctccggcgaatccgagtcgacgtcgaagctgtcccgggaacacatggtgggcagcccggtgccggggctggtcgtggtggccggcggaaaatacacgacataccgtgtcatggcgaaggacgcggtggatgcctgcgccttcaacctgaaccggtccgtcgcccgctgctgcaccgaccggatcccgctgctcggcgccgaaggctatccggcactgtggaaccggcgcggcctgatcgccgccggatccggcttgcacatcgcccgtgtcgaacacctgctcggccgatacggatcattgatccacgacctgctcgcgctgatcgaggacgacccgacgctgggccggccactgaccggtgcggacgattacctgcgagccgaagtcgtctacgccgcggccgccgagggtgcccgccacctggtcgacgtcctcacccgccgcacccgcatctcgatcgagaccttcgaccggggcacgtcctcggcggccgaagccgccgaactgatggcccgcgtgctcggctggacccccgcccaacgcgaccgcgaggtggagaactaccgcctgcgcgtcgaagccgaacgcgcctcccaggaacaacagaccgacgaaaccgccgacgccacccgcctcggcgcccctgacgtgatccccctttcctga

SEQ ID NO: 5594 - DNA, 642 bp, Actinoplanes utahensis
atggacgccagcaccgaggaactgcgggacgcccacgacgtcctctccgagttctatgcgacgcatctggccggggtcctcgacaccatgcccgtcgagcgcgccatgctgaacctgttcgccgaactcaccctgaccgtcggcaccgaggtcgcggacgtgggttgcggcaccggccgcctcctgccctacctggcggatcgcggcctgaccccgcgcggggtggacctctccccgaagatgatcgaggtggccgagcgcgagcatcccggcttcccctacgcggtcgccgacctgcgcgacctccccttcgacgacgcgacgctggccggggtggtgtgctggttctcgctgatcttcctggccccgccggcccggacgccggccttcaccgaactggcccgcgtcctgaaacccggcggctatctggtgaccgccttcaagcacggcgacgggacccgccgccgcaccggccgcagcaacagcctcggggtcgacttcgaccgctattggctctcccccgaggagatgacggcgcgtttcacgcaggccggcctctcgccggtcttccagggccacgtcccgcccgaggagaacgacccgccctacggctacatgctggtccgcagaattaccggctga

SEQ ID NO: 5595 - DNA, 585 bp, Actinoplanes utahensis
gtgaccagcagttccaccccgccccgccgccgggacgcggcccgcacccggcagctcctgctcgatgccgcccgccgccgcttcgccaccatcggctacgcggaaaccaccgtccgccacatcgccgacgaggccggcgtcaacgtcgcgctgatcagccgctacttcgtctcgaaggagggcctcttcgaggccgccctcaccgccagcttcaccgagctgcgcgccgccgccggtgacgtcgacccggcccgcatcccggaaaccatcgccgagcagatcatcggccagtccagcaataccggccccagccacgccctcctgctcatcctgcgctcctccggcgaggagcgagccgaccggatccgcctccgcttcctgcacatgttcgccgaaaagctctccgaggccgcttccctgcagggcggcgaccccgacaccctgcgagcccagatcctcctctccaccgccatcggcgccaccctcctgcgcgccaccaacctggagccgctggcctccgcctccgccgccgatctcaccggcccgctccgcgacgtcctccaagccttgatcaaagtcacctag

SEQ ID NO: 5596 - DNA, 777 bp, Actinoplanes utahensis
gtgaagtttctcagcatcgtcaccgccctgctcgccctgaccgccgcaccggcctcggccaccgcccggacgcagtcctatgtcgcgctcggcgactcctatgccgcgggcatcggcgccggcgactacaccggttcggcctgcgtgcagagcaggaccggcgcctacccgtacctctgggccaaggcgcaccccaccgcgaagctgaccttccgcgcctgcagcggcgccaccaccgccaccgtcctggccacccagctcggcagcctctcgaagagcacccgctgggtcaccgtcaccgcgggcggcaacgacgccggcttcgccaccaccctgcagacctgcctgctcggcagcgatgccgactgctccgccgcggtccagcagagcacgaagatcatccggtcggcgctgcccacggccgcggacacgctctacaccgcgatccgcaagaaagcacccaacgcccgggtgtacgtcgtcggctacccccacctgctcagcaccggcggcggcaccgggtgcgtcttcgaccccacccgccgccagttgctgaacagcacctcggacaccctggccacggtgctccggcagcacaccgcacaccgcaagaacttcaccttcgtcgacggccgcacgatcctcgccgggcacgaggtctgcaccgcgcacccgtggatccacggcctggccaccggcgacctgaccgagtccttccacccgaccgcggccgggcatcaggcgtacgccaaggccctcaccaaagtcatgagctga

SEQ ID NO: 5597 - DNA, 2124 bp, Actinoplanes utahensis
atgacaaagagattggtgctcgccgccgtgaccagcctcgcgctggccggcgcgggcgtggccgggatcagcctggccggcacggccagcgccgccgtgtcgctcaacaacagcgacgtcaccgcgaacctgtgggagtggaacttcgactccgtggcagccgcctgcaccagccagctcggcccggccggatacggcgcggtccaggtcgccccgccgcaggagtcggtcaccctcgcctcgaccagcgacggcgcccacccgtggtgggaggtgtaccagccggtgtcgtacgacgtctccggccggctcggcacccaggcgcagttcaccagcatggtcaccacctgccacaacgccggcgtacgcgtctacgtggatgcggtgatcaaccacatggccggctcgaacaacacggggggcagcggctacggcggctcgacgttcaacgcgaccggatactcgtacccggccgtgccgtactcgtacaacgacttccaccacccgaacgacggctactgcaacgacgacgacggccagatcgacgactactcgaacgccgccgaggtgcagaactgcgagctggtgtcgctctccgacctcaagtcgcaggacaccggcgtccgcacgaagatcgccggatacctgaacaagctggtcgactggggggtcgacggcttccgggtggacgccgccaagcacatggccgccgccgacctgtcggcgatcaaggcgctgctgcacaacaccaccgagggcaggagcccgtacttcgcccaggaggtgatcccgggcggcagcggcgccatcgccccgtccgcgtacaccgggatcggcgacgtgctcggcttctcctacgcctacgggctgaagacccagttcgccaacggcacgctgtccaacctgtccggcatcccgtcgtggagcctcgacgcgaccagcgaccagaccgctgccatggtgaccaaccacgacctggagcgcaacggctcgaccctgcgttaccaggacggcagcacgtatctgctggccaactacttcctgctggcctacccctacggccagccgttcgtgtacgacggtttcgccttctccacctcggccaccggcgcgtccccgcccgccgacgccaacggctacgtgacctcgaccagctgcaccaacggtgcctggcagtgcaccacccagagcgccggggtcaagggcatggtcgcctggcacaacgccacccggtcggcgaccaccgtgtcgaactggaccaacaccgccagcaacgtgatcggtttcagccggggctcgctcggctggttcggcgtcaaccggtccggcagcgcgtcgaccgcgacctacaccaccgggctggccgacggcgcgtaccgcgaccggatcgccggcacgacgatcaccgtctccggcggtagggcctcggtgaccatcccggcgaacggggcggtggcgatcgacgtcaacgccaggtccggctcctcggcgtcgccgtcgacgtcgccgtcggtgtccacctctcccaccagctccaccggcacggtccaggccacgttcaacgtctacgccgccacgactgcgggcacttcggtgtacgtcgtgggctccaccgccgcgctcggcaactgggacaccgcgaaggcggtggccctgtccgccggcggatacccgatctggtcgtcgacggtcgcggtgccgtccgggtcgagtttcgagtacaagtacctcaagaaggacgccgccgggaacgtcacctgggagagcaacgcgaaccgcgcggtgaccaccggcagctcggcggtgaccttcaccaacagcttcggggtcgccaacgccggcgcgaccgcggtcaccttcaccgagtcggcgaccgggaccgggctgtacgtggtgggttcgatcgcctcgctgggcagctggaacacggccgacgcgatcccgctgacatcgaccggggcgtccggctggagccggctggtggcccttccgcagcgcaccaccttccagtacaagtacctcaggaaggactcgtccgggaccgtgacgtgggagtccggcagcaaccgctcgtacacgacgggcaccgcgtcctcgtacacgatcagcgacacctggaagtag

SEQ ID NO: 5598 - DNA, 339 bp, Actinoplanes utahensis
gtgatcgagctggtctccgcggaccgctgcgtgacatgtgacgtgtgcatcgcggtctgcccgacgaacgtgttcgaccgcggtgcggacggtgtaccggtgatcgcccggcacggcgactgccagacctgcttcatgtgtgaggcgcactgcccggccgacgcgctgttcgtggcgccgctgcggaccccggccgagcccgggtcgccgctgcgcgacgaggcgcacctgaccgcgcgggggctgctcggcagttaccgcaaggagatcggctggggccggggccgcaagcccggcgcacgtctggcagtgggaccggagctgggcccgccatcctga

SEQ ID NO: 5599 - DNA, 1581 bp, Actinoplanes utahensis
atgcctaccgaacccaccccgctcgacctcaccgccgacgtcgtcgtcgccggcggtggaccggccggcgcctgggccgctctcaccgcggctcaggccggtgccgacgtgctgctgctcgacaagggttactgcgggaccagcgggccgaccgcgtccggcggcaccggtgtctggtatgtgcagcccgacccggaccagcgcgagaaggcgatggccagccgcgaggcgctcggcggccacctcgccgaccggcgctgggcggcccgggtgctggaccagaccttcgagaacatgaaccggctggcggtcgaggcccgctacccgttcccggaggtcggcggcgagccgtaccgacgcggcgtgcagggcccggagtacatgcggcggatgcgctcctggattcgccgggccggggtgcgcatcctcgaccacagcccggtgctggagctgctcaccgacccgggcggcacggttgccggggtgcgcgggcaccggcgccagcacgacaccgcataccgggtgcgggccggggcggtggtgctggcgaccggcgggtgcgcgttcctgagcggggcgctgggctgcgacgtggacaccggggacggcgcgctctacgccgccgaggccggggccgagctgtccgggatggagttctccaacgcgtacgggatcgcccccgcgttctcctcggtgaccaagacggcgtactacaacttcgccaccttctaccgcgccgacggcagccacctggcgggcgcgagcagccagggcgggcgctcggtgatcgccgccgagctgctgcgcggcgggaccgtcctgtgcagcatcgaccgggccgacgccgggcagcaggcgcagatgcggatcgggcagccgaacttcttcctccccttcgaccggctcggcatcgacccgttcaccgagcgcttcccggtgacgctgctgctggagggcacggtccggggcaccggcgggatccggatcgccggcgacgactgcgccaccacggtgcccgggctgtacgcggccggggacgccgcgacccgggagctgatctgcggcgggttcaccggcgggggcagccacaactcggcatgggcgatgtcgtcggggacctgggcgggccggggcgccgcacgcttcgcggccgggctcggcgcgggctcgcaccggcggcggctggtgtccgcgggcgcggacgggccgccccaggcggacgcgagcggggcactcgaggtggtgcgcgcgcaggtccacccgtacgacaagaattatctgcggcacggcgaccggttgcgacccgccctcgacgagttgaacggcgtctggtcggcgctgcgcggcagcgccggcgcccgcggcgcgcaagcggtccgcacccggcaggccgccgcgatggtggcgcacgcccggtggatgtacaccagcgcgctggcgcgcaccgagagccgcgggatggcgcggcgcgaggacttcccggccctcgacccggcccagcaccaccgcctgaccgtgggtggtctcgatgacctgtgggtacggcccgagcaggccgccgtgcgggcggtggcgtcgtga

SEQ ID NO: 5600 - DNA, 192 bp, Actinoplanes utahensis
atggagggccggctgggcgcccaccgggccgcggcaccttcgtcaccgtcccccagaacggtccagccgctggccctgcgcagccacaccgaatcgctgcacgggacgggccgcaacccggcccgctcgcgctgcccggcccgctcgcgctgcccggcccgcctcgcgctgcccggcccgctagctagctag

SEQ ID NO: 5601 - DNA, 558 bp, Actinoplanes utahensis
atgacgaaacgcctgatggttgttctggccgcgatcgtggcggtgctggtgccggcggcgccggcgttggcgcacaatccgctggtgggggcggtgccggcgaaaaacgcgacggtcacggcggcgcccgccgaggtgaagctgaccttcctggagaaactcgacccggcgaccaccaaactgaccgttaccggaccggacggggccgcggtggccgagccggtggtgaccgggaagtcggttacggtgagtttcgggacgccactgggcaacgggaagtacaccgtggcgtaccagctgaccgcggacgacggtgacgtgatcaagagttcgtacacgttcacggtggccgtggcccaggccagcccctccgcggccgcctccgacgcgccgatcgcggcggtcagcgtggtcccggcggtgaccgtggcggctccggcggcaccctcgcaggacaaggggaacggcccgtggctgggcctggccgccggaatcggggtgctggtgctcctcggcgccggcatcttcgtgttcctgcggcggcgccgcaccacctag

SEQ ID NO: 5602 - DNA, 633 bp, Actinoplanes utahensis
atgtccgacgagaagcccaccaccccgatcccggtgaccccggcgcacgccgaaccggtcgccgaacccgtcgccgagccggtggcggagccggtggccgccaccccggccgctcagccgccctacgtctccacggtcgccggtgggcagcccgcgaccccgcccccgcccccgccgcccggctgggcctacgtgcccgcgggtgcccagctcccgccgcccccgccgggctacgcctacgtcccggccggcccgcagcagtcgccgcgcaccccgtggcgtggccgtcgcgtcccgctgctgaccaccgttgccgccctgctcctgggctgcctgctcggcgtcggcgtcaccgcggtcgccggtttcgccttcggtcaccaccgggacggcggcggccacggccagttcaacggccggggcggcgacggccggggcggttccgggcggggcggcgacgggcgcggcaacggcccctacggcaaccggggcggcttcgagggcaaccgcggcggtgacttcggcccggggcagcgcggcaatgggcgtacgcccgacaatcagaccgtgccggtcaacccgccgtcgggcgcgccgcagtccgcgaccccgacgccgagcgcgtcccgctga

SEQ ID NO: 5603 - DNA, 1062 bp, Actinoplanes utahensis
gtgaagcgctcgacgctgcgcaagaccgtactgacgctcgccgctctcgctgccggcctcggcatcgcgacggccgcgccggcctcggcccaggccgcgccgaccaccgccaagaccaccaccaaggagtgcgtcaccggcgccaagctggtcccgacctgcggcgtgctgtggggcgccgcggccggcggcttcaccggcaagccgcgcgaggtggagcaccgcgcctgggagcgggcgagcggccgcaccgcgacgatcttccacacgtaccacaagggtgacgagaagttcccgaccgacgcggagatcgcgatggcccgggacaaggcgcacccgcgggtcctgctgatgaactggcgcgtcgagtacggcaccacctgggccggggtcgccgccggcaaggaggacaagcggatcgacgcgttcgcccagcggatcaagaccaagttcccggagaagttctacctggtcctcaaccacgagccggaggacgacgtgatcccgaccgccggttccgggatgaccgccaaggacttcgccgcctcgttccggcacgtgatccagcggctgcgcgccgacggcgtgagcaacgcggtcagcgtcgtcgcgtacatgggcaacgagaagtggatggcccagtcctggtggaaggacctctacccgggcaacgacgtggtcgactggatcggcctggactcgtacgtcagcgcggagaagaactactaccacgccggcgtgttcgccgacctgctggaccgtaaggccaagggcggcgtcggcttctacgactgggcggtgcgcaaccacccgggcaagccgatgatggtcgccgagtggggcgcctaccaccgggtcggcaaggtcgtgaacaagtccgcggtgttcaacagcgtgctgccggagctggccaagcggccggcgatcaaggcgatcgtctacttcgacaccaagaaggacctgtacggcgaccgtgacatcagcatcgacagctcgccggcgtcgctcgcctcgttccgcaagctggccgccagcccgctgttcaacgtcacggttcgctga

SEQ ID NO: 5604 - DNA, 633 bp, Actinoplanes utahensis
atgttgcacacgatcaccgcgggcgtcctgctcgccacatccctggccggggccccggccaccgcgtggcacggcgcgccgccaccgaccgacaagatgatcatcggggtggtggcggcgaacgggtcgggctgctccggcaagagcgcgaacgtgcaggtctccccggacaacaccgcgttcaccgtcacctacagcgacttcaccgcgcagaccgggccggacgcgaaacccaccgactaccggaagaactgccagctggcgctcgacgtgcacgtgccgtccggctacacctacgcggtggccggggccgactaccgcggattcggccacctcgaggagggggcgaccgggtcggagacggcgttctactacttccagggcgagtcgcactccacccggatcccgcacaacttcaagggctggatggacaacgactggcagcagaccgacaaggtcgaggtcgggtcgttctccttcctgccgtgcggcgagcagcggtacctgaacgtcaacgtcgagctgcgggtcaaccccggctggtcgtcgcgcaaggcgaccagcttcctgagcatggactcctccgacggcaacctggacaccgtctaccacgtcgcctggcagaagtgctga

SEQ ID NO: 5605 - DNA, 345 bp, Actinoplanes utahensis
atgacaatcaaggacatcttcctggacgcgttcggccgtttcgcggccggcgacgtcgacgtgctgcgtcaggtgatccgcgacgacttcgtcaaccacgacccggacaccccgcgtgacaaggacggtttcattgacgccacgatcaacggcccgatcgggtcgtcgaccctcgacctcaagcgggtgatcgccgacgacatcttcgtggtcgcccactaccggctggtcccggccggcggcgggctcggcgaggcggtggcggacgtctggcgcttcgagggcgacctgatcgtcgagcactgggacgtcgcccagccggtgaccgctcccgatcaggtgtga

SEQ ID NO: 5606 - DNA, 1698 bp, Actinoplanes utahensis
atgcgcaagatggttcccgtgtcggccctgtccgtcgccgtgctgctcgccggctgcaacggcggaggtggtggtgaccccaccacctccaccgcggccttcgatccgaagacctgtcagggcggcacgctcaccgtgctcaaccagggtgggatcaaccacctggacccggcccggctctacacctccggcggcggcaacctgccctccctgctgttccgcacgctgaccacccgcaaccggcagcccggcgaggccggcaccaagcccgcccccgatctggccaccgacctgggcaccccgtccgacggcgccaagacctggacgtaccacctgcgcgacggcgtccagttcgaggacggcacgccgatcaccgcggccgacgtgaagtacggcatcgagcggtcgttcgcccccgagctgcccggcggcgcgccctacctgcgtgactggctgcagggcgcggccgactaccaggggccgtacaagcagcccgacgggatcaaggcgatcgagaccccggacgacaagacgatcgtcttccggctgagcaagcccgagggcgacttcccgttcctggccaccgccacccagttcgccccggtgcccaaggccaaggacaccggtgccgagtacgagaagcacccggtctcctccgggccgtaccaggtcgagtcgtacgagccgaagaagtccctggtcctggtccgcaacccgcactggtccagccaggtcgacgcgctgcgctacgcctgcccggaccggatcgaggtgacctccgggctggactccgcggtgatcaaccagcggatctccaccggggccggcgccgacgcgaacgcggtcaccaccgacgcggtggtcggtccggagcagctggcgcagctgggcaccgggtcggggctggacaagcgggtcacccgcggggagttcccgtcgaccacgtatctcgccttcaacaccaagaaggcgccgttcgacaaccccaaggtgcgcgaggcgctgtcgtacgcggtcaatcgcacctcggtggtcaacgcgctgggcggttccgcggtggtcggtccgtccaccaccttcctgcccccgcagaaggcgctcggctaccagccgtacgactggttcccggccggcgacaccggcaacccggacaaggccaggcaggtgctcgccgaggccggcctgagcaacctgaccatcgagctggcccacgagaacgacgacagcgagggcgtcggccccaaggtcgcctccgccgtccaggaagcgttcaagcaggccggcatcaccgtcaagctgaccgcgatcgacaccgccacctaccgcgacgtgaccggcaagccggccacccagcccggcctgtcgctgcagacctggggtgccgactggccgtccggcggcccgttcctgatcccgatcttcgacggccggcagatcatcaccgcgggcggcaacttcaacctggcccagtacaacgaccccgcggtgaacgccgagatcgacgcgatcaacgcgctcaccgacccggccgccgcggcccagcgctggggcgccctggacgccaagctcggcaagcaggccctggtcctgccgctgacccacgagaaggacgtctacctggtcgggaagaacgtcaagaacgcgtacgccgacgggtggcgcgggcagctggacatcgcccggatctcggtcaagtga

SEQ ID NO: 5607 - DNA, 924 bp, Actinoplanes utahensis
gtggcgcgggcagctggacatcgcccggatctcggtcaagtgatccgtgcgctgctgcgcgaccgcggcttcgtcgcgggtgcggtgatcgcggccggcatggtgctggtcgcgctcaccgcaccgctgctggccgcgctcgccgggcaggactacacgacctaccacgacgcgctgctcgactcggcgcgcggcggcgtgccgctcggctcgttcggcggggtcagcggtgagcactggctcggcgtcgaaccgggcaccggccgtgacctgttcgcccgcctggtctacggcgcccaggtgtcggtcggtgtcgcggtcggcgccaccatcctcgaagtgctgctcggcgtcggcgtcggcatcgccgccgggctcggcggccggtgggccgacggtgtgctgagccgggtgatcgacctggtgctgtccgtcccggcgctggtcatggcgatctcgctgctggccatcgtgccgcaggactggccccggccggtgctgctggccaccgtgatcgcggtgctcggctggggcggcaccgcccggatcagccgcggcgagacgctcaccctgcgcacccgcgacttcgtggcggccgcccaggtggccggggcgccgtggtggcgggtggcccggcgggagatcctgcccgggctgaccgcgccggtgctcacctacgccgccctgctgctgcccaccaacatggtggccgaggccgggctgtccttcctgggggtcggggtccgcccgccgaccccgtcctggggccagatgctgtccagtgcgaccacctggttccgcgccgatccggcgtacgtcctactcccggggttgctcttgttcctcaccctgctctccttcgtgctggtcgccaacggcctgcgacgggtcttcgacccccggcagcgggaggtcctgcgatga

SEQ ID NO: 5608 - DNA, 990 bp, Actinoplanes utahensis
atgatcggccacctcgcgcgccggatcgtcggcggtgtgctcgtgctgctggcgctctccgcgctggtctacacgctgttctacctggccccgtccgacccggcgacgctggcctgcggcaagggctgcaccccggaacggctcgccgacgtgcgcgccgcgatggggctggccgacccggtcctcacccagtaccggcatttcctgcagggcatcctggtgggccgggactactcgctcggcccgagcgtgcggcactgcccggcaccctgtctcggctactccttcgagacctcgcagccggtcaccggcctgctgctggaccgcctgccggtctcgttctcgctggcgatcggcgccgagatcctgtcgctgatcatcgggatcggcgccggcctgctctccggcgcccggcggttccgctggctggaccggatcgtcaacgggctgatcctggccggctactcgatcccggtcttcctggtcggtctgctgctgctcctgctcttctgcgtgcacctgcagtggctgccgttccccggatacgtcccgatcaccaccgacccgctgctctgggcgcagaacctgctgctcccgtgggtgtcgctcgcggtgatccagaccgcggcgtacgcccggctgacccgctccggcctgcaggagagcctggccgaggaccacatccggaccgcccgcgcctacggcatcccggaacgccggatcctctggcgccgggccctgcgcggggcactgctgccgctggtcaccctcaccgcggtcgacgtcgccgcgatcatgacgagcgcggtactcaccgagaccatgttcgggctgcccggcgtcggccagctgctggtcggcgcggtcaaccagatcgacctgccggtggtcgtcggggtcacgctgctcaccggtgtcatcatcgtggtcgccaacacggccgccgacctgctctacgccgccgtcgatccccgggtgcaactgcgatga

SEQ ID NO: 5609 - DNA, 1545 bp, Actinoplanes utahensis
atgacactgctgaccgtgaccgatctgaaggtgtccttcggcgaccggaaggccgtggacggcctcagtttcgccatcccggccgggggttccctgggaatcgtcggcgaatccggatccggcaagagcaccgcggccctcgcgctgctcggcctcaccggcggcgccgtctccggccgcatcgatttcggcggtacggatctggtggtcgccgatccccgcccgttccgcggcgcgcggatcgcgatggtgttccaggagccgctgaccgcgctcaacccgttccagacggtggggtcgcagatcgccgaggtgtaccggctgcacaccggggcgtcccggcgcgaagccagagcccgggccgtggaagtgctcgggcaggtgcacatccccgacccggcgcggcgggccggtgcgtacccgcacgaattctccggcgggatgcggcagcgcgcgctgatcgcgatggcgatcgcctgccgtccggaactgatcgtcgcggacgagccgacgaccgccctcgacgtgaccgtgcaggcgcagatcctcgacctgctcgacgaggtgcgggccaccaccggggcggccctgctgctgatcagccacgacctcggggtggtggccggctccaccgagcaggtggtggtgatgcggcacgggacggcggtggagaccggggccacggaaaccgtgctgcgcacgccacggcacgcgtacacccgggcgctgctcgacgcggcgccgcgacccggggggcgcgtctacgtacccggtgcgccactgctggagttgcgggacgtccacaagcacttcaagaaaccgcgacggcccgccatccgtgccgtcgacggcgtcaccgtgacggtgcatgccggcgagacgctcggcgtcgtcggcgaatccggcaccggcaagaccaccctggcccggatgatggtcggcctggtgccgccgaccagcggaaccgtcaccttcgacggggtcgacatcgcgcggcggcgcggacgctcggtgcagatggtgttccaggacccgctgtcgtcgctcaacccccgacggaccgtgggggagagcatcgccgacccgctgcggctgcggggcgaccgcgacccgcgccggagagtgtgcgagctgctcgaacgcgtcgggctgtcggcatccgaatacgaccgctacccgcaccagctttccgggggcatgcggcagcgggtcgggatcgcccgggcggtcgccccggcaccccggctgatcgtctgcgacgaaccggtgtcgtcgctcgacgtgaccacccaggcgcaggtgctcaccctgctcgaggaactgcgcgccgaactcgggctggccctggtgttcgtctcgcacgacctggccgtgctgcgccgcatcgccgaccggatcgcggtcctcaaggacgggagggtggtcgagatcgggccgaccacgcgggtgtatgagcagccggagcatccctacaccgaagagctgctggcggccgcgcaccgcctacacgcgggagtggcggtcggcgagcatcgcgcagaatag

SEQ ID NO: 5610 - DNA, 564 bp, Actinoplanes utahensis
atggcacgcgcggaggtttacgtcagcacggacgtggagacggacgggccgattccgggcccgcattcgatgctgagtttcggctcggcggcgtatctgcgggacggctcgctggtcggcacgttcagtgcgaacctggcgacgctgccgggggcggccgggcatccggcgacgatgaagtggtgggcgtcccagccggccgcctgggcggcgtgccgccaggatccggaggatccggctgtcgccctggagcgttaccgcggctggctggaggcgctgccgggccggccggtcttcgtcgggtatccggccggcttcgacttcatgttcgtctactggtatctgatccggttcaccgggacgagcccgttctcgcattccgcgctggacatcaagtcgtatgcgatggcggtgctcggctcggatttccgggcgacggtgaaacgggcgatgccgcgccgctggttcggcgacttcccgcacagccacgtggcgctggacgacgccatcgagcagggtgccctattctgcgcgatgctcgccgaccgccactcccgcgtgtag

SEQ ID NO: 5611 - DNA, 1818 bp, Actinoplanes utahensis
atggatgcacatcgacgccggcaggatgcccgcgagcagctcgctgagcatggcgaagaacgacccccgcaactcggcgaagatgctggccgccagcacggacgtggcgaagaccggcccgcacgcctacaccggcacgatcgacatcagcaagacgacgacgctgaccaccgacatgctcaaggccctggagggcaggaacacgaaggtgccgttcaccgccgaggtcgacggcggcggctacctcagccggatgagcctcgacatggatgcggtcacccccggcgccggcaagatcgtcgcggagtattccgggatcggcactccggtcagcgtcgccgccccggccccggccgagacggtcgaaatgcccgacacggccctcaaggccatgggcggctgatcccgcacctggcagcgtcgatgaggttcaccgagctcacctgggccgacgtcgaccccgaccggcaccccttcgacccggacaccgtgctcgacgtggtgcgcgcggtggccccggcgggcggcgtgcccgccccctatcgacatgagcgcggcgtgttcgacgctgccgccgaccgggcgcgctgggactggcagcgggcgatgggcgccgcgctcgtcgaccactacggtccgtgggccctcggctggaacgccgagatcgccggccgcgccgccgacggtgcgctggtgctgcgctggagcggcgcccgggactcgatcacgacgccggaggagacgctggccgccgtcgccggctcgctgctggactggcggaccttcctcgaagaggtggccgagttcctcccgcgccacctgcccctgccggccgagccccgagcggccgccgccgcctgggaagccgccatcacctcgctggtcgcgatggtggccgcccggtccggcgccgacgaacactggtatccggtctgcgcacagaccctcaggtggttcctcgccgtcgccggggtgccggccgccgagcacgacgcgctcatcgacgtcgcgatcggcggccggtacttcagcttcgtcttcccgctgggcgcggaggtggccgacgtcgcggaatcagtggcggcggcggtcaccggcaccacaccggccccggacgacctgtggcccgagacgtggccgcaggactggccgaactggcgcggccggcacctgcccgccgccagccacgtgccgcgggtcccggcgccggtggtcgtcgacgcactcgccgtctggcggcgggtccggcagcaggcccgctgggaacgcgccgaccgggtcaccgggccggcgcgcgccgcccgcgacggcatcgccgagcacttcgccaaacggggatccggcgccgcccacctcctcgccgccctggagctggtacgtgccgacgcggcggggggcggccccctgaccttcgcgcgcctggagacctggcagcgcgaggtgctcggcgtcgccgccgcccggttccgcgcggtgtccgcctgggcgagagccggagccgaacactacccgtaccgcgacgacctgccggactccttcgcggcctgcctcgcggaggccaccgacccggccgtgcccctaccggcccgggccgcccgggtctacctcgacatcgtgcacttccacccgttcgccgacggcaacgcccgctcggcggcgctcgcggtgtacttcgtcctcgcccgcgagggcgtggtgctgtcccgcgcggcaccgctgctgatgacccgctggccggcctccgttcccggcaacgccgaggggctggcggccgtcatcgccctgctcatcagacagaccggtcggcttcagaggtga

SEQ ID NO: 5612 - DNA, 447 bp, Actinoplanes utahensis
gtgaccggcaccgcccaggagtacctcgacacccgcctgcccgacccggcgatccgggccgcgatcgtgctcgacatcgacaacaccgcgctggagaccacctaccacccgggcctgatctcgccggcgaccgcaccggtcctcgccctcgcccggcaggccgaagccgcgggcgccgccgtcttcttcgtcaccgcccgcccccagctcctggcctggcagacccggcagaacctgcggaccgccggatacccggtcaccgacatctacctgcgcccatggttcgacttcgacccggatgcgacgctcaagacgaacgcccggatcgcgatcgagaaccgcggctaccgcatcgtggccaacgtcggcaacaacgtcagcgacctgcagggcggccatgccgaccgcaccttcaagctgcccgactacaacggccagctctcctga

SEQ ID NO: 5613 - DNA, 501 bp, Actinoplanes utahensis
atgccggcgaacgccggtaacaacttcggctcggccgaacatctgctgggtgtaggccgagcgaaagagagatccatgaaccccgagccgaactcagcgcgtccgaagcacccccactcgcgccaccggcggcgcatgttcgccgtcgtagccggaatcgccgtggcggtcggtgtgggcggcggcgtcgcgatggccagcggtgtgccgtttgcgaagagcgacaccagcggtggcatgtgtgcccggaccctgtccgcgcaggcggatctgtccgagcccacgggtggcttcgacccgaagcatccgtccagggcctgcgcgcagggctggcatcagatgtggggcgacgggacgccggtgccggcccgcttcgtggcctgctaccaccccggtgcgaacgccggtggctcggtgatctacccggccgaccggttcgccgacgccgctgccgcctgtgcctcgatcggcagcacagcgatcccgggcgtcaaggcctga

SEQ ID NO: 5614 - DNA, 579 bp, Actinoplanes utahensis
atgcccgtactccaggaccggccggggcacgatcggcagtcggccgaacggcggctcgaggaattgttccggcttcacgccgacgcggtcctcacctttctgcggcaccgcaccgaccacgaaacggcgcaggacgtcctcaccgagacgttcaccatcgcctggcgcaagctcggcgagatacccgaggatccgcgcggttggctgtacggcgtcgcccgccgcgtcctggccaaccacgtccggtcgcaggggcgcacggccgcggtggtcgagcggatgcgccatgagtcccggttgtcgggcccggacgagtccggcatcgaggatgccctgcaccgccacgacgtgctggccgcgttggccgtcctgccggaagccgaccgtgaggtgctgctgctggccggctggtacgacctgaccggtgctcaggccgcccgggccctcgactgcaccagggcggcgtacgccctgcgactccatcgggcccgccggcgactgcgcggtgtcctcagcggatcggcgaccgcccgcggcaccacctcagccgcacgtccggcacgggaggcgaacgtatga

SEQ ID NO: 5615 - DNA, 519 bp, Actinoplanes utahensis
atgaacgacgaactgcgcgaggtgcggcggacccggcccgcacccgtcgagggctgggcggactccgccgaaggccgcgagctcttcgacaccgtcctgacgcacacccgggccgagcccgtgccccggacatcccggcgccaccgccgccgggcgttgaccatcggcgccgccctgctgctggcggtgggtgccggtggcggtgtcgcggtggccaccggggtgccgttctccccgggtgacaccagcggtggcatgtgtgcccggaccctgtccgcgcaggctgatctgtccccgccgaagggcgccttcgaccccggtgacccggccaaggcgtgcgcggacagctggcatcagatgtggggcgacggcacgccgaagccggcccgcttcgtggcctgccgccaccccggcaaggatgccggtggctccgtcgtctacccggccggccggttcgccgacgccacctccgcctgcgcctcgatcggcgccgaaccgatcccggccgcgaaccgctga

SEQ ID NO: 5616 - DNA, 1191 bp, Actinoplanes utahensis
atgccggaacgctccgaaaccgcccaccaggtcgcggacctcctgcggaccgcgcgggaagcgctcgggatgagtgtggcgttcctgagccgcatggaggggccggtgcagcacctcgaggtcgtcgagtcggacctgccgctgcacgacggcatgacccaggtccgggccacctcgctctgccaggcgatcgaggacggcacgctgcctccggtgatcccggacctcgccgcgatcccggcggccgccgggacgcccgcactcaaggtgggcatccgcagctacatctcggtcccggtggaactcagcgacggcaccgtgtacggcacgttctgcggcgccggcctgactcccgacccgctgctggacgaccgcgaccgggtgctcatgcgggtactggcccacgccgcggcgatgatcatcgaaccggacgtccggaaacggcagcgcaacgccgcgatagagcgccggctgcgcccggtgctggcccgcggcggcccggtggtgctcctgcagccgatcgtcgacctggccaccgggcgccggagcggagccgaggcgctcagccggttcccccgggagtggcagcagccgccggacgaggtcttcgccgacgccgccctgatcggcgagcgggagaacctcgaactcgcggcgctgcggcgggccgcggatcacctacccgacgttgccggatatgtcgcgatgaacatctcgccggccacgctcttcaccgacgacggcgtggccttcctgagccggttgccgctcgaccggatcgtcctggagctctccgagcacgacccggtcgacgactacgcacggctgcgggcggtgctggccccgctgcgcgcccgcggcatgcgcctggccatcgacgacgtcggcgccggcttctcgtcgctgcggcacatcgtcgccaccgctcccgacgtcatcaagctggaccgcagcatcgtcagcggcgtcgccggcgaccacgtgctctcggtggtcgtccgcgccctggccgacctggccggcgcggtcggcgcgacggtcgtggccgaggggatcgagaccgcggccgacgccgccgccctggccgggctgggcgcggacctcggccagggctggctgttcgacaaggccgtcccggccgaggacctccgcgacgcgtacgacctcgccccggccgcctgcccctcctga

SEQ ID NO: 5617 - DNA, 1191 bp, Actinoplanes utahensis
atggcgaagagccatttcgtacgcaacaagccgcacgtgaacatcggcacgatggggcacgtcgaccacggcaagacgaccctgaccgccgcgatcaccaaggttctcgccgaccgcgacccggtggccaaccggtacgtcgcgttcgaggggatcgaccgggcgccggaggaggcggcccgcggcatcaccatcaccatcgcgcacgtcgagtatgagacccccacccggcactacgcgcacgtcgacatgccgggccacgccgactacgtgaagaacatgatcaccggtgcggcgcaggtggacggggcgatcctggtcgtctcggcgcaggacgggtcgatgccgcagacccgcgagcacgtgctgctcgcccagcgggtcggggtgccgcacctggtggtcgcgctgaacaagagtgacatggccgacgacccggagctgctcgacctggtcgagctggaggtccgcgagctgctgtccgcctacggcttccccggggacgaggtgccggtggtccgggtcagcgcgctcaaggccctcgagggcgacccgcgctgggtggcgtcgatctccgaactgctcgacgcggtcgacgcgtacgtgccggtcccggcgcgcgagaccggcgagccgttcctgatgccgatcgagaacgtgctgtccatctccggtcgcggcacggtcgtcaccggcaaggtggagcgcggcgagctgcgtgtcggtgagccggtcgaggtcgtcggcctcggcccgacgctttccagcgtcgccaccgggctggagaccttcggcaaggtgctggagtcggctcaggccggtgacaacgccgccgtgctgctgcgcggggtgaaacgcgaccaggtccagcggggccgggtggtggccgcgcccggcacggtccagccgcaccgggtcttccaggcccggatgtacgtggtgaccgccgccgagggcgggcggcacacgccgttcgccgccgactatcgcccgcagttctacttccacaccacggacgtgtcgggtggtctcgacctgggaggccgcgacctggtcaggcccggcgacaccctggacgcggtcaccgtgacgctgggcaagccggtcgccctggagcccggcctgggcttcgcggtccgcgagggcaaccgcacggtcgcggccggcacggtcaccgcggtcctcgactga

SEQ ID NO: 5618 - DNA, 2274 bp, Actinoplanes utahensis
atgctcatcgagttggaaatcggcgggatgacctgcgcgtcctgcgcctcccggatcgagaagaagctgaaccgggtggacggggtgtccgccaccgtcaactacgccaccgagaaggcggtggccacggtgtcgggcgcggtgtccgccgacgatctggtcgccgtggtggagaaggccggctacaccgcgcgcctgccgatggtcaccgcgccggagacaccggacgtgtccgatccgctccgggaccggctcctgctctccgtcgtgctcagcgtcccggtcgtcgtcctggccatggtccccgcctggcagttcgaccactggcagtggctgtcgctgaccctggccgcgccggtcgtcacctacggtggctggcccttccaccgggtcgccgcgatcaatctgcgccacggcgccgccaccatggacacgctggtgtcgttcggcacgctggccgcgttcggctggtcgctgtgggcgctgttcgtcggcaccgccggcgagaccgggatgcggcacccgttcgcgttcgccatcgcccgcggtgacggcgccggcaacatctatctggaggcggccgccggcgtcaccacgttcctgctggccggccgctatttcgaggcccgcgccaaacgccgggccggcgccgccctgcgggccctgctggaactcggcgccaaggacgtgtcggtgctccgcgacgcccacgaggtccgcatcccgatcgcccagctcgcccccggcgaccgcttcgtcgcccgtcccggcgagaagatcgccaccgacggcgtcgtcgaggacggctcctccgcggtcgacgcatcgatgatcaccggcgagggtgtcccggtcgagatcggacccggcggcacggtcgtcggcggcaccgtcaacgccggcggccgcctgatcatccgcgccacccgggtcggcgccgacacccagctcgcccggatggcccgcctggtcgagcaggcccaggccggcaaggcgaacgtccagcgcctcgccgaccgcatctccggcgtgttcgtcccggtggtcatcgctctggcggtcgccaccctgggctggtggttcggcgccggcgccggctggaccgccgccttcaccgccgcggtcgccgtcctgatcatcgcctgcccgtgcgcgctgggcctggccacgcccaccgccctgctggtcggcaccggtcgcggcgcccagctcggcatcctgatcaaggggcccgaggcactggagtcgacccgccgggtcgacaccatcgtcctggacaagaccggcacggtgaccaccggtcagatgtcgctcgccgcgacccgtccggcgccgggtcaggacccggacgagctgctgcgcctcgcggccgccgtcgaatccgccgccgaacacccgatcgccagggcgatcgccgccgcctgcccctcggccgccgcttcttcgtcggccgtctccccctcggccgccgcttctccgtcggccgcttcccctgcggccgccggttctctcgcggtccgcgatttcaccagcttcgctggattcggcgtacgcggtgaagtggccggccatcaggtcaccgtcggtcgcctcgcgctgctggagcgcgacggcctcaccatccccgccgaggtcgtgaccgccgccgccgaggaggaggccgccggccgcaccgcggtcgtcgccggctgggacggggccgcccgcggcgtgctggccgtcgccgacacggtcaaacccaccagccgggaggcgatcaccggcctgcgccgcctcggcctcaccccgatcctgctcaccggcgacaaccagcgggtcgcccgggccgtcgccaccgcggtcggcatcgacgaggtgatcgccgaagtcctccccgccgacaaggtcgccgtcatcgagagcctgcagaaatccggcagggtggtagccatggccggcgacggcgtcaacgacgccgccgccctggcccgctcggacctcggcctggccatgggcaccggcaccgacgtggcgatcgaagcctccgacctgaccctggtccgcggcgacctcacggtggcggtcgacgccatccgcctctcccgccgcaccgtgcgcaccattcgcggcaacctgttctgggccttcgcctacaacctggccgccctccccctggcggcggccggcctcctgaacccgatgatcgccggcgccgccatggccctctcctccgtcttcgtcgtcgccaacagcctgcgtctgcgcaccttcagagccgcccgccggcacctgtga

SEQ ID NO: 5619 - DNA, 852 bp, Actinoplanes utahensis
atgaggagttcggtgcggttcaccgcgtacgtgctgggattgatcctgatcttcggcgccgccgccggcgccggcaagctcctcgggaccgccccgcggcccgcgccggcgcacaccgccggggcacattccggacatgagaccacgcttccggccggcctgcaggttacccagcaggggtatacgctgagcccgctgaccagctctttcgcggccggcgaggcgcagccgttcgccttccggatcctcggcccggacggacgggcggtcacccggttcgccggcgatctgcacctcatcgtggtccggcgcgacctcgccgactatcaacatctgcatccggtacgcgccgccgacggcacctggtcgaccacgctgaccgtgccggagccggggcagtatcgggtgttcaccgacttcacccccctggcggtcgcgcggaacctcgtgctcggtaccgacatcccggccgccggcgactaccggccccggccactgccggcgtccggctgggcggtcgagaccgacggctacacggtgacccgggccggtgacccgcaggccggcgctcccgcctgggtcaccatgtcggtgagcagagacggtcagccggtcacgctggagccgtatctcgggacgttcgggcacgtggtcgcgctgcgtcagggtgatctggcctatctgcacatgcatccccaggacggcagcaccgccggctcggacgtcaccgtcgacgcgacggtcccgtccggcggggtctaccggctcttcctggaattccggcacggcggcacggtgcacctggccgagttcaccgccgacgccaccaccggcggacaccggcacgactga

SEQ ID NO: 5620 - DNA, 600 bp, Actinoplanes utahensis
atgttagactggggcatgcctgagccgaccctgtggaaccgcacccgccaggcggtctacgacgagatcgcgcgcacggcgatggacctgttcctgagccgcggcttcgaggccaccacgatcgacgacatcgcggcggcggccggcatctcgcggcgctccttcttccgatatttcggcaccaaggaagacatcctgctcggcgatctggccgcgcagggcgagttggccgcgcgggcgctggccgagcgacccgaggacgaggagccgtggacggcgctgcggaacacgttccacgccatcaaggaggagacgtacgacgcggcgaccatgctgaagatctcccggatgatgtatgagacgccgtcactgcgcgcccggcacatcgagaaacacctgcggtggcaggagtcgctggtcccggagctgcggcggcggctcggggccgatcccgacgatcccctggacgtccgcgccgaggccctcgtggcctgcgtgatcacctgcctcgacgtggccggcgaggcgtggacgcgagcgaacggggcggtgcccctggaggtgctgttcgactcggcggcgaccgccctgcgcccctga

SEQ ID NO: 5621 - DNA, 846 bp, Actinoplanes utahensis
gtgtcagtcaggcatacgatgcacggcatgagcgtcgtcgactaccgcaagcagaccgtcctgatcaccggagccagcgccggcctgggcgccgagttcgcccgccggctcgccgcccgcggcgccggcctggtgctggtcgcccgccgcgccgaccgcctggccgcgctggtcgccgagctgtccgcgcccgggatcaccgtcaccccgatcgccatggacctggccgtcccgggtgccggcgagcggctcagcgccgccgtcgaggccgccggggtcaccgtcaccagcctgatcaacaacgccggcttcggcaccaaccaggccttccacgaggaggacccggcccgggtcaccgacgagatcaccctcaacgtgaccagcctggtcggcatcacccgggcgttcatcgaccggctgcgcgccggcgacggcttcctgatcaacgtggcgagcatcgcggcgtaccagccgaatccgcgcatggccgtctacggcgccaccaaggcgttcgtgctcagcttcaccgaggcgctctggttcgagtcgcggcacacccggctgcgggtgctggccgtctcgccgggcgcgaccgagaccgagttcttcgaggtcgccgggcagggcgccgacggcggtacccggcggatgcgggccgaccaggtggtcgacagcgcactgcgggcgctggaccggcgcacctcgcggccgagcgtggtcaccggcgcgctgaaccgggtgctgaccggggcgacgcgcctggtgagtcgccggttgctagccaccgtcgtgggcaccttgttggagcgatccgcggatgcgagaatcagcactcgtagtgcatga

SEQ ID NO: 5622 - DNA, 804 bp, Actinoplanes utahensis
atgcgagaatcagcactcgtagtgcatgatcttcggatggcgacgttccggtccgatgacggtgtggagatctactacgaggtgcgggagggcggcgacggcgagcgcccgccggtgctgctgcaccacggcttcatcgccgacgggcggaccaactgggagctgcccggcatcgtcgccgccctgaccggcgccgggcggcgggtggtcacgatcgacgcgcgcggccacggccgctccggcaaaccgcacgatccgggtcggtacggcgaatcccgcatggccgaggacgtccgagccctgctggacctgctcggcgccaccgaggtggacctggccggctattcgatgggcgccatcgtcgccctgctgaccgccacccgggacacccgggtgcgccgcctcgtgatcggcggcgtcggagcggccgtcgtcgagctgggcggcctggacacccgggtggtcggcggcgagtcgctgatccgggcgctgcgcaccgacgacccgtcgaccatcggcgacccggccgccgcgggcttccgcgccttcgtcgaggcggtcggcggcgaccgcctcgccctggccgcccacgccgccgcggtgcacgccgccccgatcccgctggccaccatcaccgcgccgaccctggtcctggccggtgggtcggatccgctcgcggtccgccccgaggtgctcaccgcggcgatcccgggagcggtgctgcgcaccgtccccggcgaccacctgtccgcgctgcgcgacccggccttcaccccggcgctgctggagttcctgaacgcatag

SEQ ID NO: 5623 - DNA, 393 bp, Actinoplanes utahensis
atggggcgtaactcccccgcggccgtacgcgccgcacaaccgcgccgtgacgagacggtggcgatcgacgggctgccgtcgccgaccatccgggcgatccgcgagctggagcgcacccgcctctggccgggtgccgtcgccaccgccctgcggggctggcggcgcaccgtgcacggcccgcgcgcccgcctcttcgacctcgacgacgattgcccctgctgcgatcgatcccaggaccggatggtcctggagcgggcgatgaccgccctcggcgggcgacccggccgggacctgcgcgcggcggtggacctgctggacgaggtcctccgccgccgcacccaccacgatgcgaccaccccggccggcgcggtgtggtggcaccgccgcgtctga

SEQ ID NO: 5624 - DNA, 129 bp, Actinoplanes utahensis
atgcgcggggcgaggcgtccgggtgcggtggcccgcgcggacggttcggtcgccgccaccggcctggaggtcctgctgcccgctccggacggccggatcacccacgactaccggttcatcggggcgtga

SEQ ID NO: 5625 - DNA, 1044 bp, Actinoplanes utahensis
ttgcgccggcgcaccggcttcgaaatcgagctgatggcccccgccggggtcagccggcgcaccctcgccacggatctggccggacgctgtgggggcagtgtccggccggtgtggcactccgacagcgagccgtccctggtccccgggctggggcggttcctgcacctgaccccgggtttcgaggtgcgccgcccggacggcgacctgctctgcaccctggtcgacgacatcaccctggtcgccgggctcaacccggcggccccgccgcaggccggctggttccgggtgctgaccgacgactcccggctgctgcgcctgctggcccggcacagcgacccggccggcaccatcgaccaggcgctggcgccggcggccgagctgtggggtcgcaaggtgcagcagctcggcgactactaccggctcgacgacgccgccgacgccacgatcgcgctggccgcgccgctcggcggggaacgcgaacgcccctgcgagatcgtcaccccgccgctgaccggcggcttcgagacggcgctggaggagctgctcgggccggcgcgggagctgggcttcaccgtgccctacgaagcggccgtgcacctgcacgtggacggggcgccgttccggatgccgcacgccctgtccaacctcgtgcggctgttcacctactggcgggagccgctgcgcgcggtgctgcgcaccaacccggcctgccggcgtctcgccccgctgcccgagccgctggtccgagcggtcgagggcgtcccgacgacggcacagctgcgggccgcggccgccgagggcgagctgaccaagttcttcgacgtcaacctgacccagctgctcaccgacacaccgctgcgcaacaccgtggagatccggattctgcccggcgcgatcagcgcccgcccgatcctggaccaggcggcggtgttggagttgctgctggaccgctgcctggacccggagccgatcccccgcggcgacagcgtggacggcctcctggagctggccgccgaggccctggccggccgccccggcgactga

SEQ ID NO: 5626 - DNA, 801 bp, Actinoplanes utahensis
gtgaccgaccacggtgaccggctgcgcgaggccttcgcgcgcaccgagtcccagacccctgacgccggcgacgtgtacgcccgcgtcgtcgaactgtcccgtaaacacaaataccgtcgccggggtgcgaccgccgtcggcggggtggcactgggcgccggcctgatcgccgccgtggtgaacctgccggccatcctgcccggcgacccgcagtcgggcaccgggacctcggccacggcccccttcgtggccggggccccggcttcgccggcgccgtccgcctccagcgccgaccagcaggacaaggacctgcaggcgtactgggacgccggctacaccggggacgacgtcgaagcgctggcgaagctgtggaagatgtcgcccgacgactacctcggggtcaagaccgaggccggtcgccgcctgctggccggggagaccctgccgatcaggccgcagccggttcaggagaccccggcgtcggtcgccaagttcttcgacgccggctacagcgtcgacgacgcggcgacgctggccaagctgtggcacctcaagacgccgtacgacgcgaaggtcgccggcggcgagaagctgctgcgcggcgagaccctgccgatcaagccacacccgtcggccgaacagatcgaggagaagcgggtcagcgccttcttcgacgcccactacaccatcgccgacgccaccaggctggccaagctgtggcacctgaagacggcgtacgacgccaaggtcctcggcggcaagaagctgctcgccggacagaccctgccgatcaagccgtga

SEQ ID NO: 5627 - DNA, 552 bp, Actinoplanes utahensis
gtgcacaacgggggttcgggacacgtcgatagcggtgtgaccttcgagcaattcgcgatggcccgcctgcccagtctgctgcgctatgcggtcgtcctcaccggcgaccgtcatctcgcccaggacgtggtgcaggaggtgctggcccgagcccacgtcaagtggcggcggatccagaacgcggactccccggaggcgtacgtccggcgcatggtgctcaacgagtacctgtcctggcgacgctcctgggcggtgcgcaacctgcatctcgccggagagcgcctggtcgagatcgacgacgcccgcggcggggtccacgaccacgccgaccggatcgccgagtcggacgccctctggaaccgcttggccacgctcggacgcaagcaacgtgccgtgctcgtactccgctactacgagcaaatggacgacgacaccatcgcagatctgctcaactgctcaccggcgacggtgcgcagccaggcctcgaaggcactgcgaacgctccggctggagtcggagcgagaactttcatttgccgaggagaagtcgtga

SEQ ID NO: 5628 - DNA, 1344 bp, Actinoplanes utahensis
atgacgaccaccgcaccgactcccgcccacctcgccggcaacttcgcgcccgtcaccggggagaccaccacgctcgacctgccggtcaccggcgccgtcccggccgaactgaccgggtggtatctgcgcaacgggcccaacccccaccacgggacctcggcgcactggtttctcggcgacggcatggtgcacggcgtccgcctcgatcacggccgggccacctggtaccgcaaccgctgggtgcggacccgggtgctgaccgacgacgcccgcgcctacggcccggacggcacccgcgacctcaccgccggcccggcgaacaccaacgtcgtgcgccacggcggacgactgctggcgctggtcgagtccgcgcttccgtacgagatcaccaccgacctggagaccgtcggcccctacgacttcggcggccgcctgcacaccccgatgaccgcccaccccaaggtctgtcccaccaccggggagatgcacttcttcggctacggcggactcgagccgccctacctcacctaccaccgcgccggcgcggacggccggctgtcgctcagccgcccgatcgacgtccccgcgcacacgatgatgcacgacttcagcctcaccgcggcccacgtgatcttcatggacctgccggtgctgttcagcctggacggggcgcggaccggcggcatgccgtaccggtgggacgacacctaccaggcgcgcctgggcgtgctgcggcgcgacgccccgcagggggaggtccgctggtacaccatcgatcccggatacgtcttccacaccctgaacgcccacgacgacggcgaccggatcgtcatgcacgtcgtccgccacgagcacgcgtaccgcccggggcagcccgccgccgcaccggacctctggcgctggaccatcgaccagcgcaccggccgggtcgccgaggaacggctggacgacgaagcggtcgagttcccccgcatcgacgatcggcgcaccgggcagccggcccgttacggcttcgccgtgaccgacaacgttccccgccggctcgccgacgtcagcgccgtcatccgctacgacctgcacaccggctcgaccacccggcaccgcctgccgaccgggcaggtacccggggaggcggtcttcgtgccggccggcggcgcccccgccggatcggccgacggctggctgctgacgttcgcctacgacccggggcgcgacgccagcgatctgatcatcatcgacgccaccgacctcgccgccccgccgctggcccggatccacctgccgcaccgggtgccgttcggcttccacggcaactggctgcccgaccacgaccgcgcagaatag

SEQ ID NO: 5629 - DNA, 552 bp, Actinoplanes utahensis
atggagttcctgagcggtttcgccccctggatcgttttcggcgcggtcaccgcggccaccgactggacgatcggcgctctcgccggcctgctggccaccgtcctgctgatcatccgggcacgccgcgccggcgcccgcgccgaccggctcgtcctggagtacagcaacgccgcgttcttcgcctgcgccgcggtcgtggccctgctccagccgcactccccgatcgcgtcgtggaccggcccgctgtcgctggcctggatcgcgctgaccgcctggggctcgctggtcgcgcggcggccgttcaccctcggcatcgcgaaggcatcggcgccccgggaggtgtgggacaaccccgtcttccaccgcaccaacctggtgatcacggcggtctgggcggcgaccttcacggtggccgccgtgctgctggccacgctgcaggcggtccacgcgggcaccgccgcgaccatcgccgtcttcctgctctacgtcatcccgatcgctttcacgcgccgctaccccgccatcgtccgtgcccgttatgcacgctcctga

SEQ ID NO: 5630 - DNA, 534 bp, Actinoplanes utahensis
atgagcctgcgcttcgcgctgctggggttgttggccgaccggccctccagcggatacgacctcttgacggaattccgcacgtcactggcgcacgtctggccggccacccagagccaggtgtaccgcgagctgaacacgctcaccgaggccgggatgctcaccgtcggtgaggagggcccgcgcggtcgccgagagtatcggatcactgccgccgggcgggacgctctcgacgcctggctgacgacgcccgacagcgccccgtcgtatcggagcgccctgctgttgcgcgtcttcttcctgtccctggccggtccggagcgcgccgccgggttcttccgggaccaggcggacctggccgggcagcggctctccggttaccacgacctcgtcgagtcgcgcacctgggacgccggcaccctggaacgctacggtcgcatcgccctggagtacggcatccgcctcgccgccatgcagcgcgactgggcgatctgggccgccggacagctgcccgatgacggttcgccgggcaactga

SEQ ID NO: 5631 - DNA, 1059 bp, Actinoplanes utahensis
gtgagaaccatcgaagcgcagcgtctccgcggtggatccgacgtgcccggcggccgccgcaaacaacgggtgtcgatggccgacgtggccaagctcgccggcgtgtcttcccagaccgtctcccgggtcgccaacggccaggtcggcgtcgtcgaagccacccgggaacaggtcctcgccgcgatgcgcgaactcggctaccggccgaacagcgcggcccgctcgctgcgctacggccggttcaacacgctcggggtgatcctgttcggactgtcctccaccggcaacagccgcaccgtcgaggcgatcgccacccaggccgccgccgcggggtacgcgatcaccctgatcccggtcggcgtgcccacccaggacaacgtgctcggcgccttcaccaggatgggcgaactcgccgtcgacggcgtcatcgtcatcatcgaggtacacctgctcgacgcggccaccgtcgccctccccccgggcgtccacgtggtggtcgtcgactcggacgcgggcgagcgttatccggtggtcgacaccgaccaggccgacggcgcccgccaggccgtccggcacctgctcgacctcggccaccacaccgtctggcacatcgccggcccggccgggtcgtactccgccgaacgccgcgccaccgcctggcgcaccgtcctcgaggaggccggccgccccgtcccgccgatcggccgcggcgactggtcggcggagagcggccaccgggccgggctcgacctgcccgccgattgcacggcggtcttcgtggccaacgaccagatggccctcggcgtgctgcgggccctgcacgaacgcggccgccgggtgccgcgggacgtcagcgtcgtcggcttcgacgacatcgccgacgcctcgtcgtacctgccgccgctgaccaccgtccaccaggacttcgctgaggtgggccggcgctgcgtgcaggcgctgctcgaccagatcgcggccgggccggccgcgccgggcaccgacctcgtccccacgcatctggtcgtccgcggcagcaccgcggcaccccaccgcccctga

SEQ ID NO: 5632 - DNA, 867 bp, Actinoplanes utahensis
gtgacacggcgatcctggatcggctggcagttcgtcgccccgttcctcgcggtgttcgcgctggtcttcctcgcgccgatcgcctactcggcctacctgagcctgtaccggaccaggctgatcggtggcaccacgttcgtcggcgcggagaactacaccaaggcgttgcacgacccgcaattctggtcggcggtcggccgggtgtcgttgttcctggtcgtccaggtgccgatcatgctgatcctggccctgctgatcgccctcgcgatcgacagcggccggctctacggagcggccttcttccggatcacgatcttcctgccgtacgcggtgcccgccgtcgtggccaccctgatgtggggcttcatgtacggcagccagttcggcctgatccgcaacctgaacgacctgctcggggtcacgctgcccgacccactcgccccggactacgtgctggcctccatcggcaacatcgtcacctgggagttcgtcggctacaacatgatcatcctgtactcggcgctgcgggtcgtggacccgtcgctgtacgaggcggcggcgatcgacggggccggccagttccggatcgtccgggccatcaagctgccggcgctgcgcggtccgctgctgatcagcacgatgttctcgatcatcgggacgttccagctgttcaccgagccggtggtgctgcggaccatcgccccgaacgcgatcctcacctacttcacccccaactactacgcctggcagctgtccttcggcggccagcagtacaactactcggccacggtcgcggtggtgatgggcctgctcaccatggtcgtcgcctatctcgtgcaggcccgcgccgtacgaaaggcaggctga

SEQ ID NO: 5633 - DNA, 909 bp, Actinoplanes utahensis
atggtcgccgcacccaccatccgtccggcggcgcgccggcgaccgcaacccgcagcggccccgccccggcggtccggcagccggacgctgaccgtgctcaccacgctgatgctgctctacaccatgctgccgctggcctggctggtggtcagcgcgaccaagacccagcaggggctgctcggctcgttcggcctgtggttcgaccacgacttcgcgctgttcgacaacatcggccgggtcttcacctaccaggacggcatctacctgcggtggctcggcaacacggtgttctacgtggtggccggggcgggcggcgccacgctgctgtccgcgctcgccgggtacggcctggcgaagttcgcgttccccggccgccgggcggtcttcgcgctgatcctgggcgccgtggcggtgccgccgaccgcgctggccgtgcccaccttcctgctgttcgccaagatgggcatcaccgacacggtctgggcggtgatcatcccgtccctgatgatcccgttcagcctctatctgatgtgggtgttcgccaccgaggcggtgcccgacgaggtcctggagtcggcccgggtggacggcgccggcgagttccggatcttcttctcgctggccgtgccgctgctctccccgggcctggtcaccgccctgctgttcaacgtcgtggtgacctggaacaacctgttcctcccgctgatcatgctgaaggaccgcaatctctacccgatcacgctgggcatctacagctggaaccagcagtcgctcacggtcggtggcgacgtcgtcttcaacctggtgatcaccggctcgctgctcgcgatcgtcccgctcatcgccgcgttcctgctgctgcagcgctactggcagtccggtctggccgccggcagcgtcaagcagtga

SEQ ID NO: 5634 - DNA, 1347 bp, Actinoplanes utahensis
atgagaatcacccgccggcacgcgcttttcggcgccgccatgtcgataacgctcctggccgccggttgcggctccgccggcaagtccgacgacggcaccaccaaggcggccgccaccacggtctccgacgccgacgtcgaggcggccctgcaggccggtggcaacctgacggtctgggcctgggaccctaccgtgcagaaggtcgctgagcagttccaggtgaagtaccccaaggtcaaggtgactctgcgtaacgcgggcaccggcaacgaccagtacaccgcgctgcagaacgcgatcaaggccggcaccggcgtgcccgatcttgcccagatcgagtactacgcgctgccgcagttctcgctctcccagggcgtcaccgacctgaaccagttcggcgccgggtcgctggacggcacctttgcgccgggcacctggaactcggtgcacgccggggagaagatctacggcctgccgctggactccgggccgatggcgctgttctacaacaaggaggtcttcgacaggtacggcatcgaggtgccgaagacctgggacgagtacgccgcggcggccgcgaaactgcacgccgccaacccgaagtcgtacatcaccagcgacaccggcgacgccggcttcaccaccagcatgatctggcaggccggcggacgaccgtaccgggtcgacggcaccaccgtggggatcaccttcgcggacgccggcacccagaagtggacctcgctgtggcagggcctgatcgacaggaagctgctggcgccgatccccggctggagcgacgcctggtacaagggcctcggtgacggcaccatcgccaccctggtcaccggcgcctggatgccgggcaacctggagaccggcgtgaaggcggcgaacggcaagtggcgggtggcgccgatgccgcagtgggcggccggcgacaaggtgacggcggagaacggcggcagttccctggcgatcaccgaggccagccaggccaagaccctggcgtacggcttcctgaagttcgctgcggttcaggacggcgcgcagatccgcaccgacgcgggtgccttcccggccaccaccgcccagctcaacgcggacgcgttcaagaacaagcagttcccgtacttcggcgggcagaaggccaacgagatcctctccgagtcggcggccgaggttgccaccggctggtcgtacctgccgttccaggtgtacgcgaacacggtctacaacgattcggtcggcaaggcgtacaccggcggcgccaagctgcaggacggtctgaaggcctggcaggacgcctccaccaggtacggccgggaacagggcttcacgattccatga

SEQ ID NO: 5635 - DNA, 2004 bp, Actinoplanes utahensis
atgagcgattccccgagcgactccccgaagatgcggaacacgacgccccggcgctggctgcgccgcgccggggcgccccggctggagtacggcgccgactacaaccccgagcagtggccgcgcgaggtctgggccgaggacgtccgggcgatgcgcgcggccggtgtcaccgtcgtctcgctggcgatcttctcgtgggcgcggatccagccgcggcccgaggtttacgacttcgcctggctggatgaggtcgtcgacctgctgtacgccggtggcatcgcggtcgacctggcgaccgctaccgcgtccccgccgccgtggctgaccgcccggcatccggagatcctgcccgtcgacaagcacggcaacaccgtgtggcccggcgggcgccagcactggcggcccacctcgccggtcttccgggcgcacgcgttgcgcctggtccgggcactggccacccggtacggcaagcatccggcggtggtcgcctggcacgtcaacaacgagctgggctgccacaacgtctacgactactcacaggacgcggcgctggcgttccggtcctggctgcgcgagaggtatcggacgctggacgggctcaacgcggcgtggggcaccgacttctggtcgcagcgctactccgactgggaccagatcatcccgccgcggcaggccgccacccatccgaatccgacgcagaacctggacttcaaacgcttctcctcggacgcgctcaaggaccacctgatcgccgagcgcgacctgttgcgcgagctcagcccggacgtgccggtcaccacgaacttcatggtgatgggcgagaccagcgcgatgaactatgccgactgggcgtccgaggtggacttcgtgtccaacgaccactacgtcgtgccgcatccgcaggcccgcgacgagctgtccttctcggccaacctgaccgggaacatcgcgggtggccggccgtggttcctgatggagcactcgaccagcgcggtgaactggcagccggtgaacctggcgaagaagccgggcgagctggcccgggactcgctgacccacgtggcgcacggcgccgacgcggtgtgcttcttccagtggcggcagtcgcgcgccggtgccgagaaataccactcggcgatgctgccgcacgccggtcaggacagtgagctgttccggtcggtggcggcgctgggggagcggctggcggcactcgagtcggtcgcggggaccaatcgggtgccggccgacgtggcgatcctgatcgactgggactcgtggtgggtggccgagcacgactcgcacccgaccgaccggctgcggtaccgccaggaggcgctggactggtacacggcccttctggacctgggggtcagggccgacgtcgtaccggcaagcagcgatttctccggcttcaccgtggtgatcgctccggtgctgcacgtggtgccggcggcgctcgccgcgcgattgaactccttcgtcacccagggcggacatctggtctgtacgtatttttccggcatagtggatgagaacgatcaggtgtggctcggtggataccccggcgcgctgcgtgacctgctcggcatccggatcgaggagttcggcccgctgctcgacggggagaccgccgagctggacaacggcacggtcggcacgctgtggaccgaccgggtcgacgtcaccgatccacacgtggcggtcctggcccggtacaagaccggtgaccaggcggaacgtgccgcgatcacccggcgtgcggtgggcgccggctccgcggcctacgtctccacccggctcggcccggatggtctggccgcggtgctgcccggtctgctccaggccgccggagtgaccagcgaactcgctcctgagctgcgcggacgtgtcgagctggcgcgccgggccaggcaccgattcctgatcaaccggaccgccgaaccgatcgacctgggcgcggacggcatgctggccggccgcgacgtgaaaatcattcaggattga

SEQ ID NO: 5636 - DNA, 858 bp, Actinoplanes utahensis
atgccggaagacgactcccggtcggggttgcgggtcggcggctgggtgccgccgtattctcccgacgcgcggtcccgcaagccgctgatccggccgaccgccccgaccgatttccccccacccccgatcccctatttcgccggctggaaccgtcgctccatgccgtggcggcggcgtgccgcgctggccgccgccggggccgcgaccgtcggcgtggtggccgcggtcagcctcggtgacccggcgtcccacccggcgttcgtggccgcgccggacccggccggcaccgtggtcccgttctcgctgccgccccggccgccgtcgccggtcgagaccgtcccggtggcgtctaacaccagttcacggcccaccgccaccgggagcgctcccaaaggtgggccgacgaggcgggcccccgcagcggtgaccctgagcgtcggcgggaccgaggcgctgacggtcgccgaccgcaccggcttccgggtccggcaccggaacttcctcggccggctcgatccgatcgggccgggcagttccgtcctcgaccgcgccgactccagctttaccgtgcgtaaaggcttgaatgattccagatgcgtttcgcttgaatctgttaactatcctggctatttccttcggcaccagaacttcgtgctgaaactgcaacggcgcgacggttccggactcttcgccgcggacgccactttctgtcccgtgacgattcgctcgggcgccgccctggcgttgcgatccagcaattatccgaaacggttcgtggtcgcctccggcgaccggctcacgctcgacgagtccgccccggaggcggcgctggcgctcgtgccgcgggcggcggattga

SEQ ID NO: 5637 - DNA, 396 bp, Actinoplanes utahensis
gtggaaagtcccgttacgccggaaccatccgggctgccgccgacgctgccccgcatctcggattactggcccgacgcgccgcaccggctcgggccgccggccgacgtctacgagctgcccggggtcgaggcgacacggacgggaacgccggccggcgggcttgcgggagaccccgccccaccggacggcacgcgctggatcggcgcaccaccggaaccgcgtaccggccgggactggaaacccgtcgtcttcctcgtggcggtggtgatcctggtcagcggcggggtgctcgccgcgctggccgccgtgcggtccagcggcgaggacgccggcagcctgcccgccccgccgctgccggtgccgaccgtcggcgggaccccgccggccaccccctag

SEQ ID NO: 5638 - DNA, 603 bp, Actinoplanes utahensis
gtgcccccggcgcccgccggcccggcgctgccggacaccgccaccttcgagctggccgacggcgtcgcgcagctgcgcgtctcgatcggcgacgtgcccaggggcctggtcaaggtcagcgtcgggaagaacagcaggatcgccgcgcggaccacggtcagcggcggcacggtgcgggtcgacgtcaggccgaacggccgcaggacgggcaccgcccggctcgaagtgctgctcaactcgtcggtgacctggtcgttgcggatgcgcggcggggtcagcgaggccgggatcgacctgtcccgcggcaggatccgctcggtggacctgatcggcggcgcggccaccgtcgacctgtccgttcctgatcagcgcgcggcgatcccgatcaccgagcgtggcgggatccgaacctggcggatcgtcaccgaaagcagggtcgcggcgcgggtgttcctgcgccggggagccggggtggtcaccctctacggcgacaccgacgccggcgtcgaccggggcgtgaccctgcggtccgggcagggtgacggcggcatccgggtcgattcggagggcggcatcggcgccctgaccgtccaggcccgctga

SEQ ID NO: 5639 - DNA, 609 bp, Actinoplanes utahensis
gtgacacgtactcagggtgacgccctgccgccggaggcgtcctactcactcgaccacttcatcggcctgtacgaggcgaaaggcgacccctgggacaacgccaccaaatggagcgaccagcgtaaatacgcggtcgccatggccagcctgccgcagccgcgataccgccgctgctacgagccgggctgcgcggtcggcgtgctcagcgtgatgctcgccgcccgttgcgacgaggtggtcgcggtggactgtgtggacgaggcggtggtccaggcccgggcgctgaccgccggactgccgaacgtccgggtcgagcgggcgctgctgccggccgagctgccgggcgggacgttcgatctgatcgtcgtcggggacctgctctactacctgtccgcggcggatctgcagacgatgctcgacgggatggtggagcggctggaggagggcggggacctggtgtcggcgcatttccgggatcggctcaacccgggaaactatgacgggttcaacgtgcatgaggcgatcgccgcccggccggggttggcgcgggtgatccaccacgaggacgagtggttcgtcctggacgtcttccggaaggtcgcgggttag

SEQ ID NO: 5640 - DNA, 1521 bp, Actinoplanes utahensis
gtgacagaacgtaccgtaacgctatttttgtccgggttactcgaagagcacccggtcggaggaaagcctcaaccggccccggtgaccgccgatctgacccacatgctgctccgctgctacgtcgcggtcaccacgctgctggtggcgacctatctggcgtggccgttcgacgaccgccagtggccgtacctggcggtcaccctcggggcggcactgcccgcggtcggctacgccctgcgtcgcgccccggccggcgcgcggctgccgtggtggttgatgctggcggcgctcacgtcgtacaacatcgggaatctgatctggatcgtgctggtcgaggtcggcggccgggccaccggcgacggcagcctggccgaactgttctacaccggcggcgggctgtgcctgctgacctcggcgatcgccgtggtcagactgcgcggcgccggcgacatcggcggggtgatcgactcggtgatcaccgcggtcgcgctcggcggggtgctctgggatgcggtgctgctgcccgccatgtccgcccagcaccagtcgacgccacgtcagctgtcgatgttcctcgggctgacgatgatctccgggacactgggcgcgatgctgcgcgtctcgatggccggccgtcgctcggcgtccgtctggctgatcaccgcgagcgtcgccctggtactggtcgccgacgtggtctcggccctcgccgtcggcccggacggcgtgcgggccgactggaccaacatggtgtacctggccgcctacgccgtactcggctgggccgcgctgcacccgtcgatcaccacctgggtgacccccggccaccgccccgccgacgagatcagccgcggccggctcacctttctcggcgtcatgctggccctcaccccgatggtcggcggcggccgcgcgatcctcggcctgcccaccgacggcatcctgatcgccctctcctcggccgccctcacccctctcgtcatgatccggatcgcccgtctcgccgcccagcgtcgcgccgccgagaaggccctgcaccacctggccacccgtgacgcgctgaccggcctgccgaaccgcgccgcctgcctcgaccacctcagcacagccaccatgtccgccgaacccctcgccgtcctcttcggcgacctggatggcttcaaaccggtcaacgaccggctcgggcacgctgccggcgacgagctgctcaccctggtggccgaccggctgcgcgcctgcgtacgggaaggagacctggtcagccggttcggcggggacgaattcgtgttgatctgccggggcgagacggcggtgccgggggtgagcgagcggatcgcggcgatgaccgccctgccgttcgtcgtggcgggggaagaggtctacctggggatgagcgtgggggccgccgccggacgtaccggggatcgggccgaggcgctgatccggcgggcggacgaggcgatgtacgaggccaagaagtccaagcgggtgggcgcgctgagcctggtcctggccggctga

SEQ ID NO: 5641 - DNA, 996 bp, Actinoplanes utahensis
atgcgcgttcgttccacggtcctgaccggcctgacctgtctgagcctcgccgcctgcaccgcgggcgccggcccgggcccggcgcccgcgccggtcgtctccaccgagccggcggagcagttctatgtggacccgtccggtgccgccgaggcccaggtgcggtcgtggaacgcgcagggccgggcggccgacgccaccgcggtgcgccggatcgccgatcagccggccgcggtctggttcgccgacgccgaccccgggttcgccggccgggcccgtgacctggtcaccgccgccgcggcggccgggcggacaccggtgctggtcgcctactacgtgccgcagcgcgactgtggtggtcactccggcggtggggctccggacgccgcggcctaccgggactggatcggtcagctggccggcgcggtgcacgactcgccggccctggtggtgctggagccggacgcggtcacccacatcctgcagggctgtctgtcgccggaggcggccggtgagcggttcgcgctgctcggcgaggcgatccacgcgttccgggcggatccgggggtgcgcgtctatctggacgccggcaacccgggctgggtcaaggacgtcgaccgggtcgtcgacgcgttgcgcagcgcgggcatcgccgacgccgacggcttcagcctgaacgtggccaacttcgaaaccacccaggccaacctcgattacggtacgtcgatctcggaccgtctgggtggcactcacttcgtgatcgacacgagtcgcaacggaaacggtccggccaccaccgccacgtccggggacggccactggtgcaatccgccgggccgggcgctgggtccggccccgaccacccggaccggccacgatcgggtcgacgcgtacctctgggtgaaacgccccggcgagtcggacggcgcctgcggcgacggcgccccaccggccggtcagtggtggccggagtacgcgctgtccctggccaccaactga

SEQ ID NO: 5642 - DNA, 3069 bp, Actinoplanes utahensis
atgcagatcggggtgctcgggcctctcctggtgcgcacgcgggacggcgcgccgatcgatgtgcccggcgcccgcctgcgcgcgctgctggcgatcctcgcgctggaggccggtcgcaccgtgccgaaagccaccctggtcgacgggatctggggtgacacctcgcccgcggacgccaccaacgccctgcaccgcctggtgtcccgcctgcgcaagctgctgcccggcggcctgatcgaggcccatcaggacggttaccggctggccaccgaccccgactcggtcgacgcggtccggttcgaacggctgctggccgccggccgcccgggggaggccctggccctgtggcgcggccccgccatgcaggacgtcggcctcaccggcagtcccgccttcgacgcggcggtcacccggctgcaggagcagcggctggccgcactggagacccgcgacgccggcccggagtcgatccccgaactgaccaccctggtggccgcccacccggtgcgcgagcggctggtcgccgcgctgatgcgcgccctggtggccggtggccggaccggcgaggcactgcaggtcttccagcgcacccgagagacgctggccgacacgctcggcgtggacccgtccccggagttgtccgcgctgcacgtggccctgctgcgcggcgaggcggccggcccgcgggccgccgaccgcggcaacctgcgggccgagctgaccagctatgtcggcaaggacgtcgaggtggccacggtccgtgggctgatcgggcggcaccggctgaccacgctggtcggcccgggcggcaccggcaagacccggatggccaccgagaccgcgcggtccatgctggacacgctgccggacggcgcctgggtggtcgagctggccgggatcggcgcggacggcgacgtcgcccaggccaccctggccgcgctcaggctccgcgacgccctgctcggtgaggcgccggacgcgtccccggtcgaccgggtggtggccgccctgcgcgagcgggacgtgctgctgatcctggacaactgtgagcacgtgatcgagtccgcggccaccttcgcccaccgggtcctcggcgagtgccggcggctgcggatcctggccaccagccgggagccgctcggcatcatcggcgaggcgctctggccggtcgcgccgctggcgctgccggacgaggacgccgcgccggagcacatcgcggcgtcgcccgcggtccggctgctgcgggaccgggccgccgcggtccgctccgacctggtcgccgaccctcgcgcgccggccacgatggcccgggtctgccgggcgctggacgggatgccgctggccatcgagctggccgcggcccggctgcgcaccatgtcgctggagcagctggcgaaccggctcgacgaccggttccgcctgctgaccggcggcagccggaccgcgctgccgcgccaccggacactgcgcgcggtgatcgactggagctgggagctgctcgccgagccggagcgggtggtgctgcgccgcctgtcggtgttcgccggcggggccaccctggaggcggccgagcgggtctgcggcgccggtgacgagaccctcgacctgatcaccgcgctgaccgagaagtcgctggtggtggccgtcggcgagggagcgccgcggtaccggatgctggggaccgtccgggagtacgccgagcagcggctggccgaggccggcgagaccgacgcggtgcggcgggcgcatctggcctggttcaccgagttcgccgagcgggccgagccgcatctgcgccgcgccgagcagttggagtggctggccctgctggaggccgaccacgacaatctgagcgccgcgatgcgcggggcgctggccgccggcgaggccgggccggcggtgcggctggccggggcggccggctggtactggtggttcggcgggcacaaggcggagggctacgagctgctgatggcggcggtcgcgctgcccggcgaggtggccgacgacgtccgcgcgctggcgtacgcgttcgtcatcatgttcgccgggtccgggcacggcgatcagttcgccaccgccgagtggatccggcgggcccacgcggccggccgggatgccggcggcgggcacccggcgctgcgcctggtgaccgcgatggagcggctgctgcggggcacggccgcggccgcgttcgagccgctgctggccgacgacgacccgtgggtgcgggcgctggcccggctgcagatcggcaagatgtggatcgctctgggccacgaggcgaccgacgccgacgcctacctgacggcggcgctgcgcgagttccgggcgatcggcgaccggtgggggatctcgttcgcgctgaccgagctggccgggcggatcgccatgcgcggtgacctggccgccgcgggggagtgcctggagcaggcgatcgcggtggtgaccgaggccggtgcgatcgaggacgtggtgccgttgcggtcccggcaggcgaagctgcactggctggccggggatccggccgccgccgcggccgcgctggccgaggcgcagcgggtcgccggccgggtggcctggccgcacgcgctggtcgagctggccctgacccgggccgaactggccgcctggagcggggacgcggagcgggccggcgggctgctcgacgaggcgatggcgatgctgggcgcggaggccggtcaaccgatcctgcgggcgctcgggcaccacatgcgcggccggctggccgcggatccggacgcggcccgcgagcaccaccgggcggcgctgcgcgcggtgaccgaggccgggcacgcgccgctgaccgcccagatcctgaccgggatcgccggttgggcactggacaccgggcgggacgccgaggcggcccggctgctcggggcggcggtcgcggtgctgggcatgccggaccgctcgcacccggaccccgcccggttcgagctgcgggcccgcgaccgcctcggcgaccgggcgttcgccgaggcggtgcgcgaggggggcggaccggactgggccgagctggccgaggtcacgctcgcttcgtga

SEQ ID NO: 5643 - DNA, 741 bp, Actinoplanes utahensis
atgagcgactcgatgatcatgctgcgccgcaacttccggcacaccctgcgcaaccccaccacgctgttcaacgcggtgctgttcccggtagtgatcatgctgatgttcgtgtacctgctgggtgacgcgttcagtgtgggcgtcgactatgtggactacgcgacacccgggatgatcctgctggccgtctgctacggactgagcgcgaccgcgaccgcgacgaacgccgacatgaccaagggcatcatcaaccggttcaaggtgatggacgtgtcccgcggtgcggtgctcaccgggcaggtggtggccagcctgctgaacaacgtggtcgccgtcgccgcgatcatcggcaccgcgttcgcgctcggcttccggtcctcggcgagcctgctcgactggctcggcgtggccggcatggtggtgctgctcggcgtgtcggtgggctggctgaccgtggcgctgggcctgaccgccaggacggtggagacggccgggctggccaccgtgccgctgatcatgctgccgttcttcagcagcgccatcgtcccggccgacaagatggggccgggtgcccggcagttcgccgagtaccagccgttcacgccgatcatcgagaccctccgcgggctgctcaccggcatgccgtccgggcacgacgcgatcctcgcggtcggctggtgcctcgtgatcggggtcggcggctacctctgggcggtgtccgccttcacgaagcgagcgtga

SEQ ID NO: 5644 - DNA, 927 bp, Actinoplanes utahensis
atgacaaccgcgattgaggtttccgggctccgcaaggccttcggggacagggtcgtcctcgacggcatcgacctgaccgttccggccggcaccgtctactgcctgctcggcccgaacggggccggcaagaccaccaccgtcaacgtgctgaccaccctgatcggcgcggacgccggcctggtccggatcgccgggcacgatctggccaccgaggcccgggcggcacgcgccacgatcggcgtcaccgggcagttcgcggcggtcgacgagctgctcaccggccgggagaacctgcggctgatggccgacctgcgccgggtgcgcggcgacgtggccaccgggctgctggaacggttcgacctgaccgcggccggcgacaggctggccgccacctactccggcgggatgcgccgcaagctggacctggcgatgaccctggtcggcgacccgcggatcatcttcctggacgagccgaccaccgggctcgacccgcgcagccggcgcaccatgtgggagatcatccgcgggctggtcgccggcggggtgaccatcttcctcaccacgcagtacctggaggaggccgaccggctggccgaccggatcgccgtgctcgatcagggccggctggtcgccgagggcaccgcggccgagctcaagcggcggatcccgggcagccacgtccggctgcgcttcgccaccacggccgacctggacgcggccgcccgggtgctgcccgatgccacccgcgacgacgacacgctcaccctgcgcgtggccggcgacggcggcacccggtcgctgcgctcgctgctcgaccggctcggcgggtacgcgctggacgccgaggagttctcggtgcacacccccgacctcgacgacgtcttcctggccctgaccgggaacaccccgaaggagagcaaccgatga

SEQ ID NO: 5645 - DNA, 1950 bp, Actinoplanes utahensis
atgatcccccgaccgcaaccctcgctcgcccgccggctgctgcgcacgctggccatcgtcccggccgtggcggcggtgctcgccgcgaaccagccgatcgtggtcttcgcggccgaccgcatccaccggttccggatcgaccgggagagctacaagcaggcgtacgggcactggtcgatgctggccgtcccggacaagttcaagatcaacgcaatccacgcggcgctgctcagcaccggcaaggtcctgatcatcgcggggtccggcaacaaccggcagaacttcgaggccggtacgttcaagaccatcctgtgggatccggcgaccgacgggttctcgctggtgccgaccccgtccgacatgttctgctccgggcacaccttcctgccggacggcaagctgctggtcgccggcggcaccaagtcgtacgaggtgctgccggggaacatcaggttcgcggccggggtcatgaagatcaagaacgagtcgccggaccacgggccgcggaccatcgccaagggcacccggttcgtcgcgccggacgggcggcagtacgcgacccggaccgcggtcaccgtgccggccgcgatgaagatggtgcacgccggccagaccatggtgcacgccggcgaggtcgaggtctgggtggacgcggtgatcgccggcgacacccagtcgatcaaccagcccgcgcagtacgagatcgccggactgaccgggcgggacgcgaagaacctctacggcgtcgccgacaagatcaacagagagaaacaggagtacggcggggacaacaccacctacgagttcgacccccgcaccgaacggtacgtgcggaccggcaacctgaccgaccaccgctggtatccgacgctggccccgctgcccggcggcaacgtgctcgccgtgtccgggctggatcagttcggccggatgctgcccgggcgcaacgagatctacctgaccagggagcaccgctgggtcgccgcgccgcagctgacccggaacttccccacctatccggcgctcttcgtgaccagggaccagcggctgttctactccgggtcgaacgccgggtacgggtcggcgaccgtgggccgcacccccggcctgtgggacctgacgaacaacgacttccagccggtccccgggctgcgcgacggcacgatgaccgagaccagcgcgtcggtactgctgccgccggcccagcggcagaaggtgatgatcctgggcggcggggcggtcggtgactccccggtctccaccgcgcggaccgcgatcgccgacctgagccggccgcacccggtctacaccgccggaccggacctgccgaacccgacgcgctacctgaacaccgtggtgctgcccgacgacaccgtcttcaccagcggcggatcgtcgggctaccgcggtgggccgtaccacgggcagaaccgcagcgacctgctcaccgcccagttctacgacccgtaccgcaacgccttccggaccgcggcggcgcccagcgtgggccgcgactaccactccgagggactgctgctgccggacggacgggtggtgaccatgggcggtgacccgatctacgaccggtcgggcaagaacccgggggtcttcgagcagcgggtggagatctacagcccgccctacctgttccgcggggcccggccgcggatctccggcgggccggccgaggtggcccgcggggcgaccgcttcctaccccagcccggacgcggaccggatccgcacggcacggctgatccggccggccgcggtgacccacgcgaccgatgtggatcagcgatcggtggcgctgcccctgcgccgcgggccgggcgggatcaccgtgcagatcccccgcgaccgtggactggtgccgcccgggtggtacatgctcttcgtggtggacacggatgcggtgccctcctcggcggtctgggtacacgtcccgtaa

SEQ ID NO: 5646 - DNA, 1695 bp, Actinoplanes utahensis
atggcctacgactacgacagcttcagccgcctcgccggtcccccggatccggtccccgacggtgactaccgggtcagactgcgaagactggcccatcatcgcccggtccgcagtctcctgatcgccatcttcgcgttcacctgcgaggccaccttcttcggctggctgctcacctcggccgacctgaccggtggcgtctcccccgtcaccgctgtcatgatcggcgcgatcgccctgatcgagttgttccgcctggtcaacgtggtcactctgtgcctggccacgctgcgggcccgggatcccgtgccggtcccgcccgaggccgggctgcgggtcgccttcctcaccacgatcgtgcccggcaaggagccggtcgccatggtcgagcagaccctccgggcggccgtccggatccgcggcgagcacgacgtgtggcttctcgatgagggtaacgacgacgacgtccggaagatgtgcgcggacgtgggcgcccgccacttcagccgcaagggcgtcacccggtggaatgccgcgaagggcgcgttcaaggcgcggaccaagcacggcaactacaactcctgggtggacgcgcacggcgacgactacgacgtgttcgtctcggtggacccggaccacgtgccgctgccgtcgttcggcgagcggctgctgggctatttccgggatccggacgtggcgttcgtggtggggccgcagatctacggcaactacgacaacctggtcacccggtgggcggagtcgcagcagtacctgttccactcgctgctgcagcgggccggcaaccggctgggcgcgccgatgctggtcggcaccaacaacgcggtgcggatcagcgccctgcgcagcatcgggggcctgcaggactcgatcaccgaggacatggcgaccagcctcgccgtgcacgccacccggaacccggcgaccgggcggcgctggcgctccgtctacaccccggacgtgctggccgtcggcgagggaccgtcgtcctggaccgactacttcagccagcagcaccgctggtcccgcggcaccgacgaggtctgcacgggcgcgttctggcgggccctgccacggctcggcgcgggccgcgggctgcactacgcgctgctgatggcgtactacccgacgaccgcgctggcctggctgctcggcacggtcaccgcggtcgcgcacatcgcgttcggggtgcacggcgtacaggtgccgcagcaggtgtggtcgatgctctacgtggacgccgcactcttccaggtcggcctctacctgtggaaccggcggcacaacgtgagcccgcacgaggaggccggctcctcgggattgaccgggatgctgctgtcgacgctgtgcgccccggtctacgtgaccgcgttccgccagacggtgctgcgccagcaggccggtttcgtggtcaccccgaagggcgattcggccagcccggaccgggtcgccaccttccgcagccacctgtgctgggccgccgtgttcgcggccctgctggtcaccgcggtggtgaccggtcgtaccggcggtctgatgtggctctggccgtcgctgaacctggcgctctgcctggctccgccggtgctctgggcgaccgccgcgaaaccccccgccccggtcgccgccgccccgatccccgcgcaacgcaccaaggaacccgtgaggacgtacgcatga

SEQ ID NO: 5647 - DNA, 489 bp, Actinoplanes utahensis
gtgatcgccgggcaatctcccggcggttcgccgcggacacgccgaaacccggccggtgaccgccggtcggatgattctgcggctcccctgcgctgcgtgatccgggtccggcgctttgctcggcaaaccttcgaaccgaacggtcctgtgatccgtttgctttgtcgaggcggcgcgaacgtgacccgccggagattcgacaaggcggtggcgatgctgatcctgttcctgctcatcctggttctggccgccgcctgcgtgctcgcggtgcgcggtgtccgggcggaggcccgcaaggccgaggagccgctgctggttccggaatcgttcttcgcaccgcagagcctcgaaggcgtcctctgcacccagctcctcgacggcgacatcacccgccgccaatacctgcgctcgatggccggcatcgcggcccgcgacgaggcccgtcacccgctggtcgtcccgtggcacctgggcgccggcgaggaatag

SEQ ID NO: 5648 - DNA, 756 bp, Actinoplanes utahensis
gtggccgggaccgtccggcgtctcccaggggccgcggcggcgcggcttttccggcatggtcgccgggtggagcatggggacgcgacgaaccggcggagtctgtatcaccggatttcggggggcagtgtcgagcggctcgcggcgttgagtgacggcatcttcgccgtgacgatgacgctgctggtgctggatctgcacgtaccggtggccgcagaggtaagccggcagcggccactgtggagtgccggcgcggtggcgccggagcgggcactgtggggtgcgctggtccacgtcgggccgagcgcgctggcgttcgcgctgagtttcctgactctggggatgttctggctcggccagcagacgcaactcaactactgtgcgcgcggggatcggcagctgagctggctgcacctgacgttcctgctcggggtgtcgttcatgccgttctcgacggcactgctcgccgagtacatgacggtccggctggccctggccgtctactggctgaacctgctggtcctgggcctgctgctgctggcctgcctgcggtacgcggagggcgccggactgctgcgcgaggaccgggatccgggtttccgggccggcctgcgccgccggatcgtggtggcgcaggccgtctacctggtcggggtgctgctggcgctggtcaacacgtacgccgggatcacgctgatcgtgctgatgcagctgatctcggcggtcggcccgaagatccggccgttcgaccgcttctga

SEQ ID NO: 5649 - DNA, 1974 bp, Actinoplanes utahensis
atgatcggcgactcccttgatgaggttcacctgcaggaagtgctggacgggcggtgggcgcacatccggcgggcggtgcgtgacgagctcggcaaggccggcttcgcggcggtctacggcgagactggagacgaggcccgcgagcgggtttcccggctgatccggcagattccgtccgacatcggggtggcttcggcattcccccgggcgtatggcggctccgacgacccgggcgggtcggtggtggcggcggagatgctggcgtacgccgacctgtccctgatggtgaaggccggcgtgcagtgggggctgttcggcggggcggtggtggcgctgggcaccgaacggcatcacgcggcgttcctgcccgggatcatcgacaccgagatcatgggctgcttcgcgatgaccgagaccggtcacggctccgacgtgcagaaactgcggacgacctgcgagtacgacccggcgaccgagacgttcgacctgcacaccccgcacgaggcggcccgcaaggactacatcggcaacgcggcgcgggacgggcggatggcggtggtcttcgcccagttgatcaccggcgggcgtggccgcggggtgcacgcctggctggtgccgatccgggacgcggacggcaacccgatgccgggggtgaccctcggggacgccgggcacaaggccggtctgctcggcgtggacaacgggcggatcagtttcgaccatgtgcgcgtgccccgcgacatgctgctcgaccggtacggccaggtcgcgccggacggcacctactccagcccgatcgagaacgacacccggcgcttcttcaccatgctcggcacgctggtccgcggccgggtgaccgtgggcggcgcggcatcggcggcgacccgggccgcgctgaccatcgcggtgcgctacggcgacacccgccgtcagttcggggtgcccggcgccgaccgcgaggtggtgctcaacgactacctcgcccaccagcggcggctgctgcccgcgctggccaccagctatgcgtacctgttcgcccaggaggaactggtcggcaccctggccgacgtgcaggccggcccggaaccggtcgacgagcaccggcagcgggagctggagtcccgggccgccgggctgaaggcgatgcagacctggcacgccacgcacaccatccagatgtgccgggaggcgtgcggcggcgccggctacctgtccgagaatcgcctgcccgcgctgaaggcggacaccgacgtgttcaccaccttcgagggcgacaacacggtgctgctgcagctggtcgcgaaggggctgctgaccggctaccgggacgcgttcggctcgctcgacggctggggccggacgacgttcgtggccgagcaggtgcgggagatggtcctggagcgcaccgccgcccgcggactgatccagcgcctggtcagcgcggtcccgggccgccatgaggaggtcgcggtcaccgaccggggctggcatctgaccatgttcgaggaccgggagaagcacgtcctggagggcgcgatccgccggctgcgcagcggcgcggcgtccaaaaaggatcacccgttcgacatcttcaacgacgtccaggaccacgttctcaagacggcgaccgcacacatcgaccggatcaccctggaggcgttcgtcgccggtatcgaccgggccaccgacccgggggtgcaggcgctgctcggcaaggtctgcgacctgtacgcgctgaccacgatcgaggcggaccgcggctggttcctggaacacggccgcctcaccccggcccggtccaaagccgtcaccgccgtgatcaacgacctgctgaaggagctccgcccgcacctgcggacgctggtcgacgcgttcgccatcccggacgggtggctgaacgccgcgatcctgcgcgaggaaccggcccgccaggagtcgacagccgaggaggacgcgcggatcaccgccggctga

SEQ ID NO: 5650 - DNA, 495 bp, Actinoplanes utahensis
gtgaccgagcagccgccccaccccggaccgacccctgccgaacccacgtccggctatcccgctcccggctacccggcggcctatcccccgggctatcccgcggcttacccgcccgcgcctcccggctaccccgcggcctacccgcccgcgtctcccgggtactccgcggcctacccgccgccctatccggcatcgggataccccgccgcgtacccgcccggctacccgccgttccccggtgggtatccgccacccccgccgaccggaaagatccacccgttcgccgtgaccgccctggtcaccggcctgatcggcctcgctccggtcgccgtcatcttcggcatcctggcgatccgccggatcaaccgcaccggcgagcgcggccgcccccaggccgccggcggcctgatcgccgccgccatctggctgatcgtcatcctctatgtcgtcgaattcgtcctgaccttccacgatctccggatgacgacggtctga

SEQ ID NO: 5651 - DNA, 660 bp, Actinoplanes utahensis
gtgggttcggcaggggtcggtccggggtggggcggctgctcggtcactgcttctccggcgaatcttgctcggcttctggaggcgtcaaggtaccgcggggcgccggaaaatcgcgaattcccgtcggtgggtcgctctacgatcccgggcatgctgaagttgagcttcgtcgagggcgacgcgaccgcgcctgccggcagcggcccgaggatcatcgcgcacgtctgcaacgacatcggcgcctggggcgcgggcatcgtccggaccatctcgcgccgctggcccggcccggagcggatgttccgcgcctggcacgcgtcgccgggcgccgagccgttccggctgggtgccgtgcagctggtgccggtggagccggagctctgggtggccaacatgatcgtgcagcacggcatcgccacccggcgaggtctgcgcaccggctcgggtcacgagcgggacgccgggccgccggtgcgctacgaggcgatccgcgagtgtctcgccaccctggccgtccacgcgcggacccaccgggcgtcggtgcacatgccgcggatcggttgcggcctggccggcggcgtctggagtgagatcgagccgctgatcgaggagacgctcggcgccgccgacatcccgacggtgatctacgacctccggtga

SEQ ID NO: 5652 - DNA, 1398 bp, Actinoplanes utahensis
atgttcgacgtgatcatcgccggttgcgggccgaccggcgccctgctggccgccgagttgcggctccacgacgtccgcgtgctgctcctggagaaggagaccgagccgccggccgcggtccgcatcgtcggcctgcacatgcgcagcctggagttgctcgccatgcgtggcctcctggaccgcctgcgggaacacggccggcagcgccccgccgccggtttcttcgccggcatcgacaaacccgtcccgaccggcctggactccacccacgcctacctgctcggcatccgccagccgatcctcgtcgagcagctcaccgagcatgcccgggccctgggcgccgaagtccgccagggcgtcgccgtcaccgcattcgaccaggacgacgacggcgtcaccgtcgacctctgcgccggcgagccggtgcgcgcccgattcctggtcggctgcgacggttcccacagcaccgtccgtaaactgctcggcgtccccttccccggcgagccgtcccgctcagaaaccctgatgggcgagctggaagccaccgcctccggcgaggagatcgccgcccgggccgccgacatccgccgcgccgaccggcgtttcctgctcaccccggccgggcccgcgacgtaccgggtcgtcatccccgcccgcactctcagcacccgcgcggaaccacccactctcgaggacttcaagcgggagttgcgggccaccgccgggaccgacttcggcctgcactcgccacgctggctctcccgcttcggcgacgccacccgtctcgtcgaccgctatcggatcggccgggtcctgctggccggcgacgccgcccacatccacccgccgatcggcggacagggcctcaacctgggtctccaggacgccttcaacctcggctggaagctggccgcggagatcggcggctgggccccggacgggctgctcgacacctaccactcggaacgccacccggtggccgccgaggtgctcgacaacacccgggcccagagggagctcctcgccccgaccccgggcgcccgggcgctgcgccgcctgctcaccaccctgatggacatcaacgacgtcaaccggcacctgatcgagaagatcgccgccacggacatccgctacgacttcggcgacgacctgctcggccgccgccagcccgacctggagttgacgcagggccgcctctacgacctgatgcaccggggccgggccctgctgctggaccgcagcggaaccctgagcgtcaccggttggtccgaccgcgtggaccacgtcaccgacccggccgacgccccgtcggtgctgctgcgcccggacggccacatcgcctggctcggcgccgcccagggcgacctgaaccgtcagctcacccgctggttcggctag

SEQ ID NO: 5653 - DNA, 924 bp, Actinoplanes utahensis
atgaccgccaccgctctgcgcgccctcctgcactccggccgggtcacccacgtgcccggcgtccacgacccggcgaccgccgcgctcgcggtcgccgccgggcaccgggccgtccacctgtccggcgcggccgtctcggcgaccatgctgggccgccccgacctcggcttcgtccccgcgacacagctcgccgaccgggcgtccatcctggtcccggtgctgaacggggtgccggtgctggccgacgcggacaccggtttcgacgacccggagcacgccgtgtggaccggcctcgcctaccaccgggccggcatctccgggctgcacctaccggatcgggccggcatctccgggctgccgctgccggaccgggccggcatctccgggctgcggctgccggaccgggccggcgcgacggggcgccacgaggtgatcgctcccgggccggcggccgccaaggtcagggcgctggccgaccgggtgccggagctggtggtgatcgcccggaccgacgcgtacgcggccgacggcctgggcgagacgatccggcgctgtgtcgcctacgccgaggcgggcgccgacgcgatcctcccggggggcgtgcacgacctcggggagctcgaccggatcagccgggcggtcaacggcgtaccgctggtggtcgatcgcagtgaagccgccggcagtccgcccgcctcgaccgacagcgatctggccgcggccggcgtccggctggtcctgcacccggtcgccgcgctgctcgccgcgatgcgcgccgcgtcgctggcctaccgcgcgatcgccgagaccggcaccgccgagcaggtcgaccgcctgccgtgggccgcgttcaccgccctggccggcccggacgagaccgcggacagcgacgcccgctccgtgcccgcgggtctgcagacgtga

SEQ ID NO: 5654 - DNA, 1068 bp, Actinoplanes utahensis
atgttcgacgaggctgttgtggtgggtgtcacggcgttctgtgagagcgcggcgccggtgagcggggatgaggtcaaggggaagctgctcagcggcggcgtggagccgtggctggcggagcggctcacctacttcctgccgctcgccttcggacgccgggtgatcgacggggcgtcggtggacgagacgttcctcgacggggagacccggcggcgtctcgaccgggacccggtctaccaggcggcggcccggcgagccctgatcgccgacgaggcggagatcgcccggatcgccgggtacagcagtgaggtggcggcggtcagccaggccgtgcagggcggggcggagctcacgaagctgcgcctcgggccgatcgcgctggaggacgcgctgctgccggtcgggtcgggcagtggcggggtgccgtcgccggcgagcgtgttcgcgcactggatgaccgcgtacggggtgccgatcggcgacgatctgcggctgggcgaggccgagttccgggccaccctggcggcgcatccgcggccggcgccggagctggtggtggcgcaggtgaacttcgcggtgaaccatccggcgctggcccgcccgtggatggtggagagctgcgtcggggtggcgcccacctggaaggaggcgatcttccagaccctcgcgatgttcgagcgggcggtcgcctacccgatgatcgccgccctgctggaccgcggcgcggccggcgacaacgtgcacgtggaacgcttcagccacccggccggcgagttcgacctgctgctcggcgcgcaggtggacctgttcgcgaccgacccggtgccgtccgccgaggcggtcctcgacgagctgctcgccgccctccgggacgtcccgctgagccgggcggtgcacgcgctgcgcttcttcaccgcctaccaggacggccggatgctgaccaacgaggtcttcctcgacggcgaaccgtgggaggccggctcgaaggtgaccgccgccgcccccgccccgctaccgaccggcccggtcggcgtccgcgtcttcgccttcctggtcccggtcggctag

SEQ ID NO: 5655 - DNA, 753 bp, Actinoplanes utahensis
atgcgacagatgacggtggtatcgctcaatctctgtgtcgggctgcgcaacagcctgccgccgctgcgcgagcgggcggcggcgatcggcgaacagctggaggactccggcgcgcaggcggtgctgctgcaggaggtgtggacgcggcgggcactacgcgacatccgggcccggctgccctcgtaccgcaactgggtctgcaagagcggtctggcgatcggcggccgggaaccgctgagcgaaccccgattccggcgcttcgccggcgtgcccgccggacatcgcagccaactggtccgggcggcggcgggacgctggttccgcggtctgctgacggcccggaccgcggacggggcgctgctcggcaacacccagctgacgtccaatcgggacggtgactggtccaccggaaaccgccatgacgctctgcaacgcgggcagctgaggtccctgcacgcggcgatgcgggcggccggcgacgcgccgttgcgcatcctcggcggcgacttcaacgtggccgccgacagcccgctgtattcggcggtcaccgatggcgacacctggacggacccgttcgccggcgacccgcgcgccacgttccgcatcgaatgcctgccggccggcagcaccgctcaccgcatcgactacctgctggtcagcggcgacgggtggcacgtcgccgcacgtgagctgctgttcaccggtgatctgctcagcgaccactgcgccccgctggtccgggtgacgtgctag

SEQ ID NO: 5656 - DNA, 912 bp, Actinoplanes utahensis
gtgaacgacgatcttctggctgatttcgtccgtgtcgaccgggaacggcgactggggacctacggcatccacgtgtaccgggaggggcacgaaccgctgacccaccggttccggtccgacgaccgggtcaatctgtactcggtgtccaagacgttcacgtcggtggcggccgggctggccgaggccgacggccggttccggctcgacgacctgttcctcgaccacttcccggagcttcgcgggatcgccgcggacgggttcgagcgggtcaccgtgcggcatctgatcacgatgaccagcgggtcgacgcacaagtggttcgccagtgagcggatcgacgcggcggatctgctgcacgagttcctggcggcgccactggacgccgaaccgggggagcggttctcgtacaccggctcggggccctatgcggtgggccggctgatcgcccggaccaccggcgccgacgtgcgggcctacctgctgccgcggctgttccggccgctggacctgcacaacccggcgtggcacacctgcccgctggggttcccgttcgccgagtccgatctgttcctgaaaaccggggagctcgcgcgcttcgcgcggctgctgctgcaggagggcgtctgggagggacggcagatcattccggcggagtacgtgcggcggatgcccgccgagaccgtcgacaccaccgcgatggcgcagcgcgccgcccagttcgggcacggttacggcctcggcgtctggctcagcggggacggcacgtaccggatggacggagcgtacggtcagtatgcgctgatcgacccggagcgacgggtgaccgtcaccgcgaccgcgcacagcgagggcgagcacgaggaagacctgttcgaggcactcgccgagctcctgaagcgcgtcgcgggatag

SEQ ID NO: 5657 - DNA, 1905 bp, Actinoplanes utahensis
atgagcatgttcggaggcggcttcggcggcccgggccacgccatccccggccggcacggcagcggcaccccgttcgccggcatcccgcccgagctggccgccggcgtcgcccgcctggaggccgccgagccgccgctgccggctccggacgagccgttccaccaacagcccgacacccgccggctgaccctgtggtcgctgctggccaaccgcccgggcttgctggtcaccgccgcactggccgtcctggccgaggcgttgctgctgcaggccggcccgctgctggtgcagatcggcatcgaccacggcatcgtggcccgcgacgtcccggtgcttgtcgtctcggcgctggcgttcgtcgccgcggtcgccctgaccgcggtcgcctccggggtgcggatccggcagagtggccggctcgccgcgtacgtcacccgtgatctgcgcgtccgggtcttcgcccacctgcagcgtctcagcctggatttctacaccagggagaaggccggcgtcacgatgacccggatgacctccgacgtggaggcgttgcagcagctgctgcaggagggtttcgcccagttcctgatccagggcctcaccatgatcgtggtcaccgtcgtcctggtgcactacgacgcggagctggcgctgatcacgttgctgctggtggtgccgcccctggccgccctgtcgatctggttccgccgggccgccgacctcggctaccggcggcagcgcgacgcgatcgccgctctcttctcacacctttcggagagtctgtacggcgttcgcgtgatcaccgcgcacaaccggcagcagcgcagcgtggtcgagcaccgcgaggtggtcggcgcgtaccgggacgccaacgaccacaccggacggatcaacgcggtgtacgggccgggcagttcggtgatcggcctgctgggcctggccgcgctgctggcgatcggcggccggcgggtgctgcgcggcgagctgaccatcggcgagctgaccgcgttcgtgctgtacatcaacgcgttcttccagccggtgcagcagctggtccagctgtacaccaactatcagcaggccagggcggccctcggcaagctgcgcgggctgctcgggacggtcaccggcgtaccggagagcatcgacgcccggcagttgccgccggcgaccggcggcatcgagttccgcggcgtttccttcgggtacgtgccggaccgtcccgtcctgcgcgacgtcaccctgcgcatcgcgccgggcgagacgatcgcctgcgtcggcccgaccggcgccggcaagtccacgctggccaaactggtcgcccggctctacgacccggaccgcggcgcgatcctgatcgacggtcacgacctgcgcgaggtgaccctcgactcgctgcaccggcaggtcggggtcgtcccgcaggagccgttcctgttcgccggcagcctgcgggacaacatcgccttcgcccgcccggacgccgccgacgccgaggtggacgccgccgtcgacgcggtcggcctgcgggacctggtggaccgctcgccggacggcctgcacaccgtcctgcacgagcgcggccagtcggtctcctccggcgaacgccagttgatcgcgctggcccgcgtcttcgtcgccgccccgcggatcatcgtgctcgacgaggccacctcgagcctcgacctgcgttccgagctgcgggtcgaggccgccgtccagcgcctcctgcagggccggacggcgatcctggtggcacaccgcctgtccaccgcgcgtcgcgccgaccgggtgatcgtcgtcgacgacggcggcatcctcgaatccggctcgcacgacgagctgatcgccgccggcggccgctacgcctcgatgttcgccacctgggagtcccacgcggccgcatga

SEQ ID NO: 5658 - DNA, 1770 bp, Actinoplanes utahensis
ttgtcacctgcccctcgccgtgccccgcgggccggcatcgatcccgacccgtcgaagagctggctgcggcgcgcctggccgctgctccggtcacaccgcgccctgctggtcacctcactcgtgctgtccttcgtcgggctggtcgtgcaggtgcagatcccgaatctggtccggatcggcatcgaccgggcgctggtcgcgcacaccgccggcctgtcccgctacgtcgccctgatcaccgccctgtcgctgatccagggcgtgatcaactatctggcccggctctacctgctgcgcacggcctacgagttggagtacgacctgcgcagcacggtcttcagccacttcatgcggatgtcgtacggtttctacgaccgggtgcagtccggtgagctgatctcccgggccaccgccgacatccgcgccgtgcagatgtatctgacgttcggcccgtcgatcctggtccagtgcatgatcgcggtgatcgcgttcggactgatgatctcggtcaacccgttgctggccgtggtgtcgatgctgaccatgccggccatcgcggtgctcggcgtccggatgcgcaaggcgatattcccggtgtcctggctgatccaggcgcgcctggccggggtggccacggtggtcgacgagaacatccagggcgtgcggatcgtcaaggcgttcgcggccgagcagcagcaggtggacaccctggcgtcggccgccgaccgggtccgctgggcctacgccaccgacgcgaggctgcgcagccgctggacgccggtgatggacaacctgccccggctcggcctggcgctggtcctgctgatcggcggcctgatggtgctgaacgggcacgcgacggtcggcaccgtggtggccttcaactcctacatcctgatgctgcagccgccgttccggatgctcggcatgatcatcatgatgggccagcgagccgccgcctccgcccgccgcatctacgacattctcgatacagaagccgagataaccgagagaacagaggccgcggcgccgccgccgcggggcgccgtctctttcgacgatgtccgcttcgcctacccggacggcaccccgggcctcaagggcctcaccctccacctcgaaccgggcgaaaccgtggccctggtcggcgccaccggatcgggcaaatcgaccatcgcccggctggccgcccgcttctacgacgtcaccgagggcaccgtggagatcgacggcgtggacgtccgcgactaccccttggcgaccctgcgggaccgggtggggatcgtccccgacgagcccttcctcttctccatctccctgcacgacaacatcgctttcggacacccgcacgccaccagggagcaggtcatcgccgccgccaccgcggccggcgccgccgagttcatccaggagctcccccagggatacgacacggtggtcggcgagcgtggctacaccctctccggcggccagcgccagcgcgtcgccatcgcccgggcgctgctggtcaaccccccgatcctgatcctggacgacgccaccagcgcggtcgacgtccgcgtcgagcacgagatccacgagtcgctgcgcgccctgatggccggccgcaccacgatcatggtggcgcaccgcctcgccacgataggcctcgcggaccgggtcatcctgatcgacgacggtcgcgtcctcgccgacggcacacacgccgagttgctcgcctccgagccgcgctacagcgcggttctggcccagaaggagccggtcgcatga

SEQ ID NO: 5659 - DNA, 1305 bp, Actinoplanes utahensis
gtgctccttaccgatgttgtccttagcctagctaacgatctcggtcgaacggaagtgtggcctcggcaaccgggatgcagccggccgtcactcggaccgcaaccggcgcgctccgatcgtgatggcatgctgcgccgcctcgccaccctcgccgccggtgtccttctggggctcggcctgcccgtccccgcccgggcggcgaccgtcgcctgcgggccggcggcggacagcccgcgctgcacggtgtggatgggccgggtggcctgggtgccggacggcgacacgctgatcgtcacggtgaacgggacgaagacggcccggtccatccggctgatcggggtgcaggccatggagcagcacacgtactcgccacggccggcgaaccggaccggcgaatgccacgccctcgaagcgacagcccgggtcgagcacctggtgcgggccggtggcggtgtcgtgcggctgaccgcgcaggacgcgcggagcaccagccgcggccggccgctgcggtccatcgccgtgcggatcaacggtcgctgggtcgacatcggacaggacctgatcaagcgggggtacgcgttgtggctgccgttcgccggcgagtgggcgtgggacgcggcgtacgcccgcgcccaggcgaccgcgtccacccgttcgaccgggatgtggaacgaccactactgcgggacggggccggcggcctcgatgaccgtgtgggcgaacacccagggtcacgaaggcgagttcgtccggatcgggaacaccggccgccgcgcggtggacctgaccgggtggtgggtgcgcgactcggggctgcggcggtacacgttccggcggggaaccgtggtgcccgccggtgggcacgtgtacgtgcacgtgggcaagggccgggacaccgtcaccgacaggtactgggggctcaacggccagatcttcaccaaccccgacccggcgcgacacgccctgggcgacggggcctacctcttcgatccgcagggtgacctgcgcgaatcgttcctctacccgtgcccgttgcgatgcgcgagcccgttgaccggcaaggtcaccctccgcccggagaacggcgcgatcgcgctggtgaacaccggctccgccgcggtgaacctgcagggccacatgctggtggccgagcggtggcagcaccggttcgacgagaagacgctgctgcagccgggggaggcgctgtccttcgcccggcggcccacgatgcggttgcagaccgccgacatgtggaccgtcgcctcctacagcgacgccgggccgggctcgccgttgcgccagtga

SEQ ID NO: 5660 - DNA, 654 bp, Actinoplanes utahensis
atgccggtcaccgcggcgaccgttctcgccacccggcagccggcgctggccccggtcttcggcaccctcaccctgttcaccggccggatgggctccggcaagagcaccctggctctgcagaacgcgttcaaccgtcgccaggccgggcgtcccggggtgctgctgaccagccaggaccgggcgggcgaggggataatgtcgtcgcggctcggggtgaccgcggacgcggtcgaggtgcatccgggaatggatctgaccgcgctggtcgccgagcaggtgccgtccggcgggttcgtgatcgccgacgaggcccagttcctcagcccggagcaggtggagcagctcgcctgggcggcggacgagatgggcgtcgacatcgactgctacgcgatcatcacggatttcctgtcccggctgttcccgggcgcgcagcggctggtcgagctggccgacgtgatcgtcccgctgcaggtcgaggtgacctgctggtgcggccgcccgggccggcagaacgcgcggctcgtcgacggccaggtggcccgggccggcgagcaggtcgcggtcggtgacacctcggagacgtcggcggtctcctaccgggtgctgtgccgccgtcactggcgcaacggcgagcccggcccggcgtcgctgtag

SEQ ID NO: 5661 - DNA, 1392 bp, Actinoplanes utahensis
atgactcaagcaggtcgccgccatcgtgtggtcgtggtgggagccgggttcggcgggctcttcgcgatcaaggcgttgcgcagggctccggtggacatcaccctgatcaacggtacggcgtaccacctcttccagccgctgctctaccaggtggcgaccgggatcctgtccgagggggagatcgcgccgccgatccgggaggtgctcaagcggcaggacaacgtcgacgtgcggctcggctgggtgaccgccgtcgacaccgagaacaaggtcgtctcggtgaacgggccgggcgtcgactacacggtggagtacgacacgctgatcgtggcggccggggcgtcgcagtcgtatttcggcaacgacgagttcgccgaccacgcgcccggcatgaagagcatcgacgacgcgctggagctgcgcgcccggatcttcggcgcgttcgaggtcgccgacctgcacaccgacccggaggagatccagcgctggctgaccttcgtggtggtgggcgccgggccgaccgggaccgagctggccgggcagatcgccgagctcgcccaccggacgctgcccgggcagtacaagcacatcgacccgcggcaggcccggatcatcctggtcgacgcgatcggggcggtgctgaacacgttcggtgaccacctgtcggccggggcgcagcgccagctggccaagctcggggtcgaggtgaagctgaacaccaaggtcgtcggcgtcgactcgaccggcatcgacgtggaggacccgcagggccggcaccgcatcccgtcgatcaccaaggtgtgggcggccggggtggccgcgccgccgctggcccgccagctggccgagtcgaccggggcgaagaccgaccgggccgggcggatgttcgtggcgccggacacctcggtgccgggacatccggagatcttcgtgctcggcgacatgatgaacctggccggcgcggacggcaagccgctgcccggggtggcccaggtggccatccagagcggccggcacgccgccgaccagatcaagcggcggctcgccgggaaggagaccggacagccgttcaagtacttcgacaagggcagcctggcgacgatctcccggttctcggcggtggccagcatcggcaaggtgcggctgtcgggcttcccggcctgggtggtctgggtcgcggtgcacctgttctacctggtcggtttcaagaaccgggtgaccgcggtgctgcactgggcggtcagcttcatcgggcgcggccgctcggagcgggtggccacgcagcagcaggcgttcgcccgccgggccatccgggcgtacggcgatccgttcgagcgggagcgcgccgagaccgtcaccgcgcacaagaagagcctgacggccgaccggtag

SEQ ID NO: 5662 - DNA, 99 bp, Actinoplanes utahensis
atggaggagaccgtggctgaatcgccgagagtgctggggatctcgtgggggcggatggaggtcgaggggctggctgagggcaaggatttcaagctctag

SEQ ID NO: 5663 - DNA, 507 bp, Actinoplanes utahensis
gtggtcgagaagcaggcggcgcgtcgtcgaattccgggtcgcgcgcgggttcgccgcggcacacctcctgacggtgacgatgcgccaggatggcgggcgttcgcgtcggccgggtcggggctgcaccacaagatctgccacgtgctgggcgggaccttcgggctgccgcacgcgcagacccacgcggtgctcctgccgcacgtgctggcgttgaacacggcgtacgccggcgatcgggtctcggcgatcgccgcggccctgggcgcgccgcggaccgggagcaccgcgaacgccgcgctggccggtctcgcgaccgcggtcggggcaccgcgttcgctgaacgggatcggtctgcgcgaagcggacattccggaagcggtggatctgatcatgccggtcgtgccaccgtcgaatccggcgccggtcactccggcgatcctggacgccctgttgcgggccgcgtggcggggtggtccaccggagtcgccgtcggatcgaaccatgtaa

SEQ ID NO: 5664 - DNA, 1065 bp, Actinoplanes utahensis
gtgacaacgtccgtggaacggccggccgccgccgaggccgcgccggtgagctcggcgttcaccgcgcgggagcggtgggtgctgctggtggcgagcgcctggctggtgatcggcctgcagctcgacgcatatgcgcacgccacgacaccgcagctggagacgttctggaccccgtggcacggcgtgctgtactccgggatcgcggcgtccggcttcaccctgctctggatcatgaaggcgcggctgcccagcatcccgacctaccagagcctgctggcgctgcccaacgcgctgcgcctgcccctggccggcatggcgtcgctgctggtcggcggcggcgtcgacacgctgtggcacaacatcttcggcatcgagaagaatctggagatcttcgtcagcccgagccacgagctgatcatcctgggcatggtgctggtcgcgatgggcccggcgctgatgaccgccaccgagccgggtcgccggctgggcaccggcggcgcgttcctggtggcgatctccgcgctgttcgcggtgctgcccctgcacatctactcgctgcacgccagcgcgctcggtttccaccacctcggcaccggggtgcgggtgcccaacgtcttctcggtcgacggccagctcgtgcacggctacctgttcagcacggtcctgctgctcgtcccgatcctgatgatcggccgtcgctggccgctgccgatcggcctgccggccgcgctcgtcgccatcccggcgctgctcatgcacctgatgttcgactccgaggcgccctggtggccgcagctgaccgtggcgatcgccgccccggtcgtcgagctcgccctgcgcgtggcgaaccgtctggtgacgctgccggtcaccggccgctgggtcgccctcgggctgatcgcgccgcccgccgtctggggcgccgtgctgctggtcggcaagatccagaccggtaccgtcggctggaacgtgcacatggtcaccgggctgctcaccctcgtcgcgctgaccggcgccggcaccgtgctggtcacccgcagcatccagttcctgcaacgttcgtga

SEQ ID NO: 5665 - DNA, 882 bp, Actinoplanes utahensis
gtgaccccgatgcgcccgctccggtggctgaccgtggtgctgacggccgccacggcggtcctgctcaccacggccggccccgccgcggcgcacgccggcgggctggtcgccaccgacgcccgcagccgggtggtgaccgtcacaccggcggtcccgggactcaccgtgaccgccatcgaggacggcgccagactgcgcctgacaaatcggacacccgggccggtcacggtcaccggccgccccggggtcgtcgcccccggcgacactctcacctgggcagacccgagcttcaccccggagggcaaaaagatcgcttccggccgtacgcaggattggacgctgaccctggacgccggcggcaccgccgtgacggtcagcggcatcctgatcggcgaacgcccgccggacccgtggccctggtgggcgctcgctatcgtggcggccgtggccatccccgtgatcgcacgtcgcctccaccggggcgacctgctgctctgcgcggccggcacggtggcgatggccgcgtcgatcgggcacgtcgccgggtccaccctggcggtcgagtcggcgccgccgctgggcacctttctcagcgccgccgggatcaacctgctggcctggccgctcatcctcggcggggcggtgaccacactgcgcggccggccggccgggctgctcgcggtctgcgcgggcgcggcgctgaccgcggtcttcgtcttccccgacgtgaccgcgttccaccgggcagtgctgccgttcgccgggccggcggtggcggagcgggccctggtcgtgctcgcgctgggactgggcgcgggcgtcgcggtggccggagcgtcggtgctgagaacgttggcgcagcgggcggaggcggtggcatga

SEQ ID NO: 5666 - DNA, 324 bp, Actinoplanes utahensis
atgagagtggtgaccgcgggtctgctgctggtggcggcggcgctcctgaccgtgccggcgatgctggcgatgcaggtgctggcctcggccggcagcctggtctcggtgggcgcgctgtcggcggcgttcgtgctggtggtggcctccggatcgatcgcgctgttcgtgcagctcgcgctgctcgcgctgacccggccggtggccgggtcgccggcgggtccggtcggtggggcgccggccgtcggatcgccgcccatcgcttcggcgtccgtcgctccgcggtcggtcgcttcggcgcccgccgacgccggctcgtcgtcctag

SEQ ID NO: 5667 - DNA, 1398 bp, Actinoplanes utahensis
gtgcatcgtgttcgtggcctcgcaggccgggctcttcgacgtcgaggcccacccggacacgctgctgctccagctcgaagtgcagtgaacccacccgcttccggcccggccccgctcgcccacggggtgggcagctcgtccgacctgccgctgccgctggacctggtgctgcaggccggggcggcgaccgtggtgctgtccttcctgatcgcggcggtgctctggacccggccccggctcggcggcggcacggtgcgcgccgtccggacggcgggctggctgccggtgctgcgcctggtcgtgctcctgctcgcggtctacctggtcggcgacgcgttggccgggccgggcgaggacgagaacccggcggcccgcgccctgttcgtctggctgtgggtcgggatcatcccggtcagcgtgatcttcgggccggtgtggcgggcggtgaacccgctgcggaccctcttccgcctgctgcggctgccgcgcgcgggactccggccgcgaccagcgtccggtgcctggccggcggccgggtggctgctggcgttcgtgtggttcgagctggtcgcgccgcaccggaccgagccggcggtgatcggcgggtgcctgctcggctacgggatcgtccagctcgggatggccgcggtgcggggcgaggagtggttcgggcgcggcgactgcttcgaggtgtactccgaactcgccgggcggctcagcccggtgcggtggcggcggccgctgaccgggctggccgccccgctgccggtgacgcgcgggctcgcggctttcgtggcggtgtggtgggggtcgacgatcttcgacagcgcctccgggtcaccggtctgggccggattcgtgcagcgggcggggcacggcgcggtcctggcgaccggggcgttgctgctggtgtgctcgggggtgctgctcgccgtacgcaggatcgccgggaagtgggacgtgacggcgtcgctgatcccgatcgcggtggggtacacgctggcgcactacctgtcgctgctgatcgtggagggcccgcgcgggttcctgcagttgatccaccagtgggggatgggcggcgggccggccgggaacgtggcgccgatcccgggggtgatcgccggcgcacaggtggcgttgatccttgccggacacgttctgggcgtgatcgtggcgcatgatgcggcgcaggtcgccggctcggtggcaccggtcgccgtgggctcgggtgctccggccggcgcccccggtggcgggtccgtcgtctccggtgggccggttgccgccggagccgtggccgggcgggcggcgctgggcacgctggcggacgagttcccgctggtgctgttcatgatcgggtgtacctgggcggggctgttcctgctgttcgtgcgctga

SEQ ID NO: 5668 - DNA, 639 bp, Actinoplanes utahensis
atgagcgtcgatgtcggtgatgacgacgggtcgcaggttccgcccgcgctgaaacagctaacgccgaaacagcagcgcatcctcacggtgatccgggactcggtgcgggaccggggcttcccgcccaccgtccgggagatcggcgccgcggtcgggctggtctcgccgtcctcggtcgcgcaccacctcaaggtgctggagcggcacggcctgttgcgtcgccagccgaacggttcccgcgccgtcgacgtgcgcaccgcggacccggccgtcaccatcccggtgctcggcgacatcgccgccggcgtcccgatcctggccgagcagcacgtcctcgaccacctcaccgtctccgccggcatggtcggccacggcaccctgttcgccctgaacgtcaagggtgactcgatgatcgacgccgccatctgtgacggcgacgtggtcatcgtccgccagcagcccgtcgcggagaacggtgagatcgtcgccgccatgctcgacggcgaggccaccgtcaagaccttccagcggcgcaacggccacatcgagctgatcccgcagaacccgaactatgcggtcatccccggcgacgacgccaccatcctcggcaaggtcgtctcggtcatccgccgcctctga

SEQ ID NO: 5669 - DNA, 444 bp, Actinoplanes utahensis
gtgcggggcacggagcagggtgcgaagtgcggacatgcgctctttcgtttcgcgacggaaccggaaccggaccatgcggcggccacccggcccggggagactcccgggtcggacagccggccggtgggcggctcagggcgcgaagtcggcccggtcgtggtcgaggccgtagagcggcagatccggagtgacccaggccgagaacgcggcggcgacagcgtccagcgggttcacagccgccagggtacgtccagccccccgtcgcgccgcgcgggccctcccggcgaggccgcccgcatcgccgtcgccaccctgaccggcacgcccaccgcggtcgaacggatccgcctggtcgccttcgacgcggagacccgcgaccacctcgccgcggccctccggggcgcagcggaggacggcggcagccgggccgccgggtcccggtga

SEQ ID NO: 5670 - DNA, 1233 bp, Actinoplanes utahensis
atggtccggttccggttccgtcgcgaaacgaaagagcgcatgtccgcacttcgcaccctgctccgtgccccgcacgtccgccgtctcctcaccgccagccaggtcggccgcctgccgatggcgtccgccccgctggccctgctgctgttcgcccgggagtcgcacagcctcgcgctggccgggctggtcgtcggcgcctacaccgccgggatggcggtcagcgccccgattctggcgcggatcgtcgaccgctggcgccagccacccgtcctctggggctcggccctgctctccggggcgggcttcctgctggtcgccgccggtggccacgcgaccggggcgacgatggccggcgcgctgctcggcgggctcggcaccccgccgctggaagcctgcctgcgcgccctctggccggatctggtcgaggcggacgtggtggccgccgcatacaccctggacatcgcggtgcaggaggtcatctatgtgaccgggccgctggtcaccctgctggccgtggcggtcgccggtccgccggccgggctggtcgcggccgcgctgctgcaactcgccggggtggcgctgttcgcgtcgacgccggtggtccgcacctggcgcggggtggcggcggtccggcactgggccgggccgctgcgggtgggccggttcgtgctgatcctgctcggcgtcgtcggcgccggcgcggcgatcggcagccttccggtggcggtcaccgggtatgccgaggcggccgggaaccggtcgctgagcggctggctgctcgccgccgaggcggccggcgcgctcaccggcggcctgctgtacatgcgtgcccgcccgggcggccggtcccggctgccgctggtcaccgcgggtctggcggccggtttcctgccgctgctcctgatgcccggcccggcggcgatggcggtgctgctcgcggtggccgggctgtcgctgccgccggtactgaccgcggtgttcctgaccgccgaccggctgaccccggccggcaccgccgtcgaggcgttcgcctgggtgatcaccgctttcacggtgggcagcgcggccggtgcggcgatcaccgggccgctggtcggtgactccgtccggtacgggttcaccttcgccccgatcgccggcctgctcgccgtggcggcgatgtccgcggtcgcctacggcccgggcggtcgacgatccgccgaccacccctcgccgagcggccggggagggtga

SEQ ID NO: 5671 - DNA, 279 bp, Actinoplanes utahensis
gtgcttgtcggcattctcgtgctcgcgttgcacgtcggtctcggcctgctcgccgcgcaccggctgtggaccggctccgacgacccgcaccagtggatgtatttctacggcaccggcggctgctgcatcgccccggtgaccggcgcggtcggggccttcctgacgaacaatccgcgcttcaaggcgatcggcatcggcatgatgaccggggtagcgctggccctgatcgccgccacggtcggctgggcgatcaacttcatcccctcctgggcctcatga

SEQ ID NO: 5672 - DNA, 1158 bp, Actinoplanes utahensis
atgggtggtgggggaatgcttaccgatgagcacaccgttctgctgtccccgcccgacgtcggggatctggagctggagtacgtcaccgccgccctgcgctccggctggatcgccccggccggcccggacctggaccggttcgaggcggagatcgccgaccgggtgggtgtgccgcacgcggtggcgctcacctcgggcacggcggcgctgcacctggccctgctcgggctcggcgccggcccgggtgacgtggtcgtggtgccgacgctcaccttcgtggcgaccgcgaacgccgtcgcctacaccggtgcgaccccggtcttcgccgactgtgatccggacaccggcaacctcgatccggacctgctcgacgccctgctgaccgagctgcgcgccgagggcgcgcgggtacgggcggtgatgaccgtcgacctgttcggcagctgcgccgactacgaccggatcgggccgctgtgcgaccggctcggcatcccggtcgtcgaggacgccgcggaggcgctcggcgccacccgtgcggggcgggccgccgggtcgttcggccgggtggcggcgctgtccttcaacggcaacaaggtgctcaccacgtccgggggcggcatgctgctcaccgcggacggcgggctggccgagcgtgcccggcacctggccggacaggcccggttgccggtcacccactacgagcacgccgagatcggttacagctatcgtctgagcaacatcctggccgcactgggccgcgcccagctgcggcggctggacgagatggtggagcgccggcgcgccctgcacgacgcgtacgccaaaatcttctccgatgtcgacggcgtgaccctgcccgccgacgccgacccgggctcgaaccgctggttgaccagcatcgtcgtcgatccggagcgggccggctggcaggccgccgagctggctgcgcatctggcggcgcgccgggtggagacccggccggtgttcaagccgatgcatctgcagccgctgttcgccggcgcccgggccgcgctgaccggcgccgccgagcgtctgttccgcaacgggctgctgctgcccagcggctccgcgctccgtgacgaccaggtgcggcgggtgctcgacgagatcgccgactacatgggtgaccgccgatga

SEQ ID NO: 5673 - DNA, 630 bp, Actinoplanes utahensis
atgaagccgcggccgccggggcgcggcaccgacaccgtccagcgcgcgatcgacgtcgtcgccgccggggccggcctggtcctgctctccccggtgatcaccgtggtcgccggcgcggtggcggccggcctgggccgtccggtgctgttccgccagcagcgcccgggcctgcacggccgcccgttcaccctggtcaagttccgcaccatgcgggacctcgacgagcggcgcggcctggtcaccgacgccgaccggctgaccgggctgggccgggcgctgcgcgccaccagcctggacgagctgcccacgctctggaacgtgctgcgcggcgagatgagcctggtcggcccgcggccgttgctcatgcagtacctcgaccggtacacgccggagcaggcccgccggcacgaggtgcggcccggcatcaccgggctcgcgcaggtgagcggccgtaacgcggtgagctgggaggagcggttcgcgatcgacgtctggtacgtggaccaccgctcgctcggcctgaacctgcggatcctggcccgcaccgtgcgcctgctgctgcgccgcaccggcatcaccgccccgggggaggccaccatgccgctgttcctgggtagcgaccgtgcctga

SEQ ID NO: 5674 - DNA, 636 bp, Actinoplanes utahensis
gtgcctgagcccctcgtgatcgtcggctgcggcggtcacggccgggagatcttcggcgtggtggcggcggtcaacgacgcgggcggcggcccgtggaaggtgctgggtttcctcgacgacgccccgtcggaggcgaatctgcgcgccctggaccggctcgggtccggctggctcggcccggccgcgctgctcgccggggtcgacgcccacttcgtgatcgggatcggcgatccgcgggtccgggacggggtggccgccgcgctggagccgtccgggcggccggcggcccggctggtgcacccggcggcgaccgtgggcccggacaccggcctggccgagggggtggtgctgttcgccggggcccgggtcaccacgaacgtcaccctgggccggcacgtgcacctcaaccagaatgccacggtcggccacgactcggtgctggacgcctgcgtgcaggtgaatccgctggccgcggtctccggcgactgccggctcgggcgcgcggtgctgatcgggaccggcgcggtggtgctccagggccggtcggtgggtgaccgggcgaccgtcggggccggcgcctgtgtggtccgggacgtcgaatcgggccggatcgtcaagggtgtaccggcaggatga

SEQ ID NO: 5675 - DNA, 1353 bp, Actinoplanes utahensis
gtgaccgggcgaccgtcggggccggcgcctgtgtggtccgggacgtcgaatcgggccggatcgtcaagggtgtaccggcaggatgagggggtgcggatcacctatgtgcaccagtacttcaagacgcccgggatggccggcgggacccggtcgtacgagttcgcccggcggttggtcgaacacggacaccaggtgcacatggtcaccgccgacgcgtccggcggaccggcccgggtcaccaccgaggccgggatcgtcgtgcactggctgccggtgccgtacgacaacgcgatgtcgtaccgccgccggatcctcgccttcctctccttcgtcggccgggccacgctggtggccgcccggctcgaccacgagctggtcttcgcgacgagcacgccgttgacggtggcgattccgggcgtggtcgccgcgatgcgccgccgggtgccgatggtgttcgaggtccgggatctgtggccgcgggcgccgatcgcggtcggggcgctgcggtcgccggccgcccgctgggccgccggccggttggaagcctgggcctaccgccggtcggcgcacgtcatcgcgctctccgacgacatggcggacagcatccagcgccggttcccgcgggtgccggtcaccgtggtgccgaacggctccgaccgggcgctgttcagcggcccggccgcccggcgggccggtgcggcgctgcgccggagcctgccgtggctcggcgaccgcccgatggtgctgtacgccggcgccctcggcgtggtcaacggcgtggactacctggtccgggcggccgcccggctggccgtgctcgacccggaggtgcgggtggtgatcctcggcgacggccggatgcgggagtcgatccgccggctggccgccgagctgggggtgctggagcgcaccctgttcctgctgccgccggtcgccaagaccgaggtggtcgcctggttcgccgcctgtgacctggccaccggcctcaccctgaaccgtccggagctgggcagcgactcgtcgaacaagctgctcgacgcgctggccgcgggccgtccggtcgcggtgaaccacggcggctggatcaccggcctgctcacccgcaccggggccggtctggccctgccgccggacgacccggagggtgcggccaccgtgctggccggcttcctgcgggacccggcggcgggcgcggcggcgcgccgggcggcgagtgcgctggcccgggaccggttcgaccgcaacgtgctgttccgcgacttcgagcgggtgctgatcgaagcccgctacggtctcggcgccggccggaccgcggcgagtaccagcaggatccacatcagccgggcgtcgtag

SEQ ID NO: 5676 - DNA, 1356 bp, Actinoplanes utahensis
gtgggcctgcgcgaatacctccgtgtcgcccggcgcaactggtggttgctgctgacctcggtcgtcctcgcgctcggcgtcgccctgatcgtcaacctcaacaccaccccggtgtacgcggcgcgggtcacgttcttcttctccaccccgatcgccggcgcctccgacctctacccggccagcatgttcaacgccagccggctgtccacctacgccaaactgctgaccagcgacgaggtggccaccccgctggccggcagcccgggcatcgacctcagcctcaaggacgtccgggacgcgatcagcgcgaagaccgtggcggacacggtgatgatggaggtcagcgtcgaggaccgggaccgcaaccgggcgatgctgctgctcacccggctcacccggcggttcgacaccgcggtcgaggacctggagcgtcccaaggccggtgagccgtccaccgtcaaggtcaccgtggtctccggcccggccctggacgacggcccggtctcgccggactgggcgaacaacttcgcgctggccgcggtcgccggaatggtcaccggcgcgatcggcgcggtgggccgggaggcggccgaccacaccgtgcgcaccgccgacgcgctgcaggtgctggcctccgccccggtgctggcccgggtgccgctggaccggggtcacccgttcgtctcgccgagcgcctcggcccgcaccgaggcgctgcgcgaggtccgcacccaggtgcagtgcgcggcggcggccggctcggtcaagacgctcgcggtcaccagcgcggtgcccggggagggccggtccgccaccgcctgcgggctggccctgctgttcgccgaggccggacagcgcgtcctggtggtcgacgccgagctgcggcacccccggctggccgcgctgctcggccgggaggactcggccgggctgagcacggtcctggacgggaccgcggcgctggagcaggtgctgcagccgtggggcgccgggttgtggctgctggccagcgggcggaccccgccgaacccgagtgagctgctcagctcgccgaggatgacggagctggtcgacgccgtacgcaagaaattcgatgtggtgatcttcgattgcccgccactgctgccggtgaccgacgcggccgtggtcgccgcccgcgcggacggcacgctgctggtggtgcgcgcccgtcggaccacgtcggcccaggtcaccgcggcggtccgggcgctgcacgcggtcaacgcgacgctgctgggctgcgtgctgaacatggtggcccgcaaggggccggacgcggtgccccgctacgactcctacctcggtgggcccggcccccgggccgcggccgcatga

SEQ ID NO: 5677 - DNA, 1806 bp, Actinoplanes utahensis
atgatgggcgcacggttctgggcgtaccggcgcgtgttccccctactcgtcgacgccaccgcctgggccgtcggcctgttggccgcggtcctggcccggcacgacttcctgcccacccggcgccaccttgccgggggcctggccgcggtcggcctcgcggtcctgctgcaggcggtcatcgggcacacccggcacctgtaccgggggcggtaccggttcgccgagttcgacgagatccggtccgtggtgttcaccaccgcggcggtcaccgtggtgctcaccgtgatcgtggtgttcgtctggcatccggtctcgcccgggctgcccgccctcggcggcgccgccgcgctgaccctgatgctcggcatccgcgacctgcgccggctgcggtggtcccggcaacggcgcccggacgcgcagaccgccgcaccggttctgctgttcggggccggcaccgccggggcgatgctggtcgcctcgatgctgcacgaccggcacggccgctacctgccgaccgggctgatcgacgacgaccgggacaagcgccggctgcggatcctcggcgtgccggtgctgggcacccgcgacgacatcccgcgggcgctcgccgacaccggcgccggcctgctcatcttcgcggtcgccaacgccgacgccgccctggtccgcgacatccgcgaccggaccctggcggccggcgccgcgttccaggtggtgccgtcggtcagcgagatgatggaccagccggtcgaggtcggcgacatccgcgaggtgcaggtcgccgacctgctgggccggcatcagatcgacaccgacctgtccgggatcggcggctacctgaccggcaagcgggtcctggtcaccggtgccggcggctcgatcggctccgagctgtgccggcagatccaccggttccggccggccgagctgatgatgctggaccgcgacgagacgtcgctgctcgcggtgcagctctcgatcgacccggtggcgctgctcgacgacccgtcggtgatcctcgccgacctgcgtgacgccgaccgggtccgcgaggtgttccgcacccggcgtccgcaggtggtcttccacgcggccgcgctcaaacacctggcgctgctgcagcgctatcccgccgaggcgatcaagacgaacgtgctgggcaccctgaacgtgctggacgcggcgacgtcggtggagcggttcgtgaacatctccaccgacaaggcggccgacccgaccagcgtgctcggttactccaagcggatcaccgagcggctcaccgcgtggaccgcgcggcgtcgcaccggcaccttcctcagcgtccggttcggcaacgtgctgggcagccgcggctcggtgttcaccaagttcaacgcgcagatcgcgggcggtggcccgctcaccgtgacgcaccccgaggtgacccggtacttcatgaccattcaggaggcggtgcacctggtgatccaggccgccgcgatcgggcaggacggcgaggcgctggtcctggagatgggcgagccggtgcggatcgccgaggtggccgcccagatggcgcagttcgcgccggcgccggtggcgatcgagtacatcgggctgcggcccggcgagaagatctccgagacgctgttcggggccggcgaggtggacagccggccggaccatccgctgatctcgcacgtgcaggtgccgccgctggacccggtgcggctggcggcgctcgccgagccgtccgactccggcgtgctgatcgcccgcctggcggagatctgcgccgcacccgcgccggcaacggttgttcggtaa

SEQ ID NO: 5678 - DNA, 1308 bp, Actinoplanes utahensis
atggactcctcttcgcagagcgggccgcggcccgcgcgcgccggcgtgcacgcggcgctgcgggcctggcgggagagcctgatcgacctcggtgaccacaaccggctgatcaacttcgcggccggcaacgccgacctgctggagatcacctcgcccgacccgcatcaggtggtcaccacgctcagccggggcaccggggcggtgctgaccggttccggcggcgccgcgcccggcgacggcaccttccgcaccgagctgaccgaacgctcgctcggcccgctgctgcgccggctgcagcgccgtgcccggcaggaatacctggaccgcggcgtgttcgtgctgcacctggcgctcggcatgctgcactggcggctggccgccgacgacgaggacccggacagcgagaccaccagctacaccagcccgctgctgctgctcccggccgacctggtcaccggcgacctggccgagcagcccgagctgcggctgcgcgacgaggagccggtggtcaacccggcgctcgcgctgcggctgcgacgggccgggatcgccgtccccgacctggaaccggccgccgaactcaacgtgtcccggttctgggacgagttcaccggcacggtggcccggcggcacggctggcacatcgagcggaccgtcatcctcacctgcctcaccttccacaaggatgcgatctaccgcgacctgcgcgacaacgaggagcggatcctggcccacccggtggtccgggcgctggccaccaccgacccgcggcggcagaccgaagccttcaagttcaccccgatccggcccgaggaggtggaccggctcgccccgcccgagggcatgccgctggtcctggacgccgactcgtcccagcgtgcctgcgtggccgccgccctggccgggcacagcttcgtgatggacggcccgcccggcaccggcaagtcgcagaccgtggccaacatgatcggcgcgctgctgcacgccgggaaacgggtgctgttcgtctccgagaaggtggccgcgctcgacgtggtccgcaaccggctcgccgcggccgggctggaccgctacatcctggaactgcacggccagcaggccggccggcgcgaggtggccacgctgctggccgcggcggtcgacgagacgccggagccgcccgcggacgcccccgtgctcgaccgggccgcgctgcgcgaacgccgggaggcgctgaccgcctacgcggccgcgatgaacgagacccgccggccgctcggcgccagcctgtacgagatcatcggccgctgcgccgggctagctagctag

SEQ ID NO: 5679 - DNA, 3018 bp, Actinoplanes utahensis
gtgccgtggaccgcgctgccgtccgccgccgacctgccgatgcccccgtcgttggaggcgtttcccggcccggtcggcctggacacgctgaccgcggccgacgccgacgaactcgcccgcgacttcgccagggccgccgaccaggtggaccggcaccgccgcgcggtcaaccgggtgaccgccaagctggggctgccgcaggccggcacgatccgcgacatcgcccgggtggcggcggtcgccgaactcggcgcccggccgcacaaaccggagcggttctggttcaccccgggcgcgctggccggcgtgcagaccggggcgggtgcgctgcgccgggccctggaggtgttggtcgccaccgagatccaggcccggccgtacttctccgaggcgatcctcgcgcagccggtcgaggagctggccgagcggttcgccacggtgcaccggggattcgggcggctgcgcgcggcgtaccgccgcgaccgccgccaggtggccggtttcgtgctgcccacggcgcacctcggcgacgccgtcgaccggatcggcaccgcggtcgcctggaaacgggcccggcaggagctggcggcggccgagcacgcgtacgccaccgccctcggccggtactggcagggccgcggcaccgacttcgtggccctcgacgaggcgatcgcggtggccgccgcggccctcgccgccgcaccaccggccggcatcggatcggtgctcacctacatctgcgcgccggcgcccgacccggagccgatccaggtggtcaccgaggcccgtgacgcactgctgcggtggcaggcgacgctgcggccggcgccctacccggcggcccgcccggagctggtgtccgggccgatcgacgacgcgatcgcctggctgaccgggcacgtgacggcgctgcacgcggtcgccgagacggtccgggcgtacgacgcggcgaccgggcacaccctcgactacgccgagacggtgcgactggggtcgctccgggacgcggcggcccgggcggcggcggccctcggcgggccggccgacgggctcgccgaggtcgatccgggtgccctcgccgcaaccgtggcatgggcggcgcaggcccgggacttcgccggcggtccgctctccgaggcgcagctcgtcgcgctgcgcgacctgcggccgatcgtcgggctggccgagcgggccgccgaatgggagcaggcgagccgggcggtgctcgccggcttcggcccctcccggcaggccgacctgcgcgaccggttcgccgactatcagcgggccgccgccttcctgcgcgacatccgcaacgacagcagcggccaggaggagtggttcgcctgcctggacgcccgtgacgtgctcaccttccacggcctggacgcggccgtcgaattctgcgccgaccggcgcctggacggcacggacgtgcccgcggtgctggaccgggcgctgctgcacggctgggccgacgcggtggtccgggccgaccatcggctgcggccgtggcgctccgacgaccgggaccggctggtcgccgaattccggcaggccgacgagcggctcgcggtggtcgcggcccgcgagatcgtcgcggcggtcgaggaccgccggccgccgcccgagagcgcggccgcgggcctgttgcggcgcgaggcgatgaaggccgatcggcaattgccggtacgtgacctgctgggccgtgcccgcgaagcggtcctggcgctgcgcccgtgtgtcctcgcgtccccgctcacggtgagccagtcgctgcccccggacatcggcttcgacgcggtcatcttcgacgaggcctcgcagatcaccccggccgacgcgatcaactgcatctaccgcggcacgtccctgatcaccgcgggcgacgaccgccagctgccgcccacctcgttcttcgatcgggcggccaccgaggtgccggacaccgaggtgctcgactaccagtccgtgctggagctggccaaggcctgcggagccttccccgggatgggtctgacctggcattaccgcagccggcaccaggcgctggtggcgttcgccaacgacgccttctaccagggccggctgagcaccttcccggccccgggcagtggcggcccggacaccggcgtcgccctcttcccggtcgccggggtgtaccggcgcagcaccggccgggacaacccggtcgaggcggaacgggtcgccgaacggatcgtgcaccacttcgccacccggccggaactctcggtgggcgtggtgaccttctcggtggcgcaggccgaggcgatcgaacgggccctggagaagctggcggccgggcagccggcgctggaacggatggtcaccgacgaccggctgcacggcttcttcatcaagagcctggagtcggtgcagggcgacgaacgcgacgtgatgatcttctcgatcggctacggctacgacgaggccggccggatcagcgcgaacttcggcgcgttgaaccggcccaacggctggcgccggctcaacgtggcgatcacccgggcccggcaccgggtggagatcgtcacctcgatcctgtcccgcgacgtgcccgagtcggagaacgagggcgtccggcagctggccgcctatctcgactacgtggagcgcggtgccggcgacaccagcctcgaccacaacgacccgaccggcgacttcgtcgaatcgatcctggagacggtccgcggctggggctatccggcccgggccgcgctgggcaccgcgggcggccgggtcgacatcgcgatccggcaccccgacgacccgtccgggcactacctgctcggcgtgcgctgcgacggccccggataccgggactgcccggccgcccgggaccgcgaccggctcaccgaccaggtgctgctcagtctcggctggcggctgcaccgggcgtgggcgctgtcctggtaccgcgaccgcgacggcgagcaggcccggctgcgggcggcgctggacgcggcccgggccgcctgggccgggcgcactagctag

SEQ ID NO: 5680 - DNA, 2754 bp, Actinoplanes utahensis
atgccatcgacgtcagcgcgggagcggctgcgcgcggtgctcggctgggtgcgccggcgtccacggtggctgcgccgcaccgtcgccgcgctggtcgcggtcaacgtggtgctggtgctggccgccgccggatatgtgtggagcgtcgacctgccggccgacccggccccgccgcaggcctcggtgctctactaccgcgacgggcagaccgtgctggcccggatcgggctggccgaccgcaccgacgtcccgctcgaccgggtgccggtcggcgtgcgtcaggcgttcctggccgccgaggaccgcggcttctacgaccaccacggcgtctcggtgcgcggcctgttgcgcgcgctgtggtccaacgtggcgaaggacagcgggcagggcgcgtccaccatcacccagcagttcgcccgcaacgcgtacctgacccaggagcgcacggtcagccgcaaggccaaggaggcggcgctcgccctcaagctggaacaccggttcaccaaggaccagatcctcgagcgctacctgaacaccatctacttcggccgcggggcgtacggggtggaggccgccgcccaggccttcttcggctcgtcggtggaccggctcaccgcgtaccagggtgccgtgctggccgccatggtcaaggacccgacccgtggcgacccggccgtcgacccgcactggacgctgaaccggtggaaatggatcgtccgcgcgatgagcgacgccggctggctgccgcccggggcggccgaccggacgccgtaccccgcggtcgcccccgaatcggtgaccgccagcgcggtcggcggcccggtcgggctgatcgccgaccgggtcgaggacgaactcgtcgccgcgggggtcagccggcagcagatccgcaccggcggactgcgggtcatcacgaccatcgacccgcaggcgcagcgggcggcgaccgcgagcatcggcgccgcgctggccgggcagccggccgagctgcgcaccgcgctggtcgcgatcgatccgcacgacggcggggtgcgcgcctactacggcggcgaccgggggcgcggctactacgacgacgcgttggccgcccgcccgccggcgtcgaccttcaaaccgctggtgctggccgccgccgaggaacgcgacatcagctaccggtcgtactacaacgggacgtcgccgcggctgttctccgaccgcggcggggcgcccctctacaacctggacaacctgcagtgcccggtctgcccgctggacaccgcgatggtctactcgctgaacacgccgttctacgccctggccgagcagatcggcccgggccgggtgcgtgacctggcgctgcggctcggcgtgcccgcctcctacggcgaccagaccaccctggtcgatctcaacggcgaactcacccccggccgcacccgcgccgacatcgcgatcgggcgctatccggtcgcccccgccgacctggccggcgtctacgccaccctggccggcggcggcatccgcgccgaccggcacttcgtcacccgggtcgtcaccgcccagggcacggtcctgcaccgcgcggacaccaccggccgccgggtgctgggcgccgaggtggccgccgacgtcggcgcggtgctcacccgggtggtccagcacgacggcgcggtgcccggggtggcggccgccgcgaaaaccggctcccagcagtacggcaacacgtccgactcgtccgacgcgtggaccgccgggtgggccagcggactcgccgcggtggtctgggtgggacgcgacaagccggggccgatccgcacccgcaagggcgcggccatcaacggggacggcatgccgtacaccatcttcaagaccttcctggccggagcgctgcgcggcggccagcggatgtccctgccccccgcggccgaggtcgggcacgtcgagaaggccgacctgcagacgatcgagaccaaggtgtcgatgatccccggccgggtcttcgccgggccgcggcgcggcgaccaggtcgaccgctcgctggccgtcggcgactggagcgaacgcaccgcccggctcaccgcggcgctggaccggtacgccgcgaccgcccccgacttcgcggtgtccctcgtcgaccgcaggaccgggcggcacttcgactaccacggcgaccgtgcgtacgagacggccagcgtggtgaaagtggaactgctcgccgcccttctgctgtccgcccaggacgcccaccggcaactccgggccgcggaacgccgccgcgccgaaaaaatgatcaaagcgagcgacaacgacaccgccaagcaggtgtacgacgcgatcggcggcccgaccggcctgagcgccgccctcacccggctcgggctgaactccaccacaccgaaccccagcttcggcctgagccgcaccacagccctcgaccagacccggatgatcaccgccctcagcgactccggcggccccctggacagcacctcgaagcagcagatcctcaccctgatggcgaacgtcaacgccgaccagaactggggaatcagcgccgcctccttcgacggcgaacaggtcgcgctgaaaaacggctggctgtcccgcaccaccgaatcccaccgctggatcatcaacagcaccggccggatcaccggcgccaaaaccgacgtggccctgtccatcctctcccacggccacagcaaccagcccgacggaatcagcgtggtcgaacacatcgccgccctgacccgcagctacctaggctggtga

SEQ ID NO: 5681 - DNA, 180 bp, Actinoplanes utahensis
atggccgcatccggtttcgaccggcggtctgcggcacagctgccgatcgcggccgagcgcaccatctgggccagcggagtcccgcggctcgcgcgacctctgttccggctcgacgcggtgatcgacgccgctgacctcgccccggtcctggagtcggtgcggacgcacatcgtcgcctga

SEQ ID NO: 5682 - DNA, 690 bp, Actinoplanes utahensis
atggacgagattctccgcagatcggacgcctcggcggcggtcggcgagttgggctggcggtttgtgctcggcacgttgcaggccgctgtcgcggtcgactcgatcagtgagggtgcgcaggtgctcgcccgggccgtcgcggcctgtggtgcggacgccgatgcgcacctccgggccgatctgtgcccgagccgggtcgtgttgagcctgcagtcggctgagcgggccgcggtgaccacccgcgacgccgaccttgccgggcggatcacgcgggccgtcggcgagggcggatggcggaccgggccggatctcggtgctgacgggccgcggtccgtgcagctgatcgagatcggcatcgacgcgttggacatcgcggccatccgtccgttctggcgggccgtgctcggctacaccgatgagccggggcacggtgacccggaggatcccgtcgtcgacccgctccggatcgggccggcgatctggttccagcagatggaccagccgcgtccgcagcgcaaccggatccacttcgacgtgagcgtgccgcacgacgaggcgcccgggcgcatcgaggccgcgctcgccgccggcggccggctcgtgtcgtcggagcatgcgccggccttctgggtgctggccgacgccgagggcaacgaggcctgcgtgaccacctggcagggccgtgactag

SEQ ID NO: 5683 - DNA, 168 bp, Actinoplanes utahensis
atgcgaagccgtcgatccagcctggttttcggctgtctctgcgctgccctggccgcgtcggcgatggccgttcacctgccgtactacgcgatctttgccacggccgcgtttgtcgccgtcctgaccgtgtgggtggtcgttctgtcccgatccgggcgtcgccgctga

SEQ ID NO: 5684 - DNA, 531 bp, Actinoplanes utahensis
gtgctcgccctgctggccgacgggcagagcgccgcctccgtctccatcgagcaggtcgccgccaaagccggcgtcggcaaagccaccatctaccgccggtggccgaacaaggaggcgctcctgatcgacgcggtgcgcagcatgaaaggcccgctccccacgctggtcggtgtctccgcccgcgacgacctggtcgccctggtcaccgcgaaccgctccacccgcgcccgcgagttcggcatggtcaccgcctgcctgctccccgagctgcaacgcgacccggagctcaaccgcatgcaccacgcggtcatggaaccccgccgcgaattcatgcgcgacatcctgcgccgcggcatcgccaccggcgaactccgccccgacctgaacatcgacctcaccgtcctgatgctctccggcccgtcgatgatgcagagcatgttcggctccgccaccggcctccccgaggagaacttccccgccgccctggtcgacgccctcctgcgcggcgccgccacccacccgggcccctga

SEQ ID NO: 5685 - DNA, 1578 bp, Actinoplanes utahensis
atgaacgacgtagcacaaccccaggccgggcatccccgacgctgggccatcctgggcgtgctggtgatcagcctgctcgtggtggttctggacaacaccgtgctgaacgtggccctgcgcatcatcgcggacccgcagcgcggcctcggcgccacgcagagcgagctcgagtgggccatcaactcgtacacgctggtcttcgcgggcctgctcttcaccgccggcatcctggccgaccgcctgggccgccggatcaccctgaccatcggcctggtgctgttcggcatcgcgtcgctgatctcggcctacgccgacagccccgaccagctgatcgccgcccgcgcggtgatgggcctgggcgcggccgcggtcatgccgtccaccctgtcgatcatcgccaacgtcttcgagccgcgcgagcgcggccgggcgatcggcgtctgggccggcgcggtcggtctggccgtcgccctgggcccgatcctgggcggcttcctgctggagcacttctggtggggctcggtcttcctgatcaacgtgccgatcgtggtgatcggcgtggtgctggtgaccgtgctggtgcccgagtcgcgcgacccccggcccaaccgggtcgacgtgctcggcgtcctgctctcgatcgtcggcctgaccctgctcacctacggtgtgatcaagggcggcgaggacggcttcggcgacaccctgtcctgggcgccgctcgcctccggcgtgctggtgctggccggcttcgtgctctaccagagccggatcgaattcccgtcgctggacgtgcgactgttccgcaaccggcagttctccgcctccaccggcatgatcggtctggtcttcttcgccgccatgggcgcgatgttcttcggcgcgttctacctgcagctggtccgcggctacggcccgctggagtccggcgcgctgttcgtcccgttcgcggtcggccagatggtcttcgcgccgatcagctccacgatggtgaagcggttcggcccgaaactggtcagcaccgtcggcctgctgctggtcgcgctcggtctggccatctggctgccgatcaccgcgaccacgccgatcgcgctggtcgccctcgccttcttcgtccagggcgtcggcatggccaacgtgatgccgccggccaccgagtcgatcatgtcggcgctcccccgggagaaagccggcgtcggctccgcggtcagcaacaccatccgccagctcggcggtgcgctgggcgtcgcggtcctcggcgcggtgctctcctcggtctaccgcgacaacctgggctcggccaccgacggcctgcccggcccggcggccgacgcggcccgcgaatcgatcaccggggcgtacgcggtggccgcgcaggccggaccggccggccccgccctgatccacaccgccaacgagtcgttcgtcaccgcgatgcactgggccaccgccggcggcctgatcttcgccctgctcggcgccctggtcgccgcgctgttcctgcccggcaagcgcccggccggcccgcacagcccggtcctcgccgaggagcagggcgtagccctggtcgaggcgtaa

SEQ ID NO: 5686 - DNA, 2322 bp, Actinoplanes utahensis
atgcactcccgcgggatccgccatctgtggtggatctatctgctgacgaccggcgcgctgaccgccgtctacctgctcaccccgttcaacgccgacacccggtggatctacgtggtggtgaacagcacggcaccgctggccacctggctcgggctgcgtgggaacctgccgcagcgccgggccggctggcgggtgatcgggctcggcctggcgttctcggccgccggcgacgtgctcttcgccgtgcacaccgcggtcagcggcgaaccggccttcccgtcgatcgccgactggctgtacctgctcgggcacctgaccatcgcggccggcacggcgatgctggccgcccgggccggccggaccgccttcatcgacgccgcggtgctgctgtccccgctggccagcctcgcctggatcctggtggtcgaaccgacggtcaccgtcggcggcagcctgaccgcccggttcttcgccgcgtccgcgccggtcaacacgctgatcgtggtgtactgcgcgctggccctggcgctcggcgtcgagctgcgcacacccggggtgcgctggctgctgaccggactggtcgcctggttcgtctccgacgccctctacacccaccagagcctggccgggacgtaccgcgagggcgggctgatcgacctgggctggatggcgatgccgatcctgctcggcaccgccgcgctgcacccgtcgatggtgaacaccacgccgcgccgcgccgcgatgaccaccctgaccctgaaccgagcgctgatcctgttcggcgcggccctgctgctgccctgcctgcacctgttctgggagcccggctcggacgcacccctggtgctcggcgccgcgctgtccatggctttggtcgcggtccggctggccggcccgatccacgagctggcctggcgggccgggcacgacccgctgaccgggctggtcaaccgcagcctgctgatggaccggctggcgctggcgctggacaccctgccggccgatcccgccgcccgggtcggcctgctcttctgcgacctggaccacttcaaggacgtcaacgacagcctcggccacgacgccggcgaccagctgctgatcgagatcagcacccggctgcgcgcggcggtccgggagaccgacgtggtgtgccggctcggcggcgacgaattcgtcatcctgatgccggacaccaccgaggagcaggccgacgtgatcgccggcggggtcgccgacaacctgggccggccgatgcgactggccgacggcaccgaattcttcgcgtcactgtcgatcgggctgcgcaccaccgccgacaccgacgccgacccggacaccctgatgcaggacgcggacaccgcgatgtaccaggccaaggcggccggccggggccggatggtgcgcttcgacgcggacgtccgctcggaggccgcccagcgcctgcgcctcgacgccgacctgcgccgcgcactcacccacccgggcgagctgtactgcgtctaccagccggtcttccgggtcgacgacggccggctgcactcggtggaggcgctggtccgctgggcgcacccggccgacggcacgctgccgccggtggtgttcatcccgatcgccgaggcggccggcaccgtcgggcaggtgttcacggtggtcctggagcaggctctgaccgagcagcgaggctggtacaaccggaccggcgggtggattccgatcgcggtgaacctgtccccgcgacagctcgacgccgccatcgccggccaggtgctggccgcgctggagcgcaccggcacgccgcccggccagctcaccctggaactgaccgagaccgggatggccgaaccggagacggtcgaggccgcgctcgggccgctgcgccgggccggcgtcaagatcgccgtcgacgacttcggcaccgggtactcctcgatggcccgggtcgccgaccacggctgggacgtcgtcaagatcgaccgaaccttcgtggccggcatccaccgcgaccaggcgcgcgcctcgctcgccgacgccatggtgcggatggcccacgccctcggcatggtgaccgtcgccgagggcgtggacaacgccgccgacctgcaggtgctcgcccgcctggggtgcgagtacgcgcagggttacctgctggcccgaccggtcgatgcggacggcatcctggagatggcgtccgcgtccccccgagtctcggtcgagctgggctccggcggcggtgagctctcgccgtcaggctccggcggcgtccggccgggcgatctggtcggcgtcgagctcgacgtcgagggccggcagcaggtcggctag

SEQ ID NO: 5687 - DNA, 456 bp, Actinoplanes utahensis
atgaccacgatcgtcaacggactcgacgagctgaaggccctggtcggccgggacctgggggccagcgagtggctggagatcacccaggagcgggtgaacacgttcgccgacgcgacgggggaccaccagtggatccacgtggacgtcgaacgggcgaagggcgggccgttcggcgggccgatcgcgcacggctacctgaccctgtcgctggtgatcccgctgttcggctcgctgctcaaggtcgaggggatcacgatgggggtgaactacgggctggagagggtgcgtttcccgcacccggtgcgggtcgggtcgaagatccggctggcggcgaccgtggtgagcgtcgaggacgtgcccggggggacgcagagcacgttcgacttcaccgtgcagatcgatggggtggacaagccggcctgcgtggctcgtgcggtctatcggcagtacgcgtaa

SEQ ID NO: 5688 - DNA, 855 bp, Actinoplanes utahensis
atgcgccccggccgcgccgctgcgagacttcactcggcccgcaacccgggccgttttcggcccgcgcggcgggcagtggcggaggagcagaccgagatggccctgggcgaggcggcgaaactcctggcccgggccgggcacgtggtggtcttcaccggtgccggcatctcggccgagagcggggtccccaccttccgcgacgccctgaccggcctgtggtcgcggttcgatgcgcaggccctggccaccccgcaggctttcgccgaggatccggacctggtctggggctggtacgagtggcgccgccgcctggtccagcgggtccgcccgaaccacggccacctggccgtctcccggatggcggcgcacctgccgcggctcaccgtcatcacccagaacgtcgacgacctgcacgaacgcgccggttcgccggcacccctgcacctgcacggcagcctgttcactccacgctgcgcatcgtgttcgcgcccggccccgctcccgcctcccatcccggacgacgccgacgccgagggccgccgcatccccccgccccgctgccggcactgcaccgggccgatccgacccggcgtcgtctggttcggcgagccactccccgagtacgctctggagtccgctgtccgagccgcctccgcctgcgatgtcctgctcaccatcggcacttcgggcctcgtctaccccgccgccgagatcccccgcctggccgcccgggccggcgccgccgtgctgcagatcaacccccagcccacccccctcgacccgatcgccactgtcaacctccccggccccgccgccgagatcctccccaccctggtcgacaccacctggccgtaa

SEQ ID NO: 5689 - DNA, 1455 bp, Actinoplanes utahensis
gtggggcgccgacccgccgggctggaccggctcgccgcggcggggtgtggacgctcggaccggcgatccggctttgatgccttcgcagccgtcgcccacggtgaccggaaatgcccaaccgccaccgtcggcgaagccgaagcggccgaagaagccgaagaagaccacgccggccaccggtccgaccgcccccaccgatcagaccgcggcggatccgcccgccgacgccggacagaccgagagttgcggcggctcggcgtgccggtgaccccggcccgcgccgccgcggactggcgtcggcgcctggacgcactcggcgcccgcacgatgaccgtggtcggtgactggatcgcgcccagcccccggcccggcccgtccgacgggcacgtcaaagccctggtcacggtcgtggcactggtcggcggggtggtcccgatcctggtcatggcactgacctgggcgatgcggcccaaggtcgaggaccaccatcgactgtgtacgaccccggccggtgaacgcctcggctacgtggtcgccgaccgccccgccgacgatcggtaccggccggcggcccagtgcaactcgaccggcgcggagaacgccgtgcggcgcaccgggatcgggcgctacgaggtcaccctcgccggcctgggcaccggcgggggagcggccgaggtgaccccggtaaccaccgatgaccggatctgcacactgctggactggtccgcggactcggcggacgagcggctgcgggtgggctgcttcgatcgggccggccgggcggcggacagcggattcaccgccgggttctggaccgcccgcggtagggcgcccgccgcctacctgcgcctgggcgacccgggccggaccagccagacggctcaggacgagtacagcttcaactcggcggacggactgaactcggcggaccgcggggacgtcggctcctacgtcgtgtcgttcggcggcctggacggtgtcgcgggcggtgcggtgaaggtgaccgcggtgggagacgcggcgacggtctgcgccgtcgaaggctggtcgggtgatcaggagaatcggtatctcgccgtccgcgtccactgccgggatgccgccgggcagccgatcgactcgcggttcgcggtgaccttcgcggtgggtcgccccacgacgggtgggtatgtgcgcgcggaccgtcccggacaggccgggtatgcggcgacgggggactatcagttcaacagcagcggcggggcgaacggggtgcggcgctcggggccgggcgactatcgggtgagtctcggcggggtggtcagctctgggggaagtgcgcaggtcacggcgtacggctcgaccgtcgactgcgtcacgacgccggcgggcgggaatccggatgtgcgtgtggtctgccgggatccgtccgggacaccgatcgacacggctttcgtcctgatctatacggcatga

SEQ ID NO: 5690 - DNA, 834 bp, Actinoplanes utahensis
atgatccatgaccgtcgcggctccggggccccactgctgctgatccacgggctgggcagccactggcaggtctggctgcccctgctgcccctgctgagcccgcaccgcgacgtcatcagcgtggaccttcccggcttcggcgcctcgccgccgtggcccccggccgcggtgccgggcccggtgccgcgccccgccccggcatccccggacgggcccggctcggtgcggcatctcgccgatcaggtcgaggcttttctggactcgctcggcctggacaccgtcgaggtcggtggcagctcgatgggcggtggcatcgccctggaactcggccgccgcggccgggcccgcacggtcaccgcgttctccccgatcggcttctggcccaccggcggcggccgctggtgccgcttcatcgtcaccgccgcccgggccggcgccaccgccctcgacccgctgctcccccgcctgatggccaccccggccggccgggccgcactgtgctcgatcttctacgcccacccgggccggctcgaccgggacgagtcgctggccgccgcccgggccctggccgcggcccccgggttcgccgccgcccgatccgcgttccgccggctcaccccgtgggccgccaccgaccccggcgcgctgccgaccatcccggtcaccatcgcctggggcacccgcgatgccgtcctgccgtaccgcaaccaggcgcttcgcgcccgcacggcgctgcccgccgcccgccacgtacccctgcccgggtgcggccacctgccgttccccgacgcaccggcccactgcgccgacctgctcctgcacccggcgacctga

SEQ ID NO: 5691 - DNA, 1677 bp, Actinoplanes utahensis
atgtcgttcgactacgacgtcctcatcatcgggtccgggttcggcggcagcgtgagcgcgctgcggctgaccgagaagggctaccgggtgggcgtcctcgaggccggtcgccggttcgccgacgagcagttcgccaagacgtcctggcggctgcgcgactatgtctacgcgccggccctcggctgttacgggatcctccggctgaccctgctcaagaacgtcctgatcatgtcgggcgccggcgtgggcggcggctcgctcggctatgcgaacacgctctacgagccgccggacgcgttcttcgccgacccgcagtgggcggcgatcaccgactggaagcgcgagctcgggccctactacgaccaggccaggcggatgctcggcgtgatcacgaacccggtggagaccgacgcggatcgggctttgcgagccgtggcggaggatctcggcgtcgggcacacctatcggcgtacccccgtgggcgtgtttttcggccgggacggcagcgaacccggcgccgaggcgccggacccgttcttcggcggcgccggaccggcccggcgcggctgcacactgtgcggctcgtgcatgaccgggtgccgcggcaacgccaagaacaccctggtcaaaaactatctgtacctggccgagcgggccggcgcgcgggtccacgagctgaccacggtgcgtaacgtgcggccgctgcccggcggtggctacgcggtcgccacccggcgcaccggcgggctgcggcggtccaccctcaccgcccggcaggtgatcttcgcggccggggcgctcggcacccagcggctgctgcaccggttgcgcgaccggggcagcctgcccgcggtctcgccgcggctcggcgagctgagccgcaccaactccgagtcgatcctgggcgcgcgcacccggcgccgggaccgcgactacagccacggcgtcgcgatcacctcgtcgatccacccggacccggtgacccatgtcgagccggtccgatacggcccgggcagcaacctgctcgcgctgctgtccaccgtgctggtcgacgacaccggccgcggcccgcgctggtgggccggcctgcggcaactcgccacggccgggcgcgacctgcgtctgtatctgtcgccgcgggactggtcgcggcagaccgtggtgctgctcgccatgcagccgctggacaattcgatcaccgtcttccgccgccggggacggctcaccagccgacccggggtgggcgagccgaaccccgcatgggttccggccgcgcacgaggtggcccgccggaccgcggaaaaggtggacggggtgccgctcgggtcgtataccgcatgggtgggcaagccggtgaccggtcatttcatcggcggctgcgcgatcggcgccgacccggagtccggcgtggtcgatccgtatcatcggctgttcgggcatcccggcctgcacgtgatcgacggatcggtggtggccgccaatctgggtgtcaacccgtcgctgacgatcaccgcgctggccgaacgcgcggtcgcgctgtggcccaacaacggcgaagaggacacccgcccgccgatcggtcacggttatctcggcatcggtccgacggcgccggtacgccccgccgtgccaccgtccgcacccggtgccctccgcttcccgggggtggcccgatga

SEQ ID NO: 5692 - DNA, 1758 bp, Actinoplanes utahensis
atgggtgggcaagccggtgaccggtcatttcatcggcggctgcgcgatcggcgccgacccggagtccggcgtggtcgatccgtatcatcggctgttcgggcatcccggcctgcacgtgatcgacggatcggtggtggccgccaatctgggtgtcaacccgtcgctgacgatcaccgcgctggccgaacgcgcggtcgcgctgtggcccaacaacggcgaagaggacacccgcccgccgatcggtcacggttatctcggcatcggtccgacggcgccggtacgccccgccgtgccaccgtccgcacccggtgccctccgcttcccgggggtggcccgatgacccgcatcctcgtcatcggcgccggcttcggcggggtggccgcggcgaacgccctgctcaaagccgggttcaccgacatcaccctgatcgagaaggcggaccgtcccggcggggtgtggcgcgacaaccgctatcccggctgcgcgtgcgacatcccggcgccgctctactcgtactcgtacgccccgaatgcggcctggacccgccgcttcccgccgcagccggagatcctggactacctcgaacgctgcgtgtccgcattcggtctcaccggccgggtccggttcggcaccgaggtgagcgccgccgactggaccggctcggcctggcaggtgacgctcgcggacggcgagatcctggaggccgacgtgctgatcccggccgtcgggcagctgtcccggccggtcatccctcggctgcccggcacgttcggcgggcccgcgatgcacaccgctcgatgggacgcgtcggtgccgatcgagggccggcgggtcgccgtgatcggcaccggggccagcgtgatccagctcgtgccggccatcgcgggacgggccgcgcacgtcacggtcttccagcgcagcgccccgtggacgctgcccaaaccggaccggcgctacgggcggacccgccggaggctgtacgagatggcccccgtcctgatggcgccgtcccgcgccggaacgtggctgatgaccgtggtgaccgggcttgcggtgaccggcaaccgggccgccggcgcgctgctgcacgggctgtcccgggcccagcgccgttggcaggtacgcgacccggaactgcgccgcaaggtcaccccggacgagccgatgggctgcaaacgggtgctgttcaccaacgcctggtatccggcgctggcccgccccgacgtcgacctggtcaccgagaagatcgtcgaggtgaccgagaacggcatccgcaccgcggacggtgccgaccatccgtgcgacgtgatcgtctacggcaccggcttcgcggccaccgacttcctggtcccgatccgggtcaccggccgcgccgggacctcgctggacgaggcgtggcgggacggggcacacgcgtacctgggaatggccgttccgggatttcccaacatgttcctggtgtacggcccgaacacgaacaccgggaacacgtccgtggtcttcttccacgaggcccaggcccgctggatcgcgcaggccgtccggcggatcgcgcggagccggcaaccgctggaggtacgcccggaggtggccgccgcctacgacgaggaaatgcagggccggctcgccggaagtgtctgggcggcctgccagagctggtaccgcaccgcgtccggccgcatcgtgaccaactggcccggaatggccgccgaataccgccgccgcaccgcccgcctgaacccggccgacttccggtga

SEQ ID NO: 5693 - DNA, 1032 bp, Actinoplanes utahensis
atggcatcggacctgaccggattcatcgccggcctgcccaaggtggagctgcacgtgcaccacgtcggctcggcgacaccgcggaccgtggcgcgtctggccgagcggcacgccgggagcacctcggtgccggccgacccggccctgctcgcggagtacttcaccttcaccgacttcgcgcatttcatcgaggtgtatctgtcggttgtggatctgatccgcgacgccgaggacgtggccacgctcacctacgacatcggcgccggtctggccgggcagtcggtgcggtacgcggagctgacgctgaccccgtactcctcggtggtccgcggcatcccggccgaggcgtactgcgaggcggtggaggacgcccggcgacgggtcgcccgtgaccacggcgtggaactgcgctggtgtttcgacattcccggcgagccgaccatgaccggcgccgacgtgaccctcgacgtggcgctccggcagcggccggacggcctggtcagcttcgggctgggcggcccggaagccggcatctcccgggagagttacgccggccatttcgccgccgcgcgggccgccgggctgcgcagcgtgccgcacgccggcgagtcgaccggcccgcagaccgtctgggacgcgctgcaccacctcggcgcggaacgcatcggccacggcatcgccgccgcgcgcgatccggaactgatggcctacctgcgcgagcacgacatcgccctggaggtctgcccgacctccaacgtctgcacccggtcggtgccgtccctggccgagcatcccctcccggcactggtcgcggccggggtgccggtcaccgtcaactccgacgacccgccgatgttctccaccaccctcaaccacgagtatcaggtggccgcggacctgctcggcctggacgagcacggcgtcgccgacctggcccggcaggcggtccgctactcgttcctcgacgccacgggcaggtccgccctgctcaccgagatcgacacctacgtcaccgccacgaccgcgcgctga

SEQ ID NO: 5694 - DNA, 363 bp, Actinoplanes utahensis
atgcaccccctgcgccggatcaccaccgagctcggtgccggcttccgattcctctccggaagtccgccgctgcgacgcgtgacgctcgccagcgtcctcgcggccttcgccgtcggcggcggcggcgatgcgaccggctacgccgtcatcagccagggtctgcaccgcgcaccgcagttcaccgggccgcagaccgccggcctcgccctcggcgccgtcctcatcgccgtcctcgactaccgtctggtgctcgtcggtgcgggtctctgtctactggtcgcggccgcggctctccgccgtacgaaagtcccggaggagccgtcggagacggcggcggccgccgagatcaccaccagccgctga

SEQ ID NO: 5695 - DNA, 1701 bp, Actinoplanes utahensis
gtgacggccactccgcggctgccgcgcaagctcggtgagatcggcattccgaccgcgccgatgccggccgccaccccgatcagcgaggtcgaggcgatgctgcacgccgagcagctgacgcccggcgtcatcgtcgccaccgacaccggataccgcctggtcagccggatcgcgctgaaccgcacgacgaccggccggctgggtttcgggcgggccctcacggttcgcggcaccctggccgacctggccggcgcggactcgctcgcgctgcccgccgacaccgacatcgacgtcgccgccgaggccgccctggcccgcaagggcggcgaccgcgaggagccggtcctggtcgtctggccggacggccgctgcggcatcgccccgatgatggagctgctgtccgcgatggccggtcgctacgccaaactgtcccgcaccgaccagctgaccggcctgccgaaccgcagcctgatcgccgccgagggccagcgccgtctcgacgccggcaccctggtcgccgttctgcacctgggcctggaccggttccaggacgccaacgacgtgctgggccaccacggcgccgacatcctgctgcaccgggtggcggtcgcgctgagcgccgcgcacggccccggcgacctggccgcccgtctcgacggcgaccagttcctggtgctgctcggcgacctgccggccggccacaccccgcagtcgatgggccggcacatcgcggccggtctgcgcggcccgcacaccgtcgacggcctgccgatcggcgtcgaggtcagcatcggcgtcagccccgccgaccaccacgacatccaggtcgtccagcgccgcgccgcggccgccatgcgccgcgccaagcaggaccgcaccggcgtcgtctcctggacccccggcctggactccacccagcgtgtcgacctgcgccagctcaccgagctgcgcaccggcctgaagagcggccacctgcgcctgcactaccagccgctgcacgacgccgtcacccgcgagatcaacggcgtcgaggccctggtccgctggcagcacccgcagcgcggcctgctgcccccgggcgtgttcctgcccgacgcggaacgttccgacgtcatcctggaactcaccgactgggtgctggccgaagccctgcaccaggccgccctgtggaaacgggccggtcaccacgtgcccgtctcggtcaacctgccggccgcctacctggcccaggcccgcgccgtacccaccatcctggccatgctcgacctcgaacagctccccgccgaactgctcaccgtcgagatcaccgagaccgccgtgctggcccgccccgacgaggtcgccgcccagctggccgacctgcgcctgcgcggcgtccgggtggccatcgacgacttcggcaccggctacacgtcgctgggcctgctcccccgcctgcccatcgacgaattgaagatcgaccgctcgttcgtcgtccagatgcacgactccccggcgcacgccacgatcatcgactcggtgatcgccatcgcgaaggccctcggcatgaaggtcgtcgccgagggcgtcgaggacgaacccaccgcggccgacctggcccgggccggcgtcgacctgttgcagggctaccacctcaaccgccccaccccacccgacgcggtcccgctcctcccggcccggcctctgctcacggtcctctga

SEQ ID NO: 5696 - DNA, 1347 bp, Actinoplanes utahensis
gtgttgaccccgcagatcaccgagcagccggtggccgacggccggaaccgggccgtgggcgcctgctcgctggcctacctgcacatcgaccgggccggccggatccaggactggaacgaagccgcggaacgcctcttcggctggccccgggacgaggtgatcgggcgaccgctcgccgacaccatcatcccgccggccctgcggtccgcgcacaacgccggattcgcccgccggctcgccctcggtgacggccccgacctgggccaccgattcgaggcgccggccgtgcaccgggacggctccgagctgaccgtgtcgatgaccctggactcgctcggcccggacggcttctgcgcgttcatctccgaccagaccgaatggcaccaggcccggcaggagctgcagcgcagcaaccagctgatcaacgcgattctgcagcacaccaccgcggtgatctcggccaaggacctggacggccgctacctgttcgtcaacggcgaatacgagcgggtgttccaggtgtcggccgccgacatggtgggccgcgaggaggccgacgtgctgcccgccgcgatcgccgccggcagccgcgcgcacgacgtcgaggtggccggctcgggcgccgcccggaccgtcctggaacagcttccgttcggcgacgacatccgggagtacgtggtgacccgggtcccgctcgccgacccggacggctcggtgtacggcgtctgcacgatcgccatcgacgacaccgcccgccgccgcaccgaggccgcactggccgccggcgaggaacggttccgcagcacggtgaacaacgcgccgggcatgctgtaccagttccggatcgagccggacggcacgggcgcgttcaccttcgtctccgcggcctgccgcgacctctacggcctggcgccggaacagatcgtcggcggcaccgaggccgacctgatcacctacatcgccgaggagcaccgcgagtcgtaccgggcctcggtccgcgagtcggcggccaccctggagccgtgggagtggcgcggcgcgatcgtccggcacgacgggcagcgccgttggctgtacggcgtcgcccgcccgcaccgggagccgggcggcgccaccgtctgggacggcatgctgctcgaccagacccgcgagcacgccaccgaggtgcgcctggccggcacccggcacgagctggaggacctgacccaccggctggccccgctgtcgttcaccgcggccgccgacgccggcgcgccggtcgccgacctcgtcgcgctgatcgacccggccgaccacgacgaactggcccggtgctgggcggcggcccgggacgggcggcccgcctag

SEQ ID NO: 5697 - DNA, 1383 bp, Actinoplanes utahensis
atgaatcgccggactcttctgctgggcggcgccgccggggcgctgaccaccgtcctgcccgccggcgccgagggcgcgccgcacgccgacccggtgctcaacgacgccgagatctacggcgtgccgaccgcccagccgctgatcagccagcgggccgacccgttcatcagccggcggtacgacgggaagtactacttcaccggctcggtgccggcgtacgacagggtggtgctgcgcggctcgccgaccctggccgggttgaccaccgccaccgagaccaccatctggacccagccgaacaacggtttcatctgggctccggagctgcaccgcatcgacgacaagtggtacgtctacttcaccaagagcaccgccgacgacatctggcacatccggccgtgggtgctcgagtcgtcgctcgccgacccgctcgacccgtccggctgggtgctcaagggtgagatcgctctggagtgggacagcttcgcgctggacgccaccaccttcgcccaccgcggccggcagtacctggtgtgggcgcagagcgagccggagatcgcggtcaacaccagcatctacatcgccgagctggccaacccgtggacgctccggacgaaaccggtacggctgaccacgccgacgaagacctgggagatccagggcttcaaggtgaacgaggggccggccgtgctggtccgcaacggacgggtgttcctcaccttctcggccagcgccaccgacgccaactactgcatggggctgctcaccgcggacgcgcacgcgaacctgctggaccgggcgagctgggtgaagagccccgacccgatcttcaccagcgacgacgacacccaacggtggggtcccgggcacaacagcttcaccgtggccgaggacggccggaccgacgtgctcgtctaccacgcgcgggactacccacagatcaacggcgatccgctgtacgacccgaaccggcacaccagggtgcagaagctgtactggcatccggacgggacgccgctgttcggcgtaccggtgggagacggcgggccgatcgtgcggctgtccgccggccgggacttcctgcaccacggcacgacctccctggagatggcgccggcaccggaggacctgggcgccacccagttccgcttcgtcgccgccgccgacggcacggagaccatccggtcggtcgacaaaccgtcactgtccgtccgcatcgacgggacctcggtccggctcgacccggccggcaccccggtgcgccggatcccggcccgcggcggcgtgacgatccgcaccgccgccgaccccgcgctgttcctgcgggtcgacaagggggcgatcggcaccgcgaagaccgggaccgtcttccggttgagctaa

SEQ ID NO: 5698 - DNA, 2460 bp, Actinoplanes utahensis
atgccccgcatccgttcccgcctggtcggcgtcgccgccgtcctggtgtcacttccgctggcggtcgcgccgccggtctcggcgtccccggtccagccggattacacgatcaaggtgagtccgcaggccgacggcgcggcgctgtcccggcagcagtacggcgtgttcttcgaggacatcaactacgcggcggacggcgggctgtacgccgagctggtgcgcaaccggtcgttcgagttcacctcggccgacgcggccggcttcaccgggctgaccgggtggaccgccaccgggtcggccaccgtcgtcgacgacgaccagcggctcaacgagcgcaaccggaactatctcgccctcgacggcagcgtgacgaacgcgggctacaacagcggcatcgccgtacaaaagaatgatttgtacgatttttcggtgtgggcgcggggcaccgccttgctgacgatcgagctcggcggggtcaccgggaccatcgcggtcagcggcgacacctggaagaagtacaccgcgacactgaaagccggggccaccaccgaccggggtcggctgaccgtctccagctcggcgccggtcaaggtggacgaggtctcgctgttcccccgggacaccttcaagggccgccggaacggcctgcgcgacgacctcgccgagaagatcgccgccctgcacccgggcttcgtccgcttccccggcggctgcctggtcaacaccggcagcatgtactcctacgacgcggcgaacaactacccgcgggcccgggcgtaccagtggaaggacacggtcggcccggtcgagacccgcgccacgaacaagaacttctggggctacaaccagtcgtacggcctgggctactacgaatacttccagttcgccgaggatctcggggcgatgccgctgccggtgctgccggccctggtcaccggctgcgggcagaatcgggcgacggtcgacgacgcgctgctgcagcggcacgtccaggacgcgctcgacctgatcgagttcgccaacgggccgaaggactcgacctggggcagggtgcgggcacagatggggcacccgaagccgttcgggctgaccaccatcgcgatcggcaacgaggagaatctgccggagcagtacttcgcgaacttcctccggttccaggccgcgatcaaggcgaaatacccgtcgatcacgctggtcggcaattccgggccggacgaccagggtggcacgttcgagaacctgtgggccaagaacagggcgaaccacacggacatggtcgacgagcactactacaacagcccatcctggttcctgcagaacaacgggcggtacgactcgtacgaccgtaatggtcccaaggtttttctcggtgaatacgcgtcgctggacgccaggttcgccaactcgctcgccgaggcggcctacatgaccggcctggaacgcaatgccgacgtggtgaagatggcgtcctacgcgccgctgctggccaacattgacaacgtgcagtggaaaccggacatgatctggttcgacaacgacgagtcgtggggttcgaccagctatcagatgcagaagctgttcatgaacaacgtcggtgaccgggtggtgccgagcacggtcaccggtggcggtgtggtgcggccgaagccgatcaccggagcgatcgggctgtccacctggcggaccgccgccacgtacgacgacgtgaaggtcacccgcccggacgggaccacgatcttcagcgacgacttcggcgacggcgatgccgacggttggaccgcggtgcagccgcgcggcacctggacggtgaccgatggcgggtacgcacagaccaccacggacaccgaggacaccatggtcaaggcggcgaccatcacggacaccgactacgactacacgctcaaggccaccaagcagaccggctccgagggtttcctggtcgccttcggcatccagcagacgggcaacttctactggtggaacctgggcggctggaacaacacccagggcgcggtcgagaagggggtcacctcggccaaggagcagctgctcaccaggcccaacacgatcaagaccggtcagacgtacgacctgagagtctccgtccggggcaccagggtgaccctgtacctggacggcgccgagtggggcagcttcgacgacaacgcggtgaccgagccgttcgcccaggtcgtcaccaccgacgcgaagaccggcgagctgatcgtcaaggtggtcaacgcccaggacaagccggccctgaccaggatcgacctgggcaaccgcaaggtcgccggcaccgcgaggatgaccgtcctggccggtgacccgggcgagcagaatacccgcaccgccgagccgatccagccggtgaccagcaccatccacggtgtcgcgtcgagcttcacccgggagttcccggccgattcggtcaccttcctgcgcatccggacccgatga

SEQ ID NO: 5699 - DNA, 762 bp, Actinoplanes utahensis
gtggagctgaatgtgtcggtggcggacggggtggcgctgctggagatgcggcggccgccggcgaaccacttcgatgaggagctgatcgggcggatcgtcgaggcggcgttcgcgctcgatgaggatccggcgtgccgggtgatcgtgctggcgtccgaggggaagcacttctgcgccggggcggatttcggcgggggtgacttcgggcgggatcatgtggatgcggcggcgcggctctatcggcgggccatgcagctgttcgacgtgcggacgccgatggtggcggccgtgcaggggaccgcggtgggtggcgggctggggctggcgtgcgcggcggatttccgggtggcggagccggggacgcggttcgtggcgaacttcgcgaagctcggattccacgccggcttcgggctcagcgtgacgctgccggagctcatcgggcggcagaaggcgaccgacatgatgctgaccgcgcggcgggtcggtggggacgaggcgtaccggatcgggctggcggaccggctcgccgaaccggggcgggtgcgggacgcggcccgggcgctggcgaccgagatcgccggggcggcgccgctggcggtgcggtcgatgcgggcgacgctgcgcggcgacctggccgaccgggtgcgacgggcgctcgatcacgaactggccgaacagaagatccactgggcgacgaaggacagcgcggagggcatcacggccagcctcgcccgccgcgcgccggtcttcaccggcgaatga

SEQ ID NO: 5700 - DNA, 1272 bp, Actinoplanes utahensis
gtggccggcctgctcgccctcgtcggggtcgccgtcgagccggaccggacggcgcgcctggccgccgtcgccgtgtgcgatctggtcgtcgccgtgcccgcggcgctgatgccgtggggccggctgccccggcacgccccggctctgctcgggttgcccgctttcgccgtgctcgggttcgccacctggtcgttcggcggggtggccagcggcaccggcccgttcctggtgctgatcttcgcgtgggcggcgctgcacttcccgcgctggatcctgctggcctttctggcgccggccaccatcgcgtacctgctgccgctgatcctcaccgggcagccaccgttcgtgaccggcagcgccgccgtgctgatgccgatcgccctggtcgtcggcctgctcatcgaggcacaggcccggcacctgcgcgacgaccgggagcgcctgtcccggatcgaacgctggcgcgccgccatggtcaacaccctcgcccacgacgtgcgcaccccgctgagcgcggtgcagatcgtccttgaggaactgcgcgccgaggctaccggcaccgacgccggcatgctcgacgtggcgctgcgccagaccgcccggctgacccggctcgccgacggcctgctcgacgtgcagcgcatcgaccgcaccggccacctcaccctcgacctgcgcccacatgcggccgaggaactggtgcgggacgcgctgacctacgtccgggcggacgaggagatcgaggtcgagatctccgcgtcggccacggtgtgtgtcgacaagcagcgcttcgagcagatcctgctcaacctggtggccaacgcgctccggtacggcggcccgccggtggtgatccgtttcggccgggacggcgacacggaccggctggaggtccgcgaccacgggccgggcatcccggacgcgctgcgcgacacccctgttcgaacagttcgcggtcagcgggccgggcggcgtcggcctcggcctgtggatcgtccgccagctggtccaggcacacggcggccggatcaccgccgaggcccgcgacccgggcgtggcgatgctggtccgcttccccaccggccactgacggcgccacccggcgccacgctgatctccctcttccggccctcgaaccgctcgtctcggcggcgccggggcggccgccgtcattcgccggtgaagaccggcgcgcggcgggcgaggctggccgtgatgccctccgcgctgtccttcgtcgcccagtggatcttctgttcggccagttcgtga

SEQ ID NO: 5701 - DNA, 939 bp, Actinoplanes utahensis
atgaaggtgctgctgcccgactccgtggagctcgacgtcaccctgcccgacggtgtcatcggcgtgacctacaccccgaccgcgccgatccccggggagcacgccgacgccgacgtcctggtcgtctggggcaacaccgcggcgcagctggccgacgcggcacgccgcctcacccggctgcgctgggtgcagaccctgtccgccggtccggacgcggtgctgcaggccgggttcgcccccggcgtgccgatcaccgcggggctcggcctgcacgaccagaccgtcgccgagcacaccctggccctgctgctggccgcggcccgccggctcaacctgctggtccgggcgcagatcgggcaccgctgggcgggcgagctcggcggcctgcaaccggtccgggaggagcattccttccggacgctgcgggacgcgcacgtggtcgtctggggcttcggtggcatcgccgccacgctcgccccgctgctgaccgcgctcggcgcccgggtcaccggggtggcccgcaccgccggcgaccggcacggctacccggtggtcaccgcggccgacctcccgcaggtgctgcccaccgccgacgtgctggtctcgatcctgccggccgccgccgacaccgccggcgtgctggacgccggcgtcctcgccctgttcccgccgcacgcctgggtggtcaacgtgggccggggcagcaccctggacgaggccgcgctgctcgacgccctgcgcgcgggccggatcgccggtgccgccctggacgtcttcgtcaccgagccgctgccgcccgcctccggcctgtgggacgaacccaacgtgatcatcaccccgcacgcagccggcggccgcccgctgggcgcggcccgcctgatcgaggaaaacctggccgccttccgcgacggccgtccgctgcgcaaccgggtcgcctag

SEQ ID NO: 5702 - DNA, 768 bp, Actinoplanes utahensis
atggggcgttgcgcggctcaccgccgtcgacgaccagcaccgaccggttcgagcgggccagcgtcacggccccgctcaggccggccgcgccgccgccgatcacgatcacgtcgtacgtccgctccatcgtcgtccttcctcagggcaccgccgtccccgtcaccgtgcgccgcgtcgcgcaggccggcaagtatctttgccgttatggcaaaggacctggccgcggtcggcccccggctgcgcgccctgcggcagaagcggaacatcacgctgacccggctcgccgagaccaccgggatctccgtcagcaccctgtcccgcctggagtccggcgcccgccggcccaccctggaactgctgcttccgctcgccgaggcgtaccaggtcacgctggacgacctggtcgacgcgccggagaccggcgacccacgggtgcggcaacgcccgatcgaacgccacgggcacacctacgtcccgctgacccgccgacccggcggcgtgcaggccttcaagcagatcattccggccaccccggaccgctgcgatccggaacaacagacccatgaggggtacgagtggatctacgtgctgagcggccggatccgcctgctgctcgggccccgcgacatcctgctgaccccgggcgaggccgccgaattcgacacccgggtcccgcacgccctgctcaaccccggcccgggcccggccgaggtgctgaacctcttcggcccgcagggcgaacgcgtccacctgcgcgcccactcgtag

SEQ ID NO: 5703 - DNA, 1566 bp, Actinoplanes utahensis
atggagcggacgtacgacgtgatcgtgatcggcggcggcgcggccggcctgagcggggccgtgacgctggcccgctcgaaccggtcggtgctggtcgtcgacggcggtgagccgcgcaacgccccatccgggcacgtgcacaacctgctcggtcgagaaggcgtcgcgccgaccgagctgtacgcggccggccgggccgaggtcgaggggtacggcggcgaggtgcgcaccggcacggccgagcgggccgagcgggtggacggcggcttcgtggtcaccctggccgggggcgaccgggtggtcgggcggcggctgctggtcaccaccgggctgaccgacgagctgccggacatcccggggctggccgagcactggggtggcgacgtggcgcactgcccgtactgccacggctgggagctgcgcggcaaacggatcggggtgctggtcaccgggccgctcagcctgcacggcgcgcagctctggcggcagctcaccgacgacgtggtctacctgctcaacggcagcccggccccggcgcccgagcaggccgagcagctcgccgcgcggcgtatcccggtggtcgccgaggcggtcgaggcggtgcagagcgacagcgggcggatcagcggtgtgcggctcgcggacggccgggtgatcggcctggaggcgatcgcggtcggcccgcggttggtcgcccggtcggcgttcctggcgtcgctcggcctcgaagcggtgccgatggagctcaacgggcacgtgatgggcatgcggatcgcggccgaggagcgcaccggcgcgaccgcggtgcccggcgtctgggtggccggcaacgtcaccgacctgggcgccaccgtcgcggtcgcggcggccgccgggcagaccgcgggcgccatgatcaacctggatctgatcgcggcggagacccgggacgccgtcgccgagtaccgccgccggcagcagaccatggtcgaggcggacgcctgggaggagcggtaccggggcaaggcggcgatctggagcggtcagccgaacgtgcagctggtcgccgaggcggccgggttgccggccgggcgggcgctcgacgtcggctgcggcgagggcgccgacgccgtctggctcgccgagcgcggctggcaggtgaccgccgtcgacatctcgtcggtcgcgctgatccgggcggccgggcacgccgccgcggccggtctggccgaccggatcaccttccgccatgccgacctgcgccaggaacctcccgcggagggctcctacgacctggtcacggcgcactacatgcacctgccgcggccggatcgccgggagttgtacggccgtctcgccgccgccgtggcccgcggcggcaccctgctcgtggtcggccaccaccccgacgacctggccgagcggccccgcccgatgcacttcccggagatgctgttcaccgcccgggaactcgccgccgagctggaccccggccgctgggaggtgctcaccaccgcgaagcgcccgcgggccgggcaggacggggtgatccacgacgcggtgctggtcgcgcgccgtaaacactga

SEQ ID NO: 5704 - DNA, 5199 bp, Actinoplanes utahensis
atgcggccggatgaaggtaacggacagcccggactcggcgacgacgcccgagcggccctcgccgcctggcgtgaccagctcgccgacaccggcgccgcggaccggctgatcgacctgccgcgggccggtgccgacctggtcgagatcaccggcccgggaccggaggcggtcaccggccggctgcgggccggccgggactggtccttcggcccgggcggcggcgacgtgctcgccaccgacctgcccgccgacaccctgcacacgctgctgcggcacctgcggcggcacgcccaccaggagactctcgaccacggcgaggacaccctgcacctggccaccgggctgctgcactggaccgaccgggccggcgccgggcacgccagcccgatcctgctcaccgcggtcgagctggtcgcgctcggccccggcgacgtgccccggctgcgcgccgcgaccggcgacccggtgctcaacccggcactcgccgcccgcctgcgcgagcaccgcgtcgagctcaccgccgacctcggcgcgctgcgtgaacggatcaccggccgcaacggctggcggatcgtcgacacggtggtgctggcccgcttcgacctggccgccgaggcggtccggcaggacctcgccgagcacgaagacctgatcctggcccacccggtggtgcgggcgctggccgccgaggacggcgacttcgcgtttcccccggccaccggcgaacacctcgaaggggacgagccgccgctgctgctggacgccgacgcggaccagcgggcgtgtgtcgccgcggccctggccgggcacagcttcgtgatcgacggcccgcccggaaccggcaagtcgcagaccgtggcgaacatgatcggggcgctcacgcacgccgggaaacgggtgctgttcgtcgccgagacggcctccgccctcgacgtggtgcagcaccggctggccgccgccgggctcggcaactacctgctcgacctgcacgggcagcgggccgggcgcaagcaggtggccgccgcgctcgcggcggccctggaagccgtgccgctgccaccgccgggaatggacgaaacggatcgccggaccctcgcggcgcggcgggagcagctcacgtcgtacgcccaagcagtcaatgagccgcgcgaaccgctcgggctcagcctgcatcaggtggccgggcgccacgcgctgctctccggcgtgccggagagcccggcgccggggctgcaaccgctggcgctgaccgagaccgcgctggaccgggtgctggccgccgcggagcagctcagcggcgcctggcggccggccaccgagcgcagcggattccgctggcgcgaggtgatcgagaaggagccgctcgacggcgcgctgcacgaggcgcaggtcgcgctggaggcgctgaccgaggccaccgaggcgttcgggccgctggccgccgcgttccacgtgcggctcccggtcgacgcggaggagctggcccggctcgtcgcgcatgccgcgacccgccccgccgaggtgcccgaccactggctcaccgcggtcgccctgcgtccgatcagggaggcggcggacaccctggcccggctgaccgccaccgcccgggaggcggcggaacaggcccgcgaacgcaccgggctcagcgccgcccagctcgccgagcaggaggtcgccgagctgccggagcagcccaccctgaacccgccggcggtcggcctggcatcgctgaccgcggccaccgcgaagtcgctggccggccggttcgccgcggacgccgacgagctggaacaccagcagcgcaccctggaccgggtcaccgggcggctggggctgcccgacgtggtcaccttctccgacgtcgaactggtcaccctggtggccgaactgggggcccggccggacaagccggagccggcctggttctccccgggtgcgcaggccggggtgcacgccgcggccggggcgctgcggcggcacgtcgaagcggtggccgaggcccgcaaccgggcccggcagtacttcaccgacgcggtgctgggcgagccggtcgaggagctcgccgaacggttcgcgacggtgcaccgcggggtgcgcaaactgctggccgcgcaccggtgggaccgggagacggtgacggcgctcgccgagccgggggtcagcgccgacgacgcggtggcgaacctgccgctcgcggtggcgtggcggcgcgccaacgaggggctgctcgcggcggaacggcagaacgcggccctgctcgggcggtactggcagcggctggacaccgacttcctggcgatcggccgggccctggagacggtgagcgaagtgctgcgggtgacgccacccgaggcgctggacgcggtgatcgccttcgtctgccaccggggtggcgacggtgagctgctgcgggtcgtgaccgaggcgcgggacgtgttccggcactggcgggccacgcccgaggtggcgcagcggcccgagctggggcagcggtcggtgggtgcggcggtggcgtggctccgcgcccaggtcgggccgctcggggtggccgccggggtgttggagcagctcagcaaggtgaccgggcgcgagctggacctggggtcggccgaggagatcgtggcggcccggacctcggtggtgtccgcctcccgcgccgtgacggaggcgctgcccgggttgcgcgccctgctcggcgatgtcgatctcggctcggtggaccgtgggctcgcctgggcggccgcggcgcggactctgcggagcggggccgacgcggcgctgaccgcggagcaggcggcggccctgcggctggacggcgagaacccggacctgtcggtgttcatcgaggtgtggcaggaggcccggcagcggatcatcgatgccttcgggccggcccggcaggtgcgcctcggcaccgccctcgaccgctacgagaccgcccgtgacctgctgcgcgatctccgcgaggacgacaccggacagcgcgagtggttccagtatctggccgcccgcgaggtgctcgccgaacacggcctggacagcgccatcgaccactgcgccgaccacggcgtcgaggtcggcaaactccggccggtgctcgagcggaccgtgtaccgggcctgggccgacgcggtcatcgccgaggatgaacggctgcagccgctgacctcggtggagcgcaacgagctggtcgaggagttccgccggctcgacgccgacctgatgccggatgccgccgggacgatcatcgaagcgctcaacgcgcgccggccggcgatcaccccggacggcgcgcccgcgctgatccgcgcgcaggaaggccgcctgccggtgcgcgagctgctggaccgcacctgggaagcggccgtcgcgctgaaaccgtgcttcgtcatgccgcccgccgcggtcagccggtacctgcccgccgatcagcgcttcgacgtggtgatcatcgacgaggcgtcgcggatgaccccgggcgccgcggtggcctgcgcgtaccgcggcaggtcactgatcgtgatcggtgacgactgccagctgccaccggccaacggccagccgtcggtgctggtggccgccaacgactgcggggcgttcacccggctggcgctgacccggcactaccgcagccggcacgagacgctgatcagctttgcgaacgaggccttctatcagggacgactcgtcacctatccgagcgcccacccggtcggcgacgacctcgggctggcgctgctgccggcggtggacgcgccggtggaggccgcgctggtggccgagcgggtggcgcaccacttcaccacccgccccacgctgtcactgggcgtggtcaccctgacgcccgggcacgccgacgcggtggccgacgcggtggagaccgtgctcggcgagcggccggacctggagcggttcctcggcgaggatccgctgaccgggttcttcgtcaagccggccgacgcggtgcagggcgacgagcgggacgtgatcatcctggccaccgggccggacctggcggccgccggaggaccggtgggcgcgcgcaagctgaacgtggcgatcacccgggcccggcagcgcgtcgaggtggtcacctcggtttccgagcggcgacgcgaggagccggcggacgagggggagcgccggctcgcggactatctggcgccgaccgcggcaccggccgccgccaccaccgccatctccgacatcgccgaatacgtcgcctcgctgatcgaaggctgggggttcgcggtcacccgccgggccggcgccggtcactgccgcatcgacatcggcgtacgccattccactctcgacgcgtacgccctgggcgtgcagtgcgacggacccgaatacgccggcaccccggcccgcgaccgggaccggctgcgtgaacaggtgctgcacgccctcggctggcacctgcaccgggtgtggagcgtcgcctggtaccacgaccgcgccgaggaggaggcccggctgcgcgccgccatcgagaacgccctggccgtccccgacgtcttcgccgaacccgacctggaactggtcacccgcccggctcaaccgcccgaatgggcgctgccgtaccagcacgcccagctcgagccgctgcccccggccgcccgggtcaacgaccaggtcgtccgtaccctgctggaacgcaccgtcgagacgatcgccgaggtggagggtccggtccacatcgccgtgctcacccggcgcatccgcgaggggtggggcatcaaccggatcacccagccgatccgccaggccatcgaagcggccatcgcgtcgtccacggtaggtttcgacggcaccttcatcacagcggccgtcgccccgatacccgccgtccgggtcccgggcgacggggtggcccgcaaacccgaacaggtcgccgagtcggagctgcagctggcgctggaatacctggtcctcgacgccgggctggtggaaagcgacgacctgctggccgcggcggcccgcctgttcggctggccggccaacaagaccggctcggcccggctcgccgcgatgctcgacgacctggtggcgggcgggcggctgatcgcccaccgcaacggcctgatcgccgccccggagaacgacctgctcgacctcccggatccggccacccttccgcaccgcccggacgccgcgaccgtggacctggagacggaggccgccggccgcagctag

SEQ ID NO: 5705 - DNA, 570 bp, Actinoplanes utahensis
gtgccggctccgcagccaccgttccggtggaagacgtggcacaaggtcaccatcggcgtggtcggtgcgaccacgctgctcggctgcgggacggcgatcgtcacgctcatcccggggagaccggagaggacggtcgccgccggcgcgaccaccctgcccgtggtgaccgcggccaccacggcggccacggcgtccccgtccgcgccggtcccgcccgggccggcgtcgaaggccggaccctccccgaccgccctgcggacctcaccaccggtctcctacgccgactgcgatgcggtgatcgcggcgggcgccgcgccgatccgcaccggccagcccggcttccggaaggccttcgacaccgacggcgacggggtgggctgcgaacccgccgacggcgtcccggcgaccccgtcccgcgaacccggccccaccgacgacggcgggctcgacccgcgcttcccgaactgcgccaaggccagagccgccgggtacggcccgtaccaccgcggcaccgaccccgaatacgactggtacaaagatcacgacaaggacggcgtggcctgcgactag

SEQ ID NO: 5706 - DNA, 432 bp, Actinoplanes utahensis
atgagcctgaccgccgaggaccgcctggagatccacgaagtgctcgcgctgcacggtcacctgtgcgacgccggcgactacgaccgcttcgacctggtgttcaccgcggacctgcaggtggacgtcagcgccctcggttatgaaccggtccgcaccggaccggcatcccggccgagcctggcgacctacatcgaggtcgcccggcgacgcgggccgggcagcacgctcgccatgcacgtcaccaacatcatcgtccgcgccgacggcgacggtgcccgtgcctggtcgaaggggatgaccgtgggcgaggacggccgggtcgccagcttcacctacgcggatcacctcgtccggaccgggcacggctggcgcatccggcaccgcacggtgtccccgcaccgcgagcccggccggggtgtccccgtccgctga

SEQ ID NO: 5707 - DNA, 741 bp, Actinoplanes utahensis
atgggtcggaggttgcccctggcatcggtggcactgctgggcctcgccgcgtgtggctcgccggccgcccacaccgccgtcacgcccccgtcatccagcgtcgtcccggtgcccccggtcatcgccgcacccaccccgccgccggcaaagccgaagatcagcaaggcggggctcgcctacttcttcaccgtcgcgctcagcgccaggtacggcaccgacgcccacgccgtggtcaagtggacccaccccacggtcaccatcggggtccacggcggcgacgcggcgagccggacctgcctgaaccgggtgatcaccgacttcaacgccctgtccgggacgtccgatctggcactggcctccgggccggccgacatcgagatgcacttcgcgccggtctcccggttccggtccctcgagccgagctacgtcgccggcaacgacggattcttctacatgcactggtccggccagaacgtgatcacccgcgccaccgtgctgatccgctcgaccgggatcagccggaccgtccgctgccatctgatccgcgaggagctgaccggagcgatgggtctggccaacagctccggtaagtatccggacagcgtcttctacaacagatactcggccaccccgcagaagtactcggcgctggacaccgaggtcatccgcctgctgtacagcgacgcggtccacccgggcgacgaccagccgacggtcacccgggcggtcaccgtcggctag

SEQ ID NO: 5708 - DNA, 1212 bp, Actinoplanes utahensis
gtggagttctggctcgatctcaacgaggaacaaacggatctgcgcgactgggtccacggcttcgccgagcaggtcatccggccggccgcggccgagtgggacgagcgcgaacagacgccctggccggtgctgcaggaggcggccaagatcgggctgtacgggttcgagttcctgatcaacacgtgggccgacaacaccgggctgtcgctgccgatcgcgaacgaggagctgttctggggtgacggcgggatcgggatggcgatctccgggacctcgctggcggtggccgcgatctacggctccgggacgcccgagcagctcgtcgagtgggtgccgcagtgcttcggggacgccgacgagccgaaggtggcggcgttctgctcgaccgagccggaggccggctccgacgtggcgtcgatgcggacccgggcggtctaccacgaggcgaccgacgagtgggtgatcaccggtcagaaggcgtatgcgaccaatggcggcatcgccaacgtgcatgtggtcaccgcgagtgtcgacccggcgctcggctccaaggggcaggccgcgttcgtcgtgccgcccgggacggccggcctggtcggcacgaagaagctgaagaagctcggcctgcgcgcctcgcacaccgccgacgtgttcctcgacgacgtgcggatcccgggcagctgcctgctcggcggcaaggaggcgctcgacgagcggctggccaaagcccgctccggcgtcaagcgcagcggacaggccgcgatgcggaccttcgagctctcccgccccgcggtcggcgcccaggcgatcggcatcgcccgcggcgcgtacgagtacgcgctggagtacgcgaagaaccgggtcgccttcggccggccgatcatcgagaaccaggcgatcgcgttcgctctcgccgacatgaagatggagatcgacgcggcgcggctgctggtctggcgggccgcctggatggggcgcaacgacaagccgttcaccgccggtgagggctcgatgtcgaagctcaaggccggcgaggtggcggtcgcggtcaccgagaaggccgtgcagatcctcggcggcgccggttacctgcgcgagcacccggtggagcggatgttccgggacgccaagatctacacgatcttcgagggcacctcagagatccagcgcctggtcatctcccgggcgatctccggcatgcagatccgctga

SEQ ID NO: 5709 - DNA, 1539 bp, Actinoplanes utahensis
atggacgcgcttttcgtcggtgccacgatgctgcggcgcggactgctgaacccgggcaacccgatccggatcgtccagcagttcgcggcactcggccggtggggcttcgggctcgccggtgagctccggcaggcggccgcccgcagcccgcggcggatcgcggtgatcgacgatcagcggacattgacgtacgcccaattgctgaaccgcgccgaaaagctggcccgcggcctgccggtggccccgggggagcgggtcgggattctgtgccgcaactcggcgcggatgatcgaggcgctgatcggcgtgaccagcgtcggcgccgacccggtgctgatgaataccggtctgtcggcccaccagatggtgaccgtcgccaaggaccagggtctgcgggcgctgcacttcgacgacgagttcgcgccgacggtcgccctggtcgagggcgtggagaagatcagcgaggaacgcttcgaggaactgatcgccggtgctccggcaggatcgggaacggtcccgccggagcgccccgggcgaacgatcgtgctcacctccggcaccacgggtgtgccgaaaggcgcgcggcgccccacgccgggcggattccggccgctctgttcggtgatcgaccggattccgctgcgcgccgaggaccgcgtgatgatcgccgcgccgctcttccacacctggggctatgccgggctgcagatcgcgctggcgctgcgggcgacggtggtgctgcgccgcagattcgagccggccgcgatcgtgcacgacctggtgcggcacgcctgcaccggcatgatcgccgtgccggtcatggtgcagcagctgatggagctggccgagccgccggccaagcccggcctgcgggtggtggcgatcagcggctcggcgctgcccggcggcctggccacccggttcatggaccggtacggcgacgtcctctacaacctctacggctcgacggaggcctcctgggcgtcgatcgccaccccggaggacctgcgcttcgcgcccgacaccgcaggaagacccccctacggtacgaaggtggcagtgctcgacgagcacggcgacccggtgccgcgcggtgcggtcggccgcctgttcgtcggcaacgagatgctcttcgagggctacacgaacggcgccgcgaaactgatgcgcgacggcctgctcgccaccggcgacctgggccatgtcgacgccaccggccgcgtctatgtggacggccgggaggacgacatgatcgtctccggcggggagaacgtgtaccccgccgaggtcgagggcctgctcgccgacctgccccaggtgcgcgaggtcgcggtgatcggcgtgcccgacgacgaatacggtcagcggctcgccgcctacctggtgctccgcgacggcgagaccctcgacccggaagcggtccgcgagcacgtccgccaccaccgcgcccgattcagcgtcccccgcgacgtgaccttcctggacgcgctgccccgcaacgccaccggcaaggtggtcacccgggacctgccgcgctag

SEQ ID NO: 5710 - DNA, 459 bp, Actinoplanes utahensis
atgcttttcgcggcgggactgatcgtgtgggtgctggcggccgggccggtgacgctcagcgggcacccgtgggtgttcctggtgctgggggtgctggccggcgcgatctcgctggtgatcacgcacgggcacgtggtccggcggcggcggccggtgggggtggcggccgggtcgccgggtgagctcgcggtgcagccgcgggacgagttggccgtggtgccggtcgatgggcggaccggggcggcggtcgcgttcggggcggccgggctgttcctgttcagtgtcttcttcggcgtgctggcgttcgcgctggggctgaccgcgctgcgtcgcggcacgcccgggcggtgggggcggacggccgcgaccgccgcggtgctgctcggcatcgccgacttcatcatcctgatcaccatggtggcgacccagccgcaccacggcgtcctgcgctggagctag

SEQ ID NO: 5711 - DNA, 1302 bp, Actinoplanes utahensis
gtggactctcctattgaatcgatgggagataaatactatggtcgcggcatgctctcatcgaagactttcggtcggcgggcggtgctggccgccgcagccggtgcgggcgccgccgtggtgctggcgccgtcggcggaggcggccggcgcggccgacgggcggaacgacacgctgctcgactggtacgacctgaccgccaccaccatcggcgtcgtcaccgggccgcagcaggtcaccaacagccgaacctgggcgatcgcctggatcgccgcctggcgcgcggtgtccatggtgcgcggcggggccgacgccgaactcgccctggccgccgccgtccacgaaaccctgatcaccaccaacccggccgcgaccgccgcactggatgccgcgctggcggcgaccctggcccggctgagcgtccggcacccggatcgggtcgtcgccgccggggcggacgcggcccgcgcggtgctcgccgagcgggccggcgacgggctcgacccggcatcggtcaaccggccgtacccgccgccggccgcggcaccgggggtgtggcagccgacgccgccggcgttcgcctcgccggtgcagtccggtcagggggacggccggccgttcctggtgcgcattgtggagccgctgcagccggggccgccgccggacctggacagcgacatcttcctgcgggatctcgccgagtcccgggcggtcggcgcggtggacagcacggtgcggaccgcggagcagaccgcggtggcccggttctggtcgcagtcgtcgctgaacgggttcaccggggcgctgcggacgacgctcgcacccggcgggtcgcatgccggccggcggcggccgctgcgggagcgggtcggtctgatcgccctgttccacgcggcgacgatcgatgcgcagatcacgacgtaccaggctaaatatcggttcctgcgctggcggccggtgacggcgatccggaccgggtcggtggaccccgacccggactggacgccgctgctcgccaccccggcgcaccccgagtatccgtccggtcacaccacctacgccggggcggcgcaggccgtgctcgacaccctcgccggtccgccgcgggccgcgttcaccctgaccagcgcggtggcgacggacgtgacgcggacctatcgccgctggtcggagctgacccgggacaacatcgacgcccgcgtctgggagggcgtgcacttccgcaacaccgacgagacgggtgcggcggtcggccgccgcgcggcgctcgccgggctggcccgctggcacggccggccgatctga

SEQ ID NO: 5712 - DNA, 384 bp, Actinoplanes utahensis
atgcgactgtcgatcgtggaggacgagcgggagctcgccgagtcgctgcgtcgtgggctcaccgccgagggttacccggtggatgtggcccacgacggcagcaccgggctcgagttcgcgatgacacacgcctaccaggtagacccgggaccggctcgccgacgcggtcgagcggcagcgccggttcgtcgccgacgccgcgcaccaactccgcagcccgctcgccggcccgcgcacacggtcgaggtcgcacccgccgacggcgacaccgccgaccgtgcccaccatttccacccgatcgcggtgagcgacccgctgcggtcggcgccggacggctacctgctgatcgcccggagcgtcggtgtcacggtggatcaccggtga

SEQ ID NO: 5713 - DNA, 594 bp, Actinoplanes utahensis
atggcgaaccgcggcagaccgcgcaccttcgacccggacaccgccctgcgccaggcgctcgacgtgttctgggaacacggctacgagggcacctcactcagcgacctcgcacaggccatggggatcgcctcggccagcatccatgcgtgcttcggcaccaaggagaacctgttccgccaggtgatgacccgctacggcaagatccacggcgagccgccgcggcgggcgctgcgcgagcacccggatgcccggacggcgatccacgagatgctgcgcgccaccgccgaccaggtcaccgggccggacacaccgcactactgcatgctggtgctggccgccccgaccggcgcggtggaaaaccacgcgatccgcgagtttctcgcggccggacgccgcggccagcgggagctgatccgcgcgcggctcgccgacaacgtgccggccgctgtcctcgacggcatggcccgctactacgcgaccgtggtccaggggctgtcgatccaggcccgggacggcgccacccgggacgacctggaatccgtgatcacctgcgcgatggccgcctgggacacgctcaccggtgatccaccgtga

SEQ ID NO: 5714 - DNA, 975 bp, Actinoplanes utahensis
gtgcgagcacttcagcagacctcattgaccggccccgagggcctccgcctgatcgccgacgcgccgatcccgagccccggcccgggcgagttgttgatcaaggtgtccgccgcggggatcaacttcgtggattgctcgtacgcccgcggcaccttcgccggtggacccgcagtgccctacgtggccggcatcgaggccgccggtgcggtggtcgccctcggtcccggcgtgaccggcccgccgcccgggacactcgtcgtcggcgtgcacaccggcggcggcgccttcgccgaattcatgctgctgcccgccgccgcggcggtgccggtcccgcccggctgggccgccgagcaggcgctcggcctgctggtgaactggcccaccgcgctggccgcgctgaaacccctgggcggcctcaccgcgggccagaccgtgctgatccacgccgccgcgggcggcaccgggcaggccgcggtccggatggccaaacactacggcgcgaccgtgctcgccaccgcctcgccgggcaagcacgacgtggtccgcgagctgggcgccgaccacgtcctggactcgcgcggcaccgatctggccgccgaggtgctgcggctgaccggcggcgtcgacctggtgctcgagtcggccggcggtgccaccctggaggccagcctggccgcggcgaagcgggtcaccgggcgggtcgtcgtctacgggctggccgggggaacggccacgatcagcaactgggacctggtctaccggcaccaggtgcatctgatcggcctgaacatcggcatcctgatccaggccgcgccacagctcttcggtgaggtgatgggcgagctgttcacgctgatcggggccggggtgctcgcccccggccggccggtcctgcacgacctcgccgacggcccgacggtgctcgccgagctggaggcccggtcgacggtcggcaaacaggcgctgcgtctctag

SEQ ID NO: 5715 - DNA, 264 bp, Actinoplanes utahensis
gtgaccgtgagcgaccactatgtcgtcatcaagggccgccgctggcgggccaccgacccggcgatccccgaggaggtggccgccgagctgcgcaaggcgctgatggccgcgcggcgcgacgtcggcacggccctgcgcgccggcgaggacccggccccggcccgcgcccgggtgcacgccgcgaaggtcgcgctcggcgagcgcggcaccccgtggtgggagcagaccctcgacgagcgacgacagcgctgggaacagctctag

SEQ ID NO: 5716 - DNA, 357 bp, Actinoplanes utahensis
atgacggtgaccgatgaggtgcggcggctgctggacgggcagcagaccgtggagatcacgacgatcgggcggcgcagcggcacgccccgccggatcgagacgtggcgataccgggcggccggccgctactggctgaccggcagccccgggtcgcgggactggtatgcgaaccttctcgcccagcccgcgttcaccctgcacctggcgggcctggacgtgccggcccgcgggcggccggtgaccgacgcgcgggagcgggcgcgggtgttcggcgacatcgtgccggggctcggcgggggtggcagcctggaaagctggatcgccggcagcccgctggtggagatcgagttcgggtga

SEQ ID NO: 5717 - DNA, 933 bp, Actinoplanes utahensis
atggtggcggtcgtggagttgaccgaggggccgggaacgagcgcggcgtacgccaaggccgcgctcggcatgctgcgccggggcgggtcggcgctgcccgacgtggagctggtgcaccgcggggtgagcgtggaccgggcgcatctggcgcggtacgaccgggtgtgcgggctgcggctcggcgacacgctgccggcgacgtacccgcatgtgctggcgtttccgctggcgatgcggctgatgtcggacggggactttccgctgccgatgatcgggctggtgcacgtgtcgaaccggatcacggtgcgggcgccgatcgacgcgggggcccggctggatctgcgggtacgggcggtggatctgcgggatcatccgcgggggcggcagttcgacatggtggcgacggcttcggtggacgatgaggtggtctgggaggacgtctcgacctacctgcggatcacgtcggccggcggcggtgctcgtgacaccggcaccggcaccggcaccggtcgcaacgccggcggcggctccgcccgcgggtcggggaacgctccgctcggcggcgcagcgacccggttcccgaagccggatgtctccggttcatccggtggggcggtctggcggctgccgacccgggtcgggacggattacgccgcggtctccggcgatcgcaaccccatccacacgtcgcgcctgggcgcccggcttttcggattctcccggcagatcgcgcacgggatgtggaccaaggcccgctgcctggccgccctggaaggtcgcctccccgacgcgtacaccgtcgaagtgtccttcagacaaccgatcctgctgccgtccacggtccgcttcaccgccaccctcaccggcgacgactgggatttcgcggtggtctcgaagcgtacccacctgaccggcacgatcaccggcggctag

SEQ ID NO: 5718 - DNA, 2202 bp, Actinoplanes utahensis
gtgcaccaggatgtcgacgccgccgtgcgggccggccgcgaggtatccggcgagccgcgccggcgcgtcctcggcggtcaggtcgagttgcagcgcccggccgcgcgcccggttcgccacgtcggccagcgcgtcgccggcgccgggcacgtccagcgcgatcacctcggcgccgtcgcgggccagggtcgccgcgatcgatgcgccgatgcctcgggccgcgccggtgaccagggcgagtttgccggtcagtggcttgtcccagtcggcgggggtcggggctgcggtcgcgccgatccggatgacctggccggacacgtaggcggatttcccgctgagcaggaagcgcagggtggactcgaccgactgctcgcccccgggtgccacgtagaccagctggctggtgctgccccggccgaattccttgccgatgctgcgggtcagaccctccaggctccgctgcgcggtcgcctctttcgggtccgcggcggcttccggtggcgtgcccagcacgatgacccggccgctcggggtcaggctgcgggcgtacgggtggaagtagtcgaagagcgcccggagccccgccgaggtggtgatgccggtcgcgtcgaagatcagggcggcgtgtttcgccccgtccgcgccctcggtgaccacctgcaccccggcgtcctgcagcagtttgccgaccgggtcggcgagtcgtccgccgggcgcggcgccgagcagcaccggagcggacgccaccgggtcgcccgggcggtaccgtcgcaggcggggcgggtcgggcaagccgagacgcttgaccacggcccggccgagaccggagttggcgaagttcgcgtacctgtcagccatgcgagtaccctaccggtcagtagctttgccgtcgtcgatgtcgtggatagatctgtggaggattccgtgccgaccgtgcgccgtgtcgccgtcctgggcggtaaccgtatcccgttcgcccggtcgaacagcaggtatgccgccgcttcgaaccaggacatgctgaccgccgcgttggacggcctggtcgcccggttcggtctggccggcgagcggctcggtgaggtggtggccggcgccgtgctcaagcactcccgcgacttcaacctgacccgcgaggtggtgctgggctcgcggctcgacccgcacaccccggcctacgacatccagcaggcctgcggcaccgggctggaggcggccatcctggtcgccaacaagatcgcgctgggccagatcgacgtcggcgtggccggtggcgtggacaccacctcggacgcgccgctgcaggtgaacgaggacatgcggcaggcgctgctggagctgaaccgggcgcggacgctgggcgcgcggctgaaggcggtcgccaagctgcgcccgcagcacgcgctgcagccggagatcccgcgcaactccgagccccgcaccggcctgtcgatgggcgagcacgctgcgatcaccgcggcgaggtggaacgtgtcgcgcgaggatcaggacgcgctcgcgctgacctcgcatcagcgcctggccgccgcgtacgacagtcggttcttcgacgatctgatgaccccctacctggggctgacccgcgaccagaatctgcgggccgacagcagcctggagaaactcgcgaagctgaagccggtgtacggcaaggagaacgcgacgatgacggcgggcaactcgaccccgctgaccgacggcgcgtcgaccgtgctgctggcctcgcaggagtgggccgccgcgcactcactgccggtcctggcgtatttcgcggactgcgagacggcggcggtcgactacgtgcacggcgacgaggggctgctgatggccccggcgtacgcggtgccgcggatgctcgcccgcaacggcctcaccctgcaggacttcgactactacgagatccacgaggcgttcgcgtcgcaggtgctgtccaccctggcggcctgggagtcgccggagttctgcaaggcgaagctcggcctggacgcgccgctcgggtcgatcgaccgggccaagctcaacgtcaacggctcctcactggcggccggccacccgttcgcggcgaccggcggccggatcgtcgccaccctggccaagctgctcagccgacggggcgccggccgcggcctgatctccatctgcgcggccggtggccagggcgtcgtcgccatcctggagcgctga

SEQ ID NO: 5719 - DNA, 453 bp, Actinoplanes utahensis
gtgtcgtaccagccgccgtccgttccgcagaagccgaccgcagcgttcgtcggcgcgtcctgggtcgccctcgggctcggcatcgcgtcgttcgccgtcggcctgtggaactcgcacatgaccaagagcgaggtcggcttctacgccgcgacgctcctgctgggcctgttcggtgctctctccctgcagaagtcggtccgcgaccgggccgagggcgtgccggtgacgaacctctatctgggcgtcgccggcatcatcgtcggcctctccatcgtgatgatgacgatcggactgtggaacagcggtctggcgttgagcgagcgcggcttctacggcctcgctttcgcgatgagcctgttcgccgtcgtcgccgtccagaagaacgtccgcgactcggccccgccggcggcgacccggccggccgtcgtcagcccgtacccggatggccgctga

SEQ ID NO: 5720 - DNA, 570 bp, Actinoplanes utahensis
atgacccggcggcccctttccctcgtcgcgctgctcctgctggccggctgcaccaccggccgggcacacccggccgcggcgcccgcgccggccgtgtgcaccggcgggcagaccgtgttcgccaaggcggtcaccggcaaactgctcaccggcgtcaccccggtcgagaaggggcttgccagggacgtggtgttcaccgacccgtacgaccagatcaacacccggaccgccgcggtgcggaccgcggcgacggcgccggccgagcagatctaccgggagcttgccggccggtacggggaggaccatccgctggccccctacggcgaggtgtaccacccggccaccggcgagtcgttcagcatggaccgcaccggccgcttcgtcgcctacgagtggctgcgcaccctggacgtgcccttccactacacctgcggcggcaccaccaccgacggcaccgtgatcacctggagcgccgtgctgaccgacggcatcctgaactgcgacgagccggccccggcggccaccacggccgacgatccggagcgcgaggcccgccggctgcgctgttag

SEQ ID NO: 5721 - DNA, 348 bp, Actinoplanes utahensis
atgcgcggccacgcgctggcctggcaccagcagcagcccggcggggtgtcgtcgctgagcgggtcggcgctgcgcagcgcgatggtcaaccacatcaccaccgtggccacccactacctgggccggatctacgcctgggacgtggtgaacaccgccgtctacaccatggtcaagggcttcctggcgcgcggagtgccgatcgactgcgtcggcttcccgtcgcacatcaactcggcgtcgccgccggagccggcaccagcttcggcttccagggcaccgggtcggccccttcgggcacggccacctgcacggcggcctgataccggaaggtcgcgggggccgtcatga

SEQ ID NO: 5722 - DNA, 669 bp, Actinoplanes utahensis
atgcagactggtgtgcaggcggccgtcccggtgctgtacgtgcggagcatcgagtccgctcgccggttctacgcgctgttcggctacggcgagtcgagagcgggcggcgacggtgccgcgcgctggtcgtatctgcagtgtggtgagcacacgctgctgctggccggggtccagccgccgctcatccaggtcgagctgccgctgctgatctacctgtacgtcacggatctggccgcggtgcgtgaccggctggacgaggccggtcacgagtacgagatggccgggtatccggagcacgcgcccggcggcgagctgcgcacccgcgaccccgacggcaacgtggtgctcgtcggccagcgcacggcgatcgccgccgacgcccgggtcgagaccaccgggccgcaggcgcggttctcgctgatccggcaggcggccgaggcggtcagccggcgcggcggggcgccggcctcctgccagatcggggccgcggacggcagtgcatgcccgaagccggccgaggtcaagctggcggacacctggggtgcgacggtctggggctgcctgagtcacgtcgacgaggcgttgatcaacgcgcgcgggacgttcatcgccacggaggacggccaggggctcggaccctggctcagccaccgctcacgacgaccctga

SEQ ID NO: 5723 - DNA, 261 bp, Actinoplanes utahensis
atgtcgccaagttctgagctcgaggtggtcctgccggcggcgctgcacgcccgaccggccggcgaggtggtccgggcggcggcccgcttcccggccgccgtcgagatccggcacggggcccggtcggcgagcgcgcgcagcgccctgaaactgatgtcgctgggcgtgaccgcgggggcgacggtgaccgtgcacgccgagggggaggacgcggccgcggccgcggccgccgtcgcggaggcgctacgcctagccacctag

SEQ ID NO: 5724 - DNA, 384 bp, Actinoplanes utahensis
atggggctcgtgggaatcgtgctggtttcgcactccgagcagttggcgtcaggcctgcgcgacctgctgcgccaggtcgccggcgacgaggtccggatcgagccggccgccggcaccgacgacggcgacctgggcaccagccccgaccggctgagcgcggcgatcgcggccgccgacaccggagcgggcgtggtcatcctggccgacctgggtagcgcggtgctgaccgcccgggcggtcctcgccgacacgccgggcccgctgctggtcgacgcgccgttcgtggagggggcgatggcggcggcggtcaccgcgtcgaccggagccgggccggcggcggtggccgaggcggcacgggaggctcgcgatgtcgccaagttctga

SEQ ID NO: 5725 - DNA, 993 bp, Actinoplanes utahensis
gtgaagaaattcatcaacgatcctgccgatgtggtggccgaagccctcagggggctggccgccgcccacccggagttgcgggtggacaccggggagcagtacatcgcacgggccgacgcgccgcgggccggcaaggtgggcctggtctccggcggcggttccgggcacgagccgctgcacggcgggttcgtcggaccgggcatgttggacgcggcctgccccggtgaggtcttcacctcgccggtgcccgaccagatcctggcggccaccaaggccgtcgacggtggcgccggggtggtgcacgtggtgaagaactacaccggtgacgtgatgaatttccagctcgccgcggagctcgccaccgaagaggggatcagcgtcgagacggtgctggtcgacgacgacgtcgcggtcgaggattcgacatggacggcgggccgccggggcaccggcgcgacgctgctggtggagaagatcgccggcgcgcgcgccgaggagggcggcaagctcggcgaggtcgccgcgatcgggcgcgaggtcaacgctgcctccggctctttcgcgtacgcgttgaccgccggcaccacgcccgccgccggccgccccggcttcgacctgccggccgacgagatcgaggcgggtgtcggcatccacggcgagccgggccgccgccgggagaagctgcgcccggccaaggacctggtgcacgccgcgctggacgcgatcctggacgccaaacagtttcccggcccggtgatcgtgctggtcaacggcctcggcggcaccccgctgatcgagctgtacctgatctacggcgaggtcgccgcggtcctggagcagcgcggcgtgccgatcgcccgcaagctcgtcggcaactatgtgaccagcctcgacatggccggcatgtcgctcaccctgtgccaggccaccgacgagatgctccgcctctgggacgccccggtgcgcacccccggcctgcgctggggtgcctga

SEQ ID NO: 5726 - DNA, 621 bp, Actinoplanes utahensis
atggatgcgacgctcgcccgggactggatgcgcgccgcggccgccgcggtggcggccgagaccgaccggctgacccggctggattccgcgatcggcgacggcgatcacggcgtcaacctgaaccggggtttcgccgccgtggtggcggctctcgacgccggcgcggaggacaccccggcggccgtgctgaccagggccgggaccacgctgatggcgcgggtgggcggcgcctccggcccgctctacggcagcgcgctgcgggccgccggcaaggcgttgccggacaccgccgcggtcgaggccaccgacctggtcgccgccctgcacgccgggctggaggcggtccgcaggctcggcggtgccgcgcccggggacaagaccatgatcgacgcgtacgcgccggctctggcggtcttcgagcggtccgtcgccgggggagcggacctcgccggggcgtccgccgaggccgccgaggccgctgcggcgggagcggccgccaccgtgccgttgcgggcccgcaagggccgcgcctcctacctgggtgagcgcagcatcggccatcaggacccgggcgctacctcgaccagcctcatttttcaagcactggccgcggtttcttag

SEQ ID NO: 5727 - DNA, 1578 bp, Actinoplanes utahensis
atgggtgtgggcggggcgttcgacaaccgctccctgcggacgaagatcgtcgcggcggcgctgaccgccgcggtcggcggtctgatcgtgggcgggatgtcgatcatgacggtgcgcgggctgaaccagaaggcggccgacgcgcagcacaagtccatcgcgatcgagacggcggtcagcggtttcagcaggaatctcgaggcgttcgtcggcagcaattccgccatgcagctctacccgtcgcaggcggcgcagatcggtgccgtggccgcgcagtacaagcaggccgccaccgacgcgttgaccagtcttggcgccgagctgcccggcgacgccacggtgacccggacgcagcaggattgggacagcttcctgcagttcctcggttcgacagcggcctcggaccacccgctgagcaaggcggagatcgtggccggcctggcgcagtacggcaagctgcacgacgcgctgggcgccgacgggaacgcgctgcaggcccgggccgccgcggtcgccgagacgcagatcgccgacgcgcgttccgccgccaactccgccacctggaccattgccggggtgctcgccgccggggtggtgctcagcatgctgatcggcttccgggtggccgcccgggtgcgcgacgccgtccgcggtgtctcccggctcgccgagggcctggccgagggcgacctgacccgcacctccggggtgaccacccgggacgaggtggggcagatggccgccgcactcgactccggcatcgcccggctgcgcgaggacgtggtgcagctggccggcagcgccaccaccctgcagcacgccgccactcagctgacctcggtctccagcgcggtcgacgcggccgccaccgaggcgtcgtcgcaggccggcacggtctccgcggcggccgacaacgtctccaacaacctgcagttcgtctcgtccggcgcccaggagatgggctcggcgatccgcgacatcagcgtctccacctcggaggcgacccaggtggtggtgcaggcggtgcaggcggccgcggccaccaacgcgatcgtggcccggctcggcgagtcgtccgcggagatcgccaccgtggtcaaggtgatcaccagcatcgccgagcagaccaacctgctcgcgctgaacgcgaccatcgaggcagcccgcgccggtgagctcggcaagggcttcgcggtggtggccggcgaggtcaaggacctggcccaggagaccgcgaaggcgaccgaggacatctcccggcgggtgcagtcgatccagaccgacaccagcggcgcggtcagcgcgatcgaggagatcagcgagatcatcgagcggatcaacggcctgcagctgaccatcgcctcggccgtcgaggagcagaccgccaccacccaggagatgaaccgcaccctggccgaggcggccggcggcgccggcaacatcgcggccaccatcaccggggtgtcggaagcgacccggcgcaccaccgacacggtcggcgagacccgccgggcggccgacgagctgaccgccacggccggccagctgcagaccgtggtctcccgcttccgttactga

SEQ ID NO: 5728 - DNA, 660 bp, Actinoplanes utahensis
atgtatccgcccgagccctggcacctgcgcggacagatgtatctgtcggtcttcctgataccgctgcgggacgtgccgccgctgcccggggtgctgggcgcggcggcacgtccgttgtcgttcggcggccgggccgcgatcggcgcggcctgggtcgactatcaacccggcggcgtcctgcactaccgcgagttgctcagcgcggtgctgacccacgagcgcggccggccgcgggtcagcatcaccgacatctgggtggacagcgtcgcctcccgcgacggcggccgcaacctgtggggcatcccgaaggacctggccggcttcaccctggacgccgacgacgacctgatcgacgcgacggccacggcgccggatggcgccccgatcgccgcggccctgatccggttgaagagccggcttccgggccgcttcccgctggggttcaccgtcgcccaggcgctgggcgggcacgtcaagcgcaccccggtgcgcggccgatcaggcctgcgtacgtcgcaggccgcctggcgccccgacccggccggcccgctcgcctacctggccggccaccgcccgctgctgagcctggcgatcaccgacttctggctcaccttcggtcgcaccgccgccgaccgcgcggccaccgcccgcccccgctga

SEQ ID NO: 5729 - DNA, 636 bp, Actinoplanes utahensis
atgtttcgcaatctgaccgccggcgccgccgtgctcgcctctctcgtggtcggcacaccggcccaggcagcaccgcagccgacaccgggcgaaatgatgatcatcgacgtggtgaacgcgaacggctcgggctgcccggacaaatccgcgaagatcaccgtctcgccggacaacaccgcgttcaccgtcacctactcggattacaccgcgcaggtcggcccgcaagcctccccgctcgatttccggaagaattgccagctggccctcgacatcaaggtgccgtccggattcacgttcgcgatcgccagcgcggattaccgcggatacgcgtcactggcccggggggcgtgggcgcaggaggcggccaactactacttccagggccattcccagaccacccggatcgagcacaccttccggggcccggtcgacgacgactggcagcgcaccgaccaggtcggcatcgcgtcgctgagctacctgccgtgcggcgagcgccgctacctgaacatcaacaccgacctgcgggtcaaccgcggcacctcggacgcgcaccggtacaccagcttcatctcgatggactcgaccgacgccgcgatcaacacggtgtaccgggtggcctggaagaagtgctga

SEQ ID NO: 5730 - DNA, 2280 bp, Actinoplanes utahensis
atgcgccatgatcgccacgctagggcggaagtccgcggaaacaaagggtcggtcttggcggaacccggcgttccgtgcacgatggtcgccatgcccgccgcgcaacagacctcccggccggcgccgcacgtgctggaagcggtgctggagcggctgacctatgtgaacgaggagaccggctacacggtggcccgggtggccaccgcgaagagcggatcggacctgctcaccgtggtgggcgcactgctcggcgcgcagcccggggagagtctgcggctgtccggctggtggagttcgcacccgcagtacgggcggcagttcgaggtggtctcgtacaccaccgtgctgccggcgaccatccagggcatccgccgctacttgggatcggggctggtcaaggggatcggtccggtcttcgccgagcggatcgtggagcacttcgggctggacacgctggagatcatcgagacgtcaccggaccggctgatcgaggtgaccgggctgggtccgaaacggaccgcgaagatcaccgcggcgtgggccgagcagaaggcgatcaaggaggtgatggtcttcctccagggggtgggggtgtccacctcgatcgcggtgcggatctacaagaagtacggcgactcgtcgatctcggtggtgcgcaacagcccgtaccgactcgcctcggacgtctggggtatcggcttcaagacggcggacacgatcgcgcaggcggtcgggattccgcacgacagtccggagcgggtgaaggccggcctgcagtacacgctgtcccaggcgaccgacaacggtcactgtttcctgccggtcgaccagctgaccgacgaggcgtccaggattctcgaagtcccggccggactcatcccgcgatgtctcgatgagctggtcgaggaggagggcgtggtccgcgaggacgaccacgtctacctggtcccgttccaccgtgccgagatctccctcgccgccaccctggtccggctgctgcacgacaggtcggacaggatgccgcacttcggtgacgtcgactgggccaaggcactcgactggctgcaccggcgcaccgggaacaccctcgcgcccgagcaggaggccgcggtcaagctggcgctcacccacaaggtcgcggtcctcaccggcggcccgggctgcggcaagagcttcaccgtccgctccatcgtcgaactcgccgccgccaaacgcgccaggatccagctggtcgcacccaccggccgggccgccaaacggctcgccgagctgaccgggcatcccgcggccaccgtgcaccggctgctcaagctgcagcccggcggcgacgccagcttcgaccgggacaatccgctcgacgccgacctgctggtcgtcgacgagtcctcgatgctcgacctgatcctggcgaacaagctggtcaaggcgatcccgccgggcgctcacctgctgctggtcggggacgtcgaccagctcccgtcggtgggcgccggcgaggtgctgcgggacctgctcgcggcggaggtgatcccccgcgtacggctgacgcagatcttccggcaggccgcggagagcggcgtcgtcacgaacgcccaccgggtcaaccgcggacgcccgccgctgctcgacgggatgagcgacttcttcctgttcccgtgcgacgacaccgaggagaccgcgggcctcacggtggacgtcgcgtgccagcggatcccccgccggttcggcctcgacccgcgccgcgacgtgcagatcctcaccccgatgcaccgcgggccggccggtgccggcgcgctcaacacgctgctgcagcagcagctcaccccggcccgcgaggacctgccggagcggcgggccggcgggcgggtcttccgggtcggcgacaaggtcacccagatccgcaacaactacgacaagggggtggcgggggtcttcaacggcacggtcggcgtcatcaccgggttgtcgcccgaggagcagaccctgacggtacggacggacgaggacgaactgatcgagtacgacttcgacgaactggacgagctggcccacgcctatgcgatcaccatccaccggtcgcagggttcggagtatccggcggtggtgatcccgctgaccaccagcgcgtggatgatgctgcagcgcaacctgctctacaccgcgatcacccgggcgaagcggctggtggtgctggtcggctcgcgcaaggcgctggccgcggcggtgcgcacggtcggcgccggccgccggcacaccgcgctcgccgaacgcctcggctag

SEQ ID NO: 5731 - DNA, 246 bp, Actinoplanes utahensis
atggatgttcctccggttccgggattcgcgaagtcacccggtcggtcgccggcgccccggcttgaggaatcgacccgtcccgcacccgccccgccaccaccccaccaccccaccaccccggccgacaccgccgatccgcagccgtccccgccggcgtcgtcctgcccgggcgcggccgggctgccgctactgggcggccgctacgggacggccggggcggggcggccggggcggctagctagctag

SEQ ID NO: 5732 - DNA, 648 bp, Actinoplanes utahensis
atgcagccgaccccccgtcgtgccctgcgactcaccgccgtgctcgcctcggcctgcgcgctgaccgggtgtgcggccttcgcctcgaccacggcgaccgtgtcgccgaccgtgtcgcccggtccgaccagcacgttcctgcagaccccgacggtgccgaccagctccgcgcccggcctgtcgaacaccggcaccaacctgccggtggtggtggcctccctggtcaaatacggtcagtggctgatcgcgaacccggacccgtcgctggtcgaccggatcgccgtgccgggctgcgcggccgccaacgacctcatccacgagacccagtcgctggtcgaccagggcgcctacgtgaccacggcgctgccggtggtgaccggcatgcagtatccgtcgccggccgcgtccgccggcgccgcgtcactcggcgatcagaccatgctggacatgcaggtgagccgcccggccgaggccctgacccagcggacgaccgccaagaagacgcagatcatctcctacctgccggagctcaggtccaccacggtccgcgtctcgctgatccggggcgccgacaagaagtggcgcttctgcgaggtcaccacccccctcgacggcagccgcgccgactccatcaccgtcctgctgtag

SEQ ID NO: 5733 - DNA, 270 bp, Actinoplanes utahensis
atgcttctcggcctcgtcagcctgctcctgctgatcgtgcaggtcctgctgatcgcccgcgcggtgctggactggagtgtcgtcctggccggcccggccatgcccggctccctgcgatcccgcgcctacggcgccgtgttcgcggccaccgagccgatcctcgccccgatccgccgcctgatcccgccgctgcgcgccggcggcatgtcgatcgacctgtccttcctcatcgtcttcttcgtcatcagcctgctgcgcaacttcctctga

SEQ ID NO: 5734 - DNA, 819 bp, Actinoplanes utahensis
atgacccggcttcacccacccgctggtccgggtcgtctcgttcaccgggtcgacgcgggccggccgccgggtcggcgcgctcgccggcgagcatctcaaacgcgcccacctggagctgggcggcaactcggcgatgatcgtgctggacgacgcggacgtcgaccgggcggtcgcggcggcgtccttcgggtcgtacttccaccagggccagatctgcatgacgaccgggcggcacctggtgcacgagcggctctacgacgacttcgtggaccggctcgccgccaaggccgcggcgctgccggtcggcgacccggcccggcagccggtggtgctcggcccgatcatcgacaccgggcagcgcgacaggatccacggcctggtgaccggctcggcggccggcgggcgcgggtcgcggccggcgggacgtacgagcggctgttctatgcggcgaccgtgctggcggacgtcacgccggacacccctgccttcaccgaggagatcttcggcccggtcgcgccggtgctgcggttccgcgacgccgaggaggcggtccggctggccaccgccaccgagtacggactctcgctgggcatcgtcacccgggacgtgatgcgcggcctggccctcgccgaccggatcccgaccggcatcgtgcacatcaacgaccagaccgtcagcgacgaggcgaacagcccgttcggcggggtcgcggcctccggcaccggctcccgcttcggcggcgcggcggccaacatcgaggcgttcaccgagacccgccgggtgacggttcgcgacgaaccaccggcctatcccttctga

SEQ ID NO: 5735 - DNA, 981 bp, Actinoplanes utahensis
gtgacccacgagatccagatcaccgcaccggtcgacctgtgcctcccggacgggcgtctcaacccggcggccgtcggctggagccgcaagccgctgcaccgcgccaacctgcgcggctggggccgcaacaagcgctgggagcactggggcgtggtcaccccggcgcacatcctcggggtggtcgcctcgtcgttggactacgccggcgtgcacagcctctacctgctggaccgggtcagcgggcgggagatcgcggtggacgcgacggtgccgctggcccggggcgcggtcctgccggaccgcagcggatcggggcgggtgacggcttccggcggcggcctcagcatcgagatcgcgcaggatttcgacggtacgtcggtgcgggcccgagcccgtgacctggaggtcgacctgaccatgccggccgtcgaggaccgggacgcgctcggtgtcgtggtcgcctggagccgcacccgtttccagtacacggtgaaggacgtcggccgcccggtgcacggccgcctggtggtcaagggggtggagcacatcgtcccggcgcaggggtcccatgccaccctcgatcacggccggggccgctggccgtactcggtgacctggaactgggcggccggcgcggacgcggaccgggccgtctcgctgggcggcaagtggaccgacggcaccggcaccaccgagaacgcggtcttcgaggagggccggctgcacaagatcggcgcggatctgcgctgggagtacgaccgcaccgactggctgaagccgtggcggatcaccggggacggcgtcgacgccaccttcgaaccgttccacgagcgggtcgccaagaccaacctgggtgtgctggccggcgagacccaccagtgtttcggccggttctccggctgggcgcgggcctccgacggccgcaagatcgaccttgacggcctgaccggctgggcggaggaggcccgcaaccgctggtga

SEQ ID NO: 5736 - DNA, 597 bp, Actinoplanes utahensis
atgaacgatttcgcggagatccccccgacgacgctcgccgacgtgctcggccgcggccaggtgatggacatcggtgtgcgcccgctgtggacgccggtgccccgggtggccggaccggcgttcaccgtgcgctgcgagcccggtgacaacctgatgctgcacgccgcgatctaccgggccgagcccggctcggtgatcgtggtcgagtccggcgacctggactacgcgctggccggcggcaacgtgtgcgcggtcgcgcaccggcgcggggtggccgcgttcgtgctggacgggctgatccgcgacctgggcgaggtgcgggagatcggcttcccggtgttcgcgcgcggggtgatcccgatccccggcacgaaggagaaggtcggcacgcacggggagacggtccgctgcggcggggtgagcgtgcgggccggggacatcgtggtggccgacgaggaggggatcgtcgtggtcccggccgaccggcaggccgcggtgctgaccgactcccgggcccggctggccaaggaggccgccgagacgctcgacgactgggagcgggcacaccgcgccaagatcgagaaggcgctcggctag

SEQ ID NO: 5737 - DNA, 591 bp, Actinoplanes utahensis
gtgctcctaccccttccgcccggtgacttccaggcctacctgttcgactgcgacggcaccatcaccgactccatgccggtgcacttccaggcctggcaggacgcgctggccgagtacgagtgcgagttcccgcaggacctgttctacgcgtggggtggccggccgtgcgccgacatcgtcgccgacctgaacgcgcggcagggcctgagcatgccggtcgccgcggtcgccgagcggcaggagtcgctgttccgggccgggctgcccagcatgcgcgcggttcccggcgttctcgcgcacatcgaggagtcgtacggccgactgccgttcggggtggtctccggcagcacccggccagcggtgatcgactcgctgctggcgctcggcctgctcgaccgcttcccggtgctggtctgcgccggcgactacacccatccgaagccgcaccccgagccgtacctgctgggcgcgcggcggctcggcgtggatccggcccgctgtctcgccttcgaggacaccgaactgggggtacgtgcggcgcaggcggccgggatggctgtcgtccgcgtccccccgccgtgggaacgttag

SEQ ID NO: 5738 - DNA, 456 bp, Actinoplanes utahensis
gtgcagatcgcttcggagaccggcgggtggctgcggatgcgaccggtccgctacgagttcgagtccgagcccgacggtccgcgggaggactggctgaccgtcgaggtggcggcggccggccgggacgggcacacctggcagaccgaggtgccgtgcctgctcgtggccgaggcgatcgagctggccggctggctgcacgacgaggccgggaccggcgagctggagttcatcgagccgaacgtggcgttccgccggcggcacggtgggccgggggtggagctgctggaggtgaccttcgcgcaggagacgctgccaccctggctgcccggcagcgggcggggccgggtgcaccggatccggatggaggtcaccagcgaccatctggtccaggcggccggggactgggccgcggagatcgccgcgttcccgccacgggcggatctggcagattggtga

SEQ ID NO: 5739 - DNA, 624 bp, Actinoplanes utahensis
atggatttccgtcgcacgttccgttccgccgcgatcgcctacgccgggctggtcgccgacctcccggccggaagactggacgagcccggtctcggcgactggacgctgcgcgagttgctcggccacacggtgagctcggcgctgcgtcaggtgccgaaggtgctggccgccccggcgccgcaggtcgaggtggccaccgcggagggctatttcgcgtacgcccgctccgcccccgaggagctcgtcgccgccgcccatgccgcctcggccgaggacgcgaaggcctcgggggagctgctcggcgacgatccggccgggcacgtgtcgacgctgatcggccgggccaccgaggcgctgtcccaggtccgcgacgacgacgtgatcaccagcgcggccggcggcatgcgggtccgcgactggatcccgacccgcaccttcgagctggtggtgcacgggctggacgcggcggcggccaccggcgtggagttcgacctgccggtcgaggtgctcgccgagtcgctgatcctggccacccgcaccggcctgggcatcggcgccggtgtcccgctgctgcgcgcgctgaccgggcgggagcagctcccgcccggcttcactatcgtctag

SEQ ID NO: 5740 - DNA, 3345 bp, Actinoplanes utahensis
atgtctgagatcgccgaagagacgatcgccctcgtgcgccgatggctgggcgaagccgcgaccgtcccggtcggcggctcggcggcacagttggccggcctgctgcgcgacccgaaagggctcgcgttcgcggtcggcttcgtcgacggcgtggtccgtcccgaggaccgccgggtcagcgcccgcgccctgaacgcgctggccggtgacgtcccggcgttcctgcccgcccacctcaaggccgcggtcaagctgggcggcgcgctcgccccgatcatgcccggcgtggtggtgccgctggcccggcgggcgctgcggcagatggtcggtcacctgatcgtcgacgccaccgacaggcggctcggtcgcgccatccgcaaaatccgcaagcgcggcgtacgcctcaacgtcaacctgctcggcgaggcggtcctcggccggggggaggcctcgcgccggctctccgagaccgagcggctgctggcccgccccgacgtcgactacgtgtcgatcaaggtgtcgtcgaccgtggcgccgcacaacccgtgggcgttcgacgaggccgtcgacgacatcaccgagaagctgctccccctattcaccctggccgcgcggaccggcaagttcgtgaacctggacatggaggagtacaaggacctcgacctgaccgtcgcggtcttcacccggctgctggaccggcccgacctgctgggcctgtcggccggcatcgtgctgcaggcctacctgccggacgcgctgagcgcgatgatgcggttgcaggtctggtccgcggcacggcgcgagcgcggcggcgccgacatcaaggtgcgcctggtcaagggcgcgaacctgccgatggagcgggtcgaggcggcggtgcacggctggccggtggcgacctgcgacagcaagcaggccaccgacaccaactacaagcgggtgctgcggtacgcgttgcatcccgaccggatccgcaacgtgcgcgtcggggtcgccgggcacaacctgttcgacgtcgcctacgcgtggaccctggccgggcagcgcggggtgcgcgacggcatcgagttcgagatgctgctcgggatggccgagggccaggccgaagcggtccggcgggacgtcggcgggctgctgctgtacacgccggtggtccggccggagcagttcgacgtggcgatcgcctacctgatccgccgcctcgaggagggcgccagctcggacaacttcatgtccgcggtgttcgagctgcaccacgacagtgcgctgttcgagcgggagaagcagcgcttcctcgcgtccctcgcggacctggacgacaccgtgccggcggcgcaccgggtcgccgaccggtacgcggcggtgccgcattcggcgccggggcacttcgagaacaccccggacaccgacccggcggtggcctcgaaccgcacccggatgcgatcgttgctggcccgggtgccgtcgtcccggctgggtctcgacctgcgccggatcgactcggccgccgagttggacaccaccctggagaaggccgccgccgcgaattggggcggcgccgaccgccgcgcggtcctgcaccgggtcggcgacgccctggaggcgcaccgcgacctgctgctcgaggtgatggcggccgaggccggcaagaccatcgaccaggccgacccggaggtctccgaggcggtcgacttcgcccactactacgccgagctgtcggcccggcagatcgacggcgccaccccggtcccggcccggctgaccctggtcacgccgccgtggaacttcccggtcgcgatcccggccggctcgatgctggccgccctggccgccggctccgcggtggtgctcaagccggccggacccgccgaacgctgcggtgccgtgctggccggcatcgtccgcgacgccctggccgcggccggcgccgacccggacctggtcaccctgctgcaggtcgacgaggccgggctgggccgcgagctggtcgcccacccgctggtcgaccgcgtcatcctgaccggcgcgtacgagaccgccgagctgttccgctcgttccgcgccgacctgccgctgctggccgagacctccggcaagaacgcgatcatcgtgaccccgagcgccgacctggacctcgccgtcaaggacgtggtctcgtccgcgttcgggcacgccgggcagaagtgctcggccgcctcgctggtcgtgctggtcggctcggtcgccaggtccgcccggttccgcacccagctgctcgacgcggtctcctcgctggaggtcggcccgcccaccgagccgcgcacccaggtcggcccgctggtcgagccggccgccggcaagctgctcgacgggctgaccacgctcggcgccggcgagagctggctgctggcgccgcgcaagctggacgagagcggacagctgtggagcccggggatccgggacggggtccgccgcggctcggcgtaccaccgcaccgagtacttcgggccgatcctcgggatcatgacggcggacaccctggacgaggcgatcgacctggtcaacgaggtcgactacgggctcacctccggcctgcactcgctcgacgcgggcgaggtgcgcacctggctggaccgggtccaggccggtaacctctacgtcaaccggggaatcaccggcgcgatcgtgcggcggcagccgttcggcggctggaagaagtccgcggtcggcgccggcaccaaggccggcgggccccactacctcaccgggttgagcggttgggcgccggctccggcgacggcctcgaccgacatcgacaatgcggcggtacgcacgttgctcaccgccgccgcggcgcacctcaccgccgacgaggtggcgtcggtgacccgtgccgcgcgcagcgacgcggcggcctgggcggcgtcgttcggccgcgccgaggacgtgtcggcgctgggcgtggagcgcaacgtgctgcgctacctgcccaccccggtgaccgtccgcctcgcggccggtgccccgctcgccggcctggtccgcgtcgtcgcggcggcgaagctcgccggggcgccgatccaggtgtcgacagccgaggcgacgcggctgttcccggaggccacggtcgagccggacgccgcgttcgcggccgggctggccggggtctcgcgggtacgcctgatcggcggctcggccggtgacctggcgaccgccaccggcggacgtcccgacctggccgtgtgggccgggccggtggtcgaggccggcgaggtggaactgctgccgttcctgcgtgagcaggcggtcagcatcaccgcgcaccgcttcggcaacccgctgccgatggccgccgaggtgctctag

SEQ ID NO: 5741 - DNA, 957 bp, Actinoplanes utahensis
atgcggatgctggagatccgccgcctgatcctgttgcgtgagctggccatccggggcaccctggccgccgtcgccgaggcgctcaacttcaccccgtccgcggtcagccagcagctcagccagctggaacgggagaccggcacggtgctgctgcgcaaggccggccgccgggtccggctcaccccgcaggccgaggtgctggtcgcgtcggtcgacgaggtgctggacaccctggagcgggccgaggcccggctgcaggcggcggccacccgggtcaccggggcggtccgggtggcggtcttccagtccgcggcgctcgccttcatgccggccgccctgcgcctcgcggcggcccggtttcccgacgtacgcgtcgagatggtccagcgggagcccgaggaggccctgcgcgagacttgggcgcgggacttcgacatggtcatcgctgagcaataccccgcacacgcggccccgcaccatccgggcctggatcgccgcgatctgaccaccgacgcgatccgcctcgcgctgccggccgaggccgagtcgctgcacccggtcgactcgctggacaccgcccggcacatgccgtgggtgatggagccgcgcggggccgcctcccggcacttcgccgagcagctgtgccggcgggccggtttcgagccggacgtccgctacgagacggccgacctgcaggcgcacatccgcctggtggagaccggcaacgcggtcgccctgatcccggacctggtctgggccgggcggacgccgtcgtgccggctgctggcgccggccgggagcccgcgccggaccatcttcaccgcgcagcggttgtccggggccgagtccccggccgcccgtgccttccgcgggctgctggaggaggtcgtcctcacctccgcgacgggtccggcgccggggccgggacgctctgcgccgggcacaccgcagcgatga

SEQ ID NO: 5742 - DNA, 1464 bp, Actinoplanes utahensis
atgaccatgcgccagaagtgcctcgccgtcgccgccgccgcactggccctggtcaccgcgctgagcgcgccggcctccgccgcaccggccacctgcgcggcgccgacgcccagcaccacccaccccggctacctcgtcttcgacccggcctgcgacgtctccggggcgccgttcaccccgctcaccgacgcgtccggaaaggcgatctcgaagatctacaccgggatccgggacggcgcggcgtaccgggtcgaggtgccgctgcggtggaacggcaagctggtcgtctacgcgcacggctaccgcggcaccggcaccgtggtctacgtcgacaaccccgcgctgcgcgcgcactacctgcagaccgggtacgcgtgggccgcctccagctacgccaccaacgggtacgacgtgggccagggcgtccgcgactcgtacgcgatgatcgacaccttccgcgcggccaccggccaccgcgcccgctcggtgatcatgagcggcgcgtcgatgggcggccaggtgaccgcggtggcgatcgaacggttcccgcacgccttcgcggcggccatgccgtactgcggcgtgctcggcgacaccaggctctacgactacttcctggacgcgaacgtgaccgcggcggcgctggccagagtgaagatcgacttcccgctcaccccggccgccgactacccggcgcagtggcatgcccaggtcggccggatcaccgcggcgctcggcgtcaaggtgggcagcgctccggcgctcacgccggccgggaagatctggtccgacgtggtggagcggcgcaccggcggcgagcggcccggcttcgactcggccttcgcctactggaacgcggcgccatcgctggctccgctgagtgacctgccgttcctgttcggcctctacccgggcctgaccggtggcaccggcgggatcgcgcccggcaacgtcaccgacaaccagttcaccttctaccgggccgacgactacccctggccgagcttcgccgagctgcggctcaacgccgacgtgctgcgggtgcggcacaccgcgaccggcgacccggggctgtccggcatcccgcgggtggagggccggccgaccatcccggtgctgtccctgcacgacgtcggcgacctgttcgtcccgttcgcgatggagcaggactacgcgctgcgggccgcccgcaacggccgggccgggctgttcgtctctcgggccatccgcggcgtcgggcactgcgacttcaccgaggccgagctggcgcagggcttcgacgacctgacccgctgggtgcgcaccgggcagcggccggccggcgacgcgatcctggaccgccggcaggtggccgccgactcgttcggctgccggttcaccaacggcgcgcaccccaccttcatcgctgcggtgtgcccggcgcagagcgtcccggccccggcgccggacccgtcgcggaggtga

SEQ ID NO: 5743 - DNA, 1824 bp, Actinoplanes utahensis
atgcccatgatctcccgccggacaatcttcaaggcgtccgccgccggtctgctcgcgacccagctccgcgccctgccggccgaggccgccaccggcaccggcttcgtcgacggctaccggacgaacgtcatcgcgaacctgaccaccgacaccaacgccgcggtccgcatcctgtccggcttccagaaggtctgggccaccggcgccgcctggaacaccggcaccgtgctggacgaggcgttcctgcgcgccagcatgcgctacgtcaccagggtcaccgcggagcgcaccgacgcggaggcggccaaggcgttcctcgtcgaccggcagcaccagagctactcggtgatcgccggcctcggcccgctcgccgatctgtaccgggccggcgcgctcgcggtcaccagcatcacctcggcgccggccaccaccccggctggcacgatcagcgactcggtcccggccggctccccggccggcgcggccaccggcgccggttccaccagctcggcgctcggcaaggtcgccaccctggtcaacacgctgcgcggcaactactcctcgggcaacccgtcgaagtacgcctaccagtacccgcgcccgtggcggctgaccgagcagagccgggtcgccgacaccggcgcggtggacgagttcggctacccggtctacgactcgccggtcaaggtggcgccggcgctgctgcgccagcggagcaccagcccggccgacgacgccggctacgtcagcgggcacaccaacgcgctgttcctggccgcgctggcctacgcgtacgcggtgccggagcgcttccaggagctggtcaccacggcgtacgacctggccgacacccggatcgtggccggcatgcactcaccggtcgacgtgatcggcggccggatcctggccaccgcgctggccgccgcgatcctgcgcgacccggcgaacgcgacgatcaaggcggaggcgcgggcccaggcgctcgcctacttccaggagaagaccggcacccgggatctcttcgggtacgcccatgaccccgccgaccgtaaggcgaacgcggcgatcgtgcggcacaagcacacgtacgacctgccggcgcacggcaagcgggtcccggtgaccgtcccggacggcgccgaggtgctgctggagacccggctgccctacctggacgccgcgcagcgccgcgaggtgctccggaccaccggcctgacttcgggccacccgatcctggacggcccggagcagtggggccggctgaacctgttcgccgccgccgacggttacggcgcgttcgaccagaccgtggcggtcaccctggacgccgcgctcggcgggttccacgcggccgacgcctggcgcaacgacatcgccggccggggcggcctggtcaagctgggcagcggcacgctgaccctgtccggcgacaacgactaccgcggcggcaccacggtcgcgcagggcaccctggtcgcggccgcccccaccgcgctgggccgcggcgacgtgaccgtgtccggcggcgtcctggtcgccggacaggtcacggtgcacgggtcgtaccggcagagcggtggtgtcctcgcggtcgtcgccgacccggagggcaagccggcgctgaccgtgtccggcgacgccacggtgggcggcacgctgcggatcgcggtgccgccggcgttgcgccacgatgccccgatcccggtcctgacggccggttgcctgcgcggccggttcgcgtccgtggtcgtcgacacccccgccttccgcgccgacctggtcacccacggtgacaccatcgcggtgcggctgcgcgcggcctga

SEQ ID NO: 5744 - DNA, 1278 bp, Actinoplanes utahensis
gtgtacaagacagccttgctggccgccttgcttgcggtccccgccgtgatccccgcacccgcagctgccgctggagccaccggtggcactctcaagattctttcctacaacatcgccgggctccccgacatcctgtccagcgccgacaccgaccgggccacctcgactaccgcgatcgggtcgcggatcgccggatacgacctggtcaacgtgcaggaggacttcaacttccacgcttacctgtacgccgcggacacccacgcctaccgcaccccgaccagtggcggggcgggcatcggctccggcctgaacaccctctcgaagtacgcctacgacaccgacgacttcgagcgggaccgctggacctcgtgccagtacgactccggtgactgcctgacccccaagggcttcaccttccagcgggtccggctggccgagggcgtctacgtcgacgtgtacaacctgcacgccaacgccggcaccaacgccggcgacctggcctcgcgcgccgccaacctgagccagctgaccaccttcatcggcagccactccccgggcaacgcggtgctggtgttcggcgacaccaacacccgctacacgcgggacggcgacaccatcgccgacttcgtggcgaacaacggcctcaccgacgcctgggtcacgctggagcgcggcggggtggccccggccaagggcgcggacccgatcctctgctccgacgactcctgcgaggtggtcgacaaggtcctctaccgcggcagcaggttcatcacgctgaacgccaccgcgtaccacaacgagcacgccgcgttcctcgacgccggcgggctgatgctctccgaccacgacccggtcagcgtgaacctgaactggtccaccaatcccgcgtaccagttcagcgaacagttcggcggcccacacggcgactacttcgacgacgtcgacacggccggcccgctgtcctcgatcagcctgcgcgccggatcccgggtggaccggatcggcccgcacggcgggaccggcggcaccctgaagacgctgaccctgggcgacggcgagtacgtgaccagcgcccaattgtgccgtggcgtgtacaactcacacaccaggatcttctccgcgaagttcaccaccaaccggggcaacaccctggccggcggcaccaccaccgcggactgtgtcacccggaccgcgcccaccggctggcagatcgccggcttccacggccgggccggggacgaagtggacaagctcggcctcatttacaccaggcactga

SEQ ID NO: 5745 - DNA, 909 bp, Actinoplanes utahensis
atgtaccaagcggcggcaccaccccggcggcgcacctggctgcgggtcttcctcaccgggctgctgctctggctgctcaccgtggtggtcaccctggtcaccggcaacccgaacctgatccccacgctggtgctgctgggcagcttcctggtgccggtcaccttcgtgctctgggcgttcagccgccggcacagcggcgaggtcaccgccgagctgctgttcagcacgttcatcaccggcggggtgctcggggtgctcgcggcgtcgctgctggagacgtacctgctgcacccgtccccgggcttcttcctcggcgtcggcctgatcgaggaggcggcgaaactcggcgcgctggcgtttctgacccgccggctccgccacaagtacgccgccgacggcgtggtgctgggcgcctcggtcggcttcgggttcgccgcgttcgagtcggccggctacgccttcaccgcgctgttcaccgagcgcggcctgtcgctgatgcagctggtccagaccgagttgctgcgcgggctgctggccccgctcgggcacgggctgtggaccgcgatcctgggcggggtgctcttctcggccagcgggcggcggcacttcgcgatgacccggcggctgctgtcgtcgtttttcggggtggccgtgctgcacgcgctgtgggacagcatgcacagcatcgcgctgctggtcacgctggtgctgaccggcacgccgtaccagtattcgctgctgcagcggggctacgagccgcagccgaccgccgcccagacgcacctgttcaccctgctgtcctggggcgggctgatcctgatctcgctgatcgccctgctctggctgcgcgccgtcgcccgccgagccgatcaggacggtcgatcgctgtggcgcattccggtgggatag

SEQ ID NO: 5746 - DNA, 429 bp, Actinoplanes utahensis
atggatgatcccgggatcgcctacggatacggccggcaccgcggcctgctggtggaccgcagcggagtcgaggagatcgtcttcggccgggtcctgctctacctggagaaagctgacaccgacctgatcaacgccttggccgcgcggctgtccggggtgatcatcgaggagccggtcacgccgtacgcgccggaggcccgcgcgctgtgggcgctgcccgtcccggtgctcaccggagtccgggtcgacgacagctggctgggtcacgaggtggtcgtcgacttcgacgcggccaccaccgcgccgcccgccccggccaccgccggcctacgcctgcacgccgaggtgtccagcccggccgaggcccgcgacgccgggcacctcgccgacggctgggcgccgctgcgcgccgacgatctagctagctag

SEQ ID NO: 5747 - DNA, 561 bp, Actinoplanes utahensis
gtgcgctacttcgacgagccggccggcagcccaccggccgcctccttcggccggcgcggcgtccgctccccgctcccggaagatcttgatttcctgggtacggtgatagcggcgtcccccctcgacgatccgctggtggtcctcccgatggtcgccgtgcgcgccgagatctccgccttcgcggccctcgccgacccggcctggcgactcggcctggacgtggccaccccggccgccgccctggccgtcgccgacctggtcgacgactgccacctgctccggatcagcagcggcgacctggcccagcacaccctggtctgggaccgcagcacccgcaacgacaccctgctcccgcccgaccggctgcccaccgtgatcacccagctggtcgagtggtcggcgtcggtcgcggcgacccgctcgatcccctgccaggtctcgatcgacctgcggcccaccccgcagctgcacgaccagctgcgggccgccggggtcaccgagatctcctgcccgccgccgctgatccggcactggcgtcacctgctcgaccgctcggtctga

SEQ ID NO: 5748 - DNA, 705 bp, Actinoplanes utahensis
atgacgcaggaaccgatggaccccacggtcgccttccgcgagctgagccggatcaaactcggtgacaccgatctggagggcgtcctggccacggtcgcggatctggcgaagaggagcattcccggcgcgtacgaggtgtcggtgaccctgattcgcgaccggggcccgcacaccgcggcgagcaccggcccggccgccgaccacatcgacaagtggcagtacgaaatgggttccggcccgtgcctggacgcctgccggcagagcctcaccctgctggtcggcgacgtgcgcacggagcgccgctggcccggctgggaggagcgggccgccgacgccggggtgaactgtgcgctcagtgtcggcctgccgatccgggaacgggtggccggggcgctcaacatctacgccgagacgccggaggcgttcgacgacgatgcggtggtgctggccgagacgttcgccgggtacgccgcggtggcgctggccaacgcccacctgtacgacaccacggtgaccctggccgggcacctgcaggcggcgatggcgggccgggcggtgatcgagcaggccaagggcatcatcatgggccagcggcactgcaccgccgacgaggccttcacgatcctgtcccgggcctcccaggagtcgaaccgcaagctgcgcgacgtcgccgccgagctggtcgaccgggcccagcggcgctga

SEQ ID NO: 5749 - DNA, 363 bp, Actinoplanes utahensis
gtgcccgtgccatcgcctgccgacggtgagggatgccgcgtgcccgtcgaacccccgctgaccgtgttcttccgtcacctcaccgccgactccgccctgctgctcgtgcagggtgaggtcgacgcgggcaccgccggtgtgctgaccacggcgctgaaccacgccgtcggcgcctacccgctggtgacctgcgacctgagcggggtcaccttcttcggcgccgagggggcgcacgcgatcgcgctggcccgcgcccgcggtcacgcgcaggggcacgtcctggagctggcgggcgccccggcgatcgcccgggacgtcctgctgatcgccggactcggcaccatgctgcgaatctccgggtga

SEQ ID NO: 5750 - DNA, 711 bp, Actinoplanes utahensis
ttgatggcgcacgaccggcccgaatcagccgcggccttcacggaactcggccgcatcaagctcggtgagaccgatctcaacggcgtcctcgaccgggtcgccgacctggcccggcggaccctgcccggcgccgggcaggtgtccatcacgttggtccgcaacagggccgcatacaccgcggcgcagaccggcgagagcgcgctgcggctcgacgagcggcagtacgcccaggaccgcgggccgagcctggaagcggccgccggcaagaccaccgtgcacgtcccggacaccgccaccgagccgcgctgggacggctggggcgagcacgccgccgcggccggcatcggcagcgtgctggcggtcgggctgccgatcgtggagaacgtcagcggggcgctcaccatctacggcgcggcggccggcgccttcgacgaggcggcgatcacgctggcccagacgttcgtccggtacgccgcggtcgccctggccaacgcccacctgtacgacaccacggcgacgctggcccagcacatgcaggcggcgatggcgggccgggcggtgatcgagcaggccaagggcatcatcatgggggagcggcggtgcaccgccgacgaggcgttcgccatcctcacccgggtgtcccaggattccaaccgcaaactgcgcgacgtcgccgccgccctggtcgagcgcacccagcagcggggctag

SEQ ID NO: 5751 - DNA, 525 bp, Actinoplanes utahensis
atggtcgtccctttctgcgcggccgtggcgcggcctgcgatccggggagtcagatcccaccgtacgcgtcctcaggtgccgtggcgggcggccgatctggaggaggacgagtgcccaggaggttccggcccgatgtccgtttcccggttgaaccgtgccctgcagacgccatcggtgacaccggtccggccgtccgcccgggaacgtcaccagaacgcgcgcgacgacgccgcttcgctcaccgaccgggaccgggaactgatctaccaggccaccggtcagcggatcggggacggcccgaagaacgccggctggatcaactcgctggcggcggcgatcgcggcggaccgggcggccggccggctggcgcccggtcaggaggtgaccgcggcctacctcaaagatctttcgcggcggtacgaccagggcgggaccggccgtaacccggtggccggatatctcgagccggccctgcgccacctgtcccggcgcgacgacggcaaccgcctggacgtgaccgcctag

SEQ ID NO: 5752 - DNA, 405 bp, Actinoplanes utahensis
atgaccacctggaccaccacggaacggatcgacctcggcccggtgcggctggaggccgacctgaccctcaccgaacacgccaccggcgtggtgctcttcgcgcacggcagcggcagttcccggcacagcccgcgcaaccgtgcggtggcccgggagctgcaccgccgcggcttcgccaccctgctggccgacctgctcaccacgcgggaggacacccggccgcaacggttcgacatcggactgctcgccgaccggctggtcgggctggtcgactggctgcgcgcccagccggccaccgcgccgctgccgctcgggcttttcggcgccagcaccggcgcggccgccgccctggtcgcggccgcggcccggcccgaggcggtccgctcgatcgtcctagctagctag

SEQ ID NO: 5753 - DNA, 501 bp, Actinoplanes utahensis
ttggacatcgtggtggtccgcaagctgggtgcgccgggccgcccggaattcggcctgggggccgtcgccgaggacggcccaccggtgttcgacccggacaacctgcggtatgccgggctcaccgaggaggcgatggacggcaccctggcggtcgagcgcgaggaactggcccgtcgggtgcgccggtaccggggtgagcgcccggccccgcgggtcaccggccgggtcgtggtgctggtcgacgacggcctggccaccggggtgaccgcgcgggccgcgctgcgctgggtccgcggacgggcgccggtgcggctgctgctggccgtgccggtctgcgcacccgaggcccgcgacctggtggcgcggcaggcggacggggtggtgtgcctgagcgcgccgccggaattcttcgcggtcgggcgctggtaccacgacttcggccagctcaccgacgaggacgtggacgccgtgctggatagatttcatcatacgttgaaatag

SEQ ID NO: 5754 - DNA, 723 bp, Actinoplanes utahensis
atggacaccgcgatcgaggtccacgacctcgtcgtccgccgcggccccaggacggtcctcgaccgcttctcctgcgccgtcgcgcgcggcagcgtcaccggcctgctcggccccagcggcagcggcaagaccaccctgatgcgcaccatcgtcggcgtgcaggtggtggccggcggcacggtcaccgtcctcggcagcccggccggcgcccccgccctgcgccgccggatcggatacctgacccaggcgcccagcgtctacgccgacctcaccgtccgggagaacgcgcgctacttcgccgccctgcaccggctcggccgcgacgccgccgaccgcgccctcgaaacggtcggcctcaccgccgccgccggccagctcgtcgccgacctctccggcggccagcgcagccgcgcctcgctggcctgcgccatcgtcagccgccccgaactgctcgtcctcgacgagcccacggtcgggcaggacccggtgctgcgcgacgaactgtgggcgcacctgcgccggatggccgccgacggcgccaccgtgctcgtctccagtcacgtcatggacgaggcgaaccgctgcgaccggctgctgctgatccgcgacggcacgctgatcgccgacgacaccccggccgcggtcaaacggtccgccggcaccgacgacctcgaccaggccttcctcaccctgatccgcgcccacgagagggtgtcggcatga

SEQ ID NO: 5755 - DNA, 729 bp, Actinoplanes utahensis
atgatcctgctcagcaccatccggcggatcctcacccagctgcggcacgacccgcgcaccctcgccctgatcgtggtcgtgccgaccctgctgatcacgttgatctacttcatgtacgacgggcagccccgcgccttcgaccgcatcgcgctgaccatgctcggcatcttcccgttcatcgtgatgttcctgatcacctcgatcgccatgctccgggaacgcaccagcggcaccctggaacgcctgttcaccaccccggtcggcaaactcgacctgctcttcggctacggcatcgccttcggcgcggcagccgcggtgcaggcggcggtcgcggccggattcgcctactggatcctcggcatggacgcggccggcggactcggaccggtcgtgctgatcgccgtcgccaacgcggtgctcggcgtcgcgctcggcctgctgtgcagcgcgttcgcccgcaccgaattccaggcggtgcagttcatgcccctcgtggtggcgccgcaactgctgctctgcgggctgttcgtgccgcgcgagcggatggtggggtggctgcaggggatcagcgatgtgctgcccatgtcgtactcggtgcaggcgctcggcgaggtcggcgtgcacccggagccgaccggcacgatgtggcgcgatctgatcatcgtgctgggcgcgatcatcgttgcactcgggctgggtgccgcgacgctgcgccgtcgcacgagatga

SEQ ID NO: 5756 - DNA, 633 bp, Actinoplanes utahensis
atggcacgacggaccgggcggcggcccggcaacccggacacccgcgagtcgatcctgaacgccgcccgggaagcgttcgccgacaaggggtacgacggggcctcgatccgtgtcatcgccgccggcgccggcgtggaccccgcactggtgcaccactatttcggcaccaaggacaagctgttcctggccgcgatgcaggcgccgatggacccggtggcactgatcgaagccgccaccgagggcggcccggacgaggtcggcgaccgcttcgtccggctcttcctgcggatctgggacggtccgggcggcgcggccggcgtcgccctgctgcgctccacggtcggcagcgagtggaccaccaaactgttccgcgaattcgtggtcacccagatcctgcggcgcgccgtgccccgcctcggcctcgacgagaccgaaggccggctccgggtcaccctggccgccagccagatggtcggcatcgccatggcccgttacgtgatcaaggtggagccgctggcctccgcccccgccgaggcgatcgtggcggcggtcggacccgccgtgcaacgctatctgaccggggagctgccgggcgtcttcgcatccggggaagccgtcggaccctcggcgtag

SEQ ID NO: 5757 - DNA, 1218 bp, Actinoplanes utahensis
atgccggtgtggctcatgatctccctggtggtcgcgcttgccgtgctgggcgccggcgcggcgtgggcgctgcgcgggcgtgggcccggcggcggggacggcacggtgtgggggcggttcggagccgggggtggctcgggcccggagacgctggccggggcccgggagaggatcgcggagctgtcggcggcgctggctgcccgggacagtgagctggaacagctccaagaggaccgggcggcccaggcgcaggcggccgggttgcagcagaaacagcagcagcagacgctgcggcggcgggccaaggaggcgatcgacagcaccgccgcggtgatcggcgggaagctggaagacgtcgtggtgcaggtgggggcggcgcggcaggcggcggcggccacccatgagcgggtgtcgcacaccaacgatgccgccgaggcgctggtgcggcgggcgcggagtgcggacgaggcggccaccgcgctgaacgccagcctgcggcaggtggccgggatcgccagtgtgatctccgggatcgcctcgcagacccggctgctggcgttgaacgcgaccatcgaggcggttcgggccggggcggcgggcagcggcttcgcggtggtcgcggacgaggtgaaaagcctggcggacaccacggcggactcgaccgaacagatcaccagcacgatcgccgcgctggaggcggacgtggcgcagatgggcgagacgctcagcgccatcattcacgacgtcggggacatcgaggacgcgatgcgtcagctcggggggatcgccgaccggcagcacgacatcgtgatgcggctgcacgccagtgtggacgccacgatggcgcagatcggcgacctgtccgacgtggccgaacgcctggaacgccggcggcacgaccggctggcgatcgaggggacggtacggttgcggctgccgtcccggccgcagccggtgaccgcgaacatggtggacctcagttccgaggggctcgggtgcacgctggcagcggacattccggtgcagatcggcgatgtgatccgggcggagctcagcttcgacggactgggcggggccgttgacgccaaggtgatgcgccggacgccgcgggacggccagatggagatcggattgcagttccaggacctgccgaccagcgtccgcaacgacatcgacacctacctgaccaagctgggcgccgcccccggcgaagaatag

SEQ ID NO: 5758 - DNA, 213 bp, Actinoplanes utahensis
atgaccatcagcatcggcacttcgacgcagtcctcggcctgggagacgcacgcggcgtggttgcggctccggggcgactgtcagcaactcttcgaccatgtggtcgccggcgcgaatcggcgggaactggaggacgacaaggtcgccgttctggagagccgtgatgtcatcgcccgcctggaaccgggcagcggcgtcaacatcctggtctga

SEQ ID NO: 5759 - DNA, 495 bp, Actinoplanes utahensis
atggtcgccccggtcccggtcgacctggccgagatcgtcgccgacatcaccggagcccgcgccgacgcagcggtcgtggccggcaagccggaaccccggttcaccatcggtgacctgccgccggtacaggccgagccggtgctcgtccggcaactggtcgacaacctggtcggcaacgccatcaagtacaccgcgccgggagtcgtcccggtcctccagatctcggcggacgcctccgacggcatggtgacggtccgcatcaccgacaacggcatcggcatccccgaaggccgacacgacgccatcttcggcaacttccaccgtgcccacgccggcgacggctacctcggcaccggaccgggcctggccatctgcaaacgcatcgtggaacgccacggcggcgagatcaccgccaccgacgatccgggcggcggttccactttccgcttcaccctgccggctgccaccgcctccgcactgctgtcccccgtgtga

SEQ ID NO: 5760 - DNA, 204 bp, Actinoplanes utahensis
gtgacgactggctaccggctctcgctggcccggaccgcgctcttcgcccttgtctatgccgccgcggtctacgccggacgacgtaccgcgatggtcgccgacggcgtcagtctcgtctggccggcggccggttggcggtggtctggttcggcgcccaccgcgccgcgccgacccggcgactcgacaccctgctcctggccgtga

SEQ ID NO: 5761 - DNA, 627 bp, Actinoplanes utahensis
gtggagatcgtggaactgctggcgtcgccggtgcaccggttcgaggggcgacccgcggacgggcccgcgccggcgcccgagggagaatcggtcggcgagatccggatccgggcggggctcggcatcgtcggtgaccgctacttcaaccatcccgcgcaccgggacgcgtcgatcaccgtgatcgcccgcgagtcgctgcccgcaggcgccggactggcgcaggcccgccgcaacatcctcgtcgccggactgcgcctcgccggggccccggcccgatcgcccgcgcctgacacgggcggatcgcccgcccccgaggcggctgattcgcccggcccgaccgcggcgggatcgcccgccgtccaagcgggcggatcgccgggcggcctgaccctggacgatctggtcggggcgacgctgaccctcgactccggggacgggccggtccacctgtcggtgcgccggcgagccaacccgtgcgcctggatggacgtgaccatcggccccggggcgtggaaagcgctgcgcggccgcggcggcgtgcgatgcgtaccgttgaacgacggcatcctccgggtcggtccgctgagcgcgacgatccgatttccggacgaacggaatcagcattga

SEQ ID NO: 5762 - DNA, 753 bp, Actinoplanes utahensis
atgcgaatcggtgtcattggggcagggcagctcggcggcactctggcaacatggtgtgccgaaagcggacacgacgtggcggtcacctcccggcatccggaccggttgaccgacctggtcgagcacggcgacggtcacatccgcgcgatgacgatccccgaagcggccgtcttcggcgagatgttgttcttcgcgccgaattgggactcggcccgcgaagcgatcgacatcgcgcacgacgcgatggccggcaaggtggtcatcgacgccaccaacccgtcgttcatgagcgcgccgaccgagggcatgatgcccggcgcacccgggccgggcggcctcggcgcgttcgcccccggcttcccgtcggcgctggagatcccggccttcgtccgggttcccgacaatcccggtacgagtcgcgagctgggcttttccaccaagagcgggttcgagacgctgatcgactgggcgcccgaggcgcactgggcgaaagccttcaacacgatctccaccgaggtcctcgaccgtcgccgcgggcacgacccgctcctcgccgaattcgtctgcaccaaccagcgcgacgcccgcgaggcggcctgccggatcatccaggaactcggcttcgccccgttcttcgccggcggccccgaagccgcacgcctcaccgaaaccggcggcccgctgcagatgcgcgaggtcgacgtctacgacgccaaggacgtgctggccgaggcactggccgccatccagtga

SEQ ID NO: 5763 - DNA, 1470 bp, Actinoplanes utahensis
atgtgcctcgcgcaggcccgcccgccaccgggcgatcggcgggcagccgggggcggcggcgagcgccccggcgatgagccggccctggtcacgccagaggacggcgagggcggtgagggagcggcgcagggccggcgcgtccgggccggtgccgtcgagccaggcttcggagtcgcggccgagctcgccggccagtccgtgcagcagcgcgacgacaacggccagcttggagtcgaagtagaagtagaaactggatcgggagatccgcgccccggcggccagctcgtcgatggtgatctcggcgagcggcttgcgggtgagcaggtcgcgggcggtgtccaggatcgcctgctcgcgcaggtcacccttgctcgggctgcggcggcggggggtcatgtgaatcacgataacgcgctgtccagtattttcgacgtagtgtcgattccaagtttcccgacgtcacaggagcgttcgatgcaggagatccgccttgccagccggcccaccgggtggccgaccgccgacaacttcgagctggtggagctgcccaccccggagcccgggccgggccagatcctggtgcgcaaccagttcatgtcggtcgacccgtacatgcgcgggcggatgaacgacgtgaagtcgtacgttccgccgttccagatcggcgcggccctcgacggcggggctatcggcgaggtcgtcgcctcgaacgcggccgaggtgccggtcggggcgaccgtggtgcacggtctgggctggcgggactatgcggtgctggacgccgggcacgcgcgggtcgtcgacccgaacgccgcgccgacgctctccgcctacctcgggctgctcggcatgaccggtctgacggcttatgtcggcctgctcgacatcgcccagttccgcgagggtgacgtggtcttcgtgtccggcgcggccggtgcggtcggcagcgtcgtcggccagatcgccaagctgcgcggggccaagcgcgtgatcggcagcgccggctcggccgacaaggtccgccacctggtcgacgacctgggcttcgacgcggcgttcaactacaaggacgcgccggtacgggatcagctgcgggccgccgcgcccgacgggatcgacgtgtacttcgacaacgtgggcggtgaccacctggaggcggcgatcgggtcgctgaacaagttcggccgggtcgcgctgtgcggggcgatcgcgcagtacaacgacaccgcgccgccggcggccccgcgcaacctggcgctggccatcggcaaggagctgaccctgcgcggcttcatcgtcggcaaccacggcaaccggatgaaggacttcgtcgccgaggtcggcggctggctgcggtccgggcagatctccgcccaggagacggtcgtcgacggtctggccaacgcgcccgaagcgttcctcggtctgatgcgcggggagaacaccggcaaaatggtgatcaaaatctag

SEQ ID NO: 5764 - DNA, 2304 bp, Actinoplanes utahensis
gtggcaaatcggttccaactttggggacaagctggctgggccagcgccgaggtcgtcggcgagactcactacgcgaagtcgatacgcgcgctcttcgggcccgacttcaacccccaaggcaccgacatcaccgtcccggtccagctgatccccgaccgcagcaaccgccacgaccgcaacgccgtcggagtatggtccgacaacgccctgctcggccacctgccccggccggaagccgcccgttacgtcggcgtcctcaccgcgctcaccaagcggaagctggtgcccgaggtcaccgcgcagatccacggccgcgaatggggtgagtacgagggccgcccgcccgccttcgtcgccaccatccgcctcgacctgggcgagccgcacatgctggtgccggccaacgacccgcccgtgcacgagcaccggctgctgcccaccggttccgcgctgcaggtcaacggccaggagcagcatgtcgaggcgctcgccgcgttccagcgccccgagggcgagtgctgggcgtatgtgacgctgcacgagatggccgaccacctggtggaggtgcgactcggtgacgcccgggtgggcgacctgagccccaagacgagcttcgaactcgtcccggtcctgcggtaccaggccgaacgcggcctggtggtggcggcccgcgcggtggtgaagagcaacgcggtcaagaccgaggtgatgctgtacgtcgcccgggtgcaggacctgccggagacctgggtcggcccgtcggctcgcgccggcgcggtcagcggccgggtgaccccggtgtcgccggcggccaccccggtggtcccggccaccccgggcccggatccggtcggtcccggcggcgcgtcgacaccgggctgggtgaccggcagcgacgcggtgccgagccgtgcaaccggctccggcgatggcgccccggcctgggcaacgggttccggcgcctccgcgccggcctggtcgtcagcgtccggcggttccgcgccgtcctggtcgtcaggggccggtggttcgacaccggcttggacgtccggttctggtgacgctgccccggcctggacgtccggcacccatgaggccgcgccggcgtggacttccgggaccggtgacgccgcgccggcgtggacttccggaaccggtgacgccgcgccggcgtggacttccggaaccggtgacgccggacagacgtggacgcccgagtccggcgaagtggcggcgacgagagcgtcgggatccggcgacgccgtgccgacctgggcgtcgacacccagcgacgcccagccgacctggatggaccgcagcgagctcgtgccggcctgggtgcagccgagcggaacggtgcccagctgggcggcatcgatgagcggcccggtgccgaccatcgccggccggccgcaggcgaaggacccggtggtgcccggcgtggccgcgccgccgatcccgggagtcccgacgaccccggtccccggcgtgtcggtgtccggcggcccggcgtactcgacgtccccgggcgccggcagctcggctgactcggtgttcggatcctccagccgtccggtctccgggacgtcggctggttcggcgtccggattgcctggtcgtccggtctccggggtgtcggctggttcggcgtccgggttgtcccaccgtccggtctccggggtgtcggccggttccgcgagcgggttgtcccaccgcccggtctccggagcctcggccggttccgcgtccggtttgccgagccggtccgtttccggagtctcggggcagggcgccgggttgtcggccggccaggtctccagcctgaccggcggtttcccgaactcgccggccggccggccgaactcgtcgcccgaccgcgacggctcgcagcccgacttcctcaacgcaccgaccgggcttacccggtcgccgggcgccgggggccccgggacgccgccgtccggtggcaccggcccggtcagcccggccgggccgagcgccggcgcgcggccgaccggaatgttcggcggcgccggtgagatcgccgaaaccacggtcatcccggcgctgagtgccgtggtgctgagcaaacaccaggctgccggtacggctccggtctcctcggcccccgacctcaaccgccacgccccgattccgccggctccgaccggcatcaagttcgccgtgccgccgggctggccggtcccgccggacggctggtacccgccggagggctggcatccggacgcctcgtggccgcccgcgccggcgggctggcagtggtgggtcccgacctgggaatga

SEQ ID NO: 5765 - DNA, 189 bp, Actinoplanes utahensis
gtgctcggccgggccggtgacctgcgggtcgggcagatcgtggtcggtccgaccgggctgatcgtggtcgctgccaaccggtccccgatccgcctccaagtccgcccggctcgccgggctggtgccagtggtgctggtggtgctgatgttattgccagttggcccgatccgtgcggaacgtcggattaa

SEQ ID NO: 5766 - DNA, 7572 bp, Actinoplanes utahensis
gtgcggacgacggcgcccggggtggtcgagatcgtcagcccgtcgccgcgcagcgtcgtagaggcgctgcagcagggccgcgagtgcggtttcctgggcatcgaggagcaggcggaaggtccccggccccgggccgcccacgtcttccagaccacgatggccgacgccgagatggacgccaccctgcgggcgctgcgccgcgcagcccggcgcgacctgctcgaacagggcgttgccacgctctacctggggctcggcacggttcgctggcgcgacggcgccaacgagcacatcagcccgatcctgctgatcccggtggacctgatcaccccggatccggaggattacccgcggctgcgggtccgcgccgaggacccgatggtcaacccggctctggacatctgcctgcgccgacacagcatcgagttgcctgcggtggacagcctggcggcgctggacgtcacggtgttctgggcgcggctcgacgccgccctcggcgaccacccggactggcactccgacgagtcggtgctgctcgcccggttcgccgtgcaccgcgaggtgatgtacaccgacctgctcgaccacgagcggcagatcctgtcccacccggtggtccgggcgctggccaccgcacccgaggcgcaggccgacgcgttcaagttcgaggtgatctccggccgccggatcgacgaggtggccgccccggacgacgtgccgctggtgctggacgccgacgccgcacagcgggcgtgcatcatcgccgccctgcacggccgcagcttcgtgatgcgcggcgcgcccggcaccggcaagtcgcagaccatcgccaacatggtcgccggtctgctgcacgccggccggcgggtgctgctggtcgccgagaaggccgccgctctggacaccgtccgcgaacgcctggaacccgccggcctgcacgactatctgctcgaactgcacagcggccggaccggccgggaccacgtggccgctgccctggccgccgccctcgacttcatcccgctgccgccgccggatctgtccaccgacgaacgggaggcgttgcgcgagcaccggcagcggctcaacgcatacgccgaggcgatgaacgaggtccgcgaaccgctcggccaccgcctgcacgacgtgctcggcatgtgcgcgcagatgaccgatgtgccgcaggctccggccccggccgagctgccgatcccgctgaccacccagtccctgcagcgcgtccgggacgccgccgagcgtctcggccgcaactggcgaccggcccgggagggcgacgacttcctctggcacgacgtgatcgaccgcaaccggctcgacgcccggctgcatcaggcgcaggctgccctggaccacctgtgcgaggccatcgaacgagacccgctcgccgacgccttcctgatcagctcgatcggcgaggcgatcaccctgaccaccctggtcgggcacgccgcccgccggccggccgaggccgccgacgattggctcacgatggccagcctggagccggtggcccgggccgccgagggcctgctgcgccacctgaagacgctgcaccaggcggaggatgcggtccgcgccaaggccggagccacctggagcgcgttgcccgccccggccaagctgccgatcatcccgaccctgctgcacctgaacccgcccgcggtcgagttgctgccgctgaccgccgcacaggcgcgcgggctggcccgccgcttcgccgacgaggcggaccggctggaacagcaccagcacagcctggaccgggtgaccgcccggctcggtctgccgaacgtggtggccttcaccgacctgccccggctgaccgcgatcgtcgacctgctgtcccgcccggacaagccggaacctgcctggttcgacagtctcggcatgaacgccgcgcacgccgcgatgcggaatctgcgccgggtggtcaacgtggtcaaggccgccgagagccgggcccgcgagcacttcagtgacaacgccctggtcgagccggtggacgagctcgccgagcgattcgcccatcagcacaagggcctgcggaagctgagcgcgcagtcgcggcgggacaagaaggccgccgccgacatcgcccggccggacgtcaagcggtcgcaggcggtcgccaacctgaacgcggccgccgcctggaagcgtgcgctgcaggagctcgcggaggccgagcaggagtacgccggcatcctcggcaagcactggcagggccaggacaccgacttcgacgcgatcgagcgggcactgcggaccgccgcgcagacccttgaggtcaccccgccggaggcgctgcccaccctgatcgagcggatctgcgcgccgaccccgaacagcgcgatcatccggatcgtcggcgaggccggcaaggagttcgaacgctggaccgcggcgctgcgcccaccgcccgagcccgcgccccgcccacagctggccaccggcccgatccacgacgcggtgacctggctgcgcgcccacgtcgagccgttcaccgcggtagccgagctggtccaggcctacagcgcggccgccggccgggacttcaccctggccgaggcggcggcgatcggactgctccgggagagcgcgtcggaggccgccgcagccctgtcggccaacgccaaggagtacgccaaggtcctcggccccgcctaccgtggcacgcagaccgacgtggaggcgctcgccaccgcgatggcctggacctccgaggctcgccggatccgcaacggcgcggacatcgcgttcaccctcgagcaggccgaactgctcagccggacgcgtccctcggacaccctgccggcccgggtcgccgagtggcaggccgcccgcgactggatcctgcgcgccttcgcgcccagccggcacccggccctcagcgccgctctcgacgagcgggacacctcccgggaactgctgcgcgaactgctcgacgacacacgcggccagcaggagtggttcgactgtcagacggcccgcgcggtcctggccgagcacggtctggacccggtggtcgacttctgcatccgtgaggatctgccggtcgagcagctcctgccggtgctgggccgggcgctcttccagtcctgggccgacgcgatcatccggtccgacgaccggctggccccactcgacgcggtctcccgcgaccggctggtcgacgagttccggctctgggacgccgggctgcagcgcgccgccgcggccgaggtgatgaacgcggtcgacgcgctgcaaccggcggaggccgcggccggcgaggcggcgatgctgcgcgccgcggctgcccagcagggccgccgcctgccggttcgggacctgttcgcgcgtaccgcccgggcggcgatggcggtcaagccctgcctggtcatgtcgccggccgacgtgagccgtctgctcccgcccgacctgcacttcgacgtcgtgatcatcgacgaggcgtcccgggtgccggtgccggacgcgatcacctgcgcctaccgtggcaacgccctggtggtctgcggcgacgaccggcagctcaccgcgacaccgatccccggcggcgactcccgttcgatcctggagcaggcgctcagttgcgacgcgttccgcgtcctcgacctgaccacgcattaccgcagccgcgacgagtcgctgatcgcgttcgccaaccacgccttctatcaggggcgcctgcacacctttccggcgttcgcgccggccgggccggaccggggcgtgcagctctacccggccatcggcgacatgccgctcgccgacctggtcgcgacccgggtcgcccaccatttcgtcacgcggccggatctcagcctcggcgtggtggtgtgcaccgccgaggacggctacgagatcgaggccgcggtcgccgacatgatcgtgccgcccgaggacgaccggctgcgcggtttcttcatcaagggcctggacgccgtccagggcgatgagcgcgacgtggtgatcttcgcgatcaacggcgacctggacgggctctccggaccggacggctggcgccgcctcaacgtggcgaccacccgcgcccggcgccggctcgaagtggtgtccgcggtccgcgcccgggatctctcggagaacgacgtcagcctccgccacctggccgacttcctggagtacgccgcccgcggcatccacgcgctgggcctggaggactcgcacccgggggagtcgcagaccccgttcgaggactcggtccgggacgtcatccgcggctggggttaccgggtcagcacccgggtcggggccggcgcctaccggatcgacctggcggtccgccgctccgcccggcgcaacgccccctacgctctcggcatcgagtgcgacggcaccacgtacgactcggcgccgaccgcccgggaccgggaccggatccgcgagcaggtgctcgacagtctcggctggaagctgcaccggatctggggcaccgcctggtacctcgaccgggaccgcgaggagacccgtctgctggccgccatccaggacgcgttcgccgggctccccgacgaggaggcgccaccggaactgggcgtcgccaccgcgccggaccagccggaagacatcgcgcacgccgcgcccgcaccggcagacgccgtcgagtacccggtcgcggaggcggcggagggctacggcgccggctacgccgacaccgccggggagacgcccgctccgcggacgacccgattggcgtacgacgaagtcgtggccgccgtccccgcagcgcaagccgcgccatcgtccggcaccgtctatgcgactgccgcggcgccggtgtccacgttcacccaggcggcctccgacgagcaggttcggacattcaccgggtcggcattcaccgagtcggcatccgccgagccggtcgcacgggtgaccaccgagagctcgggcggcggataccccgacgcctccgctgactccggtctcgacctcgccgagcgggaaggtctcttcgcctggaccgacgccgacgacgccggggtggcccagacggaggccgccgccgaggcggacctcgccgacgcccacgacgccgacgaccgccgtgtcaccgaggccgctctgatcgccggcctcggcctccgcgggagcagggcttcgtcgaccggtatgcccaccaccggtgacgtggccgagttcgaggagtccgccggtccgcccgacgacggcgccctcgacgagcgggtcccgctgatgggcggcgacctgccggctcagtccgtcggggccacacccgacgagccggttgtcgccgagacctccgaggccggcatcgccgtctcggccggggaacggctggcccacgccgatcactccggtctggccggtgtcgcggccgagttcgcctttgcgcaggccggtgctgaggaactcgccgccgccgaggcctacctgggcgccaacctggaggccgcgatcgctcagctccgtgccggcgggagtgagtccgccgagtggccggtcgagccggacggcgctccggccgagccggccatgaccgcgacccatgccgacagtggtgctgcggcccgaaccgacaccgctgccaccagcgacgacaacggctcctggtccgctcctgcgatggacaacccggttcgggccgagtggcccttcgccagtcgggccgagtccccgtcccgctccgactggtccgctgcggcggagtcgcacccggagccccccgtacccgggagcgacccggcggtcggctcgcccctgcagccgcttgccgtcggctccgaagccgaccggtcgatcgccgaggctggcgtggactggtccgcggacgccgaggaagccgtcgtggaagtccaggaggagtccaccatccgggcggagtggccgttcgccagccgggccgaggcgcccgaacgcgtcgcatggcccgcggccggggaccggcccggggtccaggagatctcctggccgacggctgaccggaacactggtgatcaggaacctcgggtccaggatgtcgcgtggcctacggctgaacgtccggggggaacccgtgccggccgggagccagaggtcagggaggtcgcatggccgacgaccgggcagccgaccagccgggagccgcaggtcaggaacgtggagtggccggtcgccgagcgcgaggagcggacggccgccgaccgggagccgcgcgtgcagcgggtcgagtggcccactgcgacccgcgaggaaggggtccagtggtccgccgccaccgatgagccgatccagccggccggacggcgagtctcctccgtcgagtggcccaccgccggagccgaaccggccgagcggcgagtgtcgtccgtcgagtggcccgccgccacgcgggaggagccggctcagggcaccgcatggccgtcggataccagggcgcgggaggccggaaccgtgtcgtggccggtggtgagccgggacgaccagacttctgccagccgggaggatctcgccgaggtggccgcccgcttcggggtcggcaccgaggaattggccgcagccgccgcgcaattcctggccgggctgcacgagaccgcggaacccgccgaccgtctcgacgcgatctcgcagatccgggccgaactcaccgagtccgccaacctggaaccggaactggccgatgcggccgccgccgtggccgagcagtcgctgctcggcgtcagggccgagcgtcccgactggttcctggagatggtggggcagccggacctggccgccgcggtggccgagttcgaggagacgatggccgcaccgcccggctggacccatccgagcgtcgccaccaccggaccgcatctcgccggcgcgcaccagcccgaccccgtgctcggttcggagacgatgctgcaggaggagacccggcaggatgtcacggcccgggccgccgagacgaccggggcggcgggggcgcacaccggcgagtgggcacacccgtaccggaaagcggacctgcccccgctgccggccggcgccgtgctcaccgacccgagcctgcggccggaactgatcgccgccgtgcgaaggctggccgagatcgagggcccggtgcacatcaacgtcgccctgcaacgcatgcgcgagcagtgggacctggcccggatcagccggccggcccgcaccgcgatcgaggccgcgatcgaggaggccggagtcgcctgggacggcaccttcctcggcgaccccgaccaggacatcccggtggtccggcagcgggcggacggggtggcccgcaaggccgaccaggtctccgacgccgagctcgcgattgctctggagaatctggtgatcgacgggggcgtgctgccggtggacgagttgctggccgcggtgaccaaactttacggctggtcgtcgcgccgctcggcggaactcgacgcccggctcaccggcatgatggccgacctggtcgctgagggccacctgctccaacagccgaacggcctggccgccgcgcacggcctgcccgaccctctccagctctcccgtcatgaatccggtcaccgccacgcgcatcacaccacccgtcactga

SEQ ID NO: 5767 - DNA, 780 bp, Actinoplanes utahensis
atgcgggtgcaccacctcaactgcggcacgttgcggccgcccggcggtgacctggtctgtcacgttctcctcgccgagtccgatgccggtctggtgctgatcgacaccggcttcggcctggccgacatcgctgatccggcgacccggatcggcccgccacgacacctgctgcgccccgcgctgcgacgtgcggagaccgcggtggcccaggtcgagcggctcgggttccgaccgtccgacgtgcgtcacatcgtggtgacccacttcgacatcgaccacatcggtggcctcgccgacttcccgcacgcccgggtgcacgtcaccgccgcggaggccgagggagctctgcgtgctccgacccgcggggaacgccggcgattccgcagtgcccagtggtcacacggcctcgatctggtcgaacacaccgccgacggggagcggtggcgaggcttcgccgcggccaaggagctcaccgagatcggcccgggcgtcgtcctgatcccgatgcccggccacacccggggacatgcctgcgtcgcggtcgactccggcgaccgctggctcctgcactgtggcgacgccttctatcaccgcaacaccctgaccggcgccccggtgccgctcggtctccggctcgcggagatcggcgtcgccttcgaccgcacgctggttcgtgccaaccatgcccgtctcgccgccctccaccagcgcgccgagcccgatctgacccttctctcctcccatgacccggtcatcttcgccagcctcgccggccactga

SEQ ID NO: 5768 - DNA, 717 bp, Actinoplanes utahensis
gtgactatcgggtcggaggctctgcgccgggacgtgtggctggccaaccaggtgattccggaggctggtctggcccagctgacctggggaaacgttagcggtgtggatcgggagggtggttttttcctgatcaagccgtccggggtttcctacggtgatctgaccgcggacatgttggttccggtgaatcttgaaaccggcaaggtgctcgccggggatctgcggccgtcggtggacaccgagtcgcatcgtgcgttctacctggcgtggccctcgatcggggggatcacgcacacgcattcgacgaacgcggtggctttcgctcaggcgaatcgggatattcccgtgctcgggaccacgcacgcggacactttcaacgggccggtgccggtgacccgcgggcttaccgctgaggagtgcgcgcacgactacgagttcaacaccggccgggtgatcatcgagctgatcggtgacgacgaggcggcggccgcgatgccggccgctctggtcgccaaccatgggccgttcacctggggtgtcagcccgaagaaatcggtcgagcacgcgatcatcgtcgaggcggtcgccgacatggcgatccgcaccctggcgatcaacccgcaggcgttcacgccgcagcacttgcaggaacggcatttcaagcgtaagcacggcccgggcgcctactacggcaatcccggcgccgccaaggcctga

SEQ ID NO: 5769 - DNA, 852 bp, Actinoplanes utahensis
gtgagcggattgaccacggaacccgccgtcccagggtggtggcgtcgccggcacccccggctctccggcaccctgcacatccgtgacaaccacggccacgacaccaccatcaccctccgcggtcgcggcgccgtcctgactccagccggcaacaacctcatcggatacggcgagatctgggcagtccacaccgacccggagaccaccaccaccagcctgatgatcagctacggccgttccccagcccccgacgaccgcgaaaccggcctctgcccacccggcgccaccgtcaccctgtccggcacccacttcacctggcacaccccgagccaggccccagtccccgcggaaatcccccaccagcgcaccgccgaactccgcagccacgatggcccagccaccaatggaccggcaacaaccaggcgcaagcccgccacgcccaccgccgccagccacgaatccaccactgccaccgccgccggccacgagcagcccaccacacccaccgccgccggccacgagcccgccacgaccaccgccgccaaccacgagcccaccaccgccactgccaccaggcaccagcccaccgccagcgaccacgagcccaccgctggcatcgcgggaaccggcacgaccgacgattccacggcggccaccgctgctctcggacaaaccggcgccgggtctgcgggcgtccgaggcaacgcagcgccgacaacgagccgggagccggcgacccgcaacacccgggtcccgctccctcgttccggcaacaggcgcgccgcaattcccggttttcggcaacgagtcagtgccctcgtccgggacctcacccacccgccggcctactga

SEQ ID NO: 5770 - DNA, 1113 bp, Actinoplanes utahensis
atgccgaccacagacccggcgccggacctcggaccggctgcccagatgcccttcaccgcgacccggccgcgctccggcaaggagcgcgggagcgtcatgcgcgacgtcgcgaaactggccggcgtctcccaccagaccgtgtcccgggtgatcaacgatcatcccaacgtgcgggcggagacccgggaacgcgtgctcgccgcgatgcgctcgctcaactaccggcgcaacctggcggcccgcaccctggccacccgggaatcccgcacgctgggcatcatcggcttcgagaccaccctgttcggccccgaatcgatgctgtacggcatcgagagcgcggcccgggccgccggctacctggtcagcgtcgccacggtccgcgagctggcgcaccggccggtcctggaagcggtcgaccggctcgcccagcacgacgtcgacgggatcatcgcgatcgccccgaagccggcggtgaccacggccctcacccacgcccccagtggactcgcctgcgtggccgtcggcggcgccggcaccggtgccgacccgttccccaccgtccgcgtcgacaacgcggccggcgcgcggctcgccacccggcacctgctcgacctcgggcacgccacggtgcaccacgcggccgggccacccgactggccggaggcgcaggcccgggtcgacggctggcgggagaccctgtcggcggccggggcggcggtgccccccatcacccccggctggtgggacgcggccgccgggtacgagcagggccggcggctggccgcggacccggcggtgacggcggtattctgcgccaacgaccggatcgcgctgggtgtgctgcgggcgctgcacgaggctgggcgacgggtgcccgaggacgtgtcggtggtcggcttcgacgacatgcccgactccggctactttttaccgccactgaccactattcaccaagatttcggagaaatggggcgccgcgcgctggctctgctcctggaccacatggcgcaggaggagacggacggccccctgtccaacgtggtggtccaaccggaactcgtgctgcgctccagcaccggcccgcggcgtcccctcacccttggcggtgaatga

SEQ ID NO: 5771 - DNA, 984 bp, Actinoplanes utahensis
atggcggcggcgctgacgggcatgctggccgtgtccgcgctcgccggttgcggcagcaagagcgacgacgccggttccggttcggcgaactccggcgggagcggcaagaagctggtcctcggcttctcccaggtcggtgcggagagtggctggcgcaccgcgaacaccaagtcgatccaggaggcggcggccgccgcgggcttcgagctcaaattctcggacgcccagggcaagcaggagaaccagatctccgcgatccgcagcttcatcacccagcacgtggacgtcatcgcgttctcgccggtggtcacctccggctgggactcggtgctcaaggacgccaaggacgccggcatcccggtgatcctgaccgaccgtgcggtcgactcgcaggacctctccctctacaagagcttcctcggctcggacttcgtcaaggagggcaaggaggccggcgactggctggtcaagcagtacgagggcaagtcggacccggtgaacgtggtcgagctgtccggcaccaccggttcggccccggcgatcgaccggcagaagggcttcgcccaggcgatcacggccaacccgaacatcaagatcgtcaagtcgcagaccggtaacttcacccgggccgagggcaagacgacgatgcaggcgatcctccagtccaccccgaagatcgacgtgctgtacgcccacaacgacgacatgggcctgggcgccatcgaggcgatcgaggcggccggcaagaagcccggcaaggacatcaagatcatcacggtggacgcggtccacgacggtatgcaggccctgtccgacggcaagatcaactacatcgtggagtgcagcccgctcctcggcccgcagctgatggacctggccaagaaggtcaaggacaagcaggacgtcccgcagcgtgtcctcaccgaggagaccaccttcacccaggagcaggccaaggccgcgcttccgacccgcaagtactga

SEQ ID NO: 5772 - DNA, 1533 bp, Actinoplanes utahensis
atgggcgaaccagccaccaacccggtcctcgagatgaccggcatccgcaaggtcttccccggcgtcgtcgccctggacggcgtcgacttccgtttgtaccccggcgaggtgcacgccctgatgggtgagaacggcgccggcaaatccaccctgatcaaggtgctcaccggcgtctacgagatcgacggcggcgagatccggctcggtggcgacgtggtccggatcgccggcccgctggccgctcagaaggccgggatcagcaccgtgtaccaggaggtcaacctctgcaccaacctcacggtcgcggagaacatcttcatcggccgtgagccccgcacgttcggcaagatccgctgggggcagatgcgccgccgggccaccgagttgctccagcgcctcgacctggacatcgacgtgtccgccccgctgagccagtactcgctggccatccaacagatggtggcgatcgcccgcgccgtcgacatctcggcccgcgtcctgatcctcgacgagcccacctccagcctggacacctccgaggtggagcagctgttccgggtgatgcgccggctcaaggcggacggggtggcgatcctgttcgtctcgcacttcctcgaccagatctacgagatctccgatcggctcaccgtgctgcgcaacggccagctcatcggcgagtaccggaccgccgagctgacccaggtgcagctggtcgagaagatgatcggcaaggagctcgccactctggaagatcttgaggacaaggcacagagcgcccgtacgaaggcggccgccgccgagccgatcctcgaggcccggggcctgggccggaccggtgcgatcgccccgttcgacctgaccatccaccagggcgaggtggtcggcctggccggcctgctcggctcgggccgcaccgagctggcccggctgctgttcggcgccgacaaggcggaccagggcacactcagcgtggacggcaagccggtgtcgctgcgcgacccgcaggtggcgatgaagcgggggatcgccttctcctcggagaaccgccggaccgagggcatcatcggtgacctcagcgtccgggagaacatcatcctggccctgcaggcctcgcgcggctggacccggccgatcccgcgccgcaagcaggacgagatcgtcgacaagtacatcaaggcgctgcagatccggccggccgacccggagcgcccggtgcgcaacctgtccggcggcaaccagcagaaggtgctgctggcccgctggctgatcaccgagccgcggctgctcatcatcgacgagccgacccggggcatcgacgtcggcgccaaggcggagatccagaagctggtcgccgagctctccggcgggggcatggcggtgctgttcgtcagcgccgagctggaggaggtgctccggctcagccacaagatcgccgtgctgcgcgaccgccgcctggtcgaggagctggacaacaccgccggggtcgacgccgaccgcatcatgcagaccatcgccagcggagcaacctcatga

SEQ ID NO: 5773 - DNA, 1020 bp, Actinoplanes utahensis
atgaccatcctgaagaaccggctgttctggccgaccgccattctcgtggcgatgctgatcgtgaacgtgttcacgtcgcaccagttcctcaccatccacgacgggcacctgttcgggacgctgatcgacatcatccggggcagcgccccgctgatgctcgtcgcgctcggcatgacgctggtcatctccaccggcggcatcgacctgtcggtcggttcggtgatggcgatctccggcgcggtcgcctgtctgctgatcaaggacctgagcgaccagaacgcgctcggcgcggtgctgctcatcgtggccgtctcgatcggcgtctcggccgtgctcggcctctggaacggcgcgctggtcgcggtcgtcgggatccagccgatcatcgccacgctgatcctcatggtggccggtcgcggcctggcccagctgatcaccgacgggcagatcatcaacgtgcagtccagcccgtacgcgagcatcgccaccggtttcttcctcaccctgccggtggccttcctgatcgcgatggcggcggtcgcgctgaccgcggtgctgacccggcgcacggccctgggcctgctgctcgagtcggtcgggggcagcccggcggccagccggctggccggcatccgggcccgccggatcaccatcatggtgtacgtggtgtccggcgccctggccggcctggccggcctgatcgtgtccgcggacatcaagagcgcggacagcatccacgccggcaacctgatcgagctggacgccatcctggccgtggtgatcgggggcacggcgctgatcggcggccggttctcgatcgtcggcacggtgatcggtgccctgctgatccagacgctgaccgtcacggtggtcggcatcggtgtgccggacaaggccacgctgctgttcaaggcggtcgtggtggtcgccctctgcctgtcccagtcgccggtcttccgcgagaaggtgttcggaagattcaagtcgcgtcccgccgtgcgagccgaggtccccgcatga

SEQ ID NO: 5774 - DNA, 1023 bp, Actinoplanes utahensis
atgaaaaccacgatcgacgcgacgccggaggtcgcgcagaacgctccggtcaacccgaggcgccgcgtctaccggccgaacgccaagtacatcccgatcctcgccaccctggtcctgctgctcgccatgtacatcggcggcctggtgaacctggagcacttcgacgacccccgggtcgtggtcaacctgttccgcgacaacgcggtgctgctggtggtcgcggtcgggatgaccttcgtgatgctcaccggcggcatcgacctgtcggtcggcgcggtcatctcgctgaccaccacgctgaccgccaccctgctcaagggcgggtggccgccgttgctggtgctgccgctggtgctggtgctgggcgcgctgctcggcgccgggatgggcgcggccatccactacttcaaggtggagccgttcatcgccacgctggccggactgttcttcgcccgggggctggcgctctacatcaaccaggagtccatcccgatccgggacaaactctgggtgaccctttccgacctgcggatcccgctcttcgatgacgtcaagaccacgctgatcgcggtggtggcgctggcggtcgtgctgatcgcggccggcgtgctggcctggacccggttcggccgcaacgtctacgcgatcggcggcagcgccgactcggcgctgctgatgggcctgccggtggcccgcacccgggtgctggtctacacgatcagcgggttctgcgccgcgctcggcggcgtgttgtacacgatcaactccacctcggggcacgcgctgcagggcgccggcaccgagctggacgcgatcgccgcctgcgtgatcggtggagtgctgctcaccggcggctccggttacgtcctgggcaccctgctcggcgtgatggtcttcggcctgatctcgaccatcatcaacttccagggtgacctgaactcggcgtggacccggatcgtcgtcggcgtcctgctcttcggcttcattgttctgcagcgactggtgacacggagggctcgatga

SEQ ID NO: 5775 - DNA, 1485 bp, Actinoplanes utahensis
atgagcaacggggaaatctggttcctgaccggcagccaggggctgtacggcccggagacgctggagcaggtggcgagccagtcccgggagatcgccgcgcagctggacgcgcagctcgacgcggacgtggtctggcagccggtgctgaccagtgccgagcagatcctggacgtctgccggcgggcctcgtcgacgccgggcgtgctcggcgtgatcacctggatgcacacgttctccccggccaagatgtggatcgccggcctggacgcgctgcgcgccccgctgctgcacctgcacacccagcacaacgtggcgctgccctggtccgagatcgacatggacttcatgaacctcaaccaggccgcacacggcgaccgggagttcgggttcatcgaggcccggctcggggtgccgcgcaagacggtggccgggcacgtcagcaacccggccgtgacggcccggatcgccacctgggtgcgggccgcgcgcggctactcggcgatgcggtcgctgaagctggcccggttcggcgacaacatgcgcgacgtggcggtgaccgagggggacaaggtcgaggcgcagctgcgcttcggcgtctcggtcaacacctacggcgtcaacgacctggtcgcggtcgtcgaccaggtgaccgacgcggagatcgacaagctggtcgacgagtacgccgacgtctacgaaatcgccgccgagttgaagaacgagcgggcggagtcgctgcgctacggggcccggatcgaggccggtctccggcagttcctcaccgagggcggtttccaggccttcaccaccaacttcgaggacctcggcggtctgcggcagctgcccggcctggccgtgcagcggctgatggccgacggctacggcttcggcggcgagggcgactggaagacctcggtgctggtgcacacgctcaaggcgatggtcccgggtggcgccacctccttcatggaggactacacctacgacctgaccccgggcaacgaggtcatcctcggcgcgcacatgctggaggtgtgcccgtcgatcgcggccggcaagccgaagctggagatccacccgctcgggatcggcggccgcgaggaccccgtacgcctggtcttcgacgccgccccgggtaaagcgatcgtgctcggtctcgcggacctgggggagcggttccgcctggtcgccaacgagatcgaggtggtcgcgccgaccgagccgctgccgaagctgccggtcgcccgggcggtctggaagccggcgccgtcgctgtccacctcggccgagtgctggctgaccgccggcggtccgcaccacaccgtgctgtccgcctcggtcggcgccgaggaactggccgacctggccgacatggtcggcaccgaactgctgctgatcgacgaggacacgacgacccggcagttcaccaaccaggtgcgctggaaccaggcgtaccaccgtctggcccgcggtttcggccgctga

SEQ ID NO: 5776 - DNA, 681 bp, Actinoplanes utahensis
gtgcttctcaacgggactgacggtgagacctcggagcacaaggtgatcgcgcccaacccgggcctgccgaaccaggcgctgcaggtcctcgccctggcgcagcgcaccgccgaggagcacgtggcgagcgcgcagcaccacgcggacaagatccgcacggacgccctggcggcggcagagcagatcgcccgggacgcgcagtcgcacgccggcaccgtgcggcaggaggccgatcgggtgctcgccgaggcccgcgccgccgccgagaccatggcgcgggaggcccaggcgcgcgccgaggaggcccgccgcgccgccgacaagatcgtcacggatgcccggcagcgcgccgagcagatcggcgcggacgccctgcacggcgccgagcagttgaagctgcaggcccagcagcgctacgacgacgtggtcggcagcctgggcgccaagcgcgaggcgctgcagcagcagatcgaggccctggagaactttgaccgggagtaccgcggccgcctcacccagttcatgcagggccagctgcgcgcgctctgggcggacgccccgcaggtcaccgccgaggtgatcgaggaggagccgatcgccgaggagatcgaggccgccccgcgtcgcgggcaccacgcgcaccagccggaggccgacgccgaggccgacgaggaccgctga

SEQ ID NO: 5777 - DNA, 699 bp, Actinoplanes utahensis
atgcgacgcctcgccacgctgctcaccgcgacaaccctgctagccggaacgcctacggcggcacacgccgcggctccggtcaccctcgcctactggccgatgaacgagccggccggcgccacccggatgtccgacagcagtggaaacggactggacggacagatcggcgacgaggtcggcgtcgacaccgccgtgaacggggccaccggctaccggttcgaccgcctcgaacccgacaccccgccaccccacccgggccacctggtcgtggtgtccagcggcggcctcctcaatcccggcgtgcgggatttcgccgtcaccatgcggctgcggaccgtcaaccacttcggcaacatcatccagaaaggccagtccaccaccaccggcggcaacttcaaactgcagatccccaacggccacgtgcaatgctcgttccgcggcgaccgcggcgtcctcgaggccgacgcccccgacgccatcaacgacggcgcctggcacgtgatcacctgcgtccgggtgagcagcggcgtcgccctcgccatcgacggccggcgggtggccgggcggcaaggctggaccggcgccatcagcaacaactggccactgaccatcggcgggaaactcgactgcgaccagcgggcggtgggctgcgactacttcgccggcgacctcgactacgtcaccatcgagaccgactga

SEQ ID NO: 5778 - DNA, 300 bp, Actinoplanes utahensis
gtggaccgtcgatcgcaccgatccgggtctacctgccgacatgtcgctgcccggccggccggacggtcatgcggtcggcagcggtcaaggacagaccatcacggtgtacgaggtggtgccgacgtggtggccttcggcgacgacggggtgtggaccgccccggggcaacggcgacggcaccttccgctcccccgcttcgtggtcgacgacctgggcttcgacgccgggggctggcgggtcgatcggcacccccggttcgtggccgacctgaccggcttcggcaacgacggccctggatga

SEQ ID NO: 5779 - DNA, 1863 bp, Actinoplanes utahensis
gtgcgcaaccgtctgcttccgctggccctgacggccctgaccctggtcgccgccggcccaccggccccggccggagccgcccggagccccgccgaaccggtcgccggcacctggatcggcttcggctacaaccaggacccgcagtacgccggtggcaccggcacaccgactccctgggacccgcgggcgttccagcggatgacggagcggaccaccttcatccggccgccgatcgtgcgggtgatgctcaaccgcgactggttcaaccccaccggtgtggccggccggtacgagtgggcgagtgtgcagatgacgaatctgtaccaggtcctcacgcactaccggtccctcggcacccgggtccagctcgggctgtggggagtgcaaccgtcgagcgccgtgaacccgtacaccgcgaccgagaccgccacggtgcaggcggacctgatgcgccggctgtacgtgaccgacgcgtacaccaacatcgtccgctacaccggcgtcaacgagccgaacgtcaagaacgaggccaagaactattcgtacgccgactgggtcaccgcgaccaccaatctgcgcgccgccttcgccgccgagaaccttccggtgaccctgctcggcgggcccgacaccgccgaggccaccatctccggccaggacggtgacctggggctggagtcggtgaccggcggcgcggccgccaccggacagaacgcggtgtggcgggcggacgggctggccggtttcgacgccacgttctacgtcagcccggacaccggcgcggccgactggaagttctacacctcccgcgacggatcgtcctgggcgcagctcgacccggcgagcctggtgcagtccgcgccggtcaagacggtcgccaccaacccgtggtaccgctacgaggtgcgcaacggcgccccgctggcggccggcaccgactatctgcggatcacgctgcccgcgcacgccggcaccgagcgggcgctggcttcgctcaccatgaccaccggcgccggcggcaccgtcgcggatccgatgaacgactggagccacgcgacgtcgcacagttccggctggacccacctgcagggggcgcccaccgacgactggtggctggaggctgccggctcgtcactggtgtccgggctgcagacccacttctacgcccacgagctggacctcgccgacgcgggctatccggtgcagcagctgcaggagtatccggaggcgacgctgcgcgaggcggtccggcaggtgcgggcggccgcgcccggcgtgccggtgatcctcggcgagaccgggatgaaggcgccgaagtccaccgacggcaaggactacgcgttcaccgacgagccggagcacggcgtccggatggcggacctcgccgtgcaggaggtccgcgccggtgtcgacggcgcgatggcatggtgcctggacggctacgccgcggccgtgcagtgcgggatgtgggaccacgaggggaccaccgaggccaccaccgcgctgcggccctggttctatacctggagcctgctctgccggtatctgccggccggatccaccctctacgcccctgcccagcagcccggcctgcgcctgctgcaggcccaggcgcccggctccggaggctggacgttcgtgctggtgaaccgcggcacgacagcggtcaccgtgccgatgaccgcgccgaccggcaaggtgaccttccaccgctacctgtaccaggcagccgcgaatccgccgggtccggtcgacgccgacgggttcccggtgccggccggcaccttcctcggctcgttcgacggtggccgtccggtcacggtgcccgccgatgcggtcgtcctcatcacctcgatgtcctga

SEQ ID NO: 5780 - DNA, 1638 bp, Actinoplanes utahensis
atgtccgcggatctggtcctcaccaacggtcgcgtcttcaccgccgacccggcgcgcggtccggccaccacggtcgcggtccgcgccgggcgggtggtggcggtcggcgccgacgacgtgcgcgagctgaccgggcccgccaccacgacggtcgacctggccgggcggctcctgctgcccggcttccaggacgcgcacgtgcacgccgtgatgggcggcgtcgagctcggccagtgcgacctgaccggcgcccccgacctcgacgcctgcctgcggcgcatccgggatcatgccgacgcccacccggagctgccctggatcaccggcggcggctgggccatggaggtcttccccggcggcgtccccgaccgcgagccgctcgatcgggtcgtgcccgaccggccggtctacctgatcaaccgcgaccaccacggcgcctgggtcaacagccgcgccctggcgctcgccggcatcgacgccgccacccccgatccggccgacgggcgcatcgaccggcgccccggcggcgcccccgccggcggcctgcaggagggcgccatgcagctggtcgcccggctgctgcccgcggtcaccccggccgagcggctggccggtctgctgcgcgcccagaccctgctgcactcgctcggcatcaccgcctggcaggacgcgatgctctgcgccaccaacggctacccggacgtctccgacgcctatctcgccgccgccaccaccgggcagctcaccgccaccgtcgtcggcgccctgtggtgggaccgcgaccgcggcgccgagcagatccccgaactgctcgccaaccgcgaccggcacaccgtcggccggctgcgctgcgacagcgtgaaactgatgctcgacggcgtcgcggagaacttcaccgccgcgatgaccagcccctaccgcgactcctgcggccgcaccaccgcgaacaccggcctgtccttcatcgacccggccgccctgcgatcccatgtcaccgagctcgacgcgcacggcttccaggtccacttccacgccctcggcgaccgcgccgtccgcgaggccctcgacgccgtcgaggcggcccgcacggcgaacggtttccgcgacacccgcccgcatctcgcccacctgcaggtggtgcacccggacgacatcccgcgtttccgggcgctgggcgccgcggccaacctgcagccgttctgggcgtcgcacgagccgcagatggacgacctgaccatcccgttcctcgacccggcgctggccgcccggcagtatccgttcggcgacctgcagcgagcaggggtccacctggcctgcggcagcgactggccggtgagcacgccggacccgctgcagggcatccacgtggcggtcaaccgggtgcatcacggggcgggccatccaccgttcctgccggaccagcggctcgacctcgcgaccgcgctgaccgcctacaccgccggggccgccttcgtgaaccgtctcgacgacaccggggtcatccgggccggcgcccgggccgatctggtggtcctcgaccgcgacccgttcgcgggtcgaccggaggagatcggcgcggcctcggtcgccatgaccttcatcgacggacggcttgtccacgccgccggacggaaatga

SEQ ID NO: 5781 - DNA, 1104 bp, Actinoplanes utahensis
gtggagctaccccgctgggtggagacgatcctgcgcgcccgccgctacggcgccgccgtcctcgccgccctcctcgcgctgctggtctgggacatgccgctggatctcggcgacttcgccggatacgggcagcggctgctcgacgggcggctggacggtgtctacgactccggctggaaccaggccgggccgctgcaactgctgatcagccgggcgctgatgatcggcggaacgcacgggatgccggcccgagccgtggtgatcgcggtcaacgtggggctggtactcgcggcgatgacgctgtgcgggcggctcaccccggaccgggggcggcggcgcgccgtgcgggagaccgcgaccggattgctcgtgctgctctggatgctggtgccggtcccgtggtacggacatcccgctgagcttgccgtcccggggctgtgggcgtacgcaagcctctgtcagaagcgacaacggaccgtgaccgcggccgcgctcctgggtctcgcggtcgccatcgccccctgggcggtgctgggctttccctgcctgctggcggtcagcgggccggtgcgcgcgctgcggacctgggtgctgggcggcctcgcgggcatcgccacctacctgccgttcgtgctggccggacacttcgcgatgttccgccacgtctggcacgtcgacaacgacaccctggtcaagatcctcctgcccgggatgccggacgtgacctgggagatgcgcctgatccaggcggtgctggtggccggcggctgcgccgcggtggcctggtggtgccgcgggcagcggctcgcctacgcggtggcgccggcgaccgcactgctggtccgggtgttcagcgatccggtgacgctgcgctactactgggggccgatcgcggtggccacggtgctggccttcatcctggtcgaacagccgcgcagacaggcgctggccctgctgctggggtatgcggcggcgttcgcggcgctggcgacccggcaggtcaccgggtcggcggcctgcctggtgctgctcgtcgcgctggtcagcgtgcgcccggtcgcgcgggcccggccggccgacaccctgctgacaccggcggtgtga

SEQ ID NO: 5782 - DNA, 594 bp, Actinoplanes utahensis
atgccccgccccaccaagcagcagatcgacgacgagatcctcgacgccgcggccggtctgttcgcccggcacggtttccgggagacgtcggtgcagcgcatcgccgacgcggtgggctactccaagaccggcctgctgcaccgcttcccgaccaaggaggcgctgcaggcggccgtcatcgagcgctgcgtggggcagctccgggaggtcgcggcgggcgccgccccgctgccgaccggtccggagcgcgaccggatggtgatcaccggggtggcccagctcgcgcgggatcagcccggcgccgtggcgctgctgctgtcctgcctgctcgccgagccggagagcgagttcggcgtggccctgcagacgatcggcgagcaggtcgccgcggcgttcggcgacgagccgttcaccggtgccgcgctgggcggggcgggcgcgctcgccgacccggtccgctcggtccgggtgatcggcgcgctcggcgcgctcgcggtggccagcgtcgccctgcgcgactgtctcaccccggacgcggtcaccacgctcgtcgacgtcgcctacggcgcgctcgggcacccctccaccctctga

SEQ ID NO: 5783 - DNA, 2154 bp, Actinoplanes utahensis
atggcaacgctgctgcaccgcctcggcctcggcgccgcacggcatcgcatcgtggtcaccgtcgcctggttgctcgccctggtggccgtggccttcggcgcggtcaggctgtccggcgagaccgtcaacacgttccgcatccccgggcaggagtcgaccaccgcgctcgacctgatgaagcagcggttcggcgacgcctcggcgggcgccaccgtgcaggtggtgttcgagaccccggccgggcagaagatcaccgacccggtgatcgtcaaccaggtcacccagtcggtcacggcgttcggcaagctgcccggcgtggtcgccgtgagcaacccgttcgaccagcagaacccgtcggtctcgcgggatctgagcacggcgctgaccaccgtcacgtacggcgtgcagccgtccgaggtgaccgacgacgagcggtcggcgatcacggcggccctggcccaggccaaaaccggcggcctgattgtcgaggcgcgcggcgaggcgctgagcaacgcggccgacatcggcggcgcgtccgagggcatcggcgtgatcgtcgcgctgatcgtgctggcactcagctacggctcgctggtggcggccgggatgaacctgctgaccgcgatcgtcggggtgggcatcggcgtcgccggcatcaccacgttgtccggtttcgtccagctgcagtcgaccaccccgatcctggcggtgatgctcggcctggcggtcggcatcgactacgcgctgttcatcgtcacccggttccgccacgagctccgcgccggccgggacgtcgagtcggccgcggcgtacgcggtgggcaccgccggttcggccgtggtgaccgccggcctgaccgtggtgatcgcgctggccggcctgtccgtggtcggcatcccgttcctcaccgagatgggcctggccgcctcggccaccatcgtggtcgccgtgctggtggcgatcaccctggtcccggcgatcctggggttcatcggcaagcgggcgctgccgcgcaggctgcgcgacctgccgccgacgaccgaccacctggcggagggccgcggcttcatccggggctgggcgaacaccgtcacccgcaagcgggtgacgagcctgctgctggccgtgctcgcgctcgccgtggtggcgttgccgttcttcaaaatgcagaccaccctcgctcagcggtcgccggagggcagcacccaggccaaagcggacgccatcatcgaccagcggttcggcccgggcgtcagcggtccgctgctgatcctgatcgacggcccgcaggcggtgccgtacgcggcgaccgtgcagaagcagatcagcaccctgccggacgtggccctggccaccccgccgcggcctgacccgaagcagtcggcggcactgatcacggtgatcccgggctcgggcgccgaggatcagaagacggtcgacctggtgcaccggatccgggacgaggtggccgacagtgccggcgccaaggtgtacgtgaccggccagaccgcgatcagcatcgacgtgtcgcagaagctcaacgccgccctcccggtctacctggcgctcgtcgtcggcctggcgttcgtcctgctggtgctggtcttccggtcgctgctggtgccggtcgtcggggtgctcggcttcctgctcacgatcggttcggcgttcggcgccacggtcgcggtgttccagtggggctggctgtccggtctggtcaacgccggctccaccggcccgatcatcagcctcgcgccgatcatcatcgtcggcatcctgttcggcctggcgatggactaccaggtgttcctggtgtcgcggatgcacgaggcgcacgcccacggcgcgtcgccgcgggacgcgatcgtcaccgggttccggcaggccgcaccggtcgtgctggccgccgcgacgatcatgttcgcggtcttcgcggcgttcgtcccgcagggcaacgacacggtcaagccgatcgcgttcgccctggcggtgggcatcgcgttcgacgcgttcatcatccggatgatcgcggtgccggccgcgctggcgctgctcggccggtccgcctggtggctgccgcgctggctgcgctggctcccggaactggacgtggagggcgcggcgctggagcgccgcgagcaggtccccgtctga

SEQ ID NO: 5784 - DNA, 339 bp, Actinoplanes utahensis
gtgcggtgcgtggatacgacccagctcctcaagggcgtgctggatctcgcggtgctcgccgtgctgcgcgacgaggacggctacggctacgacatcctgcgccggctgcgcgccgccggcctgcaggacgtcggtgacgcgtcggtctacggcacgctgcgccggctgttcgccaacggcttcctgaacgcgtacgtggtgcccagcgacgagggcccgcaccgcaagtactacgcgctgaacgcggccggccgcgccgagctggaacgcaacggcaagacctggcacggcttcgccgtcatcatggacgacctgcttcgcgaccgggggaccgcgtga

SEQ ID NO: 5785 - DNA, 996 bp, Actinoplanes utahensis
gtgaacgacaccgcaaccgaccagatcgccacctacgtcgccgcggtgcgcctcgcgctgggcggggtgcccgagaccacccgcgaggagctgctcgacgacctcccggaacacctcgccgaggtgctcgccgaggacaacggcactctggtcgagcgtctgggcgcccccgcggcgtacgccgcggaactgctcgccacggccggattcgtctccctgccaccgcagcccgacccgcgctgggacaacctgcgcgagacccgcgacctggtgctgcgcgggctgcgcgtggccgacgtgcgggtcggcccggcgctgggccacgagcgggccagcgagttcctcctcctgctccgcccggcctggtgggtgctgcgcggctacctggtcgcgatggtcctcgccgtcgtgctcgaccacggctccggcccgatcggcctgctgccccggatcggcggcagcgacgtggtggcgctggccctgctcgccggctgcgtggtcgcctcgatctggttcggccgtcgcccgctgcccgacaagccctgggcgcggtacgcgctgtggtccggcaccacgctcctggtgctgatggcgctggccggcttcaccggtttcgacagcgacctgcgccagacgccgttcgtcgagtccggttacagcggcggtggcccggcggacgccatccaggacatcttcgtgtacgactcgcagggccacccgatccaggacgcccagctgtacgacagctccggcgccccgatccagctgggcaacgccacctgtaccgaccctcggaccgggaactcctacaccagctggcaccgcggctatccacactgcccggacgccgacccgttccagtccccgagccccgaccccaccctcgacggcgacaacccgcacgaggaggtcacgccctcggcgaccccaccctccgcgggcccgtcggcgagcggcaccccgtcggccgcgccgtcggcgtcaccgagtcgctga

SEQ ID NO: 5786 - DNA, 1098 bp, Actinoplanes utahensis
atgcgcagatccatcggcgccgccatcggagcggtgctgctgatgctggcgctctcccccacccccgcacacgccgcctcgctcaccatgctcggcgcggacgtctcgtcgctgcagcggaccctcgacctgggcggcaggtactacaccgcggccggtgcgcaggccgacccgtacgacatcctgaaaggcgccggcgccaattacctgcggctgcgcgtgtggaacaacccggccggcggatacaacaacaaggccaaagtgctgcagcaggcgaaagccatcaaggccaagggcctgaaactgctggtcgacttccactactcggacacctgggccgatcccggcaagcagtatccgccggtggcgtggagctcgcactcgctcagccggttgcagaccgacgtgtacgactacacctacgacgtgtgcaccgcgctgaagtcgcagggcaccacgccggacagcgtgcagatcggcaacgagatcaacgtcggcatgctgtggcctgccggaaaggtgtcgaacaacaatttcgcgccggtggccggcctgctgaaacagggctacaacgcgaccaaggcgtgcaacagcggcacccaggtgatgattcacacggccgacgcggacagcgacgcgaacgcgcgctggttctacgacggcatcaaggcgcagggcgtgtcctgggacgtcaccgggctttcctactactgcatgtggcacggcacgctggccaatctgtacaacgtgatcgccgacgtgaaatcgcggtacggcaagcccgtggtgatcgtcgagacggcgtacatgtacaccacggccaacgccgacagcgagacgaactcggtgcccggaacgacgacctgcgacgggcaggccgcctcgaagaccgggcagggcaccgaattcacctggatccagaacacggcccgcaacgccggagcgatcggcgtcttctactgggaaccgacctggtatgcgatcgccggaaacggctgggacccggcgaacatcaacggcaccggcgacggctgggacaacatggccgctttcgacgccaccggccggtggaactcctcggtgaagtggaccgcctga

SEQ ID NO: 5787 - DNA, 1059 bp, Actinoplanes utahensis
atgaaattcgccgcactactggccgccgccctcctgctcccacccaccccgccacacgccggcctcgccatgcacggtgccgacgtgtccaccctgccccgcgcccaggacctcggcgcgaagtactacgacaggcacgggcaccgggccgacccgtacgagatcctccagcggtccggggtgaactacgtccggctgcgcatctggaacaacccgaccagcggctacaacaaccgggccgaggtggtggcgcaggcccgcgaggcccggcggcacggcctcaaggtgctcatcgacttccactactcggacacctgggccgatccgggcaagcagttcatccccgccgcctgggccggtcacgacctcgaacaactgcagaaggacgtctacgactacacgtacgacgtgtgccgggccacccggcccgacagcgtgcagatcggcaacgagatcaacaccgggctgctgtggccggccggtcaggtggacgacagcgacttcggcccgctcgcgtcgctgctcaaggccggctacaccgcggccaaggcgtgcgatccacggacccgggtgctgatccacaccgcggacgccggcagcatcgacgcggcgcactggttctacgacggaatcgcggcccagggcgtgcgatgggacgtcacggcgctgtcctactactgcatgtggcacggggacctgacgaatctggcgtcggtcctcaacgacctgcgcgaccgttacggcaggccgacggtgatcgccgaaaccgcctaccccttcaccaccgacaaccacgaccacctggcgaacatcatcacctcggcggcgccgtgcgacgggattcccgcgtcgccgcggggacaggcggagcaactgcgccgggtgcaggacgtggtgcgcaaggccggcgggctgggcgtcttctactgggagccgacctggaccgcggtcgacggcaacggctgggaccccgaggacatccagcattccggagacgcctgggagaacatggcgaccttcgacttccacgggcggatcaacccctacatccgcttctga

SEQ ID NO: 5788 - DNA, 1032 bp, Actinoplanes utahensis
atgatcccgaacgtgtcgcgcaaacgcccaacgatccgcgatgtcgctcgcgaggccggggtgtcctatgcgacggtctcccgggtgctcaacgggcgcgactgggtgagcccggaggcggtgcgctccgtccaggacgccatcgcccgcaccggctacaccaccaaccagcacgcccgctcgctggccaccggccgttcggggtcgatcgccttcctgctcaccgagccgcagcacctgctcttcgaggacccgaacttctcggtgctgctgcgcggcgtggcccaggcgctctccgaccgggagcagaccctgatcctgatgatcgcctccacccagcaggagcgcagccgcaccctcgcgttcctcaacggcggtcacgtcgacggcgtgctgctggtctccccgcactccggcgacccactgctccggcagctggtgcaggcccaggtcccgatcgtggcctgcggccgggtgctcggcctggaggagatgatcagctcggtctcggccgatgaccgggccggcgcccgcagcgccaccgagcacctgatcgcggccggccgccggcggatcgccaccatcaccgggccgatggacacctccggcggtgtcgaccggctggccggttacaccgacgcgctgctggcccacgacctgccgatcgactcggacctgatcgtgcacggcgactggagccgggagaccggcgcggccgccatgcgcatcctgctgagccgggccccggacgtggacgcggtgttcgccgcgtccgacgcgatcgccgcggccaccctgccggtgctccgcgacgccgggcgcgcggtgcccggtgacgtgcgggtggtcggcttcgacgactccgggctggcggccaccaccgaaccgccgctcagcacggtgcggcagccgctggaccggatcagcgaggagatggtccgtctcctcgtcgacgtgatcaacggccggacgccgctctccatcaccgtgcccaccagcctcgtgctgcgggcttcctcaccgggttcctga

SEQ ID NO: 5789 - DNA, 828 bp, Actinoplanes utahensis
atgaagaccggtaggatcgccaccaccctgctgctgctcggcgccgcgtactgcctgttcccggtgatctgggtggtgatcgcgtcgagcaagagcgccggggagctgttcgccaccttcaccctggcgccgagcacccacctgttcgacaacctggccgacctgagcgactaccgcaacgggctgtactggcgctggatggccaacaccgccctgtacgccggggtcggcgcgggtgtctccacattcatctcggcgatgagcgggtacgcgctggccaagttcgacttcccgggcaagggcctcgtcttcaacgtgatcctggccggtgtcctggtgcccggggtcatcctggccatcccgcagtacctgctgctggcgaaggtggggctgaccaactcctactgggcggtgctgctgcccagcttcatcagcccgtacggcatctacctcgcccggatcttcgcggccgccgcggtgcccggcgagatcctggaggcgtcccggatcgacggggcgggcgactggcgcaccttcgtccgcgtggtcctgccgatgatgcggaccgggctggtcacggtcttcctgttccagttcgtcgcgatctggaacaacttcatgcttccctacatcatgctgggcaacgacaagctgtacccgctcacggtcggcctgaacgggctgctcaaccagggcgccagccagccgtcgatgtacacctcggtgatcaccggcgcgctggtgtcgatcgtgccgctgatcgccctgttcctcactctccagcggtactggcaggtcgacctggccgccggtggcgtcaaggcctag

SEQ ID NO: 5790 - DNA, 924 bp, Actinoplanes utahensis
atgtcgcgaaccacctcagtcaaccgcaccgccggcgtcccgtacgccttcctcgcgcccggcctgctgctggtcaccctgttcctggccgccccggtcgcctacaccggctatctgagcctgcgcaaggtgaaggtcagcggcctcggcctgggtgccaggtcacgcaccgaggtgtgggccgggctgagcaactacgcccggtcgatgaccgaccccgacttcctgcccagcgtctaccggatcctcgggtacggcctgatcgtggtccccaccatgctcggcctggcgctgctgatggcgctgctgctggacgccgggcggacccggccgacgatcggcgccttcgcccggatctcgatcttcctgccctacgcggtaccggccgtcgtggcgtcggtgctctggggcttcctgtacctgccccgggtcagcccgttcagctacgcgctggagcaggccgggatccatcccccggagctgctctcctcgtcctgggtgctgtacgcggtcgccaacgtcgcggtctggggcggcaccggcttcaacatgatcgtcctctacaccgcactgcgcgccgtgccgaccagcctgtacgagtcggcccggatcgacggcgccaccgagttcgcgatcgcctggcggatcaagatcccgatcgtgctgccctcgctgatcatgacattcgtcttctcgctgatcgcgacgctgcaggtgttcgccgagccgatcacgctgaagccgctgagcaacacgatctcgttcacctggacgccgctgatgaaggtgtaccgggacgcgttcgtccgcaacgacatctacgccgcggccgccacctcggtggtcatcgcggtggccaccttcctgctgtccttcggcttcctcaagctcgtcggccgtcgcgcgttcaaccaggaggactga

SEQ ID NO: 5791 - DNA, 1311 bp, Actinoplanes utahensis
atgaagaagacccttgccccgttgctggccaccctgaccgcggcggccctgctgaccatcgccgcctgcagctcgtctgacgacaaagctgacgatacgaccggcaccgggaaggtcgcgctgacctactggagttgggcgccgaacatggacaaggtcgtcgcggcctggaactccagccacccggacatccaggtgacggtcaacaagcaggatggtggcgacccggccgtcaccaagctgctgaccgcgatcaaggccggctccggcgccccggacgtgatgcaggcggaataccagaagatccccactctggtctccgccgacgcgctcgccgacatcgccaaggaggtcggcgggctcaaggacaggttcccggccgccacctggaacagcgtcaccctgggctcggacgccgtctacggcgtcccgcaggactccgggccgttgatgttcttctaccgctcggacgtcttcgagaagaatgggctgaccgccccgaagacctgggacgagtacgccgcggacgcccagaagatccacaaggcgaacgccgagcagtacatcggcaccttctcggcgaccgacgcgggcctgttcaccggcctcgcccagcaggccggcgcgtcctggtggggcgtgaacggccagtcctggacggtcaacgtcaacgaccccgccacccagaaggtcgccgcctactggggtggcctggtggagaagggcgtcgtcgacaacaagccgatgtacaccccggagtggaacgccgcgctcaacgacggctcccaggtcggctgggtctccgcggtctgggcgccgggcgtgctcgagggcagcgccaaggacaccaagggcaagtggaaagccgccccgatgccgcagtgggacgccgccagcccggcgaccggcaactggggtggctcggcgaccagcgtgaccagccagagtaagcaccccaaggaagccgcgcagttcgtctcctggctgaacagcgacccggccgcgatcaagctgctggccaccaccgccaacgtgtaccccgccgcgaacgacgccaccgccgcgctcaccacaccgccggccttcttcgccgaccaggccgacttctacacgatcgcgggtgaggcggccaagcagaccaggccgttcacctacggcccgaacgtgaacgtggcgtactccgcgttcaacgacgccttcggcagggccgccgagtcgaagaaggcggccgccttcaccgcgtcgctggccaccatccagaaggccaccgtggacgacatgaagaacaacggtttcaccgtcgccggctga

SEQ ID NO: 5792 - DNA, 2427 bp, Actinoplanes utahensis
gtgcccgaaccgacggcgccgctctccgtgcgccaccaaccctggacgacgccgctgcgccggccgcggatgagcaacgacgaggacgtccggccgggcgtgtccctcaccaaccgctacctgaccaggaacggcgtcccggtcgtcccggtctccggcgagctgcactacagccgggtgccgcggcaccgctgggccgagcgcctgcgccagatgaaggccggcggtgtcaccgtggtggccagctacctgttctggctgcaccactcgccggcccccggcgtctaccgcttcgacggcaacctcgacgtcgccgcgttcgtcgacctggccgccgcgaccggcctcgacgtggtgctgcggatcggcccgtgggtgcacgccgagagccgcaacggcggttttcccgactgggttcagcaggccccggtccggcaccgcaccgacgatcccgactacctcgcgatggtcaccgagtggttcgaccggatcggcggcgaaatcggcacccgcgagatcctgggcatccagatcgagaacgagctgtacaccgaccccgagcacctgcgcacgctcaagcggatggcccgcgacgccggcctggccgcgccgatctggaccgccaccgcctgggacagcgccgagctgcccgacgaggaggtgctgccgctctacggcggctacggtgacggcttctgggtcgactcggactcgccctgggcgccgaacttccgcgaccactacttcttctcgcacgtctgggacgacccggggatcggcgccgacgtgcgccgcgcgcagaacatcgaggcggccaagggtggcccgcgcaccccgtccgcggagttcccggccgccacctgcgagctcgccggcgggatggcgaccgcgtaccaccgccgcccgctgcccaccgcgctcgacgtggccaccatcgcgcattgcaagatcggcaacgggtcggcctggcagggctactacatgtacgccggcggcaccaacccggccggtccggacggcatgcaggagtcgcacgccaccggctacccgaacgatctgccgcgcctgggctacgacttccacgccccgatcggcgaggccggcgtgctcgcggaaagccacgccgaactccgccgccagcacatctttctgaccgctttcggtcatcagctcgcggagatgccgtccagtctgcccgagacccgcccggacggcgtcgaggacagctccaccctgcgctgggcgctgcgcagcgacggcaccagcggtttcgtcttcctcgcctggcaccagccgtacttcccgctcgacacctaccgcggcgcccgcttccgggtcgacctcggcgagcggagcgtggaattcccctcccggccggtggacatcccggccggcacgctggcccgctggccggtcggcctgaccgtcggcggcgtccggatcgactgggccaccgcctcggcgctcaccgtgctccccggcacggtgcccacgctggtgctgctcgccgaggccggcatccccgccgtggtggccgtttccgatcgggaacacacgcccggcgccgagccgctgcgggtcgagaccgccgacggcgcgctcgacatcctggtgctgccggccgacacggccgcctcgatctgggtcaccgaggccggcggccgccggctcctgctcagcgacgacgaactgcagtgggacgcgaccgggaagatcgtggtcaagaccgctgcgattgccgcggtacgccgttacgacccggccgtccgagccttcgccctcctaccggtcgagcccgcaccccgcccggtcagcgtcgccgtggccaccaccgaggtacgcgccgccaccaccgtgcccgcgtcgtacggcaagcacgacggccgtgcctccgcccccggccgggccgccttcgacgagcacgccgcggtccacgagctgcacctgccggactgggccgccgaccccgagcaggacgccctgctgcgcatcgactgggccggcgacgccggggagctgcgcctcgacggcgtaccggtcaccgaccggttctgggacggctcggcctggcaggtcaacctggtcgacgccggctaccgggccggcgcccggctcaccctgcacctgctgccgttggccaccgtctccagcgtcgcgctgccctcggcggcccgcgaccggctggtcgccgccgggtcccagctgctcgccgtcgacgcgatccgggtgaccggccgccgcgtgacgaccgagcgggtggacgagcacccggtacgcaggacgtcgcggcggatggccgacggccgggagatcatctacttcgacgacgtctccgcgggggtcacccgggaggcggtcgacacccggccgctgccaccggccgaggaggtgctccggggcggggcgcaggtccgctacgaccgctga

SEQ ID NO: 5793 - DNA, 360 bp, Actinoplanes utahensis
atggcggcgcaccgcaacgaccggaccttcatgccaccggccgaccgggacccgctcgccccgaccgggccgggcggcttcccgaccgagatcgccgaggccgactacgacgtggtcgtcttcgagaaccggttcccgtccttctcaccccgcaacgggggcaccgcggacctggtcgacggcgatccgctctggccggtgcggcccgcgaacggacgtaccgaagtcgtgtgtttttcgtcggccccgaaggggtcgttcggcggtctgagcccgcgccgggcccggaccgtgctggacgcctggatcagcgacaccacccccgagcggaccgccgcccgcctgcgccggatcgggtga

SEQ ID NO: 5794 - DNA, 243 bp, Actinoplanes utahensis
atgacggatgaggacgacctcgccttcgcggcggtgcgggcccgggtgcgggccggcgagtgcctggctctctaccggcacgggttctccctcgcgtcgtggctgcggcggtgggtgcggggagagctgtccctgcccctgctgatcaccgacgaggagaccggcgtctggcgtcacgagacggaggccgaccgggcgaccaggccgggcggccgtcccggggccgcggggacggccatctga

SEQ ID NO: 5795 - DNA, 432 bp, Actinoplanes utahensis
gtgttcgacgacaacggctcgttcctcctggcaaccctggagttcttcgtcttctgcgcctggttcatgtgcctgttctgggtcttcggcgacctgttccgcagccgggacctgggcggcggcgccaagacgacgtggaccgtcttcctgattctcctgccgatcatcgggatgctgacctatctgatcgcccgcggccacgacatgtccacccgggccctcgaagcccaggccgacgcccgggcccggcaggacgcctacatccggacggaggccggctcgggcaccgccggccccaccgccaccgaacagatcaccacggcgaaggaactgctcgactccggcgccatcgaccggatcgagtacgaacagctcaaagccgaggcgctgggcacgaaggcgccctcgaccaccgccaccggctcccactga

SEQ ID NO: 5796 - DNA, 846 bp, Actinoplanes utahensis
atgaccaagcaggcaccgcgcagcgatcaccgggccgcgaccggcccgggcacaccgcggatgagcgagaaggagtaccagcgcgaactccgccacctgcacggcgaactggtcgccatgcagcactgggtgaagaccaccggcgccaagatctgcatcgtcttcgagggacgcgacaccgccggcaagggcggcaccatcaaggcgatcaccgaacgggtcagctcccgggtgttccgggtcgtcgccctgccggcccccaccgaccgggaacggtcccaggtgtacctgcagcgctacgtgccgtacctgcccggtgccggcgacgtggtgatcttcgaccgcagctggtacaaccgggccggggtggaacgggtcatgggtttctgcaccgacgaacaggcccggcagttcctgcaggcggtgcccgccgtcgaacgcgcgatcgtggactccggcgtcatcctggtcaaatactggctcgaggtcagcccgagggagcagacccgccgcctcaagaaccggatcgacgacccgcgcaagacctggaagctctccagcctcgacctcgactcgtacaccaggtgggacgcctactcccgggcccgggacgagatgttccgggccaccgacaccccgtgggcgccgtggtacgtcgccggcaccgacgacaagaagcgcgcccggctcaacatcctcacccacctgctcagcctggtgccctacgaaccgatgccgccgcacgccgtgaaactcccccggcggtcggagaagaacgacgacgagcggtcaccggtcgccgtccggcacatccccaccccgttcggcgatccgccccggagatga

SEQ ID NO: 5797 - DNA, 2037 bp, Actinoplanes utahensis
atgggcgttgatcgacctattgacgtcgctgacccggccgcggtgcactacgacgacgaggagcggccggcccgggagctcaccgggcgtgtcgcgctggcggtcgcggtggtcgcggccggggccggggtgctgacgctctggcaggtgttccggccgctggcgcagggcagccagttctacctgatcgtctttctggcggtgacgctgccgctgatcttcgtcgcctaccgggcgcgcgccgcgagtccggggcggccgagccggctggactgggtgctgggcgggctggcgctggccgcctgtctctatccgctcaatccgttcggcggcggctacgacgctttcctcgaccggcaggcgctgctcgaaccggccgacgtcgccttcggcgccgttcttctgatcacggtgctcgaggccgcccggcgcaccaccgggttcgctcttcccgcggtctgcgccggattcctggcgtacggctactacggcggcctgctgccccagagctggccgatcgcgcattccgggctggacttcgcgcagatcgtcgacgccctctacaactcgggcagcggcttctacggcaccccgctggacgtggccgcgacgtacatcgtcctgttcacgctgtacggggcggtcctggacctgtccggggcgagccggttcttcgtcgacctgtcggtggccgcgttccgccgctcgcgcagcgcggccgggcggaccgcggtggcggccgggttcctgctcggcacggtgtccgggtcgggaaccgcgaccgcggtcagcgtgggggcggtgacctggccgatgctgcggcgggccgggtatccgccggagcaggccggcgggatgctggcggcggccggggtgggcgcgatcctgtcgccgccgacgctgggcgcggccgcgttcatcgtcgccgaatacctcgacgtgtcgtatctgaccgtgctcggctgggcgacgatcccgacactgctctactacctcgggatcctgctggcggtggagatcgacgtacgccgcttcggggtgcgtgccgtcgatctcccgcaggtcggtgccgggcggctgctgatccggttcggctaccacttctcctcgctgatcgtgatcgtggtgctgctcgcgctcgggacgagcgccacccgcgcggtggtctacgccaccctgctcgcggtggccctgtcctttctggaccgaccgggccggctgaccccgcggcggctgttccaggcgttggcggccggggtgcgcggggtgctgccggtggtcgcggtatgcgccgcggccggcgtgatcaccgcgatcaccacgaagaccgggctgggcgcgcagctggcgtcgctgctggtcgacggcgcccggtcgatcaccggcaacccggccgcggtgctggcgctgaccgtggtgctggccgcggtggcgctcgccgtgctgggcctcgcggtgccggtcaccgccagcttcatcatcggctgggtgatcatcggtccggcgctgctcgggctcggggtcggcgccccggcggcggccatgttcgtcttctactactcggtgctctccgaggtcaccccgccgaccgcactggccgcggtcggcgccgccgcgatcaccggcggccgggcgatgggcaccatgtggcaggcgttgaagtacgcactgccggccttcctggcgccgatcgcgttcgtgctcaccggcaacggtgaacatctgctggcccgcggctcctggccgggcatcgtggcgaccgcggtggcgtccggcttcgccgtgttcgggctggcgatcgccaccggcggctgggtgccgggagtcggcccggccggcccggcgagccggctgctgggcggggtcgccgggctgctgctgctctacctctcgtggctcgcggtgagcgccggcctgggcgtgctggcggcctcggtcctgctcgcggcgatcgcccggtggcggtcacgagccgagcccgccgtgccgccggatacggaacctcgacattcacggaggatcggagggaaccgatga

SEQ ID NO: 5798 - DNA, 1002 bp, Actinoplanes utahensis
atgagacggatcatgaccgcggcgtcgatcgccgcgctggccctggccgccggcgcgtgcggcggccggcagcacaccgcggccaccgacaccggcggcgacgtcacctgtcaggtcgcccggcagacccggatcgggatcgccaccggcaacgccaccggggtgtacttcgcgctgggcaacgcgtacgccgagcagatcaacgcggccggcggcagggtgcaggcgaccgccgcggagaccggcgcctcggtgcagaacatccagcagctggtggccggcacgtacgacgtggcgttcgcgctggccgacaccgcggccgacgcgatcaacgggacggccgccttcagcgcgaagcagccgatcgcggcactggcccggatccacaccaactacacgcaggtgatcgttcgcaaggcggccgggatcagggacgtcgccgggatgcggggcaagcgggtctccaccggttcgccgaagtccggcaccgaggtgatcgccaaccgggtgctgaccgccgccggtctcgacccggccagggatgtcagcgcccagaagctcgacctgaccaagaccgtcgacgggatgaaggagggcaccatcgacgcgctgttcttctccggcggactgcccacgccgggcatcaccgacctgctgaccaccgcgcgggaccaggtggagttcctcgacatcaccccggtcctgccggccctgcagaagatcaacgaggtgtatcggcagggggtcatcccggccgcgacctatcagcagccggccgacgtgacgacgatcgtggtgccgaacctgctgctggtgcgcgccggcctggacccggacgtggcctgcgtgctgaccaggacgctgttcgaacggcagccgcaactggcgcaggcgaacgcggcggcccgggagatcagcctggacaccgcgcgccggaccagcccggtgcccctgcaccggggggcggagaaggcactcgacctgctgcacgcgccccggtga

SEQ ID NO: 5799 - DNA, 498 bp, Actinoplanes utahensis
atgagcgaccgtgacgaggcgttcgcggaatacttcgcggcccggtcaggcagcctgcgcgccaccgcgtatctgctctgcggcgactggcatcgggccgaggatctggtctcgaccacgttcaccaagctctacctgcggtggggccgggtgaaccgccaggagtcgctggatccgtacgtccggcaggtgctgatccgcaccttcatcgacgagggtcggtggggctggtggcgacgggaacgcccgcacgacaccctgaccgaccgtcccgtcacgcccgcggtgcagaccgaggaccgcctggtcctgctgcgggcgctggccgaggtgccaccgagacagcgcgcggtgctggtgctgcgctactggcaggacctcagcgtcgaggagacggcggcggcgctcggctgctccgccggcacggtcaagagccaggccgcccgtggcctggcgacgttgcgcgcgctgatcggcgcgcccgtgacggctgattga

SEQ ID NO: 5800 - DNA, 852 bp, Actinoplanes utahensis
atggaggagaacgaattccgcgaggcgctgcacagcgtgctggcgcagagccccgaaccgccgccgatgcggtcggccgaggcggtcgcggccgggcgccgggcctcccggcggcgcaccgtggtcgcctgcaccggggcggtcgccgcgctggccgcggtcaccatcgtgccggcccgctacctgtccgccgcgacgtcccccaccgggtacgacgccgcggcgccggccggcacgcccagcgtgctgaccaccccgccgccgagcggggtgccgtccccgcaggacaccgaaccgtcctggccggccgagaacaacggcgacgccacggccgacagcgggccgcgctaccagaagggcaggcaactgctcaccgacctgctcaaggtggtgccgtccggatacaccaccccgaccggcaccacgccggacggcagcgacctgcagtccagccaggccgcgctcgacgatccggagtggacgtacctggccagcgtgaccgtggcccagggcggccacaacggtgagctgatggtcgaggtgcacgagaagaacaacaggctgcccaccgacccgtgcgggttggccgagtcgttctgggggctgggcggcagttgccaggtggtccgggacgggccggcgaaggtcgcggtggccaggtcgaacggcggcggcgacaaccggatcgaccagtgggcggcgtaccgttatccggacggggtggtggtgttcgtggcgcagaccgggcgacccacctacgccgacgcgcgcgcggcgaaactgaacccgctcccgttcaccgccgacgaactcggcaagctcgcgctcaacccgcggttccacctgaggtag

SEQ ID NO: 5801 - DNA, 1344 bp, Actinoplanes utahensis
atgaccgccgtgacccagccccgcatcatcaccttccgtcgatctatccgcgtcgcgcgggtcgcgatcgtcgccttcctcgtgctcaacgtcgtcgtcgtccaggtcatgttcgccgcggccggcccggcccggaacctgcccggcacgatcggccggctcctcggactccacctggccctcgcgctcgccctgcaactgctgctggtcgcccgcctcccggtcgtcgaccgggcgtacggcatggaccgcctcaccacctggcaccgctggaccggcctgacgatcttctggctggctctggcccaccccgcgttcgtgctgctcggcttcgcccgcctcgaccgggtcccgatcctcgacgagacggtcaccctcgccggccagctgccggtcctgctgggcatgatcgccgtcggcctgctgctcgtcgtcgtcggcctgtcgatccgcgccgcccgtcgccggctctcctacgagacctggcacttccttcatctgctgatgtacgtcgtgatcctgctcggcgtgctgcaccagctgtccgagggcaccgcgttcaccgtcaacgcgttcaccgaggcctactggtggggactgtgggcgttcgccctgggcgcgctgctcgccggccgcctgatcgtcccgctgatccgcaacgcccggcaccggctgcgggtcgccgccgtcgtcgacgaatccgcggacaccgtctccgtccacatcaccggccgcgacctggaccggctcgacgcccacgccggacagttcttcctgtggcgtttccccggccacaacccctggtggcaggccaacccgttctccctgtccgccgcgcccaactcccgatcgctgcgcctcaccgcgaaaggcgtcggcgccaccagcgccggcctgcgcgacctgccgcccggcgcccgggtgtacgccgaaggcccgtacggcgcgttcaccgccgcccaccgcacccgcgccgccaccgtcctgatcgccggcggcatcggcatcaccccgatccgcgccctgctcgaagaccccgagctgaccggccacatcatcgtcctctaccgggtccgcaccgcgaccgacgccgtcctgctcggcgaactgcgcaacctcaccgacacccggcacgcccggctgcacctgctcgccggccgcagcggcaccggctaccggccgttcgccccggaccgcctgaaagccctgatccccgacatcaccgcccgtgacgtgtacgtctgcggccccgacgcgatgaccaccggtgtcctggacagcctgcgccggctacgggtaccggcccgccaggtgcacgcggaacgcttccggctcgccgggtga

SEQ ID NO: 5802 - DNA, 243 bp, Actinoplanes utahensis
atgcccatcacgacagaggtgtaccggcgcgcgaccgaaacggtgaccgtcatggcgtccatcgacgacgagggagccgagatccgcgtcatccacgaacgcgacggcgaggtcctcaccgacacgatcccggagtggggcgacgacccgcaagcgggacggcggtgggtggcccggcatcgcgaggcccgcctcgccgagggctatcagctcgccgaggagaccgagggcccgccccggtag

SEQ ID NO: 5803 - DNA, 540 bp, Actinoplanes utahensis
atgacgtgcatcgtcgggatcacggacgggcggaccgtcaccatcggcggggactccgcgggcagcgacggctggcacgtcgccgtccgttcggactccaaggtcttccaggtggggccctacctgatgggtttcaccaccagctaccggatgggtcagctgctgcgctactcgctggccgtcggtgaacccgacacctgggacgtcgaccggttcatggtcaccacgttcatcgaagccgtccgcgagtgcctctccacgggcggctacgcgcgcaccgagaacggccaggagcagggtggccagttcctggtcggcattcacggccgcctctacgtcgtcgacgccgactaccagatcggccacaccatctccggctatgccgcggtcggatccggctacctggtcgccctgggctcgctgcactccaccgccaagtccccgatcagcagccggcaacgggcggagatggccctcgaagcggccgccgacctcaccgagggcgtgcggccacccttcaccgtggtccagtcggagtga

SEQ ID NO: 5804 - DNA, 300 bp, Actinoplanes utahensis
gtgatcccgacgatgcacgtcatgacgacactcttcacggccggcagcccggtgccaaccgtgatcggagaacgcgatcacgccggcagcgcgtcgacgtgtcggaggattcccgccgccgacggcacccggctgctcaccgtgcacccggcacaggtgaggagacaatggagcactggccgcctgtacgaacacctgcggcccaccctcactctcgaccggatcatgcccgccgacgaagcggattcctggctcacccgagtccagcccgcccgcgaacccgacatgttccaggtctag

SEQ ID NO: 5805 - DNA, 795 bp, Actinoplanes utahensis
gtgagtgcgaggttgcgggcgatcgcccaggagacggtggggatcgcggagcgcggccactacgacgggccggacgggcgggtggagatcgccgggcaggtggcgcgggcggtggcggggacccggctgcacctgcccggggaggacctgggcgagccttccgtcgacaacccggcgccgctgatcgagatcaccggggagtcgacgctggtggcggcgcggcgggccggtggggttccggcggtgctgaacttcgcttcggcgcggaatccgggtggcggcttccgcaacggcgcgcaggcgcaggaggagagtctggcccgcgggtcggcgctgtatccgtgtcttctcgcggccggcgagttctacgaccatcatcgggccgagcggtcgctgctctacaccgaccgggtcatctacgcgccggcggtgccggtcttccgcgatgacaaggggcggctgctgtccgcgccctatccggtgtcgttcctggtggcggccgcgccgaaccgggcggcgatccggttgaaccagccggagcacctgccgcgggtgcggccggtgctggcgcgccgggcggcccgggtgctgcgggtcgcggccgcgcacgggcaccgggatctggtgctgggggcgtggggctgcggtgtgttcggcaacgatccggccgaggtggcggcggcgttcgccgaggcgctgcgggcgagcccgtggttcgaccgggtgatcttcgcgatcctggaccgggacgagagggtgcgcgacgcgttccgccgggcactgccaccccgctag

SEQ ID NO: 5806 - DNA, 1689 bp, Actinoplanes utahensis
gtggctcatgcgtaccgccgccatcgaagcggcccgggccgtcggggacctggccggtgcggcgctcagcaggcgccggaggttgccgaatcatctgatatgaagcggttctgggcggatctcagcgtcaacgtcaagatcatggcggcgatctgtgtcgccgcggtgatcgccctggtcatcggggtgaccgggctgagttcgctgaaccgggccagcaacaccgcggacgagatctactccgacaacgtgaccagcgcgtcagtgctggggcggatccagaccgcgatcaaccaggctcggctggacctggtgaaccacgtgatctacaccgacgccgcgaacaaggcgaagtatgagcaggagatcacgaccgacttcgatgacgtcgccacggcgctcaaggattacgcggccaccgatccggccggcaccccggtcatcgtggccagcctgaacgacacctggcagaaatatgtcgacgtcgcccagagccagctgatcccgctgtcccgggcgaacaaggtgacccagtggcagcaggtccgggccgatcaggtgttaccgctggtggatacgatcaaggcgaacctgggcgatctcaacaaggcggaacgggccgacgcggaaagcgccgcggagggggcgcgcacctcgtaccggcagaaccggctgcagcagatcgtcatcctggtcgtcggcatcgtggccgccctgctgctgggcctgatggtggcccggggcatcgtgcggtcgctgcgccaggtgaccgcggtgtgtgaggcgctcgcggccggcgacctgacccgcagcaccgggatcacctcggccgacgagccgggccggatgagccgggcgctggacgccgcggtgcagcggctgcgcgacgcggtcagcaccatcggcgagtcggcggtcaccctcgccggcgcctccgaggagctcagcacggtcagctcgcagctgcagagcggcgccggcgacgtggcgcagcaggccacctcggccagctcggccagcgacgaggtcaacgtcggcgtccagtcgatcgcggccggtgccgagcagatgagcgcgtcgatcaccgagatcgcctccaacgcggccgaggcggcgcgggtggccaacgaggggatgagcgtggccgagcgcaccaaccagcaggtcgccgagctgggcgcggccagcgccgagatcggcgacgtggtccggctgatcacctcgatcgccgagcagaccaacctgctcgcgctgaacgcgaccatcgaggcggcccgggccggcgagctcggcaagggcttcgcggtggtggccggcgaggtcaaggagctgtcccagcagaccgccaaggcgaccgaggagatcaccgcgcggatcaccgcgatccaggcgtcgagcacctcggcgaccgcggcgatcggcgagatcaccgaggtgatccagcggatcggcgactacaccacgacgatcgcgtcggcggtcgaggagcagaccgccaccaccggcgagatgagccggtcggtggccgaggccgcggccggcagcggcgaggtggcccggaccgtcaccaccgtggcggaagtggcggccgccacggccgagggggcccgcaccacgcagcaggccgcggcagacttgacccggctggccggcgatctgaccacgctcgtcggcggcttccgccactag

SEQ ID NO: 5807 - DNA, 510 bp, Actinoplanes utahensis
atgagaaccgatctctacgaccgtctcgccgatcccgcccgtctgatcgagctggcccgctacgacctcggctcggaccggctgcgcgccgccctggacgaggtggcccagcgcagcgccaaactgctggacgcgccggcctcgctggtgtcggtgctgggcgcggacgcccagcagatcatcggggagtacgggctgggcgactgggtcgcggtggcgcagggcgcggccgccgagtgggcggtgtgcagccggaccgtgctgaaaggcgagccgtactgcgtcgccgacttcagcgacgacccgcagtacgcggccaacccgttcctggccaccgccgggctgcgcagctatttcggggtgccgctggtgaccccgggcgggctgatgctcggggcgcactgcgtggtggacacccggcggcgcatctacaccggggtggacctggcggtgctcagcgacagcgccgacgaggcgatggaggcgctgctgcggcaccggcgcccctag

SEQ ID NO: 5808 - DNA, 627 bp, Actinoplanes utahensis
gtgacgacagaggacttccccaccgccggcgacgtccgcgccgtgacccggcgggcggtcgccgcgctgcgcaccgtcgcggccgaggactggcacgccaccactgccggcgatctcacctggagctgctgggagacggtcgagcacgtcgccgacgacctgttcgcctacgccggccagctcgccgccgaccggccgccggtcgaccggtacgtcgcgtggggctggcggaggtcccggccggacgcccccgcgctgaccgtccacgccgaccccgagcagggcaccgagggcctgttgcgggtcctggaggcggccggcggcctgctcgccgcggtcgtcgaggtgagcccggccgaccggcgcggcttccatccgttcggggtgtccgacgccgccgggttcgccgcgatgggcatcaccgaggtcctggtccacctgcacgacatcgcggcgacgctgaagttcgactggacccccgatccgggcgtgtcggcccgggtgctggcccggatcttcccggacgccccggccggccacgagccgtggcccgccctgctctggtgcaccggccgcatcgagctgcccggccggtcccgccggaccgcatggcggtggcacgcctag

SEQ ID NO: 5809 - DNA, 396 bp, Actinoplanes utahensis
atgggagaacccgcaacgccgatccgccggcgcatcgagctgtccatcgccgagacccgcctgcgtttccagcagctggtccggctcaccggcctgaccggccaggtgaccgtggtggtcgacggcggccgcccgatcgccgccatcgtcccggccgccgacgtgctgcggccgccgtcaccgcccgatccgcccggccggtccggggcgggctggctgcagcgcatcgagaaggtgcgcgacgacgtccgccgccagcacgccggccggatccaggagctgtcccaagccttggacgaggcgtggcagatgctggaccagcggcatccgccgggcaccgaccggcacgtcgacgcgctgcgtgcggcacagagagacgtgcgccgcacccggtga

SEQ ID NO: 5810 - DNA, 1062 bp, Actinoplanes utahensis
atggcgcgccagctcgatctgttcgtacccgggatggtgttcctcgatgtcatcttcaccggcctgcgggagctccccgggcccggcaccgaggtgcgcgcctccgggatgggctcgtgcccgggcggggtggcgaatctcgccgtcgccgccagccgcctcggcctgcgcaccggcctcggcaccgcgctgagcaccgacgcctacggcgaattctgtcaccaggtgctcagccggcaggagggaatcgatctctccgcatcccggcggctggacggctggcactcgccggtcaccgtctcactggcctacgaccgcgaccgcagcatggtcacccacgagcatccgctgcccaccgacgacgagggcctggtcaacggcctgcccccggcgctggccgcggcggtcagcctgggcggcccgggcaccggctgggtgccccgggcggcgcggaacggcacactgatcttcgccgacgtcggctgggacgagaccgaccagtggtccttcgacgcgctgtcggtgctgcccgactgccacgccttcctgcccaacgcggtcgaggcgatgcgctacacccgcaccggcacccccgccgaggcgctcgacaaactggccggcctggtgccgatcgtggtggtcaccgacggctcggagggcgccctcgccgtcgactcggccaccggcgaggtcgccaccgtgccgggcgtgccggtcgaggcgctcgacccgaccggcgccggtgacgtgttcaccgccggcttcatcaccggcaccgtcggcggctggccgctcgccgaccggatcgccttcgccaacctggtcgcggcgctctccgtgcagcacttcggcggctcgctctcggcgcccggctggggcgacatcgccgactggtgggaggtcacccggttcgccgcgcagagccggcaccccgagtccagcgagggcgagttggcccggcgctacgcgttcctgcccgaggtgattccgcccggccggcgcaacgccgtgcatcgggccaccgccaccatcgcccggctctccgacgcgcatgccggctga

SEQ ID NO: 5811 - DNA, 870 bp, Actinoplanes utahensis
atgccggctgaccgtcgcgacaccctggccgggtgggcgttcctcgcgcccagcctggtcggcgtcggcggtttcctgctgctcccggtcctggtcgtggtgggcatcagcctcacccggtgggacctggtcagcccggcccgctgggcggcgctggacaactactcctcgatcctcaccgacccggcgttcggccgctcactcgccgtcaccgcggtcttcgtgctgctggtcatcccgctgcagaccgggctcgggttggccgccgcgctgctgctcgaccagcggttgcccggctccaccgtcttccgggcgatcctggtgctgccgtggatcagcgcgccgctggcgctgggcgtcgtctggcgctggctgctcgacccgtccgacggcgcggtgaaccagctgctcggccaccgggtcgagtggctgaccagccccgccctggcgctgcccgcggtcgccgcggtcaccgtctggaccaatgtgggctacgtggcgctgttcttcctggccggtctcgccgggatcccggcgcagtacgccgaggcggcccggatcgacggcgccggcccgtggcaggcgttccgccggatcacgctgccgctgctgcggcccaccatgttcttcgtgctggccaccggggtgatcaacagcttccaggtgttcgacacggtgtacgcgatgacccagggcggcccggccgggcgcaccgaggtggtggcgtacgcgatctaccgggaggcgttcgtcgacttccggatggggcgcgccgcggccatgtcggtgctgctgttcctgctgctgatcacggtcaccgtggcccagcagtcgtatttccgccgccgcacgacctacgaggtggggtga

SEQ ID NO: 5812 - DNA, 816 bp, Actinoplanes utahensis
atgcgccgggccgtgctcacctatctcgcgctggccgccggggccgtgctgatcctcgctccctacctgatgagcgtgcagacctcggtgaagaccgcgcggcagttcgcccagcagccgccgctcgccccgcccgacccgccgaccggggcgaactacgccgagctgatcgtcggcgggcacaccctgatcccaccgctggtgatcaccgtccaggtggtgctgatcgtcgtgatcggacagctgacctgctcggtcctcgcggcgtacgcgttcgcccgcctcgacttcccgggccgtgacgcgctcttctggctctacctcgccaccctgatggtgccgatcgtggccgtcctggtgccccggttcgtgctgctcagtcaggccggactgaccgacacgttctggggcatcgtgctgccctcgatgttcggctcaccgtatgcgatcttcctgctccgccagttcttccgggccgtcccgcaggagctgctggacgccgcccggatcgacggcgccggccacccgcgggtgctgcgccacgtcatcgtcccgctgagccgcccgatcctggccaccctgctgatcatcacggtggtcacccactggaacgacttcctctggcccctggtgatcaccagcggggtgcgctggcaggtgctcaccgtcgcggtcgccggcctgcagagtcagtaccacggcaactggaccctggtgacggccgcgaccacgctcgccaccatgccgttgctgctgatcttcgcgatcttccagaaacacatcgtccgatcgatcaccatcaccgggatgaggtga

SEQ ID NO: 5813 - DNA, 1236 bp, Actinoplanes utahensis
atgcgacggttcctggcgttcctgatgatcctggcactggccggctgctcggtcgccgacaccggcgacagcggctccggcaggacgacggtcaccttccggctctgggacgaccaggtggccgaggcgtaccagcagtccttcgccaccttcgagaaggcacaccccaccatccacgtcgacgtgcagctggtgccctgggccgactactggaccaaactgccggccgacatcgccgccggcaccgccgccgacatcttctggaccaacacctccaatttcgggttgtacgccgacaacaggcaactgctgcccgtcgacttcaccggggactggacgaaatccgtcgtcgacctctacacccggggcggcaccctgtggggcgtgccgcagctgtgggactcgatcgccctctactacaacaaagacctggtcgccaaggccggcgtcgatccggccacgctcagctgggacccggccgccgccgacgacccgctgcgcgccgccgcccgcaagctcaccgccgcgaacgcgttcggctacaacgccgccttcgaccagcaggcgatcctctgggacttcgtcggttccaacggcgggacctggcagtccggcgacaccttcgacttcgccgaccagcccaggacggtgcaggccgtgcagtacgtggtggatctgatcaacaagtaccacgtggccccgtccgcggcggacaccaacaccaacggcgacaagaccacccagctgttcacccagggcaaactggcgttgttccaatccggaccgtacaacctgaaggccatccagcagggcgccggcttcccgtgggggatcgccccgctgccccagggcccggccggacgggtcagcgtggtgcacggcgtcgccgcggtcgcctccgccaagaccccgcaccgggacgccaccgtcgaggtgctcaagtggatcggctcggccgacggccagaaaccgatcgccgagggcgggtatgcgttccccggcgtgaccgccgcgcagcccgccttcgtcgactactggcggaaacggggcgtcgacctgaagcccttcctggacgcggcggccggcaccaccttccccgcaccggtcggtccgcgcgtcggggcgggtggcaccgcgtacacgccgatcctgcaacagatcttcctcggacagaccggcgtcaccgacggcctgcgcaaggcccaggacgccggcaacgcggcgatgaaaggctga

SEQ ID NO: 5814 - DNA, 1311 bp, Actinoplanes utahensis
atgcggttagtgatcctcggtggtggcggattccgggtgccgttggtttaccgggcgctgctggccgaccaccggcagaccggcatcaccgaggtcgccctgcacgacgtcgaccccggccggctgcacgccatcggccgggtcctgcacgccctcgcccgcgacgtgcccgacgccccgaccgtgcacaccaccaccgacctggacaccgcgctgaccggcgccaccttcgtcttctccgccatccgggtcggcggcctgcacggccgggtcgtcgacgaacgcgtcgcccgcgccgccggcatcctcggccaggagaccgtcggcgccggcggcatcgcgtacggcctgcgctccgtcccggaatcgctgcggatcgccgagcgggtggcggccgtcgccccggatgcctgggtcatcaacttcaccaaccccgccggcctggtcaccgaagccatgtccggcatcctcggcgaccgggtgatcggcatctgcgactcgccgaccggactggtcgaccgggtgctccgggtcctggacgcccccggcgcccgggtcgactacgccgggctcaaccatctgggctggctgtacggcgtgtacgacgcggctggtcgcgacctgctgcccgggctgctcgccgacgaggcgggactggccaccatcgaggaggggcggctgtttcccgggctgcgcgaactcggggccatccccaacgaatacctgcactactactaccacccggtggcgaaggcggacgggccgaccaggggagagttcctggctgagcagcaggaacgctgctatcgggagatgtccgcgggggagccgctcgaagcctggctgcgcgcgtggcgggaacgggaagcgacgtacatggcggacaaccggtcgcagagcggggcgggggacagggaccacgacgaatcccggccggccggatacgagggggtggcgctggcggtgatgcgggcgctggcccgggacgaaccggcggaactgatcctgggggtgcgcaaccggggagtgctcgacgtgctcgacgccgacgcggtggtggaggtgccgtgccgggtcgacgggacgggggcggtgccgcgccgggtgggggcgttgcccgggcatgcggtgggactggtgcagacggtcaaggcggtggaacgcggggtgctggaagccgtgcagaccgggtccgcggcggcggcggtgcgggccatggccgggcatccgttggtcggcgacccggagctggcggggcggttgatcgcggcttaccgcgctgagctgccggagttggcctacctgtcctga

SEQ ID NO: 5815 - DNA, 594 bp, Actinoplanes utahensis
gtggagcaacggtgggccgagctggcacgaaccctgcgagagctggggcggtggcagcacctgtccggggacgccgccgccgaggcggagcgggcggtggcggcgggtgggtatccgttcggggagagcggcggggatcacgacgtccggcggttctggctggacagcgaaaccatggccgagggcggcgtcggccgggtgctgcgggagatggcgccggcgttgcggacgcacggtgtcgacctgcgggtcgaggtggtgactgtgccgctcaccggggccggcgaaggtgactacatcgtgtcgatcaacgggcggcggtgtgcggcctggacccgggcggaccgggcggctgactgctggtgggaatcggcgacggtgcggccactcgcggtcgtcaacgatctgctggccgaggcgggcgcgagggtacggctgttcgcgctgtacgtggggaccgaggacgcgcttgcctggctggtcgatccgcggatcgtcgcggcggtggccgacagcggtctgttccgggagtccgacgtgcccctgctcgccgcgcacgacaccgtcgagcaacacttcctcaagcgtgggtga

SEQ ID NO: 5816 - DNA, 636 bp, Actinoplanes utahensis
atgaacgatggtgaggactggcacgcctggcacacccgctacaccgacccgggctcacccctgtcccggcggctgagactggtccggcaccacatcgccgcgtggctcgacgagcggcccggtgagccggtgtccgtactcagcatgtgcgccggccagggcgacgacatcctcaccgtgctggcgtcgcgcccggacgccggccgggtcaccgccaccctcctggagtacgacccgcgcaacgtcgccgcggcccgcagccgggtgcccgcccacgccaccgtgagcatcgtgcgagccgacgccggcgacctcgcctcgtaccgcgacgcggcccccgcggacctggtcatcatggcgggcgtcctgggcaacatcagcgacgccgacacccaccgcaccattctcgcgctgccccggctctgcgcgccggacgccacggtgatctggacccgctcacgacgagcaccggacctgacaccggcgatccgcggctggctgacccacgccggcttcgccgagcagtccttcaccgccccgcaggacgtgctgttctccgtcggcgtgcaccgcttcaccggcaccccgcagcccctgacaaccggcaggatcttccagttcgtcacccacgcttga

SEQ ID NO: 5817 - DNA, 390 bp, Actinoplanes utahensis
atggtctcccacgtcgctgccggcgccgcctccgtgtccgggtggacaaccctgcgccgggccgcgatcggtgcggggctggccctcgccgcctccctggtggtagccgccctgggccaccccgtcatcagcttctgggacgtcaccctgatcgtctggtcgaccggcgccctgcacagcaacgccgaccaccgccacggccgtgccctgaccaccgcggccctctccgcgaccgtggtctggctcggcatcaccgctctgctcgacgccaccggactgcccaccaccggcgcaccggcgaacctggcccgcgccgtcctcggcatcctggccgccagccagagctatgccctgatcacccgtaccggccaggcagactgtcgtccatga

SEQ ID NO: 5818 - DNA, 1359 bp, Actinoplanes utahensis
atggatctccagcaccgaggcgcgcgggtgggcgggggtggctgtctcgccacgatggcgctgctgatccatgtcggtcatgcggcgcggctctcggtggcggggcagcgggccgaggtcgagtggggggatactggcctcgccgaacggggtgcacggctgtcggtctcggtttgtccgaaagcgggggcggggatgacggcgagtgatgtggtgcggctgctgaccggcggggagttcgacgagctggagcgccggttcaccgcggagatgcgcgccgtcgtgtcggcggagaccgtccgggtggcgtggacggtgcagaccggcggtgttcccggcgagccgggcgaaccggtcggcgagccgttcaccggcgacctcacccgctggcgcgtgccggtccgccatcccgccggcgacttcgtggtggtgatgtccctcgatgcgggcgggcggctgcacgggctgcggctcgccgccgatgcgggcccggcctggcagccgccgcgatacgtgcgcccggagcgtttcaccgagcgggcggtcggggcgcacggtgcgctggtcaccccgtccggcaggagggtgtcgaccgcggcagtcgttctgccgggcggcggggagcaggaccgggacggcacccacgggcccgacaaaccgctcaaagacctcgcgtggggcctggccagccgcggcatcgcggtctttcgattcgacaaacccgggcctgaccgcacgctggtggaggagtacgtgacgcccgcggcgcaggccgtgggcgagatccgggccgccgtgccgtcggtggagcggatcttcctgatcgggcacagcctgggtggcaaagtggcgcccagggtggccgcggccgtgccggagatcgccggtctggtgctgctcgcggccgaggcgatcccgttgcagcggtcggccgagcgggtcacccggcatctggccgcgcgtgatccggggccggccgccgacgcgatgctggccgcgatgcaacggcaggtcgcgctggtcgacgacgggctgacggcgcagactccggcggcggatctgccgttcggatttcccgcttcctattggcttgatctgcgggggtacgacccggtggcgaccgccgtggccctgcggcgcccgatgctgatcctgcagggcggccgcgaccatcaggtgaccgtcgcggatgatctggcgcgctggcgggccgggctcggcggtcgtcgggacgtgaggttccgcgtgctgcgccgggccgaccacatgttccacagcggttccgggcgcgggccgcggcacgtcgacgcgtcggtgatccgcggaattcatcgatggtcgcgtctggcgctgggctga

SEQ ID NO: 5819 - DNA, 336 bp, Actinoplanes utahensis
gtgccgcacgtcgaagtgtccgccgggaccatcgtcacgatcctgggcctgctggtgctggtggcgcagcccggcgcgatcccgttcgcctacgcggtgacgacccggcacgtgaggcggggtggcacccggccgaccctggcggcgatcgtcggctacctgctgggctgcctgttcacgctggtgtgtgtggcgacgttcgcctgctcggacttcccgtggctgtgggcggcgctgctgggatacgtgcccatgtggctgttctcggtcctgatcctgcgacagcccgagatcagcccgggcccggtcgtgcggaccgggcccgacggaagatga

SEQ ID NO: 5820 - DNA, 1155 bp, Actinoplanes utahensis
gtgacgacgctgcaacgccgggaagacaacccgatcgcccacctgaccgccgaggacatcgaggcgatcggccgggaactggacgccatccgggacgaggtgctcgccgcccggggggaaagcgacgccgcgcacatccgccgggtgatcaaggtgcagcgcagcctggagatcggcagccgggcggtgctgctgttctcgctgttcccgccggcatggctggtcggcacggccggcctctcggtggccaagatcctggagaacatggagatcggccacaacatcctccacggtcagtacgacttcatgcgcgacccgaagatccactccaccacctgggagtgggacatggccaccccggccgcgcagtggcagcactcgcacaacgaggtgcaccacaaatacacgaacgtggtgggtaaggacaacgacctcggctacggcatcatgcgggtcgacgagaaccagcgctggcaccccttctacctcgcccagccgctgtggaacttcatcaacgcgctcttcttcgagtacggcatcgccgcgtacgaccttgagctcggcagcaacctgaagaccaagaagcggcgcaacaacccggagttccgggccaacgtgaaggcggtcggccgcaagatccgccgccaggcgctcaaggactacgtgctgcacccgctgctgtccggcccgtcgttcctgcacacgatggccgcgaacttcaccgccaacgtggtgcgcaacgtgtggagccactcggtgatcatgtgcggtcacttcccgaacggcgtctccaccttcgagcgcacctcgatcaagggcgagacccgcggcgagtggtacctgcggcagatgctcggctcggccaacatctccggcggcaagctgatgcacgtcatgaccggcaacctgtcccaccagatcgagcaccacctcttccccgacctgccgagcagccgttacgccgaagtcgcggtcaaggtcaaggcccttttcgagaagtacgacctgccgtacgtcaccgggccgttcccgaagcaggtcgcctcggcgtgggccaaggtcatccggctgtcgctgcccaaccgcaagccgatgccggcggcgaaccccgcgatcccgccgcgcttcccggcggtcgagcccgccaccgcctga

SEQ ID NO: 5821 - DNA, 1296 bp, Actinoplanes utahensis
atggtgatcgcggcgatcgtctgcacggcgacctccgccaggccgcgccgcagcggatcgacgaccgccgcgggcagacggtacgaccggacgtcacgtaacggttcgatcaccagactcctccggtttaaggtcctgctcttgttcccggcgaacaattatggtgcctccgattcacttccgccggtcatgctttcgcccgtccgggccgccaggcttggtcaggtggctgttacacagacattgcgcaacggcgcctggcgtgtcgtcgagttgatcaccaccccggtggtgccgaccgactacctcgacgtgatcgcccccctgcgcaatccgaacgtcctgcgcggccggatcgaggcggtccgccgcgagaccccgaacgcggtgaccctcgacctgcggcccggccgcggctggcgcccgcacgagccgggacagtacgtgcggctcggcgtcgacgtcgacggcatccggctgtggcgggcatattcggtcagcagcgcggcgggacacccctccgggagaatcagcgtcacgatcaacggcgtacgcgacggcgtggtctccgcgtacctgatgaaaaatgcccgccgcggcatgatcgtcaacctggacctgccggccggcgacttcgtcgtgccgcgccagcggccggcgaagagcctgttcgtgaccgccggcagcggcatcaccccggtgatgggcatcctgcgcagcctggtgcacgagctcagcgacgcggtcgtggtgcactcggcgcgcaccgggccggacgtggtgttcggtgccgagctgcgcgcgctggccgcggccggttcgatcacgctgatcgagcggcacaccgcgaccgacggccggatcaagccggccgacctggacgccctggtccccgacctgttcgaacgggagacctgggcctgcgggccgggcgagatgctggacgcgatggccgaccactgggccgaggccggcgccggcgagcggttgcacgtcgagcggttccgccccaccgtgctggtcgccggcgacggcggcacggtcaccttcgagcgttccggtgcggtggtcgaggccccggccggcgtctccatcctcgatgccggtgaggcgtccgggcagctcatgccgtccggctgccggatgggcatctgctacagctgcgtgctgccgatgcgcgagggcatcgtgcgcgacatgcgcgacggacagatcaccaccgccgtcgagggcgacaacgtcctgatccagacgtgcatctcggccgccgccggcccgtgccacctggacgcctga

SEQ ID NO: 5822 - DNA, 1242 bp, Actinoplanes utahensis
ttgttcgccgggaacaagagcaggaccttaaaccggaggagtctggtgatcgaaccgttacgtgacgtccggtcgtaccgtctgcccgcggcggtcgtcgatccgctgcggcgcggcctggcggaggtcgccgtgcagacgatcgccgcgatcaccatggaggtgccggcctacgccgaggcgttcgccggcgagctcggccacaagatcgagcgggccgtgcaggccgccctcggcaccttcctcaacctggtctcccggcccggcaccgaccccggcaccccgctcgcggcggcgctggaggcggcgtacgccctggggcggggtgaagcccgctccggccgcagcctggacgcgctgctctcggcctaccgggtcggcgctcgcgtcgcctggcgcgaactggccgccatcagcgtacgctccgggcagccggccggcaccatcgccgacttcgccgaactggtcttcgcgtacatcgacgagctctccgcggccagcgtcgccgggcacgccgacgaactggccgcctccggccggatccggctgcggcacctgcaactgctcgcccaggccctggtcgccggcgagccgtcgcacgtgctgcaggccgccgccgaacgcgccgagtggaccccgccgcagaccctcaccgcggtgctgctgcccgagcgctcctcacgatcgctgatcgatctgctggatccgcgtacgctgcccctggccggcgccctgcccgacctgcccgggacggcggtgctgctggtccccgacccgcagggcgcctcccggccgcatctgatccggctgctcaccgggcacaacgcggtgctcggcccggcccggccgtggcagcgcgcgcagtgctcggtcgaacgggcggtccgcgtccaccagctgcacaccccgatcggcggcgcggtggtcgacactgaggaacacctcgccgagctggtcgtctcggccgaccgcggggcgctggccgacctgcgtgaccgggcgctggccccgctcgccggggagcgcggggcggccgcggccaagctggtcgagacgctgcgcagctggctgctgcaccacgggcggcgcgaggacgtggccaccgagctgttcgtgcacccgcagacggtgcggtaccggatggcgcggctgcgggaactgtacggggagaagctcaaggatccgcagtgggtgctggcgctgaccatcgccctggccgtcccgccggtcgcggaggcgtag

SEQ ID NO: 5823 - DNA, 1812 bp, Actinoplanes utahensis
atgggcgctcgggctgcacctgccgctgccgttgcggccggccgtcacggtcgtcgcccgggtcgacgcgccctgggagttcgccgtgcaggccgtgctgctggccggcgccgggctgatcgcctccgcggccctgcacgagcgactgatcccgatcagcgtgtcgcccgaccggctgcgcctcggcgggaccgagctggcccgcgccgggatcgcggcgatctatccggacagggacactctgatcgtgctcgaccacgaatcccgcccggcggcccgcggtatcccgcgcgcccggcgcgggacgctcgccgccacgctccgggagttcggatacccctggcgcgacaccgacccgtacgcggatgtctaccggccctggacggccggcgccgacgggctgcccccggccgtcgaggcggtgctcgccgcccgggcggtggccctggaacggaaagccggccgggagaccgcggcactgcgcgacagcctggcgcggctcggccacgtggtacgcgacgagggcgggcggcagttctggcgaccgctggtgcggtcgtgacccgccgccagcgtctcgccgcggcctccggcgagcgggtcttcgacgcgatcgcgatcgtggtgtccgccgtcggcgcggtggcgatcgcggccgaggccgaggccgccgggcggatcggcggcgacgccacgttctacagcctgctgctggcggtggtcgcgtccggggcgctgtggtggcggcgccggcatccggtggcggtggcggcgctgttcgtgccggtcaccgtggccaccgacttcgccggggtggccgcggtgatcgccctctacacgctgatcacccggcggcgcgggtgggtgatcccgctgctgttcggcctgcacctgctcgccgggaccggatacagcctgctgcggcccgacccgcacctgccggccgcggccgagttcgccgtcacgctggcgttcctgacggcgacggcggcggtcgcggtcgccatgcgggcccgccgggacctggtcgacgtgctgcgcgagcgcgcgctgcgggccgaggaggaggcacggatgcgggccgagcggctgcgggccctcgaacgggaacggatcgcccgggagatgcacgacacgcttgcccaccggatctccatggtcagcctgcacgccggggcactggtgatccggcccgacctgacagccgaggagatcgccaggtcggccgcgacgatccgggagagcgcgcacgcggccctggaggacctgcgggagatcctcgggctgctgcgcgccgggccggacgacctgcgcccgcaacccgatctggcgcaggtgggtgagctggtcgcggaggctagggcggccggggtgccggcccggctggacaacggtctcgccgggggcgttgcggggtcggcactcggccgcacggtgtatcgggtggtgcaggaggggctgaccaatgccgcgaaacacgcgccggggatgccggtgcacgtgaccctggggcgcaccggtgacggcatggtgcacgtcacggtgaccaacccgctggaccggccggccggggtccatccggtcagccgggcgtccggggttcacccggtgacccggccggccggggtccacccggtcagcctgccggctccggacgagggtcgtgagccgccgcccggcgcgggggccgggctgatcgggctcggcgagcgggtcgacctcctcggcggccggttcgagcacggggtgcgtcgggagggcgacgaaaggctcagcttccggatggaggcgtggttaccgtggcggatgtga

SEQ ID NO: 5824 - DNA, 648 bp, Actinoplanes utahensis
gtggcggatgtgatccgggtgctgatcgccgacgatgaccggctggtgcggatggggctgtcgctcgtgctcggcgcggaccggcagctggagatcgtcggcgaggcggcggacggggtggaggccgtcgagatgacccggcggctgcggcccgacgtggtcctgatggacatccggatgccccggatggacgggctcgcggcgaccgccgagatccgccggtacggacccgagccggtggtgatcgtgttgaccaccttcgacaccgacgactacctgctcggcgcgctccgcgagggggcgaacgggtttctgctcaaaggcgtcgcgccggaggagatcctggacggggtgcggcgggcgatggccggcgagtcgatcctggcgccctcggtggtgccccggctgatccgccacgcggtgggcgggtccgggcggccccggcgcgaccgtcgcctccagcggctcagcgggcgggagctcgaagtggccgaggcggtcgcgaccggccggtcgaacgccgagatcggggcggaactcaacatgagcgtgccgacggtgaaggcgtacgtgtcccggctgctggagaaactgggctgcgccaaccgcgtgcaggtcgccatcctggtgcacgagtcgcggcggtga

SEQ ID NO: 5825 - DNA, 183 bp, Actinoplanes utahensis
atggacgacgagccgatgaccgccgaggaggcggagctctcccggatcgagcggttcgggcagctgccgccgcgggtccgggctgaggacctggtggagatggccgacacccggagcgggttcgagacgccggtgacgacgatgaccgaggacgagcggaccctgcggtacggggccggctga

SEQ ID NO: 5826 - DNA, 714 bp, Actinoplanes utahensis
atgcgtacgaagatcgttctgttcgccggcgccgcggctgtcgcactgctcgccggtgggtgcggtgacaaggcgacaccggcggccgccccgggggcgggcgcggtcgcctcggccgcctcgggtgtggccgcggcgcccggtggggccagcgcggcgcccgcggacgctgcgaactccgcgccgggggtcacgccgaccaagaacacgccggtctccacctcccagccgaagccgggcaccaccaaggacggccagccgggtcccgcacccgccggggacccgggtgacggcgggaactggttcgccgcgctcaccccgtgcccgaacaaggggcagcagcacgaggtgcagaaactggtgttcgcggacgtcaccggggacggggtcaaggacgcgctggtggcgagcacctgtcagaccaccaatgcgtactggccgagcaccgtggaggtgttcgacggcaccaccgggaagaagccgaagcggctcggggtgctgctcaaggacgtcgggccgaccgacgagccgtggtatgtgtcgtcgtcggtgtccggaaaggtggtgacggtcaaggcgtacgggctgagcgcccaggcgccgcgggcctgccccgacctgaacctgacctacacctacaagtacggcaacgggacgttcacgcggaccggtcggcaggccgccaaggcctccggctgcctgccgatccagtga

SEQ ID NO: 5827 - DNA, 1236 bp, Actinoplanes utahensis
atgcgcagtcgacagagtgtacagaatctcgttcgctcggcttgcccggtcactgcacatcgtttcactctagcgttatcaggcgtcgcccccggcgccgagggaaaggacatccccatgcacatcggtgtgccgaaagaggtcaagaaccacgagtaccgggtggcgatcacgcccgccggtgtggtcgaggccgtgcgccacgggcacgaggtcgtcgtgcaggccggcgccggggtgggctcggcgatcagcgacgacgactatgtggccgccggcgcgcggatcctgccggacgccgacgcggtctggggcgccgccgacatgatcctcaaggtgaaggagccgatcgccgaggagtaccaccggttgcgcgccgggcaggtcctgttcacctacctgcacctggccgccgacccgcagggcacgaaggcgctgctgcacagcggcaccaccgcgatcgcgtacgagacggtgcagctcgccgacggttccctgccgctgctcgccccgatgtcggaggtggccggccggctcgccccgcaggtcggcgcgtacagcttgatgcgcaacagcggcggccgcggcgtcctgccgggcggtgtccccggcgtcgcccccgccaagatcaccgtgatcggtggtggcgtctccggggcgaacgccgcgacgatcgcgctcggcctgggcgccgaggtgaccgtgctggacctgagcatcccgcggctgcgccagctcgacgcgcagttcggcggccgggtgcggacgctggtctccagcacgtacgcgatcgagcagtccgtcctcgaggcggacatggtgatcggcgccgtcctggtccccggcgcgaaggcccccaccctggtcggcaacgacctggtgaagcggatgaaggccggttcggtgctggtcgacatcgccatcgaccagggcggttgcttcgaggactcgcgcccgaccacccaccaggacccggtctaccaggtgcacaactcggtcttctactgcgtcgccaacatgcccggtgccgtcccgaacacctccacgtacgccctgaccaacgccaccctcccgtacgtactgcgcctggccgacctgggctggaaggacgccctgcgcgccgaccccgccctggccctgggcctgaacgcgcacgacggcgtcctcaccaacgacctggtcggcaaggccctcggcctggacaccgagtccgtcagctcggtgctcgcggcctga

SEQ ID NO: 5828 - DNA, 471 bp, Actinoplanes utahensis
gtggtgaccgacctgccgaaggatgttcgaggcctggatcacatcgacctggagctgctgagcctgctgcgcgccgacggccggatgccgaacaacgcgctggcggagcgggtcgggatcgcgccgtcgacctgtctgacccggatccggagattacgcgagatcggggccattcgcggctttcatgcggatgtcgacccgtcctggatcgggcggccgatccaggcgatgatcgcggtgcggatccgctcggatgcccgggacgggatcgggaagttcgccgagtcgctggccgggatcccggcggtgcgcgacgtgtacttcatctccggcaactatgacttcctgctgcacgtggcggcggccgacgtggacgacctccgctcggtgatcaccgagcggctcagcggcaccaggctgatcgccggcaccgagacctacctgatcttcgagcaccgccgcggcggctga

SEQ ID NO: 5829 - DNA, 789 bp, Actinoplanes utahensis
atgacgctctcgcacctgtcccatcgggaattgccgctgcagattccggccgtcgctcccggccgctcgccgatcatcggcggtacgccggaggcagccccgtcccgaccggcggaaccgtcgccgaaggcagccccgtctcgaccggcggaaccgtcgccgaaggcagccccggcccggccggcggaaccgtcgccggtgacggtcccggcctggccggcggaaccgtcgccggtggtgcgcggcgactggcgggagcggctggccctcgccaccgacctggcgatgatcggcgtcgtggccaccgtgctggcactgcccctgatcaccgcgccggccgcgctggccgccggatcggtggcggtgcgcgcccggtaccgcgacgggcgcatcccgccctggcggtcgctgaccgccgcctatcgccggggcgtcctgcccgggatgaccgcgctgcccgccgtcgccctgctcgcgctggacctggccgccgtccgcggcggccgggtgcccggcgggacgccgctgttcgcggtgaccacggtcgccgcgatctggctgaccggggtgggcacgctgacgctggccatgctcgggcgggcactcccctggcgggaggcggcccggcaggcctggaaccggccgtggtgtgcgagcgcgctggccgtgatcaatctggtggcggtgttcctggcgctgaccgtgccggccaccattccgctggtgatcggcttccacctgttcgccgcgcacatgctggcggaccgcctggcgccgccgctggtgtga

SEQ ID NO: 5830 - DNA, 834 bp, Actinoplanes utahensis
atgaccgcccgactgacccgcccggtgctgctgatcgtgctcaccgcgctggtgctctaccccctgctgtggatgctgggcagctcgttcaaggccccctcggagattctgaacaatttctcggtctggccgcgggagtggacgccggccaactatccggacggctggacgcatttcgacgtcgcgttcggccgcttcttcctgaacagtttcctggtggccgcgctgaccgtgctcgccaactgcgcgtcctgcctgctggccgcgtacgccttcgcccgcctgcgattccggctgcgcggcttctggttcgccctgatgatcggcaccctgctgctgcccagccacgtgctgatcgtcccgcagttcgtgatgttccgggcgttcggctgggtcggcggcccttggccgtacctcccgctgatcgtgccgcacctgctggccgccgacgcgttcttcgtcttcctcatggtgcagttcatgcgcggcgtaccccgcgaactcgacgacgccgcgaaaatcgacggctgcaccccgtactcggtgttccggcacgtgatcctgccgctgtcccggcccgcactggtatcgaccgcgatcttctcgttcatctggacctggaacgacttcttccgccagctggtctacctgtcggacctctcgaaatacaccgcgccggtggcgctcaccctgttcatcgactccaccgggcaatccgcggtcgggccgatgttcgcgatgtcggtgctctcgctggcgccggtcttcctgttcttcgtcgccttccagcgactgctggtggagggcatcaacacgacggggctgaaaggatga

SEQ ID NO: 5831 - DNA, 975 bp, Actinoplanes utahensis
atggctgtcagcacccggccgtcccgcccacggccgcagtccggtcccgccgctgaccagcggcgggaccggcccgcccggcatcggggcgagggccgggccggctacctcttcctcaccccgtggctgctcgggttcgccgtgatcaccgcgatcccgatgctgatgtcgctgtacctcagcttcaccaactacgacatcctgagcccgttctccgaagtcacctgggtcggctgggccaactacgaccggatgttccaccacgatccggcgtactggcacgcggtcagggtgaccctggtcttcgcgttcctcgccaccccgctcaagctcggtgccgcgctcggcgtggcgctgctgctcaaccggccgttccgcggctccggcctgttccgcgggctgttctacctgccgtcactgctcggcggcagcgtcgccctggcgatggtgtggcacagcctgttcgaccggggcggctcggtgaacgcggtgctcggttggttcggcatcgagggcaaggcctgggtcaacgacccgcacaccgcgctcggcacgctgatcctgctggccgtgtggcagttcggtgccccgatggtgatcttcctggccgggctcaaacaggtgccggccgagttgtacgaggcggccgaggtggacggcgcgggcacggtccgcaggttcgtcagcgtcaccctgccgatgctgtccccggtgatcttcttcaacctcgtgctggagacgatccacggcttccagggattcacctccgccttcgtgctctccaacggcaccggcggcccggtcgactcgaccctgatgtacacgctgtatctctacatccgcggcttcgcgaactacgagatgggctacgcctcggcgatggcctgggtcttcctgctcaccatcggcctggtcaccgcgctgctgttccgcaccggccggttctgggtccactattcggacggagacgattag

SEQ ID NO: 5832 - DNA, 1278 bp, Actinoplanes utahensis
atgtccgcacttcgactgtcacgtgccctgatggccgccgtgctcgtcctgccgctggccctggccggttgcggcggcgacgactccagcagtgccggcaagacccagctgaccttcttctggtggggcggcgagggccgcgccaaactcacccagcaggcgctcgacctgtacaccagtaggcatccggacatcacgttcaagaccacctggcaggccaaccaggggtacttcgacaagctggcgacgctcaccgccggcgacggtgcgccggacatcttccagatcgacgacaactacctcgccgagtacgcgacgcgcaacgtgacgctcgacctcacctcgtacaaggactccgggaagttggacctttcgaagttcccggagagcctgtggaagtacggtgtggtcgacaacaagctggccggcatgtcgatgggcgagaacacccagggcctggtctacaacaagaccaggctggaggcggccaagcaggagctgccgaccaccgggatgacctgggaccagctgatcgcctgggcgcagaaggcgggcgccgccaccaaggtgcccggcaccatggacccgagcgccgactacaaggcgttctgggtgtggctgcggcagaacggcaagcagttctacaacggcaaccagctcggcttcacctccgacgacgtgcagaagtggttcgagctgtggaagggcgcccgggacgccaaggccaccccgaccgccgacgtgatccacgagggcaacgccaccgacatcaccaagcagctggtcgtcaccggcaaggcgctcacctcgtgggtgtgggccaaccagatgccggacatccagaagaacaccaaggacgagctgggcgtcgtcgcctaccccggtgacccgtccgcgcagtgggcccgcgcgtcgatgtacttctcggtgtaccgcggcagcaagcaccgggacgccgcggtggacgtgctgaacttcctggccaacgacccggaggcgggcaagatcctgggtaccgaccggggcctgccgtccaacctggacatccgccggcaggtcgcgtccagcaccaccgacccggccatgaaggcgtcgatcgccctggaggactcgctggtcagcaagttcggtccggcgccgagcgtgccgccgaagggccacgccacggtcaagaccgaactgatcaaggcggccgaggccgcgcagttcggcaccgccagcccggcacaggccgcggaccagttcttcaccgcagcccaggccgcgattagccggtga

SEQ ID NO: 5833 - DNA, 2004 bp, Actinoplanes utahensis
atggcggacggccgagcgtgcgcccgcgccgacgtccatcaccaccgccgggagcccgtcgatcaggcggttcacgacgaccaggggcacctcgcggcgcgactcgacgatctggtcgtcgctcatccggggactgcacagcaggatcccgtcgacctgcttggccagagcccggacgaggtcggtctcgacgaccgggtcctcgtcggtgtcggcgacgaagacgtggtagtcgcgccgccgggcgtgggtctcggccgccttgatcatgggtgggaagaacgggttggcgatgtcggccacgatcaggccgatgttgtgggtccgcccggtgatgagtgcccgggcggcccggttcgggcggtagcccaactcctccgcggtggccagcacccgggtgcgcgtctcggggttgaccaggtgcggcgccgagaaggtgcgcgacaccgtggagatgtgcacaccggacgccttcgcgacgtcccggatggtcacggccacgatgccacctccccgaagtgtgatccggctctctctggtggagccattaatgcaaacggttgcgtacgtgtcaacgcccttcgatgcaggattgcgctttcccgcccttgcaaaggcctcgtaagtagacataagactccatgtattgactcgcatcgtcatctgatcgctaatctgatgcaaacgtttgcggagggagatgtcgtgattcgctacgccctcgtgggagccggtgcccgagccgggatgttcatccgggcgctcaccggcgaccacgccgacgtcgcgcgactggtcgccctggccgacaccaacccggcccggccgcaggtctaccgcaggcggcacgacctcgacgtaccggtctatccggccaccgggttcaccgagatgctgcagcgggagcgggtcgacgtcgtgctggtcaccaccgtcgaccggtaccacgagcggtatctggtggcggccatggaggccggctgcgacgcgatcaccgagaagccgatgaccgtcgacgccgcgtcctgccggcggatcctggagacctcccggcgcaccggccggagcgtccgggtcaccttcaactaccgctacaacccgctgcacgaagcggtgaaacgggcgctgccggagatcggcgagatcggctcggtgcacttcgaatggctgctcgacgtacggcacggcgccgactacttccgccgctggcaccgcgagaagcagaactccggcggactgctcgtgcacaaggccgggcaccacttcgacctggtcaactggtggctcgacgacgcgcccgagcaggtgttcgcggccggccggctgttcttctacggcgaggcgggccggcggcacgggtacgcccgcgactacgaccgggcgcacggcgccgcggccgccgagggcgacccgttcgccctgcggatggccgacgagccggccatgcgcgagctgtacctcgacgccgaacggcacgacggctacctgcgtgaccgcaacgtcttcgcgcccggcgtgaccatcgaggacgacatggcggtgctggtccgctacgccggcggcgcgtcgatgagctaccacctcaccgcgtacgccccctgggagggctaccgggtgatggtcaacggcagccgcggccgcctcgaactcgaggtcgtcgagaccgaccacgtcgccccggccgccgccgccggcgtcaagggtgagcccggcgcggtctccaccgccgagcggggctggcggcgcctgctgctgcgcccgttctgggccccgccgcgtgagatcaccgtggacgggtactcgcggcagggacacggcggagccgacctgcggatgctcgccgacctcatccggccggacgcgccgcccgacccgctcggccgcggcgccaccgcggtggacggcgcccgtgccctgctcaccggcttggccgccaacgaaagcctggcaaccggacaggccgtccgcgtgtcagacctcctagatcttgaggagatcaggtga

SEQ ID NO: 5834 - DNA, 1410 bp, Actinoplanes utahensis
gtgactctgttccccgccgaggcgacccagcgcgggatcgcccgtgagctctacgcccacgcccgcgacctcccgctgatcagcccgcacggccacgtcgacccggcgctgctggccgaggacgagccgttcggcgacccggcccggctgttcgtggtgcccgaccactacgtcacccggatgctggccagccagggcatcccgccggcccggctcggcgtgccgagcatcgacggcagcccggtggagaccgacggtcgggccgtctggcggctgctcgccgagaactggcacctgttccgcggcaccccgtcccggctgtggaccgagaaggtcttcgccgaggtgttcgggatcgggaaacgcttctcggcggcgaccgcggacgagatctacgaccagctgtccgcccggctggccgagcccgactaccggccccgcgcgctgttcacccggttcaacatcgaggtgctggccaccaccgagagcccgatcgacgacctcggcgtgcacgccaaactggccgccgacgggtggggcggaccgggtggccgggtgatcaccacgttccggccggacaacctggtcgacatggagtgggacggctgggccgaccgcgtcgccgcgctcggtgcgctcaccggtcaggacgtgggcacgtaccccggcttcctgaccgcgctgcgcgcccgccgcgaactgttcgtggcggccggtgccacctgctccgaccacgggcatccgaccgccgccaccctcgacctggacgacgccgaggcggccgtgctctaccgcaaggggctgggcggggcggccgacgcgcgcgacgccgaggcgttccgcgcgcacatgctggtcgagttcgcccggatgtcgatcgacgacggcctggtgatgcagctgcaccccgggtcggtgcgcaaccacaatcaagcgttgtacgcgcggcacggccgcgacgtgggcggcgacatcccgtcggccaccgagtacgtccgcgccctgcgcccgctgctcgaccggtacggtcacgacccgcgcctgcggatcgtgctgtacaccctggacgagaccgcgttcacccgcgagctcgcgccgctggccggcggctacgccgcgctctacctcggcgcgccgtggtggttcctggacagtccggagggtctgcgccggttccgggaggcggtgaccgagacggccggcttctacaacaccgccggcttcgtcgacgacacccgcgcgttctgctcgatcccggcccggcacgacgtggcccgccgggtcgacgccggcttcctggcccggctggtcgccgagggccggctgccgctcgacgaggccgccgagaccatcgccgatttggcctaccacctgcccaagcgggtctaccggctggaccgggcggcatga

SEQ ID NO: 5835 - DNA, 1455 bp, Actinoplanes utahensis
atgaccgtgaccaccactctcggccgcgccgcgctgcccgggctggctccgcaggcccgccccctggtcacgccgggcgaggtgcggcccggcatcctgcacctcgggctcggcgcgttccaccgcgcgcaccaggcgatctacaccgaggccgcggtcgcggcggccggcggcgactgggggatcgtcggcgtcgcgccgcgctcccgcgacgtgctcgacaagctgcgcgctcaggaccggctgtacagcgtgctcaccgtcggtggcgacggcggcgaccgggcccgcgcggtcggcatcctctccgggctgggccacgccgccggtgatccctacggggtgctggccgcgatcgccgaccccgggatccggatcgtgtcgatgaccgtgaccgagaaggcgtaccggctcggaccggacgggaaactgcttctcgacgacgacctgcgggcccagctgaccgggcaggcgccgccggtgagcgtgcccgccctgctggcccgggccctgctcagccgctccgcgccgctgaccgtgctgtgctgtgacaacctgcagggcaacgggccgcggatccgcgggatggtggagcaggccctcgaggtcgccggggccgggctgccggacggggtcgacttcccggccaccatggtggaccggatcgtgcccgccaccagcgccggccacctgcggcgggcggccgtggcactgggcgcggcggacgccgcgccggtcgtcgccgagccgttccaccagtgggtgatcgaggaccgtttcccgggcgggcggcccgactgggcggcggccggggcgatcatgaccggcaacgtggcgccgtgggagacgctcaagctgcgggcgctgaactcggtgcactccgcctgcgcgtacctcggtgcgctggccggacaagagatgatctccgacgcgctggcgttgcccgggatgggcgggctgctgcgccgcttcctggccgaggacatcgcgccgacgttcacgccaccgcccggcatccgggtcgccgactacggcgagacggtgctggaccgcttcgcgaaccgggagctcgggcatcgcacccaccaggtggcgatggacggcacccagaagctgccgcaccggttgctcgggacgctggccgaccggcgccgggccggtgccgtcccggtctggggcgcgctggtgctggccgggtggatgcggttcgcccgggggtacgccgacgacgggaccgcgctgccgctcgacgacccgctggccgggcggatccgggccgtcgtgagtgccgcgccggacaccccggccgggctggtggacgcgctgctcggggtgaccgaggtgttcccggcggcgctggccttcgacaccgctctgcgcgccgagctgatccggtggtccggggagctggcccggcacggggcggcggcgacgatcgcggcggccgggcgatga

SEQ ID NO: 5836 - DNA, 1098 bp, Actinoplanes utahensis
atgaccgcccgggtggcgctgatcggggccggtgggcacgggctgtcgcatcggcgcaagcttcgcgagctggccgggctcggcgagctggagatcgctgcactgtgcgaccggaacccggtcgacccggaacccgcagtgcccgtcttcaccgatcacggcgcgatgctcgcggcggtccggccggacgcggtgatcatctgcacgccaccgcacacccacctgccgatcgccctcgactgcctggccgcaggagtggatctgctgctggagaagccgccggtgacctcgctgagagagcacgagacgctggtgacagcggtccgggagagcgggcggcgctgccaggtcgggttccaggcgctcgggtcagcggcgctcacccggttccgtgagctgaccgcggccagcgccggtgacctgtccgcggcgggcgcctggtggcggccggacacctactatcggcgtgctccgtgggccgggcggcaggcggcgttcgacggggcgctggtgaatccgttcgcgcacgcgctgatgcaggcgctggcggtggcggacgggttcgagccggttctgctggagctggaacggtatcgcacccgggatatccagaccgatgactgtacgttcctgcgtctgaccgatggggacggccggcggatcgtggcggcggtgaccctggcgtccccggtgttcgtcgcgggggagatccggctcggggacatcgtgctcgagtatccgaccgatcgcgtgcttctcggcaggactcatcatgagctgtgggggcggaccgggctgctggagaacctgctgtccggcgagccgctggtggcgccgctggagcggaccagggcgttcaccgccgtggccgaggcgatcgtggccgcgccgctgccggcgaccgttccggcgggcgagctgcgcccgcacccggacggcgacggcaacgtgcttcccggcgccgatgaactcgtccggcaggtcgccgccaccggcctcctgccgtccgagaccgacgtctcctgggcggccccgccgcaccgggtgaccctcgaaacgcggaaaggaacgaccgatgcgcaaactgagcgtcgctga

SEQ ID NO: 5837 - DNA, 336 bp, Actinoplanes utahensis
atgcgcaaactgagcgtcgctgagctcgaagcccatcaccgcggggcgaccttcaccagtgtgctgcccggccacgtcgtacaaaaaggcggtttccgggtttatgccgagccgaacttccgcacgcacgacgagccgggccggcacgtgcacaccgtgccggagatcttcgtgatcgtccagggcagtggcgtgatggaggtcgacggcgccgaagccggtgagttccgggccggcgacgcggtgatcttcgagccgggggaggaccaccacctgatcagtcgcggacccgatccgctggtcttcgtctggatgcacctggaacccgtctcctga

SEQ ID NO: 5838 - DNA, 1344 bp, Actinoplanes utahensis
atgtcccgaagatccgccctcgcggcgacgatcggcctcgtcctggccggagtcgccaccgtccctgccgccgcttccgcttccgccgcgacgatccccggatcagctgtcccaggatctgctgtaccgggcgttgctgtaccggctgccgcccggcaggttctgccggtgaacgacggctgggccaacggtgccaccggcggctcggcggccgccgccgaccacgttcatgtggtccgcacccgcgacgaactcgccgccgccctcgccccggccgacaccgctccccggatcgtgctgatcaccggcacgctgcgtccggacggcgactgcgcggcctacaccgacccggcctactcgctcgacggttacctgggcgcctacgaccccgcggtctggggccggaccagcaagccgagcggcccgctggaggaggcccgcgcccgctccgccaagaaccaggccgcggacgtccagctcaaggtcccgtccaacaccaccattctgggcctggcgaacgcccgcctggtcgggctcaacctgctgatctcggccgccgacaacgtcatcgtccgcaacctgcgcctcgaggacgccgccgactgcttcccgcagtgggatccgaccgacggcgccaccggcaactggaactccgcgtacgacctgatcaccctggtcggcggcacccacgtctgggccgaccacaacacgttcagcgacggcgacgacgtggacgcgaaccagcccctgtacttcggccgcccgtaccaggtgcacgacggcgcgctcgacgtgatcaaggcgtccgacctggtcaccatctcgtacaacgtgttccaggagcacgacaagacgatgctgatcggctccaccaacacggtcggcgccgacgtcggcaagctccgcgtcacgctgcaccacaacaggttcgccaacatcggccagcgcgccccgcgtgtccgattcggacaagtcgacgtctacgacaactactactacgccaccgacgaggacttctaccagtactcctggggtgccggcgtctactcggccatctacgccgagaacaacttcctgctacgcagcgccgacatcccgctggacgccgtcgtccacaactggggtggcaccgcgatgaccgagaagggcaccctcacccggatcggcaccggcaaggtcaccccggtcagtctgctcgccgagtacaacgccacccacgaccccgacctcggcaccgacgccggctggacccccacgctgcggcccggcccgctcacccccaccgcccaggtcccggccgtcgtcaccgcccagtccggcgccggcaggatcaacctcagctga

SEQ ID NO: 5839 - DNA, 561 bp, Actinoplanes utahensis
ttgcgcgccgtcgtcgagctgggctccgaccgttggctggagctggacggtcgatgcggcgccgagcaggccgcgctgttcgtcggcgcgctggcgggagcggacgccgacctgcccgcggccgagcggatcgccgccctgctcgcggccgagatgctgatcgtcgccggtggcctcgctctcgatgacaccgtgtccggggtgtcgatccgcccgggttgctgcgccggcctggaggactggcgcgactgggcgtcgatcgccgcggggcagccggtgtggctggggcactcgccggagccccggatcgaggtggacggtgaccggcgccgggtgtggcaggacgtgacccccggcagcccgcacgtcgacgtgaccggagctgagctgttccggctgctggcgggcgtgcagcgggatctggtcggctttctcggagtgctccgtgcctggggccggtcgttcggtcgcggtgacctcctggcggcgcggatcgaccgggacttcgcgatcaccgcgcccctgccggatgccgggtgggtcgatcaggccatctcgtag

SEQ ID NO: 5840 - DNA, 708 bp, Actinoplanes utahensis
atgaatctccccgccgaggtccgagcgctggtccgcacccgtttcgccgaaccgcgggcgaacgctctgctggcgctgagccgcccgtcgatcggctacgagccgtcggacgagggctggtccgcgttcggcggcgagccacggctggccgccttcgactggccgatgcaccggggcaccccgatgctgctgctggccgccctcgacggcgacgaggccgccaccctcctcggcccggcctggccgttccccgacgacggcagcctgctcttcttccacgacgaggacttcaccgccgggtggtccccgcacggcgacaccgcctgccgcgtcctgcacgtcccggccgacccggtggcccccctcccccggatccggcgcaccatcgaacccaccccgctcaccccggccccgcaggccaccctgcccgccccggaagacctggccgaccatctggacgtggacctcgacgagctgctccacctcgccgaggacctgcggccgcaccttccggtgccccgccaccgcctgctcggccacccggaccacctgggcccccagccgccggaccaccgcccgctgctgcaactgcggccggaagccggcaccgtctggggcgaggtcgtcagcgtcaccttctggatcaccgacgcggacctggcgacgggcaccctcacccacgtccgccgcacctacgagatggcctga

SEQ ID NO: 5841 - DNA, 1170 bp, Actinoplanes utahensis
atgaagcggtaccggagtaacgctgcaggctccaacgcccgccgctggcgggtcgccggcatcgcgggcgtcgcggtggtcctcgccggcgtcgggctcggcgtggcgaacgcggcgacctcggaggccgtgccgaccgtcaactgcccgcaggtggccccccggctgccggccgtaccggcggccgccaaagccgaggtggagcggaacctcgccctgctcaacacccagatccaggaggcgaacaagcgcctggcgaccagcgtgggacagggcggcccgaacttcatccagaacgcgatcctgggcccgctgaaggacaagcgggcgtccacgatcgaccggatcgccatctccatcggtcgtcgagccgccaagccgaacctgccggtcaaccagctcgcgacgtgtgcgctcaacaagaacggtggcggaaacgcggccccggaaccgaccacggtggccgccgacaacggtgccgcagccggcaacaatggtgcggcggccggtgtgccgaccgttaactgcccgaccgtcggcgacaaactcccggccgttccggcgtccgccaaggccgagatcgaacgcaatctggcgctgctgaacacgcagatccaggaggcgaacaagcggctcgcgagcaccgtcggccaggggggcaagaacttcattcagaacgccattctcggcccgctgaaggacaagcgattcgccaccatcaatcggatggagaccgcgatcggccgggccgcggcgaagcccgacctgaacgccgagggcctgtccggctgcaccctgaaccagaatggcggcggcaacccggcgcccgagcagaccgccgtgcaggcccaggacccggccgtggcggccgcgaacgcgccgaccgtcaactgcccggacgtcaagatcggcgtggcgatcccggcctcggcgcaggccgagatcgaccgcaacctggccctgctgcagacccagatccaggaggcgaacaagcggctggccagcaccatcggtcagggtggcccgaacttcatccagaacgcgatcctcggcccgctgaaggacaagcgcttctcgacgatcaaccggatggagaccgcgatcggtcgtcaggcggccaagccgaacctgaacgccgagggcctgtccacctgctcgctcaacaagtga

SEQ ID NO: 5842 - DNA, 669 bp, Actinoplanes utahensis
atgctccggcggattgcaccaccggaggagacgcacgtgccaccatccctgccccggccggtccgggtcggttcactgtcgtacgcggtcgcggcggtcgccgccgcgctcgtcggcgtcatggcggtcgcctgctggtggcgggtcggcgcgacggcggacagcttcctggcgctgcccctgccgccccgggatgtggccgccgtcccggcgaaggccgcgtccctgcgcctggcactcggcggcagcgcggtggccgcgatcctgatcgccggggccgccggactgctcgcggcgggaatccagcgaccggcggtcgcctggatccgcaccgccgggctgtgggtgagcttcctgggcggggcggcgctgatcgccggcgtgctgctggtgccggtggatcgcagcgagggcaccacggtggtcatcgacctggccgcggtggcccacaccgacctcgggtccggcccgctcccgctggcggactggtatcccacggtgttcgtcccgctgggctggctcgccttcgccgcgctggtcgccgcgggattccagctgtcacggacgtcgatggccgactactcccgcccggccagccacctggaggacgagcggtggaccagtttcgtccagcgacagcaggagcggcagcagctgcccggcgagtga

SEQ ID NO: 5843 - DNA, 903 bp, Actinoplanes utahensis
gtgatcgtgcgtgcgctgcctggcaccgccgttcctcctcgtcgtccggggcattctcgctggcgcggatttctatcacgtatccgggtggcacgcgaagaacgcacgctatcgcgagggccgccggatgaccatccatcgccggcgggctgggcatcggcgcaccgtccgggcagaatcggccgggtgcgggtgttcctggccgagggcgtgcgtgagacgtgcgtcgcactgcgcgcgccggccgccacggtgccctgcgaccacctcgagatgggttcgctggtgctgctgcgcccccgcccgggcgtctacggacagttacgtctcgcgttcgagccaccccgctcggcgagctggcggatgctcggccgctcccccggggagtaccgtttcgtcgtccatcagggcgaccgtgccgccctgcaccgctcgatcgaggccgccgtgcgcaccctgcgacgctggccgatcctcagcggacacgtcggtctggccgaccccagcccgcgcctggcccgcaccctctgggacctgtccggcctgctgatcgagcgggaccgcgtccgccgcacccgcgaccggctgaccgacgtcgatccggcggtcccgccggacaccccgctgcgcgccgagctggccgaccgggccgcgcaggcgcggctgcgcctgcgccatctgggcgtccaggcccgcgatcagctcacccacctgacccgcctggccgctgaaaccgacgctttcgtacgtcatgagcaggcgtccgccgcggcccgcgccgccctgcgcgcctccgactacctgctctcccccgccgcgcccgccccgcccgacgacgaggccctggatctggccgaccacacgtccgcggtcctgcgggcctaccgcgagctcaccgcctga

SEQ ID NO: 5844 - DNA, 1275 bp, Actinoplanes utahensis
gtgtcggcagctttggtctcaccggggccggtccggccggtgcagccggtgcagttcacgccacccgcgccggttgcggcaccggccgccgctccggttgccgctgcgccggttgccgcgtcgctcgctgcgccggtcgccggtccggtcgccgctccggtcgttgcggaagggccggtgcggcccacggtggcgcagatcgcggcgctggtcaccgcgacgtcggaggcgccggtggccggatcgctcgggcagcggctcgcggcggcggtgacgcccgaggagatgctggggatgccggcacccgcaccggaggcgacggccgacgtgccggcgccgcggcggccggcggagcagacggcggtgcccggtgcggtgccggcggtgccggggccgatctccgcgccgcggccgttcctggccacgagcccggtccaggcgaccaacggtggagccaacgggacgaatggtgccggcaacggcaacggcaacggcaacggcaccggcagcggcagcggcagcgccgcgcagggggccgccccgcagacgccggcctgggcggccaccccgaccggagcccagcgcgccgtcaacatcgtcggctcgccctggtggcggctcgccgtggagcgcatggcccgcatcgtgcgtagcgagatcacccccgacaatctgtcggagatgacctattcccggatggcggagctcgtcaaatcgatcgcgccgcgggtctccggtctcggcgagggcgtggtgaagtcgttcgtcaacgactacgtccgcgagatgaacggtgaaccgggcgaggccgcctacccgtggcgggacctgctgcccgacccggtgaccctgccggtcggctccgagctgtggatgcaggagatcgaggatctgcgcaccgctctggtcgaggagctggagagcagcgacgagacggacccgcgtgagctggcgatgatgctggcgccgagcgttccacggctcgacgacgagacgatccgcgcgttcgtcagcgactacgtcgccgcgctcggcggccagccggtcggcgtcgaccagccatgggagcacctgttgccccgcccgcagggtggtcgtggtccgagtgacgaggagatcgtcgagcagttcggcgggctgctgcacgagcacctgcgcaccaacggcaggctctcccgctaccgggtgaccgcggtgaccggtgtcaagggtgcccgcgccgaccggatcaaggggatcatcgaggaccaggccgcggagtcggccccggcgtga

SEQ ID NO: 5845 - DNA, 432 bp, Actinoplanes utahensis
gtgactgacgtcgatcggacccggccggccccggcagccggcagggcggtggtgtgggtgcagctcacgctgctcacggcgtacctgatcggcagtttcgggatcctgatcctggccgccgtgcgggtgggcgacgccggggcactgctgcatcccgggctggatcggctcggcgatcccgaggattcgctgcccggggcgggcaatccgctggtcggggtcctcggggtctgccggctggtggcctggttcgtctatccgctgggcatcgccatgatcagcttcggggtggtgacgctggtgcacagctggcggcgcgacgagcggcgacgggccgggtggctggccgcgctcaccgcgagctggctggtcctggtcctggtcgccgcctctccctacggcggcgacctgatcacctggctgctccactga

SEQ ID NO: 5846 - DNA, 1014 bp, Actinoplanes utahensis
atggcggtcaccctggcagatgtggcccggctggccggggtctcccccgccacggtgtcccgcgtgatcaacgacagcgccaagaaggtcgcgcccgagctgcgcgagcgggtcctggccgcggtcgccgagctgcactacgtgcccaacgcgcacgcgcagagcgtggcccgcccgcgcaagtccgcggtcggggtgatcgtgcacgacgtctccgacccgtacttcgccgagatcacccggggcctgcagcggcaggccgcggcccacgaccggctcctggtgatctgcaacagctaccgggagccggagcgcgagctggcctacgtggcgctgctgcgggcccagcaggtgcacgcgctgatcctggccggctcgggataccacgacgacgcgttcaccgcccggctcaacggcgagctgaacgcgtaccagcagggcggcggccgggtcgcggtgatcggccggcacgagctggtcggcagcgccgtgttgcccgccaacgaatccggggcgtacgagttgggctgccggctgctcaccctggggcaccgccggatcggggtgatcgccgggccccggtcgctgaccaccaccaccgaccggctgtccgggatccgccgggccctcgccgaggccgggacggccctgccgccggagcggatcgtctacgccgacttcacccgggacggcggggcggaagccgcgggccggctcctcggcgccgcaccggacctgaccgcgatcgtcgcgctcaacgactcgatggcggtgggcacgctggccaccctgcgcgagcacggcatcgcggtgccggcccgggtgtcggtcgccgggttcgacgacatgccgatcgcgcgggacgtgacaccggcgctgaccacggtgcggctgccgctggtcgggatgggcgagcgggcgatggccctggccctggccgacgacaccgccggggtcagcgagccggccgcggccacgctgatctggcgggagagctgcgccgccccggcctga

SEQ ID NO: 5847 - DNA, 1086 bp, Actinoplanes utahensis
gtgagtaccgccggaacttcgctggcggaaagcttgcgcaaggtgacgcgcggccccctgccgaccggctcggcacggcggcaggctgacggcatgacaactcgcgtgggaatcaacggattcgggcggatcggccgcaatgtcttccgagccgccgcgaacagcgacgtggagatcgtcgcgatcaacgacctgaccggctccggcaccctggcccacctgctgcgctacgacagctcgctgggccgctacccgggtaccgtcgaggcacacgaggaccacctgctcatcgacggccaccgggtcgaggtgaccgccgtccgcaacccggccgaactgccctggaaggacctgggcgtcgacgtcgcgctggagtcgaccggcagattcaccgcggccgccgacgcccgcgcgcacctggccgccggcgcgcgcaaggtcctggtcagcgccccgtccccgggcgccgatctgaccgtcgcctacggcctgaaccacggcgactacgacccggccgcgcacgacgtggtctccaacgcgtcgtgtaccaccaacgggctggccccgatcgcctcggtgctcgacgacctggccggcatcgagaccgggtcgatgaccaccatccacgcctacacccaggagcagaacctgcaggacggcccgcaccgcgacctgcgccgggcccgggcggcggcgctgaacatcgcgcccaccacgaccggtgcggccaccgcgatcggcctggtgctgccccggctggccggccggctcaccggatactcggtgcgggtgccggtgccggtcggctcgctggtcgagctcaacgcggtggtcgagcggccggtcaccgccaccgagatcaacagtgccttcgaggcggccgcgtccggcccactgcgcggggtcctcgcatactcggccgacccgctggtctccaccgacatcaccggcaacccggcgtcgtccctcttcgactcgctgctgaccgcggcgaacggccggctggtcaaggtggtcgcctggtacgacaacgagtggggcttcgccaaccgggtcgtggacaccctgacactgctgggccgctga

SEQ ID NO: 5848 - DNA, 978 bp, Actinoplanes utahensis
atgtttctcatgcccggggccgcaccgctggacgtgggcatcccggcgcaggtcttcgcgccgcggcacgggctggactaccgggcggtgccgtgcgcggtcgaggccgggccggtgcgcggccgcgacgggctcggtttcttcgtcgacgcggggctggaggcgctggacgacgcggacaccgtcatcgtgcccggcttcctcaacccggccggtccgatcgacccgcgggtgctcgccgcgctgcgcaccgcggcgttccgcggcgcccggatggtctccatctgcaccggcgcgttcgcgctggccgcggccggtctgctggacgggctgcgggcgaccacgcactggctgatggcgccgacactggcccgggagtacccgaaggtgaccgtcgacggcagggtgctgttcgtcgacgagggtcagatcctcacgtcggccggggtggccgccggcatcgacgtgtgcctgcacctggtccgccgcgaccatggcgtgcaggcctcgaacgcgatcgcccgggtgctggtcgcggcgccgtaccgcagcggcggccagtcgcagtacgtgccgcgcagcatcccggagccgctcggcgacgtgttcgcggccacccgcgagtgggcgctggcgcacctgggtgagccgctcaccgtgaccggcctggcccggcacgccggcgtctcggagcgcaccttcggccggcggttcgtcgaggacaccgggtacaccccgatgcagtgggtgctgcgcgcccgggtcgacctggcccgcgagatgctggagcgcaccgacctggggatcgagcagatcgccgcccgggtcggcgtcggcaccggcgccaacctgcggatgcacttccagcggatcctgagcacctcgccgagtgagtaccgccggaacttcgctggcggaaagcttgcgcaaggtgacgcgcggccccctgccgaccggctcggcacggcggcaggctga

SEQ ID NO: 5849 - DNA, 1011 bp, Actinoplanes utahensis
atgagggaccacagcaaccgctcggccgggcggccgaccctggaggaggtcgccgtccgggccggcgtcggccgggggacggtgtcccgggtggtgaacggctccgcccaggtcagtccgaaagcccgcaaagcggtgcaggacgcgatcgacgagatgggctacgtgccgaaccgggccgcgcgcgcgctggtcacccagcgcaccgattcgatcgccctggtcgtgttcgagtccggcgagcggttcttcgccgagccgttcttcggccggatcgtccagtcggtgtcgtccgtgctggtcgcccggaacctgcagatggtcctgatgatcgcgcaggccccggaggagcggcgccagctggagggctacctgacccgccagcatgtggacggcgcgctgctgctgtcgctgcacggtgacgacccgctgccggccgtcctggaggagcgcggcgtgcccaccgtgcgggtcggccgcccggtgcacccgggcccggtcacctcggtcgacgcggacaaccgcgggggcgcccgggccgccgtgtcgtacctgcgcgagcagggccgccggtgcatcgccacgatcaccgggccgatggacatggcgccgggcatcgcgcgctaccagggttaccgcgacgtggtcggcgacggcccggccgcggccggcgacttcggcgagatcagcggcgcgatggcgatggaatggctgctcgccaaccacccgcagctggacgcggtgttcgccgcctcggacatgatggcggccggcgcgctgcgggtgctgcgccgggccggccgccgggtgccggaggacgtggccgtggtcggcttcgacgactcggtcgtggcccggcacaccgacccgccgctgaccagcgtctatcagccggtcgagcagatgggccaggagatggtccggctgctgctggccaagctcgacggcgacgagccggtcgagcacgagacgatcatgccgacccggctgatcctgcgcgggtccgcctga

SEQ ID NO: 5850 - DNA, 1053 bp, Actinoplanes utahensis
gtggccggccgccgccgcggtgggcgccgcggtcgccggagcgctggccgccgcgcacgccgccggggtggtgcaccgcgacatcaagccgggcaacgtgatgctctgcaacggtggcgtgaagctgctcgacttcgggatcagcgcggccgccggggagccggacgacgacgacaccggggccaccttcggcaccccggcgtacgcggcgccggagcgcctggacggcaagccggccgagccggccaccgacctgtacgggctgggcgtgctgctgttcgagatggtggccggggagccgccgtacagtgtggacacctgggaggagctggcggtggcccggcagaccgggcccacgccgctgccgggcgggctgcccgccccgctgaccgatctgatccaccgctgtctggacgacgacccggagtgccgcccgtcggccgccgaggcgtggaaggtgctggccgagctggctccggcggagaacaagaagacgccgacggtgccgctgcccggcgcccgccggccggggcggcccgggtgccggccctcaacccgccgccggtccgggccacccgcggtcgcaagatcgcggtgggggcggcgctgggtgccaccgcgatcgccttcctggcgctggtgcacgtggtgtcgcagtcgggcgacgatctggcgcagccgccgccggccgcgccggtcgcgccgtccgtgccggcgacgtcggccgcctcgtcaccttcgccgcggccggcgacgactccgccgacggtggcgaagagggcggcgccgacgctcaccgtggacgtggcgctgcaacgggtggaggccgcggtcgatcggggcgagcggaccggcgagatccgcggggacgtcgcgcaggatttccggaacctcctggggcagctcgccactcaggacaatcccgacatccgcgggcaggtggatctgttgcgcaagaaggtccgccagcggctcggcgagggcgggctgagtgccggccaggccgccctgctgcaggaccgcctggccgacctgggccgggccggggcctag

SEQ ID NO: 5851 - DNA, 651 bp, Actinoplanes utahensis
atgcgtatgcgccgaatcgccgtagccgtcgccatggccgccgccgtcaccgccccggccgtcgtcaccgacgtcgcggccttcgcgaaatcgccggcggtcagcaaacacggcgatgacagaaacgacaacaagggcaacggcaacgccggcaacaagggcggcgacaacagcaacaagggcggcgacaaggccaggtccaagaaggtcgccttcgccgccgagggcacggtcaccgcggccgacgccgcgtcggtcaccgtcgcggtcaagggcggcaccaaggacgtccgcggccgtaccgtcaccttcgccgtgaccagcgccacccggatccggctcaacggcaagcgggtcgcggccaccgcgctggccgccggggcgaagctcgaggtttcgggcacccgggtcgacacggtctacaccgcggtgcagatcgaggccaccctccgttccggccgccccaagccggcgccgtcgcccagcggcagcgcgacgcccaccccgtcgccgacggcgacgccgtcacccagcggcagcgcttccccgtcgccgagtgtcagcccgtcgcccagcggcagcgctaccccgtcgccgagcgacagcccgtccccgacggataccccggaccccaccgacagccccagctga

SEQ ID NO: 5852 - DNA, 1836 bp, Actinoplanes utahensis
gtgcgcgaccgcgtgctggtgccgatcacgctgctgtccctgctggtgttgaccccgtacgtcgtcggcctgggcaccgaccgcgagcggctgatcctctgctggatcgtcgccccgctcaccgacctgggcatggccgcgctgagccggcaggccagccggctgccgggttcgcccgcggcgaacgcccggttctggcgggcgatggcggccgccggtctgttgttcgccgtcggcgacaccgtgcagctcgcgtcggtgctcgccaccccgggcggcagcgtcttccgcctgcatccggtgcagagcctgctgggcgtgctcggcgtgatcctgatgtgcgtcgccggcctgcgacatcccggccatctgtggtcgcgcggcacccggatccgggtcgccctggacgcggcgatcgtgtacagcgcggccggcgtcgccgtctggtgcctgctcacccggcccggcgtcgcccaggccggcgcgatggggtacgccgccgccacgttcggctgcggcgtgctgctgatcggcggtttcctcgcggtcaagctcgggctcggcggcagcagcccgatcgccctgccggccgcgatcaccatcgtggcgggcgccgccgtgcaggcggtcggcaacgccctgctgcccagcggcagcatccagggtgtcaccgtgccggccctgctgatcctgttcccctgcctgctcacgctgcacaccccgcggctgcacacgctggccgtgcgggcccggcagcgggcgcccgagcggcggtccggcacccggcgccggtacagctcgctgccctacctgggcaccgtgctgtgcgtggcgatcctgctggtggtgctgctcgtcgagggtctcggggtgtccgcctggggcgcgctgatcggcctgctgctcaacgtcaccctggtggtggcccggcagatgctcgccctggcggagaacaacacgctgctcgaccagctggacgagagcctggccgagatccgccgccgcgagcgccggcaggacgcgctgctgcggcacgcctcggacatcaccgcgatcctcggcaccgagggcgtggtgcgctacctgaacccggccgtggagcggatcatcggcggctcggtcgacgactacctgggccgcagcctgttcgacctgatccacccgggtgacgcggcccggatccgggaggagatgaccggggtgttcgccgtccccggcgccaagggcaccttcgagctgcgcgcccagcacgaggacgacagctggcgctggctctcggtggtcgcggtcaacctgatcgaggagcgcggcatcggcggcgtggtgatcaatgcccgggacatgaccgaggagcgggaactgcgcgaacggctgcgcttccaggccgggcacgacgcgctcaccgggctggcgaaccggcggcagttcaccggccggatcgccgcctgtggggcgtccgaggtggccgtgctgctggtcgacctgaacgggttcaaacagatcaacgacacgcacgggcacgccaccggcgacgcagtgctgcggcacgtggcggaccggctgctggactgctgcggccccggggacctgccggcccggctcggcggcgacgagttcgcggtgctggccgcggcgggcgcgccgggagcgcaccggatcgcggaccggttgcgggcggctctgacggcgcccgcggagatcggtgaccaacggctgtccgtcggcgccagcatcggcgtcgcggccgggccggccgaccagccggacaacctgctgcacctggccgacctgcggatgtacgccgacaagcagcgctcccgagagttcgcatcgtga

SEQ ID NO: 5853 - DNA, 2292 bp, Actinoplanes utahensis
gtgacccgagcctggcgtccggccgccctcacgggcgcggtcgcgctgctcggcaccctctggtacgtctggtggtgcctcgccccggccggcaccttcgcggtggcgtacgtgttcatgccggtcggctcggcgctcaccgtggcggccgtccgttcgctgcgccggtcgaccgcgatgcccccggccggccgtcgcttctggctgctgctggagggcggcgccgcgctgatgacggtcggctacacgatcctggcggtcgccgccttccgggccgctccgcgtttcgccgcgatgccgctgtcggcggcgatcacggtcgggctgggcctgctcgccgcgatcgccgcggtcgccgtcgtgccactcggcatcaccagctggtacgagcgcggcaagcagtggctggaccggtccatcgcgttcctcggctgcgccgccgtgctctggcacttcggcgtggctccgatgctcagcggggcgatccggtggagttccagcgtgctcgccgtggtgctgctggcgttcgtgttcgcggccggcgcgatcaccaaggtgtcgtacgtcccgggtggcccggtcgaccggctcgcgatccgcctggtggccggcaccgggctggtcaccgccgcgttcgcgatactggcggtggcccgcccggtcgacggctcgattccggcccaggcggttctgctgccgctggtgccggtgctgatcacgctggccgtgggccgtcagcgcacggcgccgccgagccgcccggcccgctccggcacctggctgccgtacctggcgatgctcgccgccgacgtgccgctcgcgcatgtgctgttcggcggcgccacggtgggcgaggcgatccacgagggccggatcgtcgtcagcggaaccgccctgatcaccacgctcgtctcggtccgccagtgggtggtcaaccgggacaacgcccggctgctgcgcgaccgggaggcctccgatgcccggatgaagtacgaggcgacccacgactcgctcaccggcctgggcaaccgggtgctgttccggcagcggctggagaccgcgctggccgccgacggcgccaccgtgctgctggtcgacctggacgacttcaacacggtcaacgactcgctcggccacgacgtcggcgacgagctgctgatcgctttcgccgagacgctgcgcgccgcgaccggcgccgacggcgaaccggcccggctcgccggcgacgagttcgcggtgctggtcaccgcgcccggccaggaccaggcggtggtcgaacggatcatgacggcgatcgccgcgccgatcagcgcgcaccgtctgctggtgcacgccagcgccggcatcgcggcggccccgccgggcgccccggccggccaggtgctgcgcgacgcggacgccgccatgcacaccgccaagcagcgcggcaaggccaactgggtgcggtatgcggccggcatggagaagcccgcccaggcggccgcccagctcggtggcgacctgcgccgggccctggacgccggtgagttcaagctcgtctaccagccggtggtggacctgcgcaccggccgcacggtcggtgtcgaggcgctggtccgctgggcacatccggagcgcggcatggtctctccggccgacttcatcccggccgccgaacgcaccgggctgatcgtcccgctgggccgctgggtgctgcgcgagacctgccggcagaccgccgcctggctcgccgagttcggcccggacgcgctggacaaggccgcgccgaacgtctccgtccggcaggtgcacgaccccgacttcgtcgccgacgtgcgggccgcgctcgccgacaccggcctgcccgccgcccgcctggtgctggaactgaccgagtccgcggtgctgcgcggccaccaggtcctcaaagtgctgcacgaactgcacgatatgggcgtccggctggccctcgacgacttcggcaccggcgagtcctccctgagcctgctgcgcaccttcccggccgcgatcgtcaaactcgacaaatcattcgtcgaccacatcgagctggacgagccggacagcccggcggcgaacgcccggcaggcggtggcccgggcggtggtgcaactcgccgacgcgctcggcctggacacggtggccgaggggatcgagaaccaggagcaggccgaccgcctggcccggctcggctacagcatgggccaggggtatcacctggggcggccggtggctccggaggagatcacggcgcgcctggcggcggagcaggtgtcgttgcggaccgctgcctga

SEQ ID NO: 5854 - DNA, 549 bp, Actinoplanes utahensis
gtgcagaggtcggcgccggtgacgccagtagagttcccgggaatggacacggcggacgacggcacattcacggcgcatgcgctgacggcgtggctggagcggctcagcttcaccgacctgcccgaggcggaggcgacggcgcggatcatcgacgcggtcgtggcgtggggtgcggcacagcggtggcgcgtctatcggcgcgcgccgagcgtggtgccgatgccgccgccgctgcacgggaattccgtgctggacgtggcctgtgcccggccgggcggcgccgcgccgatcgcgatcgaggtggaccggctggaccggcagcgaaccgtggacaaactgctcgccgaggcggccgccggccgggtggcgatctgggtgcgctgggggaccgggccgttcccgccgccaccgctgcccgtgcatctggtgatcagggaggccacccggcgctccggcaggtggcatacggtgtccggacgaccggccccgaaccattcgggcgccgctcctgtcgtcgccgaagccgaggagctgccgtgggaactgtga

SEQ ID NO: 5855 - DNA, 1005 bp, Actinoplanes utahensis
gtgggaactgtgaccgagagcccgtcccgactcgcctggcgggtgaccgagccactgcacgcgctggtctacttcgtgccggaggcggccgcggcgtaccgccgactgggtcttgatccgatgggtggctatttcgcgctgcgcgccgccgccctgggtgccgccgggccggagctggtcgccgccacgttctacaacttcaatccgtccgtgatcggcaaggtgctgccggccgcctgggacgtcgcctccccgcagcagatggtcgagacgcgcctggcgatcgccgacgccgcgctcacccgcggtctgggcgccgaaaccctggcgggcccggagatcgccgaggccgccgacctcgcccgcacggcggcccggcacgcgtccaccatgccgcacggccgcccgctgttcgccgcgcacgccggcctgccctggccgaccgcgccccacctggtgctgttccacgcccagatgctgctccgcgagttccgcggggacgggcacctggcggccctactgagcgccgggatcagcggactcgaatcggtggtgctgcacgtggccagcggcgagatcgaggagcgcttcctgcgcggcacccgcggctggaagcgggagcagtgggcggcggccgccgacgccctgcgcgcgcggggtctgctcagcccctccgcggcccccgcagccgccgcgcccgatcccgcctccacgcccggcgctgtcgccccgtccgcctccgcttccaaggctgtttccgcctcggcgttcgccgcggcgtccgctgccgccgccgcgggaacgggcgagcggacccgggacgagctctccgaggcgggacgggctctgcgggccgagatcgaggccaccaccgaccggctggccgagccggcctaccggattctcggcgatgacggctgccggcgactggccgagttgacccgtccgctgagccgcaccctggtcaaatccggattcctcaatcctgtggcgcttctcggttga

SEQ ID NO: 5856 - DNA, 774 bp, Actinoplanes utahensis
gtgattcgacagcagcggcacccggcatcgtggtgggaccagttccagcaggcgtccgacaagttcgacctggccatcctcacagagagtctgggcgacgagatcgcgccgaagatctcctcgccgctgctgcgccgcgaggccgagatcgccctcgaagtgatggtccggcatctgaacaagccggccagcgaggaactcgccgagcgcgccaccaagggcgtacagcgcctcgtcgaaaccgtcgcccgcctccaggagcgctccggcgacggtttcgagctgcgcgaggcccaggccctgatccacctgttggagggcaagaccggcgacgccgccagtgaggccgaggagttcctgaagagccaggtcatccttcgtgccttcgtcgccgccctccgcctggaacgtttcgactccaccctggccgtcaaactcctcgccgccggccacgacccggccgccgcgctgcactccggccaggtgatcggcaagtacgcctggtggcccagctggctgctcaaggtcgtcaccgagcgcgccatggccggcaccctcgacgaggacacggtcgccgccctggaccgctgcgcgtacgccgagctgagcccggcccaggcccgcatggcccgccgcctcctggacggcgaggaagcgttgatcgacgcctcctcggtccggctggaagccctgggcgaggtcgactccgccgaaaagctgcgtaagggcgacctgaccatggtcgcgctcgccgcccgcctgatcccgatctag

SEQ ID NO: 5857 - DNA, 1341 bp, Actinoplanes utahensis
gtgatcctcgcgctggtggtcgtgacggcactcgccttcgacttcaccaacgggttccatgacacggcgaacgcgatggccacctccatcgccaccaaggcgctgcggcccaaaaccgccgtggcgctctccggagtgctgaacctgatcggcgcgttcctctccgtcgaggtggccctgaccgtcaccaacgcggtcgtcaagatccaggacaagtccggggcgccgaaagccgcgctgctcgcccacggcgggacgacactgctcctgatcatcctggccgggctggtcggcggcatcgtgtggaacctgctgacctggctcgtcggcctgccgtccagttcgtcgcacgcgctgttcggcggtttgatcggcgcgaccgtggccgggctcggctgggccggcgtgaactggaacggcgacggatcgaagctcgacggcgtggtcggcaaggtactgctgcccgccgtgctctccccggtgatcgcggcggtcgtcgccgcggccggcacctggctgatcttcaagatcactggcgggatcgcggcccggttcaccgagaagggcttcaagtggggccagatcggatcggcgtcgctggtctccctggcgcacggcaccaacgacgcgcagaagacgatgggcgtgatcaccctcgccctgatcgcgagcggtgactggcacgacaccaagaacatcccgctgtgggtgaaggtggcctgcgccctcgccatcgcgctcggcacctacctgggtggctggcggatcatccgcaccctcggcaagggcctgacggacatcaacccgccgcagggcaccgccgcccagtccggcgcggccgcggtcatcctggcgtccagccagctcgggttcgccctgtccaccacccacgtggcgaccggttcggtcctcggctccggcctgggccgccccggcggcgccgtccgctgggcggtcgccggccggatggtcgcggcctggctgatcaccctcccggcggccgccgtgatcggcgccgcgatgtggtggatcggccatctgatcggcggcgtccccggtgccgtcgtcgtcttcctgctgctggtcgccgcctcggtcgcgatgtggctgcgttcccgggcccaccacgtctcctcggagaacgtcaacgacgactgggacacctcgtcgcccgcggcccccgccgacgccgcggtcgtcctcgccgccgaccccgaagcgccggccatccttctcggcgcggacccggcgtcggatgtcaaggttcctgattccccggcctcgctgacctcgccggcgacggcggccaccgacccgggccgcgtggcctcgaagaactga

SEQ ID NO: 5858 - DNA, 309 bp, Actinoplanes utahensis
atgcacaacctcggattcgcgctggacggcgcgtggcgggtcctgctcgccggcctggttctcggcgccggcctgccggtgctcttcgccctcggcatccgctccctcgcctggggcgcgggcgaagcctcggtcggcccgtcgggcgtcacggccggcgccaagcacccgctgggcacggtcctcggctacctgctgttcgcggtggtcatcgccggcgtcctgctcggtctgaccttcatcgtcgccaccggcttcggcgacaaactcagcttcgagcacatctacccgacgatcgtcccgaagtaa

SEQ ID NO: 5859 - DNA, 1122 bp, Actinoplanes utahensis
gtggcagatcgccgtcaggtgctgcgcttcggcgcggtggccgccgccgctccggcgctgggtggggccgtcgcgagcccggcgttcgccggtgcgcagcagcacaccggtgccggacaccggcccagcaagcacaccacctcgctggtggtggggcaccggggtgcctccgggtaccgtccggagcacaccctggcctcctacgagctggccgcccggctgggcgccgactacctggagcccgacctggtcagcacgaaggacggggtgctggtctgccggcacgagccggagatcggtggcaccacgaacgtggcgtcgcacccggagttcgccgaccgcaagcgcaccatcgtcctggacggggtgagcgtcaccggctggtggacgcaggacttcacgctggccgagctgaagacgctgcgcgcggtcgaacggctgcccggcgtccggcagcacaacacgctcttcgactctcggttcgaggtaccgaccttccaggagctgctcgacctgcgcaagcggctgtccagggagctgggccgcgacctcggggtcatcccggagaccaagcaccccacgttcttccgcaacctcgggctggaactggagaccccgctcgtcaagatcctgcgccgcaacgggctggaccgccgcggcgccagggtctggatccagtccttcgagtcgaagaacctgcacgcgctggccgaccgtcatcgggtggaggttccgctgatcttcctgaccagcgcgtccggcaccccgttcaacgactcgcgcacctacgccgactacctgtccccggccggcctcgaggagctgtccgaatacgtcgacggtgtcggcccggacaagagccagatcatcccccgcaacgccgacggcaccctggccgcgccgaccagcctggtcaaggacgcgcaccacgccggcctgcaggtgatcccgtacaccttccgcgcggagaaccagttcctgcccgccgagctgcgggtgggcaccgacccgaacgcctacggtcgggcgatcgacgagcagatcacgttcctgcgcaccggcatcgacgggctcttcaccgatcaggccgacatcggcgtactggcccgcagcctggcctga

SEQ ID NO: 5860 - DNA, 1137 bp, Actinoplanes utahensis
gtgcccgtgcccctgcgttcgctcctgggagaaccgagtcctcccggcgcccctccgctgtcctggcgggacgggctcctggtcgccgtctgcatggccgccgccgtgctcgaaggggtctttcgtcccgatcttccgcaccggatggtcgccgtcgcgctcgccgcgggcctcgctccggcgcttctgatccggcgcagccgtccgctgctcgcggtgaccgcgatggtcaccgccacgcttctcgccccgctgctcaccgacggcgcgccgccggaggagtattcgctggcctaccttctgctgctgccctatgcgttgttccgctggggctccggccggcagatcgcgatcgggctcggcgtgatcgtcggcaaacaggccctggcgtacgcgttcgggcaggtcgacgtcggtgacacgatcggtggcacggtgctggccggggcgatcctggcactcggtgcggccgtacgctaccggaccggcgcccgcgcgcgggagagggagcaggtgcggctgcgcgaacgtgaacgtctcgcccgcgacctgcacgacacggtggcgcaccacgtctccgcgatggcgatccgcgcccaggccgggctggccacctcggccgcccacccggacgcggccgcggacgccctgcggctgatcgaaaccgaggccaaggaggcgctggccgagatgcgcaccgtgatccgcgccctgcgcaccgacgaaccggacgcgccccggctcgccgacctgatcggtctcgcgacgggcgccggaccgcgggtggacatcgaggtcggggcggatctgggggcggtggcgccggcgatcggggcggcgatctaccggatcgcccaggaggcgatcaccaacgcccgccggcacgcacggggcgcgacccggatcacggtgcgggtcgcggcggacgcgacgcaggtgcggttgcgggtcgaggacgacggcgcggcaccgggtccgctgcggtccgggacgatggcggggtacggggtgagcggcatgcgtgagcgcgccgagttgctgggcggcacgtgcacggccggcccggccgccgatcgtggctggtgcgtcgaggccgtcctgccccggccgatcctccccggcgcggtgacccgatga

SEQ ID NO: 5861 - DNA, 651 bp, Actinoplanes utahensis
atgaccgtgcgggtgctggtggcggacgatcaggagatcgtgcggaccgggctgaccctgatcctcaacgcgcagccggacatccaggtgatcgccgaggcggcgaacgggtatcacgccgtcgagctggcccggcggctgcggcccgacgtgtgcctgctcgacatccggatgcccggcgtggacggcatcaccgccacccgggaactcgccgggcccggcgtcgccgacccgctggcggtcgtggtgatcacgacgttcgacctggacgagcacgtgtacggggcgttgcgggccggggcgcgcggtttcctgctcaaggaggccgggccggaactgctgggccaggcggtgcgggcggccgcggccggtgacgcgatcatcgctccggcggtgaccgcccggctgctgggggagttcgcccggggcccgcaccggggcgcgtcgcggcagccggccgagccgctgaccgaacgcgaggagcaggtcctggcggcggtcgccggtgggcggacgaacaatgagatcgccgctgacctccacatcagcctcagcaccgtgaagacccatgtggccagcctgatgaccaagctcggggcgcggaaccgggtggagatcgcgatgtgggcatacgagaccgggcgccggtaa

SEQ ID NO: 5862 - DNA, 768 bp, Actinoplanes utahensis
atgaccactgcggcggggatcgatcgggcaccggacgacgacaggatgcgagccggcggggacgtgcctgccggccgcgccgggaaggatgccgcgaaggaagggcgcggtgcgcgacgtccgcagcggcggcggcgtggcggctggcggatcccggcgggtctgatcgcgctgagcctggtgccgtcgatcgcgggcgcacaccggctcggggagctggcgacgagcgcgccggtcaccgaggagaacgcgcggttcttcgcgatgccgctcccggtggtggcgcacatcatcggcgcgatcgtctacagcgtgctcggtgcgttccagttcgcgcccgccttccggcgccggcacccgggctggcaccggatcgcgggccgggtgctggtcggggcgggcgtgatcgtggcggtcagcggcctgtggatggcggtgttctacgatctgccgccgatcgacggtccggtactggagctcacccggctggtcgtcggcaccgggatgctcgccgcgctggtcctggccgtggtgacgatccgccggcgggacatcgccgcccaccgcgcctggatgatccgggcctacgcgctggcgatgggcgccggcacgcaggtcttcacccaccttccctacgagctgatcgccgggacacccggtgtcgggacccgcgcgttcctgatgggcgccggctgggggatcaacatcatcgtcgctgagtggatcatccgaggccgtcccggtccacgcgcccgccgcccggcctga

SEQ ID NO: 5863 - DNA, 3009 bp, Actinoplanes utahensis
gtgcgtggagcggggacgcctagacttcggcgcatgctcaccatgcaggaggctctggcccggttgacggcgtactggacggagcagggatgcctgatcgtccagccgatgaacaccgaggtcggagcgggaaccctgaacccggccaccttcctgcgggtgctcggtccggagccgtggcgggtcgtctacgtggagccgtcggtgcggccggacgactcccggtacggcgagaacccgaaccggctgcagacccacacccagctgcaggtgatcctgaaaccggacccgggcaacccgcaggagctgtacctcgggagtctggcggcgctgggcatcgacgtggccgcgcacgacgtgcggttcgtggaggacaactgggcctcgccggcgctcggggcgtgggggttgggctgggaggtctggctcgacgggctggagatcacccagttcacgtacttccagcaggccggtgggctgaacctggacccggtgtcggtggagatcacctacggcatcgagcggatcatcatggcgctgcaggacaagcagcacttcaaggagatcgagtacgcgccgggggtcagctacggcgaggtcttcggccaggccgagtacgagatgtcccgctactacctcgacgacgcggacatcgacgccaaccggcggctgctcgagctgtacgccggtgaggcgcagcggatgatcgacgccggcctgcccgtgccggcgcacagctacgtgctcaaatgctcgcaggccttcaacgtgctcgactcgcggggcgccgtgtcgaccgccgagcgggccgccgagttcggccggatgcgccgcctcgccggggaggtcgccaagctctgggtggcccgccgcgcggaacaggaacacccgctcggcaccaccggggagccggcggcggcccgcgcggccggcagcacgcagaccggggacacgccgcgcaccctgctcttcgagatcggcaccgaggaactgccgccggccgaactgcgcaacgcccgggagcagctgctgcgcctggtcaccgagggcctggccggcacccggctggggcacggcgagatccgcgtcttcggcacgccgcgacggttgatcgcggtggtccaggcggtcgccgcccgcgaggacgaccacgtgcgcaccgtcaaaggccccaagacccaggcggcgtacgccgcggacggcaccacccccaccaaggcgctcgacgggttcctccgcgggcagggcgcgacgctcgccgagctggagacggcggagttcaacggcgtaccgcacgtcgtcgtccgcaagccggaggccggtggcgcggcgccgcaggtgctggccgccgtcctggcgaaggtcgtcggcggcctgcgggccgccaagaacatgcggtggaacgacccgaagctggcgttcagccgtccgctgcgctggctgaccgccctctggggcgacgacgtggtgccggtcgcggtgtccacgctggccgccggccggcagacccggctgctgcgcaccgccgtcccgccggtcgccgagatcgcgtcggccgagacgttcctggagacgctcggcgtcaacgggatcgtggccgaccacgaggaccgccgcgagctgatcgtggtcggcgcgcaggacctcgtctaccccgacgggaaggtggacgtggccggcgaggcggcgctgatcgaccagatcaccgacctggtggagcagccgctgccgctgctcggcacgttcgacgagggttacctgacgctgcccgacgcggtgctgaccacggtgatgcgcaagcaccagcggtatcttccggtccgcgacgaggacggccggctgctgccgatgttcgtcacggtggcgaacgggccggtcgacgtcgaactggtccgctccggcaacgaggcggtgctgcgggcccgatacgaggatgcccgcttcttctaccgggccgacctcgacaccccgctcgccgagctgaaggcccggctggaccggctcaccttcaccgacaagctgggctcgatggccgaccgggcgggccggatcggcgctctcgccaagcagctcgccgagcgcctcgacctgggctcgccgaccctggatcgggccgccgagctggtcaagttcgacctggggtcgcagctggtcaccgagatgaccagcctggccggggtgatggcccgggactacgcgctgcacgccggtgagtcgcggccggtggccgaggcggtcttcgaggcggaactgccgcgcaacaccggggacgccctgccccggacgctgcccggcgccctgctctcgctggccgaccggctcgacctggtggccggcctggccgccacggtcgggctgccgaccggctccagcgacccgttcgccgtccgccgggcggtgctcggcctgctcgccgtgcaccgggccacgcccgagttcgccgacctgtcgctggtcgacgcgctcaccctggccgcggccgcgcagccggtgccggtcgccgccgaggtgcttccggcggtggccgacttcctggcgaaacgtctggagcaggcactgaccgaggagggccggccggtcgaccggatccgtgcggtgctgccgcacttcgcccgcccgtcggtggccgacacgctgctagcgcagctcgccccggccgtcgccgacccggatttcgcggcggtcgccgcggcgatccagcgggcccggcggatcgtcccggacggcaccaccgcgcggtacgacgcgggcgccctgaaggagccggccgagctggccctgcacgacgcggtcaccgcggtccgcgccgctctcggcccggatgcgggcaccgatctgccccgcttcgtcgcggccaccggtcggctggtgaccccggtcaacacgttcttcgacgacgtcctggtgatggccgacgacccggcgatccgggcggcccgcctgggcctgctggccaccgtccgcgacctgggtgacggtctgctggactggccgcagctccgcctctga

SEQ ID NO: 5864 - DNA, 657 bp, Actinoplanes utahensis
gtggcgatcgaggcgctgatctttgatttcgacggtctgctgatggacaccgagaccaccctgctggacagctggcgatgggagtggcggcagcacggcctgcggctcgacgagtccggattcttcgccgaccacggcggcgacaccagcgagatccgctacgccgccctcgccgcggcggtcgggccgggtttcgaccggtcggccagccatgcccgccgcaccgcgtaccgcgagcgggcgcacgccgcgctcggcctggccaccggcatctccgcctggctcgccgaagccgaacgccgcggcctgcgcctcgccgtcgccagcagctccgccggcgcctgggtccgcaccaacctggcccgcaccggtgacctcccccgcttcgaggtcctggcctgcggtgacgaggtcccggccgacaaacccgacccggccgtctaccacctggccctgcaccgtctcggcctcaccgcggaccgggccgtcgccttcgaggactccccgcacggcgtcaccgccgcccgggccgccggcctgcgctgcgtcgccatccccaacccgcacaccccgcatgcccgctaccggcatgccgacaccctgctccccagcgccgccacgaccatcctcagcgaggtcctcgcccgtctggcgtag

SEQ ID NO: 5865 - DNA, 2145 bp, Actinoplanes utahensis
atggtccaggtcggcggtgtgcagcaggatcaccgggtggtcactgctggccagggtgcggcgcagacgctggtgctcggccaggaccacggccgggtcgccggtggtggcggccagttcggcggcgaactggccggacagggtcagcgtggccaggtcgtcgcggcgggtgaagtcgagctcggcgcgggggtcggcggaggccggccaggactccgggcgggggccgaaaccggcgtgcggctgggcggcgggggtcagcgccgggggcgcgctgtgacgatcgaacgcggacaggacgatggcggcgaccgcggccgaggcgaacagggtgacggcggtggcggtcacggctgggtggcgcacgtgcacggggccctccgggtgtccggcgcgcgggacttctcgacgctaaccgcccagagcatcgatttccagggcatacctccggttcagccggacgggtcggcggcgcacggcgcggggccggcggggacggtggggcggggagggcccggtgggatgccccgcagggccgggtaccggatcgcaactcaactgcgaccgggtggcgggcgccggcggctcaagccgggggcggttgtgccgaccagtgggaccatgagcgtgggcagcggattgcacacagccggtcctctggtggaggctcccggcggcacgggcgcggaacccgatcggcaggtgctcctgctggccgaacttgtcggcttcatgaccaaggacaccccgtcggtccagcacgtactggacctgatgaccccgcacctgtgcgaggtggccgggttgaccgcggcaacggtgttcgagctggattcggagagtggcctgatggccgcgaccgcccagttcggcgagccggggcggcgcgaccagatggtcgccggcaaggtgttccgggcggcggccggtgggccgccggtggtcagtggtcagcagatggcgatccggctgcggatcggcggccagaccgtcggggtgctgctgctgaccggcgagaggctcgccgagctgcggccggacaccatctcgacgatcgcgctgcatttcgcgaccaccctgcaggggctgttcgcggagaaggcgcggcagttcgtggcgcacaccagcaccacgatccaggagctgttcgagaagggcatgaccgcgggcagcgtggaagaggcggccgagctgctcacccactcgtgcgcgaccgcgttccggaccgagcacgccgggctccacctgatcgacagcgacgggcggatccggtacgtctacggggtgggctgccccgacgagcggctggagcagttgcgcctgaacctggtcggcaagtccgcgatcgagtcgccggtctggcgcagcacggtcgagtcgggggagccggtgctgatcaacaacgcctcgacggccaaggtgcggccgggcgggatgaccgagaccctcgggctcgggtcgttcatcgcgatgccgttgatgaccggtttcggagcggtcggcatggtgctgtgcggcgactcgtccggcgcccgggagtggagcgggcgggaccggatcctggcccagcagctctccgccgagggtgcactgatcatggacagtgcccggatgcggcaggcgaaccgattgcacgtcgaggagctgacccggcaggcgttccacgactcgctgaccgggctgccgaaccgcaagcacctgctggaccggggcgacgaggcgatcgagatcgccatgtgcaccggcacccggctggccctgctgctgctcgacctcaacgggttcaagcaggtcaacgacacgatcgggcaccacgccggcgacgtgctgctgcagctggtggccaagcggctggacggcctgatccgcaagccggacctggtggcccggctcggcggcgacgagttctcggtgctggtcaccgggaacccggacgaccaggcggcggtccgggtcggcgagcggatctgcgagcggctgcgcgagccgttcgagatcgacggcaagccggtgcagatcggggcgagcatcggggtggcgctgttcccgcggcacgcgaccaacatcggcgatctgatgaaggacgccgacgccagtatgtacctggccaagcgcagcggcggtggagtgcacctgaccgcctga

SEQ ID NO: 5866 - DNA, 1320 bp, Actinoplanes utahensis
atgcgatcacgccgacgacgtggccggccggctcgacgacgaacggcgcatgcgggaggtcctgaccgcggtccggggactgccccgtgccgaacgggaggccgtcgccctctgcctctggtccggcgtgggttacccggaagccgccgcggtcctcggcatcaccgagaccgcggtccgcagccgggtgagccgggcgcgctcccgcctcacccgttccctctcccccgcgccgccgtccgcctctcccgctccgccgcctgcctcgcccgcttctcccgctccgccgcctgcctcgcccgcctctcccgctccgccgcctgcctcgcccgcctctcccgctccgccgcctgcctcgcccgcctctcccgctccgccgcctgcctctgccgccgcgccgcccgtcttgcctgccgcgacgctgaccggaaaccatcagacgcttacggagggacaccgatgaccaccgacctggacctcccggccgagcgcgacctcccgccggcccacgccgcgcggatccgggcgacgctgctgcacacgccggaaaagcgcgaccggcgcgcgctgcggctcgcgatcgcggcgtccctcacgatcgccgtcgcctccgcgatcgccttcgtacggccgcagccgctgcccaccacgatcgccctcggccccggtgagttgtcgtcgaccctggaggccgtggtcgatcactgcgtcgcccagcgcgccgagatcgtcgaacgccttcccgagcccgcggacctgcccgcggtgtcatcggccgatgtcgcggtggccgccgaaacccatggccaggccaccgtcctattcgtcaacgagcgcggattcgcggcctgctccgcggcccagatcgcccgccccgtcttcggcgtccgcatcgaggcggacggcggtttcaccggcggcccgtgggacggccggcgggactggctgcccggcccggtggaggtgctgatgtccggctcgtcggatcgcggcggccccgcccagctggacgtggtcggccgggtcagctcccgggtggcccggctggtcgccgtcgacgggccgcaccaggtcccggccagcctcgcgaacggcgccttcggcctgctcggcaccggcgacgtgctcggcccgggcacccgcctgatcgcctacgacgcggccggcgagccgatccacgaggagccgctgttccccgccaccgcggatcgcgtcacccgatgctgggccgatcccaccggcagggtcctctaccagccctcggaccagccccccggcaagcccggcaactgccttcccgccgagccctggggcttctga

SEQ ID NO: 5867 - DNA, 1776 bp, Actinoplanes utahensis
atgagacccatctccacccgggcccgcgccctcacggcagccgccgccgtgagtgtcgtggccggcgccggcgcggtcgcgatcgcgtccgaggccagcgccgccgccggctgtcgcgtcgattattcggtgaaccagtggagcaccggcttcaccggcaacgtcacggtcaccaacctcggtgacccgatctccggcggctggaacctcacctgggacttccccggcaaccagacgatcacccagggctggagcgccaccatcgcccagtccggccagcatgtcaccgccaccaacccgtcgtgggccacctccatcggcaccaacgggacggcgaacttcggcttcaacgcgaactactcgggcaccaacaccgcgccggccgcgttcaagctgaacggtctcgcctgcaccgggacggtcccgaactcgccgccgccgtcgtcgagcggaccgtcgaccggtccctccaccggtccgtccaccggaccctcgaccgggccgtcgacgaacccgggcaccaaggtggacaacccgtacgccggggtgaagggttacgtcaacccggagtggaaggcgaaggccgacgccgagcccggtggcagccgggtctcgaacaacccgaccgccgtctggctggaccggatcgccgcgatcgccggcacctcggacagcagctccaacggctcgatgggtctgcgggaccacctgaacgccgcgctcgcccaaggcgccggctacatccagctggtcatctacgacctgcccggccgggactgcgccgcgctcgcctccaacggtgagctgggcccggacgacctgccgcggtacaagagcgagtacatcgacccgatcgccgcgatcgaggccgacgcgaagtacaagaacctgcggatcatcaacatcgtcgagatcgactcgctgccgaacctggtgaccaacacctccggccaggccggcggcaccgcgatgtgcgacacgatgaaggccaacgggggatacgtcaacggcatcgggtacgcgctgaacaagctcggtgcgatcggcaacgtctacaactacgtggacgccgcgcaccacggctggatcggctgggactcgaacttcggcccgaccgcggacatcatgctgagcgccgccaaggcgtccggcaacgtcaacaacgtgaccggcttcatcaccgacacggcgaactactccgcgctgcgggagccgttcgtgcagccgaccaccacggtgaacggccagagcgtccggcagtcgaagtgggtcgactggaaccagtacaccgatgagctgacgttcgcccaggcgttccggcagaagctgatctcgatcggcttcaacagcaacatcggcatgctgatcgacacctcgcgcaacggctggggcggctcggcccggcccaccagggcgagcacctcgaccgacgtcaacacctacgtcaacgagtcgcgcatcgaccgccggatccacgccggcaactggtgcaaccaggccggcgccggcctgggtgagcggcccaccgcggctcccgagccggggatcgacgcctacgtctgggtgaagcccccgggtgagtccgacggctcctcctcgctgatcccgaacgacgagggcaagggcttcgaccggatgtgcgacccgacctacaccggcaacgcccgcaacggcaacagcatgagcggtgccctgccgaacgccccgatctccggggcctggttctccgcccagttccagcagctgatggccaacgcgtacccgccgttgtcctga

SEQ ID NO: 5868 - DNA, 705 bp, Actinoplanes utahensis
atgcccggggcgggggtcctaccgtgtccgacgatgaccgatgaggtgcagtggcggatcggcgggcggcgggtggtcgcggccgccgccggcgtgaccggccggcgctatgaccggaactacgacgtcttccacctcgacccggaccggccgctggccgtcgtcgccgacggaatgggcgcgggggagggcagcgcggccgccggtcggatcacggtgcggaccttcgtggcgctggccggcgatccggccccggccgcgctgcgggccgtcacggcgcgggcccacgagggcgtacgcacgcaggtccgaacccgggacgggctgaccgggtgcacgctgaccgccctgaccgcggtggccgatgacgacggcgccgccgtacggatcgtgcagctcggtgactcgcgcgcctaccgcctccgggacggcctgctcgaactgctcacggtcgaccacacggtggcctggctgggcctggtgcacgggtggtacgccgcctccgacccgcgcgcggaggcggacggatatcgcctcatccgttatgtcggacatccggatcgaccggagccggacgtggtggaggtcgcggtgcgccccggggaccggctgctgctctgcaccgacggggtgtcgggccagctcgactacccgactctgggccggctgttgggcggcgctggcccggccggggggtctagctag

SEQ ID NO: 5869 - DNA, 705 bp, Actinoplanes utahensis
atgaccacccgtaccgccacgatcgccgccgggatcggcgcgctcgccctcgtctccgtcggcctgccggcgggggtgtcgttcgccggcaccgaccgacccgtggtcgccgaccgagccgtggtcgccgaccgagccgtggtcgccgaccgacccgcgatggccgaccgacccgcgatggccgaccgacccgcgatggccggccgagccgcggtcgccgaccggtcggccaccacccgggaggagggcttcctcggcggtgagcccccggtcccgacggcgctgcagccgccggccgggaatgtcctgcacgctgtcctcaaagcccgcggtgtgcagatctacgaatgcaggcgcagcatgtggcagctgctcgaagcggccgcgtcgctcaacggggccaccgtgaacccggtccggaaggtcaccgcggtgcacttccgcgggccggcgtgggtctccgaccaggacggctcgacggtggcgggcgccgacccggtcagcgcgccgggcgccggggcgggtgacgtgccgcaggtgctgtatcgggccaccgggaaccggggcggcgggctgttcggggaggtcacctacattcagcggatcgccacccagggtggcgtggcgccgacgaagtcctgcgggggcaatcagccgatcgcagtcccgtaccacgctgtgtaccgatttttcgtgaaaaagtag

SEQ ID NO: 5870 - DNA, 876 bp, Actinoplanes utahensis
gtgggcccgcgactgaaccattcggcccggccaggcgaactcataggtgacggtgacgtcacgaggagggggaacgacgtgcggcatcacaccgcgctgatctgggccacactgaccggcatcaccctcgcggcggccacggccgccggacccgccctggccgacgtgccgggcttcgcgctcaaggtgacctcgcccgccaccgccaaggccggcggcgccgccccgaaggtgaccgcggtcgtcacctcgaaccaggcgggctgccgcaaggtccgctggaccatggtgatccgcggcggcgacgtctcgctcgaccagatccgggtgacccggatcgagaacggcggcgagttcgccacccgggtcagcgtcaccgggaacaccgccaccatcgtcgaccagcagcccgacccgggcatcctgtgccgggaccggacggtgaccggcacctggcagctcgccttcggcggccgtgacggcggccgggtgcagttcgaggtgcaggccttcgacgagcgcaacacccggctcaccgcggccggttcggcgatcgaggtggccgggccggtggcgaccaccacgccggccccgcgcccgccgcagaccagcgcctcccccgccacctcgccgaccggcgacgacggcgtcagcgaggtggtcaccaccgcgccgatcgtgcagccgacccggagcgacaacgccgccgcgctcagcccggcggccaaccagagcaacctgctggggcccggcctgatcgtcggcggggtgttcttcttcctcgggttgctgctgatcctgcggctgcgggcgcgcacccggaaggcgcgcgggcgggacgaggcgctgccgaccgggttctacacgatgccgtga

SEQ ID NO: 5871 - DNA, 969 bp, Actinoplanes utahensis
ttgagcacggggcgttccccacgaacgccggcgtcccaccgcccacgggacgtgaccgttgcggaaaacgaggagtcaatggcccggtcgaagaacaaagagcgcaccgccagtagggtggcggtcgacatcggctccaccggcggtcggtccgtgcccccgagcgcggtgatcctgctggtggtctgtgtcctggcggcaatctgggcggtcgcgatgatgaccaagcccggccgcgtcggctacgtgtacttcttcatgtacgcggagtactacatgggggttctgaccctcgtgtcgctctccatcaccatcatggtcggcctggtctccaccgaccgcctggtcctctccatccggcagcgggtcttcctgcagtccacccaccggaccaccggcgtgatggcgatctcgtccctggcgttccacctgtggacgaagaccgtcgaggggcacatccgtgtcatcgacatctttatcccgttcatcgcccagggaaacaacctgttctacatcgggctgggacagatctccggatacatcctggttctggtcacctggagcggcctgatccgggcccggttcatcggccgcggcaagccgtggatgtggcgggcgatccactcgatctcctacctgatgtggccgatcgccctggtccacggtctgagcgcgggccgtgccgcgaagacctgggtgatcgtcagctacgtgatctgcgtgctgctggtgctgatcggcctggccgtgcggctctcggtcagcctgaaccggcgcaaggacttcgcctcggccgccggggtcggcgcggccaagccgtccgggaacgtggtgcccacctccggtggcggcgcccgcggccggttcggcgggggccggtcggcccgcgagcagaccaccgacctgctggcgcccgccgaaaccccggcggtgagcagctggatcccggccgcgcccgcggctagctag

SEQ ID NO: 5872 - DNA, 675 bp, Actinoplanes utahensis
atgccgcgccgcgagttcgaggacgaccggtacgaggagccggccctgcgcggacgccgccgggacgacgactactacgacgaggagccccggccgcggggccggcgctacgccgacgacgaggtggaagaggagccgcgcggccgccgggcggcgcggacctcgatggacgacaccagcacccggctgcgccgcgacgagatgaccgagaccggcacccggctgcggatcgaggacaccggcaccgggctgcgccgggacgagatgaccgagaccggcacccggctgcgccgcgacgagatgaccgagaccggcacccggatgcgccgctacgccgacgacgacgcctactacgacgagccggcccgcggccgtcgccgggccgacgccgagccccgctacgaggacgtcccccgccagcgcgccccgcgctacgaggaggacgacgagccgcgcggcggccgccgccgcgccgacgacggccggcacagccgcagcgagttcgtcgacctggccgacgaccggtacgccgatgacgacagcctggtcgacacgtccgcccgccgtgcccgccggccctccgccgacgtgctccgcggcaacccggccggccgcggccgggcccgggacgacgacgactcgtacttctcgcagctgcgcggtgacgtcaattga

SEQ ID NO: 5873 - DNA, 1479 bp, Actinoplanes utahensis
ttgagcacggcacaggttcccccggtcacctcgatcggcatcccgcggatcaccgcgggctacgacgagtacggccgcctcgacctgcaggcgcaccaggaggtgcacggcgggtttgcggcgctgtcgtccggtgagctgatcggcctcaccgaccgcatcgagctgcgtgggcgcggcggggcgggtttcccgttcgcccgcaaggtgcgcgcggtcatcgactcctgcaagcgccaggacctgcccccggtgatcgtggtgaacgccaccgagggtgagcccccgtcctggaaggacaaggcgatcctgacccggtcgccgcacctgatcctggacggcgcggcgctggccgcggccgccctggacgccgaggagatcgtgatcggcatcgccgatgacggcatcgggcagaattcgctggccgccgccctggccgagcggaagatgccgtgcccgacccggctcgtcacggtcccgcaccggttcatctccggcgagggcggcgcgctggtccgcgggatcaacggcgaggcgcacatcccgcccggccgcaaggtccgctccagcgacaacggcgtgatggggctgcccaccctgctctccaacgccgagacgtactcgcagctggcgatcgcggcccggctcggcccgtgggagtacaactcggtcggcatcccggaggagccgggcacggtgatgctcaccgtcggcggttcggccaccaacccggccgtcgtcgaggcgcccagcggcaccccgctgatggacgtgctcaccatgtgcggcgcggacatcggccccggcctgctggtcggcggctaccacggcaagtggatcagcgccgagcaggcgcagacggtgaccatctcgcgcaagggcttcgccaaggtcgggggcacgctcggcgccggcatgctgatcccgatcggctcgaagacctgcgcgctgggcgaggtcgcccaggtcgtgcagtatctggccggcgagtccgccggccagtgcggcccgtgccggctcggtctgcccgacctggcccgcgcggtcaccctggtgtcactcggcggttccgcgctggagcaggtccggcaggcggccggcctggtgaagggccggggtgcgtgcagccacccggacggcacgtcccggttcgcgctgtccgcgctcgaggtgttccagaaggacgtggaggcgcacgccaacggcgagggctgcggcaagcaggtccgcggcatcctcccgctgccgtacacggccgagaagggcgcccggaagctggccctggactggtcccgctgtgacgggcacggcctgtgctcggcggtcgccccggagatcatccggctggaccacaacggcttcccggcgtttccgcagacgccgctgccgccgtggctggaggacggcgcccgtaaggcggtcaacgtctgcccggcgctggccctgcgtctgatcgacccggccaccgcggcgcattga

SEQ ID NO: 5874 - DNA, 534 bp, Actinoplanes utahensis
atgagcacccggcgtgccctgctgacgcttccgttcgcgatgctggccgccggctgcgccgcggcgccggaggcggcgaccccggcggccgcggccggtcgagggtccgggtcagccgcggccccggccgtccccgacacactgcgattcagcggtacgacgctggacggcacgaagttcgacgccgcccagttggcgggccggcccgccgtcctgtggttctgggcgccgtggtgcgccacctgtgccagcgaggcccagtccgtcgccgacttccacgacgagtacgccgggcgtctcaccttcctcggcatcgccggtctgggcaccgcgaaggccatgcgccagttcgtcgccgacctggacgtcggcaaggtcacccacctgaacgacccgtccggcacgatctggtcgaagttcggcatcgcccagcagagcacctacgtcctgctggacgccgccggaaagatcgtcacccggggttacctcgacgacctgcagctcaccgccgccctcaagaagctggccggctga

SEQ ID NO: 5875 - DNA, 267 bp, Actinoplanes utahensis
gtgaccgtcgtcgccaccctggtcgtcgaggggccgtcccgctcactggccaccctcgcccgcgccgtcccgatcaccgtggacggcgcggcgaaagggcgggtccgggccgggaaacggctcacgctggccctcccgcccgggtcgcactcgatccaggcgggcggcgggccggcgctgccggtgcggctcgcgcccggtctggtcacccgggtgcgggtggagcgggacgcggccggccgcacccacctgatcgaggtcggctga

SEQ ID NO: 5876 - DNA, 249 bp, Actinoplanes utahensis
atgaactccgtgcacgacacgatggcccggcagggcctggtccgcccgcgggacggccgcatgctgggcggcgtctgcgcggggctggggcgccgcttcggcctcgacccgtggctcgcccgcctgctgttcgtgctgatcctgttcctgatcccgggcagccagatcctgatctacccggtcctctgggtgctgatgccggccgaggagaccgtctacagcccgcacaccccgccgaccacctggtga

SEQ ID NO: 5877 - DNA, 1794 bp, Actinoplanes utahensis
atggtcgacgacacggtgccgggcgaacggacgcaaccgttgcgtccgcacgatccgcgcacgcttggcgactacgagttgctcggccgtctcggcgagggcggcatgggcaccgtctacctgggccgcagggcgggcagtgagatcctggtcgcggtcaaggtggtccgcctcgacctggcgcacgacgacgagttccgccgccggttccgcagcgaggtggagcgggcccggcaggtgccgccgttctgcaccgccgaggtgctcgacgccgaccccgaccacgagcagccctacctggtcgtcgagttcgtcgacgggcccaccctggccgacgtggtcgagcgccgcggcccgctgacctcggccaacctgcacagcgtcgcgatcggggtggccaccgcgctgaccgcgatccacggcgccggcgtgatccaccgcgacctgaagccgcgcaacgtgctgctcgccccgggcacccccaaggtgatcgacttcgggatcgcccgggccatgtcggccaccagcggcaacacccgccccgaccagatggtcggcaccgtggcgtacatggcgcccgagcggttcaacaccgactccgacaccccgatgctcaccccggccgccgacgtgttcgcctggggcagcgtggtcacctacgccggtaccggcaagaccccgttctccgccgactcgccgaccgcgaccgccgcccgcatcctcacccagccgccccggctgcacggtctcaccggcccgctgcgcgacctggtggcccactcgctggagaaggatccggccaaccggcccagcgcccgcgagctgctcgacctgctgatctccggtgaccgcccggcggccaccgcggccgccctggccgaccagcccgacctgcgcgccgccgcggtcgaggcgcaggccgtcaccgggtacgcgttgccgtcggcgaccgtcacgccgctgcccggtccggccctggacatcccgcccggcctggtcggctacagcgagaactcgatcgtcacggtgccgatcgagcagacccgggacaccacggggaccggcgcgccggccgcccgcccgcgccgccgggtgctgccggtcctgctcgggctgctgaccgtgctggtgatcgccggtggcctggcgttcaccggggtgctgctgcgcgaccacttcgccggccgctccgacgcggcggccggcccgtcgccggtccccgagtccgggtcgaccggcgccgcgcctcgctacgcggacgcgctggccaccgagggcctgtggcaccccaccgtgcaggacgacgagcaggccagctgcgcgttcgccaaggcggccctggtcgcgcggcgcgagaccacggggacctaccggtgccgtgggccgaaggacgtgctcaccgacgccacggtggaggtcggcgtccggctcgacacccggtacagctgcgccgccgtctggttccgcttcgacgacaagctcggcggctaccagctgcgcgtctgcgagagggacgtctatctcagcgagcaccgcgacgatgtgatcacggccccccggacgctgccgctgacccggccgatcgccctgtacgccacgccggtccggatcggcctgcggatccagggcaacgcggtcgagatcagccaggacgacacggtgatcggcacactcccgctgaagaacgccacgctcacccacggccgcgtggtgctcggcgtcttcaacgacccggcggcgcccaaggccggcccctacgaggtcgcgttcagcgacgtcaagatctggggctga

SEQ ID NO: 5878 - DNA, 2565 bp, Actinoplanes utahensis
atggtgcaagagtgccaaagcccgggaagggttgtctctagtaaacgtgcacctccgctcggaagaccccgatcgcccgggcgtttccgcaggtcgtggcggtgcacccggccgggcggttcacccgggagccagacatcgcgcgggcgcgtcggaaaagccctacgggtgatcatctaccgccgggtgtgcggggcggcgcgacaagccgcggcggcctcggtaacaatcgtcgacgtgacgacagcgatccatcagcgcattgcctccgagctcggggtccgcgaagggcaggtcaccgccgcggtcgagctgctcgacggcggcgccaccgtcccgttcatcgcccggtaccgcaaggaggtgaccggcaccctcgacgacgcgcagctgcgcaccctggaggagcgcctgggctacctgcgggagctggaggaccggcgggccgcggtgctggagtcgatccgctcgcagggcaagctggacgacgcgctggagcggcagatcctggaggccgacacgaaggcccggctggaggacatctacctcccgttcaagccgaagcgccggacgaaggcccagatcgcccgtgaggccggcctggagcccctggcggtcggtttgctgggtgaccccaccgtcgacccgaaagcggccgctgaggccttcgtggacgccgagaagggggtcgccgacgggcaggccgccctggacggcgcccgggccatcctgatcgagcggttcgccgaggacgccgacctgatcggcgagcttcgcgagcagatgtggacccggggccggctggtcgccaaggtccgcgacggcaagcagaccgacggggcgaagttcgccgactacttcgacttcgccgagccgtacgccaagctgccctcgcaccgcatcctggccatgctgcgcggcgagaaggaggaggtcctcgacctcaccatggagccgcacccggaggaggacgagggctacttcgagggccggatcgccgggcgcaacgggatcagcaaccagggtcgcgccggcgacaagtggctgatcgacacggtgcgctgggcgtggcgcacccggatcctcatccacctcggcgccgacctgcgggtccggctgcgcgaggcggccgaggacgaggccgtccgggtcttcgcggcgaacctgcgcgacctgctgctggccgctccggccggcacccgcgccacgatgggcctggacccgggcttccgcaccggggtgaaggtggccgtggtcgacgcgaccggaaagtgcgtcgacaccgccgtgatctatccgcacgtcccgcagaacaggtgggacgagtcgatccacaagctggccgcgctggccagcaagcacaacgtcgagctgatcgcgatcggcaacggcaccgcctcccgggagaccgacaagctcgccaccgagctgatcaggagacacccggacgcgaagctgaccaaggtcgtcgtctccgaggcgggcgcgtcggtctactcggcgtcggcgtacgcgtcgcaggaactgcccggcctcgacgtgtcgctgcgcggggcggtgtcgatcgcccgccgcctgcaggacccgctcgccgagcttgtcaagatcgacccgaagtcgatcggcgtcgggcagtaccagcacgacatctccgaggtcaagctggcccgctcgctggacgcggtggtcgaggactgtgtgaacggtgtcggcgtcgacgtgaacaccgcgtccgcgccgctgctcacccgggtctccgggatcaccgccggcctggccgagaacatcgtgctgcaccgcgaccagaacggcccgttcaagaaccgcaacgagatcaagaaggtggcgcggctcggcccgaaggcgttcgagcagtgcgccggcttcctgcggatccgggacggcgaggacccgctggacttctccagcgtgcaccccgagtcgtacccgctggtccgcacgatcgccgcggacgccggctccgacgtcaagacgctgatcggcaacagcccgctgctcaagggcatccggccggacaagttcgtcaccgacacggtcggcctgccgacgatcaccgacatcctcaaggagctggagaaaccgggtcgggacccgcgcccggccttcaccacggcgaccttcgccgagggggtcgagaagatcgccgacctgaagcccggcatgatcctggagggccaggtcaccaacgtggcggcgttcggcgcgttcgtcgacatcggcgtccaccaggacgggctggtgcacgtctcggcgctgtccgagaagttcgtgcaggacccgcgcgaggtggtcaagtccggtgacgtggtcaaggtccgcgtcctcgaggtcgacccggtgcgcaagcggatctcactgaccatgcggctctccgacgagccccaccggaaccgtccgccgcgcgaggaccgcggtggtcagggcggcggcggacagcgcgaacagcgcgggccgggcggcggtccaggtgggcagcgcgggcagggtggtggccagcgcgggcagggcggtggccagggcggtcagcgcggcctagctagctag

SEQ ID NO: 5879 - DNA, 894 bp, Actinoplanes utahensis
atgatcacccgtagggcttttccgacgcgcccgcgcgatgtctggctcccgggtgaaccgcccggccgggtgcaccgccacgacctgcggaaacgcccgggcgatcggggtcttccgagcggaggtgcacgtttactagagacaacccttcccgggctttggcactcttgcaccatgacgcttgctgtccgggcggtcgccgccactgatcagggcctggtccggtccaacaacgaagactcggttttcgtcggaaatcgcctcttcgtggtcgcggacggcatgggcggtttgcccgccggtgagctggcgagcgacatcctggtgcaggtgctcggcggggtcgatcagaaacccgacaccggggagccgctgcaggacctgatcgaggcgctgcaggtcgccaacaagcagatcgagaagtcggtcgccgaggacgacgcccgcgacggcatgggcaccacggtgaccgcgctgctgctctccggcgaccggctggccgctctcaacgtcggcgactcccgctgctacctgctgcgcgacggcgacttccagcagctcacccgcgacgacacgtacgtgcaggcgctcgtcgaccagggcgtgctcaccccggacgacgcccgccgccacccgcagcgcgccctggtcacccaggccgtgcagggcggcccgttccgcccggccggccggatgatcccggcccgggtcggcgaccgctacctgctgtgcagcgacggcctctccgactacgtcgaggacgcggtgatcgcccagaccctgcgggacaacgcggaccgccgcacctgcgccgccgagctggtcaaccgcaccctggagaacggcgccccggacaacgtcacggtcatcgtcgccgacgtcatcgaggtctga

SEQ ID NO: 5880 - DNA, 555 bp, Actinoplanes utahensis
atgctgttggcgacggagcggttgatcctgcggaggttccgggcggcggacgcggcggcgttcgcggagtaccggtcggacccggacgtggcgcggtatcagtcgtgggacgccccgttcccgctgaacaaggccgatgtggcggtccgcaacttcgcggccagctcccccgaccagcccggctggttccagtacgcgatcgagcacacctcggagcgggtgctgatcggcgacgtcgcggtccgcctgcacgacaacctgcggcaggcggagatcggcttcacgctggccaccgcgtaccagaagatggggtatgccaccgaggcggtcagcgccgtcctggaccggctgttccgcctgcagggcctgcaccgggtgatgggggagtgcgacgcccgcaacgtcgcctcggccgccctgatggaacgtctcggcttcacccgcgagggcctgctgcggcagcagaccttcatcaagggcgaatggaccgacgacctgctgtacgggatcctcgccccggagtggctggcccgggagagtgtcgtacccctgtga

SEQ ID NO: 5881 - DNA, 483 bp, Actinoplanes utahensis
gtgtcgtacccctgtgatcggatcgccgccatggacatcgacggcttctggcgcctgatcgagcgcagcgcccccgagcccgaccgcgacgcctggctcaccggcacgctgcgcaagctggcccgggtgcacatcgaggatttcgagatcctgctgcaggagtgccgtgaccggatcgacaacgccgccacctgggccgccgcctacgtcgtctacgacgggcactgttccggcgacagtttccggtatttccagtgctggctgatcgggcagggccgggcggcgttcgagcgggtcgccgccgccccggacgcgctggcgacgctcccggcgatccagcggctggccgggcgcaccttccgggcgtgggacgacgacgagtggccggaccgggaggctctggccggcgtcgccgcgggggcctatccggacgactccctggaggacgtcctggcggagcgcggcttccggcgccgggagtag

SEQ ID NO: 5882 - DNA, 2151 bp, Actinoplanes utahensis
atgatcgggcacaccacctctcgcctggccgccgacgagcgcgccatgaacgccgtgatcgccggcgacacacacgacccgcacgccgtcctcggcgcgcacccggccggcgggcacaccgtcgtgcggaccctgcgcaagggtgcgacgaacgtcgcggtgctgcacgacgaccagcggtacgagacgaccctggtccacccggacgggatcttcgcggccgaactgccgggcaccgtcaccgactaccggctcgacatcgacgggacgcagtgcgacgacccgtaccggcacctgcccaccctgggcgaactcgacctgcacctgatcggtgagggtcggcacgagaagctgtggcgggtgctcggcgcgcagccgcgcggcgccggcgtcgccttcgcggtgtgggcgcccggcgcacgcggtgtccaggtgatcggcgacttcgccggctgggggccgttcgacgggtggccgatgcggtcgctgggctccagcggggtgtgggagctgtacgtgccgaacgcgcacatcggcaccaagtacaagtacaagatcctcggacgggacggggtgtggcgcgagcacgccgacccgctcgcgcagcacaccgaggtgcctccggcgaccgcctcggtggtgttccagtcgtcgtacgagtggcacgacgagtcgtggatgcgctcccgggcgtcgaaggcctggcatcaggagccgatcagctgctacgaggtgcacctgggctcgtggcggcccgggctcacctatctcgagctcgccgatcagctcgtcgactacgtcgtcgagacgggcttcacgcacgtcgagctgatgccggtgatggagcacccgttcggcggctcctggggctaccaggtgaccggatatttcgcgcccacctcccggttcggcaatcccgacgaattccggcatctggtcgacaagctgcaccaggccgggatcggcgtgatcctggactgggtaccggcgcacttcccgaaggacgaatgggcgctggcccgcttcgacggcaccccgctgtacgagcacggcgactggcggcgcggcgaacaccccgactggggtacgtacgtcttcgacttcggccgcaaggaggtccgcaacttcctggtcgccaacgctctgtactggtgcgaggagttccacgccgacggcctgcgggtcgacgcggtcgcctcgatgctctacctcgactactcgcgcaaggacggcgagtggacccccaaccagtacggtggccgggagaacctggacgcgatcagcttcctgcaggagatgaacgcgaccgtctacaagcaccaccccggcgtgatgacgatcgccgaggagtccaccgcgtggcccggggtcacccgccccacccacctcggcggcctcggcttcggcttcaagtggaacatgggctggatgaacgacaccctcgcctacatgacgaaggagccgatccaccggcagtggcaccaccaccagatgaccttcgccaccgtgtacgcctggagcgagaactacatcctgccgatcagccatgacgaggtggtgcacggcaagggctcactcaccggcaagatgcccggcgacctgtggcagaagctcgccaacacccgggccctgctcggcttcatgtgggccttcaccggcaagcagttgctgttcatgggcgccgagatgggtgacctgcgggagtggagcgaggaacgcggcctggactggggactgctcgacgacccgcagttcggcggcgtcaaaggcctgatcaccgacctgaaccgggtctaccgggagactcccgcggtctggacccaggacacctcggcgtccggcttccgctggatcaccagcgacgactcgcagcacaacacgttctcgttcctccgcttcgccccgaacggcgacccgatggcgtgcatcgtcaacttcgccgccgtcccgcacgagaactaccgcatcggactgccccgggccgggcgctggaccgaggcgatcaacaccgacagcgagctgtacggcggctcgggcgtcggcaacatgggcgcggtcgaggccgaggacatcccgtggcacggtttcgaccactcggccgccctgcgggtgccgccactgggcgccctctggctcaagctcgaccactga

SEQ ID NO: 5883 - DNA, 1314 bp, Actinoplanes utahensis
atgacgctgccctataccgagtggttgccgaaacagcgctggtacgcgggacgcagccgggtgctggcctcgctcaaggaggcgtccagcaccccgctgggcgaggaactggagctggtcctgctcgacgtgtcgtacaccgacggcagttccgagcggtaccaggtgctcatcgcccgcggcgccgagctgctgccggagtacagcgcggtggccaccatcggcaccgacgagcagggccgggtggcgtacgacgcgctctactccccggacgccgcgcgctacctgctggggctggtcgaccgctccgaaccggtcgccgacctgaccttcgagaaggagcccggggtcgagctgccgctggacaagtggccccgggtgttcgacgccgagcagagcaacaccagcgtgatcttcgagcaggacgcgatcctcaaggtgttccgccgggtcacctgcgggatcaacccggacatcgagctgaaccgggtgctcggccgggcggagaacccgcacgtcgcgcgcctgctggggtcgttcgagacgaccgacgacgcggggcagtgctcgctcgggatggtcaccgcgtacgccgccaattccgccgagggctgggcgatggcgaccgcgtcggcccgtgacctgttcgccgacgccgagatggccgccgacgaggtgggcggcgacttccagggcgagtcgtaccggctcggcgaggcggtcgcctcggtccacctgaccctggccgagcagctcggctccgggccgtcgccgttcccggtggacgcggtgctggcccggctgcggaccgccgccaacgcggtccccgagctgcagcagtacgtgccggcgatcaccgcgaagttcgaggcactcaccgggcatcaggtgaccgtccagcgggtacacggcgacctgcacctgggccaggtgctgcggaccccggaggcgtggctgctgatcgacttcgagggcgagcccggtcagccgctggacgaacgccggctgcccgactccccgctgcgggacgtggccggggtgctgcgctcctacgagtacgcggcctaccagctgctggtcgaccaggaggacgacgagcacctggcggcccgcgcccgcgagtgggtggaccgcaaccgggcggcgttctgcgacgggtacgcgcacgccgccgggctcgacccgcgggccgagggcgcactgctcgcggcctacgagttggacaaggcggtctacgaggccgcatacgaggcacggcaccgccccggatggctgcggatccccctccgctccatcgcccggctggccggctga

SEQ ID NO: 5884 - DNA, 1758 bp, Actinoplanes utahensis
atggacttgacgagcgagcatgatccggcagagggaagtcacaccgaggacgggatggtcgagcacccgtccgcggacgacttcggccatgcccgggcgctcccggccgaccgcacgtggtttcaacgcgcggtcttctacgaggtgctggtccgggcgttctacgactcgggctcggacggcggcggcgacctgcgcggcctgatcgagcgcctggactacctgcagtggctcggcgtggactgcctctggctgcccccgttctacgactcgccgctgcgcgacggcgggtacgacatccgcgacttctacaaggtgctgcccgagttcggcacggtcgacgacttcgtggcgctgctcgacgcggcgcacaagcgcggcatccgggtgatcaccgacctggtcatgaaccacacgtccgactcgcacccgtggttccaggcgtcccggcacgacccggacgggccgtacggcgacttctacgtctggaacgacaccagcgagaagtacaaggacgcgcggatcatcttcgtcgacaccgaggagtcgaactggacgttcgacccggtccggcggcagttctactggcaccggttcttctcccaccagccggacctcaactacgagaacccggccgtgcaggaggccatgctcgacgtgctccggttctggctggacctgggcatcgacgggttccggctggacgccgtgccgtacctgttcgaggaggaggggaccaactgcgagaacctgtcgcagacccacgccttcctcaagcactgccgcaaggtgatcgacgacgagttccccggccgggtgctgctggccgaggcgaaccagtggccggccgacgtggtggagtacttcggcgacgcgaagtccggtggcgacgagtgccacatggcgttccacttcccgctgatgccgcggatcttcatggcggtgcgccgcgagtcgcgcttcccgatctcggagatcctggcgcagaccccggccatcccggagaactgtcagtggggcatcttcctgcgtaaccacgacgagctgaccctcgagatggtcaccgacgaggaacgcgactacatgtacgcggagtacgccaaggacccgcggatgaaggcgaacgtcggcatccggcggcggctggccccgctgctggagaacgaccggaaccagatcgagctgttcaccgccctactgctgtcgctgcccgggtcgccggtgctgtactacggcgacgagatcgggatgggcgacaacatctggctcggcgaccgcgacggcgtgcgcaccccgatgcagtggaccccggaccgcaacgccggcttctccaccgccacccccggccggctctacctgccggtcaaccaggacccggtgtacgggtaccaggcggtcaacgtggaagctcagcgcgacagcgccacctcgctgttgaactggacccggaccatgctggcggtgcgccgccggcacgaggcgttcgccgtcggcacgttccgggagctgggcggctcgaacccctcggtgctggcgttcctgcgcgagttcggcgacgacgtggtgctgtgcgtcaacaacctgtcccggttcccgcagccgatcgagctgaacctgcagcactggaacgggtacaccccggtggagctgaccggccacgtgaacttcccgcggatcgggcagctgccgtacctcctgacccttccgggccacggcttctactggttccagttgtgcgggtcggaggagaagcaatga

SEQ ID NO: 5885 - DNA, 1965 bp, Actinoplanes utahensis
atgaccggtcgcttccccatcgaagacgtgacgccggctgtgtccggtggccgctaccccgcgaaggcggtggtcggtgaactggtaccggtttccgcggtgtcctatcgcgaaggtcaccacgcgctgggtgtgaatgtggtatggcgcggcccggacggccagccgcaggcgttcacccggatgacacccggcacgccgggcctggaccagtggcacgccgcgatccgccccgaccaggtcgggcggtggacgttcacgatcgaggcgttcgacgacccgtaccggacgtggcgcgacgccgtggtgaagaagatcggcgccgggcagggggccgaggacctggccaacgacctggccgagggcgccgacatcctggatctggccaccaagatcgtgccggccgagcacgaggagcgggtccgggccgcgtccgccgcgctgcgtgacgagcagcggtcgctgttctcccgggtcaccccggggctcgacctggaggagctgctctggcacaacccggtgcggcacctggtgaccacgacccggtcgttcgccatctgggtggatcgccagcgggcgctgtactcggcgtggtacgagttcttcccgcgctcggagggagccgagatcgggccggacgcgacgcccatcaggcacggcaccttccggacggccgcgctgcggctcccggccatcgccgagatgggcttcaacgtcgtgtacctgccgccgatccacccgatcggcaggatcaaccgcaaggggcggaacaacacgctggtcgcccgtccggtcgacgtcggctcgccgtgggcgatcgggtccgaggagggtgggcacgacgcgatccaccccgagctcggcacgctggaggacttcatcgccttccgggagagggccgaggagctgggcatggaggtcgcgctcgacctggccctgcaggcggctccggaccacccctgggtgtccgagcacccggagttcttcaccaccaaggcggacggcaccatcgcgtacgccgagaatccccccaagaagtaccaggacatctacccgatcaactgggacaacgactaccgcacgctgcgcgatgaggtctaccgcgtggtgatgcactgggtgaacgccggcgtgcggatcttccgggtcgacaacccgcacaccaaggcggtcaacttctggcagtggctgatccccaaggtcaaggagtcgcacccggacgtgctgttcctggccgaggcgttcacccggccggcgatgatgaacgggctcggcaagatcggcttcacccagtcgtacacgtacttcacctggcgcaccaccgcgcaggagatgcgcgagtacatggagcagctgctcacctcgatcgactggatgcggcccaacttctggcccaacacgccggacatcctgcacgagtcgctgcagcacggcggtccgccgatgttcaagatccgcgcggtgctggcgtcgatgctcacgccgtcctggggcatgtactccgggtacgagctgttcgagcacgtgccccggcccggctcggaggagtacatcgacaacgagaagttcgagctgaagccgcgcgactacgccgcggccgagcgggccggccggtccctcgccccctacctgaccaagctgaaccggatccgcgagcagaaccccgccctgcactggctccgcaatctgcgcttccacgagatcgacaacggcgcgctgctgtgcttctccaagcgcgacgccgacaccggcaacaccgtgctggtgatcgtctcgttcgactctgccaacgtgcagtggggcaacaccactctcgacatgccggccctcgggaaggactggcacgagaagttcactgtggtcgatcagatcagcggtgcgacgtacgagtgggggcagtacaacgcggtccggatcgacccctatgtcgagccggcgcacattttcgtggtgcaggcggggtaa

SEQ ID NO: 5886 - DNA, 597 bp, Actinoplanes utahensis
gtgtccggtccgtccaccgcactgtccccggtgatcgccgccagcacccactggctggcccgcgcttaccccggcggggagtcgaacacggtcgcgcacacgctctccgaactgcaggcccggcaggccgtgacggtcgccgcctggctgcgctacccgaccgagatcgacgcggcgctggtcgcgatcgccgggccgggcgggtcggcgatcctcgactggaaggccggcagcgagccggacgacgagttcgccgagggcgagggctggcgcacctgggtcgacgaggtcgtggtcagctgggcggcctgcctgctcgccgacccggccctggcccgccgcggcgtcgacgcggtgatcgccgcgatcccgatcccggagccccggccgcgcccgcacgcccgccgcacgggcggcctgcccagcgagttccgtcgcctcctgcagcccgacgcccgtgaccgcgaggccgccaccctgctgcgccaccccgacctgctggagcccatcgccgccatgcaccgcgacacgctgctgtacctgctcgacgctgagccggctggcctcgctccgctcggcggggatcgcgccgcctga

SEQ ID NO: 5887 - DNA, 468 bp, Actinoplanes utahensis
atggcccgcacgatcgcgacgaacgaccgggtcagtcgggaggagctggtcgcgttcctgcggccgcggcaccacgcgatcctgatgacggtccgcagggacggccgtccgcagtcctcgccgaacacgtgcggcgtcgacgagcagggccggatcgtcatctccagctatccggagcgggccaaggtggccaacctgcgccgggacccgcgggtctccgtctgcgtgctctccgacgagtggaacgggccgtgggtccaggtcgacgggaccgccgaggtgatcgacctgcccgacgcggtggagccgctggtggagtatttccgctgcatctccggcgagcacccgaactgggacgagtatcgccaggccatgcgtgaccagggcaaatgcctgatccgtatcaccgtggacgggtggggcccgatcgccaccggcggcttccccgcccgcctcgccgacaactga

SEQ ID NO: 5888 - DNA, 852 bp, Actinoplanes utahensis
atgaccatcctcggcatcgacatcggcggctccggcgtgaaaggcgccccggtcgacaccacgcgcggcgagctgctcgacgagcggttccgcgtgccgaccccgcagccggccgacgtggacagcgtggtggacgcggtcgccgaggtggcggccaagttcgacggcttcgacagcatcggagtgaccttccccggcgtggtcgtcgacggcgtcacccgcaccgcggccaacgtgcacaagtcctggatcgacgccccggcggcgcggctgttcggcgaacggctgggcaggccggtcaccgtgctcaacgacgcggacgcggcgggcgtggccgaggtggccttcggtgccgggcgtgaccggtccggcttgatcatgatggtgacgctgggcaccgggatcggcaccgcgatgttcctcgacggggtgctgctgcccaacaccgagctgggccacctggagatcgacggcaaggacgccgagctgctcgcctccgaccgggtccgcgaggctgaggacatgagctgggagaagtacgcccaccgggtcagcaagtatctgcggcacgtcgagatgctgctctccccgcggctgttcatcatcggcggcggcgtcagcaagaaagccgacaagtacttcccgctgctcgaggtgcgcaccccggtggtcgccgccaccctgctgaacaacgccggcatcatcggcgccgcggtctccgccgagcaggccgcggccgggcccggcgggcagcacccgggctcgatcccggtgcacgccggcgcgccgggcgccgaaccgcacacggtcaacgccggccggccggcctccgacgcggaggatcggcactga

SEQ ID NO: 5889 - DNA, 810 bp, Actinoplanes utahensis
atgacaacagctccgcttcatattcatcgatccgctgggaccgcctccgccgacccggcgcccgaggccaccgccaccgagctgctcgacgcgatggccgtgctgccggtcggccagcgacgctgccgggtccgtgaccgggcgatcgaggcctggctgccgctggcccgccacctggccaaccgctacgccggccgcggcgaaccgaccgacgacctgatccagaccgccaccgtcggcctgatcaaggccgtcgacaaattcgacccggagcgcggcgtcgacttcgccggctacgccatccccaccatcatcggggagatcaagcgccacttccgcgaccgcacctggtcggtccgcgtcccgcgccggctgcaggagctccgcctcgccatcaccgaggccaacagcacgctcacccacgcgctgggccgctcgccgaccgtcccggacatcgcggtgcacctcggcatcagcgaggaggacgtgctggagggcctggagggcgcccgcgcctacaacgccacctcgctgtccaccccgatcaacgcggacggcaccaccgagctgggcgacacgctgggcgccgaggaccacgagtacgagctggccgagacccgggtggcgctcgggccggcgctggccctgctggacgagcgcgagcagcggatcctgacgctgcgcttctacggcaacctgacccagtcgcagatcgccgaccagatcggcatctcccagatgcacgtctcccgcctgctcaccaaggcgctggcgaaactgcgcacccagctggccgccgagacgctgtag

SEQ ID NO: 5890 - DNA, 546 bp, Actinoplanes utahensis
atgaccaccccctcacccgaggtcccggccggcccggccggcgtgccgcaggtccccgcccgggcatccctcgacgatccgaggcacgccggccccaccgtcgtggtcggcacctatccggagtacgcgcaggcccagcaagccgtggaccacctctccgacaacagattcccggtcgagcggacctcgatcatcggcaccgacctgcgcctggtcgaaacggtgctgggccggctcaccaccggccgcgcggcactggccggcgcggccagcggcgcctggttcgggctgttcatcggggtgctgttcgggctgttcggcaacgcgaactggttctcggtcatcctgaccacggtgctgatcggcgcggtctggggcgccgtcttcggggcgatcgcgcacgccgcgaccggcgggcggcgcgacttcacctcgcgcagcagcctgcaggccgcgcagtacgcggtactcgccgacgccgaggtggccgacgcggccaaggcgctgctggtgcgactgaactggcaggccagcggcgcttcgtaa

SEQ ID NO: 5891 - DNA, 906 bp, Actinoplanes utahensis
atgacggcggtcgcgacacggcggacaaacgtcaccggcgacacaccgagcacctggcattcgatatcaccgctggtggtggcgatcctcgcggccgccggcggatacctggtctacctggggttcatccggaccgggttgggccagagcatcgacaccgccgcgctgcgcggcggcgatgtccaccacgaacaggtcaccctggtgctcagccgcaccctggaggccacccagctcgccgtgctcggcgtggtctgtctggtggcggtcgcggtgggcgcggtccggcgacgcttcgacctgtcgatcggcgcgaccctgctggtgatcgccgcgaacctggccgtccagcagctcaagagccacctgtcccggcccgacctggacggtaccgggatgccgaactcgttccccagcggacacaccgcggccgccgcctcggtggcgttcgtgctgatcctggcgtttccgcgggcgctgcgcggggcgatggggctgctcggcgcggcctacgtgacgatcgtcgcggtggccaccgtctgggccgagtggcaccggcccagcgacaccatcgccgccctgttcatcgtgctggcctgcggtgcgctgatcacctgggtgatccggctgcgccggatcggcggggcccggccgtcgatcgcgccggcccgggtggccaccctgccgctggcgctggtcgccgcgatcggcaccgccgcctgcctgttcggcctggccaccgtggcggtgtccgagcgcgtcatgccggatctggtgtccggccggttcgcctttctgaccggtgtggcgggcatcgtggccgccgtcgccggcaccttctacttctgggtgcggctcaccgccggtgacccgctgcccgaaccgcagcagggaggcaagtcatga

SEQ ID NO: 5892 - DNA, 2517 bp, Actinoplanes utahensis
atgctttccgacctcggacgcgttccgcacctacgcgtcgatggccgactcgttccgcgaccacggaagcttcctgcgggtgaacagccggtacgcgccggccttcgcctacacccgggacgccaacaacttcatctggcaggtgtggaaggccgggtacgccaccgacccgaactactacaccaaggtgaccggcctgatgaccgcgttcaacctgtaccggtacgacacctggaaatagcaagtcggtccgatccgggcgttttgcggcatacgctgcatgtggtggagggacggagtcgatacacaggtccggcgctcgcgaccgcggtcgtgctcgccggactgctgtgcactctgctgaccgtcgccgggctgcgcggcgcccagcgggacaacgcccgccacgtgatggaccagcgcacccggatggccctgtccgcggtcaccgccgagaccgaccgttaccgcgatctgctggaaaccctggccgccgggctcgccgaccaacccgccctcacctgggcgggtttcgaccaggcgagcgcgccgctggccggggccgggctcaagggcgcggccgcgatcgccttcgtggccccggtcgccaccgccggggtggccgcggccgagcggagctggcgggcccggggggcctccggcctgaccctgcggccggccgccggtctcggcgagcactacttcacggtcttcagccgcaacctgaacgaggacgagacggtcaccgcgaccggcggcaccgacgtggccggcgtgccgcagccggccgccgccctgcagaccgcccggcaaaccgggagcaccgccgtctccgacacctacgtcctgctccgcgaccgcgacattccggccgcccagcggcagcattcgttcgtcttcgccgcgccgatctggacccgggccaacaacccggtattccgcggctgggtggtgctcggcctgcgcggcggcgacttcctcgccggcgtgctcagcacggtcagccagcagcagctcgacggcagcctggtcgcggtcaacagcgacggcacccgggccgaggtggccaccctgcgcgtgcccggcaagcgcgacctgcgccgcgagcaggcggtcccggtcgccgaccacgtctgggagctgaccctgcaggccgactcggcccggctgcccggcgccggcggtcacctgccgggcaccgtgctggccggcggcctgctgctcagcatcctgctggccggcctggtccaggtgttggccggcggccggtaccgggcccggctgcgggtcgaacaggccaccaccgagctgcgcgcggccgaggcggagagccgccggcaggccgggctgctcggagcgatcatgacgaccatcggcgacggggtcagcgtgatcgacgccgacggccggatgctgctggagaatccggcggcccggcggctgaccggggtgaccgagtcgagcgacgcaccggagcggtggcagcggcactacggcgtgtaccggccggaccgggtcaccccactcccggtcgacgagatgccgctgatccgggcgctgcacggcgagacggtcgagggcgcggagctgttcgtgcgcaacccgggccggccggacggggtgctgctcggggtcgacgcccggccgctggacccgagcgccggcctgcgcggtgcggtcgcggtctaccgggacgtcaccggcctgcgccgctacgaacaggacctgtcgatcttcgcgggcgtggtggcgcacgacctgagggcgccgctggcgatcgtccgcgggcactgcgagctggccctcgacgacccgggtgacgaggccgaggtgcgttcctcgctgggccggatcatccgctcggtggaccggatggacgcgctgatcgagacgctgctggcgtacagcaccgcccgggacgcgccgctcaacgtggtcgacctggatctggaaccgctggtccgcgaggtgctgcaggagcgggccgcgagcctgcgcggccagggcggcgccgagccgcggtggtcggtcggcccgctgccgtcggtccgggccgatccggcgatgctccggcacgtgctggacaacctggtcggcaacgcgttcaagtacgtccgtccgggcgcggtgccgtgcgccgacgtcaccgccgggcccgccgcggtgcccggctggacccggatcgaggtgtccgacgccgggatcggcatcccggagccggagaaggcccgggtcttcgagtcgttccaccgggcgcagggctcggccgggtacgccggcaccgggctcggcctggccatctgccaccgggtcgtggttcggcacggcggcgagatcggggtcgaggacaaccccggtggtggcacccgcttctacttcaccctgccgctgtcaccggcggccacccgagaggagaacgacatgagacacatcccggccgaacccgccgagcaggaggacgcgagggtacgcgcggcgctggaccgcgccctggccgagcgggccgccgtcctctag

SEQ ID NO: 5893 - DNA, 390 bp, Actinoplanes utahensis
gtgatcgttgtcgcagaggaccacgacgacatccgttacgtgctcaagcgttccctggagcgggccgggcaccgggtcgtcgtggcggccgacggcgttgccgcgctggccgcgatcaaggaacaccgtccggacctggtggtcaccgatgtggacatgccgcagatgaccggactcgacctgtgccgggcgatcaaggcggacgacgatctgcggcacatcccggtggtggtggccagcgggtcgctgctgcccggcgacgagcgggccagcgacgcgggcgcggcggcgacactgctcaagccgttcgtgccggcccagttgctggccctggtcgccgcgctgatcccgcagccggccaccgacggcgccggtccccgtaccggctag

SEQ ID NO: 5894 - DNA, 1116 bp, Actinoplanes utahensis
ttgaccggtcgtaccgtcatccgcacagtgaggcgcgtgaatccagatcatcaggacggcgagctgatcccgggcgacgacgccccgccccgcaggcgcggctggttcggccggcggcccggctggcagaaggcgctgatcctgatcgccgtgctggtggtggtcctcaccggcggggtggccggcggcggcctgctgctggtcgaccactacaccggcaaggtcgaccgggccgcgctgctgccctcgccgccggccgacgaggccgcgcagagccggcagaactggcagaacggcgcgctcaacctgctgctgctcggctccgactcgcgggccgccgaaccgggggagaagagcccgatcggcgagcgctcggacaccatcatgctggtgcacatcaaccgggcccgggaccacgccacgatcgtctccatcccgcgggacagctacgtcgacgtgccggccggcggtacctggaagggcggcaagaacaagatcaacgccgcgttcgcgttcggcggggcggcgctgaccgccaccacggtccgcaagctcaccggcattccgctggacggcgcgatgatcgccaacttcgcgagcatccgcgacctggtcgacgcggtcggcggggtcgacgtctgcgtgccctacgacgtcaagtccaccttctccgaccgggagtggaagccgggttgccacgacatgaccggggacatcgccgaggagttcatgcggcagcgctacaacgtgcccggcggcgacttcggccggatccacaaccagcagctggtcgtccaggccgtgatcagcaaggtggccaggaacaacctgctctacaagccgctggccctcgacgagctgctcggcatcgcggccgactcgctcaccgtcgatgagaacctcgacctgcgcgacctggtcctcgcggtgcgcgacatccggccgcgcaacatcgcctacgccaccgtgccgtacacctcggcgaacctgaagacgccggccggcgccgcggtgcagttggacaccggggcggccgccgagatgttcgcggccgtcgggaacgacaccatcgatcagtggctggcggaccacccgcagcacttcccgggaagctga

SEQ ID NO: 5895 - DNA, 3924 bp, Actinoplanes utahensis
atgtcgacatcgccctccgctccgccggccgagctccgcagccggatcacccagctcctgccccgtgacgaacaccggatcgggcgccgtctcgaggggacccggcggatccgcgacgacgccgccaagtccgccgcgctcgccgagatcaccgccgaggtcgagcgggccgaggcgcgcctggcgagccgggccgccaccgtgcccccgattacctatccggaggcgctgccggtcagcgcccgtaaggacgacatcgccgccgcgatccgcgaccaccaggtcgtggtggtggccggcgagaccggctccggcaagaccacccagattccgaagatctgcctggagctgggccggggcgtgcgcggccagatcgggcacacccagccgcgccggatcgcggcccgcacggtcgccgagcggatcgccgaggagctggaccggccgctcggcgccacggtcggctacaaggtgcgcttcaccgaccaggccggcgaggacacgctggtcaaggtgatgaccgacggcatcctgctggccgagatccagaccgaccggatgctgcgccgctacgacacgctgatcatcgacgaggcgcacgagcgcagcctcaacatcgacttcatcctcggttacctgcgcgacctgctgcccaagcggcccgacctcaagctgatcatcacctcggcgacgatcgagacgcagcgcttcgcggagcacttcgccgacgccgccggccagccggccccggtgatcgaggtctccgggcgcacctacccggtcgaggtccgctaccgcccgctgatcaccacccaggtgatcgacgatgacgagatccgtgaggagccgatcgatcagatcgagggcatcgccgccgccgtcgacgaactgcccgccgacggcgacatcctggtgttcctgtccggcgagcgggagatccgcgacaccgccgacgcgctcaccaggaaggacctgcgcaacaccgaggtcgtcccgctgtacggccggctcagcgccgccgagcagcaccgggtgttcgagcggcacaccggccggcggatcgtgctggccaccaacgtcgccgagacgtcgctgaccgtgcccggcatccgctacgtgatcgaccccggcaccgcccggatcagccggtactccagccggctcaaggtgcagcggctgccgatcgaggcggtctcgcaggccagcgccaaccagcgcaagggccgctgcggccgcacgtcggacggcatctgcatccggctgtactcggaggaggacttcgacggccggccggagttcaccgagccggagatcctgcgcaccaacctggcctcggtcatcctgcagatgaccaacctgggcctcggcgacctggcgaaattcccgttcatcgacccaccggacaagcggaacatcaccgacggcatcaagctgctcgaggagctcggcgccctgcaggaccgcaagctcaccccgatcggccgccagctggcccagctgccggtcgacccgcggctggcccgcatggtgatcgaggcggaccgccaggagtgcgtggccgaggtgatggtgatcgcggcggcgctgtcgatccaggacccgcgcgagcggccggccgacaggcagcagcaggccgacgagaagcacagccggttcaccgacaaggaatcggacttcttcacctacctcaacctgtggcgctatctgcggcagaagcagcaggagctgtccggcaaccagttccgccggctctgccgcgccgaattcctcaactatctgcgcgtgcgggaatggcaggacatctacgcacagctgcgccaggtcgtccgtacgctcgagctgaatttccgcgaggactgggagtcgggagtcgcgccgcagccggtgcacaccgcgctcctcgcgggtctgctgagccacatcggcctgaaagacaccgacaagcgcgaatatctcggggcgcgtggcgcgaaattcgcgatcttccccggatcggcgctgttcaagcggcagccgcgctggctgatgtcggccgagctggtggagaccagccggctgtgggcccgggtaaacgcccgaatcgagccggagtgggccgagaaactcgccccgcacctggtgaaacactcctacagcgagccgcactgggatcggaagatgggcgccgtgatggcgttcgagaaggtcaccctctacggtctgccgatcattccgcggcgccgggtcggctacggaaagatcgatccggtggtggcccgggacctgttcatccggcacgcgctggtcgagggcgactgggacacgcaccacaagttcttcgaggcgaaccggcaattgctgcgccggatcaccgagctggagaatcgtgcccggcggcgtgacatcgcggtcgacgacgaggcggtccacgcgctgtacgacgcgcgcatcccggccgacatcgtctcctcccggcacttcgacggctggtggaagaaggcccgccacgagaacccggatctgctcaccttcacccgggaagacctcgtcaacgccgggcgggacaccgtcgaccccaacgccttcccggacgcgtggctggccggtggcgtcaaactcccgctcctctacgagttcgagccgaactcgcatgccgacggcgtgaccgtccgggtgccgctcgacctgatcaacaagatcgacgcggacgacttcggctggtccgtgcccggcttccgcaaggacgtggtgatcgcgctgatccgggccctgcccaaggcgctgcgcaccagcttcgtcccggtgccggactgggccgacgcggtcctcgaccgggtgccggtgcgccgcggcccgctgcccgacgcgatcgcgggcgagttgcgccggctcagcggcaccatcgtgccccgcgacgcgtggcgccccgaccaggtccccgaccacctgcggatgaacttccggatcgtgaacgaggcgggcgaggtggtcgccgaaggccgcgacctggacgtgctgcggcgcgccctggcgcccaaggtgcaggccaccatctcccgggcggccggcaacctcgaacgcaccggcatcaccaccaacgacttcggggcgatcccgcaccgggtcgcccagcagcgcggcggctatgcggtgaccgtctggccggccctggtcgacgagggcgccagcgtcggcgtcaaggtcttcgagaccgaggccgagcagcgggtcgcgatgcgcgccggcacccggcggctgctgcttctcacgctgccgccggccgcccggttcctgcagggccgcctggacaaccgggccaaactcgaactgtcccgggccaacccgtaccggtcgatcgccgacctgctcgacgactgcgcgggcgccgcggtggaccggctggtcgccgacgccggcgggccggtctggtcgtcggtcgagttcgcctcgctgcgcgacaccgtccgcgaggacctggtcgacgcggtcgccaacgtggtcacccaggtgcaggcggtgctctccacggcgtacgacgtcgatcagcggatcaggcagctcaaggaccccgggctgctgcccgcgctggccgacatccggcagcagctcaagggcctggtgtacccgggcttcgtgaccgagaccggctggcgccagctgcaccacctgccgcgctacctcaaggcgatcgcccaccggatggaccggctgggcggcggcgtcggccgggaccgtcagctgaccacgcagatccacgagatcgagacggagtaccgcgagctgctcgccgaggcgccgcccggcgggccggccgcggaggggctgcgggagatccggtggatgctcgaggagctgcgggtgagcttcttcgcgcagtccctcggcaccgcctatcccgtctctgacaagcggatattcaaggcgatggacgcgctgccgctgtag

SEQ ID NO: 5896 - DNA, 369 bp, Actinoplanes utahensis
atgacgaaccgtgccgctgcctccgcccccgtctccgccgtctccgccgccgtctacctcgacgagatgatggcccgggtcggcgtcgacggtctcgccgcggcgttcgccgcccccggtctgctggccaccctcgaccagcacgcggccgccgttcgggaggcggtgctgggcgcgggccggatgctggacgcggacgggctcgcggcgtacgcccgcagcatcgccgccgcggcggtccgggccggccgtccgctgcccgcccccggcgcggccccgaccacggtggccggttggagcgccgccgcctggccgatggtgcggatggtcgcggtctgcctgatcgcggagtccgccggtctcctctga

SEQ ID NO: 5897 - DNA, 732 bp, Actinoplanes utahensis
atgaggatgttcaaactctccgcactcgcactgctgacggttccggtcatggccgcccccgcggccgccgcccccgtggtcgacccgccgtccaccctggtcgcccgctacaacttcgacggcggcgccaccgccggcaagatcagcgacctgtccggcaaaggctccagcctcaccgtccgcggcgaggacaacggcacggtcgcgatcaacaccgagggcgccggccggtacgcgtccttccccgccgtctgctccggcaccggctcctgcgcccgcgccctgctcgaagcccccaactcgcccgacctgaacccgggcgtacgcaccttccactgggccgccagcatccgcgtcacccaggcccagctgcacggcaaagccaacatcatgcagaagggcctggccggcgccgacagtgtctggaagatgcagctcaccggcaagaacggccgcgccgtctgcatcatgaccggcaagggcagcgcgcagaccttcagcgccatctcctccaagcccctcgccgacggcacctggcacaaggtcgtctgcgagcgcacccccaccagcctcggcatctcggtcgacggcacggcgggctcgcacgtcaccatcccggcgaccctctcggtggacaacaccatgccgttgcggatcggcggcccgaacttcggcgccaccagcgacatgtaccacggccagctcgacgacgtgtacatccaggtcggctga

SEQ ID NO: 5898 - DNA, 243 bp, Actinoplanes utahensis
atgcctgcccagcctttctccgtccatcccgacctggcggaactcgcccgccgggacattgccgcggccctgacccgcccggcggtcgaggacggttccggcgcccagcccgacccggccgacgccgcgcaccacggcgcccgcgacacccggcaggccgcccgccgcagctcggaccgcgcccacgcgggccgagcggccggtgccggcggtggccgcagctacgccttccgccgcagctga

SEQ ID NO: 5899 - DNA, 1257 bp, Actinoplanes utahensis
atgatcacttcggtcaccgtccactcgctcgacgacccggacctccacgacgagtatctgcgcctggtcggcgacggcgacgagtacgccgccgtcgagctcgccctcaccctgctcgacaacggcgtccgaccccagcggatcatggtcgacctgatcggcggcacgcaggcccgggtcggcgagctgtgggcggccaacgagtggtcggtcgcccgcgaacacgccgccaccgccgtcaacgaacgtgtcctcgccgccgtcgccgcccacctgcgcccctcaccgcgccgctcctccacgaccgccgaccgcgacctctccgccgctgaccgctcccccgccaccgccgaccgcgacccctctgccgctcgcggcgtcgcggggccggatgccggtgcctctcccgcggaccgcggcaccgcggggccgggccgcgatgctgctcacgcgcaccggggcggtgcttccacgtatcgcggccggatcacggtggcctgcgtggacggtgagtggcacggcctgcccgcccggatcctggccgagctgctctccctggatggctggcgggtcgacttcctcggcgccagcgtccccggcccgcacctgatcacccacctgcaccagaccggccccgatgcggtggccctgagctgcatgatccccacccggctcccccgcgcccacgccgccatcacggcctgccgcgcggccggcgtcccggtcatcgccggcggccggggtttcggcccgcaggcccgctgggccgcccggctcggcgccgacgcctgggccacctccgccgaggaggccgtcgtccgcctggccaccgactggccacccccgccggccccggacttcccggcttccggcggtttcgtcccgagcagcctgagcgagcacctcggcgacgaggagtacacccacctggtccgctcccgcccccagctgatcgacaccgcgatgcagcgcctggccgccgtccaccccgaggtccgcgactacgacgaccgccagcgcgaagccaccgccgaggacttcggccacatcgccgacttcctggccgcctcgctctacatcgacgaacctcagatcttccgcgacttcacctcgtggaccgccgacgtcctcaccgcccgcctcgtcccggtgaccgccctgcgggccggcctgcatatcgtccgcgaccagctgatcgacttccccaccgccacgaaaaccctcgacctggccctggccgacctctccaccccctga

SEQ ID NO: 5900 - DNA, 1686 bp, Actinoplanes utahensis
atgtcggcccgcatgccggccaccgcggcgcctcccgggctgctgcgcgcggtcctcgacgcggcgagcgaggcgatgctgctctgcgccgccgccggggacaccgtcgtgctggtcaacgaggcggcccgcgcgctgctgcccggcctgcagccgggcgatccgctgaccgcggcgccgctgccggagctggccgcggccgcggccgccggcggcgagtcgttccggtccgaggatcgacagcattgctggtacggtcgtcgccgcgccgtgggtgacgagcattacgtgtggtttctggccgacggcgccgccgagcgcgaccgcaccgccgcgctggaggccgagcgcgcccgggccgcgttcctggccgacgccggccgccggctctccgcctcgctgcactcccggctggtccggcgcaccacggtcgagctggccgccgcgcacctggccgacgcggccgtggtcatcctcccgccggacaagcggcagagcgcctggagccgggcgctgcccggccacccggtcgaggagggcacgctgcccgaacgcaacctggccgaggtgcccgggctgggcgaggtgatcgacggcttcccgccgatcccgagtcgctggctggacccggcgcagacgccgggctggctgttcccggccgcgctcggcccgctcggcgccctgctggtcatcccgctgcccggcaacgccgagccggccggagcgctgatcctggcccgcaccggcacgttcagcccggaggaggaggccctggcccgggtgtacgcggcccgggccggcgccgcgctcgccgccgccgccctctatcaggagcaggtggcgaccgccgcggtgctgcaggccgacctgctgccgccggagctgcccgagatcgacggcttcgagctggccgggtcctatcaggcggctcgcgagacgatgctcgtcggcggcgacttctacgaggtgttcggcccggtcccgggcagcacggacacggtcgtggcgctcggcgacgtgtgcggcaccgggccggaggccgcggtgctgaccggcaaggtccgccagacgctgcgcgcgctgcggctgatgcacgccggcccggagacgatgctgcgcgtgctgaacagggcgctcaccgactccggtcgccggcagcggttcgtcaccctggtggtcggctcggtgacccgcgtcgaccacggccggatctgtctcgaactggccagcggcggccatccaccgccgctggtgctgcgcgccgacggccgggtcgaggaggtgccgaccggcggcaccctgatcggcgtgatgccggagacgacggtccgcccggccaccgccgagctcggccccggcgaactctgcctgctctacagcgacggcctgaccgaggcccgcggcggcccggccggcgacgagcagttcggcgagacccgcctgcgccgcgccctgagcgactgcgccggcctgcccggcgcggtcaccctggaacgcctgcgccaactggtctccgactgggtccgcggcggccccggcgacgacatcgccatgctcgccgtccgcgcgcacccccgcccgccgctgagcctccgcgacggcggcgccaccctgcgcgccccgaaccagtccccctatctcaccgccgcccgccgccccgaccgaagggtccggccccgatcatga

SEQ ID NO: 5901 - DNA, 774 bp, Actinoplanes utahensis
atgcgcttcgcgacctggaacgtcaactcggtgaaagcccgcctcccccgcctgctggagtggctggagaccgccgcccccgacgtggtcggcctgcaggagaccaaggtcgccgaggacggcttcccggccgccgaggtccgcgagctgggataccggacggcggcgtacggtcagggccgctggaacggcgtcgccctgctctcccggatcggcctggacgaggtccgccgcggcttccccggcgagcccggctatcccggcccggaggcccgcgcgatcagcgcggtctgcgacggcatccggttcatgtcggtgtacgtgccgaacggccgcaccccggacgacccgcactacacctacaaactccagtggctgcgggcgctgcggctcgccctcgccgacgacctggcggccggcccgctgatcgtggccggcgacttcaacgtggcgcccaccgacgacgacgtgtgggatccgtcggtgttcgccggctccacccacgtgaccgagccggagcgggccgccatcgccgcgctgcgcgacctcgggctcaccgacgtgccggcccgcgccatgaagggtgaccacccgttcacctattgggattaccgcgccgggatgttccatcagaacaagggcatgcgcatcgaccacgtgtacgcgagcgccgaactggccgccgcggtcacggatgccgtggtggaccgcgaggcacgcaagggcaagggcccgtccgaccacgccccggtgatcgtcgatgtgaaacgctga

SEQ ID NO: 5902 - DNA, 549 bp, Actinoplanes utahensis
atgccggtggtgccggacgagctgcgggacggtgcctgggacttctaccgcgagtcgttcgccgacctggcggtgctggcggtccaccggcacgtgctgcaccgcgaggagttcgacgagctgatggccgacgagcgggcgcccaagtacgtcgcgtacgacgccgaggaccgggtggccgggatggcctcgatgaccaccgagctggacgcggtctcgctgatctcaccggactacttccggcatcactggccggagctgtacgcgcagcggcggatcttctacgtgctgttcgtcggcgcggcccggggcgcccgcggggccggcgtcttcgtcgcgctgctgcgccggttgtacgcgccgatcgccgaggtcgacggcaaggtgttcgtggacatctgcacctacaacgaggagcgtcaccagctgccccggatgatcggggtgatcctcggccgggtctccggcaaggcggtgccgacccggctggacgcccagtcgttctggctctacgagttcccgggcaacggtctcccggagtccgtctag

SEQ ID NO: 5903 - DNA, 2331 bp, Actinoplanes utahensis
gtgctatcggtgctcccgcccggcatagcccgccgccaatggcagttgatggccgtcatcggggtcctcgctaccgccctctacgcggcctattcgtcgtcgagcctggcctcggtgagcctggtcgtgctcggcgtgctgaccgtcgcggcgtgcttcgtcggcccccgccggtggggcgccgagccgccggtcgcctggctgctgatggctctggccgccaccctcttcctggtcggactgctgatccggcccacggtcaccaaccagccgatgccgctgccgctgctcgccgacgccgccagcttcagcggctatctgctgctcggcgccttcctgttcatgctgctgcgggcccggcagagcctggagcggcacgccgtgctggacggcctgatcgtctgcctggccgccggactgaccagcacgctgctgctggccgcgccggccgcggcgatcgccggccggcccgcgctgctctccatcatccagggcacctacccgctgttcgacatcgtgctggcactgctggtgatcaacctggcgttcaccaccaagacgtggccgatcagcatggtggcgctgctggtcatgatgatcgggctgttcctcggcgacaccgcgtacgccatcgtcggggtcaacggccacatctacgcgtcgccgctgctcaacgtgccgtacgtgctggcctacacggctttgggggtggccgccctgcacccgtcggtgaccgagatgagccgggccgaccggctgcccgtacaggcctggtcctggcagcggctcgcggtgctgctgcccgcgctgttcctgccgttcgcgctgctgctgaccaccgggaccagcgccgcctcgcaccggctgctgatcgccgtggccggcgcgctgatggtggtgctgctgctggcccgggcgatgtccgcggtgcacgcccaggtggccgcccagctgcactccgagcaccaggccacgcacgatccgctgaccgggctgcccaaccggcagtccatctccgccgagatcgaacgcctggtcaccggggtgggcggtcagcagcgggtctgggtctacatgctcgacctggacggcttcaagtgggtcaacgactcgtggggtcacgacaccggtgaccagctggtgatcgaggtgggccggcggctgcgcgccgcggtgccggaggccgtgccggtggcccgggtcggcggcgacgagttcctgctcgccttcgtcggcgacaaggccggcgcgctgcggctggtcgacgacatccgcggctgcttcgcccggtcgctgccggtccgcgacaccgaggtggtgatcagtgcgtcgatcggcatcgcgcactcggtcggcgacgcggtgcgctccgcggtcaccgccgaggcgctgatgcgcgacgcggacaccgcgatgtaccgggccaagggcgatgggccgggccggtccacgatcttcgacacctcgatgcacgaccaggtgcgcgagcggatcgagctggaggtcgcgctgcgccaggcgctcaccgacgatcagctgtacgtggtgtaccagccgatcgtgcgcctggagaccgggatgccggtcggcgccgaggcgctgatccgctgggagcacccggaacgcgggtcgatcccgccgatgctgttcatcccgatcgccgaggactccgggatgatctcgcagatcggcacgttcgtccgtaacgaggcgctgcgtcagcttggcgtgtggcgctcgcagggggtcgtgtcggagagcttctacctgtcggtgaacgtgtcaccgcgccagctgagcgaacccgagctgccgctggtggtctccggcgaactgttccggtacggcgtaccggcgcactgtgtcgccctggagatgaccgagtcggtgatggtggacggctccagtgtcaccgccagagtcctgcacgagctgcgccagctgggcctgaaactgctggtcgacgacttcggcacgggcttctcggcgctgggctacctgcgccgtttcccggtcaccggcgtcaagatcgaccgctccttcgtcaccggtctcggcaagaacgatcaggatgacgagatcgtccgggcggtggtggcgatgagccacgcgctgggcctgagcgtcatcgccgagggtgtcgagaccccgttgcagcgcgaagccctctaccacgtcggtgtggtgaacgggcagggctggctgtggggcaaggcggtgccggccgccgagttcgccgaacgctggcacctgaccgcggcgctgcccgaggtgccgctgccggtggccacggtgaccagctccgggcgccaccgccggatcgacgactag

SEQ ID NO: 5904 - DNA, 744 bp, Actinoplanes utahensis
atgcggatcccgaatcaaccgccggtggtggccggtgtcgccgggaccgcgggcggtctgtccgccgtgcgcctggccgcccgggaggcggtctcccgcggcactcagttgtcgatcgtgcacgctttcgcctgggacggtgcggaagcccggcgcgccgccgcccacgtcgtcgaggaggcggtcgccaccgcccagcgttgcacacccggggcggacgtgcggggtcaactggtggatggatccgccgggagtgtgctgcgccggttcagccggaccgcggcgctgctcgtcgtcggcgcgaccgacctgccgacatcgtcgctgctggaggccgtgacgcaggcctggtgcccggtgctggtggcgcgcggggcccgaccggccgccggtccggtgctggccgcggtggacggctccggcccgtcggtgctggcgctgcggcacgccgccgccgaggcggtacgccggggcctgccgctggaggtggccggggacgacgacgcggtgctcgaccgggtgctggccgggctcccggacctgccgtcgccggagcgccggctgctgaccggcgacccggccggcgcgctggtccgcctgtcgcagcgggtcgcgttgctcgcactgggaccgcgcggggcgggcggcgcggcccgattcggttcggtggcgcacgagttgctgcgccatggtgggtgtccgaccgtttttgtccacggcaggcgcgaaccgttgctacggtga

SEQ ID NO: 5905 - DNA, 1284 bp, Actinoplanes utahensis
atgacggatgtcaagctcgaccaccctggcggccaattgtcgatgggtgtgcgcgaggccgtcgacgggccgggcggcatcgacgtcagtgcgctgctgaaggagaccggttacgtcaccctggatcagggtttcgtcaacaccgcgtcgaccacgtcggcgatcacctacatcgacggtgatgccggcattctgcgttaccggggttacccgatcgagcagctggccgagaagtcgacgttcctcgaggtctcgtacctgctgatgaacggcgagctgcccaccgaggcgcagctgcgtgacttcgccgacaagatccgggtgcacaccctgctgcaggaggagatgcgcacgttcttctccggtttcccgcgggacgcgcacccgatggccgtgctctcctcggcggtcaccgcgctgtccaccttctaccaggacgcgctggacccgctcgacgacgagcaggtcgacatctccgcgatccggctgatggcgaaacttccgacgatcgccgcgtacatctacaagaagtccatcggccacccgctgccgtacccggacaactcgctcgactacgtcgagaacttcctgcgtctgaccttcggcctgccgaccgtcaactacgacgtcgaccccaaggtcgcgaagatcctcgacatgctgttcatcctgcacgccgaccacgagcagaactgctccacgtcgagtgtccggctggtcggctcctcgcaggcgaacctgttcgcctcgatctcggccgggatcagcgcgctgtccggcccgctgcacggtggcgccaacgccgccgtgctggagatgctggagcagatccgcaaggacggcggcgacgtcaactccttcgtcacgcgagtgaagaacaaggagaagggcgtcaagctgatgggcttcggccaccgggtctacaagaactacgacccgcgcgccgccatcgtgaagaaggccgcccaggagatgctctcgaccctggagacgccggacccgctgctggagatcgcgttccagctggaggagatcgcgctcaacgacgagtacttcgtctcccgcaagctgtacccgaacgtcgacttctacaccggcctgatctacaaggcgatgggcttcccgaccaagatgttcacggtgctgttcgccatcggacgtctgcccggctggatcgcccagtggcaggagatgatgcacgacccggccaacaagatcggtcgcccgcggcagatctacaccggttcgccggtccgcgacttcgtcccgatgtcgcagcgctga

SEQ ID NO: 5906 - DNA, 306 bp, Actinoplanes utahensis
gtggacgtcatcggggccctcgccgaaccggcccgccgccgcatcgccgaggtgctgctcaccggcgacgccagcgtcggtgacctggtcgacgcgctgcggatgagccagcccgccgtctccaagcacctgcgggtcctgcgcgacgccggcgtcgtcaccgtccgcgcccatgcccagcagcgcatctaccacctggaggccggcccgttccggcagctcgacgcgtggctcacgccataccgcaggctctggagccggcatcgggacgccctcggcgaacaccttctcgaggaggagccatga

SEQ ID NO: 5907 - DNA, 522 bp, Actinoplanes utahensis
atgaccggaccacagccgcaagcccgggtcgccgccgacggtgaccgctggacgttgatcctcatccgcgatctgccccagccgcccggcgaggtctgggacgcgctgaccgacccggagcgcctcgatcggtgggcgccgttcaccgcggaccgcccgctgaccgcgcccggccccgcgacgctgaccctggtcgacggcgacgagcggaccgcgctgcccgccgaaatcgtccgggtcgagccaccccacctgctggaatacacctggggtgaagacctgctgcgctgggagctcgccgcggccgcaggcgggacccgactgacgctgcggcacacgctgaccgatcgtgacatggatgcgatggtggctgccggctgggatctgtgcaccggggtgctgcggcggctgctcgacggcgagtcggtcagcgcgatccgcgggcggtcggcgatggaccacggctggcgcgacctgcgggaccgctacgccgaacagtttcggtcagattcgggatcctga

SEQ ID NO: 5908 - DNA, 351 bp, Actinoplanes utahensis
atggccgtacagggattgcagcgcatcatcgtctccgttgccgacctcgaccgggcgctcgggttgtaccgggacgcgctcgggctcaccgtgaccgcgcagttcggcgagatcgcccggctggacgtgccgggcaccaccaccgaactcatgctccaccagcggccgccgacagccggactcgccggggtggcggccagcttccgggtcgacgacgtggacgcgaccaccgcggccgcggagaaggccggggcgacggtcgtggacgcgccggcggatcagccgtggggtgagcgccaggcggtcctcaccgaccctgatggacatgtgatctgcctggtcgctgtttga

SEQ ID NO: 5909 - DNA, 1275 bp, Actinoplanes utahensis
gtgactactccgtacccgttctcggccgtggtcggcctggacgatctgcgcctcgcgctgctgctgacctcggtgtcgccggcggtgggcggcgtcctggtccgcggtgagaaggggaccgccaagagcaccgtggtccgggcgctggccgggctgctgccgccggtgacggtggtgcgcggctgccggttcgcctgcgaccccgccgcgcccgacccggactgtccggacgggccgcatcccgcggacacgccggccgggcaccgggcggcgacgctggtcgagctgccggtgggggcgaccgaggaccgggtggtcggcaccctcgacatccagcgcgcgctggccgacggggtgaaggcgtacgagccggggctgctcgccgccgcccaccggggcgtcctctacgtggacgaggtcaacctgctgccggaccacctggtggacctgctgctggacgcggccgcgatgggccgcgcgcacgtggagcgggacggggtctcggtcaagcacgcggcgcggttcctgctggtgggcacgatgaacccggaggagggcgagccgcggccgcagctggtggaccggttcgggctggtggtcacggtggcggcgccgcgggatgcgcggctgcgggccgaggtggtgcgccggcggctggcatacgagctggatccggccgggttcgcggcccgtttcgccgacgacgagcgggagtacgcggcccggatcgccgccgcgcgagccctcctgccgagcgtgaccctgccggacgcggagctcgaccggatcgcccggatctgcctcgcctacggggtggacgggatgcgcgcggacatcgtcgtggcccgctgcgcggtggcgatggccgcctggcacgggcgcgacgtggtcaccgccaccgacgtcgccgacgccgcccgcctggccctgccgcatcgccgccgcaccgatccgctcgacccgccgggcaccgacgaggagaagctcgatcaggccctggccgaggcggagcgtcaggctcaggacgaggcggggcgtcaggctcagcaggaagcggaacgtcaggcccgggaggacgacggcggccccgacggtgacgggccggacgacaccccggacggcggcccgcgcgacggcggcccggacgacgggggcccgggtccggacgggggtggtcccggtggcggtccggccggtgacccgccgcccggccccccgagcagcagcgcgccaccgaccgaggcgccggcatcggacggcgggtcaccggactag

SEQ ID NO: 5910 - DNA, 69 bp, Actinoplanes utahensis
atgccgctcgacgagttggaggcggcgaccgcccggtcggcggagcgcggctaccgccacgccgcctga

SEQ ID NO: 5911 - DNA, 600 bp, Actinoplanes utahensis
atgccgcaggggaaagtgaccaccgtgcccgacgacggcctgaccacgcgtcagcgtcgccgtcaggcggtcttcgccgtgcacaccgggccgggcaagggcaagtccacggccgccttcgggatggccctgcgcgcctggagcgccggctggccgatcggggtcttccagttcgtcaagtcgcagaagtggaaggtcggcgaggagaccgcgctcaaggccctcgacggcgtgaacggcaccccggtcacctggcacaagatgggcgagggctggtcctggatccagcgcgccgggaccgagagggatcacgccgcggaggcggccgaggggtgggcgcagatcaagcgggatctggccgccgaaacgtacaggttctacgtgctcgacgagttcacctacccgatgaagtggggctgggtcgacgtcgccgacgtggtcgcgacgctgaccgagcggcccggcacgcagcatgtggtgatcaccgggcgggacgcgcatcccgatctgattgaggcggccgacctggtcaccgagatgaccaagatcaagcatccgatggacgccgggcgcaagggacagcaggggatcgaatggtga

SEQ ID NO: 5912 - DNA, 603 bp, Actinoplanes utahensis
atggtgacgattccccgggtggtgatcgccgcgcccgcctccgggcacgggaagaccaccgtggccaccgggctgctggccgcgttcgcccggcgcgggacgccggtggccccgttcaaggtcggtccggactacatcgatcccggctatcacagcctggcggccggccggccgggccgcaacctggacccggtgctggtcggcgaggagctgatcgggcccctgttcgcgcacggcgcgcggggcgccgacctggccgtggtcgagggcgtgatgggcctgtacgacggccgcaccggcgccggtgagaccgggtcgaccgcgcaggtcgccgcgctgctgcaggcgccggtgatcctggtggtggacgccgccgcgcagggccgctcgatcgccgcggtggtgcacggcttccgcagcttcggcacggtccggctggccggggtgatcctcaaccgggtcggctcggaccggcacgagcagatcctgcgggacgcctgcgaggaggtcggcacgccggtgctgggcgcgctgcgccgggccgacgcggtcgccgcgccgagccggcacctgggcctggtcccggccgccgagcgccgctag

SEQ ID NO: 5913 - DNA, 153 bp, Actinoplanes utahensis
gtgcccagcccgagcggccgggtggccgagctggccggcacgcccagcgtggccgaggcggcggcgctgcgcgcggccggccccggtgcggtgctgatcctgcccaaacggatcttcggtggcgtcaccgtggcgatcgccggcccggtctag

SEQ ID NO: 5914 - DNA, 1479 bp, Actinoplanes utahensis
gtgggcgagaaagtcgaacagacacagttttcccgagaggaccggagccggtaccggcagaaggtccgccgcagtctggacgtgttcgcgacgatgctgcgcgaagcccgtttcgacttcgagcggccgatgaccggcatggagatcgagctcaacctgatcgatgggcaggccggcccggcgatgcgcaacgccgaggtgctcggcgcgatcgccgacccggacttccagaccgaactgggccagttcaacatcgagatcaacctgccgccccggcggctggccggcgacgacatcgccgacctggagaaggggctgcgggccagcctcaaccacgccgagggcaaggcccgcacggtgggcgtgcacctggtcaccgtcgggatcctgccgaccctgcgccgcgaacacctgaccggcgcggcactgtccgcgaatccgcggtacgcgctgctcaacgagcagatcttcgcggcccgcggggaggacctggacatccggatcgacggggtggaccggctggcggtcaccaccgacacgatcgcgcccgaggcggcctgcaccagcacccagttccacctgcaggtcagcccggcgcagttcgccgcgtactggaacgcctcgcaggtgatctccgggatccaggtggcactgggcgcgaactcgccgctgctgttcgggcgcgagctgtggcgcgagacccggatcccgctgttcgagcaggccaccgacacccgctcggaggagatccgggcacagggtgtccgcccgcgggtatggttcggggaacgctggataaccagcgtcttcgacctgttcgaggagaatgtccggtacttcccggcgctgctgccgatctgcgacgaggacgatccggccgacctgctggagcgtggtgacaccccggcgctcagcgagttgaggctgcacaacggcacggtctaccggtggaaccggccgatctacgacgtggtcggcggccgcccgcacctgcgggtggagaaccgggtgatgccggccggaccgacggtggccgacacgatggcgaacgcggcgttctactacggcctggcccggcacctggccgaggcggagcggccggtctggacgcagctgagtttccgggccgccgaggagaacttccacgcctgcgcgcggcacgggatcgatgccagcgtgttctggccgggcgtgggcacggtgccggtgaccgagctggtgctgcgccggctgctgccgcaggcggccgacgggctggaccggtggggggtctcgacggcccagcgggaccggctgatgggcatcatcgagcagcgctgcctgcgccagcagaacggcgcgtcgtggcaggtggagacactgcacgagctggagaagcaggggatggagcggcagcgggcgctgcacgagatgatgcggcgctacctgccgctcatgcacgagaacatcccggtccacgaatggccggtcggcgtctag

SEQ ID NO: 5915 - DNA, 522 bp, Actinoplanes utahensis
atggacgacaccgagctgcaccgcgagcggatcctccggcacgtcagtccgatcatcaccggccggttcatcggcttccagccgtcgtacacccgggaggtgcgggtggggcggccattggcggtcgcggtgttcctcaccgccggcatcgcccagctcctggccgcgctgctgcggatgaaaccggcccggcgcagcctgcgtgagctgcgcagcggcccggagttcctggtcaccccggtccgcctgcgcgacgatctggggcagacgtacgagatcgagatgcacgggcagttgccgcagtccgcgctgcaccgcggcgacctggtgcaggtgcgcaccgagccgcagcgggaccggaccctgccggtgcggctcacccaggtggtgaacctgaccaccatgcagccgctcaccccgcgcatcccgacccgctggtcacacctgggcccggcgatgctgctgcaggcggcggccggtctggtggtggccgggatcatcatggccgcgatcctccgctag

SEQ ID NO: 5916 - DNA, 1149 bp, Actinoplanes utahensis
gtggcaccgacgaactatgtcaaaccggatagtgtgctggcgcgcaccgcgcgtgacatgctcgccgcacacgccggtggtgaggggccgcgcgagggtctgacccgctgtcccgcctgcggcgaaccgctgccctgccgctccgggcaggccgccgccgaagtactcgccgccgccggactcgccgaggcgtccggcctggtcgcggccacccgggtcgcgttcgccccgccgcccgggcaacccgccttcctgccctcctggaccgcttcggaagaggttgcggatccgctcggctccggaccgattgccggtggtacgccgtcggcactcgcgccgtgggccgcggtcgccccgtcggccgacccgctcaccgatcccctccccggcgcctccgaaggcccgctgtccggtgcctctgcgggaccgctgtccggcgcctccgcgggaccgctgcccggcgcctccgctggacccctgtccggtgcctccgtcggaccgctgcccggcgcctccgctggtccgccggctggggacgggggggagtcggccggcgggccgctctcgacggagctgccgaggtgggccaccgaaccgaccggcacccacgagcggccctgggcgtccgcgggcggggaatcgtggaccgaatcccggctcggcggtcttccgcgcaccggcggcggccagtccggagccggcgcgggcggcaacgccgggccggccccggcggcaaccgggccgggggcgaactccggcccgggatttatttcgcagacatcgagcaatggtacgaatggtgcgccgagcgcgagtggcttgaccgtgtccggactcggctcggccgaaccgccacccggcggggaagcgacccccgaagccggtcggcacggccgcgacggcacccccggcgtgaacggcgcggcggccgacgcctccccgctgcgcgcctgggccaccggcgacgagccgtcccccgccgacggccggacctccagcggtcagccgtcgagcggtcagccgtcgagcggtcagccgtcgagcggtcagccgtcgagcggtcagccgtcgagcgctcagccgtcgagcggtcagcccttcgtcagtcggtcgccggagggccgcgcgccgggccgcggcgcgcactag

SEQ ID NO: 5917 - DNA, 1128 bp, Actinoplanes utahensis
ttgcgggcgtggccgcccgcggaggatggtccggcgagcggctcgggcggtgggctgcgggcgtggccgtcggcggagagcggcgagacggctcaggacggcgggcagcgggcgtggcccgcgactgacggtacctcggcgaccggttcgggtagcgggctgcgggcctggccgccggtcggggagaccggcacgacggacttcggcacccccggctccgggccgggcgctggtgccggtgcaacgggatccggtgacatcggggtcgagccgtccggcggccgccccggttccggcttgacggggatgggtggtgcaggtgcttcgttggctgacagccctggttctgggctggctggtgcgcccggtaccggcgaaccgggatcgggcccggcggggctcggcggctggggcgcgtccgctgccgggctgggcggtcctggcgcgtctgcgctcggtgtctccgctccggggctgggcggtgtcggctcctccgtcgccgggccgggcgcgccgggctccggcgagggaggttctgcggcgtccggcggggttggcgcgggggcggccggtgggggactgcgagcctggcctccgccggagagtgtgcctggcggtgcgggctcgcccaccgggaacgcgaccgggtcggccgccgttcccggagtcggcggtgccgcgggcggagatcgcgcgtggccgccggccgcagccgtcgagaagccggtgtccggcgggctcaagccgtggccgccagccgacgacacgccgggtgatgcggccggttccggcctgagcgcgccgtcgggactcggcggcccggcgggaccgaccgggctcggtgcgggtaccggggtgaaccttccctcgctgtccgacgacgcagggaacgcgcccgccgcggcgatgaccggcacgccgccgtgggcgacctccgctccggcggactcgccggtgaaccccgcgtggccggcgcccggcaacccgggtggggacggcgtggccggcaccggcgtaccgccgatgacggccgtgcccggcgacaacggtgacggggcgccgccgccctgggccgtggctgcccccggtgcggtgcagcagccgacggcgccgccgcccgcgggctag

SEQ ID NO: 5918 - DNA, 537 bp, Actinoplanes utahensis
atggggcaggcccgccccggcctccagccgtccgacatggggcagcacaaggcgccggccggtgcggctcagcgttccgggctgcaggcgccggacatggggcagcacaaggcgccggccggtgcggctcagcgttccgggctgcaggcgccggacatggggcagcacaacccgccggccgggcccgctcagcgttccgggctgcaggcccccgacatggggcaacacaatccgccggccgacggcgcggcgcgatccgggctgcagccgccggacatggggcagcacaaccgtccgggcgcgctccaggtcccggacatgggtcagacccgtcccgggctgcaggcaccggacatgggccagcacaccccgccggccgcagaccaggcggagccctcgggtgcgccgatggacgagaccagcgccccgtccggtctgccgggccgcgccggcgcccagccctcccgcggcgccggcccggcggaagacggcccggacgacccggccagcgcaccgagcggcttgccgcgccgctag

SEQ ID NO: 5919 - DNA, 738 bp, Actinoplanes utahensis
atgcccagccagctggtctgccggccggagcaggacctcccggtggcggtgttgtcggtcagcggcaccctggaccggctcaccggtgacgcactgggcctggcggtccgccgcagcctcgccgtccagccggtcaaactgctgctcgacgtgagccgattgaaggtcgccgacccgctcgccctcggcacgttcggctcggtggtctgccagaccgcggagttcccgaacgtgccgatcgtcgtctgcggcgccgacccgggcacctgcgccgcgctggccgccgccccggactgcgccgccgtcgagatggccaccgactgcgcggccgccctcgccgaggccggccggcaaccactcccggaatcggtgcggatccgcctgcgccccgtccccgacgcctgccgccaggtccgccacctggtcgaccaggcctgcgcccgctggcaccgcaccgagttcgccgccaccgcggcgctgatcgccaccgaactggtcgccaacgtggtccggcacgcgcacaccaccatggtcttcaccctgggcctgcgcgacggcacgatcacgatggcggtccgcgacggcagccggcgcctgccgcgctcgctcgaccccggcgtcagtgacgccggcggccgcgggttacggctggtccgggaactctcggcggcgtggggcgtgctgccggtcagcgacggcaaggtggtctggacacagctgactccggccctccgctga

SEQ ID NO: 5920 - DNA, 2274 bp, Actinoplanes utahensis
atgaagaaccgattccgcaagtttttgcagcgtcccggcacgactgtggacctcgggccgctgtcgaggcgcctggagccgatcgaggctcgcgaggaggcgctcaaggagctcgacgacgcggcgctgaccgacgcggctcgggaggccgccgatttcaccgaggtctgcgcggtgggccgggaggcggcccgccgggcgatcggccagcggccgtacgacgtgcagctgctcggcgcgatggcgctgctctccggccgggtcgccgagatggccaccggtgagggcaagacgctgaccgcgacgatcgccgcttacgggcacacccgcctcggcaacggtccggtgcacgtgctgaccgtcaacgactacctggccaagcgggacgccgagtggatggagccgatctacacgctgctcggcctgacggtcggctcggtcaccgaggcgatgaccccgcaggagcgccgcgaggcgtacgcgtgcgacgtcacctacgtgtcggtgtccgaggccggtttcgactacctgcgtgaccagctggtcaccgacgtggccgaccgggtgcagcgggagctggccaccgcgatcgtcgacgaggccgactcgatcctgatcgacgaggcccgggtgccgatggtgctggccggttccacctcgtcggagagcgacccggtgcacgaggccgccgagctggtccggacgctgcgggccggcaaggactacgaggtggccgaggacggccgcagcgtcgccttcaccgagtccggcctgaagaacgtcgaggagcagctcggcggcgtcgacctgtacgccgacgaccaggtcgcgacgctgtccgcggtgaacgtggcgctgcacgcgcacgccctgctgcgccgcgacgtggactacatcgtgcgcaacggcggggtcgaactgatcgacgagatgcgcggccgggtcgcccagcgtcgccgctggccggacgggttgcaggcggccgtcgaggccaaggaggggctgtccgccaccgccgagggcgaggtgctcaacaccatcacggtgcaggcgttcatcgcgctctaccgcaccgtctgcggcatgacggcgaccgcggtgcacgtcggcgagcagctgcgggagtatttcaagctcgaggtcgcggtggtcccgccgaacacgccgaacatccgcgaggacgacccggaccggatctactcggcgcacgacacccgggacgaggcgctggtcgaggagatcaagatcgcgcacgagaagggccggccggtgctgatcggcaccctggacgtgcaggcgtcggagacgctcgcggcccagctggccgaggccggggtgccgtgcagcgtgctgaacgcgaagaacgacgccgaggaggccgcgatcatcgcggaggccggcgccgtcggcgcggtcaccgtctccacccagatggccggccggggtgtcgacatccggctgggcggcagcgacgagaaggaccgcgaccgggtggtcgagctgggcggcctgtacgtgatcggcgcgggccggcacgacagccgccgggtcgacgaccagctgcgtggccgggccggtcggcagggtgacccgggcacctcggtgttcttcgtcagcctcgaggacgagctggtctcccgacacgccggcaacatcctgccggcctcgccgcggatggacatggacggcgtggtgcacgacccgcaggtggactatgcggtcgagcacgcccagcgggtcgccgagggtgtcaaccacgagatccaccgcaacacctggcggtacagcgtggtgatcgagcagcagcgactgctgctggccgagcggcgcgagcggctgctcacctccgaggtggcggcgatcatgctgctggagaggtcctcggagaaggccaaggagaccgacgaggacgtgctgtccgacgcggcccgggcgatcgcgctgttccacctggaccggctctgggccgaccacctggcgtacctgtccgaggtgcgcgagggcgtgcacctgcgggcgctgggcaagctggacccgctggacgagttccaccggtcggcggtgcccgccttccaggacctgctgaccaaggtcgaggagcggaccatcgagacgttcgaggaggtcgacctcaccgacggctgggagccggaccgcgcggagatcgtccggcccagtgcgacgtggacctacctggtgcacgacaacccgttcggctccgagctggaccggctgatcgccgcggtgggccgccggctcaccgcgggtggctga

SEQ ID NO: 5921 - DNA, 555 bp, Actinoplanes utahensis
atgccggtcagcgcattgtcgccacgtgccgatcgtcgttccgccggtccgggtcgcggcccgggcaaccgtcgcaccgagccggcgctgaccgtgacgctcgcgatcccgctcaccggggacgccgtgtcgccgcaggcccaccggctgctcgccgcggtccgcgagctggtcgagatgagccggggcacggtgaccgtcgagtccgcgtcggcggccgccgagtccgagccggagccggttcccaccgggccggaggtgcggctgctcaccgggtcgcgccaggtcctgctggagggcgagccggtgccgctcacccgcctcgagttcgacctcctgctctacctcgccgagcggccgcgccgggtgttcagccgggcccagctgctggccggcgtgtggggttacgagcgggccggggagcgcacggtcgacgtgcacgtccgccggctgcggctcaagctgggcgccagcgtgcccgcggtgaccaccgtctacggagtgggctaccggctggccgacgacgcccggatcacgatcatgccgcacgattga

SEQ ID NO: 5922 - DNA, 633 bp, Actinoplanes utahensis
atgcgtgctcgtcccgtctcgttcaccgtcctgatcgacgatctcgccgatcggctggccggtcgggaatccgacagtaggatccgggtggccgtcgacggcgcggacgcggccgacccggcccgcctcgccgacgccctcgtcgacccgctgcgggtccgcgggcgcccggcggtccgcatcgacaccagggacttcctgcgcccggcctcggtccggctggagttcgggcgggccaatccggactcgttctacgccggttggttcgacgaggccgggctgatccgcgaggtgctcgacccggccggaccgggcggctccgggcgcatcgtcacccgcctctgggacgccgccgtcgaccgggccgcccgcgaaccgtaccgctcgctgccggacaatgccgtcgtgctggtcagcgggcccctgctgctgggttccgggctgcccttcgacttcaccgtccaccttgccgtctcgccggccgcgctggaccggcggaccacctcggacgaccggtggaccctcccggcctttgtccgatatgcggacgaggtggccccggaaacttttgcggatgtggtcgtccgtctcgatgatccccggcatcctgccctggtcacagcgttgggctga

SEQ ID NO: 5923 - DNA, 543 bp, Actinoplanes utahensis
atgctccggttactttttcgcgggggtctcgtttgggacccccggcggtgggtatcaggcggctccacaagccgatccgggacccaccggcaggggctgagggaagggcagggggactacatgctcgtcaacggagcggtggtggccggtaagggcgccagcacggtcaaggcacggtcggccgacgagctcgaccagatccgggtgctcctgcggacgcgattcgaggagctcgacgcggagtacgaggaggctgtcgcccagagccaccggctgcggctcgtcgagatcggcgactcggccggcgacgaccaggccgacagtgggtccaagacggccgaacgggacgctgccgggtcgctgctgcggaccctgctcgatcggcgcacccaggcggagtatgcgatgcagcggctcgaggacgggacgtacggcaactgtgagggctgctccaacccgatcccggtggagcgcctcgaggtcttcccgtcggcgaccacgtgcgtgaactgcaagcaggtccgggagcggcgggccagctga

SEQ ID NO: 5924 - DNA, 933 bp, Actinoplanes utahensis
gtggtttccggaccggcgggggcgggcaccggcaccggcatgggaaacatccggatcgggacctgtggctggaccgacaagacgctgatccggtcggggtggtacccgccggccgccgacaccccggagaaacgcctggcgtactacgcccgccagtttccgatcgtcgaggtcgactccacctactacggtccgccgagcgagcagaccaccaaactgtgggcggcccggaccccggccggcttcaccttcaacatcaaggcgttcagcctgctgaccgggcacccgaccagggtctcggcgctctacaaggacctgcggccggacacggcgaaggccaacgtctacccgcaggacctgccgccgcaagcctacgaggaggtgtggagcaggttcctgaccgcgctcgacccgctcgccgaagccgggaaactcggggcgctgctcttccagttcccgccctggttcggcatccgccggtccaacaaggaattcctgctcgaggtcgcggcccggtgccggccgctgcggccggtcttcgagttccgcaacgcggcctggttcgaaggcggcaaccgcgaggagacgctgggctttctcaaagacaacaatctggcgtacgttgtcgtggacatgccgcagggccacaagtcgtcggtgccacccatcctgaccgccaccgccgacctcgccgtcgtgcgattccacgggcacagcgacaagtggacgagtaaggacatcggcgagaagttcggatatcgatattccgacgaggaacttgcagactgggtgccgaaactgcgcgcgctctccggcgaggcgaagaacacccacgtcctaatgaacaattgtctgtcggattatgcccagcgtaacgccaccactctgctcgacctcctcgacgacgccgccgtccccgccccggccacctga

SEQ ID NO: 5925 - DNA, 840 bp, Actinoplanes utahensis
atgccgcggtggaagcggtgcgattgtgggtatgcgggcggggtgttgtggatcggaacgtcggggtggcagtaccgcgactggcggccgggcaagggggcgcaggacgccgggttcctgtatccggccgggctgccgcagcggctatggctggagcactatgccgagcggttcgcgacggtggaggtgaacaacgcgttctaccggctgccggagcgcaagaccttcgccgactggcgggagcggacgccggacgggttcgtcgtggcggtgaagatgagccggtatctcacgcacatcaagcggctgcgggagccggccgagccggtggggcggtttctggaccgggcggcggggctcggggacaagctcgggccggtgctgctgcaactgccgccgaatctgcgggccgacctcggagctctggacgagacactggggttgttcccggccggggtgcgggtggcggtggagccacggcatgcgagctggttcaccgccgggtgcgaggaggtgctccggcggcacggggcggcactgtgctgggccgatcggggcgggcggccggtgaccccgctgtggcggaccgccggcttcggatacctgcggctccatgagggcggggcgcgaccgtggccgcggtacgggcgggcggccctcgcctcctggctcgaccgggtggcggctcatgacgtaccggacaattttgtctttttcaacaacgaccccggcggcgccgccgtgatcgacgccgccgtgctggcccggatggccgagcggcgcggcctctccgtcagcagggtgccggtgatgaaaccgcgccacccgcacagtggatga

SEQ ID NO: 5926 - DNA, 177 bp, Actinoplanes utahensis
atgagcgaagagcccgagacccccgtcgctgcggcgggggaccagaccggccccgagttcgacccggccggcgacttcgaatacgacgaggcgcacggcgccgggcatcaccaggacatcccggcgaccctggaggaggaggccgagcggcgtcgcacgctggcggcgccccgctga

SEQ ID NO: 5927 - DNA, 702 bp, Actinoplanes utahensis
atgagcgatctcgaacgcgccgacttcgaccgggccgactatcggaccgtgctgcgccggctcaccaccctcgaccagcgggccgccgacctgcgcaccgaagccgtcgcctggcacgccgaacagcacgccgccgccgacgaggcggtccgggtcgccggggaacgcgtccgggacgcccgccgcgcggtccgcgacgcccagcgcgaactcgaagaggtcgacgcgcgggcggccgggctgtggtccgactacgtgcacaaggtcggttcggtggcggaacgcttcggcagactgccgccggccagcatcccccggcagcgggccgacgaccggaccgcccaggagcacctggccgaggtggagaaacgggtcaagtggacgccgccggcccggccgatcacgttcggggtgaaaaccctgttcgtgatcttcgggctggtcggcggcatcctcggcgcgatcgggaaccagattctgcgcagcaccggcgccgcctcccggggcgactggcaccaggccgcgccggtggtggcgctgctggtgctgctggcctgcccgatgctggcggtggtggccgccaaaccggtcgcggaccggcgcaaggtcgggctggacaccgcgaccgtggtgaccgtgctggtgaccggcctggtcacggcaatgctgctgttcacggcggtgcagtacgcgcaaggctga

SEQ ID NO: 5928 - DNA, 2265 bp, Actinoplanes utahensis
gtgccggccctggtgcagctgctcgaccacgggcacgtggtggtccaaggcgaccgcagactcggcgacgacgtggtggccgggctgctgctgcgcgcgctgggcaccagcacgccgggcacggtgcgggtgatcggctacgacccggagcacctgggtggcggcctggcaggtttcgctccgctcgcgccggcccgggtgctcaccttcgtcgccccgaacgggctgggtgcgctcctcgacgacctggtcgcccaggtacggcggatcaacgagacggtgctggccggcgagttctcgtcgctgcgcgagctgcacgcggcgacgaagcggcggccggagccgtggcgggtcgccgtgctgctgggcgccggcgacctgaaccggcacgaacgcacgcaggtggagcgcctgctgcgaacgggcgcggcctgcggcgtacacttgatcattcatggttttgcggttgatcccgcgcccggcatcgagttcgtgaccgccgcgcccggcgatgaggcgcgcatgaccagcgccggtgacctgcccgtccggctcgatccggggccgccgccggcggtgctgaccgccgcctgccggcagatcgccgaagcggccgcggccggtccggcgccggtcgcgctggacagcctgctgccggatccgggcgacgagtggcgcgagagttcggcgaccgggctgaccgcgccgctgggcgacagcccgcagggcacccgggtgatggtgacgctcagcgactacccgccgcatgcgctgatcgccgggccgtccggcaccggcaagacaaatttcatctacgcctggatgggtgcgctcgccgcccgctactcccccgccgagctggcgttctacctgctcgatttcaaggagggcgtatccttcgcccggttcgcgccgggccgccgcgaccagagctggctgccacacgtccgcctcgtcggggtgaacgtcaacacggaccgtgagttcggtctggcgctgctccgcttcctgggcaccgagctgcgccggcgcgccgacgccgcgaaacagcacgaggtgaccaacctggccgagctgcgcgccgaggacccgcagggggtgtggccgcggatcgtggcggtcgtcgacgagttccaggtgctgctcgccggccgggacgccgtcaccaccgaagccgtcgacctgctcgaagacctcgcccgccggggccgctcgcagggcatccacctgatcctggccagccaggacatctccggcatcgaggcgctgtggggccggcctgcgctggtcgcccagttctcgctgcggatcgcgctgccccgggcccgccgggtgctggccgaacagaacgccgccgccgactcgctgccccgctaccacgccgtggtcaatccggactccggggcgaccgaggcgaaccaggtcgtccgcgtcccggcggccggcgaccgcgaacagtggggcgcgctgcagcaccggctgtggcgccggctgcccgccggtgaactgccaccgcggctgttcgacggtgacgtgcagccgcggctcgccgacaaccccgacttccgggctctggtcgccgacgactcccccgccccggtcgcgctgctcggcgagaccatcgacgtgatgtcccgctcggcgcgcaccgtgctgcggcgcgcccccggccgcaacctggccgtgctcggcacccgggtcgaggaggcgtgcgcggtgctggccaccgccggccggtccctcgccgcccagttcgcccgagacggcgcccgcttctccatcgcctgcttcgacccggacgcgcgggccgccgcggaggcgttgcacgccaggatccccgactgcggatggtacgacgcgaccaacgtcgactggctcctcgaggacgcggccgccgagtccaccgccgcctggccggccgaccggccacacttcatcatcctgtacgcggcggatgcgctccccggtggcaagaccgccggtgaccagctgcggaccgtgctgcgccagggcccggaacgccggctgcacgtcctcggctggtggcgcggcgcggggctgctgcgcgacaccctcggcgggcagggctcccggaccgacccgatcggcgcctgggtcgccctcgacgtgcacggcagcgaactggccccgtactaccccggggccggcgcccccaactggtacccgcggccctggcgggcgctgcacttcgaccgctcggtgcaccgcggcgccgaggtgatcatcccctacggtgtctcatga

SEQ ID NO: 5929 - DNA, 144 bp, Actinoplanes utahensis
gtgcccgtggtcgagcagctgcaccagggccggcacctcgggggtctccggcgccgcggccggcgcgtcggcgtcccactgccaggggcgttccggctcggccgacggttccggcgcggcgggcagcagcagctagctagctag

SEQ ID NO: 5930 - DNA, 1017 bp, Actinoplanes utahensis
atgaggcggtggggacggcgcacgcctccctgtcgcaggccgaccagtcgctcgaggattgtttcaccgcgacccgggtcgccgtggaggccgcgcagaactacacggcgatgctctgacgcgatgtcggtcctgcaggaactcggcgcccggctccgggccgcctccgacgagctacccgacggcctggtcctggtcgcgctggagaaactgcgcagcgccaccgagctgctgaactgggtgcgcgaggagtcgcatcaggagatcggcgtgccccagctgggtggtgccaccgaacacgcggagcgtgccgcggcggcgctgcgcctggccgaggacgccatcgaggcctatctcgcggttctgggtctcggcggcgagcccggggcgcggcgcggtcaggagtggcgggaggccatgcgcccggaggagccgcgtccgccggccgccgagccggatgcgccgccggccgagccggagaagctgggcccgtggtggcaggagcggatcgcccagctcaccggggagtcggcggcaaaggatcagaagcggatcgagggtacgaattctgccgacctgctgcgccgcgtcgcggccggggtgcgttccggtgaccgcgcccgcctcggccgggaattgcacggggtgaccgcatcgaccggcctgggcctgtccgcggtgaccgccccggtgctgcaccgtctggccgccgacctgctgggccacgagccccggccggaggatgtgccccggttgcggacggccgccgagggccgggtccgggcgctgctgccgggcacctcgccgtcggtgctggagtcgctgctggaccggatctgccgggtgccgccgcgcggcgggcagcggccgcccggccatccggcggacaacgcggtgaccgcgagcgtgctcaccggagtgctgttggcccgcctgggccgcgacgccgaagccctcgacccgaacgccccggagcccctgcgcccgcacggcgacgccggcgaggcccgatcatga

SEQ ID NO: 5931 - DNA, 852 bp, Actinoplanes utahensis
atgctcatcagtctctcttctcctggtacttccaccagcggcccgcacccggggcctacccgggtccggtgggggcaaacgcccgccgccgactgtcaacagcgcgggaaacgggacgttgattcccggatccggcaaaaagttgacaggagtagactcaacttcatgcccgactccccgaagcccgctcccggacccctgacaccggtcttccgcgagccgtccttccccgagccggcacccgcgtcagcgaagtccccgccgcagccaccctccccggggtccccgactcggccggcctccgcggaggccgcgtcccggccggtccccccggcggccccggcggggccgacctgcccggagtccccgtttcagggagccacatcaaaggccgccgtgtccggtgaacgcacgcctcagccgacttcgccacccgccgccgtcggcgccgcggcaccggcggccacatcggcaccactgaccccgctggtcatcgtcgacggcgccaacgtcgtcggctccgtcccggacgggtggtggcgcgatcgggccggtgccgccgcccgcctccgcgacaacctggccccgatcccggccgccgggctcggcgggctacccggcccggtcgagctcatcctggtcgtcgagggcaaagcccgggacatcccggcagccacggccggcgtccgcatcgcccgcgcccccggctccggcgacgataggatcgtcgacctggtccacgccgagcagggcagccgccacatcgtcgtgatcaccgcggaccggggcctgcgcgaccgggtgaccgccctgggcgccgaggtccgcggcccctccgcagtcccccgctga

SEQ ID NO: 5932 - DNA, 2604 bp, Actinoplanes utahensis
atgagcatcggaccgatggggccgggtggacccggtcagtgggacgacctgttcgcgcgcttcttcggtgcggcggagccgcgccgggcggcgcagcggatcgatatcgcgcgctacatgagcaacgacgcccgccgggtgctggccgacgccgcgcggcgggccgccgacctcggggccggcgacggcctcgccgacctcgataccgatcatctgctctgggccgttctgcagcaggagccgatgaagcagaccgtgcgccgggccggcgccgacccgcagaccctgctcgccgagctggaggcgcgactgggtgacgacgcgtcgcggaccgcggcggcgaaccggcgggccgacatgggcgccgaccgcgacgggccggagcaggtcgcgctgaccccggccgccaagcgggcgctgctggacagcctgcagatctcccgagccgtgggcgcctcctacatcggcccggagcacatcctgatggcgctcgggctgaacaccgactcggcggccgggcggatgctggccggccggctcgacccccgggccatcccgaacccggagaccccggccggtccgcccggtggcggccagggcggttcccggggcggcgggcgtggcggcgcggcggcgaccccgacgctggagcagttcggtgtggacctgaccgaggtggcccggcgcggcgagatcgacccggtgatcggccgggccgacgagatcgagcaggccgtggagatcctgtcccggcgcaccaagaacaatccggtgctgatcggcgaggccggggtcggcaagaccgcgatcgtcgagggcctggcccagcggatcgtggacggcgaggtgccgctcaccctgcaggacaagcgggtggtgcagctggacctggccggcctggtggcaggcacccggtaccgcggcgacttcgaggagcggctgcggaagatcatcgacgagatccaggcgtccggggacggcctgatcgtgttcatggacgagatccacaccctggtcggcgccggtggcggcggtgagggcggcgggatggacgccggcaacatgctcaagccggccctggcccgcgggcagctgcgggtgatcggcgcgaccacgctggacgagtaccgcaagcacatcgagaaggacgcggcactggcccggcggttccagccggtgctggtcggcgagccgtcggtggaggacgcggtggcgatcctgcgcgggctgcgggacaactacgaggcgcaccaccaggtgcggatcaccgatgaggcgctggacgcggcggccgagctgtccgaccggtacgtcaccgaccggttcctgccggacaaggcgatcgacctgatcgaccaggccggcgcccgggtgcggctgcgggtgaagacgccggacaagaacctgcgcgagcaggagtggcagctggagcagctgtcccgggaccgggaccaggcggtgcacgcggagaactacgaggtcgcctcgcagctgcgggatcggatcaacgagctcaaggcgcggatcgccggagccggggcgggcgaggacggcgtgccccgggtgaccgcggccgacgtggccgaggtggtgtcccgggcgaccgggatcccggtggcgcagctgaccgaggccgagcgggaccgtctgctgcgcctcgaacagcacctgcacgagcacgtgatcggacaggacgacgcggtggtcgcggtcgccgaggcggtccgccgctcgcgggccgggttgggtgacccggaccggccggtcggcagcttcctgttcctcggcccgaccggggtcggcaagaccgagctggcgcgctcgctggccgaggcgctgttcggcgaggcggaccggatgatccggctggacatgagcgagttccaggagcggcacacggtgtcccggctggtcggggcgccgcccggatacgtcggctacgacgaggccgggcagctgaccgaggcggtgcggcgccggccgtacagcgtggtgctgctcgacgagatcgagaaggcacacccggacgtgttcaacatcctgctgcaggtgctcgacgacgggcggctgaccgacagccaggggcgcacggtcagtttcaagaacaccgtgttgatcatgacgagcaacctggggtcggacctgatcagcgggaccacccgcagcgtgggcttcggcggcggcgagaacggccgctcgccggaggacgagctgcgggaccggctggaccggcggctcaaggagcagctgcggccggagttcatcaaccggatcgacgagatcatcatcttccggcagctggagaccgaccagctgcggaagatcaccgagatgctgctggagtcgacccggcggcggctgcacgggcaggacgtcacgctggagctgaccacggcggcggtggactggctggccgaccgcgggtatcagcccgagttcggcgcccggccgctgcgccggacgatccagcgggagctggacaaccggctgtcgaggatgctgctcgcggcggacctggcgccggggcagacggtgacggtcgacgtccgcgacggcgagctcgccttggaggtgtcgtccccggcgaaggtcacggctcgatag

SEQ ID NO: 5933 - DNA, 369 bp, Actinoplanes utahensis
gtggcacgcgaggtgacggctgggctgcccggaccgggcgacgggctgcccggaccgggcgacatggtcctggtcaccggcgagcccggagccggcaagtccgccctgctggaggacgccggccggcactgggacggagccgtgttccggaccgcgggcacggccgccagcgccgccgagccgctggcggcggccggcgtcctgctaccgggctggtctccggcggacgccggtgccgccgcggtgcgcgccggcgtcggccgtatccgcgaactggcgaacggccgcccggtgctggtggtggtcgacaacgcgaaccatgtggccccggagtcggcggcgttgctgcgccgggtggcgccggtctag

SEQ ID NO: 5934 - DNA, 1293 bp, Actinoplanes utahensis
gtggccctgctgggccgggccctggtcgcgcgggaccgaccggtcgaggcggaggaggcgttgcggcagacggcctgcgcgcaggtacgggcgctgaaccggctctggggcctgcgccgggccgagccgccggccgtgaccgccggccccgccgcccaggccgccgcgctcttcgtgcccggtgtgccggcgacggcggcgacggcagtcgacagtgccgatccggtgctggccgccgcggacgcggcgctcaccacgttccgtctcgtcttcgccggggcgcccgagcgggtggtccgggagaatcgcgagctgccgcgcctgtggccctcgatgcgcggcgcggcggccgcctgccgggtgcacgccctggtgctcaccgggcggatgaccgcggcccgggacaccgcccgggcgtactacgaagcggccgtggccggcggcgagccggccgaactggcaccgctggcgctgcagcgcggggtgtgcgagtggtgggccggcagcccgcgacgggccatgcccttcctgcgcgaggcgatggcactggtggacgatcgggtgccgttcccgatccgggcctacgtccgcagcgagtacgcggtctgcctggccgccctcggcgacggaccgcaggcgtaccgactgatcgccgccctgcgcaccgagcagagcgccgggcccgggctggacgggcagctccgcacgaccgaactgcaggtcatggcgttgaccggccggtatgtgcacgccgcggacctggccgtcgcgctggccgccgacctggtggccaccggtcgggacaccgagcgggtggaggcgctgtacctggcctgccgcctgcgtccgtcccgggccgtcgcggccggcctggcagccgccgtggacgccgccgacagcccgttcttcccactgctcgcccggcacgcggtggcgctcgccgagggggacggcgcggagctgatccggtgtgcggacgcgttcgagcgcagtgggtatccggggctggccgccgaggcgtgcgccggtgtcgacgaggcccgggcgcggcgcctggtcgacagctgcgacggtttccggcccgcctggctgcccggccgctcggggccggcgacgctgaccggccgggagcgtgaggtgtgcgagctcgccgccgcgggactgtccaacgcgtcgatctcgcaacggctcggcatctcggtgcggaccgtcggcaaccacctgcagcgggcgtacgagaaactgcacctcaccgggcgccgcgacctgggcgccgcgctcggcctcagctga

SEQ ID NO: 5935 - DNA, 2463 bp, Actinoplanes utahensis
atgccggatccgctggccggccggttggcggcgatgctgaccggcgcgccgccgcccggtggcatcctgctgaccggtccgcccgggatcggccggacccggctgctcgctctggtggcacaggcctgttccgggcgggccgtggtgctccggccggacgatctgccggcaccgtcggcagcaccggcgccgcggcggtatgccgccacgacccgcgcgctgcgccgccgcgcggtcgaccgcccgctggtgctcgccgtggacgacctgcacctgctgcccacggacaccgtccacctcgtcgagcacctcgccgacgctcaggtggcgcggctcctggccaccgcgccgagcagcgccacctgcgccgcaccggtcgcgccgctgctgcggcggggaacgttgcgacgcgagcccgtgccgccactgaccgcggccggcatcgccgccgtggtcaccgccaccctcggcggacgcgccgatgcggtgacggtggccgagctgctgcggtacagccagggaaacccggggctgttgcgcgcgctgctggcggcggcgccggcgagcgggacgctgatccggcgggccggcacgtggcgctggtccggccggctgccgctggacgcggtccgtgacacggtgacggcgctgaccggcaccccgccgaccaccgccgcccggtacctcgccgtggccggtccggtgccggtcccggtgctggagcggctggtcgatgcccgcacgctggaggtgctggaggaacacgagatcatccggctggagccggccggcggcgaggcggtcctgcgactgagccagccgttgtacgcggcgttgctccgggaacagctcgcccccacggaccgttcccggctcctgcgcgagctggccggcgccgcgacggcggcccgtgcggatccggtgcggacggtggactggctggtgcgcggtggtctggccgtcgcgcccgggcggcgcgtggcgcacgcgcgaatcgcactggctcgcggcgacgccgacctggcgcaccggctggccggcgccggcgactcggtggcgcacgcggacgtccgggcccaggccctgctcgtacagggccgggtgaccgacgccgaggagctgttcgcccggatcggcgcggcgctgccgccgtcgtcgcgcgcactgcggatcgtcaatctgctgtgggggctgcgccggccccaggaagcggcccgggtggcgcgggaggcgttcgccgcggcgcagccgccgtacccgccggagctcgaactggccggcgaggccttggcgctgttcaccacggtcggcggtggcgtgccggtgcgcagtgcgccgatccggcatccgctgctggccagcacggccgccgccgtccggggctaccgaatgatcttcacaggccggccgggccggatcgccgcggagcacgccgccgacctggtgtggccgtcgatgcgcggctcagcggccgcctgccaggtgcacgccctggtgctcaccgggcggctcgcgcgggcccgggaggtcgcggcggagtactacgacatggccgtcaccggcggggaaccggccgaggtcgccccgctggcgatgcagcgcggggtgtgcgagtggtgggcgggcagcccggcccgggcgttgccgttcctgcgggaggcggccgcgctgctcgacgatcgggtgccgtacccggtgcaggcatacgtgaccagcgagtacgccgtctgcctggccgccgtgggggagggtgggcgggcgttgcgcatgctggccggcgcgcgagccgccctgcccgccggcggccggctgcgcaaccatctgctcgtcggggagatccgggtgctggcgctgaccggggagctgtccagggccgcggaagccgcggtgcgccgcgccgccggcaacctgcgggaagggcggctgaccagcgcggccgagggctactacctggccgcccggctgaccggggacccggatgtcgcgaaccggctggccgcggtggcacgccgctgcgacggggagctgttcgagctgttcgccgcgcacgccacggcgctcgccggcgcggaccgggccggcctgcgcgaggtggccgatcggttcgaggcgggcggctactccggcttcgcgctcgaggcggtggcggccgcggcggggctggcccggcgcgacggcgacgaccggggcaccgccgagggcgcgcgggtcgccgcccggctgacgctggcctgcgacggtttccggccggcctggttgcggttcccgcccgggccggtgcggctgggcgcgcgcgaacggcaggcctgtgagctggctgccgccggactcgacaaccggcagatcgcgcagcggatggggatcgccgtacgcacggtgaccaaccacctggcccgtggttacgccaagctgggcgtccgcgggcggcaggaactggccgccgcgctggctccggtcagctga

SEQ ID NO: 5936 - DNA, 2946 bp, Actinoplanes utahensis
gtggacggtgtccgtgggcagcaggtgcaggtcgtccacggcgagcaccagcgggcggtcgaccgcgcggcggcgcagcgcgcgggtcgtggcggcataccgccgcggcgccggtgctgccgacggtgccggcagatcgtccggccggagcaccacggcccgcccggaacaggcctgtgccaccagagcgagcagccgggtccggccgatcccgggcggaccggtcagcaggatgccaccgggcggcggcgcgccggtcagcatcgccgccaaccggccggccagcggatccggcatcggcgcgatcccttctgctcggtggtcgcgggccagcgtgccgggacccggtgtcccggcgcaaccggacgatggcgaattgagcagcgattactcaggtggtcgggcgtcgcggtgcaccaccatgggcaggccccgcgatctggaaggaccgaatcgttgacctcccgtacaccccgacgaagccggtggggtctgctcgccgccggcatcctcgccgtcaccctggccgggctcggcgtgccgctggcgctggccggcaccggacgacccgcggccaccggccccacccgtgccgggctgctcaccacgctggactgggagaacgccgccgatcgggcgctcccgccgcccggctggcagcggcagtactgttgcgccaagtcgctgcaggtcgtcaccgacccggtgcgcgacggcgggcacgccgtgcagttcaccctggaccgcggcgacccgcacgtctccagcagcacccgcagcgagctcagccagcccgaccggcagccccccgggctggaccggtggtacgggttcagcgtccatccggcgcgcgactggacggtggaccgctcctcggagatcgtcagccagtggcatcagcagagcgacaacgggtctccgccgctcgccctgctgaccaacaggggggattggaagatcgactttcggggcgagatgatcgacctcggcacctatcggaccgttagctggaccgactgggtcttccacgtcgtctggcgcaccgacacctccggcgtcctgcaggtgtggcgcgacggcagcctggtgctcgaccgcaagggccgcacccacgacgacgcggcgcactccccgtacttcaagttcggcatctacaagtgggactgggacgggcggccgaaggtttccgacaccagccaccgcagcctcttctacgacgctctgcggatcggggaccagcgggccggctacgccggggtcgccccgggcggcacggttgcggtgtccccgccgccatccgccggctcgccgggcccgagcgggacgacgccgtccgatccggcgtactcggtggtcccggcgacgcagaagatcgcccgccggtccaccgtcaccggcacaccccgggccgtcctggccggcgcccgcaacgagttcgtctccttccaggtcgtcctcgccggtggtcagcgcggcgtgtcggtggcgccgggccgggcgctgagcggatccggcgggaccatcccgaacagtgctgtgacgatctaccgcgaggactattacacgaccaggcaggcgtcggccggtgggcgtgccgtgggtgcctggccggacgccctgatccccgcggtggaccggctctacggcgaacgccgcaacgcgttcccggtggacgtcccggccggggagaaccgggtcgccttcgtcgacgtgctggtgcccgcgggccaggcggccggcggatacgacggctcgctgaccgtcaccggcagccggggccgcgccgacctgccgatccacctggacgtgcacggtttcaccctgcccgccacctcgtcgctgcgatcgctctggagcatcggctggtcgaccggctgcgacgcgctccacggctcgtgcgacgcgtggtccagcgccgcgaacctgcagcgtgcctggcgcaccaacgcggacttcgcccggctcgccctggacgatcggatgaccgtcgccaacgcgcagttccagcctccggccccgggcagtcagcgggccgccttcgaccggtatctgctgccgctgctgcgcggcaccgcgcagacccagcttcccggcgcccggctgaccacggtggcggtcgatccccagcaggtgcgggtctggaaggcggtcgccgatgccgagggcttcgccgaccgggccgtgacctacgacgcgcacgactgcgacgagccgggcagccgcgcggccaggtggaacgcctgccgcgccgccgtcgccgggtacaagaaggcgtggcccggcctgccgaacgtgatgaccgccgagctgtccgacgtcgaccggtacgaccctcggcacgtcgtcaccgacatcgtcacccccgtggtggaccacttcgacgacagctccggggaccagccggccgcgtaccgggcgttcgcggcacgacccggcaaacagatgtggctctacacctcgtgtgacgtgtccggttgcggtggcgccgacgagcaggacgccgagctccgtctgccctgggtcgactacacgatcgacacgcaggcggcgcagaaccgggcgatggggtggctcgcctaccggtaccgggccaccggtgagctgtactactcgacgacccagcagctgggcaccgcgtggaccgaccagtggggcttcggcggcaacggcgacggcacgctgttctacccggggacgacggcccgcatcgggggaagcacgccgatcccgctggagtcgctgcggatgaagatgatccgcaacggctatcaggactacgaatacctgcgcctggccgaccgggcgggccggtccgccgcggcgcggggggtggccgcccggctgtacccgtcgatgcacgcggccgctccggcaccggcgtcgatcgaggccgcccgggcggagctgatcaccctgatcgagggccggccggtggccgcccgatga

SEQ ID NO: 5937 - DNA, 960 bp, Actinoplanes utahensis
atgaaccttgagctgcggcatctgaaggtggtctgcgccatcgcggagaccggcagcgtcaccaaggccgcgtcacaactcggcctggcccaacccgcgctcaccgcccaactgcagcggatcgagcgcaccctcggcggtcccctgttcgaccgggaccggcgcggcgcacggcccaccgcactcggcgagctcgtgctgtcccgggcccgggtgctgctgccggcgatgaaaggcctgcaggacgaggcggcccggctggcggccgggggtggctccacgatgagccgctaccggatgggcgcgatcggcgggccggtcttcgcccacctgctgcaccggctgtccgccgcccggccggaggcgcagatctcgacctacgcctcgtactacgtcgacgagctggccaccatggtgctcaacggcaaactcgacttcgcccaggtcggggtgtgcggcgacgcgctgccctcggcggactacgggctggtctgggacaccatcgcggtcgacgcggtgtgcgtgctgatgcccgaggaccatccgcaggccaagggggccgaggtcgacctcggcgaactcgccgacgagcagtggtcggcggcggccggcgacggctgcttcgagacctgtttcgcgaccgcctgcgcccgggccggtttcgcgccgcgccgggtgctcgaggccgacgcgcgggcctgcatcgacatggtggagctgggggtcgcgctggggctgtgccagccgacgttccggccgccggccggcctgacgacgcggccgctgaagggggcgccgctgcgatggcggctgatcctcggctggcatccggactcgccggcggcgcgctcggcgccgcaggtgctggaactggcccgcgaggcgtatcaggacgttatcaaccggaatgccggatatgtggcgtggagtcaggatcatccgacggtggcggtcgcctga

SEQ ID NO: 5938 - DNA, 567 bp, Actinoplanes utahensis
atgtctgacgtgaatcttccgccgctgccgccggtggccggcgccacctccgggcgtaacgtcgtcgatgtcctgtccgagcagcaccggcagatcctcagcctgaccgaccgggcgctgaccgacgagtccggtcgggcccgcgacgtgctgatcgccaccctgtcccggcacctgtcggccgaggagcagtatctctacccggcggtccgcacggcggtgccggacggcgaccggatcgccgaccgcgagctggccgaggaccgtgagctgctggtgatgatgcgcgacggggtggagatgggcacgctgcgggcggcggtgcgccggcacgtcgaggccgactcggacgagctgttcccgctgctggagcagatggtgccgatcgaggacatgatccggctgggcaaccgggtggagaccgcgcaggaggccgcgccgacccggccgcacccgtccaccccggtcacgccgccgtggaacaagatcgtggatccgctgctcggcgtggtcgacaagctccgggacgtggcgacggcacgtacgacgtacgcgaaagatctgtag

SEQ ID NO: 5939 - DNA, 1305 bp, Actinoplanes utahensis
atggaaacctccgccgatgaggtcgtcgacctctgccgggatctgctgcgcatcgacaccaccaacaccggggatccgcggaccacggtgggcgaacgcgtcgccgccgagtacgtcgcgacgaaactcgccgacgccggcatcgagtcgcggatcctggagtcggcgccgacccgggccaacctggtcgcccggatccccggcgcggaccgttcccgcggcgcgctgctcgtgcacggccacctcgacgtggtgccggccgacgcctccgagtggtcggtggacccgttctccggcgagatcagggacggctatctctggggccgcggcgcggtcgacatgaaggacttcgacgccatggtgctcgcggtcgtgcgggactggcagcgcaccgggtacgtgccgccccgcgacatcgtgctggcctacaccgccgacgaggaagccggcatggagttcggctcgcagtggctcgcgcagcaccacgcggacgtcttcgagggctgcaccgaggcgatcggcgaggtcggcgggtactcgtacacggtcaacgacaacctgcgcctctacctggtgcagaccgccgagaaggggctcgactggctgcgcctgcacgccagcgggcggcccgggcacggctcgttcatccacgacgacaacgcggtgaccgcgctggccgaggcggtcgccgcggtcggccggcaccgcttcccggtggtcgtcacgccgaccgtgcgagccttcctggagcagatcagcgacgcgctgcagatcgacctggacccggacgacccggagctggcgatcgccaagctcggcccgatcgccaacctgatcggcgccaccatccgcaacaccgcgaatccgacccggctcgcggccggctacaaggacaatgtgatcccggggaaggcgtcggccaccatcgactgccggaccctgcccggccaggccgagtcgttcctcgccgagctgcgtgacatcatcgggccggatgtggagatcgagcacgtgcaccggcagccggccgtggagaccgagttcggcgggccgctggtggaggcgatgggcgcggcgctgcgcgccgaggacccgggggcgcgtaccgtgccgtacctgatgtccgggggcaccgacgcgaaggcgttcagcaccctgggcatccgatgcttcgggttcgccccgctgcaacttccgcccgacctgaacttcgccgccctgttccacggcatcgacgagcgggtgccggtggagggactaaagttcggcgtacgtgtgctcgaccgtttgctccgcaacagttag

SEQ ID NO: 5940 - DNA, 669 bp, Actinoplanes utahensis
atgagcgaccagaacgctgagctcgacgccgcactggagcgggtcgtggaggcggcgcgggcgcacctcgcggccgtgaaggcggccgcgggccggatcgacgacgacgacgtctggcaggcgtacgtcgacctcaacaacgcctcgttcgcctacgacgagaagctgctcgacgcgttcggcgaagtcacgccgtgggacgtcgagtcgatcgaccccgacgaggccgaccagcgcttcctggccggtgaggccggcgccgacggcggggccggcgacgcgtacccgcaggtgatctcggtccggcagcgccgcgactaccgggtgccgagcgtctccgccctgctgcgggtcgccgagaacgcccggaagaacgcggtgcccgaggacgaggaggtcggcccggtcgagtcggtcggcgaggccgtcctggagctgctgcaggccggcgacggctcgctggcctcgctcgacgtgcccgagctggagccgctcgacggcctgctcaccgtcaccgaggtcgaggccccgctggacctggaggccttcgacgacgcggacggctccggcccgttcgccccggccgagggcgatcagctggtcggccgcctcgacgagcacccgttcctgcccgacgaggaagacgaccacgccggccacaaccattag

SEQ ID NO: 5941 - DNA, 201 bp, Actinoplanes utahensis
atgtgtcccatggactacgaatatgcgccgctgcggttgccttcgaatgtcgatcgtctgaccgcggcggcgcagctcgccatcgccgcggagttctccgggtgggagctggcccgcgtgcagctgttcgcggacggtacccgcaaggtgatgctccgccggcggctccaggccacgccgcagcccggcctcagctactga

SEQ ID NO: 5942 - DNA, 642 bp, Actinoplanes utahensis
atgatcggcgtgctgatcgtcgacgacgacgcgctggtccgggccgggcttcgggccatcctcggcgcccagcccgggatcaccgtcaccggcgaggccgcggacggcgccgaggtggtgccggccgcgctgcgtcggcggcccgacgtcgtcctgatggacgtccggatgccgcacctggacggcatccaggccacccggctgctgctcgaccgcttcccggtggacgcgccccgggtgctcgtggtgaccaccttcgccaacgacgagtacgtctacacggcgctgcaggcgggggcgagcggcttcctgctcaaacgcgcccgcccggagcagatcgtggaggcggtccgggtggtggcccgcggcgactcgctgctcttcccggccgcgatcaagagtctggcggccgcctacgcccgtccggacggcggcctcagggacgccgggctgaccgggcgcgaggccgaggtgctcaccctgatggccgatggactgtccaacgcggagatcgccacccggctgttcctcggcgtcgagacggtcaagacccatgtcggcaacatcctggccaaactgggcgtccgcgaccgcacccaggccgtcgtcaccgcgtacaagtccggcttcatcacaccctga

SEQ ID NO: 5943 - DNA, 1113 bp, Actinoplanes utahensis
gtgccggcgatccgcacggggcgcgctgacgccgtcatgcgtcgcgcggtgttcctgctgctcggagcggtgctggccctgccgtacaccatcgccgcgggattcgtcgcccatctcgtcgccgcggacccgcggcactggccgcgggtcgcgttcgccgccctggtgatcggcggcctcgcgctggtgccggcgttcctgagcggcacccgggagctggagatcaccgcggctcgggcgctgctcggcgtcggcctgcccgggcacgaccgtgggcaccggatggagcgggagacccggctgcgctccgccctctggttcggcctgcatctggtcagcggggtgctggtcggcgccgtgctgctgatcgtggtcccggtcggcctgatcgcgctgaccggtggcgaggcgttcggccggggcggctggtggtggctggccgccgcgccggtcatcctggccggggccggttacgcggtcgccgggctgggctcgctggccgccaccatggccccgatcctgctcggcccgtccgcctcggaacgcgagcaccacctggccgagcgcaaccgtctcgcgcgcgagctgcacgactcgatcgggcacgcgctgaccgcgatgaccctgcaggccggcgcggcgcgggcggtgttcgacagcgacccggagttcgcccggcaggccctgaccgcgatcgaggagaccgggcgggccgcggccggtgagctcgacgccgtgctgggcctgctgcgcgacgaggcgaccggaccgacactgaccgatctggaccagctgctgaccggcgccgtgcaggcctcggtgacggtcggcgagctgccggtggcggtgtcccgggaggcgtaccggatcgtgcaggagtcgctgaccaacgcggcgcggcacgggaccggcccggtcacgctgcgcatccggcaggagggggacctgatgatcacggtgaccaaccggcgcggggcgggcgacgcccggccgggcgggcacggcatcgccggcatgcgggaacgggcccggctgctcggcggccgggtgaccgccggcccggacggcgagaactggcgggtcaccgcccggctcccggtgcgcgcccgatga

SEQ ID NO: 5944 - DNA, 996 bp, Actinoplanes utahensis
atgcatcagcgaccgctcggccgaagcgggctagcggtctcgcggctcgcgctcggcaccatgacctggggacgcgacaccgaccccgacgacgcggccgagcagatgaaactgttcctggaggccggcggcacgctgatcgacaccgccgacgtgtacggcaacggcgacgccgaggcggtgatcggctcgctgctcgaccacctggtcccccgggacgaggtggtgatcgccaccaaggccggcctcaccccgcacggctggcgggcccgcgacggctcgcgaggcaacctgctgcgctcgctggacgcctcgctgcgccggctcggcaccgactacgtcgacctgtggcaggtgcacggctacgacgggcagaccccgttcgaggagacactgtccgctctcgatcacgcggtgaccagcggcagggtgcgctacgtcggggtgtccaacttcgccgcctggcagaccgcccgggccgccacctggcagtcggcgtatccgggacgcgccccgatcgtcgccgcccagatggagtattcgctggtcgagcgcggcatcgagcgggagctgctgcccgcgtcggcggcgctgggcttcggtgtgctggcctggtccccgctcggccgcggcgtgctgaccggcaaataccgcaacggccggccgctggattcccgggccgcgtccgagcactacgcgccgttcgtgcagacctatctggagccacgcagctccagcatcgtcgaggcggtggtcaccgcggccggcgggctcggcgtgtcaccgctggaggtggcgctggcctggatccgcgaccggcccggggtgaccgccccgatcctcggcgcccgcaccgccggccagctgcagggcgcgctgcgcagcgaggagctggtgctgccggccgagatcgcccgtgcgctggaggacgtgtcggcgatcgacgtcgggtatccggagcgtgagggtgccggcgatccgcacggggcgcgctga

SEQ ID NO: 5945 - DNA, 1053 bp, Actinoplanes utahensis
gtgcggctcggactcagtctcggctaccagacggcgtggagcacgcccgccgaccacctcgccatggcccgggaggccgaccggctcggctacgcggtggtctgggccgccgaggcgtacggatcggacacggtcagcatgctggcctggatcgccggccagacggaacggatcgacatcggctcggcggtgctgcagatcccggcccgcaccccggcgatgaccgcgatgaccgcggccaccctggacaccctgtccggcagccggttccggctcggcctcggcgtctccggcccgcaggtctcggagggctggcacggcgtgagattcgccaagccgctcgcccggaccagggagtatgtcgacatcgtcaagatggcgctgcgccgcgaccgggtgcagtacgacggcgagcactaccagctgccgctgcccggcggcgccggcaaggcgatcaagctcggcttccacccgccgcgcaccgagatcccgatctacctggccgccgtcgggccgaagaatctggagctcgccggcgaggtcgcggacggctggctggccatcttcttcgccccggacgccgccgacgaccagctgcggcacatcgccgccggtcgcgcccggcacggtcagggcctggccggcttcgacgtggcgcccagcgtgccggtggtggtcggcgacgacatctcggcctgcgccgacgtggtccggtggtacgccgcgctctacatcggcgggatgggcagccgggagcagaacttctacaaccagcttgcggtacggatggggtacgcggacgccgcgcgccgcgtccaggatctgtacctgaacaggcaggtggccgaggcggccgaggcggtgccccaggagttcatcgaacgcacctcgatcatcggcaacaaggcgcagatcaccaaacggatcagggagtacgcggcggccggcgtcggcaccctgtcgatcagcccgtacgtcggcgacctgcagtccggcctcgacacgttgcgcgtggtcgccgaggcgtacgaagagtccggcgtggcccgctag

SEQ ID NO: 5946 - DNA, 603 bp, Actinoplanes utahensis
atgacccaccaagtgcatgccttcgagccgcccgagcggttcgtcgccgggacggtgggcgagcccggggaccggacgttctacctgcaggcccgcggtggcggccgggtgatcagtgtcgccctggagaaggtccaggtgtcactgctcgccgagaagctcgaagagctcctgctggaggcgaacaagcggttcggggtcaccctgcccgaggccccgctgctggccgtgcacgacaacgagccgctggacaccccggtcgacgaggagttccgggtcggcacgctgggactggccttcgacgtcgacacggccaccgtggtgatcgaggcgatcgaggccggcgaggccgaggtcgagatctccggcgacccgctcgccgaggacgacaccgaggacgagggcgacgacgaggacgaggacgacgagcccgacgacgacctcgaccggctccgggtccggctgacccccgaggccacccgggcgttcatcgaccgggcccgccgcgtggtcgccgccggccggccgccgtgcccgctctgcggccagccgctcgacccgggcggccacctctgcccccggcacaacggttaccaccggtga

SEQ ID NO: 5947 - DNA, 885 bp, Actinoplanes utahensis
gtgcccgctctgcggccagccgctcgacccgggcggccacctctgcccccggcacaacggttaccaccggtgacagccgagccgaccgaggtgctcgccgaggccgacgccctggagctgctggcccgcgggcagatcgagatcgagggccggctggtcgacgcgtcgaacacgacgctgcgcgccgagatcagcctggccgggctcacccgccggtgcgtctacaagccggtccgcggcgagcgcccgctctgggacttcccggacggcacgctggccggccgcgaggtgtcggcctacctggtgtcccaggccaccgggtgggacctggtgccaccgacgatcctgcgggacggcccgctcggccccggcatgctgcagctctggatcgacgagccggaggcggccgagtcactgatcgggttcgtgccggcctacgacgtgccggcgggatggtttccggtggccgcggcccgggacgacgacggcgacgcctacgcgctggcgcacgccgacgacccccgcctggcccggctcgccgtcttcgacgcggtgatcaacaacgccgaccgcaagggcggccacgtgctctacccgtcgaccggcacggtgcacggcgtcgaccacggcgtcagcttccacgtggagaacaagctgcgcaccgtgctgtggggctggaccggcaagccgctgcccgccgaggccgccgaggtgctcggccggctcgcggcgggcttggacgggccgctcggcgaggcgctggaggagcacctgaccgtcgccgaggtgcagcacgtccggctgcgggtgaaacggctgctgcgggccggccgcttcccgaaaccgccgaccgactggccggccatcccgtggccgccgatctag

SEQ ID NO: 5948 - DNA, 1251 bp, Actinoplanes utahensis
atggacgcttggaccgggcatgacgtgccgaccctgccgggggacgcccccacgctgaagctgtacgactcggcgcgccggtcggtgcatccggtcacggcgggcggcgcggccggcggcgccgcgacgatgtatgtctgtggcatcaccccctacgacgccacccacctcggccacgccgccacgatgatcgcgttcgacctggtcaaccgtctgtggcgggacgccgggcacccggtcacctacgtgcagaacgtgaccgacatcgacgacccgctgctggagcgcgccgagcgcgacggtgaggactgggtcgtcctggcgatgcgcgagaccgccctgttccgcgaggacatggaggcgctgcggatcatcccgccggcccactacgtcggcgccgtcgagtccatcccggcgattgcggggcacgtccgcgacctggtcgccaatggcgcggcgtaccgtctcgacgacggcaccggcgacgtctacttcgacatcaccgccgcaccccgctggggctacgagtcgaacctgtcccgccccgagatgaccgagctctccgccgagcgtggcggcgaccccggccgccccggcaaacgcgatccgctcgacccgttgctgtggcgcggggcccgcgacggcgagccggtctgggacggcggcgacctcggcccgggccgtcccggctggcacatcgagtgcgccaccatcgcgctcaacctgctcggtgacacgatcgacgtgcagggtggcggcagcgacctgctctacccgcaccacgagtgctcggcggcgcacgccgaggtgctcaccggcgcggcgccgttcgccgggcactacgtgcacgccggcatgatcggcctggacggggagaagatgtcgaagtccaagggcaacctggtcttcgtctcccggctgcgggccgacgggatcgacccgatggcggtccggctcgggctgctcaccgggcactaccgcgccgaccgggagtggaccgacgaggtgcgcaaggcgggcgagcagcggctggcccgctggcgggaggcggcggccgcgccggccggtccgtccggcacggggctgctcggcgcggtccgcgaggccctcaccgacgacctggacgcgcccgcggcgctggccgtggtcgacgcgtgggtcgaggcggcgctgtccggggccggggacgacaccgcgggtccggcgctgatggcgcagaccgtcgacgcgctgctgggcgtccggctctga

SEQ ID NO: 5949 - DNA, 291 bp, Actinoplanes utahensis
atgcgtcgtccggctatgtacctcgccggtctgttcctggccaccggcgcgagcctcgcactcgctgcccctgcctcggcggccggcacccactgcaagaagaactacggcgccgcggctgtccacggatacgggcacggtgccgcgtacggccacgccagcgggggtggctggtacccggggggctacgagtacggctacccggtcggctacgaagacaacgacttgtactaccagaacaacacccaggtcggcctgatcaacatcaacggcgggccgttcggcttctga

SEQ ID NO: 5950 - DNA, 711 bp, Actinoplanes utahensis
gtggccggcctgacgggcgatcccgattctcccgcggccgccggcgacggcggggtgcggccgatccgggtggcgatcgtggacgacgatccgctggtgcgggccgggctgcggatcctggtgggcggttcgccggagatcgaggtggtggccgaggcggcagacggcgcggaggcgatccgggccgcgcaggcgcactggccggacgtgatgctgatggacgtgcggatgccgcgggtggacggcctggtcgcgacgcggcggatccgggagcgggcgggtgctccgcaggtgatcgtgctgaccaccttcgacgtggacgactacgtgctggaggcgctgcggggcggggcgagcgggttcctgctgaaggacacgccgccgctggagatcctggcggcggtgcggacggtggccgcggggaaggcgatcctctcccccggggtgatccggcggctgatcgatcacgtcgccgatccggcggcggggacccggcgggcccgggcgcggggccggctggacgacctcaccggccgggagcgggaggtcgcggtgctggtggggcagggctgcgcgaacgcggagatcgccgcccggctgggcatgagcgtgccgaccgcgaaggggcacgtgtcccggttgctgaccaagctggacctgaacaaccgggtgcagatcgctctcctggtgcacgacgccgagctgatctga

SEQ ID NO: 5951 - DNA, 1995 bp, Actinoplanes utahensis
atgccggtccgcctccagccgtgcggcgtgctcgcgcagcgaggtggtcagccgccggtaggcccgcacgaacgacccccagcccagcgccgccgtcgtgatcaccccgcggaccacgaagtcgacccagacgtcgtaggccgggcgctgctgcagcacgaagtacagcccgccggtggcgaggttgaccgcgcccagcgccagcaccagcgggaagcgcagccggatcgcggcggtgaacagcgccaccaggaccggtccggtggcggtcaccgacaccgccccgagcggcagcagcgccagcagcacggcgagcggatgccgccgtcggaacagcagcgcggccgcgccgagcacgccgagcgccaggtcggccggccacgggatcgccgccccggggcgcatcgcgtcgccgagcagcatcatcgtcgcgccgtagagcagcgcgagcgcgatcgcgacggcatcggcgagccggtcccggacggcggcgcgcggcccacccggatcggataccagcagcaggagcagcatgccgccgagactaggccgcgggcccggccgccggcaccctgccaaagtagggggtcgcacggttccgccggccggtgcggcgggctgctgcccgcggtcaccctggccggcatgcatgatttccgccgactgtcggttctgctcgccccggctgcctggggcgtcgtcgccgcgcgctggaccccgcacggcccgctcaccggtgccgaggccctctggtcggtgctgatcagcgccggcgtgggcttcggcgcgggccgcgtgctgcgctcgcggtggtcgattcccctgaccccgatctggtacgtgctgtgcctggagatgtcccgggtgccgccggatccgccgcacgtgagtcttctcggggtggtcaccgcgctcaccgggcgcggcgtgcacggcctgttgtcggtgttcccgatggccctcgccgcggcgtacggatgcggcttccggcgccgccgcggccggttcctggccggcggggggacgctggtgctgctgctgatcctggtcgcggtggcgatcccggcccgcacgcccggcatcccgggcggcgtcgccgagctgaccaccgtgccggcggccgggcaccgcctcaccgtgatgatccgtggccgggaccggacccggccggtcctgctgttcgtcccgggcgcgcccggcggctccgagctgggcgcgatgcgggcccacctggccgggctggaggcacacttcgtggtggccaccatggagcgccgcgggggtggtgcgtcctatgcggccctcgacccggtgtccagcgtgacgccggccgggtcggtggcggacatcctggcggtcaccgatcatctgcggtcccggtttcagcgggaccggatcgtgctgctggcccactccggcggctccctgctggcggtgttcgcggtccggcagcacccggagaagtacgcggcctacgtcggcaccgggcaggcggtcgacgtcgaggccagcgaccagatcttctacgacgacatcctggcctgggcccgcgccaccgggaaggcggacgtggtgcggaccctgcggcggcaggggcggccgccgtatcgcagcttctgggcgtacgagccgttcctgctgcacgagaacgaggcgtacgcgcagcgggccgccccgctggaggtctccggcccggagtacacgctgctgcagaaggcgcacacgctgaacgcgatcgtcgacacctgggccgcgctgtacccccgcgagcagggcatcgatctgcgccgcgacgtgcctgaactcgcggtgccggcctacttcgtgcagggcggccgggagatgcgcggcctgagcgtcctgttcgccgactggtacgcgacgctgcgcgcccccgtcaagcgcctcgtgacgatccccggcgcgggacaccgggcgatgttcgaggaaccggccgcgttcaccgccgcgctcaccacgctgctggccccgtga

SEQ ID NO: 5952 - DNA, 792 bp, Actinoplanes utahensis
atgacgatcaacccgggcgccgccgagttcccgcatcggcagatcgcggcacagctgcgggagcgggtgcgccgcggtgagtggcagccgggtgagcgtctgccgtcgatcccgggcatcgcggagatgttcggggtggccaagcagaccgtgcagcgggccgtcgaccagctgcgggtcgagggggtcctgatcaccaagccgggctccggcacgtacgtccggggcacccgccggcggctgaaccgcctgtcccggggccggtacggcgcgcaccgcggctaccacgccgacctcgccgctcgctaccgccagcaactcgtcggcgtcggccgggaggcggcgccgccggaggtgaccgacgcattcggggttcgcgacggcaccgagatgctggttcgccggcacatcgtgcgcaccgacgaggccaccgtggagctcggcgcgtcctggttccgggtggccgacaccagcggcaccaccctggaacgcccggaggctttcgggcgcccgctctaccaggaggccgaggaggcgctgggccgccgctacaccaccgccaccgacacgatcaccgcccggcagccgagccgggaggaggcggagatcctgcagatccggccggacacaccggtgctgcacctgctgcacgtggccttcgacgagacgcgcaaaccgatcgaggtggcccaggcgacctggcccggcccgatgaccacgctgaccgaggagtaccggatcccgtcgcccacccccgacccggacccggatcccggcctggcgctggcctga

SEQ ID NO: 5953 - DNA, 1515 bp, Actinoplanes utahensis
atgcaactcggccagcagcacctcgggccccggcgacatcagacccacatcgacgacgtacgacatctccccgccccgatgccggacccgcggcgccaaccccggcccgtccagcacccgcgcatagtcgacgccgatcggggtgaccaccagctcggtgaacggcccccacccgtgcaggcccaccgacgcgatcccggaccacggcagatgcaccgcccggcgcccggtcgccgcgaagtcgatgccgtgcaccgacgtgtgcagccagccgagccgccggtacaccgccagcagcaccaccgccgccacgatcaccgggacgatcatcgccacctcgatgtacaccacgatgcccgccgcacccggacgctcgccgaacaccaccgagaccagcaggaacagcagcagcagcgcggcccagccggcggccaccacccacagcaccgtcacgtagaacatggcgcgcggctggatgaaggacaccgtgtcgtcggacgggccgaggacctgatcaacgtggctggtcacagccgaattatgctggcttatgcaccccttcatggcgaaaaccgctcgcgaccggggaggggccacggcgcggccgccgggtgcgtttccaggcccgcacgtaggctgtgttgcatgactgagttcgacggcctcccgctgctccgctcccccgtggccatcgccgccttcgagggctggaacgatgctgcggacgcttccaccgcggccgtggaacacctcgagcaggtctgggaggcccgtgaggtcaccagcatcgaccccgaggacttctacgacttccaggtgagccgccccaccatcaccatggccgagggcgagacccgcaaaatcgagtggcccaccacccggttcaccgtggccagcccgcccggcagcgaccgcgacgtggtgctgatccgcggcatcgaaccgagcatgcgctggcgcaccttctgcgagtcggtcctggagatctgccacagcctcgaggtcaaccggatcgtgctgctcggcgccctgctcgccgacgtcccctacacccggcccctgccgatcagcggcagcgcgtcggcccaggagatcgccgagaagtacaacgtggtccccacccgctacgacggccccaccggcatcgtcggcgtcctgcaggaggccgccacccgcgccgaactcgacgccctgtccttctgggtgcacgtcccgcactacgccaacaacccgccctgccccaaggcgaccctggccctgctcagccgcatcgaggacgtcctcgacctgccggtcccgatggccgatctggcccaggaggccgacgagtgggagaagcgcgtccacgccgccgccgagcaggacgccgagctcggcgaatacgtccgcgaactggaggaacgcgtcggtgacgcgggcatccagccgctcaccggcgacgagatcgccagcgagttcgagaaatacctgcgccgccgcggcggctccgccggccccaccgccggctcctggtag

SEQ ID NO: 5954 - DNA, 330 bp, Actinoplanes utahensis
gtgaccgaccggctcagcgtgatcttcgcggccctggccgatccgacgcggcgggcgatcctggcccggctcgccgagggtgaggcgaccgtgaccgagctcgccgagccgttcgacatcagcctcccggcgatctcccggcatctgaaggtgctggagaccgccggtctcatctcgcgcagccgctcggcgcagtggcgctccagccggctggaggcggcgccgctgcgcgaggcgacagcctggatggagcggtatcgccggttctgggacgagaatttcgcgcgcctcgacgcccatctcaagcgcctgcaggaggagaagccatga

SEQ ID NO: 5955 - DNA, 441 bp, Actinoplanes utahensis
atgaccgacctcgtgatcacccggatcttcgacgcaccccgggacctcgtctaccgtgccttcgtggaccccgatcaggtggccgcgtggttcggcccggtcggctggtcggtgccgcgcgacacggtcgagatcgacgcccgtccgggcggacggcaggccttcaccatggtcaacgacgccgacccggcgacgtcctcggcggtgaacgcgaccttcgtcgaggtggtggagaacgagctgctggtcggcgaggaggacgtcagccacatcccggccttcggcgcggagaagctgaccctgcgtctggagttcttcgacgaggagggcggccggacccggctggtgctgacccagagcccgttcccggcggcgatggagaccggcgcccgcgagggctggggctccagcttcaccaagctcgacaagatcctggcctga

SEQ ID NO: 5956 - DNA, 3339 bp, Actinoplanes utahensis
gtgccccggcgggtccacgatcagggggagacgaacggtgactgggacgttggccggcgagccggtggcggcgcgcgcggagcaggtctggaaggtctacggcagcggcgaggcgcgggtcaccgcgctgcgcggggtgagcgccgagttcggccgggcccggttcacggcgatcatgggcccgtcgggcagcggcaagtcgacgttgatgcactgcctggccggcctggacacggtcgacgagggcaccgtccacgtcggcggcacggagatcagcaagctcggcgacaaggcgctgacccggctgcgccgggaccggatcgggttcatcttccagcagttcaacctgctgccgacgctgagcgcggcggagaacatccggctgccgctggacatcgccgggcgcaagccggacccgcggtggtgggacgtcgtgatcgacacggtcggcctgcgggaccggctcggccaccgccccagccagctctccggcggccagcagcagcgggtcgcctgcgcccgggcgctgatgggccgccccgacgtgatcttcgcggacgagccgaccggcaatctcgactcgcgctccggcgccgaggtcctggccttcctgcgcgcctcggtgcgcgagcacggtcagacgatcgtcatggtcacccacgacccggtcgccgccgcctatgccgaccgggtggtcttcctggccgacggcgcgatcgtggacgagctgaccgacccgaccgccgagacggtgctggacaccatgaagcggctcgacaagcacggcgacccggtgatgctctgatgctgcgcgccacgctgaagagcctgctcgcccgcaagctacggctgatcctttccggcctggccgtggtgctgggcgtgatgttcgtgtccgggtcgttcgtggtcaccgacaccctcgaccgcaccttcgacgccatcttcgccgacgcgttcgcggccaccgacgtgtcggtcagcgcgaagcccagggtcgaggtcgcccggatggagggcgagcaggtcgcggcgccgctcccggccgcgacggtcgaccggatcagaacgatggcgggggtacgctcggcgaccggccgcgtcgacgccgacggcgcccgggtgatcggcggcgacggcaaggtggtcacctcgtccggcccgccgcgtctgggcgagaactggaccggcaccgacgccacgatggagctgcgcggcggccgtggcccgcaggccgacgacgagatcgcggtcaacgccaccaccgcgaaactggccgggctccgactcggcgaccgggtcggcgtgctcaccctggccccgaagaagcagttcaccctggtcggcatctggggttacaccggcaaccgggacagcgtcggcggggcgcaggaggtcgccttcaccaccccggtcgcccagcggctgatggtcggtcaggccggcgcgttcacctcggtgaccgtccaggccgccgacggggtcaccccggacgcgctgcgggaccgggtggccgccgcgctgggcgacggctatcaggtgaagaccggtcggcaactggccgacgagagcgcgtcgagcatcaaggaggggctgaagttcttcaaccggatcctgctcggcttcgccggggtggcgctgttcgtcgggatcttcctgatcctcaacaccttctcgatcatcgtggcgcagcgcacccgggagctcgccctgctgcgggcgatgggcgccagccgccgccaggtgatcggctcggtgctgatcgaagccgtcatgatcggcctgatcgcctcgatcctcggcctggccgccggcgtcggcgtgggcgccgcgctggccggcctgttcggcaggttcgccgacatgacgctcgccgcgatcggggtgccgctgtccgcggtgctcagcgcgttcaccgtcggcctgctggtcaccgtggtggccgcggtgctgcccgcgctgcgtgcctcgcggatcgccccggtcgccgcgatgcaccaggtcagcatcccggaccggccactgacccggatcagcgtcttcggcggcgtggtgctctcggccggcgcggcgatgctgggcaccggcctgttcgtcagcaccagcgcgccggtgacgctgtggctgatcctcggcggcgtgctggtctcgttcatcggggttgcgctgctcactccgctgctcagcaggccggtgatcagtgtgctcggccggatcttcgcctggtcggtgccgggccggctgggccggctcaactcgggacgcaacccgcgccgcacggcgatcaccgcggccgcgctgatggtgggaatcgccctggtcaccggcgtcacggtggtcatggactcggcgaagagcagtctgcgggccgaggcggccacggtcctcaaggcacagatcatgatcagcggtgaccagtccgggtcccggccaccgacgtacgatcaatccgttctgcagaagatcacggcgatcggcggggtgcgggcggccgccggcctctggaacgacgtggcgtcggtcgacggcaagcggcagtacgttgccggcaccaccgatctgagccggctcgcccaggcctacggcacgacggccaccgcgctggccgacgaccagatcgcggtcagccggtcgaccgcgaccgacgagcactggccgaccgggcagcgggtgaccatccagaactcgcggggcgacccgcacacctacaccgtcacccggatcttcgccgacgacacgctgcccggctccatcatcctgcccgggtcccggctcgccgacttcggcatcacccagccggtggtcggcttcgtccggctcgacgacggggtcgccgtctcgtcggtgctgccgcaggtcaagcagctgctcgcggacagccccgaggtgtcggcgaccgacgcggcgaccttcgtcgacggccaggccgcccagttcgaccagatcatcacgatgatccagattctgctcggactggccatcctgatcgccgtcctcggcgtggtcaacaccctcgccctgtccgtgctggaacgcacccgcgaactcggcctgctgcgcgcggtcgggctgggccgggcgcaaaccatgcggatgatcaccgtggaggcggtggtgatctcggtcttcggcgcgctgctcggcgtcgcggtcggcgccgggatgggctcggcggtggcccgcgccctccgggacgacgggatcaccacgatcgtgctgccctggggccggatgggcacctacctggtgctggccgccctggtcggggtgatcgcggcggtagtgccggcgatccgcgccgcccgcctcaacgtcctcggggcgatcgcccacgactga

SEQ ID NO: 5957 - DNA, 636 bp, Actinoplanes utahensis
gtgctcttcgacatggacggcaccctggtcgacagcgagaaactgtggggcgtcgcgctggaggacctcgccgtccgggccggcgggcaactctccgaacgcgcccggctggccatggtcggcaccagcatgccggtcagcatggcgatcttccgggccgacctggggcagcccgaccggcccgccggacccgacgtggcctggctgaccgaccgggtcgccgagctgttcgccgccggcctcgactggcggcccggcgcccgcgaactgctccacgcggtgcgcgccgccggcatcccgaccgccctggtcacgtccacctcgcggcgtctcgccgagatcgcgctcgacaccctgggcgccttcgacgtgacggtctgcggcgacgaggtcgacagtcccaagccggacccggagccgtatctgaccgccgccacccgcctcggcgtgccgatcgcctcatgcgtcgtcatcgaggactcgccgagcggggtgaccagcgcggtcgcggccggggcggtggtcgtcgccgtcccctccgacgtcacgctgccggtcatcgccggagtccacctgcggacctccctgctggaggtcgacctcggcgggctcgcggcgctcatcccccgggtgtga

SEQ ID NO: 5958 - DNA, 717 bp, Actinoplanes utahensis
ttgcctgaccacgcaccgtcggatgcccggcgggggccgggcatccggccgctgcggctgctgctggccgattcgtccgctctgcaccgggccggcctgcgcgcggcggtcgtcgccgcgcccggcgacgtggagttgatcgtcgcgggggaggccggtgacggggcggaggctctggagctggcccggcggctgtcaccggacgtgctggtggccgacgccgcactcccccggcggggcccggccgcgctggcccgggcggtcgcggcggcgcgcctgccggtgcgcacgctggtcctgaccgagcacgacaccgacgacgagctgatcgagctgctcggcgccggggtggccggctacctgtgcaaggacgcgcccccggaggagctgttcgcggcgatccgcgcggtggccgccggcggcgcggtgatcacgccgcgggtgctggcccgggcgctgccccggttcgtcgccgccaccaccgcgccgggccccgcggtcaccgccgacctgcgggtgctgaccggccgggaacgcgaggtgctgcggcacgtggcccgcgggcacaccaacgccgagatcgccgaggcgttgcgggtcagcgagaccacggtgaagacgcacgtcggccacatgctcggcaagctgcggctgcgcgaccgcacccaggcggtcgtcctggcctacgagagcggcctggtcacacccgggggatga

SEQ ID NO: 5959 - DNA, 1110 bp, Actinoplanes utahensis
gtgtccccggcgttttcgtcgtacccctgccctagcctggctggcatgacggcgttctctcccccgcagccccgccccggtgcgccggcgcccgcgtcccccgccacgtccgccgggcgccccggcctggacgaccggccggccgggccgtcactgtcgccgtcgcgggccgccgacttcaagacctgcccgctgctgttccgcttccgcaccatcgacaagctgcccgagcagccctccgccgaccaggtgcggggcaccctggtgcacgcggtgctggagcggttgttcgacctgccggccgccgagcgcacgccggaggcggcggccgccctggtcgccccggagtgggagcgcctggtcggccacgagcccgagctgaccgcgctgttcgccgccgagcccccggcgccggctgtggcacacgccactgagtcgcccgcgctcgtccgggatcccgccgcgatcgccgccgaggtcgatgccgccgggcagatcgcgctggtcgacgctccggccggggcggccgaggcggcccggctggccgcgttcctctccggtgcccgcgatctgctggccggctacttcgccgtcgaggacccgcagcgtctggagcccgccgagcgggagaccctgatctccaccatgatcggcgacgacgagctgctgatccgcggctacatcgaccgtctggacgtctccccggccggcgacctgcgcgtcgtcgactacaagaccggcggcgccccgcgcgaggcgttcgagggccgcgccctgttccagctgaagttctacgccctggtgctgtggcgcacccgcggcgtcgtcccccgggtcctgcgcctgctctacctcaaggatgccgaggtcctcgactacagccccgacgccggcgagctggagcgtttcgagcgcaccctgatcgccctgtcccacgccgtcgaacgcgcccgccgcgaccaggacttccgccccaagccgagccggctctgcggctggtgcagccaccaggcccggtgcccggagttcggcggcaccccaccgccgttccccaccctgcccgccgccggcctgcccaccgacgccgagcccgaccgcctggctagctag

SEQ ID NO: 5960 - DNA, 1152 bp, Actinoplanes utahensis
atgggagacagcgcgacgcgcaggccaccggcggcgcccggtgggcggccggtgggccgggtgctgggcatcccggtgcacgcgaacggctcgatgctactgctggcgctgctggtcacggtggtttacggcaattacgcgcgcgacgagctcgggctcgcacagccctgggcgtacctcatcggcctgggttttgtggcctgtctgctgggttcggtgctgctgcatgagctggggcacgcgctgatcgcccggcgtaacggcatcggcgtgcgccggatcactctggagctgctcagcgggtggaccgagatggagcgcgacgcgcccagcccgcgggtcgacgccgccgtgtcgctggccggcccgctggtgtcgctgctgctcggcggggtggccaccggtgcggcgctggtgctgccggaggacaccgtgcccgggcagatcgccttccagctggcggtcagcaacgtgctggtggcggtcttcaacgtgctgcccgggctgccgctggacggcgggcgggcgctgcgggccgggatgtgggcgctgctcaaggaccggaaccgggcgaccgtggtggccggctgggccgggcgggtgatcgcgttcggcaccgcggtggccgtgctggtgctcttcgagctgggcctgctcaccctgttcgggatgctgttcgtgctgctggtcacgctgaccctgtggcacggtgccggccagtcgatccggctgggccggatgaccgggcggttcccgctgctcgatctgggtgtgctggcccggccgctgctgacggtgccggccggcaccccgctgggtgaggcgcagcggcgccgcgccgaggatccgcggccggacgtggtgctcgcggtcgccgacgggggcggtaatctcaccgctctggtcgatccggtcgccgccgagcgggtgccggtcgaccggcggccctgggtgagcgtggagagcgtggcccgctcccgggacgcgctgaccagcctgtcggtcgagctgaccggtgagcaggtggtccgcgcgctgcaggcccacccgggtgcgcagtacctggtgacggcaggcgaggatgtcatcggcgtcctgcgggtcgccgacgtcgcggccgtcctcgagccgcggcgggcgcaacgcacctga

SEQ ID NO: 5961 - DNA, 921 bp, Actinoplanes utahensis
gtgaccacgatccccgcccaccgcggcccgttccgcccgggtgaccgcgtccagctcaccgaccccaaggggcggatgcacacgatcgtgctggagccgggcaaggcgttccacacccaccgcggcgcgctggagcacgaccagctcatcggcctggccgacggcagtgtgatcgccgccaccagcggcacccagtatctggcgctgcggccgctgctcagcgactacgtgctcagcatgccgcgcggtgcgcaggtgatctatccgaaggacgcggcgcagatcgtcgcgatgggtgacgtcttccccggggcgaaggtgctcgaggccggcgccggctccggcgcgctgacctgttcgctgctgcgggccgtcggcgagtccggcgaggtgcacagctacgagctgcgcccggacttcgcggcgatcgcccgcaagaacgtcgaggcgttcttcggcggcccgcacccggcgtggcacctgcacgagggcgatgtggccggcaacgagatcggcggattcgaccggatcgtgctggacatgctgaccccgtgggaggcgctcgacatggtggagcgctcgctgatccccggcggggtcttcatcggttacgtggcgaccaccccgcagctgtccgagctggtcgaggcgctgcgcgagcggggtggctggaccgagccgcgggcctgggagtcgctgatccgcgactggcacgccgagggcctggcggtccgcccggaccaccggatgatcgcgcacaccgcgttcctggtgtcctcgcgcaagctggcaccgggcgtgaccgcgccggcgcgccgccgcaagccgagcaagggcgccgaggcgtacgcgctgcgccgggcggcgatggcggcgctggccgccgagagcaaggagtctgcggacacctccggggagtga

SEQ ID NO: 5962 - DNA, 591 bp, Actinoplanes utahensis
atgagttctccgccgttcggcggcagcaacgagatgccggcggtgttcccggactggtcgccctaccccgacctggattcggcggcccgtgcctacctgcgcgaccccgaggtggccctggaggcgctgttcggcgtcctgcgtggcgcctcggtgctctgcttcaccctggagcgcttcgtcaacgaggtgaacggggtgtggcaggaggtcgtcgtctgcgacggcagccgcctggtgctctggcacggcgaggacgtggcgcccggggacggcccggccgggtcgatgacctcgtcgctgcgcgtggtgccgctgtcgacgatcaccgaggtgggctgccggcggcggctcacccgcacctcgaccgggcaggcccgggtcgacagcatcgacgtctacctgctgctgagctcggtcgacgacgctctgccgccacccgggttggccgaggaggagggccgggcgccgctgcgccacgacgcgctgcgcttcggtaagaccctcgacgacggcgggccggggcagatcgcccggttggaggaattctcccgggtcgtcgcctccctggtgggccgccccaccctctga

SEQ ID NO: 5963 - DNA, 288 bp, Actinoplanes utahensis
gtgtcagcagacactgatgagctgcaggtctggatcgatcaggacttgtgtaccggtgacggactctgtgtccaatacgcgccggaggtcttcgagttggacatcgacggcctcgcgtacgtgaaatccgattccggcgcgttgttgcagaacccgggcgtgcgcaccggcgtaccccgcaatctgatcctggaagtcatcgactccgccaaggagtgcccgggcgactgcatccacgtcgtgcggacggccgacgacgtggaggtcgccggcccggacgccgcctga

SEQ ID NO: 5964 - DNA, 1782 bp, Actinoplanes utahensis
gtggcacgtagcgacgaagcggactcccgcgccgcacgatgggagaaagaggccaacgatctctccagccaggtcgcgttcctgcaagaggaactcgccctggttcggcggaagttgaccgagagcccccgacacgtccggcagctcgaggaacggcttgcggcgacgcaggcgcagctctcccgagtgaccgagaacaatgagcggctcgtggcgaccctcaaggaagcccgcgcccagatcgtcactctcaaggaagagattgaccggctcgcccagccgcccagcggctacggcgttttcctgtcggcccacgaggacggcacggtggacgtgttcaccggtggccgcaaactgcgggtggcggtctcgccgtcactcgccgcggacgagctgcagcggggccaggaggtcctgctcaacgatgcgctgaacgtggtggacgcgttcggtttcgagcgcaccggtgaggtcgtcctgctcaaggaggtcctggacaacccgggtggcggcaccgccgaccgggccctggtggtctcccacgccgacgaggagcggatcgtcttcctcgccgagtcgctggagatcgccaagctgcgcgccggcgactcgctgatgatcgagccccgttcggcgtacgcatatgagcggatccccaagagcgaggtcgaggagctcgtcctggaggaggtccccgacgtcgactacaccgacatcggcggcctgcactcgcagatcgagcagatccgcgacgcggtggagctgcccttcctgcacgccgacctgttccgggagcaccagctgcgcccgccgaagggcatcctgctctacggcccgcccggctgtggcaagaccctgatcgccaaggcggtggccaactcgctggccaagaagatcgccgagcgccgtggtgaggagaagcacaccagctacttcctcaacatcaagggcccggaactgctgaacaagtacgtgggtgagaccgagcggcacatccgcctggtcttccagcgggcccgggagaaggccggcgagggcaccccggtgatcgtgttcttcgacgagatggactcgatcttccggacccggggctccggtgtctccagcgacgtggagaacaccatcgttccccagctgctcagcgagatcgacggtgtcgagggcctggagaacgtcatcgtcatcggcgcctccaaccgggaagacatgatcgacccggcgatcctgcgccccggccgtctcgacgtgaagatcaagatcgagcgtccggacgccgaggcggccaaggacatcttcgccaagtacatcctgtccgacctgccgctgtccgaggacgacctcggcgagcacggcgggaaccgggaggccacggtcgccgcgatgatcgaggcggtcgtcctgcggatgtacaccgagtccgaggagaaccgtttcctcgaggtcacctacgccaacggtgacaaggaggtcctgtacttcaaggacttcaactccggcgcgatgatccagaacatcgtcgaccgcggcaagaagatggcgatcaaggagttcctcacctccgggaccaagggcctgcgcctgcagcacctgctggacagctgcgtcgacgagttccgggagaacgaggacctgccgaacaccacgaacccggacgactgggcccggatctccggcaagaagggcgagcggatcgtctacatccgcacgctcgtctccggcggtaagggcaccgaggccggccgttcgatcgaaacagcgagcaataccggtcagtatctgtaa

SEQ ID NO: 5965 - DNA, 1275 bp, Actinoplanes utahensis
gtgacccgatcccgcctgacctggctcgatgcccttcggggtttcgccgccgcggtcgtcgcgctcttccacctcagcccgtccgtaatcggtctcgatcggcacgcggcgatgcagcagcacttcgacctcggccgctacggcgtgctgctgttcttcctcgtcagtggatacgtcattccgatgtcgctggagcggcacgggtcactgcggcggttctggatcgggcgggtcttccgcatctaccccgcctacctgctggcgatcggggccgggctgctggtcgccggggcgggcctgcaggagctgcacggcagcctgtactcgaacaccttcgcgtcggtcctcgggcacgccacgatgatgcaggacctgctcggcctgcgcggcgtggtgcgtccgatctggaccctggcgtacgagatggtcttctacctaatcgtggccggcctcttcgtctggggccggcagcgggccagcgcctggtgggccggcggtctggcgctgctcgcgctggtggccggccgccggctgccggacggggtgttcgccgccgacttccacgaccgccgcatcaccgccgtcgtgctcaccgtgatcctggtggccagcatcgccgcgtacctcagcggtgcccgcccggtgatgctcgccgccggtctggtcggcgtggccatggtgctgctgccgatgctcaacggccagcccacccggtatgccaccccgggcgcctccagcaccgccatcctgctgctcgcggtgatgttcgccggtaccgtgatctaccgcgcgcagcaccgcgaactccaccggtgggtggccggggccacgctgaccctggtcctcgtcgtccaggcggtcaatcagtggctgctggacggtacccagctggtgcgcaacatcagcgtcgccggcgcggtggccggcaccttcgcggtcgccttcctgatgcgccaccgcgccgtcccgggcttcctcacctggctcggcgtggtcagctattcggtctacctcttgcacatgccggtgctcgcggtcgtcacccggctgctcaacggtcacccgctgccgctgttcgcggccttcgtcgtggccaccctggcggccgcctggacctcctaccacctggtcgaactccccgggcaggaactcggccggcgggtccagcgccgcctggacgccctcctgggccccgacacgccgcggaccgccacgaccacggaaggtggcacgccgagcacgggcagcttcggtatgcgccatgagagcgtctag

SEQ ID NO: 5966 - DNA, 1518 bp, Actinoplanes utahensis
atgagcgttcgacggattatgggcaccgaggtcgagtacggcatttcggtgcccggccagcccggcgccaacccgatggtcacctcctcgcaggtcgtcaacgcctacggcgcccggccggaactcaaccgtggccagcgcgcccgctgggactacgaggaggagtccccgctgcgtgacgcccgtgggttcacctactccggcgccgcctacgaccccgccgaagccctcgccgacgaggatctcggcctggccaacgtgatactgaccaacggcgcccggctctacgtcgaccacgcccacccggagtacagcactccggagtgcaccaacccgctcgacgtggtcaagtgggacaaggccggcgagcgggtgatggccgaggcgtcccggcgggccgccaccatccccggcgcccaccgcatccagctgtacaagaacaacaccgacaacaagggcgcgtcgtacgggtcgcacgagaactacctgatgcgccggcagaccgcgttcgccgacatcgtcgcccacctcaccccgttcttcgtcacccggcagatcttctgcggggtcggccgggtcggcctcggccaggacggcagcggcgccggtttccagatctcgtcgcgcgccgacttcttcgaggtcgaggtcggcctggagaccaccctcaagcggccgatcatcaacacccgcgacgagccgcacgccgacgccgacaagtaccgccggctgcacgtcatcatcggcgacgcgaacctctcggagatcgcgtcgtacctgaagatgggcaccaccgcgctggtcctcaacatgatcgaggagaaggtcttcaccggcgagctcggcatcgccgacccggtcagcgagctgcgcgcggtcagccacgaccccaccctcaagcacctgatgcggctgcgtgacggccgccggctcaccgcgctcgacctgcagtgggcgtactacgagcgggccaaggcgttcgtcgacgagcgctacggcgccgacgccgacgagcagaccaccgacgtgctcaaccggtgggaggacgcgctcgacaagctcggccgtgacccgatgctctgctccgacactctggactgggtggccaagctgcggctgctggagggttaccgcgaccgggagaacctcacctgggcgtcgccgaaactgcagctggtcgacctgcagtacgccgacgtgcgcccggagaaggggctgtaccaccggctggtggcgcgcggttcgatgaagacgctgctcgacccggacgacacgcagcgcgcgatgtacgacccgccggaggacacccgggcctacttccgcggccgctgcctcgcgcagtacgcctccgaagtggtcgccgccagctgggactcggtgatcttcgacgtcggacgcgagtcgctggtgcgggtgccgatgatggagcccgagcgcggcaccaggaagcacgtgggcagcctcttcgacacctgtgagagcgcgaaggatctgctggaagtgatcacgagtcggtaa

SEQ ID NO: 5967 - DNA, 216 bp, Actinoplanes utahensis
atggcaacccgagacaccggtggtcagtcgcagagcgggcgtggctccagcgactccgagatcgaggacgtcaccgtcgaagccaaccctgaggtggcggagcggcacgcggaaatcaccgaggacgtcgacgacctgctggacgagatcgactccgtcctggaggagaacgccgaggagttcgtccgcggctatgtccaaaagggcggccagtga

SEQ ID NO: 5968 - DNA, 843 bp, Actinoplanes utahensis
gtggcgacgggttttgatccatccgggcggctaccggatatctttctcaacacggggacgtcctccttcacgcagttcctgagtgcggcggcccccgaactcctgcccgggcggcgcccgcttccgccggggctgtccgcgggtgacgtggcgccgcacggcaccacgatcatcgcgatcgcgaccgccgacggggtcgtgatggccggtgaccgccgggcgaccatgggcaacctgatcgccagtcgggacatccgcaaggtgcaccccgccgactcgtactcactgatcggcatcgccggcacggccggcatcggcatcgagctgatccgcctgttccaggtcgagctggagcactacgagaagaccgagggcgcgatgctctcgctcgacggtaaggcgaaccggctggccgcgatggtccgcggcaacctgggcgcggcgatgcagggcctggccgtggtcccgctgttcgccggcttcgacctcgccccggccgactcctcgcgggccgggcggatcttcagcttcgacgtggccggcggcctctacgaggagaccggctacgaggcgatcggctccggttcgctgttcgccaagtcggcgctgaagaagaagtaccgcgcgggcgtcagcaccgaggaggccatccggctcgcggtcgaggcgctctacgacgccgccgacgacgacaccgcgaccggcggccccgacctcacccgcaagatctacccggtggtgatgaccgcgacggccaacggcacggtgcggctcagcgacgaggagatcaccacggtggccgagcaggtcgtctccggacgcatggagaacccgggcggttga

SEQ ID NO: 5969 - DNA, 798 bp, Actinoplanes utahensis
gtggccatgcagttctacgcatcgcccgagcaggtccagcgggaccgctcggagtacgcccgcaagggcatcgcccgcggccgctcggccgtggtgctgtcgtacgagggcggcatcctgctggtcgccgagaacatcaccaccctgcgcaagatcagcgagatctacgaccggatcgcgttcgccgcggtggggcgctacaacgagttcgagagcctgcgccgggccggcgtgcggatggccgacatgaccggcctgacctacgaccggcgcgatgtgaccgggcgggcgctggccaacgcgtacacccagaccctgggtgcgatcttctcggagacccagaagccgtacgaggtggagatctgcatcgcgcaggtcggcgccaccccggaacaggacgagctgtaccggatcatgtacgacggctccgccctggacgagcccggcttcatggcgatgggcggccaggccgaggcgatcgcgaacgtgctgcgcgagcggcacgacgtcgcggccgatctgccgaccgcgctggcgctggccgccgaggcgctgggcagcgtcggcggggagaacggcgcgacccgcaccctcgggcccaagcagctcgaggtggcggtgctggaccgccgccgggtcgggcggacgttccggcggatcgccgacgcggcgctgaccacgctgctggggcacgaggccgtgccggacgcggatctcggggagaccgacgccgccccgccggcgccggccgacagcaaacccaccgagtcggccgcttcggagagtaccgagggctga

SEQ ID NO: 5970 - DNA, 1359 bp, Actinoplanes utahensis
atggaacggcgaattttcggcctcgagaccgagtacggagtcacgtgcacctatcgggggcagcggcggctgtcgccggacgaggtggcccgctacctgttccgccgcgtggtgtcctggggacgcagcagcaacgtcttcctccgcaacggcgcccgcctctacctcgacgtcggttcccacccggagtacgcgacacccgaatgtgactcggtcaccgacctggtcgcccacgaccgggccggcgagcggatcctggaaggcctgctcgtcgacgcggagaagcgtctgcacgacgagggcatcgcgggcgagatctacctgttcaagaacaacaccgactcggccggcaactcgtacggctgccacgagaattacctggtcagtcgccacggcgagttcggtcgcctggccgacgtgctgatcccgttcctggtcacccgccagctgatctgcggtgccggcaaggtgctgcagaccccgcgcggcgccgtcttctgcctctcgcagcgcgccgagcacatctgggagggcgtctccagcgccaccacgcgcagccgcccgatcatcaacacccgcgacgagccgcacgccgacgccgagcgctaccgccgcctgcacgtcatcgtcggcgactccaacatgaacgaggtcaccaccctgctcaaggtgggcagcgccgacatcgtgctgcgcatgatcgaggccggcgtggtgatgcgcgacctgtcgctggaaaacccgatccgcgccatccgcgaggtcagccacgacgtcaccggccgccgcaagatccgcctggcgaacaacaaggaggtctccgcgctggaaatccagcaggagtacctggcgaaggcgaccgagttcgtcgagcgccgcggcggcgacccggtcgccaagcgcgtcgtcgaactgtggggccgcgtcctcaacgccatcgaaaccgagaacctcgacccggtcgcccgcgagatcgactgggtctcgaaataccggctgatcgagcgctatcaggcgaaacacgacatcccgatgtcgcatccgcggatcgcccagctcgacctcgcctaccacgacgtgcgccgcggccggggcctctacgccctcatggagaaacgcaagcaggtcgaccggatcgccaacgacctgcagatcttcgaggccaaggaaaccccgccgcagaccacccgcgcccgcctgcgcggcgagttcatcaaacacgcccaggacaagcggcgcgacttcaccgtcgactgggtgcatctgaagctgaacgaccaggcgcagcggaccgtgctgtgcaaggacccgttccgcgcctacgacgaacgagtggaaagactcatcgccagcatgtga

SEQ ID NO: 5971 - DNA, 96 bp, Actinoplanes utahensis
atgggccgcgagggttcggccggccggtgggcgatcctcgcggctgcgccggcgaccctcgtcggatcgccggtggtgccggtcggtcttcggtga

SEQ ID NO: 5972 - DNA, 195 bp, Actinoplanes utahensis
atgacatcgatcaactccggccagcccgatcccgaggatgtgcgccgcctcaaccgtgccgaccgtcgtcgggagcggatccgccaacaggtgcagcaggcgcggcacggccgcaaactgatcccgacgtggctgatggcggcggtattggcgctctttctggccggctgggtgtatctgatcgtcaccaaatag

SEQ ID NO: 5973 - DNA, 687 bp, Actinoplanes utahensis
gtgcgggatcggccggtttgcgagaggctccgggctatgaccgagattctggggccgggcatcgaggactacctgctggcgcacagcacgccggccgatgagctgctgcgggagttggcggcggagaccagggcgtcgcttccgccggattatgccggcatgcaggtctccgcggacgagggcgccctgctcaccatgctggtgcagctgaccggcgtggattatgccgtcgaggtgggcacgttcaccgggttctcgtcgatctgtatcgcgcgcgggttgcggcccggtgggcggctgctggcctgtgacgtgtccgcggagtggacgaggatcgccggcggctactgggagcgggccgggctgcgggaccggatcgagttgcggctcgggccggcggtggagacgctgcgtgcgctcccggccgatccggtgatcgacttcgggttcatcgacgccgacaagatcaactacccggcctactacgaggaactggtcacccggctgcgtcccggcgggctgctcgccctcgacaacgtcctgcgtgacggccgggtgctgcacccgaccgatccggccgaccgcgccatcgcgcagctcaacgaccggatcgtcggcgacgaccgggtcagttcggtgatgctgccggtccgcgacggcgtaaccctggtccgcaagcgcgactga

SEQ ID NO: 5974 - DNA, 1263 bp, Actinoplanes utahensis
gtggtggtgcttcgccgccggcgtgttcagcaatgcgaccggcatcctggtcgccaaggtcagcgcggtgtggtggaacctggcggatctgccgacccgttcttcctcgggctgtatccggcatgcgcggccgggatcgccctgctgatccgccgccgcgacgagtggcgcaacgggaccgccctggtcgacgcggccaccatcacgatcgggttcgggctgctggcctgggtgttcgtgatcgagccggcgcatggggacattcagatggaccggctggcgtacggcacccaggtcgcctatccgatcggtgatctgctgctgatcgcgatgatgacccggctggtgcgcggccgcggtgcccgggggccggcgctggccgcgatggtcgcggcgctgggggccctgctggtcggcgacagctcgtgggtgatcatggacaatctgggcggcgccgagaagtggctggggctgctgccgtggctgggccgcgccctggagtcggtgttcgtgaccgcgttcgcgctgttcgcggtagccgccctggacccgggcgcggggcggctggcggagccggcgcaggagcggtcggcccggctcggcccgggcctgctggccctgctgaccggcgcttcgctgatcgcccccgggttgctggccggccagttgcacagcgggtcggtgaagaacggctggagcatcgtgctctgctccaccaccctgttcctgctggtcgtggtgcgcatggcgggtctggtgcgggaggtggagcgacaggcccggcaggtgcgggacctggcccgctcggatgagctgaccggtctgccgaaccgccgggcgtggaacgacgaactgccccgcgccctggaacgggcccgccgcgatcaccagccggtggtcgtcgcgatcgtcgacctggaccatttcaagcggttcaacgacacgtacggtcatccggccggtgaccggctgttgaaggcggccagcgcggcctggcacgagacgctgcgcaaggcggatctgctcgcccgctacggcggcgaggagttcgtggtgctgctgcccggctcggatgcggcgcacgggcacggcgcgttgagccggatgctcgccgccaccccgcaggggcagaccttctccgccggtctggcggtctgggacggccaggagacctcggacgagctgttgcagcgcgccgaccaggccctctacctggccaaggagcggggccgcaaccggatcgagatgccggccgccgcgtga

SEQ ID NO: 5975 - DNA, 942 bp, Actinoplanes utahensis
atgccgggtctcatcttcgcggcgctgatcgggccggcgatcgccacgtcgccggagtggatcttcgggagcatcgagccggacaccacgaccacgctggtccagccgaagacgacgggcagcagcgaccagagcaccgccaccgcgcaggtgcccagcaggatccgggcgagcacgctcgcgatgaaccaggcccaggcacgggcttccgccatccctcaagtgtccggccggacgtccgatcgggagcggcgttccgctggagagccgcagggagtcgccatgtcgcagaccgatgccgccgagcgccgccgtcgccggcgtcgccggttctccgggctcgccgtgccgttgagcatcctgctggggtcgatgctggtctggcagtcgtccgagtcggcgtacacgacgacctcgtcgacgctgaacaacacctggaccgcggtgagcgtggcgctgaccaacagccaggtggcgtcggcgccgttcaccgtgtcggtcgcggtgccggacgcctcggcgagttcgatcacgcttgccgggttctcgcccagcagtgtgcggaccggtggtcagatgtgcatcatggtcgactaccagaccggtgcgccggcgcacatccggatgcggatcgacgacaacgcggacgccctgtccgcggcgctggagatggtcatcgacgagggcaccggcgcgacgaacgcggcatgctcgggtttcacgtccaacggcacctacgtgtacgggacgggtgcggccagcaccgcgaaggtcagcggcctgccgacgacgtggggcaccagcaccgcgggggagtggaccgcggccacggcggcgcagctgtggtacagggtgacctggctgctgccctcgaacgcgctggcggcgacctccggcaccagtgccgacttcaagttccagtgggaggcgcagccctactga

SEQ ID NO: 5976 - DNA, 636 bp, Actinoplanes utahensis
gtgggaggcgcagccctactgatgcccggggtacgacggtcccgaccccgccatcggcgtcaccttcggtggcaccggcggtggtggccggccgccgtcctggtgatcgtcacggccgccgccctgccggtcaccggcgccgggtacacgggcaccacgtcgaccccggtgaacacgttcaccgcgggaacggtggtggtctcggcgtccgccccggccggcagggttttcgcgatcaccaacgcgatccccggcacggtcggtacgacgtgtgtgatcaccgcgtacaccggaaccgccccggcgaccgtgaagatgtacttcacctcggtcgccgggacgctcggcgcctacctggtggcccaggtgcagagcggcaccggggcgcagaccgactgctcggatttcggctcgtccgccacgctgtacaacgggagcgcgccggccaccggcggccccaccctgggcccgtatctggccgcgcacaccggctggtccagcggcgacggcgcgtgggcggtgtccgggccggccacccgggcatggcggttcgacctcctgctgccgaacaccgccggtgacgccgcggccgggctggggctcaccttcaccgccacctgggaggcgcagacctga

SEQ ID NO: 5977 - DNA, 2310 bp, Actinoplanes utahensis
atgccggggggaagcatggcgacgtggagccggcgccggcgggtggccgcggtcctgttcgccggcaccctgctggtggcgatgccgctggcctggcggccggtggccgcccagtacacggccaccaccgcggtcccggccacggtcgccgcctcggcgggtttccccggcctgccgcagctggtcaccgacggcgggccgctgttctaccaccggggcgaggagagccagaccggcgcgctcagctcgaccgccgtggactcgtccggcaacggccaggacggcgcgtacgcgaacagcacgaacggtccgtcgctgtggtggccgatggacgacggcccggcggccacaaggtaccgcgacctctccggcaccaccgacaccggcaagcccaccggtaccccgatgacggtcaccaacacgaccgggccgaccggcggcgcgtacatgctcggggcctcgaccgcgagctgttgtgcccaggcgacgctctcctcggtgctgtcgccgttccgggcggaccgggacttcaccgtcgcgctgtgggtcgacatcggcgacaccgcgccggctgccgggagccggttctccgccttccacatgaccaacagctcctaccggcgcagtgacgtggcgctgctggtggacaacagcgcgtcctgcgcgatggcaccgtgctgggcgttcaccatggccaaggatccgaacagcaccacggtgaccggctgggacaccgcctacggttcggccgccgcggtgaacacctggacccacctgaccgcggtcttcgtcgccgcgacgggcacgatgagcctgtacgtcaacggcgtcgccccgcccgcgaccgccacgcacaccgtcccggccgacgccgccaccgaccggaacgtgggtttcggccggtaccgtaccggcgccggtaccggcaactgggccggctacggcggccggaacaccggcatcggcatgatcatcggcgaggcgcgcacctggcggcgcgcgctgagcgcggccgaggtggccgagctgccggtccgggccaccagccgctggaccttcgacgaggccaccggcacgacacccgggtacaccaccgcgtcggcgagcaccggcacaccgtcggtgaccggctcgtcgaccgccggggtgacggccggcgcggcggccgccctgacgaccggccgcaccggtaacgcgctgaccatcgccacggccggcgtgaacggctacgtgcagggaccctcggcgcaggtgaccaccagcggcagcttctccgtggcggcctgggtcaggctcaccgacacgagcgcggaccgcacgatcgtctcgcagaacggggtgctcggcaccgccttcacgctcggctacgacagcaccgccaaccgctggcggatgcgctggtggccgagcgacgccgcggtggtcacgccgaagagcacggtcagcgcggcggcgccggtgctgaaccagtggacccacgtcgccggggtctacgaggcgggaaaggagatccggctgtacgtcgacggccgctccagtggcaccgccacccccgcgaccacggccgcctggccgtccctcggggcgacccagatcggccgccgggtggtcggcggcgccaccgccgagggctggcagggtcagatcgacgacctgcgcgtctacaacggctacccggtggtgtccaccacgatgcggcagctggtcggcagcgtcgaggtcgaggagaccggtggtctggccggcacgcgtccgctgcacgcgaacaccaccgcgatggccttcggcggttcgtccagcggcgggaacggccggttcgccgccgcggtggccggtcccgccttcaccgaggagtgcctgatccgggtggcgagcggcgagaccggggtgatcggcgggttcgccgacaccgacgaccagctcgacagcaccgtgaccgaccggctgatgtacgtcgacaccaccggcagggtgcggttcggcgtgctcggcgcgggcgtcccggtcaccgtggtcagtgcggcggcggtcgacgacgggacgtggcaccacgtgctggccagcgtcggcgcggccggtctgaagctctacgtcgacggcgtcaaggtgaccggcacggccgtcaccgcggccgcctccacgaccggctactggcgctggggcggggtggcgatgctgccgctgaacggctggccgtccgccccgtcgaatccctacctgaccggcacgatcgacgagttcgcggtgtacgaccggcagctgaccgatcaggaggacctttggcgggtgtacgcggactacctggagtga

SEQ ID NO: 5978 - DNA, 654 bp, Actinoplanes utahensis
ttggcgggtgtacgcggactacctggagtgaggcggcggcggatcgccggcctggcggtgccgctgagcatcctgctgggctcggtgctggtctggcggtcgtcgacatcggcctacagcgcgaccacctcgacgccgaacaacacctggaccgcggtcagcgtgacgctgaccaacagccaggtggcgacggcgccgttcaccgtgccggtcgcggtgccggacgccacggcgagctcgatcacgctggccggcttcgcgcccagcagcacccgcaccggcgggcaggcgtgcatcatggtcgattaccagaccgctgcgccggcgcacatccggatgcggatcgacgacaacgcggacgccctgtccgcggcgctggagatggtcatcgacgagggcaccggggcgacgaacgcggcgtgcgcgggcttcaccgccaacggcaccttcgtgtacgggacgggcacggccagcaccgccaaggtcagcggcctgccgatcacctgggggaccagcgcaccgggggagtggacgacggccacggccgcccagctgtggtaccgggtgacctggctgctgccgtccaacgcgctggccgccacctccggcaccagcgccgacttccggttcgtctgggaggcgcagccctactga

SEQ ID NO: 5979 - DNA, 1080 bp, Actinoplanes utahensis
atggtgcgctggcggtccggaacggtgtcctcggtgcggcgacgctggcgcggcgccatcgagctggacgtgctgtgcgacggcggcggcgtgcgcgcgctggcctacccggagctggtcggctcgccggagcccggcgaccgggtgctgctcaacgtcggcgcgctggtgatgggcctgggcaccggggggtacgcgctggtcgtcgcgctgcccgaccggttgcccgcggacccggccgacgacggcaccacccgcgacgcgggtcacctggtgaaggcgcggtacacgccgctgcagccgatcctgctcggggtcgacgaggaggcctccccgcaccgggcggtgctggcagccgccgagtcgctcgaggcgatgccggtggtcaccgccgacctgcactccgcgctgccggcgatcctggccggggtccgcgcggaccggccggacgcccgggtggcgtacgtgatgaccgacggcggcgcgctgcccgcgtggttctcccggaccctggacgggctcaccgggcacctggccgggacggtgacgaccggacaggccttcggcggcgacctggaggcgagcaccgtgcacaccgggctgctggccgcccggcacgtgctgcgcgccgacgtgaccgtcgtcgcgcagggcccgggcaacctgggtaccggcaccacctgggggttctccggggtggcgctgggcgaggcggtcaacgcgatcggtgtgctcggcgggcggccggtcgggtcgctgcggatctccgacggcgacgggcgggaacggcaccgcggggtgtcccatcacagtctcacggcgtacgggaaagtcgccctgatccgagcggacctgccggtgcccgagggtctgccggcggccctggccgcctcgatcgcgccgctcgccgagcggcaccggatcgtcgaggtgcccaccggcggcctggacgcggcgctgcgggcgtcgccggtgccgctgtcgacgatgggccgcgggctggaccgggaccacgcgtacttcctggccgccgccgcggccggccggcacgccgccgccctgctcggcgccgatcagtag

SEQ ID NO: 5980 - DNA, 1008 bp, Actinoplanes utahensis
gtgacgatcgcacccgagcccgagaccgcaccgaccggtctgcccgacaacgagccgcaggccgcgaccgaaagcgtcgggacggtgctgctggcgctgctggcgaacctggtcatcgcggtcgccaagctggtcgccgggctgttgtccggctcggcggcgatgctgtccgaggcggcgcactcgttcgccgacacggtcaccgagatcttcctctacgtcgcgctgcgccggggcggaaaaccggcggacgaggaacacccgttcgggtacggcaaggagagctacgtctgggcgttcatcgcctcgctgttcaccttcgtgggcggtgccggcttctccatctaccacgggatcagcaccatcgtcagcggcgcggacgccggcgactacctgtggtcgtacgtcgtgctggcgatctcgttcgtcgccgagggatcctcgttcctgaaggcccgccgccaggtgcgcgagcagtcccgccggtggaacgtcagcccgcagcgcttcctgcggctcacctcggacaccacggtcaaggcggtcttcttcgaggacgcggcggccctgatcgggctgctgctggccgccgccgggctggcgctgacccagctcaccggcagtgaggtgtgggacgggtcggcctccgtgctgatcggcgccctgctgctggtggtcgcctcggtgctggcccggaccaacgtgtcgctgctggtcgggcgggcggtgccgcgccggatgcacaaccagatcgcggccgatctgcggtccatcccggtggtgaccggcgtgccgacgctgttcaccatgcagatcgggccgggcgacatcctggtcgcggcgaaggtcgacttcgacgacgaggtgccgggccgggacatcgaggccgcctcggacgaggccgaacgccggctgcgcgaccgctatccggagatccggtacgtcttcctggaccccacccgcggcgttccgggacgcgaccacatcgacggtggcctggaccgatag

SEQ ID NO: 5981 - DNA, 996 bp, Actinoplanes utahensis
gtgtcgcgcactcgaaccgagcgcctggtgaacctggtgatctgcctgctgtccacgcgacggttcctgaccgccgcgcagatcgccctgaccgtgcccggttacgagcacgacccctcggatccccgggaccacgaagccttccagcgcaagttcgagcgggacaaggccgagttgcgcgagctgggcgtgccgctggagaccggcaccgcgagcatcttcgaccaggagcccggatatcggatcgcccagcgggagtacgcgctgcccgacatcctgctcgaacccgacgaggccgccgcggtcggcatcgccgcccggctgtggcagcacgccgggctggccgccgccgcctcgtccggcctggccaagctgcgtgccgccggggtcgaggtggacccgcaggccaccctgggcgtcgagccggtggtcacggtcgacccggcgttcggcccgctcaccgcggccgcccgggcccgccgcgcggtccagttcaaataccgggtgcccgcggtcgacgagcccagcgtccggcgcctggagccgtggggcgtggtctgctggcgcggccggtggtacgtggtgggccacgaccgggaccgcaacgccgcccgctgcttccggctgtcccggatcgtcggcgacgtgcgcgccgtcggccgcccggaggccttcaccccgcccgccgacgccgacctgatcagccacgtggcccacagcaccgggccgatcgcgcgcaccggccgcgccaccgtcaccgtgcgtcccggccgggccgccgggctgcgccggctggccagcgaggtcactcccggtccggacggggacagattgactatttcgtacggcgatccggactggctcgcgtcccggatcgcggggtacgggccggacgcccgcgcggacggcccgccggagttgcgggacgcggtcatccagcagctcaaggagctcaccacccggtacgaccgggacgtcccggcggtcgcccgatga

SEQ ID NO: 5982 - DNA, 987 bp, Actinoplanes utahensis
atgaccgccccgcgcaccccgtccgccgaccggctcggccgcctgctcaacctggtgccctacctgctggcccgccccggcatcctgatcgccgaggccgccgacgacctgggcgtcaccgccaagcagctgcgcgaggacctggagctgctctgggtctgcgggctgcccggttacggccccggcgacctgatcgacatggcgttcgacggcgaccgggtgacgatcagccacgacgccggcatcgacaagccgctgcggctcaatcaggacgaggcgctcgccctggtggtggcgctgcggatgcttgccgagacaccgggcatcggctcgcgggacgcgatcgagcgcgccctcgccaagatcgagagcgcggccggtgacctggcggacgccccggtcgccgtgaaactcccggccaaccaggagaagctcgccaaggtccgggccgcggtcgactccgggcacgcgctgcggctcacctactacacggcggcccgcgacgagaccaccgagcgggtcgtcgacccgatgcggatgctgaccgtcggcaccttcgcctacctggaggcctggtgccgccgggccgaggcgacccggatgttccggatcgaccggatcgacgcgttcaccgagctcgacgagccggcccggccgccggtcgaggcggtcccgcacgacgtcacgcacggcgtcttccagcccggcccggagctgcccctggtcaccctgcgggtgggccgcggcggccggtggatcaccgagtactacccggtcgagcaggtgcagcgggagcccggcgagtggctggtcacgatgcgggtcaccgacctggtctgggcccgccgcttcctggtcggccgcgccgacgtcaccgtggtcggcccacccgagctggtcgagcagatccgtgacgccgcgcacgaggccctcgaccagtacgccgcgccgcactcactcgcggcggaccgggccccggccggatag

SEQ ID NO: 5983 - DNA, 243 bp, Actinoplanes utahensis
atgtgggtctggatcgccgtgggtgcgatcgcgttgatcatcctggtcgtcaccgccgcgcggctgctgggccggctgcccgagctgcgccgggcggccgggcggttgcagcggcggcaggccgaggcgatgggcctgcaggccggggcggcccggctggagcagaccctgcagggcctgcagcagcgggccgagcgggcgcaggagcacgtggaacggatcaaggccggttccggccactga

SEQ ID NO: 5984 - DNA, 399 bp, Actinoplanes utahensis
atgggcgccctcaagccatggcacctcatcttgctcgtcgtcgtcctcgtgctgctcttcggcgcgaagcggctgccggacgcggcgcgctccctcgggcgctcgctgcggatcatgaaggcggagaccaagggtctcatcgacgagaacaacaacgacaacctggcggagaaggccgacgcgcagtactcgcgccagccgctgcagggtgacgtgcagggcggctacccgcagcagggttaccagcagcagcccccgccgggctaccagcagccccagccgggttaccagcagccgcagccgggttaccagccgcacccgcagccgggcttccagcagccgcagcagccgccggcccagccgttcgtcgacccggtgcagcgcaccaacgaccgctga

SEQ ID NO: 5985 - DNA, 960 bp, Actinoplanes utahensis
atggcttccctgaccctgcgtcgcaacaagaagccgagcaagttcgagcaggccgccgacggctcgatgacgctcatcgagcacgtccgcgagctgcgcaaccggctgttcatcgcctcgatcggcatcgttctcggcctgatcgtcggcttcgtcatctcgcagtgggccttcgacatcctgaaggcgccgtactgcgcgctgcccagctcgatcaacgaccggaccggcagctgtgagttcatcaccctcgcggtgaccgaccagctgatgcttcggctgaagatctcactctggctcggtctggtcctcggcgcacccgtctggctctaccagctgtgggccttcgtcgcccccggtctgcaccggcacgagcgcaggtgggcgtacctgttcgtcgcgctggccctgccgctgttcgccgccggcgtcatcatggcgtacctcgtgatcggtcacagcctggccttcatcatgaaggccggtgtgctcggccagccgaccaaactcgaagtcacgtcgtacgtcggcttcgtgatgaacatgctgatgctgttcggttgtgccttcgagttcccgctcctgctgctgatgctgaacttcaccggcgtggtcaccggcaagcgcctgctcagctggtggcgtgcggtcgtgttcctggcgttcgcgttcgccgcgatcgccacgcccgacccgggcccgttcggcatggccctgctcgccgcctgcatcagcgcgctgtacttcgtcgcggtcggcgtggcgatcctcaacgacaggcgcaagggccgcggcaaggagatctacgaaggcctctccgacgacgagatctccgctctcgacgaggagcgggtcccggtcggcgcctccgacccgatctccgccccgaccccggtcgacgctccgacacccgtggaggccccgcgttccatcgagcggcgcttcgacgacatgacgtga

SEQ ID NO: 5986 - DNA, 1092 bp, Actinoplanes utahensis
gtgggtgccggcctgccccaaggtttgtggggtgggtgcggtgcgtcggggtgggggctagcctcggcggctgtgacgagcgacttcatcgcggtgctggcgaacgcccgggcggggcggggtcggcaccgcggtctgcttccgggggtgttgcaggcgctcggcggcgcggggcatgccgtgcgactgctggatgcggacagcggggccggcgcggaacgggcctgtcatcaggcggtggccgagggcgcggtggcgctggtcgcggtgggcggggacgggaccgtgcaccgggcgctccaggccgtggcgggtggtgggccgcgagtgggggagtcggcgccgcccggcgcgcagtcctggggatccgcgaatttcggggcggctgctgcgggggccgtggattccgggctggttgccgcgggggccgcggcgcggcgggtggggttcggagtggtcgcggcgggcaccgggaacgacttcgcgggtgccgtcggcgtaccgggcaatccgatcgaagccgcgcgggagatatccgcggccctggaagcgggccgtgcgcagtcgatcgatgcggtgctgacggcggatgccgtcgggcggcagcggtggttctgcgccgtgctggcggccgggttcgatgcgctggtgaacgagcgggccaaccggatggcctggccgcgcgggccccgacggtacgacctggcgatcgtgctggagctggcgcggctccgggcccgggcctacacgctggagctggacggcgagaccctgcatcgggacgcggagatcgtggcggtggggaacacggcgagctacgggggcgggatgcggatcgtgccggcggccgacccgtcggacgggctgctcgacgtgatctgggccggtggactcgggcggggtgggctcagccggctcacaccgcggctgcggcaggggacgcacgtcaccgatccgcgggtgcatcagcggcgggcccggcacgtgcgggtggccgccgaagggatcgtcggatacgccgacggggagcgactcggcccgctgccgctcgacatgaaactagtcccgggtgcgatccggttgctccggtga

SEQ ID NO: 5987 - DNA, 195 bp, Actinoplanes utahensis
atgaacacggtctccggcaccgcgaactcgatgacctccctggcgacgtcggtcttcggcaacgcccgccaggcgttcaaggcgatggccgaggcggccaccaaccagcagttcggcgcggacaccgcggcgaccgcgcaggccacccccggcaggtcggcgcggcgcggcaccatcctcgaccgctacatctga

SEQ ID NO: 5988 - DNA, 3603 bp, Actinoplanes utahensis
gtgggctcacggcgtagcgccgccatcggatcttcagatgcaaccggcgagggcgagcgtggcgccgaggccgttgttgcggcccggctcggcggccgggacgaccagggcggtgcagccggccttgaccgcgccggcgtccgccggggtgtctccgaccatcagcgtgcgttccggatcagcgcccaacatgccgcaggcgcgcaggaagatcgccgggtcgggtttgatccggcccacctcgaaactcagcgcgaacgcgtccaccagaccgtccagcccccagtgcgtgaacagcgggcggatgtcgaagccgatgttgctgaccacgccgaccttgatcccggcgtcgtgcagcttgcgcagggtgggctcggtgttcgaatatggcagccagccgtcggggctcagcaaccggtcgtagagcgcgtcggcaaggccctcgacatcggtcggcacggtggccgccagcccggtgtaggcggcccggtgactgtgcgcgtagagatcgcggtcggaccagtgctcggccagctgcggcggcacccggtgcggcagcgggccaccggcccggcccgcggtgaccagccggtcggccaggatcgtggccttaccgcggtccagcgtggcgccgcaggccgcggcggccgcgacgacccaggtcaccgggtcctcgacctgggcgagcgtgccgtggaagtcgaacaggacggcttccacgagccgcgcggacgggggatgttcgggggcaagcggcactcgtgcaccttaccgatgaccggccgatgcccccgagcgcccataccgtgtcgcacattgtcgtacccgcgaactagtcttttgttcatgactagtcccgccgacaggtatgcggaatccaagcggcgggcggcgcgggtcgccaccttcccggcgctcgacgacttcatgctcgacgtcggtttcgacctggacgacttccagcgcgagtcctgcgaggcgctggagcgcggcaacggggtgctggtgtgcgcgccgaccggcgccggcaagacggtggtgggcgagttcgcggtgcatctggcattgcgcgccggcgagcgcaagtgcttctacaccacgccgatcaaggcgctgtccaaccagaagttccacgacctggtggagcgctacgggcccgacaaggtcggcctgctcaccggcgacaacgtgatcaacgcggacgccccggtggtggtgatgaccaccgaggtgctgcgcaacatgctctactccggctccagccagctgaagaatctggcctacgtcgtgatggacgaggtgcactacctggccgaccgcttccgtggcgcggtctgggaggaggtgatcatccaccttccggcctcggtcaccctggtctcgctgtccgccacggtcagcaactacgaggagttcgccgactggctggtcaccgtccgcggcgagacctcggtggtggtctccgagcaccggccggttccgctctggcagcacatgctggtcggccggcggatgttcgacctgttccacgacgccgacgcggccaggaaacacgacgtccaccccgagctgctgcgctacacccgggagatggagcgccggctggagctcggcgagcgtgcctccgggtggaacgggcggggtggccggggccgccgctggcagccgccgccgcgcgccgaggtggtcgaccggctggagcgtgccggtctgctgccggccatcctgttcatcttcagccgggccggctgcgacgccgccgtccagcagtgcctgggcgccggtctgcggctcaccgacccggacgagcgtgccgagatccgccggatcgcccaggccaaggtcgccagcatccccgccgaggacctgtcggtgctcggctactgggagtggctcgacgggctggagcggggcgtcgccgcgcaccacgccggcatgctgcccgccttcaaggaggcggtcgaggagtgcttcgtcaacgggctggtcaaggcggtcttcgcgaccgagacgctggccctggggatcaacatgccggcccgctgcgtggtgctggagcggctggtcaagttcaacggggaagcgcacgtcgacctcactccgggggagtacacgcagctcaccggccgggctgggcgccgcggcatcgacgtcgaggggcacgccgtggtgctctggagtcccgaggtcgacccgcggcacgtggccggcctggcctccacccgcacctatccactgcgctcgtcgttccgcccgtcctacaacatggcggtcaacctggtcggcacggtcggcgcggacaagtcccgcgagctgctggagtcgtcgttcgcccagttccaggcggaccggtcggtggtcgggctggctcgccaggtgcagcgcaacgtcgacacgatgcagacctacggcgccgacgccgcctgtcaccacggcgacttcgacgagtatttcgggctccgggtcgccatcgccgaccgggagaaggcgatggcccggcagggggtggcgcagcgccggtcggcggccaacgactcgctgtccaaggtgcggatcggcgacgtgatccgggtgccgcagggtcggcacgccggcctggccgtggtgctggaaccggccgccggcgggttcggcgagccccggccgatggtgctcacccaggaccgctgggccggccgggtcagtcccgccgagttcggcggcgaggtggaggtgctcgcccggctgcgggtgccgaagaacttcaaccaccgctcccccggcgcccggcgggacctggccgcccaggtcagcggcaccgggctcgaccggcatccggaccggcggcgcagccggggccgggccaacccgggggaggacgccgagatcgccctgctcaaggtgaagctgcggcagcacccgtgtcacgcctgcccggagcgggaggaccatgcccgctgggccgagcgccggcaccggctgcagcgcgacaccgacgccctgcgggacaaggtggccggccgtaccgggtcgctggcccgcacgttcgaccaggtctgctcggtgctgacggcccgcggctacctgtcgcacgacggtgaggtcaccgaggccggccggacgctgggccggatctggtcggaggccgacctgctggtcgccgagtgcctgcggcaggacgtgtgggccggtctggcccccgaggaactggccgccgcggtgtcgatggtgctctacgagtcgcgccgcgagggtgaggaccgcgcctcggtgccgaagggaccgatcagcgaggcggtcgacgcctgcgccaagctgtggacggagatcgccaccgaggagggcgagcacgggctgtcgctgacccgcgagcccgacccgggcttcgtctggccgatgttccgctgggcgcgcggtgagccgctcgccaaggtgctggccagcggccacaactatgacgccgacatgccggccggcgacttcgtccgctgggcgcggcaggtgctcgacctgctggggcagattcgcgaggcggcggtggcgtcgccgggggtcaaggagaccgcgcgcaaggcgatcagcgcggtgaatcgcggggtgctggcctatcaggccggcctctga

SEQ ID NO: 5989 - DNA, 831 bp, Actinoplanes utahensis
atggttgcgggctcgccccatctgatcgggtggtccggggacgcgcgcgccgacgccgtgctggcggtcatcgacccggagaccgcggtcatcgaggtgaccctgtgcgggccctgggaccggcaactgtccgcgcaggcccgcgctgtgctggacaagtgcctggccgagcacccgaccggcatgatcgtcgacctgcaccggctgaccgacccgcgtgcggtcagtgccgccctctggctcacgctctgcgcacagggcgcggcgatgcggccaccgatcgcgatcggggtctgcctgccggcgtccgccccactggcccgtcggctgcgccggctcggcgcccgcgactggctggtcatgcacgcgtcggtgcagcaggcgcacaccgccctggcccaccgccgcccgctgatcgaccggatgcagctggccctgccgcccgacccggccgccgcctccctggcccgggccctgatcggggacgcctgccagggctgggatctgccgcacctgctggagcgtggccggctggtcgcctccgagctggtggtgaacgcggccgagcacgccggcaccgacatcgcgatgatcgtgtcgtcgcgcggggagggcgtcaccgccgcgctgcacctcgcggtgcacgacggcgatccggcgctgccgcaggtccgcgacccggttccgggcccgctcgggccgtcgctcaccgaccgcggcctgggtctgcggatcgtcggggcggccgcctcggcgtggggcgcgcttccggcccggggtgggaaactggtgtgggcgatcctgcgcaaccgcccggaggtgccgggatga

SEQ ID NO: 5990 - DNA, 363 bp, Actinoplanes utahensis
atgatcggcggacgcgacgagccgcggttcgcgggcgccggcgtggccggcgcccgcaccggtgaccggctgctcatccacctgcgcggcagcctggacgcgatgtcggtgaccgcgctgcagacccagctgtacgacctgacccgggtgcacgacgtgctgggcctggccgcaccggtccggcagatccacatcgatctggccgaggtggacttctgcgacgcggccgggctgcggatgctggtcgcggcccgctgtgtggccgatgcccgggacgccacctgtcacctgcgcaacccgcagccgcatctgcgctggctgctgcgcgccacccgggccagcgacctgttccaggtggactga

SEQ ID NO: 5991 - DNA, 1908 bp, Actinoplanes utahensis
gtgactgccgaggcgggctcctaccgtgtggggatggtggcttcgcaggagcatgtcaccgccgatctggcgcgcggggcgacgctcgtcggcggcggggtggcggtccggttctgggcgccggcggcgcggcgggtcttcgtggcgttcgacggggtgctcagctatctgcccgatccggcggacgagctggtccaggatccggtgaccggcgactggaccggctggtttcccggggtgggcgccggcacgaagtaccggttctacgtgatcggggccggcggggagggcttcaagcgggacccgcaggcgcgggagctggagctgtacggctatccggagtgtgacgcgctggtcgtcgacgacgacgcgtatccctggcacgaccaggggtggacgccgccgggcgcggcggagctgatcgtctaccagttccatgtgggggtgttcgcggcggccgatccgctgggccacgaccgcaggccgcaccgtaccgccaaactgctcgacgccgtgcagagggtgccctatctcgcggcgctcggggtgaccgcggtgcagccgctgccggtggtcgagttccagggggagtggagcctcggatacaacggcacggatctgttctcgccggagatggactactgcgtggatccgcacgcgctgccgccctatctggacgcggtcaacgagctgctggccgcgaccggggccgggccgctcaagttcgagcagctggccgggcaggtgaaccagttgaaggcgttcgtcgacgtctgtcaccggttcgggatcgcggtgctcttcgacgtggtctacaaccatgccggcggcggtctcgacccgcagagcctggactacatcgacatgccggccgcgccggggccggacaacaacgcgtatttcaccggcgacggctgggccggtggccgggtgttcgccttcggccggccggcggtgcgcgagttcctgaccgcgaacgcgctgatgttcctgcgcgactatcacgccgacgggttgcgcttcgacgaggtgaccgtgatcgacgcgaacggcggctggggtttctgccaggagctgaccggcacgctgcgggcggcgaagccggcggccgtgcagatcgccgagtactggggcgagttccgcgggctggccgtcgcgccgccgcccggcgggatgggtttcgacctggcctacgcggacacgttgcgcgacgcggtgcgcgcggtgctggccgatcggggagccggggtcggtcggctggtcgccgggttgcactcgcccggctggtcctacaactgcctggaaaaccacgacctggtcctcgacatggacgaccaccgggcgccgcggatcgccacgctggccgacagcgccgacccccggtcctggtacgcgcgcagccggtcccgggtggccaccggcctgctgttgaccgcgcccggtgtgccgatgctgttcatgggccaggaattcctggaggacacgctctggtcggacagcccggggcgcaccgaccggctgatctggtgggacggggcgctcggcgccgaccggcacatggtcgacttcctgcgctgcacgcgggacctggtccacctgcgccgggagttgccggcgctgcgctcggcggcggtcgacgtgctgcacgtcgacgaggacaaccgggtggtcgcgatgcggcgcggcgacgacgtggtggtgctgctgaccttcagcgagtccacgctgtacgactaccggctgaacctgccgtgggcgggccggtggcgcgaggtgttcaacagtgactactacgacttcttccccaacccgatggtggccgggaacgcgggcgcggtgaccgccgccccggaggtgtcactgaccgtcccggcgaacgggatgatgattctgcaggcggaccactga

SEQ ID NO: 5992 - DNA, 561 bp, Actinoplanes utahensis
atggacctgtccggcatccgcaccccgctgctggtgatgggcaccgcgcaggtggtgatggtcgcggtgatgaccgccgccccggtggagatgcacgtgcaccaccacgggctggccacgatcggggtggtgctgtccgcgcacaccctcggcatgttcgcgctgtccccggtcaccggccggctcgccgaccggctgggcgcccgcccggtgatggcggccggcctggtcacggtcgccgccggaccggtcctggcggcggtcggcgcgccccgggtgctcgcgttcctcctgctcggctacggctggaacctgtgcctgatcgggggcagcgccgtcctggccacccgggtgccggagccgctgcgggcccgcgccgagggcaccgtcgacggaatggtctgggtcgccgccgcggccggcgggctcgcctccaccggactgctcaccatcggcggatacggcctgctggccgcgctcgcggtggccgcgatcggcccggccgggctgtcagtggtccgcctgcagaatcatcatcccgttcgccgggacggtcagtga

SEQ ID NO: 5993 - DNA, 465 bp, Actinoplanes utahensis
atggcgaagtccctgttcgtggccgccgccgcgatgaacaccgcgatggcgacggccagcccggtcgccaccctggtcgtcgccgaccggctcgggccggcctggggcggcgtgcccagcaccgccgcgatcaccggcaccggggtgggcgcgctgatcctggcccggtcggtcagccggcgcggctggcggcacgggctgctggtcgccttctgctgcgcggtggccggcgggctgctcgccgccgcggcccgtgggccggtcccgctgagcgtcgcactggtgctgctgggttacggcaacgccggcgcgctgctggcccgctacgccgtggccgagacgcatccggcgcggcaccgcggcaccgcgatgggcctgctggtctgggccggtgcgatcggcgcggtcggtggcccgctgctgctcggcgtcctgcacccggccaccgtggtcctagctagctag

SEQ ID NO: 5994 - DNA, 381 bp, Actinoplanes utahensis
atgcatcgaagccggttgttcggaatgctcgtcgacaccccggccaccgaggccggcgccgcggtctcgttctggaccgccgcgctgggcggctcggcccggcaggatccggacgagccggagtacacccgggtcgccgacgtggtcccgggtgtcgccgtggtcgtccaggcggtcgacgaccggccgcggatccacctggacatcgagaccgacgacgtcgaggcggagaccgcccggctgctcggcttcggcgcccagctggtcgaggaccgcggcggccaccggatcctccgggcgcccggcgggcacctggtctgcgtggtgccggtgcagagctccccggagctgttcgccggcgactcccgggtctggtcctga

SEQ ID NO: 5995 - DNA, 1764 bp, Actinoplanes utahensis
gtgacgcagacctgcaccgccccaccggccgagcacgacctcctgacccggctgcggcgcgacgagccggcctcgttcggcgcgatgttcctggccgtcgccgagcgccagccgcaggcggtggcctacctgcggcccggcgacgacggctggcagagccagacctggacgcagaccgcgcgggcggtcaccgagatcgccgccggcctgctcgcgctcggcctgcacccggaggaccgggtggcgatcgcgagcggcacccgggtcgagtggatcgaggccgacttcggggtgatgtgcgccgggggcgcgaccaccaccatctacccctcgtcgtcgccggacgaggtggcacacatcctcaccgactccggcagccgcttcgcgatcgcggagaacccggcccagctcgccaagatcctctttcccggtacgccggtggaacgcgccgtcctcatcgacggcaccgccgcggacccgcgcgtgctgaccctggccgagctgcgcgccctcggcgacccggcccgggtggccgaggcggtcgccgcggtccgcccggacgacctggccacgctgatctacacctccggcacgaccgggctgcccaagggcgtccgggttgcccaccgggcgtgggtctaccaggggctggcgatccaggcgatgggcatcgtgcggcccgacgacgtcggctacctgtggctgccgctgtcgcacgcgttcggcaaggcactgctcagctgtcagctctcggtcggcttcccgttcgcggtggacggggacgtgagccgggtcgtgcagcggctcggtgaggtgcggcccacgatcatgccggccgtgccgcgcatcttcgagaaggtctatgccgcggtgagcgccgccgacggcgtacagaagcggctgttggactgggccgtggcaacggccggacggcggcgttccggatggcgattccggatcgccgaccggctcgtgctgtcccgggtgcgggcgcggttcggcgggcgcatgcggtatttcatctccggagcggccactctcgatccgggcatcgcccgctggtttggcgcgatcgggctgccgatcgccgagggttacggcctcaccgaatcgtgcgccaccaccgtcttcaaccggccggaccgcccggaatacggcaccgtgggaatgccgctgcccggcaccgaggtgcgcatcgccgaggacggcgaggtgctgctgcgcggacccggcatgatgcagggctaccacggcctcgattccggcgcggcgctgcgggacggctggctgcacaccggcgacatcggggagatcaccgagcgcggctcgctgcggatcaccgaccggaagaaagacctgatcaagacgtcgaacggcaagtacgtggcgccgcagaccctggagtcgcgattcaaggcgatctgcccgctggcgggccagttcctggtgcacggggagaaccgcagatacgtcaccgcgctgatcgacctcgatccggacgagatggcgaaatgggcggcggccaacggactcggggacgcctcgcacgccgagatcgccggttccgaaaagctgcgcgccgccctgcaggaatgcgtggaccggctcaacggcacgctcaatccgtgggagacggtgaagcggttcgccgttctcgaccggcatctgagcgtcgagtccggtgagctgaccgcctcgctgaaactgcgccgacgggtcatcgaggaccgtttccggccggtgctggacggcctgtacgcgtag

SEQ ID NO: 5996 - DNA, 675 bp, Actinoplanes utahensis
gtgacgcgggaacggcgtgggaagattggagtaacaagacgtactcagatgggatgtccgcccgtgccggaccggatcgccagcggcgtggtcttcaccaccccgccgtcgctgccccgcggccggcacgagctcgcccgggaccaggtggtcgccgcccagcgggagaagatgctgatcgccgccaccgagctgctggccggggcgggctaccgcggtttcggggtgcgcgagatctgcgcccgggcggcggtgtcccgggccgccttctacgacaacttcgccgacaaggacgcgtgcatccacaccgcgtacgaccgcttcatcgaggtgctgatgagccgcctggcggccggagcggtgtcgatagacggtttcgtcacgacgtaccttcaggtgctggacagcgaccgggtcgccgcccgcgccttccaggtcgagatggacgcgctgggccggcccgcgcgccggcggcgccgggccgcgatcgagcggctcgccgcgctgatcgccggcctgcgcgatgcgcccggcgtcccgctgaacgcccacatcggcgcgatctacgcgctgcgccagatcacctcggacgccctcgacgccggcggcacccctgacctgacggccctcgccccggagctcaccccctggctgacccgcatgctcaaggagtag

SEQ ID NO: 5997 - DNA, 774 bp, Actinoplanes utahensis
gtggagaccgacctggaactggcccagcgggccgcactgaccggcgcggccgaggcgctgcgccacttcgcggtgatcgccgacctgccgcgggagacgaagaaggacggcagcgtggtcaccctcgccgaccgggcggtggagaacgcgatccggggcgtgctgaccgaggcccggccgcaggacgccatcctcggcgaggagcacggcgagaccgcgagcggcaacggccggcgctggatcatcgacccgatcgacggcaccgcgctgttcgtccgcggtgacgaccggtggctggtgctgatcgccctcgaggtggacggcgaggtgaccaccggcgtgcagatcgtgccggcgcaggggctggcctggtgggcgcagcgcggtgccggcgcgtaccggggccgggtcgccggcggcgccctggtggacgcggagcggatccacgtcgcggcggcccacggtcgggcgaccgggagccggctcggtgtggtgccgctggactgggggcgggaggtggccgcgccactggtcgcggtggccgacgagcggacgtggccgatccacccgccgctgctggtggcgcagggcgacctcgacgtggcggtgcagaccggcgggcagatctgggacttcgcggccagctcggtgatcatcccggaggccggcggggtgttccgcggcctcgacggttcgccgcgcccgggcgccggcccgcacgtcttcgccagcaacccggcgctgctcgacgaggcgctgcggatcctccactga

SEQ ID NO: 5998 - DNA, 615 bp, Actinoplanes utahensis
gtggtgcccatgacaacgatcgactccatcagcgtcggagcgtccgaccccaccgccgccgcggcgttctaccgggccgcgttcgacctgggcgacatcgtccaggtgcaccgttcggacgcaccgaccaccggcttccgtgggttcgcggtctccctggtcgtcgcccagcccgccgacgtcgacctgttcgccgcggccgctctgcatgccggcgccaccgcactcaagccggtgaccaagggcttctggggctacggcggcgtcgtgcaggcaccggacggggcgatctggaagctggcgacctcgtcgaagaagaacaccgcgccggccacccggcagatcgaggccatggtgctgctcctcggcgtcgagaacgtcaaggcgaccaagcagttctacctcgagcacggcatgactgtcgcgaagagcttcggcagcaagtacgtcgagttcaccgccggaagttcgccgatcaagctggcgttgtacacccgtcgtgccgcggccaaggacgtcggggtgcccgcggaaggcaccggatcacaccggatcgccatcaacggtgacaccggcgggttcaccgatcctgacggtttcgtgtggaatgtctga

SEQ ID NO: 5999 - DNA, 189 bp, Actinoplanes utahensis
gtgagatcgggtcccggcggatcggcgagaccgacgacgaacgctcccgccagctctgcgcgctgctgcctgctggtgctggacaacgccggcagcgaggcccaggtgtacgccggtggcccgcacggcatcaccgacacccggctgaaccaggacctgctcgccttcctgaacagctacgcggcctga

SEQ ID NO: 6000 - DNA, 639 bp, Actinoplanes utahensis
gtgaccacttaccgctgccccaacgggcatgactccggcgagtccgactattgcgacacatgcggggcgctgatcggttccgcgccggccgacccgccgacgctggtggacaccgcacccaggggcgaactctgtccccattgcgggacgccacgcgcgggcagcgcccggttctgcgaggactgcggttacgaccacaccacgggcaaggtgccccagctgaccgaggtgctgccgatcccggcggccccggccgccgactggaccgccacggtggtcgccgacccggcgtacttcgcgatgaacgcggtggagggggtgagcttcccggccgacaccggggagcgcaccatcacgctgactccgccgcaggtccggatcggccgggccagctcgtcgaagggcaccagcccggagatcgacctggccgacaccgatccgggggtgtcgcacaaccacgcgctactcaccctgaacatcgacggtgtgtggctggtcaccgacctcggttcgaccaacggcacgtacctcaacgacgaggaccagccgctgaccgcgggccagtccaggaccctgaaggacggggatcaggtccacgtcggagtgtggacgaccttcaccctgcacgccccggagtga

SEQ ID NO: 6001 - DNA, 1266 bp, Actinoplanes utahensis
gtgtcctacagcgccgaggctttccagaacgagtacctcgcgatgggcgccagcgaggtcaacgcgatcgtcaccgtcacctcctcgggcggcgacggcggccgccgcagcgccgaggcgaccgagatcatcatcgtggacgcgtccgggtcgatgcaggccgagggccggatggcggccgcccggcaggccgccaaggcggcggtgaactgcctggacgacggcgtccggttcgccatcatcgccggggtcagcaccgcgcagcagctgttcccggacccgggccaactggccgtggccaccccgcagagccgcgccgacgcgctgcgggcgatcgaccggctgcaggccagcggcggcaccgcgatgggcgcctggctgctgctggccgcccagctgttcgaccagcgaccgggcgacatcaagcacgccatcctgctcaccgacggcgacaacggcgagcggtacggctacctggagagcgtgctggagcaggtcggcggccggttcgtctgcgactgccgcggcgtcggcacgaactggaaggtctccgagctgcgcaagatcgccaccgcgatgctgggcaccgtcgacatcgtggcccgcccggagggactgaccgcggcgttcgagcagatgatcaccgcggccatgggcaagaccgcggccgacgtgcagctcaaggtgtggaccccggtgaacgccacggtccgcttcgtcaaacaggtcgagccgcaggtgctggacctcaccggcaaacggtccgaggacggtccgcgcgccgggcgctacccgctgggctcctggggccaggagagccgcgactaccacgtctgcatcgacgtgccaccgggaaagtcgggcgacgagatgctggccgcgcgcatctcggtggtcgaaggcgacacggtgcacgcgcagtcgctggtgcgggcggtgtggaccgaggacaccgcgctgagcacccggatcaaccggcaggtggcgcactacaccgggcaagccgagctggccgacgcgatccaggaggggatcgccgcccgggaggccggcgacgaccggaccgcgacgctgaagttcggccgggccgcacagctggcgcacgccagcgggaactcggcgaccgaggagctgctggccaaggtggtggagatcgaggacgcggcgaccggcacggtgcggctgcggcgcaaggtgaacgcggcggacgagatggcgctggacacgcagagcaccaagacggtgcgggtagggcggtcgcagtga

SEQ ID NO: 6002 - DNA, 1248 bp, Actinoplanes utahensis
ttgattctgaccgagtgcgactcctgtgctgaggggcgcgcgtccggcgctgcgttctgcgaggcgtgcgggcgcccgctgaccgagaccgccgccgtcggcgacggcgcggaaccgccgaacgacaaggacgatggcggcggtacgccggtgagcccggccgccgggcctcgacgcggccgggactgcccgcactgcgcggcggccggcgcggtcgacgccgacggctactgcgaggagtgcggcctgctggccgggcgcccccgcgaccacgtcgaggcggacggcgacacggtggcggccgcggtcagtgaccggggccggcggcaccaccgcaacgaggacgccatgtggctggcggtcggtgtcgaggcggccgacgtggtcgtctgcgacggcgtctcctcctcgttcgacccggacgtcgcctcggaggccgccgcccgggccgccggcgacctgctggcccgggcacagcacccgctggagcccgcccaggtggccgaggccgcggacgcggccggagcgaccgggccggtcgagagcgtcgcggccgccgggccggcggacgacgacgtaccgcgggcggcaatcgatccggaagcaggcggcgaaccggaccccgggatggcgatcgccgagatcgtcgcaacggcgatccaggaggccgggcaggccgtcgccgccctggtcggcaacggcgatccgcgccgcgccgcctccaacccggcctgcacgatcgtcgccgccgcggtccgcggcccgcacgtcggcttcgggtgggtcggtgacagccgtgcctactgggtgaccgccggcggcccggcccagcagctcaccgaggacgactcgtgggcccggcacgtgatcgcgatgggtgccgacccgcgggtggcgatgaacgacccgaaggcgcacgcgatcaccgcctggctcggcgccgacgccgggccgatcctgccgcatctcggcgcgttcaccgcgcagacgccgggccacctggtgctctgcagcgacgggctgtggaactacctgaccgacccggccgatttcggtgacgcggtgcggtcggcgctgaccctggcgaccgggccacgcccgctgctggaggccgctcgggcgctcgtggcgtacgccaattccgccggaggcgccgacaacatcaccgtggccatcgtgccggtggtcccgcgatccacggcggacgccgaaggcgacgccgacatcaccgagcccagcgaagcataa

SEQ ID NO: 6003 - DNA, 2211 bp, Actinoplanes utahensis
atgaaatgtcagcgggacgggtgcggcggcaccatcgaggacggctactgcgacaacctgcggctggccccggtcgccggtgcgccgagcgtgccggcacagcgcaccccggagaaggcctcgcggaacaccgggacgcagagctcgtcacggaccaccggcgccctctccacccgcaccggctccagccgccgcggcagcggccgcaccggctccagccgccgcttcggcagcggcctggtcgagatcgccccgatcgccagggtcgacccggccagcacgatcatggcggacgcgcaggtcccggagtcgaagcggtactgcgccaagtgcaacaacccggtcggccggtcccgcggcgaccgcccgggccgcacctccggcttctgcccgtcctgcggcgaggcgttcaacttcaccccgaagctggtcaagggcgacgtcgtcggcggccagtacgaggtggccggcgccctcgcgcacggcggcctgggctgggtctacctggccgtcgacctgaacgtgtcgcgccgctgggtggtgctcaagggcctgctcaactccggtgacgaggacgcgctggccgccgccctggccgagcagcggttcctggccgaggtcgagcacccgaacatcgtcaagatctacaacttcgtcgagcacgacggcgccggctacatcgtgatggagtacgtcggcggcaagtccctcaaggacatgctcaagcagcgccgcgacgccaaccacggcgacgccgacccgctgccgctggaccaggccctggaattcctcatcgagatcatgccggcgttcagctacctgcacgagcgcggcctgatcttctgcgacttcaagccggacaacgtgatccagtccggcgaccagatgaagctgatcgacctcggcggtgtggtgcacatcgacgaccaggacgcggcgctctacggcacggtcggctaccaggcgccggagatggccaccgacggcccgtcggtcgcctccgacctgtacacgatcggccgcaccctggccgtgctcaccacggacttccgcggctaccagacgacgttcaaggagagcctgccggaccgggactcgttcgacgtctacaagcagcacgagtcgttctaccgcctggtcgaccgggccacccggcgcgacccggacgagcggttcgtggacgcggccgagatgcaggagcagatgctcggcgtactgcgccaggtggtggccgcgcaaggcaccccgaaaccggcgccgtccaaggtcttcaccggtgagctgcgcaccgacctgaagtcggacgcgccgcgctggcaggacctgcccaccccgctgatcgacctggccgacccggccgcggtcttcctcgcctcgatcacggtgaccgatccggccgaggtgctcgccctgctccagcacgccccgcaggagacccccgaggtgcggctgcgggcactgcgggcggagatcgacctgggcacccgccacggcttcttcggcgacgcgatgaaggcccgggactcgttcgccgagctgcacggcgacgactggcggctggcctggtacgacgggctgctcgcgctggccgtcgaggactggaccacggcccggacccggttcgaggcggtctgggcggcgctgcccggcgagctcgccccgcagctggggttcgccttcgccgaggagctggccggccggcccggctcggcggcgtggtattacgacgtggtcagccgcaccgatccggcgtacacgacggcggccgccgggctggcccgctgccggctcgccggcggcgaccgggccggcgcggtggaggcgtaccagcgggtgccgggcacctcctcggcgtacgcgatctcccaggtgggcgcggtccgggcgctggtccgggcgcatccggtggcgcaggtggacgtgcagtcgctgaccgacgcggcggcgctgatcgagcggctcgaggtggagcgcgcccagctcgccgagttgcgcgccgagctgctggagcagacgctgtcctcgctcaggggcggccaccaggtgccggcgtcggtgctcggcccggcgcgcaccggcgacacggtggagaaggaggtgcggttcgccctggaggacgcgtaccgcgagatggcccgcgccgcgcacggcgccgagaagatccgcctggtcgatctggcgaacgcggcccggccgcgaacccgcacctga

SEQ ID NO: 6004 - DNA, 453 bp, Actinoplanes utahensis
ttggaccgcgcggagcgggaggcgatccgggcccgggagcgggtcgacggccggttcgcggccgaccggatcgccacggtccgcgccgtgaacctgcgacccgacctggccgcggtcgaggcgctcgcggccgccggccagtgggcgctgatcagcccccggctggcccgctggtcgcgggaggccggggagcggctggccgcgctcgccgcggtgcgtcaccacaacgaccggttgctcgccgaccgggacgagctgcgcggccggctcagcgcctaccaggccaaggcgctgcgccacggtctcggcgaacacccccggctcaccccgctcgccgagcgggcccggacccttctgcacaccgcgccctgcgagctggagcaggctcggcgcgcggtcgacgcgtaccaggaaatgctcaccgccacgatcgcgagggatgcccggtcatga

SEQ ID NO: 6005 - DNA, 573 bp, Actinoplanes utahensis
atggctgggccgcttcggcgcggcgccgaagccgccggcggcacagtaccgatgacggcaccatcggtagcccccgccgacgccgagctggcgcgcctcgagaccgcggtcgaagccatgtcgcgcaacctcgtcgagctcgaccagctgccggcccgccaggagctggacgccgcgacgctgaccggccggacggcggccgagtgggccgacgcgagcgtcgcgatggccgcgctctgggacggtttccggatgctctccgagtcgatcgcgcgtgcccagtcgctgcgcgcccagcggcggctcagcgacagtgaccgggccacctacgtgcacgtcgtgctcggcccgtcgatccttctctccaccaccacggtgccgctggcccagcgcgggctgctcggcgccgggcaggtcaccaccacctgctcaccggccgagttgctggccgcgatggagcgctcgttcagcaccgccgtcgacgtcgccacccgggcctcggaggcctggcagcggctgctgccggcggccggcgaggtggccgacgcgctgcagcgggccctagctagctag

SEQ ID NO: 6006 - DNA, 1311 bp, Actinoplanes utahensis
gtgaccaccaccctggcgcatcgacccacggcgaccgcggcctattcgccgccggcgggccggctggcgcgccgggtcgccgacctgcgtcaccactcccccgggcggctgcagctgatcctcgccggcctgctcaccctgggcctgctgaccggcctggtggccgggctgaccgcgcactcggcgagcgccggcaccgcggatctcggccggcgcgcccagccgctgatggtggaggccgaaacgatctactcgacgctggccgacgcggacaccaccgcggcccaggcgttcctggccggcggcctggagccggccgggatgacccagcggtacgacgacgacctgggccgggccggcgccgcgctgacccgggccgcccggctggcgcccgacgacagcgacgccgaccgtcaggtcgaggcgctggccaccggcatctcccggtacgccgctctggtcgccaccgcgcgggcgaacaaccggcagaacctgccgatcggcgcctcctacctggcggccgcctcccagctcaaccgggagaccctgcagccgcaggcgcaggcgctgttccgggtcgccgaccggggcctgtcccggggctacgcgacggcccgcagctcctggtggctgatcctgctgctggtgctgttcgtggcgctgggcatcgcgctggtcgccggccagggctacctgagccggaccacccggcgcaccttcaacgtcccgatggtcgccgccaccgccctcttcgcgctgctcgcgctgaccaccggcgtgctgttcaccaaccagcgggcacacctcgacgacgccacccgggacgggtcggccccggtcgcggcgctggccgagatccggatcgcggcgctcaccgagcgggccgacgaggcgctcaccctcgggtcccgcggcacggtcgacaaggaggccgacttcgcggcggtctccggccgggtcaacttcgacgatccccgcctaggggccacctcgccggggttgctggacaccgcccgccggcagcatgcggcctacgtgcaggagcacgggcaggtgcagaagctgaacgccgggggtgactacgacggcgcggtcaaggcggccctgagcgacacctcggcccgggcgttcaccgggctcaccgacgccctggaccggtcgatcagcgagcggcgggcggcgttcgccgacgagatcgacggggccggcgccgggctgaccctgctgaccgtgctcggtcccctgctcgccctggccgcctgtgcgctggttttcgtgggcatccgcgcccgtctggaggaataccggtga

SEQ ID NO: 6007 - DNA, 1650 bp, Actinoplanes utahensis
atgccgaaacggtggttccgccgcgaggcaggctcatgttgggatgagaccgccgtcacagcaccagtcacagcaccactcgaagggatccaccggatgctcaacctctccattctgctggaggacagcgcccgtcgtcacccggaccgcgccgccgtggtgctcggcccgcagcgcctgacctacgcccaggtggaggcggcggccggccaggtggcgaacatgctggtcgcgcgtggcatccagccgggtgacagggtcgccctctcctgcccgaacctgccgtacttcccgatcgtctactacggcatcctcaaggctggcgcggtcgtggtgccgctgaacgtgctgctcaaggggcgggagatcacgtaccacctgaaggattcgcaggcgacggcgtacttctgcttcgagggcaccgccgagctgccgatgggcgtcgagggccgggccggcttcgagggcgccgcggactgcgagcacttcttcctgatcaccgcggacccggcggccgcctcgccgatcgagggcaccgaaaccctggggcaggccctcgccgggcacggcccgaccttcgagacggtgctgcgcgccgagaccgacgccgcggtcatcctgtacaccagcggcaccaccggccaggccaagggcgccgaactgtcccactcgaacctggtgctcaacgcgctcacctgcaaccggctgttcaactcccagccggccaccgacacgcacctgctggtgctgccgctgttccactcgttcggctcgacggtcaacatgaacgccggcttctcggtggcggccaccctggtgctgctgccccggttcgaggcgaacgccgccgtacggctgctgcaggacgagaacgtgaccttcttcgccggcgtgcccaccatgtactgggggctgctgaacgcgctcagcgccaacgagggcgtcgacgtcgagcggatcgcggcgaacatgcgggtcgccgtctccggcggctccagcctgccgatcgagatcatcaaggcggtccgggagcgcttcggggtcaccatcctggaggggtacgggctcagcgagacctccccggtggccaccttcagcgacccggacggcgagccccggcccggctcgatcggcatcccgatctggggcgtcgaggtcaagctgatcgacgccgagtggaacacggtcaccggcgtggacgagatcggcgagatcgcgatccgcggccacaacatcatgaaggggtactacaaccgaccggaggcgaccgccgaggtgatgcgggacggctggttccgctccggggatctggcgcgccgggacaaggacggcttctactacatcgtcgaccgggccaaggacatgatcatccgcggtggcttcaacgtgtacccgcgggagatcgaggaggtgctgctcacccacgaggcggtgtcgctggccgcggtgatcggggtggcgcaccccagccacggcgaggaggtgaaggcgtacgtgatcctcaagccgggcgcctcggccaccgaggacgagctggtcgcctggagccgggagcagatggcctcgtacaagtacccccggatcgtcaagatcgtcgagtcgctgcccatgacggcgaccggcaaactgctcaaacgcgagctcgactga

SEQ ID NO: 6008 - DNA, 1203 bp, Actinoplanes utahensis
atggaagcggtgcacgtcggtcggcagccgatcttcgacgcgcagggcgctgttgtcgcatacgagctgctcttccgcggccgtatggacgacgtcgcgtcgggccgtcaggacacctatgcgaccagcaccgtcatgatcaacgcgttcaccgagttcgggatcgcggaggtggccggcaaccggccgtgcttcatcaacctcacccgtgagttcgtgaccggccggctgccgttgccgttcggtccggaacaggtcgtgctggaggttctggagacggtcaccgtcgacgacgaggtgatcgaggggatcacgcagctgaccgcggccggctacaagatcgccctggacgacttcgtctggggctccggtcacgaacagctgctcgcgctcgcctcgtacgtcaagctcgatctcctggacggcgacctcagccggctcgacgagatcgtcgccgcctgtcgtcggtacccgggcatcgcgctggtcggcgaacgtctggagaccgacgagcagatcgcgatcgcggaccgctacggcatggaactgcggcaggggtacgccctgagccgcccccaggtgctcagcgcccccagcatgtccccgtcccggctgcgccgcctggaactggtcgcggccctgatgtccccggacgtcccgctggagaagatcacctcgatcatcgtcagcgatccggctctggccatgcgcgtcctgcgggtgagcaactcggtggcggccggcgtggtcagccggatctcctcggtgcgccaggcggtcatgctggtcggcctcacccggatccgccgctgggccaccctgatggtggtcgacgacgtcgccgaggccccggaggagcagctgctcaccgcgctgacccaggcccgcctctgcgagaacctggcccagcgcttcggcgccgacccgggtgccgccttcgtggccgggctggtcaccgggatggcccggctgatgggtttcaccccgaccgcgatggctgagcacctgcccctgaccagcgacgtctcggacgcgctcacccacggcaccggccgtctcggcatggtgctgggcgcggtccgggcctacgaggccggcgagcccggctccgaggacctggccgtcccggcgctggacgcgatgcgctggtccacccgcacgctcaccgccgcgcaccggttcaaccccaagcggcgtcgctga

SEQ ID NO: 6009 - DNA, 579 bp, Actinoplanes utahensis
atggggttcgaggagcgcgcgaccgcgccggtgatgagccggcgcaccatcatcacgctggatctccccggcggggtgccgtcgatctgccggctccggcccaccgacccggtcaccgctgaacgcttcgtggtccggcgcgaactcgccccggcccactgcggcgtgccgatgatgctgcgcgtccgggtgctcgacgcggtcgaccgtccgctgcccggggcggtcctggagatcatccaccggggcccgctgccgaccgcgcccgaactcagcggtgcccaggtcaccgacccgcacgggtacgccgagttcaagacggtctatccgggctgggcgtcggaccggccggccggcatcgacctggtgctgtacctggccggctcgtgcgaccggggccgcctgcacttcccggccccggtgaccgcccaggtcgcgaggctcacggcgtaccgggagaacccggacccgctgccgccgccggagccgccggccgggttcccgaacatcgtgccccgcgaccgctacgacctcgcggccggcctgctcgcctcgatcaacgcggtcaccgaccggtag

SEQ ID NO: 6010 - DNA, 993 bp, Actinoplanes utahensis
gtggaacacgcggtcctcgttcgctccatctacaaccatttggttgtacgttatcgccggccgacgaagatcacaacccgctgcggatcggatagcgtgccggacatgacgttctcgatcgtggcccgctccgccgacatgttcggggtggccgtcgccagcaggttcctcggcgtcggcgcggcggtcccggccgccctcgccgacgtgggagcggtcgccacccagtcgtacgccaacctcgcctaccgcccgcaggccctcaccctgctgtccaccggcgtgccggccgagcacacggtgcgggcgctggtcgccggcgacgacggcccggtcgggcatcggcaggtcggcgtggtcggcgcgagcgggccgggcgccacctacaccgggccggcctgccacccgtgggccggcgggacggccggcgacggctacgccattcagggcaacatgctggccgggccggccgtcgtggccgacatggaggacacctggctgcggtccaccggcgaggcgcggctggcgcatcggctggtcaccgcgctccgcgcgggcgatcaggcgggcggtgaccggcgcgggcggcagagcgcggcgctgctggtggtcgccaagggacgggggtacgcgggcaccggcgacgtcctggccgacctgcgggtggacgaccaccccgacccggtcaccgaactcgcccggctgctcgccgtgcacaccctgtatttcgaacgccccgacccgacgacgctgctgccgctgaccggctccttggccgcagaggtggcggaccggctgcgcggggccggccggacggaaccggacctggacgaggcgctggcgtcctgggccggcatcgagaacctggagatgcgcatcgtgcccgggtcgatcgatccgctcgtgctggcccacctgcgggccgccgccgcggcggaccaggccgcgtccgcccgccgatccgagccgccgggcggagctaccggtcggtga

SEQ ID NO: 6011 - DNA, 489 bp, Actinoplanes utahensis
gtgaccgtccgcgagacgattcccgacgccgaggcgttgaccctgaccttcgtcaccgagttcgacgcgccggtcgagcgggtctggcgggtctggtccgacccgcgccggctggagcgctggtgggggccgccgacctggccggccaccttcgagcggctcgacttcgtgccgggcggtgcggcgcgataccacatgaccggcccggacgggacgaaggcgcgcggctggtggtcgatcaccgcgatcgacgagccgtaccggttggagtacgacgacggcttcgccggcgacgacggtgagccgctcgacgccgatcagccgatgcacgccgtggtgaccctggaacgggccggcgaccgcacccggatgaccgtggtcaaccggttcgccgacgccgcccagttcgagcggctgatgacgatgggcatggccgaggggatggggctggcactgggccagatcgacgagctgctccgggcggcctga

SEQ ID NO: 6012 - DNA, 744 bp, Actinoplanes utahensis
gtgatcgccggccgcatcaccgccgtggtcactccggcagggccgcgtcggtggtcgccgcccgctccgagcgggcacgtgggtcatcccgactgcgtcaatctcgtggcagaccatgccacaaggcagaccgcgccaagacacggcgtcggcgataatcccggaatgaccggcaccaacctgagagaccgcaaacgggagcagaaccgggtggcgaccgtacgggccgcctgggagctgttcatcgagcgcggctacgaccacgtgacggtgagcgacatctgcgccgcggcggacatcgccccgcgcaccttccaccggtacttcgccggcaagcaggacgtggtcgcggagcccgtccgggagatgaccgggctggtcaccgactacgtggccggcgcaccgccggaggccgacgaccgggcggtgatgcgcgaggcgatgacccggctggcccggcacgtggtgaccaaccgggagctgctcgccgcgctgcgcaccgtcgtgcaggactccacccacctgcgcacgtgcggcctggtgatccgcaccgacaccgagccggacatcgccgggatgctcgccgcgcggcaccccggggcggatccggccgactggcggcggcggctgctggtcgcctgcagcaccgccgccttccggatctggtacgaggactttctgcccggcgagctgaccgacccgatggggcacctgcgcgcggtgatggacgcggccggcacctga

SEQ ID NO: 6013 - DNA, 606 bp, Actinoplanes utahensis
atgcagccggcgcgggtggatcatggcgtggtcagcgggacgttcagcctggacgggcagacgttcgacgtcgacaacaacgtctgggtggtgggcgacgacaccgagtgcgtggtgatcgacgcgccgcacgacgtcgacgcgatcatggcgatcgtgggcgagcgccgggtcaccgcgatcgtctgcacccatgcccacgacgaccacgtgcgggtcgccccggcgctgcgcgagcggaccggcgcgccgatcctgctgcaccccgccgaggccccgctctggaagctgacccacggcgacgcggtgacctgggacgcggacctggccgacggtgaccgggtccaggtggccggcaccacgctgaccgtcctgcacaccccgggtcacgccccgggcgcggtctgcctgcacgcccccgacctgggttgcgtcttcaccggcgacaccctgttccagggcggcccgggtgccaccggccggtcctactccgacgccgacctgatcgtggcgtcgatcgaggcccggctgttcaccctgccgggcgcgacggtggtgcacaccggacacggcgccgacacgacgatcgcggcggagcgcgcctga

SEQ ID NO: 6014 - DNA, 1110 bp, Actinoplanes utahensis
atgcggctctgggcgaagtgcggcatcgccgtcgggtgccttctggccacctccgccggattcgccgggccggtgaacacgctcggcggactctcggccacggcactgggcgggctgccggccgccgcggcgcagttgcgggcgggggtgatcggggcgctcaccgaaccgatccggggaccgctcaacatcctgctgatcggcatcgacccgcgcgacgaccacaccgcgccgctctccgactcgatggtggtcgcgcacatcccggcggaccgcagcggcgcctacctgttctccctgccgcgggatctggtggtgccgatcccggcgttcgccaagtcgggcagcccggcgcaacgggccaagctgaatgcggcgatggcgctgggcagccggatcggggagcaccggtacagtccggcgcagggcttcgagctgctcaccgagacgatccggaacgtcaccgggatccggttcgacgccggggcgatcctgaatttcggcgggttcaccacgctggtcgccgcgatgggcggagtcagcgtgccggtggacgagacggtcgtctccgagcaccgcaaaccggacggcacctcgcgggaccggctcccgcagtgcccgggccacgacgactgccaccggccgtacatcggcgtgcagaaggtttatccgaagagcgacaagccggtgcacttccagggctgggaggcactcgactactgccggcaacggtacggactgccgcactccgactatgaccggcagcgtcaccagcggcagttcgtgcaggcgctggccaagaagatgaagcggcggatcctcaccgatccggccgccctgccgcggctgaccgcgacggtcgggagctcgctcaccttcatcggcaacgggcacccgatcgccgactgggcggcggccctggggtcgctgcggaccagggacatgaccgggatcggcctgcccggctatccgctcttcgagaacggcgcctaccagggtgagcaactgccgccgacggtcacgccgttcttcgcggccgtccagcgggaccggatcgctgcgttcctgcgcacccatcccgggctggtctcgctggacgccagactctga

SEQ ID NO: 6015 - DNA, 1392 bp, Actinoplanes utahensis
atgaccgcgacagctctgcgccccccgaaagcgcccctcggcaacaccccgcgctggtacgccgacctcggtggcgtggccgccgcgatcagcctgctgatcgtggtggcgctctgggtgggcaaccgcgggctgcagcagatcgccgggggcggcgccgaggcgatgtcggcggccggccggctgaccggcctgatcgcctccgacctgctgctgctccaggtgctgctgatggcccggattccggtggtcgagcgcgcgttcgggcaggaccggctggcccgctggcaccggtggaccgggttcacctcgttctggctgatgatcgtgcacatcgtcacgatcacgctgggctacgcggcgtccgcgcacgccaccgccttcgccgagctgtgggacatgatctggacctacccggggatgctgctggccaccgccggcacgctgctgctgatcctggtggtggtcacctcggtccgggcggcccggcgccggttgcgctacgagtcgtggcacctgctgcacctctacgcctacctcggggtcgggctggcgctgccgcaccagctgtggaccggcgccgacttcaccgcctcggccgccgcccggctgtactggtggacgctgtacggcgtctcggccggtgccgtcctggcctaccggatcgggctgcccgcctggcgcaaccaccggcaccggctggtcgtcacccgggtggtccccgaggggccgggcctgacctccgtctacctgtccggccgggacctgtccgggctgccggcccgggccgggcagttcttcacctggcgcttcctggacggtccgggctggacccgcgccaacccgtactcgctgtccgcgacgccgggcggcgaccagctgcggatcaccgtgaagaacctgggcgacagcagctcccgggtggcgaacctgcggccgggcacgaaggtgctggtcgagggcccgtacgggaagctgaccggggagacctacaccggtggcccggtggtgctggtggcctgcggcatcggcgtcaccccgctgctctcgctgctcggcgagctgccgtaccggccgggcgaggccaccctgatctaccgggcccgctccgaggcggaactcgccttccggggtgagctggaatggttcgccgcgcaccgcggggtccgggtggtcaccctgctcgggccgcgcgccggccacccgtcctggctgcccgccgacgtcgccgcgcacggcgacgtccaggcgttgcggcagatcgcgccgcagatcgccggctcgcaggtatacgtctgcggccccgaggcctggaccgcacaggtgcacgccgcggcccgggcctccggggtcgccgccgaccgcctgcacaccgaactcttctcctggtaa

SEQ ID NO: 6016 - DNA, 408 bp, Actinoplanes utahensis
atgcgtcgcatttccctgtggatgctctccacggtggtcggactcgtgctgctcttcagctaccggaccagcctcggtggcggcgccgtcgccaccgccgcgacggtcgccaccgccggtggcaccggcaccggcaccgcctacgacgggtccaccgcgtcgacccggtggggcgacgtccaggtccggatcaccgtcgacaacggcaggatcaccggggtcaccgtgccggtctacccgaccgggaacggcaaggaccaggagatcaacgcgtacgcgctgcccaaactggtccaggagacgctgaccgcgcagagcgctgccatcgacgcggtctccggcgcgaccgtgaccagcggcggctacatcgagtcgctgcaggccgcgctcgacgccgcccacctctga

SEQ ID NO: 6017 - DNA, 708 bp, Actinoplanes utahensis
atgcggatcctggtggtggaggacgacgcggcggtgcgcgactcgctcgcccgcacgctgcggttcgagggatatcaggtggagatcgccggcgacgggctgcaggccctcgacgcggtccgcgccgccgagccggacgcggtgatcctcgacgtcagcatgccccggatggacggcctcgaggcgtgccggcggatgcgcgccgacgggctgctgctgccggtgctgatgctcaccgcccgggacagcgtcggcgaccgggtcgccgggctcgacgccggtgccgacgactacctgatcaagccgttcgccctgcaggaactactggcccgggtccgggccctgctgcgccgctcggcgctgaccgcgccggccggcgccgccggtgcgacggaggcgggtgagctcctggtcttttccgatgtacgcctcgatcccggcacgcgggaggtgcagcgggccggtcgccagctgcggttgacccgcaccgagttcgacatcctggaggccttcctgcggcatccgcggcaggtgctgacccgggccgcgctgttcgagcaggtctggggctacgacttcggcgagcagtccaacagcctgcacgtctacctcggatatctgcgccgcaaactggaggcggagggcgagccccggctgctgcacacggtgcgcggcgtcggcttcgtgctgcgggaggagccgctgtga

SEQ ID NO: 6018 - DNA, 1437 bp, Actinoplanes utahensis
gtgagacggtccggacgctggtggcgggcgcggacgctgcacacccggctggcgctgctggtcgcggcggcggtgggggcggccgtgctgttcgtcgccgccggcgcctgggtggcggtccgcgagatccagcggcatcaggcggacgggcagctggccgacgccgcccagcagatcgccgccaaccccgggcagtggctggccaccgaatcgtcccggacccgcgacctgcccactctgccgccgccgcacggcccgggccgcggcggtcaccacggccgcgagatcggcacgtgctggcagatcctcaccgcggccggcaccgcttccggcggcagccgcaccaccctgccggtcaccgccgccgccaggcaggtggccggcggcgcccgcacccggcccgccaaggagcagatcaccctcggcccggactcgtacgtgatgctcaccgtgccgctggccggcgggggagcggtccaggtcggcatggaccaggacccgggggagaacgtgctgaccgcgttcgccgccctgctcgccctgggctgtctggccggggtcggcggtgccgcgttgctcggccgcacggtggcccgggccggcctcgccccggtggaccggctcaccgaggcggtcgagcacgtcgccgccacccaggacctgagccggtcgatcgaggtggacggcaccgacgagatcgcccggctgggccgctcggtcaacgcgatgctggccgccatcgacgcctcccgcggcgcccagcgggccctggtcgaggatgccggccacgagctgcgcaccccgctgaccagcatccggaccaacgtggagctgctgctcgaactggaacgccgccccgagctggcgcaccggctgcccccggaggaacgcgccaagctgctcgccgacctggacgcccaggtgcaggagctggccacgctgaccaccgagctggtcgagctggcccgggaggaggcgacccgggagacggtcgagccggtcgacctgtccgaggtggtcgccgccgcggtcgcccgggtccggatccgcgcgcccgggctgacctacgacaccgacctcgcgccgtcgaccgtcgacggccggcccggcgaactggagcggatggtggtgaacgtgctggacaacgcggcgaagtggagcccggccggcgccgtggtccgggtccggctggccggggccgagccggggtggaccgaactgaccgtgaccgacagcggcccggggatcgccgaggaggacctgccgcacgtgttcgaccggttctaccgggcgacggcggcgcggtcgatgccgggttccggtctggggctggccatcgtggcgcagaccgcgtcccagcacggcggcacggtgatcgccgcccccgccgacggcggcgggaccgtggtgacgatcaggctgcccgcggcggcctag

SEQ ID NO: 6019 - DNA, 1191 bp, Actinoplanes utahensis
gtggctgacgagatcatcgggatcgtgggcgcgggcatcgtcggcctggcgatcggacgggagatcacccgacggcggcccggcaccagggtcgtggtgctggagaaggagagcgcggtcgcccagcaccagaccggccacaactccggcgtggtgcacgccggcatctactacaccccgggcagtctcaaggcgcagctgtgcacccgcggccggtcgctgctcaaggagtactgccaggagcggcagatcccctacgacgaatgcggcaagctggtcgtcgcggtccgcgccgacgagctgggccggctggacgacctggagaagcgggcccgggagaacgacgtgcccggcctgcgccgggtcgatccggccgggatccgcgagatcgagccgcacgccgccgggctggccgccctgcactccccggaaaccgcgatcaccgacttccccgcggtggcccgggcgctggccgccgacatcgtcgcggccggcggcgaggtccggctgaactggccggtcaccggcctggacagaacggagaggatcgaggtccgctccggcgaccgccgcctgacggccgaccggctgatcatctgcgccggcatccagagcgaccgggtcgcccgcctcgccggcgaccgcgcggagccgatcatcatcccgttccgcggcgagtacatgcgggtcacctcggccaaggcggacatggtccgcggcatgatctacccggtccccgacccgcgctacccgttcctcggcgtgcacttcacccgccgcgtcaccggcgtcgtcgaggtcggcccgaacgcggtgctcgccaccgcccgggagggctaccggcggtccgcggtctcggttcccgacctggccgcgctcgccgcctggccgggcgcctggcggatggcccggcagcactggcggaccgggatcaaggaggtccgcggctccgtgtcgaagacccgctacatggccgaggccatgcgctacgtcccggagatcggcccggccgacgtggtccgcgccggcgccggcgtgcgcgcccaggccctggaccgggacggcagcctggtcgacgacttccggatccaccggatgggcgcggtcaccgccgtccgcaacgcgccctcacccgcggcgacgtcctgcatggcgatcgccgaacacgtcgtggacgcaatcttcgcctga

SEQ ID NO: 6020 - DNA, 558 bp, Actinoplanes utahensis
gtgtcagacgacgccggcgtgaccgcagaagccactgaaccgaccgtggagccggcgacgccgggaaccccggagacgccggaagccccggatcgaacgtggatccggcaaagcctggtcgcgggcgccatcgtggtgtcgatcctgctgggggcggccgtggcgaccggcgtgtggctggtccgcgggctgccgggacagccggtgcagcacttcagtgtcagcgtgtacctgaaggatgacgtcaccgctgagcagaaggcggcgatcgaagcggcacttcccgccttccagccggtcgggccgatcaccttcatcgaccgagacaaggcgtggcgacacgccaaggagttgttcaaggacgacccggacttcctggacagcgtgaacccggatgtcatgccgcagtcgttcagcctggagaccaagggtcggctgttcgactgcacgggttacgccacggtccgtcacctgccgggcgtccagaaggtgcaggtggtgcaggcaccggtgaaccattacatcgccagcatcacctgtgatgccgagtaccggtag

SEQ ID NO: 6021 - DNA, 840 bp, Actinoplanes utahensis
atgagccggctccgtggcaccgggatgaccctggcatacgacaagcgggtcatcgccgaacagttgagcgtggcgatcccggacggctcgttcaccgtcgtcatcgggcccaacgcgtgtggcaagtccaccctgctgcgggcgctgtcccggctgctcaagcccaccaccggcacggtgctgctggacggggccgacgtgcagtccctgccgacacgtaccgtcgcaagggtcctggggttgttgccgcagtccgccacggcgccggacggcatcagcgtcgccgaactcgtctcccgcggccggtatccgcaccagggcctgctgcgccgctggtccgccgaggacgaccggatcgtcgccgagtcgatggccgccaccggcgtcgccgacctggccacccgcagcgtcgacgaactctccggcggtcagcgccagcgggtctggatcgcgatggccctggcccaacagaccccgctgctgctgctcgacgagcccaccaccttcctcgacgtcgcccaccagctggagatcctcgacctctgcgccgacctgcacgaacgccagggccgcacactggtcgcggtgctgcacgacctgaaccacgcggcccgctacgccacccacctgatcgccatgcgcgccggccgggtggtcaaggccgggccgcccgcgcaggtgctgaccgcgagcctggtcgaggaggtcttcgacctgccctgccgggtcatcgacgacccggagaccggcaccccgctggtcgtcccggccgcccgccgccgaacggcggtccggccccggccaccaggcgtccgcggcaatgatgatcttcgctgttag

SEQ ID NO: 6022 - DNA, 978 bp, Actinoplanes utahensis
atgagaacccgcctggtcccgctcgtcgccatcgtgctcatgaccgcggtcgccgtgctcacgctcggcaccggcgactacccgatcgccccggccgacgtcgtcaagaccctggccggccagggcagcgccgcccaggcgttcatcatcggggagctacgactcccccgggtgatcaccgcgatcctggtcggcatgtccctcgcggccggcggcgcgatcttccagtcgatcacccgcaacccactgggcagcccggacatcctcggcatcaccagcggcgcgggcgccgcggcgctgaccgtggtgatcctcggcggcggcagcaccgcgctcgcgctcgccgcggtcgccggcggggtcgccaccgccctgctgatccagctgatcggcggccggcgcggcctgcggggctaccggctgatcctgatcggcatcgggatgaccgcgatcctcaacggcgtcatcggctggctgctcaccaggggccagcagatggagaacgcccgcgccatgctctggctcaccggcagcttcgacggccgcggctggacgcaggcgctgccgctgctcggcgtactgctggtcgccgtcccgatcctggctctggccggtggccccggtctgcggatgctggagatgggcgacgacctggcggccggtctcggcgtgccggtcagacgattgcgcaacggcgccctgctgaccgcctcgatcatcgtggcgtgcgccaccgcggcggccggcccggtcaacttcgtcgcgctgatcgcgccgaacatcgcccgccggctgacccgcgcgcccggccccggcctgctgccgtcgatggcggtcggcgcgctgctcaccgtcggcgcggactggctggccatgcactccggccatgcgctgccggtcggcgtggtcaccggcgcgctgggcggcggatacctgatctggctgctgatcgccgcccgccgggcgggccggatctga

SEQ ID NO: 6023 - DNA, 921 bp, Actinoplanes utahensis
gtgctggtgctcggcatcggcttcggagcccgcttcctgacccccggcgaggtctgggccggattgatcgaccccgcatcgccgtactaccggatcgttcatcagatgcgattgccgcgtacgctgtcgggcctgatcgtgggtctcgccctgggcctggccggggcgatcatgcaggcgctgacccgcaatcccctcgccgacccgggactgctcgggatcaatgccggcgcctcggccgcggtcgccaccgccgccgcgttcctcggcgtcgcctcgttctccgggtacgtctggttcgccctggccggcgcggccgtggtgaccgcgctggtctacgcggtgggcggcggccgctcggccaccccggcccggctcgcgctggccggggcggccctcaacgcggcgctctactcgtatgtcagcgcggtgctgctgtcggacaccgcgtcgatccagaaggtacggttctggaccgtcggctcactggccagcgccgacttcgacacgctgcgccggctcattgcgttcatcgcggccggcgtggtgctcgcgctggccgccgcccgcccgctgaacgcgctggccctcggcgacgacgcggcccgcgccctgggcgcccgccccggcgtgatccgcgccatggtgatcgccgcggtcaccctcctgtgtggcgcggccaccgcggcgtgcggcccgatcgtcttcgtcggcctgctcgtcccgcacctggtccgcccgctcaccgggccggatctgcgctggatgctcccctacgcggcggtgctcgccccggtcctgctggtcggcgcggacgtgctcggccgggtcgtcggcagccccggcgaattgcaggtcggcgtggtcaccgcggtcctcggcggccccctgttcctctacctggtgcgggtcgcccgatga

SEQ ID NO: 6024 - DNA, 1056 bp, Actinoplanes utahensis
atgctccggccgagtggccgggccgctgccctgccgaaagatgtgaccatgcctgtttcgtccctgcccctgtcccgtcgtggcctgctcgcggccggtggtgtcgccgctctcggggcggtgctgaccgcctgtggcacgaaggaggacgccaccgccggcccggccggccaggccgccgcggggccgtggaccttcaccgacgaccagcccaaggcgctccaggcggcgaagacgccgtcgaggatcgtcgccttcaccggcgtcgcggcggccctggccgacctgggcctgcaggaccggatcgtcggcgtcttcggcgaggcccggacccaggccggagacctcgacgtcaccaaggtccaggtcatcggcgacgcgtggggcgagttctcggtcgagaagtacgccgcgctcaccccggacctgctggtcacccacgagttcgacccgggtgcgtactggtacgtgccggacgagtccaaggacaagatcctcgcggtcgcgccgtccgctctgatcaacgtcggccgggtgccgctgaacaaaccgatcgagcggtacgccgatctggccaggtcgctgggtgccgacctgaccgcgcccaaggtgaccgaggccaaggcccgtttcgagaaggccgcccaggacctgggcgacgcggccaaggcgtccggcgggatcaaggtgctgttcggctcgggcagcgcggacatcttctacgtgtccagcgcggacgtcagctccgatctgatgtacttcaagtcgctcggcgtcgacctgatcgtgcccgaggtcgagggcaaggactactacgagtcactgagctgggagaacgccgacaagtaccaggccgacatcatcttcctggacgcccgcaccggcaccctgcagcccaaggacctggccgccaaaccggcctggaacgcactgcccgcggtcaaggcgaaccaggtcttcccgtggcaggccgtgccgatctactcctggaaccacgcggccccgctggtcgaggcgatcaccgccgcgatcaggaagtcgaagaagctgggctga

SEQ ID NO: 6025 - DNA, 1008 bp, Actinoplanes utahensis
atgatcaccgtgaccggcgaggcgcagctcgaagcatggcgatcgcgcgcgctccccccggtggagcgcctggccggcggcatctggtcggtcccggtgccgatcccgcagagcccgctgcgctacacgctgtcctacctgatccccggcgacgacggcctggtcgtcgtcgaccccggctgggacagcgccgagggctgggccgccctgcacgccggcctgtccgcggccggcgcgaccaccggcgacgtgcggggcgtggtcgtcacccacgtgcactccgaccatcacggcctgtcgaaaaggctgcaggacctgggcgcctgggtggccatgcaccccgccgagcgggacgcgctgcaccccggcggctcccccgccgactggctgcgcgcgcaccacgtgccggaggacgagatcgcggcgctggccgggacgatcgggcagcaccgactgagcgagccggcccagcccgacgtgctgctgcaggacggcgacccgatcccgctggccgggcgcacggtcaccacggtgtggacgccgggccacacgcccgggcacatctgcctgctggagccggccgccggggtgctgctcaccggcgatcacctgctgccccggatcagtccgaacatcggcttgcagcggcccggctcgtcaccgctggagtcgttcctggagtcgctggaccgggtcgccaagcacgacgaactggaggccttcccggcgcacgagtaccggttccgcggcatcgcggcccgctcccggcagttgcgggagcaccacgaggcgcgctgcgacgagatcgtggccaccgtggcggcgctcggcgcgccgacgatctggacgctggccgcgagcctgacctggtcgcggccgtgggcggagatcgggccgatgcgggtcggcgcggtcgccgaaacgatggcacacgtgcgctatctcgccgaccgtggcgccctgcactggtccggggagacggtcagcccagcttcttcgacttcctga

SEQ ID NO: 6026 - DNA, 609 bp, Actinoplanes utahensis
atgtcagcaaccccacaggcggccaccggccgtccccgcgacccggccgtcgacgagcggatcacccgggccgccgccgaggtcttcggcgagaacgggtggcaccggttcaccatcgacaccgtcgcccggcgggccggggtgggcaaagcctccgtctacctgcgctggcccaacaaggaggcgttgctggcggccgcgctgaccgcgcggctcaacggcatcgaggacatcgacacgggtacggtacgggacgatctgatcagcctcgcgcggcagatccagcggtcctacctgggcgagtccggacgggccgccctgcaactgcgggtcgacgcgcagcgggtgcccgaggtgcgcgaccacctgcaccggctgcaggagtcccaggtgctggcggcgcgggcgatcgtgcgacgggccatcgcccggggtgagttgcgatcggacaccagcgtgaccctgctgctcgactgcgtctgcgggggagtgatgaaccacgtgctggcgaccccgccgcagctgcgcgaccaggtcgcggccggtgccgacgagtacgccgccgccctggtcgacttcgtgctgtcggcggcccgccccgcgccctag

SEQ ID NO: 6027 - DNA, 6318 bp, Actinoplanes utahensis
gtgtccagttcccaccgagggaacacctaccggcggcggacgtggccgagtcgccggatgctggcgtacggaaccgtcctgctggtgacggcggccggcctcgcggccccctggtcggcctcgccggccgtcgcggccccggcatcccccgcacgtccggacaaggccgagcgccccgacaaggtgtcggccttcctggcggcgcaggccaccggccgcgacatcctggtgaccggggagacgtcggcgaccaccctgacgtacgtgcgtcccgacggatcgctgcgctccgaggtcacgccggcgcccgtgcgggtcaggcagcgggacggctcctgggccggggtggactaccacctcgtcaaggtcggcggcgggtacgcgccccgggtgtcgcccgcgaacgtggtgttctccgccggtggcgacggccccgcggtgaccctcgacaacggccgccgggccgtcgacctgcgctgggcgaagtcgctgcccgcgccggcgatcagcggcaacagtgccgtctaccagctcaccgacaacgagcagctggtgctgacggcgacctcggacggcttcgaacagtcgttgaagctgctggcccggccggccggcgtgcccaaactgcggctcgggttcgacgccaccggaatgaccatggtcgccgacggcaccggcggctaccggttcgtcgcgaccgaatccggcagagcgacctccaccgtgctctacaccatgccgacgccgcgcatgtactcgtcccaggtgatcaacgaggagcacacgcagatccagcgggtccccgtgacgctggcgaccgacaccgacggcacccagtacgtcgacctcagcgcgggcaagtcgttcctcgacgatccggccaccgtgtacccggtgtggatcgaccccgccgtgtcgtcggtgtcccggtacggtgacacctacgtgaccgaggcggactccgactcgcacgtgtccgacagtgacctgcgcatcggcaactccaccaacggcaacatccggcggtcgctggtgcggttcaacaccaccggcagcatcccggccggcgcccacgtcacctccgcggcgctcaagctctggacgaactactcgggcacctgctcggcgcggtcgatggcggcctacccgatcaccgagaactacacgatgaccagcgcgacctgggcgaaccagccgtcgtactcgacctcgtcggcgtacagcgcgtcgtcgtcgttcgccttcggcaacgaggatctcggctgcgccaacggaaccggcaccgtgccggtgacgaacatggtccaggcctgggtgtcgggcaagctggccgactacggcatgctgctcaaggcgggcagtgagaccgacacgacctacaccaagtacttctgcgcgatgaacgtggacgcgaccggcgcgacgagctgcaccagttcggcgcactatcccaccatgtcggtggtctacaacacctacccgggaacgccgggcagcgtcaccttctccccgcgggtcgccggcaccaccagcgacagcaacaccggcggcgcgcggatcttctcgacctcactgaccccgaagttctccgccaagctcgccaacgccgacggtggcaaggtcaccctgcaggtgaagctgtcgcacgacgtcaacaacaccggcgaaggcaccggcgagatcaccaccttgacctcgaccgcggtgacccccggctcgaccgccacggtggccgtaccggccggcgtgctgaccaacaacacgcacgtgatgtaccagacccgggcacgggtcaccaacggcgcgggcggttacgactactcggcctggacgccggcttcgctgtcggccaccaccgccacgaagttcctgctcaacaccgacacgccggccgagccgtcgattgcctgcggtgcgtacccggccggcacctggaccgcgcaggtcggcgccacgacgtcctgcgcgatcgacacgaccgcggccgacggggccggctactactggggtctggacgacccgtcggccccgaacctggccgccgacagcagcaacaccggcgccgccgtgacggtgtccacgatcgccaccaccccgggctggcacacgctctacgcacggtcccgggacaccgccctgcacctgtccaccggcaccaccgcctacatcttcggggtcggtgcgggcggggtgttgagccccgagccgggtgcctccacggccaagggcgtggccctgtccgcctccaccggctcggcctacaccggggtcacctaccagtgggccgccggcaccaccgggaccacctggaccgacctgccgaccgccgacgtcaccccggccgggtcgtcgacgccgatcacggcgtggccgctgaccggcaccgccgccggcccactggtctccttcaccggatacaactggaacgtggccgcgaccctggccgccgccggtgagccggacggggcactgcgggtgcgggccaggttcaccaccgcgtccgggagcaccggctactcggcggagcgggtcttcaccctcgcggtgaccaccttcgggcagaacgccgccaccagcgacctgggccccggcacggtgtcgctgaccaccggcgacttccaggtgtcggcgggcgactcgtcggtcggtgggctcagcatcggccgtaccgcgacgagcctggtccccgccgccgcctccaacggcccgtccggggtcttcggccccggctggcgggcctcgctgcccggcgcggacgccggcgccggcgacgccgtgctgctcgacaactcggtgtcgggctcggtgaccctccagcacgccgacggtaccgaagcggtctacgtcaagcagtcgtccggcgcctaccggggggtgggcggcgcgaacgacggcaccgtcctgacccggtcgacgtcgatcaccaacccggcggatccggccgacaccaccgcgtacaccggctggcagttgaccgatgccggcggcaccgtcaccacctggaccagaacctcgaccggcatctggacggtggcctggatcgacgagcccggcaaggagggcgagacggcgtacgcccgcgacggcaacggccgggtgaccaccatcctggctccggcgccgaccggcgtcacctgcacgaccggttcgttcaacgcggcgggctgcagcgcgctgcggctgacgtacgccaccggtaccaccgcgtccagcaccgacgaggccggctggggcacctacaacggcctgctgtcgggcgtctcctggaccggttacgacccggctgccgccaccatggtcaccaaaccggtcgcggcctacctctacgactcgaccgggcacctgcgtgccgcctgggacccgcgggacacgaccccgctgaagatccggtacggctacgacgccgccggccggatcgccaccatcacgcccgcgggcctcaacccgtggacgctgagctacgacaaccggggccggctcgccggcgtgtcccgcaacgaccccgcgaacggcgtggccacccgggcggtcgcctacgacctgccggtctccggcctgggcggcgcgcccgacgtctccgggacggccgccgcgggctggggacagaccaccgacctggcgtactcgggagccgcggtcttccccgcgtcccacgtgccggccgccgacaaggccaccggcgcctacgccccggccgcggccgactggccgtacgggtcggtgacgtacgccgacgtcgacggccgcgtcgtcgacgtcgccggatacggcgcgtcggcgtggcagatcgacgccacccgctacgacaccgacggtgacgagatctggtcgctgaccgccggcaaccgcgcccaggccctgagccccaccgcggacaccgacccgtacgtggcgtcgcagagctcctcggcggcccgggccaacctgctggccagcaccagcgtctacgacgcggacggtgtcgacctgctcagcacgctcgggccggcgcatccggcccgactcgccgacgggacggtggcgtcgatccgcctgcggaccgactacacctacgacgccggagcgcccacgaccgacgcgtaccacctggtgaccaggacggtgaccggcccggtggcgctggacggctcggtcaccaccgcggcggacaccaggacgacggtgaccggctacaaccccatcgacggctcatcggcgaccggcaacacgtccggctgggtgctgcacacccccaccacggagaccacctggctgggcagcagcgcctcggcggccgacctgacccggcagacgcggtacgacgccgcgggccgggtggtggagtcccggcttcccggcggctccgccaccgacgccgacaccaccgtcaccacgtactacacgacaggctcgaacacgacctatccggcgtgtggcgggaagccgtcctgggccgggatggtgtgccggaccgatcccggcggcgcgccctcgaccgggtacgcggtgccgtccaaggcctacacgtacaacctgtacgggcagccgctcaccgtcaccgagacctccggtgccgtcgtgcgtaccaccaccaccggctacgacggggtgggccgcagcaccgggaccagcctgagcgtcaccggactgccgggctccgcggcggtcaccgccaccgggcgcacctacgatcccgcgaccgggctgccggccacgacgacccagggttcagcggtgctgaccagcacgtacgacgccatcgggcggcaggccagctacaccgacgccgacggcgcggtgagcacctacgggtacgacctcgacgggcacaccacccgcttcgtggacgtgcgcaccaccacctacacctacgactccggcaccgagcaccgcggcctgctcgtcgggatgaacgccgggatggacaacgccccgtcgaccttcaccgccggctatgacgcggccgggaagatgaccgtgcagtcctacccgaacgggacgaccgccgcctatcacttcgacaacaccggtcagccgacgagcctgtcgtaccagctgcccacctattccggtggcaccgccggcacgatcgagttctccacggtcgccaacccggacgggcagacggtgcacgcgcagtcaccgctgtcggcccaggactacacctacgacaacgccaagcggctcaccgaggtacaggacaccaccgacggctcctgcgtcacccgccggtacgggttcgacaaacagtccgaccggacgagcctggccagctacgcggccaccgccgacgggggctgccagacgacgaccgccgccggcaccagcaccagcacctatgacaccgccaaccggatcaccaccgccggatacacctacgaccagctgggccggaccctcaccgtccccgccgccgggctggcctcgggcagcagcgcgctgaccgtcgcctaccaggacaccgacatgccggtcagcatgacccaggggaccgcgggcaagacgttcaccctggacccggcccgccggtaccggcaggtggtcgacaccacctccggggcggaaaccaggcgcaccgtcaaccactacgccaacaactccgactcaccgtcgtacctcaccgtgtcggcagacggtggcgccaccgccgcctgggcccgcaacatcatcggcctggacggcagactcgcggcggtgcacggctccgacgcggtcgccacgctcgaactgaccaacctgcacggtgacgtcgtcgccaccgtccccgaccaggtgccgaccgccaccgacaccacgggggccagcgccacggcatacttcgagtccaccgaatacggcaccgcccgggacggcacgctgaacgggcgctacaactggctgggcggcgcacagcggtccaccgacgcggtggcgtccctggtcctgatgggcgcgcggctctacaacccggccagcgggcggttcctcaccgtcgacccggtcgccggtggcaaccagaacgcgtacgactatcccagtgatccgatcaactcgttcgacgtcaccggtctcaaacggcacggtggcttctcccggcactggtggggaatcagcctctacctcaccgaatgggcgaccaaccggctgatgcgcggcttcgccgccggatccggggtggcctgggcggccgccgagctcacgtcctggacgggaatcggcggagtgaccggcggggcgatcgcggccctgctcgccgccatgggcggtggcatctggctctgcgactggaacgatcggggcgtcgggttccactacacctatccctggtacggcggtgcgttctggtgctgggcccgatga

SEQ ID NO: 6028 - DNA, 384 bp, Actinoplanes utahensis
gtgcatcgatggcggcgccctgccatcgtgacaaccgtggactccttgggcccgggcgccgactacatgtacgcgatgaccgcgatcgggctgttcctgatgccttgggtcatggccggcctgggggtgctcagcggcgccgggcgcaccgcccggtcccgggccgccggccggctgaccgcgttgctgctgctgatctggttcgtcgcgtccttcgtgatcgcccagtgggacaccgaccagggctactttctggccgacgtggtcggtggcggtttctgcgtgctgacctggctgctggttccctggttggtcagcttcctggtcacccggtggcgccgggcccggcgtcgctccggcggatcaccgggggccgcggcctga

SEQ ID NO: 6029 - DNA, 348 bp, Actinoplanes utahensis
atggatgccgagacgctgaagaaatactgcctggacaagccgggcgcgtggccggaccagccgtgggagggcgacgtcgtggccaaggtcgggccgaagatcttcgcgtttctcggcagcaccggcgagacggtcggggtcaagtgcggcaagggacgtgacctggccgacgagtggctcgcgcggtatccggaggatgccacggccagcgcctacatcggccggcacggctggaacacgctgcggctgcggggtgcgatcccggccgaggagatcctcgaagcggtggacgcgtcctacgacgcggtggtggcgtcgctgccgaagaaggaccggccgaccgggtga

SEQ ID NO: 6030 - DNA, 633 bp, Actinoplanes utahensis
atgattgatgccagtgagcagatcaaccggacccggcgtacgttggcggggcgcaccctgcaagccggtgaggcccgggtgctgacgatcagccaggtttacgacaccgggctcgacgacctgtgggaggtggtgaccacggcggagcggctcgagcgctggttcctgcccatctccggtgagttgcgcgagggcgggaagtatcagttcgaggggcaggccggcgggaccatcacccgctgtgaccgaccgcatgtcctcgccctgacgtgggagttcgccggtcaggtgagctgggtcgagatcaggctgacgccggagggggacgaacggacccggttcaccctggagcacaccgcgccggtcgacgagcactgggaccggttcggaccgggtgcggtcgggatcggctgggaaatggggctgctcgggctctcgatgcacgtggcggcgccggacgcgccgcgcgacaacgcggcgatcgcggcgtggaccgcttccgaggatgcccagaggttcatgcggctgagcgggcaggcctgggcggaagcggacatcgcggccggcaccgatgccgcggaggcccgggcgcgggcggccaacacctacgccgcgtacacgggggtggagtga

SEQ ID NO: 6031 - DNA, 600 bp, Actinoplanes utahensis
gtgcatgcgttcgacgtgcttggggatccggtgcggcggcggatcatggaggtgctcgcggacggcgagcagacttccggcgccgtgaccgcggtgatccgcgccgagttcggcatctcccagcccgccgtctcgcagcacctcaaggtgctgcgagacaacggtttcgccacggtgcgcccggatggagccaggcggttgtacgcggtggacgacaccgcgctgcgacaggccgacgagtggctggggcggttccggcgattctggacgccgcacctcgccgcgatggccaccgaggtggcccggggcaaacgactgcgccgcttggccgcccccgacgaccaacccggaaccactcccgaccaacgactgcgccgcccggctacccccgaggaccaacccggggccgatcgactgcgccgccccgctacccccgaggaccaacccggggccgatcgactgcgccgccccgccacccccgaggaccaacccggggccgatcccggtagacgccgtgcggccgtccgacgcccaccggccccggccgcttccgaccgcggagggccgggcgcctccgacgactatcaggagcttcgatga

SEQ ID NO: 6032 - DNA, 1452 bp, Actinoplanes utahensis
ttgaagcgtagcttgaaactgatcctggcctcggcgctcgccgcggctaccgtgggcacggtggcgttcttcgcactgccggccagtgccgaggccgcctcgttcacggtgaccaactcgtggagcaccggctaccagggtgaggtcacggtcagcaacccggcctcctcgaagatcaacacctggaaggtgcagctcaccctgccggccggctcgacgatcggccaggcgtggaacgccaccctcgcgaccggcggccagaccttcacgttcaccccggccggctggaacgggacgatcgccggcggcagcgcgaccagcttcggcttcgtcgtcaccggaaccgggcggcccacctcgtgcacggtcaacgggcaggcctgcaccggcctgaccggggcgccgtccgcgaccgccacgagcgcgccgggcaagacgccgaccagcgcgccggcgaccgccacgggcgcccccaagccgagcgcgacgaccgcttccccgacccggacggccaccgccggcggcacgccgctggccgcgaacgggcagctcaaggtctgcggcgccggactgtgcaaccagaacggcaagaagatccagctgcgcggcgtgagcagccacggcatccactggttccccggctgctacaccggtgcggcgatggacgccctggccaccgactggaacgcggacctcttccggatcgcgatgtacgtgcaggagggtggttacgagtccgacccgaccgggcagaccgccaaggtgaacagcctggtcgacatggccgaggcccacgggatgtacgcgctgatcgacttccacgtcctcaacccgggcgacccgaacctcaacctggcccgggccaaggagttcttcgccaaggtggcggcgcgcaacgcggccaagaagaacgtgatctacgagatcgccaacgagcccaacggggtcagctgggccggcatcaagagctacgccgagcaggtcatcccggtgatccgggccaacgacccggacggcatcgtgatcatcggcacccgcggctggtcgtcgctgggcgtgtcagagggctcctcgtcggcggagatcatcgacaacccggtcaacgccaccaacatcatgtacgcgttccacttctacgccgcgtcgcacaaggacgactatcgcgccgaggtgcagaaggcggccgcctcgatcccgctgttcgtcaccgagttcggcacggtcagcgccagcggcgacggggcggtcgacacggccggcaccaccgcctggctcgacctgctggacaaactgaagatcagttacgcgaactggaacttcggcgacaaggcggagggcagctcgatcctgaagccggggtcgtgcaacgccggggcgttctccggcaccggcgccctcaccccgtcgggccagctgatccgctcccggatccgcacgcccgacgacttctga

SEQ ID NO: 6033 - DNA, 447 bp, Actinoplanes utahensis
atgagcgacgaggagttcatccacacggccctcgtcgtggcgttcacggcggactcgggccacccccggggcctgcagcacgccattgacgagatctaccgcctgctgcacgaggccccggcgggccatcccgatctcgtcatcgggtggggtgttctcttcgatctgctccaggagcaggctgaacagtccggcgacctcggcgactgggatgcgctcgtcgacgcgggcggctgcatggtcctggtcgccgagccgggcaccgagctggccgttcgggcctggcgacggcagtggcaggcgctgctgctacgccaccaggcgacccgggatccggccgacctgcgggatgcgaaggtggccgcgacggccctcgccgccgcggccgccgccgtgccaccgtccccgcatcagccacggccgcgccgactctggcgctgcgactga

SEQ ID NO: 6034 - DNA, 93 bp, Actinoplanes utahensis
gtggcgcaggagggcgggaccgagctgggcgagctggcgccgggcatcgcggtgcgactcacgctgcgtccggttccggttgctctggagtga

SEQ ID NO: 6035 - DNA, 231 bp, Actinoplanes utahensis
gtggccgatttcgcgggtctcagcaaccggctgcccggcaccgtccaaggcgacgtgatcgaggtgttgggcgagcggctgccactggtcgcaccacacacaggcgggatcgccacggcgctggtgcgaccggagtcgatcagtatcgtccctgatccggacggatcggggcgggtgctgacggccagcttcccgcggccgatcggccgggtcacgatcacctcccggtga

SEQ ID NO: 6036 - DNA, 402 bp, Actinoplanes utahensis
gtggcaaccgagtcccggcatgtggctgagcacatcgaccgtcccgcccgggacgtgtatgaatacgcctcggaaccggccaacctcgcgcactgggcgcccggcctgggcggctccgtgcgcctggaggacggacgctggctggtcgacgtgccggacggcggcgtcgccgaggtggtattcgtgccccgtaatgacctcggtgtgctggatcatgaagtacacctccccgatggtgcgatcgtctacgttccgctccgggtgatcgccgacggcgaccactccgagatcgttttcacggttcgccgtgccgtcgggatgaccgacgacatgtatgacagggacatcgcggctgtggccgctgacctgggccggctcaagcagatcctggagagccgctga

SEQ ID NO: 6037 - DNA, 804 bp, Actinoplanes utahensis
atggacgaggcgacgacgcacatcgtgacgtactacgagacgcggtacgaggaggcgacccgcctggagcgacgcccgcaaagccggctggaacgcatccgcactctcgaactgctccgcgaggtgctgcccgccgcacccgcccggatcctcgacgtcggcggtggcccgggggcttatgcgcgcgagctcctcgccgacggtcaccacgtccgcctcgtcgacctggtcccggcgcacgtcgaccaggcccgggccggccatcccccgatcgatgcggtcgtcggcgatgctcgttcgctgcctgagcccgaccggtcgcaggacgccaccctgctcctcggcccgctctaccacctccacgaccgcgccgaccggatccgtgcgatccgtgaggccatccgggtgacccgccccggcggccccatcgcggtcgcggccatcagtcgtttcgccggtcccctcgatttcaccgccaccgcccgattcgacgaccggaccctggccgaggcccgccgcctgctcaccgacggcgtcaacgacacatcgatcggtttcacccacgcctacttccaccgcatcgcggagctgaccgccgagtgccaggaggccggcctcaccgacgtggtggtccacggcgtcgaaggccccggctggcccgccgccgaggccgcccagcacggcccacacgccgagtcggtcttccagggcgccctccacctggcccgcctctacagcaccgaacccgaactggtcgccgtcagcagccacctcctcgccctgggctcctgcccccaccagtga

SEQ ID NO: 6038 - DNA, 1521 bp, Actinoplanes utahensis
ttgttgcgtaaacgcacccttgccgttccgttcgccgccgccctgaccctggccctgctcccgcagccggcccgggcggtcgacgaggtcaacacgaagaagctgcgggacgcggtcaccgtcgccgggatcctcggccacgaacgtgtcctgcagcggatcgccacccagaacggcgggacccgcgcctcgggcacccccggcttcgcggccagcgccgcgtatgtcggtgacgtgctgaggaaggccggctaccaggtcaccgagcagaagttcaccttcccgttcttccgcgacctgagcccggcgcagctcaccccggtcaccccggccggcccggcctacccgacgaacaccctcacctattcgatcagcggcgacgtcaccggccaggtggttcccgccctcaacaacgtgctgccgcccacccccgcgccgagctccacagccggctgcgcccccggcgacttcacccgcgcctcggccaccgccccgcagatcgccctgatccagcgtggcggctgcaacttcgcggtcaaggcggcgaacgcggccgccgccggctacgacgcggcgatcatcttcaacgagggccagcccggccgcaccgacctgttccagggcaccctgggcgacccgtcggcgatcccggtcgtcgcgctgagcttcgccgacggcagcgccctggccgccgcgccgggcatcgtgcgggtccagaccaacacggagatcaacctcgccgccagcaccagcaacatcatcgccgactatcccggcggtgacccgaaccgggttctggtggtcggctcgcacctggactcggtggtccccggccccggcatcaacgacgacggcagcggcaccgcccaggatctggagatcgccgtccaactcgccaagctgaagacgaaaacccaccagaaggtccgtttcgccttctggggtgccgaggaggccggcctgctcggctccacctactacgtgtcgcacctgtccgacacggacctgagccacatcttcgccaacctgaacttcgacatggtcgcctccccgaactacgtccgcttcgtctacgacggcgacggctccgccaccggcaccgcgggcccgtacggttccgaccagatcgagaacctgttcaccacctacttcaccgcccagggcctgcccaccgccccgaccgcgttcgacggccgcagcgactacggcccgttcatcgccgccggcatccccgccggcggcctgttcagcggcgccgagggcgtgaagaccgccgaggaggccaccgtctacggcggcaccgccggcaagccctatgacgcctgctaccaccaggcttgcgacaacatcaacaacctgaacccgaaggctctcaacgagttcgccgacgccgccacccacgccgtcctcaccctggccaagaccaaaaccggcttctacccggacggcagcctccgcgccgcccgccgcaccgccacccccgccaactccctctaccgcggcgacgacctggtccgctaa

SEQ ID NO: 6039 - DNA, 1449 bp, Actinoplanes utahensis
atgcagggcgagatcttcgagtacgcgggcgccaccgtcgagttgctcgacgcgtccacgatcctggccgccgcccgggtgaacccggtcgacctggtgcaccatgcggcggggtggccggccccggtgcagcgggccgaggtgaccgtgtcgagccgggacaccgcggcgggcccggtgcacgtgttcatcgcgcggctgcacgtcggcgccgagccgatgaccaccgagcggatgcgcggactggtgctcggccgggacccgatcggggtgctgctctcgaagcggatcgccgagggggatccggtggccaccaggatcgtggacggggtggggacggcggcggccgcggcgtaccgcaaactgggtttcgaccgcgtcgacaacccggcggcgaaccggcagcccggtgtgctcgcggacgccggggtcggcctgcaggccgaggtgacccacgaggccgccggcgatgtggtgcggctgcgcgccgaggtgccgcgcgacgaggtgaccgcgacccacctgcgggcgttcgtcacgctgaccctgcaggcggtggccgagctggccgacccggacgcgctgcgcgggcggcggttcgtgttcagccgggaggcgaccccgccgccggtgccggtcaccacccaggaggtgaccctggacatggtcggcggtttggccgacgtggtggctcagctgcggcagatcgcggtgtcgttccggcatccggacgcgatggcccgctggggcgcccgccggccgcagggcctgttgatgtacgggccgcccggcaccggcaagaccatgctgtcgcgggcgctggccaacgagatcggcgccgacttccgggagatccgcaccccggagatcctggacaagtggctgggcggttcggagcgcaacatcaagcagatcttccgggacgcccggcggtaccgggtgccgacgctgatgctcttcgacgagttcgattcgatcgtcagctatgccggtgccggcggggacgcggccagtcaggcgctgaacgcggtcgccgggatcttcaagcaggagatgaacgacctgttcgaggcgaacccgaacgtgatcgtggtggccaccacgaacttcccggcccgggtcgacgagtcactgatccgttccggacgcttcgacatcaagatcagcgtgccgaagcccgacgaggtgagccgcgcggagatcttccgcaagatggtcgacgggctggtggcggcgcaccagcggggcgcgttccggatgttcgccgaggacctggacgtggccgcgctcggcgtcgccagcaccgggatgaccggcgccgacatcaaggaggtgctgcgccgggtgcagatgaacaaggccatgcaggacgcccggaccggtgccgccgacccgatcacccagcaggagctgctcaccgaggtgcgcaacctgcggggcagcgtctga

SEQ ID NO: 6040 - DNA, 1605 bp, Actinoplanes utahensis
gtgacccacgaggtgttcaaccagccaccgccgctcaccggattcgacgtcgccgccgacgccgcgctgaccgcggccctggcccgggagggagccggctggcacaccgacgacctgcacaaactcggttcactggcgggcagtgagcaggttcagcggtgggccgaggaggcgaaccggcacgagccgcggctgctcacccacgaccggtacgggcaccgcattgacgaggtcgacttccacccgtcctggcaccgtctgatggaggtcgcggtcggcgcgggactggccggcgccgcgtgggccgatccgcgacccggcgcgcacgtggcccgggcggcgagcttcttcgtctggtcgcagccggaggccgggcacggctgcccgatctcgatgacctacgcggtggtcccggccctgcgcaacaaccctgacctggcagcgctctacgaaccatcgctgaccagccggtcgtacgacccgggcctgcgcaccccggccgccaagagcggtctgctcgccgggatgggcatgaccgagaagcagggtggctcggacgtgcgggccaacacgaccacagcgaccgccacgggcgccggcacctggcggctgaccggccacaagtggttcaccagcgcgccgatgtgcgacctgttcctggtcctcgcgcaggcgccgggcgggctgtcctgcttcctcgtcccgcggatcctgccggacggcacccgcaacacgttccggatccagcggctcaaggacaagctgggcaaccgcagcaacgcctccagcgagccggagttcgacggcaccgtcgcctggctggtcggcggcgagggccagggcgtccggaccatcatcgagatggtgtcgatgacccggctggactgcgtgatcggctcggcctccgggatgcgcgccgccctcgtgcaggcgatccaccacgccgagcaccggtcggcgttcggcgggcccctcgtcgacaagccggcgatgcgcgccgtcctggccgacctggcgatcgaatccgaggcggccacgctgctggcgatgcggctggccggggcggtcgaccggcgggaggacgcgttccggcggctggccatcccggtcggcaagttctgggtctgcaagcggcagccggccgtggtcggcgaggccctggagtgcctgggcggcaacggctacgtcgaggattccgggctgccccggctctaccgcgacgccccgctcaactcgatctgggaggggtcgggcaacgtgcaggctctcgacgtgctgcgcgccctgcagcgctcaccggacagcctggaagccttcttcgccgaggtggacgccgcccgcagcgccgaccaccgcctcgacagcgccgtccgtgacctgcgcagagagctgaccgaccggaccgatgtcgaggtccgggcgcggcggctggtcgaacgcatggcactgaccctgcaaggctcgttgctggtccggcacgcgccgtccgcggtcgccgacgcgttctgcgccagccggctcgccggcgactggggccacacgttcggcacactgccgaccggcgccgacaccgcggcgatcgtcgagcgggccgctccgcactga

SEQ ID NO: 6041 - DNA, 993 bp, Actinoplanes utahensis
gtgacccctttccagcgattcgtcgtctggctgcgggtgcccggccggatcccgctgctcagcctgatcgccgtcatcctggccgtcacctatgtcccgctgtgggtggtcaccatccgttccttcgacaacctggagcagcgcgagaacgtggacgaggccgaggagttgcgcgtcgctcccggcgcccagttgcagcggctcagcgacttcgggatgaccaacgcgatctggaccgcgctgtacgacgacatccggcgtggtgatcaggcgcatttcgcgatcgacgtgccgggttcggtggtcggtccgcggtacggcatgaccgcggtgatcggcacggacctgaccggcgaggtccgggtcggcggggcgatcgacggatcggcctacaccgcgctgccgggcgccctgcgcgagccgtcgacgctgcgcacgctgttcgacccgggcgcctcggcggacaccgggaagtgcggcttcaccagcgtgaccggcgcgcccaccgagttctgcggcttcccggcatacccggacgccggcactccgggcggtccgtccggcggtctgctgctgttccgcgagctcaacgccgccgcgctcgccgagatcaccgagaagaccaacgaccgattgacggtacgggcacagccgcgccccggccgcgagcacggcagcctgaccgcctcgtacgggccgatcggcgtgcgcaccgcggtggtcgacacggcggagagcaccgagcggatcaccgcgacgctgggcgcgctgaccgcgtcggccaccgaggtgtcccgggcggtggccaccatgaccgacaccatcggcagcgtgcgggcggcgatcgggcaggtccgcacggtcgccgacggtcagcagcacaccatcagcgggctgatgaaccaggtgcagaacgcgatcgggcagatcgaggatctgggggaccggcagcagccggccggcgggggcgggtcggacctggagctcttctag

SEQ ID NO: 6042 - DNA, 495 bp, Actinoplanes utahensis
atgagcaccgacgagccgcgctggctgcaggccgaggaggaggccacctggctcgccatgatcaagatgctgacccggttcccggccgccctcgacgccgatctgcagcagaccgccggcctctccttcttcgaatatcaggtgctcgccggcgtctcgatgaaacccgggcgcaaggcccggatgagcgagctcgccgagttcagcgcctgctcgctgtcccgcctctcgcacaccgcccgccgcctggagtccaagggctggctctaccgcgagcccgacccgaccgacgggcgctacacgctcgccgtgctcaccgacgccggctgggacaaggtggtggccaccgccccgggccacgtcgccgaggtgcgccggctgctgatcgacgcgctcacccccacgcagtaccggcagctgcgccagatcagcgagcgggtcaacgacgcgatcggccacaacccgtgcctgggcgtgcacaacaagagctgctag

SEQ ID NO: 6043 - DNA, 633 bp, Actinoplanes utahensis
atgagcattcttcgtatcgacgccagcatcctcggcccgaactccgcgagcagcgagctcgccgacatcgccgaggccgcgtggctcgagacggcgccggacaccaaggtcgtgcggcgtcacatcggcaacgagccgctgccgtcgcacgcgtggcagctcgccacctcggccggctacgtccccgaggccgaccggtcgcaggcgatgaacgacgcggtcgccctggccaacgagctcgccgcggagttacgcgacgccgacggcgccatcctggccctgccgttctacaactacggcgtctcccagcacgtcaagacctggttcgacctggccatggccggtggtgagcagggcgagaagttcctcgacggcaagccggtcatcgtggtcacctcccgcggcggcgcgtacggcccgggcaccccgcgcgagggctgggaccacaacaccgactacctgcgccgcgtcatcggcgacatctggggcgccgacctgatcctcatcgagcgcgagttcaccctggtcggcctgaacccggcgctggaccagttcaaggacgtcgccgccgagatgaaggccgccgcccacgcggccgccgccgaggccggccgggcgcacgccgcccgctga

SEQ ID NO: 6044 - DNA, 675 bp, Actinoplanes utahensis
atgcagtcgctcggagtacgcaccacccaggccgtcggcgccgcgctcggcctgctcgtgccgttcggcgggatcgccgccctggtcgccggcaaatggtccggcctgcgtgagatcgacacgcaggtcgccgaccggttgcacgaggcagcgctcggccacgccgccctggtcgatgcgctggcctggtggagcctggccttcgacccgaacacctggcgggccgccgccctggtcctggcgatctggctggtccgccgccgggaacggatgctcgcctggtgggtggtggccaccatggccgccgggggagcgctcggcggcgtgctcaaactcctcttcggacgccaccggcccgacctgctcgacccggtcgcccgggccaccggatactcgttcccgtccgggcacgctctcaacaacgcactgggcgccgccgtcttcctgctggtgctgctgccccgcacccgcggccgggcgaaacgcgccgcgctggtcaccgcggccgtcgccatcccgttgatcaccgcgtacacccgggtcgcgctcggtgtgcactggaccagtgacgtggtcgccggcctgctgctcggggcggccgtaccggcgatcaccgtcgccgtgttccagagacgccgcgttcgggtagaaggcggccgtgtccagattcgttaa

SEQ ID NO: 6045 - DNA, 717 bp, Actinoplanes utahensis
gtgtccagattcgttaaacaggcgttcacccggatcgtgctgccggtcgccgcgatcctgctgctgatgatcgggctcggggtgctgctcacccacgtgctcaaggacgagaacgggttcaaccgcaccctcgaacacgaccgcaccccggagttgacccacatctcctcgttcttcagcagcgtgggcaacaccatgacgatcatcgccgtcaccgcggtggccgcgctgatcctgcgcctcaccctgcaccgctggcgcgaaccgctgttcctctgcctcgcggtcaccgcccaggccgtggtcttcttcttcaccaccctggccatcgaccgcccgcgtcccgacgtccaccgtctcgacgcctccccgcccacctccagcttcccgtccgggcacacctcggcggcgttcgccctctacgtcggcctcgccgtcgtcctggcctcgctcgcgcgtcccggctggctcaaagccctctgctggctgctcgtcctcgtaccgctcgcggtcgccaccgcccgcatgtaccgcggcatgcaccacccgagcgacgtgctgtccgcctgcctcaactcgaccctgtgcctcaccgtgatgggccgcgccatcctcaaccgcgacgtcccctggcgacgcgccgggatcggatccgcggcaccggcgggcacgctgcagccggccggaaacggcgcagaatcgacggcgacctcctga

SEQ ID NO: 6046 - DNA, 1692 bp, Actinoplanes utahensis
gtgggaacccgacgtcatgatggaccagctggagcgggccggggcggagcaggcccggacacagccgcccgggcacttctggcccgtcatgaaccaccggccggtaccggccgccgtcatcgtgcccgacgacgaggtcgtgaccgaccccggcccctggcgtgcggccggcgccgccctgctgctcgccggcctcgcctccctggtcaccgccgccttcccggcacggcccgagacgtacctttactcctatcgactcagtgggtaatctcggcgcgtcgacaccgatccacaggagacgatgtgacgaaccgtgggaccacccggcgcggggtcttcagcgccctggccggtgccgccgccgcgaccaccctgcccacggagccggccgaggccgccgaacgccccttccaggccgccgcctcctcgaagccggcgcagcgaccgaacatcctgttcatcttcgcggacgatctcggctgggccgacctgagcagctacggctctccggacatcaagacgccgaacctcgatcgcctggcgagttcgggtgtccgtttcacccaggcctactccggtggcgcggtctgctcgccgacccgcatgtcgctctacaccggacggtatccgggccggcttcccggcggtctgcccgagccgatcgccgcgccgagcccgaccgccggtctgccgccggagcatccgacgctcgcctcgctgctgaagaaggccggctacacgaccgccatgttcggcaagtggcacaacggtttcctgccctggttcgggccgctgcgttcgggttgggacgagttcttcggcaactattcgggcgcggtcgactactactcgaagatcaccgggcagggtgtcgacctgttcgagggtgagacgcgggtcgagtccgacgagtactacaccgacacgctggcgcaccgggcggaggcgttcctgcgccgtgagcaccgcgcgccgtggctgctgaacctgaatttcaccagcccgcactggccgtgggaggcgcccggcgaccgcgcggtcagcgccgagatcaccgcccgggtgcgggccggcgacacgttcgcgctgttccacaccgacggcggctcgctggaaacgtacaggaagatggtggagaacctggacgtccgggtcgggcaggtgctcagcgcgctgcggcagaccggtcaggaggagaacaccctggtgatcttctccagtgacaacggcggcgagcggtactcctatcagtggccgctgaccggcaccaaggccagcctgaacgagggcggtatccgggtgccgacgatcgtccgctggccggcccggatccacggcggccaggtcagccacgaaccggtcgtcaccccggactggacggccaccctgctggagatcgccggcgccgcccccgatccggcctatccgctggacggcaccagtttcgccggctacctgctgcacggttcgccggcgccgggacacgacctgttctggcgcacccggcagtcccgcgccctgcgccgcggcaactggaagtatctgcgcgacaccgacaccgaccagctcttcgaccttgaccacgacccccgcgagcaggccgacctggcccagaagcaccccgacctggtcgccgaactccgcgcccgctgggaggaactcgccgccacccagctcccctacccgtcctga

SEQ ID NO: 6047 - DNA, 1554 bp, Actinoplanes utahensis
gtgcggcggcggcggtgcgggcctggagatgccggccgcggacgtggtcggcgcccacctctccgggctggcgtcgagcggcacggtccgcgcgttctatgccgatctggcgcaacgctccggttggcagcccgacaaacgaaccgccggcctgttctcggccaccaagccggccggcggctgcccctggtggttcgtgctgtcggcggccgccggcggctaccacctcagggtcttctaccagcccgacggcgccccggcggacagctgcgcctggaagaccggcgacgcgatcatcttcccggtgaccggagcctgacgcccgcggccgggctgagtggcacggcggcgcggcccgccgtgttcccccagcgtgccgtcgccatccgccgtccgaccgtcgaccgcggccgccgtcatccgtccggccacccaccgcaaccgccggcgccatcaaccgtccggccacccacctcgccctttcgccgatgccagtcggtgcccgttttgcgcaccatgtcagtgatgcgtactgcgaactggccggccctgaccttcgccaccggcgccagcctcctgatcaccggcctgtggcaggtcggccacccgctcctgcccctggccgagctggtcgccatgggagcgctcgtcgcgtacgccgtcatcaatacgacgacctggaccgtcccgcgacgctggaccatcgcgggcctgttgttgctggccgcggccttctccgtcgccgatccgctggccgacgccaccgtgggcaacgacgactccctgatgccgtggctcccccgcgagctcctgatcgtcgccggcggagccgctctggccatcggcctgctcctgcgctccgggctgcctccccacgccggccccggcctcccccgcctcgtcaagctgctgccggccgccgctttcaccgtgctcaccgccgccgcggccgcgaagctgagcgagaccgatttcctgaccaccgccagcccggcccggacgtccctgctcaccgtgaccgcgatgacgctgtccgcggccggcctggcgatcaccgccgcactggccggcccgcgccgcaacgccgccgccgccatcggcctgctgccggtcctcgggaccctgatcggagcgctgttcacgatcggcaccaccgacgccctgaatgcgcccgtcgtcaccgacccgaacttcgcctcttgggcgccgctgcaagcctccatcagcccgttcgtcctcgatcaggtgcgcgccgaccggctgcacggggatccgggaccccgggcgtgggaacccgacgtcatgatggaccagctggagcgggccggggcggagcaggcccggacacagccgcccgggcacttctggcccgtcatgaaccaccggccggtaccggccgccgtcatcgtgcccgacgacgaggtcgtgaccgaccccggcccctggcgtgcggccggcgccgccctgctgctcgccggcctcgcctccctggtcaccgccgccttcccggcacggcccgagacgtacctttactcctatcgactcagtgggtaa

SEQ ID NO: 6048 - DNA, 654 bp, Actinoplanes utahensis
atgacgaagctgagtgggcgggagatcgcggagcgggcgccgggtgggtgggtctacctgctgggggtgctgcggacccggctgcggaccggggacttcgccaccgggctggcgctggtcgacgcgatcggggcggtggccgaggagatggatcaccatccggatctggatctgcggtacgggttcgtggacgtgcggaccagcagccacgacgtgggtgcggtgaccgggcgggacctgcgactggctcaggcgatctcggagctggccggcagagccggggtggcgctcgacccggccggactgggtgggctcgaatgggcgctggacactcccgcggcgaacggggtggcgccgttctgggcggcggtgctcgggatgcggcagcaggaccacgacggggtcaacgacgaggtgcgcgatccgtccgggacgctgccggcgatctggttccagcggtccgggagcgaggagccgcggcagcgctggcatcccgacgtgtggatcgacccgagcgaggtgccgacgcggatcgatgcggcggtcgcggcgggcgggacgctggtgagtgacgcgaacgcgccgagcttctgggtgctcgccgaccccgaggggaacaaggtctgcctctgcacctggcaggaccgcggctga

SEQ ID NO: 6049 - DNA, 246 bp, Actinoplanes utahensis
atggcccgctacgtgcacaacgaccggctcgccgacgccctgcagggccaagccttcaccgcgctacgcgcctcacccggcgcccgcgcctactacgacaggcaacgcacccgcggcatcggccaccgacccgccctgcgacaactcgccaaccgcctcgtcggcatcctccacggctgcctcaaaaccagcaccccctacaacgaaaccaccgcctgggcacaccacctcgaccaagccgcttga

SEQ ID NO: 6050 - DNA, 1623 bp, Actinoplanes utahensis
atgggtgccgaagagatcaccatcaccggaaccaccgcagaccgatactccgagattctgacccccgaggccgtcgcgttcgtggtggcactggaccgggagttcggtgcccggcgggtgcagctgctggagcgccgccggcgccgccgggccacccgcaccacggacctggacttcctgccctccacccgggccatccgcgacgacgcgtcgtggcaggtggcggccccggccgcggacctgcgcgaccgccgcgtcgagatcaccggcccgcccgagcgcaaaatgaccatcaacgcgctgaactccggcgccaaggtctggatggccgacttcgaggacgccacctctcccacctgggagaacgtgatcctcggccaggtcaacctgaaggacgcgctggacggcactctcgactggacggcccccgacggccgccggtacgaggtgggcgccgacctgcccaccatcatggtccgcccgcgcggctggcacctgcccgagtgccacctgcggatcggcggccgcgcggtctccgcgtcgctgttcgacttcggtctgtacctgttccactgcgggcagcggcagatcgaccggggttccggcccgtacttctacctgccgaagctggagtcgcacctggaggcccgcctctggaacgacgtcttcgtcttcgcccaggagcagctcggcatcccgcgcggcacgatccgggccaccgtgctgatcgagacgatcaacgcggccttcgagatggacgagatcctctacgagctgcgcgagcactcggcgggtctcaacgccggccgctgggactacctgttcagcatgatcaagaaccggccggacgtggtcctgcccgagcggtcccaggtcaccatgaccgcgccgttcatgcgggcctacaccgaactgctggtcaagacgtgccaccggcgcggtgcccacgcgatcggcgggatggccgcggtcgtccccagccgtgacccggtcgccgccaagcgtgccctcaaccaggtccgccaggacaagcgccgcgaggtcggcgacggcttcgacggctcctgggtggcgcaccccgcgctggtcgagacctgccgcgaggtcttcgaccagtggctcggcgacgagccgcaccagatcgtccgcaagcgcgacgacgtgcgggtcggcgccgcggaactcctcgatgtgaaggccaccgcggtcgccgtcggcgaggtcgcgctgcgcaacaacatcagcgtctcgctgcgttacatcgcctcctggctgggcggccgcggcgcggtcgcgctcggcggactcatggaggacgccgccaccgcggagatctgccgggcccagctctggcagtggatctcgtcgggcacccccaccgactacggcgtcccggtcacggccgccatggtcacccggatgctccgcgaggagctggacgtgctcagcgagaccggtgcgctggacgaggaggcggcccggctcttcggccaggcccgcacgctcctcacggtcctgctcaccgaacggacgtgcccggagttcctgaccctgccggcatacctacggcacctgtcgggcgggtcggctccggtcgtcacgagggctactgtcgcggcctga

SEQ ID NO: 6051 - DNA, 1287 bp, Actinoplanes utahensis
atgactgagcttgccgaaaccaggggcggtaccgctgcggacctcactcaggcgtgggccagcgacccccggtgggcgggtgtcaagcgcacctacaccgccgaggacgtcgtcaagctgcggggcaccctgcaggagcggcacacgcttgccgagcgtggcgcggccaagctgtgggagctgctgcacaccgaggactacatcaacgcgctgggttcactgaccggcggccaggcgacccagatggtgcgcgccggcctcaaggcgatctacctgtccggctggcaggtcgcggcggacgcgaacctgtccggccacacctacccggaccagtcgctgtacccggcgaactcggtgcccgcggtggtccggcggatcaacaacgcgctgctgcgcgccgaccagatcgacacctcgaacggcaagtacgagcgtgactggttcgccccgatcgtcgccgacgcggaggccggcttcggtggcccgctcaacgcgttcgagctgatgaaggccatgatcgcggccggcgcggcgggcgtgcactgggaggaccagctggccagcgagaagaagtgcggccacctgggcggcaaggtgctgatcccgacccagcagcacatccgcaccctgaacgcggcgcgcctggcggccgacgtggccggcgtcccgtcgctggtcatcgcccgtaccgacgctctcgcggcggacctgctcacctccgacgtggacgagcgtgacaagccgttcgtcaccggcgagcgcaccgccgagggcttctaccgggtcaccccgggcgacgacgcggcgatcgcccgcggcatcgcctacgccgactacgccgacatgctgtgggtcgagaccggcaagccggacctcgagttcgcccgcaagttcgccgaggccgtgcacgcggtgcaccccggcaagctgctgtcgtacaactgctcgccgtcgttcaactggaagaagaacctggacgacgccgacatcgcccgcttccagaaggagctgggcgcgatggggtacaagttccagttcgtcaccctggccggcttccacgctctcaaccactcgatgttcgagctggccaagggctacgcggagagcggcatgaccgcctacgtgaagctgcaggaggcggagttcgcggccgaggccgacggttacaccgccaccaagcaccaggccgaggtcggcaccggttacttcgacgccgtctccaccgccctcaaccccgagtcgtccaccacggcgctgtccggcagcaccgaggccgagcagttctga

SEQ ID NO: 6052 - DNA, 1452 bp, Actinoplanes utahensis
gtgaccgcttcaccttctgactccgtcgatctcgtcactctcgggcagcgtctgcggcatttgcggcgcacccgcggcatgacgctggaccagctcagtgaggcggtaggccgggcaccctcccagctgtcgctgatcgagaacggcaagcgggagccgaaactctccgtgctgcaggcgatcgcggcggcgctcggcgtccccatgcaggacctgctgcgcgcggaggcgccctcgcggcgggccgcgctggagatcgagctgacccatctacagcagaatccggtttattccgcgctgggcctgccggtggtcaagggcggccggcggctgccgcccgacgccctcgagtcgctgatcgggctgcaccgcgagctgaaccgggtgctcaccgagcagagcgccacccccgaggtggcccgccgcgccaacgcgcaactccgcgctgacatgcgcaaacgcaacaactacttcgccgacatcgaggccgcggccaacaagatcctgctttccgtacggcatgccaccggcccgctgtcgcaacgcgggatcctggacgtcgccgcccaggtggggttcacgctgcactacgtgaacgacctgccgacctcgacgcggtcggtcaccgacctgaagaatcgccgaatttatctgccgcaggtggccagcgggaagggccacgacccgcgcggcgtggtgctgcagaccctcggccacttcgtgctcggccacaacgacccggccgactacggcgacttcctgcgccagcgggtcgaggtcaactacttcgcggcggcgctgctgatgccggagaagttcgccgtcgacttcctggccgccgccaaggccgaccgggccctggcgatcgacgacttccgggacgcgttcggggtcagctacgagaccgcggcgcaccggttcaccaacctggccacccaccacttcgggatcccggtgcacttcgcccgggtgcacgagagcgggatcgtctacaaggcgtacgagaacgacaacgtgcgcttcccgtccgacgtcaccggggcgatcgaggggcagccggtgtgtcgcaagtgggcgtcccggacggtgttcgaggccgacgatccgtactcgtcgttctaccagttcaccgacaccacggcgggcacctactggtgcacggtgcatgtcgagtcgacccggtccggggagttctcggtgaccgtcgggacgccgtacgagcacgcccgttggttccgcggcggggacgtctccgggcgcaccgtctccacctgccccgacccggactgttgccgccggccgccggcgcaactggtggaccgctgggcgggcaacgcgtggcccagcgcccgggtgcactcgcatctgctggccgcgctgccgccgggcaccttcccgggggtggacaaccgggacgtctacgacttcctggagcggcggaccggttcctag

SEQ ID NO: 6053 - DNA, 936 bp, Actinoplanes utahensis
gtgatcgactacgacgccgatcgtgtccgcgtcgcccggccggcagcggcgccggcccgacccgcgctaccgggtgccggccgtccgccgccctggcacgatgcgcgcatgaccgacgacgagcagacccggcatcaggcgggcacgaccgacgacgagcagacccggcatcaggcgggcacgaccgacgacgatgtgacgctggccgagttcaccgacctgatgcgggcgcaggagtccggtgcgggcatcctggccacactcgccgatgcggtgcgccacccgcggcccgatcttccgatcgtcgatctgggctgcggcaccggactcggcacgctgcgactggccgggagtttcccgcaccaccggatggtcgcggtcgagaagtcggcggcgatgcgcgccgtcctgttctcgcggatcgcctacgacgagtcgttgcggcagcggatcacggtgctgcccggcgacctgttcaccgccgacctgccgggggtgtggggtgcggccgtcgccgtccacctggtgtgtcagctggccccggctcagcgcgccgacctgtggcggctgctcgccggccacctcgcgcccggcgctccggctgtcgtcgaccggcactacggcagcacggcgacgatgcgggtcgaggaacgcctggcctgccgcaccacggtcggcgactgcacctacgagcgctggttcgcgtgcgcacccgcggaccacgagtcgatcacctacaccgacacgtaccgggtactgcgccacggcaggatcctggacgagcggagcgtgtcccggcggtcgtggatcgccaccgaggacgacgtgatcgccgaagccggccaggcgggcctgacggtggcctggaccaccggcgagttcctggccctcaccgtcgaggagggccggctcacacatcccggcgctggcgggtga

SEQ ID NO: 6054 - DNA, 1161 bp, Actinoplanes utahensis
atgaccatccacccggccgcctgggccgtcctcgccttctccttcctggtcatcccggtgctctgggtgctgatcgaccgggccaccctgatccgggcgggcctggcccgcccggtgccggccggcgccgagccggtccaggacttcaccgtcctggtcccgatctacggctcggtgcggtatctggagaacgtcgactatctggcccagtacggcggccgggtggtgctgtgcacgaccgacggcgagtccgccgagttctacgccgggctgggcgggatcgccgagcggcacggcttccggatcttccgcgccgccggggtggccggcggcgccggggccggcggcaagcgggccacctccggcaccatccgcgaccgcctggtccgggacgcgctcgaggtggcggtgcacaccccgtacgtcgtctgcatcgacgccgacaccaccaccgagcgcccgttcggcgagctggtcggccagctcgtcgccaacgggtacgacttcgcgtcggtgcccctggtgccgaccaacgaccgcagtgccctgggccgcctgcaggcctacgagtaccgcaccgcgatgaagttgcggatcatcgcaccctggcaggtctccggcgcctgtcacgtggcccgcaccgaggcgcaccgcgaggtgatgcgccgccactcgctgttcttccagggcaacgacgtcgaggcgggcctgctcgccggcgccctcggcctgcgcgtcggccacctgccgttccacgtcgccaccagcgtcccggaaaccttcaaagcctggtaccgccagcgcctggcctggtccggcggcgagttccggctcttcgccgtcaacgcgcacctgctgttccgccaccccttcttctggctgtacggcagcgtgatcaccctggccggcttcccgctgcgctggctcaccctggccaccggcggctggaccctgctggccatcttcggcctgcacagcgccctgatcgtctacatgcactggccggtgcgcacccgctggctcgccctgatgccgctgtacaccctgttcaacagcgtggtcatgaccccgctcggcgccttctggtacttccggatggcgatcgccgaccgcaacgccggcctgatccgcaccaaccggccgttcccggcaaaggcctga

SEQ ID NO: 6055 - DNA, 1113 bp, Actinoplanes utahensis
atgcagaacaccccgaacccggccacgctggcacggctgctcggcaagcacaccgaacccctgttcagcccggccacccaggtgtcggtcgagggccgctcggtgctggtcaccggcgcgggtggctcgatcggcagcgagatcgtgcgccaggtgcaccggctcaacgcctcccaggtgttcctcctcgaccacgacgagggcgccctgcacgccctgcagctggagctgctcggccacggcctgctcgacaacgacagcgtcgtgctcgccgacatccgcgacgagcaggtgctcgaccggctgttcgcacggatccggccggacctggtcttccacgccgccgcgcacaagcacctgccgctgctggagcgctacccggcggagggcatcaagaccaacatcctcggtacggcgaacgtggtgcgcgccgcggcccgggccggcgtgcgggtgttcgtgaacatctccaccgacaaggccgccgccccgaccagcgtgctgggcgccaccaagcggatcgccgaacgggtcacctcggcgtgggccggcgacgcgatgcgggtcgcctcggtccggttcggcaacgtgctgggcagccgcggctcgttcctgccgaccctgcactggcagctgagcaacaacctgccggtgaccatcaccgacccggccgtcacccgctacttcatgaccatcccggaggccgccgcgctggtcgtcgaggccgggcagatggcctcggccggcgagacgtacgtgctggacatgggcgagccgatgctgatcgaggacgtggtccgccggatggccgccgcgctgcgcaccgagccggagatcgtctacaccgggctgcggccgggcgagaagctgcacgaggagctgcacgacgggatcgagatgctgggcaccaccgggcatccgcggatctcgacggtcacctcgtacggggcggccgaccgcggtctgctgtacgacgtcgccatgctcgccgagcgcctcgccgagcacgacgaggaccggctccgcgccgagctgcgctccctgctgcgcgacgcggccggcgtcgacttcccggtcggtgcgggccagccgctgagcacgggcgctcgatga

SEQ ID NO: 6056 - DNA, 750 bp, Actinoplanes utahensis
atgagacgtcgattcaccctgcccgccctgaccgtcgcggcggtcgccggatcgctgttcgtggccgtcaccccggcgttcgcgcacggctacatctcctcaccaccgagccgtcaggccaactgcgccagcggcgcggtgaccggctgcggcgacatcgtctatgaaccgcagagcgtggaagcaccgaagggttcgacgcagtgcaacggaggcggcagccgtttcaccgtgttgaacgacaacagcaagagctggccggccgccacggtcgggcagacggtcaccttcaactgggtgctcaccgcgcggcactcgaccgcgacctgggaatacttcattggcaacacgctgctggcgtcgttcaacgacggcggagcgcaaccgggggcgaccaagtcgcacacggtgagcatgaaaggcttcaccgggcggcagaccgtgctggcccggtggaacatcgcggacacggtcaacgcgttctactcctgcgtggacctgaacatcaccggcgggtcgacgacgcccacgccgaccccgaccccgacgcccacacccacgccgacggtctcgccgtcgccgaccaccccgccgcccacgtcgggcaccacgacctgggcggcaggcacgacgtacaaagccggcgatgttgtcgtttatgccggtaggtcgtatcagtgccggcaggcacacaccgcgatcaacggctgggagccgccgaacgtgccggctctgtggaccgcgctgtaa

SEQ ID NO: 6057 - DNA, 663 bp, Actinoplanes utahensis
gtgccggcaggcacacaccgcgatcaacggctgggagccgccgaacgtgccggctctgtggaccgcgctgtaaccatgtcgtcgacgatgacaccgagcggcccggttcgccgggccgcctcggccctgctgctgaccgccgccctcctgggtggctgcaccgccggcaccacctccgcagccccggccccgtcgggtgcggtcaacgacgtggacgtcatgttcctgcagatgggcctcgcccagatcgccgagggtgaccgggtcgccgcgctggccgagcagcacgccggcaacccggagatcggccggatcgccggggagctgcgcggccagtggcggaccgagggcggcaccatgcagcgctggctgctcgggtggtcgcagccgaccgccgccgacccgtcggccggcgcgcacgccgggcacggtgacctgcacgccctgcgcgaatccgacttcaccgacctggccgcgcggcacggcgccgacttcgaccgcaccgcggtcggcatgctgctcggcaccctgcacaacggcatggagacgctgcgcctggagtccgccgcgggggcatacccgccggcccgcgccctggccaccaggatgaccggcgagcggcagtcccagatccagcgcctgctacggctcgccgcgggctga

SEQ ID NO: 6058 - DNA, 141 bp, Actinoplanes utahensis
atgcccgaaccgatcgtgcccaccgcgcgcccgcggaccggccggctcgaagcccgcgacgagggccgtggcggtgtcctggagggcatcctggacacccacatcggacggctccgacgtcactggatcacgctctcctga

SEQ ID NO: 6059 - DNA, 930 bp, Actinoplanes utahensis
atgatcgactcccggcggctgcaggtgctctccgaggtggccaggcacggcagcttcaaccgcgccgccgccgagctgagactcaccccgtccgccgtgtcccagcagatcagcgctctggagcggtccctgggcacccccgtggtgcggcgcagcacccggggcgtcgcgctgaccgaggccggcctggtgctgatcgacgccgcccaggcgatcaccgccgagctgcgcaccgcccagcgcgagatcgaccggctcgccaccgcccgcaccgagcggctcaccgtggccaccttcaccagcggcggccagcggctgctgccacccgcgctgacccggttcaccgccgagcacccgggcgtcgagctgaccgtgatcgagagcgagccggaggacagcctgcccctggtccgttcgggcgcggccgagctcgccctggcctaccacttcaccggtccgccaccggtcgtcggcggcgaccggtccggcctgctctggacaccgatcctggacgacccgatgtggatcgtcctgcccgccggccaccccctggccggcgccgccacgctcggcctgaccgacctggccggggaacgctgggtgtacggctgccccgggcagagcgacctgctggagcactacgccgcgctggagggcctcagcgtccgggtggcctgccgcggcaccgactaccagttcgcgcagtccctggtccgggccggggtgggcatcagcatgatccccgaggtggggctctcgcaggaccgggccggtctggtggcggtgccgatgcgaccacccggcccgtgccggtacgtgggcgtggcgaccccgcggcggcggccgtcaccgctggccacggccctgctggcgacgctgcgggaggtggtcgtggcgctgccgccgaacccgttgaccactccggggtga

SEQ ID NO: 6060 - DNA, 468 bp, Actinoplanes utahensis
atgacgaagtccggaccggtggtgggcctgctggtcacggccgccctcacgctgcccaccgcggcgccggcggtggccgctccggtgcccaccggctgcggcgaagcctgtgaccagcaggacccgcagacctacaacacgtgcggcgccggctgcccggacaacgtcccgcagcactgcgccgacgaggccgtcaccccgcacgtctcggcgcgcggctgggtcgagctgcgctacagcgccacctgccgcaccgtctggtcccgcgtcggcgccgccttcccggcccacgccgaacactggaccgagacccgctactccaacggccgcctgcgcctggcgaccaccccgaccacgcagacctggtccccgatgctctccgacgccgacctggccggccgggcctgcgccgccactctcggcccgtccggccggcacctcatcatggactgcaccccctggttctga

SEQ ID NO: 6061 - DNA, 639 bp, Actinoplanes utahensis
gtgatccgtgtgctcgtggctgacgaccaggcgatggtccgcaccggcttcgggatgatcatcggcgcgcagcccgacatggaggtggtcggcgaggccgcggacggcgtggaggccgtcgaggcggcccgccgcctgcgccccgacgtcgcgctcttcgacatccggatgccgaagatggacggtctgcaggcgctgcggctgctggccggccccggcgtcgtcgacccggtcaaggtggtcatggtcaccacgttcgacctcgacgaatacgtccaccaggcgctgcgcaacggggcctgcggcttcctgctcaaggacgcggggccggcgctgctcatcgaggcggtgcgcgcggcccactccggcgacgcgctgatcagcccctcgatcacggtacgtctgctggagcacctgtcccagcccgcgccgtccaccgacgacggcggcctgtcaccgcgcgagctcgaggtggtgcggctgatcgcccggggccggaccaacgcggagatcgccaccgagctgttcatctcggtgggcacggtcaagacccacctgggcagcgtgcagtccaagatcggcctgcggaaccgggtcgaggtcgccgcctgggcctgggaacaccgcatcgtcacctga

SEQ ID NO: 6062 - DNA, 1137 bp, Actinoplanes utahensis
atgaaccgcatacttctgggcttcctgcaggtggccgggctggggctgatggccctgctcggcatcgtcgacgtgaccggaagcatgaccgagagcccgctgttcccgatccaggtggcgctcgcgatcggcgccgccgcggtctggctgccgcactacaaacccgggtcgatcctgctgcccaccgccgcgatcgccgccgccggcgcgtcgctgctggtcaccgcggggctggcggtcaccgatccgtacggcggactgtggggcctggccgaatcgaccgcgctgctgatcaccctgaccctggtcgcccgcaacgcccggcccgactgggcggtgctggccctggtcgccaccggcgcggcggtcagcgtgatgccgctgcgctccgggcacagcaccatctacgggacgttctgcctgatccaggcgctcggtgcggccggcgcgatcggcttcggcgtcaccctgcggatcaccgccggcaaccggcagcgggccctcgacacggtccgcgccgaacagcgcgccgaattcgcccgcgacctgcacgacttcatcgcccaccacgtcaccggcatcgtggtgcaggcgcagggcgcccggttcatcgccgaacaggacccgaaacgggtgctgctcgccctcgaacagatcgaacaggccggcaccgagacgatgacctcgatgcgccggatggtcggcgtgctgcgcgacccgcagtcccgcccggacgcgccgctcgccccggtcgccggagtgcccgaactcgccgccctcgcggaccagttcaccgcggccggcggccccccggcccggctgcacctcgacggcgacccgcacggcctgccggtcgaggtctccacctcggcgtaccgggtggtgatggaggcgctgaccaacacccggcagcacgcgccgcaggccaccgccgtcgacatctgggtccgccggctccgcgaccagttgctgatccgggtggccaacgacggcccggccccgcgcccgaccctcgaccggccggggtacggtctggtcgggctgaccgaacgggtccgcgccgccggcggccggatcagctccggccccggcgtcgacggtggctgggtggtcgacgccgtcttcccgattccgtaa

SEQ ID NO: 6063 - DNA, 768 bp, Actinoplanes utahensis
atgcagacgcagtcctcacctctggccggccgcgacgccctcgcggcggtcgcggccgttgacctggtgaaggtgtacgggaccggggacaccgcggtccgcgccctcgacggggtcaccgtcggtttcgaacgctcccggttcaccgcgatcatgggcccgtccggctccggcaagtccaccctgatgcactgcctggccggcctggacacggccacctccgggcaggtgctgctcggcggcagcgacctgaccaagcagtccgaccgggtgctgacgaaggtgcgccgggagcggatcggcttcgtcttccagtcgttcaacctgctgccgcagctgaccgcggccggcaacatcacgctgccgctcgacctggccggccggaagccggacgccgagctgtacgaccggctggtcaccacgctcggcctggccggccgcctcgggcacctgcccagcgagctctccggcggccagcagcagcgggtggcgctggcccgggcgctggtctcccggccggaggtgctcttcgccgacgagccgaccggcaacctggactcccgctccggcgccgaggtgctcggtctgctgcgcgactcggtgcgccagctggggcagacgatcgtgatggtgacccacgacccgggtgccgcggcctacgccgaccgggtggtgctgctcgccgacgggcagctggccggggagatccggaacccggacatcgcgtcggtcaccgacgcgctgcagaagctggcggccggccggtga

SEQ ID NO: 6064 - DNA, 2508 bp, Actinoplanes utahensis
gtgaacacgattctgcgtacgcagatggccggtgccgcccgtcgccccgcccggctgctgctcaccggtctggccgtgctcgtcgcgtcgttcgtggtctacgccaccgtgctggcccgcgacatcaccgagcgcagcgttctggacgggctcagcggcaccccggagacggtcgacctgatcgtccgcaacggcgcactgaacgacaagcagctggcccagatcaccgccctgcccggggtggccggcacggccgcgcgcaccgaggtcggcggccagctgggcgggcagtacctgagcatcaccgcggacccgggcagtggcccgctcgccctggtgaaggtcgcccaggggcgctatccgagcgcgcccggcgagatcgcgatcaccccgcgcaccgtgcagctgctcggcctgtcgatcggctcgaccgtcggcgtcgacccgggcagcggcaggaaggtgccgctcaaagtggtcggtgtggtcgacccgccgcacgacttcggcggcgacgcgtacgccccgtcgaacaccgtgatcgggctgaccccggagccctacctgcagcagatcgacatcgacgtggccgccggggccgacgccgggccgatccaggagaagatccaggcgatgttcgccggcgccaagcaggaggaccggccggaggtggccacgggggccgacgtccggctggaggaggcccgccaggcggcgagccagatcgattccctgttcgcggtggtcggcatgttcgtcgggatcgcggtcgccgcggccggactgatcgcggccagcacgttccggatcgtcttcgcccagcggatgcgtcagctggcgctgctgcgggcgatcggtgcgggccgcggcgcgacgttccgggcgctggccgccgagggcgcgctcaccggcctggtcaccggcacgaccggggtgctggccgggcaggcggccggcttcgggatcccggcgctgctgcgcggcttcggctggaaggtgcagaacccggggatcccggtcctctgggcgatcggcaccatcctgctggccgtggtgatctcggtggtcgcggtactcgccccggcggtctcggcggcccgggtggcgcccctcgaggcgctgcgcgccgcggccgggaccggcgcccgcaccgggatcggggtgctgcgctggatcggcggcctgctgccgctggcgggcgcgctggcgctggccggttacgtgatggtcaacctgcccaagccggatcagaaggattacgacgcgcagaccatgctgctggccgtggtcgcctccggcgcgctggccttcgtggcgctgatcgcgctgggcccggtgctggtccggccggtgctggcggtggccggctggccgctgcggcgactcggcccggtcggccggctggccgtcggcggggtgggcggcagcgcccgtcgggccgcggcggtctcggtggtggtcgcgctgggtgtcaccctggtcgccggggtgctggtcggcggcgcgtcggtccgggcgctcggcgagcgggagctggccgcctcggcaccggccgacttcgagctgaccggtggggacggggtgaccgtgccggccgagatggtcgccaaggcgaaggcgagcggcgagctgacccgggtcgtggcgtaccggcggctggccgcggccagcatcggcgacatcgatcacgtggcggtcaccgacctggacgtgccgtcggtgccgaggctggcggatctcgacgtccgctcgggctcgctcgccgacctcgcgcccggcaaggcggtgatctccagcttcaccgcggagtccgccggcgccggtgtgggtggtcaggtgaccgtggcgaacggcgcgaagaaggtcaccttcaccgtggcggcggtgctcggcgacgacgcgccgctgcacgccagcctgctggtcaccccggcggacctgaccgcgctgggcgcgggcgccacgttcaacgggatcctggcggacgcggcgcacgacggcgagagcggccggaccgaggcgctgcgggcgatccgcgcggtcgccggcggtcagggcgactacagcgtgaccgtgctcgccgaccagcgtgacgagctgaactcggagctggcgacgctgctcgggatcgcgctcggactgatcggcctgaccgtgctgatcgcggtggtcggggtcggcgccaccaccgcgctgtcggtggtcgagcgggtccgcgagtcgggtctgctgcgggcgatcggcatgtcccgcggcgcgctgcgcaccatgctgaccgccgagtcggccctgtacggggtgatcggtgcggtgctcggcctgctgctcggggtgccctacgcctggctggcgatccaggcgatcggtgtgaacgcgccgctcgcggtgcccggctggcagctcgccggcgccttcctggccctggtggcgctgaccggggcggccggggtgctgccggcccggcgggccgcgaaggtcagcccggtgaccgcgctgggcaccgagtaa

SEQ ID NO: 6065 - DNA, 1998 bp, Actinoplanes utahensis
atgaccccgaccgtcctgatcgtcgacgacagcctgaccgtccggatggatctccacgacgcgttcaccgacgacgggttcaccaccatcctgtgcgcgaccggcgccgaggcccgcgaggcgttcacccgcgccgagttcgacgcggcggtgctcgacgtgctgctgcccgacgcggacggcctggaactgctcaccgagctgcgcgcctcggccgggcacgcgaacgtggtgacgatgctgctgtcggtggagagcgacgtgtccgaccggctggccgggctgcggatcggcgccgacgagtacatcggcaagccgtacgacgccgggtacgtggtggcccgcacccggcagctgctcggcgggcagccgtccggccgggccgcgggcggggcgccggccatcctggtgatcgacgacagcatgacgttccgggagcggctgcgcgagctgctggagccggaggggtacacggtgctgaccgcctccggcggtgaggagggcctgcggatggccgccgaccgccggccggacgcggtgatcgtcgacggggtgatgccgggcgtcgacggggccacggtgatccgccggatccggctcgacccggcgctgcgcgacaccccgtgcctgctgatgacggcggccgacgactacgccaccgagatgcagatgctcgacgccggggccgacgcgttcgtgcgcaagcagcaggatctcgcggtggtgctggccaagctggccgcggtgctgcggcaatcggccgagcagctgccgatcgaggggatcggcggcctgcacggccccggcaaggtgctcaccgtgaccccggaccgcgacgagcaggagtgctgggcggaggcgctgcgcaccgacgggtacgacatcgtcgcctgccgggacgtcaccgaagccctggcgctgctcggcgagcagccggccgactgcatggtgctcgggttcgaccacgacctggccgcggcccaggcggcctgccggcgggtgcgcgaggtgccgcaggtgggcgacatcccggtggtggtcgtcgggcgcgaggaccacatgctggagtgcctggccgcgggcgccgacgactacgtgcgctcgtccgacgtcccggaggggctgcgggtgcacgtgcgggcgcagatccgccgcaagcagtcccacgacgaggcgcggcggatccgtgaggagctgatgcgccgcgagctggacgccgccgaggagcgggcggcccggcagctggccgagacccgggccgcgatggtcgaggagctggagtggcgcaaccgggagctcgaggcgttctccggttcggtttcccacgacctgcgcggcccgctgcaggtgatcagcagtttcgccgagcacatgctggacgaggcggacgacgagcagctgggtgagcagacccggcaccggctcggccggatccacgcggccgcgctgcggatggccgacctggtcgagtcgctgctgatcctggcccgagccagccgcggcgagctgcgccgggcgcgattcgacatgaccgccacggcccggcaggtgtgcgccgaggtggccgcccgggatccggaccacaaggtcgacttccaggttcaggaggggatgaccgcggacgccgacgagggcctggtccgggtcatcctggagaacctggtcaacaacgcggtgaagttcacccgcaaggtcgagcgtccggtgatcaccgtcggcttcgcggacgacacctacttcgtccgcgacaacggggccggtttcccggccggcaaggccggggagctgttccgcccgttcgcccgcctgcacgacgcgcgcgacttcccgggcaccgggatcgggctgaccaccgtgcaccgggcgatcgagcggcacggcggggagatccgcgccgagggtgaggagggtcagggtgcgacgttccggttcagcctgcccccggcggacgggccgcccggtccggagcggcggggccaggcccgccgctccggctga

SEQ ID NO: 6066 - DNA, 1074 bp, Actinoplanes utahensis
atgatccgggtgctggtggtcgaggactccgcgaccatgcgctaccacctgcgcgaggcgctgaccgaggacccggagctggaggtggtcggcgaggcggtgaccggcgagcaggcggtcacgctgaccggccggctgcgccccgacgtgatcaccatggacatgatgctgcccgggatcagcggactgcaggccaccgagcacatcatggccgagcacccgacgccgatcctggtggtctcctcggccgaccggcaggagttgttcagcacgtacaacgcgctggccgcgggcgcggtcgacgtgatggagaaaccgcgcggcgacgactcggacgccgactgggccccgcggctgcgccggacgctgcggatggtctcccggatccgggtgatcacccacccgcgggcccggctggacggccgggcccgcgcggcctcaccgtcgctgccaccgaccccggccgcgaccatgccgcacccggcgaacgcgatgacgctgatcgcggtcggtgcctcgaccggcggcccggccgcgctcaccgagctgctgcgcagcctgccgccgaacttccggcccccggtgctgtgcgtgcagcacatcgcggccagcgagcagttcgccgtggcgttctccgactggctggccgggcagaccgggcgcaacgtgcggtacgccaccgacggcaccccggtgcgcacgctgaccggtcaggtgctgctcgccccgccggaccggcacctgtacgtccgcgaccacgtgctgcgcctgtccgacgggccgccccggcactcctgccggccctcggtcgacgtgctcttcgagtcggtggccaccgagtacggcaacctggcggccggctgcctgctgaccgggatgggccgcgacggcgcggccgggctgctgcagatgcgccaccgcggggcgatcaccttcgcccaggacgagcacagctgcacggtgtacggcatgccgcgggaggccgcgctgctcggcgccgccatgcacgtgctgccgccggcgcggatcgcggcccggctggccgagctgcagccggtggtgatccgccgatga

SEQ ID NO: 6067 - DNA, 2109 bp, Actinoplanes utahensis
atggccgagagccgcgacccgttgcgctacttccggatcgaggcgcaggagttggtcgagcagatcagcgccggggtgctcgacctggaccagcagcgcggggcggagccggtggcccggctgctgcgggccgcgcacacgctcaagggcgcggcccgggtggtccggcagaaggagatcgccgaccgggcgcacgagttcgaggagatcctggtcgcgcaccgggaggacgcggccgggctggccgccggggacatgcgggaactgctgcggctcaacgacgagatcagcgcgcaggtgaccgcgctgacccggccaccggcgccacccccggtcgtggagaccacgcccgccctggagaccacgcccgccgtggtggccacgcccgccgtggaggtcgccccggaacctcgggcggagccggtggcggagaccgtggcgccccgggcggcgaccgccgatctggacgacctgctcgacgcgatcaccgagaccaccgcccggatggccccgctgcgggccggcagccgcgtcgtcgagaagctgcggaccagcgccgagacgctcgccgatcagctgcgcggcggccggaccgcggccgcggtcacgcacgcctcggcccggcggctggccggcgagctgggctcggccggccggcggctcagcgacgcggtcgaccagatcgaacgggagctggacgacgtccgggccaaggcggagagtctgcggctggtgccggccgggagcatcttcaccgcgctgcgccgggcggtccgcgacgccgcggacaccgagggcaagcaggtccggttcgtcacccacggcgccgacgtgcggatgggctcgcacctgctcggcccggccagctcggcgtttctgcacgtggtccgcaacgcggtggtgcacggggtggagccagccacggagcgggcggcggccgggaaaccggcggagggcacggtcaccttcgaggtggaacggcagggccggtacgcgaccttccgctgcaccgacgacgggcgcggcttcgacgtggccgcgctgcggcaccaggcgcaggcccgcgggctgctgccgggcgccgggccggccgacgccgaggtcctcgacctggtgctgcacggcgggatcagcacgtcggcgacggtcaccgaggtggccggccgggcgatcgggatggacgtgctgcgcgacgtcgccgcccagctccgcggcgaggtgcggatccgcagcaccccgggggccggggcgagcgtcgagctggtggtgccgctggccctgctgagcatgacgggcctgctgatcgaggcgggcggggtgaccgcctcactgccgctggacgcggtacgtgcctgcgtgcggctgagcccggcggaggcggagaccgcggccggcagcggccggctggtccaccagcatgtggcgatgccgtaccagccgctgatcgaggcgctgggcgtcgggcggccggcgccggacgcggccgggccgggcgccgccgtggtgctgcacggcgaccagggcgccgcggcggtcggcgtggatcgactgctcggcacgcattccctggtcgcccggttcctgcccgaactggccccgaccaccccggtgatcagcagcgtgtcgatcgacagcgagggcaatccacggctggtgctcgacccggacgggctgatccgggagatggtgcacgacccggccaccgcgggtcgcccggccgtcgccccggtcacgccgccgctgccgatcttggtcgtcgacgactcgctgaccacccggatgctggagcgcagcatcctggagtcggccggttacgaggtcgacctggccgcctccggcgaggagggcctggagcgggcccgctcccggcggtacgggctgttcctcaccgacatcgacatgcccggcatcgacggcttcaccttcgtcgagcggacccgggccgacccggagctcgccgccgtcccggccatcctggtcagctcccgggccagtgcggccgaccgcgaccgcggcatccgggccggagccagcgcctacgtggtcaagggcgaattcgatcaggaggagcttctggggcacatccgccgcctggtggtgcgcgcatga

SEQ ID NO: 6068 - DNA, 1467 bp, Actinoplanes utahensis
atgatggacggccagacgttcggccggaagctcggcttcggagtcgggctgaccggcctgctcaccctgctgtcggtggtggtctccaccctctgcctgctgttcgtggtgcacgccaaggaccgggtgatcgccgcggcgacccacgagctgaccggcgcggagaacctgaaccggctgatggagaaacggctgggcgactaccggggcttcatgctctacggaagcgacgagttcgccaccgccaccgggcaggaccgcgccgacttcctcgcccagctcgccgacctgcagaacgactccagtacggcggtcaaggcgttgctcaagcagaccgccgacgccgaggccaagcacgccgaatgggtcgacgtggtgatgcagaagcggacccagacgaaggatccgctggccgcggcggcgctcaacaacactcaggcgatgccgctgcgcagacaggtgcaggcgaccctcgccgacctgatcgccacggtgcgctccgacgtcgaggccgaccgccggcactcgtcgcggcaggcgaacctggcgatcgcggtgatcgtcgggctcggcgcgctcaccacggccagcgcggtcatggtggcctggcgcctgagccgggacctgcgccgcgaggtgggcgccgcggtcgggcacatccagagctcgtcggcccagctggaggcggccgccgcccagcaggtcaacggtggccgggaccaggccagcgcgatcaacgagatcaccaccacgatcaacgaactgctgatcacctcccggcagatcgcggacagcgcgcagcgggtgtcccagatcgccgaggagaccgaggcggcggcccgcaccggggacgccaccatcgaccagacccgggcctcgatcaccgcgatccgcacccaggtcgaccagatcgtccagcacatgctggcgctgggcgagaagtcgcagcagatcggcggggtcgtcgacctggtgtcggagctggccgagcagaccaacatcctggcgatcaacgcgaccatcgaggccagcggggccggcgagtggggtcgccggttcgccgtggtggccgaggagatccgcaagctggccgaccgcacggccgcctcagccaaggagatccgggcgctgatcgacgacgtgcgcggcgcggtgaacaccacggtgatggccaccgagatcggcgccaaggcggtcgacgccggcgcccggcagttcgacgaggcgaccaactcgttccgggagatcgcccagctggtgtccaccaccaacgacgccacccgggagatcgagctctccaccaagcagcagaccaccgcggtggagcaggtcaacctggcggtgtcggacaccgcccgggtgtcccgggagaccgagagcagcgcggtgcagaccaagcagaccgcggcgcacctgagcaccctctccggcgacctgctggagctggtcgggacccggagccactga

SEQ ID NO: 6069 - DNA, 534 bp, Actinoplanes utahensis
gtgaccgaccgggtgctgtcccgggtcgaacggctgcgggccgagttcgaccactcgttcgcggtgccgctgcgcaccctggacgacgagtcggtggagctgctcgcggtcggggtcggtggccgggcgtacgcgctgcgcctgtcacagacctcgggcctgtacccgaaccggccggtcaccccgctgccgaccaccgtcccggcgctgcgcggcctggccgggttcgccggcgtggtggtcccggtgtacgacctggccgcgctgctcggccacccgatcgccgagcagccgcgctggctggtgctggccgccgggagcccgccgctggcgctcgccttccaccagctcgaccaccacgtccgggtgccgtccgccgacgtcgtcgacggttccggggcggcgtcgtcccggggctgcctgcgcgggatggtgcggctgccggacggcgaccggccgatcgtcgacgtgccggccacccgcgtcctggcccaccggatggccgggcacgaacacccggaggtgtcctcatga

SEQ ID NO: 6070 - DNA, 1377 bp, Actinoplanes utahensis
gtgagcggcgagccgcccctggtgcgattccgggaaatcctggagcggcggctcggctgggccgccgccgacaccgaggcggtgccggtcctgccggtcctcgccgaacgcgcggccgcccgccagctgaccgaatccgcctacctggatcggctggccggccgggcctggccggaggagaccgtgatcctggccgagcggctcagcatcaccgagacgtacttcttccggcacggcgaccagttccgggcgctcgcctcccgggtgctgccgcagcggatcgaggcccgggccggccagcgggtgctgcggatgctctcggtcggctgctcgtccggcgaagaggcgtactcgctggcgatcgtggcgcaccgggtgcgaccggccccggactggatcgtcgcggtgctcggcgtcgacgcgaacccggaggtgctgcgccgggcccggcgggcggtctactccgagtggtcgctgcgggagaccccgccggacgtgcggagccgctggttccggtcggtcccggacggctacgaggtggcccgggagatcaccggctcggtgcagttcgtcgagcacaacgtggccgggccggaggatccacggatctggcagcccggccggtacgacgcggtgttctgccgcaacctgctgatgtacctgaccccggcgacggtccgcggcgtgctggaccggatcaccggctcgctggccgacggcggcgcgctgttcctcgggcacaccgactcgctgggcagcgccccgccgggcttcaccgtggaacaccacggcgacacggtgttctaccgccgcagcatcgcagcgcccaccccgcagcccgcgccccgggccgcgccgccgcgggtcgcgccgccgccacgggtgcggtcaccgcgtacgccggaaatccgctcgcgagcccttgatcttctgcgggacgagcggttcgccgaggccctcgacctgctcgccccggtgtcgtcgcagcatccgctgctgtacggcgtgctgctcgcccagctcgggcggctcccggaggcggccgccgtggccacccgcctgatcgacgccggcgctccgcagccggacgcgcaccagctgctcgggctgtgccgggagatcgacgaaccggatcaggcggccgcgcagtaccggctggccgcctatctcgatcccgggttcgcgatgccccggctgcggctggggctgctggcccggcgcgagggcgacgagacggccgccgcggccgagctgaccgccgcgctggacctgctgccgcgcgagtccgaggagcggatcaccctgttcggcggcgggttcgggcggctcacgctgagtgtcctctgccgggccgagcgggacggggcacggcggtga

SEQ ID NO: 6071 - DNA, 534 bp, Actinoplanes utahensis
gtggggcagctacgacaggctccggcgggcgaggccggaacgatcgcgctggtcttccaggccggtccgcttttctgtgcgctgcccctcgccgaggtcatcgagaccatgcggccgctgccgacccgcccgctggccggcaccccgtcctatgtccggggcctgacgatcctgcgcggcgagcccgccccggtgatcgacatgacccggttgctgaccggcgtgtcgtccgggatcgatcggtacgttgcggtgcacgccggacgcggtccggtggcctgtgcgaccgggccggtgctgggcgtgcggaccgtgcacgcggtcccgccggagggtccgagcacgctgttcaccggagcatcccgctcactggtcgcggcggtcggcacggtcggcaccgagccgctgctggtgctgcgcagcatccgcaccgtcccggacgaggtctgggacgccgccggccgcgaccgggacaccgcggagccgggcaccgcgcaggcggtcgcggcacacgacaccggagcgaccgggtga

SEQ ID NO: 6072 - DNA, 264 bp, Actinoplanes utahensis
gtgccgcgggcggcccggttcgggccggctccggcgagcggccgcccaccgcgtccgccggagccggcggctcactccttgtccgcccaccaggtcgggatcagcgactccggctggcgtttcgccttccgggacagacggccccgggacgggcgttcccgcttctcggtggaggcgccggcgctctccgtactgtgccgggcggccggcggacgccgcccggcgaccggggtgccctcccggccggcgtcggtccctagctag

SEQ ID NO: 6073 - DNA, 1122 bp, Actinoplanes utahensis
atgcgcgttccgcgtggctacggttccccggtgcgcaaccgatacctggatctgctccgtgccgcggcgatcgtccgggtgatcgtctaccacctgttcggctggtcgtggctgtccatcgtgatgcccgccatgggcgtcatgttcgccctggccggctcgctgaccgcggcgtcgctggagcggcgcccggcccgggacgtggtcacctcccgggtgcgccggctggtgcctcccctgtggctgctcggcctgctcgccgtgccggtgatgatcgctctgggctggtcccgggaacacgggggcgagcacccgttcaaggtgtggaagctggcgttctggatcctgccgctcggcgatcccccgggcagcgagctcgccgtcgacgcctgggaaccactctggtacatccgggcctacgtctggttcatcctgctctccccggtcctgtggttcctctggaagaagctgggtccggcctgctggctgctggtgatcgccccgatcctggccatcgtggcgctcgacaagaccggcttcgagctgccggagaccgccgacgtggtgatgtgggacttcgtcacctacgccgcctgctggatcaccggtttcgcccaccgcgacggccggctccgcagactcgccccggccacggtcgtgttcctgttcgtgacgctgtcctgcgccgggctgtactaccagagcggccaccagggtgacgatccgtgggacctgaacgacgtctccgagtcgcagtcgctgtactccctggccttcgtgctgctggcgctgcgctggcagccgagcatgacctggctgtcccggaccaacctgctggaccgcgcggtcaccctgctcaacgcccgggcggtcaccgtgtacctctggcacaacctggccatcgccgccgtctggccggtcctcagcttcctgaccgccgacgacctgggccacctggagaagccggtcaccctcgggatgacgatgacgctgaccgcggtcgcggtgctgctcttcggctgggccgaggatctggccgcccgccgccgcccgcggctgtggccggacaccgccatcccggcggccgccgaccccgcgccgaccgcccccgctcctagctag

SEQ ID NO: 6074 - DNA, 783 bp, Actinoplanes utahensis
atgcgtaagccttcggttgtgctctccgtggctaccgcggccctggtcgccggtggtgtcgccacgacacgcgcgctggcgcaggagccgccggatgtcgccggcttcacgatcttcggcggtcccgtgacgtccgacgcgtcgccggcgccggacgatgccggcccggatcccgcggccgggttggggaccgcgccggccacgatcccggcccgcgtgatcacccgcaagccggccgccgagcccaccgcggagcccaccgccgagccggccgtcgaacccgggccgatcaaggcggtcgccccgaagaagaactacggcttcgccgccgcggccgacccgatcgccgcctcgcacaccgaggtgaccgtggaaagtatctcgtccagcccgtacgccccggtccagcagcagatcctggccctggtcaacctccagcgggggcgggccggctgccgaccggtcaccatcgaccgccggctgatcgacgcggccaacggccacgccgccgagatggcccgccgcgactacttcgaccacgcctcgccgaacggcaagggggccggggaccgggtcagtgcgaacggctacccgtggcgcttgtacggcgagaacatcgcccgcggccagcgcagcccgtgggaggcgatggacgcctggatgaacagcccggagcatcgggccaacatcctcgactgcaagctcgaccagatgggggtcggcctggccatcgacggcggccacaccccctactgggtgcaggacttcgccagcccccagtag

SEQ ID NO: 6075 - DNA, 753 bp, Actinoplanes utahensis
gtggcagtgaaacgtgttagcgcacgtctcacgacggcggccctggccgccatggtgggcggcgggctgggcgcgttcgccgtgacgccggcgagtgccggcgccgccgtgcggaccacgccggtggccacctcggtggtcacccgggcggccgcttcgtcgtgtgccaccggtaggtaccagaagcaggttgagacgtatctcaagcagctcggcggatacggcacggtgaccgtcgacggcaggcagtcggccgccgactgtgccgcgatcgtccggttccagaagcggttcggcatccagccggcccagggcctggccgggccgaccaccgtcgacgtggccaagcggctcgcctcgacgaagatcgcggcctgcaagccgaaccggaagggcatcaccttctgcgtcgatctgaccaaccagacgacgtgggtgatgaagaacgggaagctgttcgtcaagccgaccatcacccggaccggcatgaagggctaccacacgccggccggcaccttcaagatcaacaagcggacgccgaaggagtggtccgacccgtaccacgtctggctgccctactggcagcgcttcatcggcgggcgtggcttccaccagaccaccacgtacctccacgacaagtggcgtgggtcgcacggctgcgtcaacctgctgccgcaggacgcgaagcagtactacggcatcggcacgatcggcatgaccgtcaaggtgttcgggcgtcgccccggcacctga

SEQ ID NO: 6076 - DNA, 1353 bp, Actinoplanes utahensis
gtgtgctctgtgtcccggaccccctcccgcagcgcgctgatcaccggcggcaccgcggtgctcctgctgctcaccgccgcgtcctgcaaggacgacaacgccggggtccacctcggcaccgccaccatcggcacggtcgacgagatcgtcgaggcgcccggctcggtcaccgcccgcggcgccgccaccctcaccgcgccggccgccggcaccgtcaccgacctgcgcgtccagcccggcgaccgggtgaagaagggcgacgtgctggcggtcatcgactccccggagctgcggcagcgccgggacgccgcccgccgggccctggcgcagaccccgtccggcggcggtggcggagtctcggccggcaacttcacccaggtccgccggagcaccgaccggcaggccgggcaggcgttccaggacgcgctcacggccgccgaccagatcaccgacccgaccctgagggacgccctgcgcaaacaggtgtccgccgcgcagcagcagtaccgggcggcgtcggcggcggccgcctccgcggtccgcgcggtgcagcgcggggtcgcctccctcgggcaggcggtcagctcgctgtccgcggcacaacggctccaggcacagcaggcgtacgagttggccgacgccgccgtgcgggcactcaccctgaaagccccggtcgccggcgtggtccagttcggcgggtcggcgtcccccgccgccccggccgacctctccgccctcctgcagagcggcggcgccaccaccggcgccaccaccaccgcgggcggcgccgagggcgtggacaccgcggtcaccgagggttccccggtgaccgccggagccccgctgctcaccgtcgtcgacgtgggccggctcggcctcaccgcccaggtcgacgagacggacgtgctgctcgtcaagcccggggtgaccgccgacgtcgagctggacgcggcgaccggggccgcctacaccgcgacggtcggctcggtcgacctgctgcccaccacctcggcccgcggcggcgtctcctaccgggtgcggctcgacctgggcgacggcacctacaccgacggcagcggagcggcgccgacgccccggcccgggatgagcgcggtgatccggctccgggtgcgccaggtgcagcaggcggtgaccgtgcccgcctccgctgtggtcagcgccgacgggcacgacaccgtgtgggcggtgcgcgacgggcactaccgggcggtgccggtgcgtctgggcgtgcagggggaggacaccgtacaggtgcaatccggtctccccgccggggagcggatcgtgatctccggagcggaccgggtgcacgacggcgccgaggcaccgtga

SEQ ID NO: 6077 - DNA, 687 bp, Actinoplanes utahensis
gtgaccacgcccgccatcgtcgccacggacgtcacccggacgtacgagctggacggggtgtcggtgcccgccctgcgcggcgtctcgctcaccgtcgagcccggcgactacgtggccatcgtcggcacctccggctccggcaaatccaccctgatgcacctgctcggcggtctggaccggccgaccagcggcaccctgctgatcggcggccgcaacgtcggcgagctcaccccgaacgagctggccgaactgcgcaacaccacgatcggcttcgtcttccagtccttccacctgctggcccgcaccaccgcgcaggacaacgtcggcctgcccctggtctaccgcggggccggccgccgggaacgccgcgcccgggccgccaccatgctgcaacgggtcgggctcgcgcaccggatcacccaccggcccaaccagctctccggcggcgaacagcagcgggtggcgatcgcccgggccctggtcaccggtccgtcgctgctgctggccgacgagccgaccggcaacctcgactcggccaccgggcagtccatcctggccctgctggagtcgctgaacgccgagggcgtggcgatcgtgctggtcacccacgaccgggacgtggccgcccgggccgggcgccagatcctgatgcgggacggcctgatcgtcacggacaccgccgagtga

SEQ ID NO: 6078 - DNA, 1185 bp, Actinoplanes utahensis
gtgagggtcgccgaggcctggcgggtcgccctcgacgcgctgcgcgccaaccggctgcgcagcctgctcaccatgctcggcgtcatcatcggggtggcggcggtggtcgcgctggtcgccatcggcacgggcaccaagcagcagatcgagcaccaggtggaggggctcggcagcaacctgctgatcgtcgtacccgggaaactggctgtcggatccgcgcccaccagctcaccgatgaccctcgccgacgccgacgcggtgagccgcgtcgtcggcgaccgctcccgggtcgccgtcaccatcgcgtcgggggagaccgtccgggccgggcagcggtccggcttcgccagcatgcagggcgtgctggagaccaccccgtcggtgttcgtccggcacctcgcccgcggcgcctacctgacccggaccgacgtcagcaccggccgccgggtcgccgtcctcggcgccggcgtggcccgcaccctgttcggcgaccgcgacccgatcggccggcagatgaccgtcggtggcgtccggttccgggtcatcggcgtcttcgaggagctcgggcagagcctcggtgtcgaccgggacaacgaggtgcacgtgccggtcaccgcggcgcaacgactgctgggcaccgaccggatcgacggcctggcgatccgcgcccccgaccgggacaccatcgaccggctcggcaccgacgtggtcgccgcgctcaccgaacgccacccggacaccgacttcagcgccgtcacccaggaacagatcctcggcgtgctcggcgacatcctcggcgtgctcaccggggtgctggccgcgatcgccgggatcagcctgctcgtcggcggggtcggcgtgtccaacatcatgctggtctcggtccgcgaacggaccagggagatcgggctgcgcaaggcggtcggcgcccgcccccgcgacatcggtgtccagttcctcctcgaagcggtgctgctgaccaccaccggcggggtggccggcatgctgctcggcgccgccgcggccctgctcgtcgacggcctcagcccggtccccgccgcgctcacctggtggtcgatggccctggcgttcggggtgtccgccggcgttggcatcatcttcggcgtcgtaccagcacagcgggccggtcgcctcgatccggtggtcgccctccggacggagtga

SEQ ID NO: 6079 - DNA, 849 bp, Actinoplanes utahensis
atgcaccaacgggtacccgcaccactactggtgctggcctcgatcgcctccgtgcagttcggcagctcggtggcccgcaagctcttcggcgacctcggcgccaacgggatcacgttcctgcgcgtcggcctcgccgcactgatcatcgcggcgctcacccgcccccgggtgcgcgactggccccggcgcgcctggctcgccgccgccctgctcggcgtcgtgatggccggcatgaacctggtcttctaccaggccatccgcaccgtgccgctgggcaccgcggtcaccgtcgagttcctcggcccgctgctgctcgccctggtgcagacccgccgcctgaccgacctgctctgggcgctgctcgccgccgccggggtggtgctgctcggcctgcactccggcggcgccgcaccgctcgccgggctcggcctggcgctgctcgccggactgttctgggccggctacatcgtgctcagcgcccgggtcggcgcgctcgtcccgggcaccggcgggctggcggtctcgctcagcgtcggcgcgctgctggccgccccgttcgggctgcccggggccggcgccgtgctgtaccacccgcacctgctgatcggcgccaccggggtggcgctgctctcctcggtcatcccgtacgggctggagatcaacgcgctgcgccgcatccccacccggatcttcggcatcctgatgagcctcgaacccggcgccgcggccgtcgccggactgatcgtcctcggccagcgactcggcccgatcgaggtcctcgcgctgctgctggtcaccctcgccagcctcggtgtgaccttggccgctccgcagccggcaccggtctga

SEQ ID NO: 6080 - DNA, 1047 bp, Actinoplanes utahensis
gtgccctatcagttgcgtgaccagcacggtgcatcccgtgccgtcgcctacctgatgatggtggccggaccgtacaacctgatcaccggcgtcctgatgaagatcggcgcgccgatcgccgaactgatctcgctcggtgtgaccgcagtcgccctcatgctggtcggcgtgctctgctggcgccggccgcaggtcctgccgaaactgttctggcccgccgtgcccctgctgtccaccgccgtggtcaccggcctgaactacgggacccgggacgcgagcaccggagcccaactgttcttcctgtggccgctgctgttcggcgcgtgcttcctcggccgccggatcaccacgctcaccgtcgtgatgatctccgccggacacgccctgatcgcgttcagctacctgccgatgagcggtgccctcaacgactggatcgcgatgaccgtcgcgatggccatgaccgcctgggtggtgaccagtctcaacgaccgcaacgaccggctccggagggtgctgcagcagcaggccaccaccgactcgctgaccggggtggcgaaccgccgggccctcgacgaggcgctgcacgaggcggtccgcgacgccgacgccggcgccgaaccggccgcgctgatcgtgatcgacgtcgaccacttcaagaagatcaacgacacccggggacacgccgccggtgaccaggcgctgcgcgccgtcgccgacgcgctgcgcgccgcgggcgacggcctggtggcccgggtcggcggcgacgaattcgcggtactgctgcggaccgggccgacagaggctttccggtacgccgagaccgcgcgcgccgcgctcaccgcggtgcccgcggcgccgacactgagcatcggggtggccgtggtgccgcaccactcggccgcgtccgccgacgaactgcaacgggtggcggacgcggcgctgtaccaggccaaggaagccggccgggggcggacggtgatcgcctcggctccggcgcggcagaacgtcgaccggattcctgaggcgcgggctacgtccgctttctga

SEQ ID NO: 6081 - DNA, 768 bp, Actinoplanes utahensis
ttgctgagcgtacgcgccgaggtgtaccgcctgctcggcgagctgggcatggcggcggcggcgagccggctggcgctggcgcatgcggagtcggctcaggacgagcagtcgatggtgatcgcgcaggcggagctggcgcatgtgttgcggctgcgcggggactggatggaggcggatcggctgttccagcgggcggtggattcgcaggtgtcgccggcggtgcgcagtgtggtgcacgagaatgccgggcggagcgcgttcgatcaggggcggcacatggaggcgctcgatcatttcgcgcgggcgatccggctcggggcggacgaggacaccgatctggtggagcgggtcggggtgtgcctggaggcggtctacatccatgtcctgcgggacggctggggaccgtatccgcggcgcccagaggagatcctggcaccgctgaccggccgcaacgccgaggaaccgcccgaaagcaagggccacaccgccgaggagccggccgcaagcaagagccacaccgccgaggaaccggccgcaagcaagagccacaccgccgaggaaccggccgcagacaagggccacaccaccgaggaaccggccgcaagcagaggccgcgacggaaccggaaacccggccacaggcgaaagatcggacagcgccacctaccacaacccagccacagcagacagccacggcgggcacggcatccgggccgacgctttcagcgagccgaccgcggaacagaagaccgtcagaaagcggacgtag

SEQ ID NO: 6082 - DNA, 2130 bp, Actinoplanes utahensis
atgccggcgtcaatgaacggcccgggagcaccgggcgatccggccggtacgccgcacttcgagcgcccggtcgcgccgcctttgcgtctgctcggcgcccagccggggcagccgaccacgtcgcacccacggatggctggaccgcagccggatcagccggttgcgccgcctccgggactggtcccgtcgcagtacacgggcagcaccggcggcccagcctcgccgcctccgatggctgcgcccggagtagtgccgccgtatgccggctcagagggaacggcggccgctccgcagggctggcacgccggtccgggcggcccggtgaccccgcacgggcagcacgccggacccatgggttcggagacaccgcacgggcagcacgccggtcccggcggcccggtgaccccgcacggacagcacgccggacccatgggttcggagacaccgcacgggcagcacgccggacccatgggttcggagacaccgcacgggcggcacggggtggcgccgggcagtccggccgctccgcacggcaggccggtggcgctgcccaacggctttgtgcccaagtccgaccagggtgcggtgccaccggtgtccggtggtgcgccgggcggtcccggagtccccggtgctctgccgaacagcggaaccgccggtcctgcgccgttcgagtcggggcgcctgacgttcccgcctggaactttgccgcagcaaggtgtccatccgcagtcgccatcggcgcccggctgggtgccggatcaagcggtcgtgcagggtccggctcagccgcagaatcccgccgccgcgcacccggtctcctcgggcgcgcaccgggagggtgtctaccaggaggccgcccatgcggccggcggccagccggctttccctgccgcacagtggaacgccgacccgcacggcacggaccaggtgggtcgtggcttcgaacgagcagcccacagtccggaggggccgggccacactcgggaggcctggccggtctccggtgccgggcactgggaggcgaaccagcacggtggaccgctgccgcatggggcggtccggcagggcgtgccgcaccagcgcccgatgcccgaagcgccgtggccggtctcttcaccaggacaggcaatgcaggcgcagccaggcctaggacaggccgtcccagcacaggccgtcccaggacaggccgtcccaggacaggccatcccagcacaggccatcacaggacaggccatcccaggacaggagcgggtcaccggcgaactgccgctggtggcggcgcgcgatggcggcgggccgacaggcgagttgccgctggtagcaccggcggacagtggcgggcctacggacgagttgccgttggtggcgtcgggtgacgacagctgggggccgcgggccggacaacgaccggtctcccccgcgccgggaaaggcttggctcccggcgcctcgaccggattccagcgcggcgccgggcgcgaccgacgcagcgctcggcgcaaccgggcctgtaccgggaacgatcggcgcggccggtgcggcgcccggcgcaaccggacctgtaccggaagcggccggtgcggtgtccgggccggccagcggtggggcgtcgggtggcggggagccggcgccgtacatggatgcggacgggacctggcacaacctgaagccgatcgggcggctggagctgtccgggcctgatcaggagcctcgacggttctcggatccggcgttcggcagtgggtggttcgtcaccaagaccgcggcggccaaggaggatgcggcgggggcggccgacggcgcgggcggccggggcagcgacggcactgccgtccggcgatccggcggcgaggccggcgtggcgacgcgcgcggtgaccgatgcggcggctggatcccaggaccatggatcccaggaccacggatcccaggaccacggatcccaagaccacggtattcaagaccgcccaacccaagatcacgcaactcaagaccctggagccgagaagagcggatcccacgacagcggaacccaggacggcggagcccaggccccggcgatcgtcgaacccacacaggcgggcggcagcgcggcgcgcggaaacgacgcgggccggcgcgctagctag

SEQ ID NO: 6083 - DNA, 162 bp, Actinoplanes utahensis
gtggccgaccggtacaccgggctgctggtcgactggcacacccggctgctggttgaggggtacaccgggctggtggcggaccggtacacccggctgctggttgagcggcacaccgggctgctgactgatgggcagcggcgaagtggcggcctggccgggtga

SEQ ID NO: 6084 - DNA, 2640 bp, Actinoplanes utahensis
atgagcttcgaggacgacgaatactgggacgaggagtacaacgaatactccttcatgccgaagtacgcggtagcccaggaacgccacttcgagaagcggaccgcccccgacccggtcatccccacccgccgctcgaacacggacagtgacgactcgggggctcgtcgaccccgggcgccgttcgacgaccagcggcccagctggctcgacgatccggacttcgtgccgatcgacacctcggtcgacaacctgtccggggactacttcgacgacatcgacttcaaccggcccgagctggggatcgacttcgacaaaccggactttccgatcgtggatccggctgctctgcagaatccggagcggcggcagcggcaggcggggcggccgggtgatcggtatggcgcgccttcggggcggcgggaggacggtgctccggtccggcgggatgccgggctttcaccgcggcgggatggtgcggcctccgggcgccgcgatgaatcatcggccgggcggcgggacgatgcgctgccggggcgacgggaaaactcgttgcccgggcggcgggacgatgcactgccggggcggcgggacgatgcactgccggggcggcgcgaggacgcgctgtccgggcgggacgccgcgtcccccgggcggtgggacgacgcgcgtgggtcgcggccggtggagcgccgggatgacgaccggcgcggacggcgcgaggacgaaccccggcgtgggcggcgcgaggacgagcggtgggacgggccggaaccgcggcgccgcgatgccgagatcgacgcggacggccgcgggcgggtgggcgaacggcgcggcagcggaccggttccgcgacccggcgaccgcggacgcggtacggtctcgcagccctgggaggacgaggatttcgggccgatccggccggtcggcggccgccgaccccaccgcgacgacgaggacccgcggcgcggcccggcccgccgtgacgatcggacgggcgccgtcaccggacgggctcaggtacccggcggcgaggaacggctcgacgatcgcaggcgcgccccgctggacgctgatatttccggcatcgaccgcaggaagcggccggtggacgccgacgttcccggcgccgacggcgagattcggccgctggacgcctccggtgccgaccgccggaaccggccgctggacgctttcggcggcgaccacgagaaccggccgctggacgtttccggtgccgaccgcaggggcgtgccgctggatgccgatgcttccggcatcgagcggcgttcggacggtccccgggtctccggccgggccggctcgccagcccgggacgacgagccgatcgacctgcacgcccaggactggaacgccccgcgggcaaccacgggctggaacaacaccaacgccgagtggcccaccgccgacaccgaaaggtccgccgccgccccggagtggaacggtagccccggccattgggacggcgccgccgaccagtggaacaacgactccgaccagtgggacggcgagccccaacagtgggacggcgagccccagcagtgggacggcgagccgcggcaatggaacggcgagcacgagcagtgggaaggcgctgccgacccgggccgggccggccagggcgtgcccgcctggaccgcggacgagcggtccggccagcgggacgaccgtgccatcggccgggacgaccggaccggcgaggacgacgaccgccccatgggcgtcagcgtgccgacggtgctggacggcgagtactacgagaccccggtcgagccgccggcgcaggaccctgcggccaccggggacggcaagccgcgggtggtccgccgggccgagccgccggctccgcccaaggtggtcagccgggccacccctcccccggcgccacgggttctcaagagcgagccgccggtcgccccccgcgtcgtcgccgctccgcagccgaccccgccggcccggatcatcggtccgaacggcccgcaggtcccggtcgcacccgccgcctccggctcgccgactccgtcggcttcgcccgcgatgcccccttcgtcaccggagtccccggtcccggtctccgtcgattccggtacgccggcagccccccgccccggcccggccacacccgtcagccccaccgccgcggaccgtgccggccaccacccggcaccgctctccgccatggaccaccccgccggctcggcaccgtcgaacaccacacccagcgcaatgccggccgacccgcgcttcgcgaacccccacccgccgttccccggcccccagcagacgcccggtgccatcccccaccagcccggtgcgcccggccagaccggtggccccggccagttcgtcgattctcagcggctcaacggccccggtcatctcaccgacccgcggcagacagccgaacccgggcagatcaccggttcccgccagggggccggcccggcctcgcccgccgacctgcggcaggtcggcggcccgactcagcttcccgacccgcgagcggtaagtggagcaccgcagcccggcggaccggctcaggatcccgactcccggcagttcggcggaccggcacaggtttccgacccccggcaggtcagcggaccggcgctagctagctag

SEQ ID NO: 6085 - DNA, 372 bp, Actinoplanes utahensis
atgttcgccgttccgtcgcctggccgtccgcgggaagccgcctctcgtccccgggcgaaatgtcgggaacattctgtgaatcgaagcctgccactaggaaccgacgtcaccgaacgtcatgatcagcgcgtgatgccgacgcccgggacgctgcgactcgtggcgacgctcggtgcggtgccgggcctgcgtccgaccgtggacagcgcgatcccgccgatggtgacctgggaggacggcccgagcgggcgcgccgcggcgcaagcactggtcgccagcggatatacggtgagtgagcagttctggggcggcggggtggtggacgtgccgacctcgaaccatgcgtattccagcgcgtcctgcggcccgtga

SEQ ID NO: 6086 - DNA, 1152 bp, Actinoplanes utahensis
atgcgcatcgcgctggtcacagagtccttcatgcccgacgtcaacggcgtcgcccactcggtcgtccggaccgcggagcacctgatccgtaccggtcacgaaccgatcgtcatcgcgccggtgccggcgcccggaccggtcccggccaccctgccgtacccggtggtccggatcccgtcagtgccgatgccgggctatccgcagatccggctgggtctgccgatgccggccctgcgggcggcgatccgggatcatcgcgccgaggtggtgcacctggcgagcccgttcgtgctgggcgcctgggcgcgtaccgccgcgtcgagcctcggcctgcccacggtggcggtctaccagaccgatgtggcggcctacgcccgcgcccgcaacctcggcgtctgcgaggatctgtcgtggcgctggatccgccggctgcacaacgccgccacccgcaccctggcgccgtccaccgagtcgatgacggcgctgcgcacgcacggtgtcgagcgcgtgcacctgtggcgccggggtgtcgacgacgtccggttccatccgggtcggcgcagcgccggtgtccgacgcgcgctgtgccgcgacggcgaagtgctggtcggtttcgtcggccggctcgccgtcgagaaagaggtcgacctgctggccggcgtctcccgcctgccgcatgtccggctggtggtgatcggcgacggcccggccgaggcgcacctgcgccgggcgctgccggaggccaccttcctcggcgcccggcacggcggccagctcgcccggatctacgccagtctcgacgtgttcgcccacaccggcccgttcgagacgttcggccagaccgtccaggaggcgatggccagcggcatcccggtggtcgcgccggccaagggcggcccccgcgacctggtccaccacgaccacaccggtctcctggtccccgcgcacgaggagacgggtttcaccgatgccgtcgcccggctcgccgccgacccgtcgctgcgccgcgcgatgggcgccgcgggccgtgccgcgatcgccggccgcagctggtccgcggtcggtgaccagctgctccaccactacgccgaggttctcggcaggccgctcgcccgtcaggaggttgcccgcccccgggccgctgccgcttga

SEQ ID NO: 6087 - DNA, 1632 bp, Actinoplanes utahensis
atgaacaatgaccgaaccggagtccggcatcgccttctggacgcctgccgttcgtccaggctcggcctgctggtcgcccgtcgccgggaccacctgccggtgctgacgacgcgggctctgcgctgggccggtttcggtggtgccctgctgctcgcgctggccggcctgttcggcggggcgctgccggacgagggcggccacaacctgccggtcaccacgctgtggctggccggcacggcgctgctggggtacgcgtggtggtccggccgggatcgcgagctgagcccccgctgggtgctcggcaccgccgcgctgtgggcggtcccgttcctgctggtgccgccggtcggcagccgcgacctctattcgtacagctgtcagggtgagctcttcgcgcacggcctgagcccgtacacgtcgaccgcgcagaccctgccctgctcgtgggtgggtgcggtgccgccgatctggcgggacacgatcaccccgtacggtccgctgttcgtcctgctggccggtgcgatcatcctgctcggccaggcggttgcgctcccgtccggcctggtcgacgcgctgccgccgcacctgggttcgctgatcctgccgctggtcctgttccggctggtcgcgctgggcggcgtggtggccatggcggccgggctgccggtgctggcccgccgctgcgggatcgcgccggcccgcgccctgtggctgtcgctggccggtccgctgatcggcctgcacctgctgggcggcccgcacaacgacgccgcgatgctcggcctgctggtcggcggcctggccgtggtcacccggtgcccgcggcactgggcggcccgggtcggcggcggggtgctgctgggcgccgcggtcgcggtgaaggccacggccggcgtggccatcccgttcgccgtgctgatcgtcgccgccacctaccggagccggctccagggcctggtgatcggcacgctcgcggtcgccggctcgtcggtggccgcgctggccggcatcaccgtggccggcgggctcgacctcggctggatcgccggcctgtcggacagcggcgccctggtccagttcagttcgatgcccaccgcggtcggcatgaccatcacgtacgccggccggctcttcgatccggatttcgacgccgtgccggcggtccgcgcggccgcctacgccgtgctcgcggtcgccctggtggtcatctgggtccgggcgttgcgggaccgcgccgacccggtgcgggcggcgctgttcggctcggccgccgcgatcgtcgccacggtcgccctggccccggtcttcctgccctggtacatgttgtggccgctgaccctgctggcggccaccacgctgcgcaccaaggcggtcatggtgatcaccatcgtggcgtcgttctcggtgctgccggacggctccgggctggtccggtcgctgaagttcccgggcgccccgatggtgaccctctacctgatctacctcggtgtccgccaggtgcgccggtggcgcggtgggcgcgagcttcaggcgctggtcgcggccgacggcatcagcgaggccgagccgagcacccgggcgacggcgacctcgatgaccacccgggccgggttggggcgcggcgtccggtaa

SEQ ID NO: 6088 - DNA, 1422 bp, Actinoplanes utahensis
atggacgcgacacccaccatcggcagccctgtggtgcccggctcagcgggcgacgagggcttcacctccctgcgccgtcccgcacggccgcgcgccgaacgatacgagatgggccgggctctgcgcgagcggtccccccggtcggacgtggcgcagtggcgtccgccggccgaccggcccgacccggtgggtcaggtgcgggcctcgcacgagggccggttgccgtggctcgtgccggtccggatcggccggatgatcgccagtccctacgcgttcctgcgcggcaccgccgggctgatggccgacgacttcgccggcctgccgcacaccggcatcaccccggtcatctgcggcgacgcccacctcggcaacttcggcttctacgcctccccggagcgggacctggtcttcgacctcaacgacttcgacgaggcgcaccccggcccctgggagtgggacctgcgccgcctggtggtcagcgtccacgtggccggccgggtcaacggcttccgggagagcgcctgcgccgaggcggtgcagcactgcgtcgaggagtaccgcgggcagatcgccgatctggccgcccggccactgctggcccgctccttcgaccggctcaacgtcgacgcgatgcggtcggtggcgacccgcggcagcttccgcgacgagatcgagcgggccgcccgccgggcccggcggcgcaccagcgaccgggcgctgccccggttcaccgagcggcgcgacggcagccgccggctggtcgaggagccgccggtgatcacccggccgtcggacgccgaccgggacctgctcgacgaggccctggacggctatctgaacacgctcaaaccgcactgggcgcggatcctcggcggctaccgggtcatcgacgtggcgcacaaggtggtcggcgtcggctcggtcggcctgcgggcgtacgtggcgctctgcgagggcagcgacccggaggacgtggtcttcctccagctcaagcaggcccgccggtcggtgatcgcgaaacaccagcacggcgcgctggcctggcaccggcaccaggggcagcgggtggtcgaataccagcaggcgctgcagacggtcagcgacccgctgctgggctggaccaccgtgggtgagcaccagtactacgtgcggcagttccgcgacatgaagggcgccatcgtcgtcgaggacatcaacgccggtgcgctcgccgactacgccgggatctgcggctacctgctggccaagtcgcacgcccggaccagcggggcgtcgatgatcgccggatactgcggcggcagcgacaagctggacgagtcattggccaagttcgcccggtcgtacgccgaccaggtggagaaggatcatcaggcgctcgtcgcggcggtccgtcgcggcgagctggcagcggaggtggcatga

SEQ ID NO: 6089 - DNA, 1014 bp, Actinoplanes utahensis
gtggagaccaagggatcacgttccccggcgatgaccgacgtggcacgtctggcgggcgtctcccaccagaccgtctcccgcgtgctcaacgatcatcccaacgtcaaggagcagacccgcctgcgggtccgggccgcgatcgccgagctcggctaccgccccaaccgggcggcccgcgccctggtcaccggccggtcccagctgatcggcgtggtggcccgcaacagcatgctctacggcccggcctcgatgctcaccgagttcgagcaggcggccgccgacgccggcttcgcggtcagcgtcggcagcgtgcgtgagctggaccgggactcgatcgccgcggtcgtcgaccggcacctggaccagcgggtcgccggcctggtggtgatcgcccaggtcgcctcggccaccgaggccctcgccgagatcccggccgacgtaccggtggtctgcatcgacggcgacccggcggccgggcgctcgctggtcaccgtcgaccaggtggccggcgcccgggcggcggtccggcacctgctggaggccggccacgagaccgtctggcacgtctccgggccgaccgactggttcgactcggccgggcgcatccagggctggcggcagaccctgcaggaggccggccgggaggttccgccgctgctcagcgccgactggtcggccgccgagggctaccgggccgggcagatgctggcccggatgccggaggtcaccgcgatcttcacggccaacgaccacctggccctgggcgtgctgcgggcactgcacgagcggggccgccgggtgccgcacgacgtcagcctgatcggcttcgacgacgtgcccgaagcggcctatttcatccccccgctgaccaccgtgcgccagtcgttcggggacgtggcccgggccgctctgacacttctgctgggacagctcagggacgccccgcggcccgccgatacggtgatcgtcccggcacggttggtagtgcgcgagagtgtcgccccgcccgcgtaa

SEQ ID NO: 6090 - DNA, 1518 bp, Actinoplanes utahensis
gtgactgcaccacgacaccaaaggaaacggatgaagccgcagatctggtttctgaccggcagccagcacctgtacgggccggagacgctccagcaggtggccgaccagtccgctgagatccagcgcaccctggccgccggcctgagcgccgagctcgtcacccgcccggtgctgaccgactcgggcgcgatcaagcaggtgatgctcgacgcgaacaacgacgcgaccgtgatcggcgtgatcgcctggatgcacacgttctcgccggccaagatgtggatctcgggtctggacgcgctgcgcaagccgctgctgcacctgcacacccagcacaacatctcgctgccctgggagtccatcgacatggacttcatgaacctgaaccaggccgcgcacggcgaccgcgagttcgggttcatccaggcgcgcctgggggtgccgcgcaagacggtggccggccacgtctccgacccgtccgtggtgtcccggatcgacggctgggcccgcgccgctgccggcctgcagcgcctgcgcaccctgcggctggcccgcttcggggacaacatgcgcgacgtcgcggtcaccgagggcgacaaggtcgaggccgagctgcgcttcggcgtctcggtcaacacctacggcgtgaacgatctggtcaccgtcgtcgacgcggtggacgacaaggcggtcgacgacctggtcgccgagtatgccgaccggtacgagctggcccccgagctggccgtcggcggggcgcggcacgactcgctgcgctacggcgcccggctcgaggccggcctgcggcagttcctcaccgagggcggcttcggcgcgttcaccaccaacttcgaggacctgggcggcctgcggcagctgcccggcctggcggtgcagcgcctgatggccgacggctacggtttcggcggcgagggcgactggaagacctccgccctgctggccgccgtgaaggcgatgggcaccggcaccggccggggcacctccttcatggaggactacacctaccacttcggtccgggcgagccgaagatcctcggggcgcacatgctcgaggtctgcccgaccatcgcgtccgcccggccgcgtgtcgagattcatccgctgggcatcggcggccgggaggacccggtccgcatggtgttcgacgccacgcccggcccgggtgtggtggtcggcctggccgacctcggtgaccggttccgcctggtggcgaacgcggtcgaggtggtcgagccggacgagccgctgccgaacctgccggtggcccgtgcggtgtggaagcccgccccgtcgctgtcgacctcggcggagtgctggctcaccgctggaggaccgcaccacacggtcctcacccaggctgtcggcgcggaggtcctgcgggacttcgcgacgatggcccagaccgagctcctgctcatcgatgaccgcacctcgaccgacgacttcgccgaccgggtgcggtggaaccaggcgtaccaccgtctggcccgccccctgtaa

SEQ ID NO: 6091 - DNA, 1128 bp, Actinoplanes utahensis
gtgaaatacacccggctcctggcggcgctcggcgctgccacgctggtcaccaccatggcggcctgcggctccagcgagaagaccgcggacaaggccgccggcagtgggaacaccgcgggcgcgctgatcggcatcaccatgccgaccaagtcctcggagcgctggatccacgatggcgacaacctcaagcagcagctcgagggtctgggttacaaggtcgacctgcagtacgcggagaacgacatcccgacccagacgcagcagctggacagccagatcaccaagggcgccaagctgctgatcatcgcgtcgatcgacggcaccgcgatctccaaccagctggacaacgcgaagaacgccggcatcaaggtcatcgcgtacgaccgcctgatccggggcaacgcgaacgtggactactacaccaccttcgacaacttcaaggtcggtgtgcagcaggccacctcgctgctgaccggtctcggcgtgctcaaggccgacggcagcaagggtgacgccaagggcccgttcaacgtcgagctgttcgccggttccccggacgacaacaacgcgacgttcttcttcaacggcgccaagagcatcctggacccgttcatcaaggacggcacgatcgtcgtgaagtcgggccagaccgacttcaagaccgtcgccaccctgcgctgggacccggagaccgcgcagaagcgcatggagaacatcctcacctccacctacaagagcggcgccaaggtcgacggcgtgctgtccccgtacgacggcatctcgatcggtatcctgtcggccctgaagtcgggtggctacggcaccgccgcgcagaagttcccgatcgtcaccggccaggacgccgaggtcgcgtcggtcaagtcgatcatcaagggtgagcagtactccaccatctacaaggacacccgtcagctggccaaggtcaccggtgagatggccgacgccatcctcaagggccagaccccgcagaccaacaacaccacggactacgacaacggcaagaaggtcgtcccggcccagctgctgcagtcggtcatcgtcgacaaggacaactaccagaaggtgctcgtcgacggcggttactacaccgccgaccagctgaagtga

SEQ ID NO: 6092 - DNA, 1536 bp, Actinoplanes utahensis
atgaccgacacgatcctgcggatgaccgggatcaccaagacgttccccggcgtcaaggcgctccaggacgtcgacatcgaggtgcgcaggggcgagatccacgccatctgcggggagaacggggccggcaagtccaccctgatgaaggtgctgtccggggtctacccgcacggcacctacgagggtgacatcgagttcgagggtgagccgtgccatttcggcggcatccgcgacagtgagcaccggggcatcgtcatcatccaccaggagctggcgctcgcctcgaacctctcgatcgccgagaacatcttcctcggcaacgagcgcagcaagcgcggctggatcaactggaacgagacgaacgcggcggcggacgatctgctgcgccgtgtcggcctcaaggagaaggctgtcacgccggtggtcgagctcggcgtcggcaagcagcagctcgtggagatcgccaaggcgctctccaaggacgtgaagctgctcatcctcgacgagccgaccgccgcgctcaacgacgacgactcggcgcatctgctcaacctgctccgaggcctgcgtgacgagggcatcacctgcgtcatcatctcgcacaagctcaacgaggtgatgggaatctccgatcgcgtcaccattctgcgtgacggccggaccatctggaccgacgagatcgagaacctcaccgaggacaagatcatctccggcatggtgggccgcgacctcgagcaccggtacccggagcacgaaccgaccgtcggcgaggaggtgctgcggatcgaggactggacggtctacagccccacccagccggaccgcgcgctggtccgcaaggccaacctgacgctgcgccgcggcgagatcgtcggcctggccgggctgatgggcgccggccgcaccgagctggcgatgagcgtcttcggccgctcgtacggggtgaacatctccggccggctgatcaaggacggcaaggagatcaaggcgcggaccgtgcgcgaggcgatcgaccacggcatcgcgtacgccaccgaggaccgcaagcggtacggcctgaacctgatcgaggacatcaagcgcaacgtgtccgcggccggtctgtccaagctggccaagggcggctgggtggacggcaacgaggagttcaaggtcgccgacgagtaccgggcgagcatgaacatcaagtcgccgaccgtcgaggcggtggtcggcaagctgtccggcggcaaccagcagaaggtcgtactgtccaagtggatcttcacggatccggacgtgctgatcctcgacgagcccacccgcggtatcgacgtcggcgccaagtacgagatctacacgatcatcaaccggctcgccgacgaggggaaggccatcctggtcatctcctccgagctgcccgagctgctcgggatctgtgaccgcatctacaccctctcggccggccggatcaccggtgaggtgccgcgcgccgaggccacccaggagagtctgatgactctgatgacgaaggaagaacaggaggtggcgccgtga

SEQ ID NO: 6093 - DNA, 1248 bp, Actinoplanes utahensis
gtgaccgtcgcacctaccaacgctgacctgtcgatcagcgagggaccggccggtgccgggaacgcggcccagcggaaggtcaacttcgacctgaagtcgagcggcatctacatcgcgctcgcgctgctcgtcctgggcttcaccatctggaccggcggcgacctgctggcgccgcagaacctcagcaacatcatcgtccagtactcgtacatcctggtgctggcgatcggcatggtgctgatcatcatcgccggccacatcgacctgtcggtcggctcggtcgtcgccgcgaccggtgcgttctccgcggtcatgatggtcaactggggcctgccctggccggtcgcggtgatcgcgacgctggtcatcggcgccctgatcggcgcctggcagggctactgggtggcgtacttcggcatccccgccttcatcgtcacgctggccggcatgctgctgttccgtgcggtcacctacatgatcctgggcaacaagggcatcggcccgttcccggacgagatccgcaccctggccaacggcttcatccccggtttcctgggcaacgtcgggctcggcagcctcggcggcgccgacctgttcagcctggtcgtcggcatcctcgtcgtggtcgccatggtcttcgtgcagtggcgcgcccggatgggccgggtccgctaccggcaggccgtcgacccgatgtggctgttcgtggccaaggtcgccgtccccgcggccctggtcatcttcctggtcgtgcagctcgcccggttccgcaacctgccctgggtgctggtcctgctcgcgatcctggtctgcgcgtacacgctggtcaccaaccgggcggtgttcggccgccagatctacgcggtcggcggcaacctgcaggccgcgacgctgtccggtgtcaaggtcaagtcggtcgtcttctggctgttcgtcaacatgggcgtgctgtccgcggtcgccggcatcatcttcgccggccgcctcaacctggccggcccgaccgccggtaacagcttcgagctggacgccatcgccgcggccttcatcggcggcgcggccgtccagggcggcgtcggcaaggtggtcggcgcgatcaccggtggcctgatcatgggcgtgatcaacaacggcatgggcctgctcggccgcgcgccggaggaggtcatgctgttcaagggcttcgtgctgctgctggccgtcgccttcgacgtctggagcaagcgccgcaccgccaccgccaagtag

SEQ ID NO: 6094 - DNA, 147 bp, Actinoplanes utahensis
gtgggccgtcacggtgacgtggcggcccactgtcgtcatcgggccacggcacaaccgaaactgctcggccgtacgccggggaacaccccgtccagcgacccgaaaccgcagcgcctctgcagcacctccccgatcaccgaccggtag

SEQ ID NO: 6095 - DNA, 1215 bp, Actinoplanes utahensis
gtgatcatgaacggcaccgtttcccgccgcagcatcctgggcgccaccctggccggtgtggccggggccgcgctgagcacccgggtggcgttcgccgcgggcgcgtactccggcgacacgctcgtggtgatctcactgcgcggcggtttcgacgggctctcggcgatcgtcccaatcggcgacagcgcctactacacggcccggcccgggatcggtgtgccgaagagtcaggtgatcgccggcgacggcaccttcggcctgcacccggcgctcgccccgctgctgccgctctggcagggcggccggatggcggcggtgcacgcggtcggtcagccgaaccccacccggtcgcatttcgccgcgatggaggcgatggagaacgccgcgcccggcacctcgctgcgcagcggctggctggaccggatgctcgggctgaccggtgcgaccgccccgctggccggggtgtcgctggggcacgcgatgccggcccggatcctgctcggcgcggccgacgacgtggcgatgaccggactggacggcttcagcctggccggcgaggggaagcggccgatggccgcggcgctgcgggcgatgtacgccgacgcgccggcggcgctggccggtccggcccggtccgccgaccgcgcgctggccgcggtccacacggtccgcgatgcggcgtacgcggcggcagccacgtatccggacagtgagctcggtgcggcgctgcgggacgtggcccggctgatcaaggcgaaggccggcctggtcaccgcggcggtcgactgcggcgactgggacatgcacaacgggctcggcaccgcggtcaagggccagcggatgtacgacaacctcgccgacctggcggccgcgctggccgcgttcaccaccgatctgggcccggcgctcggctccgtcacggtgctgacgatcagtgagttcggccggcgggtgcaggagaacgcctcgcacggcgcggaccacggccacggcaacgcgatgctgctgctcggcggcgggatccggggcgggaaggtgtacgcggactggcccgggctgacccccggcgcgctggtggcgggcgacctggcggccaccaccgactaccggtcggtgatcggggaggtgctgcagaggcgctgcggtttcgggtcgctggacggggtgttccccggcgtacggccgagcagtttcggttgtgccgtggcccgatga

SEQ ID NO: 6096 - DNA, 1398 bp, Actinoplanes utahensis
atgacgacggccgacgacctggttgcccacctgctgcgccggaccaccttcggtgccaccccggactctctcgccgaggcacgccgactgggcgccgccggctggctggaccgtcagctcgacccgcagcgcatcgacgacagccgctgcgacgcggtgctggcccggctgccgctggccggcgccaccccggcgcaggtgcgtgccgcgctgccgaaggactcctacgagggtttccgccagctgggccgggccgcgatcgcccgggccgcgtggagcgagcggcagctgttcgagacggtggccgccttctgggccaaccacctgcacgtcgccgcgccgtccgccggggtgtgggacacccgcgccgactacgacgcccaggtgatccgcaagcacgccttcggccggttcgccgacatgctccgggccagtgcccggcacccggcgatgctgacctatctcgatcagcgctcgtcgacccggtcgcaccccaacgagaactacgcccgtgagctgatggagttgcacacggtcgggatggcctacgacgagggcgacgttcaggacgccgcccgcctgctcaccggcatgacggtgggcaggaccggggattacgtgtacgacaccacccggcacgccgtgggcggcgtggacatcctcggcttccgccacgcgaacgcgggcgtcaacggggagccggccgcgctggcgttcttcgaccacctggccatgcatccggcgaccgcccggaacctggcccgcaagctgtgtgtccggttcgtcgccgacgagccgccggccgcgctggtcacccggctggccaaggtctatctcgacaacggcaccgcgatcgtgccggtgctgcgcgccctgttcaccgcgccggagttcgcggccgcggccgggcagaaggtccgcaccccgttcgaggatctgatcgccaccgtgcgggtgctgggcctgggcccggacgcggacggggtgaaggggctggacgcgctctacgacatcgcggtgaccgcgggccaggcgccgttccgctgggcgccgccgaacgggtatccggacgtcgcggcggcctgggcgtcgccgtcggcgttcctgctgcgctgcaactggcacctcaacctggccgccggctggtatccgaagcagctgagccggccggccgacctgctcagggcgctggttccggtgctgccggcgacctacggcgcgctgatcgacgcgctcgccacccggctgatcggcaccgttctgcccccggcgcacaccgccgccgtgctcagtgccgccgggaagctgccgaacactgtcctggaccggtccttggccgggcacaccccgtacctgatcgcgctcgtcctcgacgcgccgtccttcccgctgaggtga

SEQ ID NO: 6097 - DNA, 1050 bp, Actinoplanes utahensis
gtggatcaggctgaaacggtacgcaccccgtcgtcctgggtggtcgtcggactcgacaacggcggcacctgcaacaacgccaccgtcctcgacgcgacgggccagttcctggtgaacaatctcgtggagaacccgtcccgggtcctcgacggccccgagtcggcggtcgagtcgctcgccgaggcgttcaccaacatcctggagctgaccagcaccccgctgtccctggtccgcgcggtcgggctggacacgcccggcccggccagcgcgcacggagtgatctcctccaagggcgccaccaacttcaaccaggtgtcgtggcacggcttcgacatccgcggcgccctggagacccggctcggcctgccggtgatctacaacaacgacgcgaacgccgccgccctctacgcccaccaccgccacttcggcacggccgccctggagacgtcgtcggtggccgcgatcgtcggcaccggcctcggcggcggcgtcgtcgaaaacggcaaggtgatccgcggcgcggccggaatggccggcgagctcggtcacgtccagattcccctgcacggcgtcctcgacgacggccagccggtccccaggtgcaactgcggcttcgagggcgacgtcgagtcgatcgcctccctcaccggcatccgcaacaacctgctgccgtactggctgacccgcttcccgggacaccccctcgccgccgagccgatcggatcagcggccaagatgctccgcggctacggcgagaaggacgacccgctggcgatcgccgtcttcagccagcaggcccgggcgatcggcaaactcttcaccatcgccgccaacttcaccgacccgtcggcctacttcctgggtgggggagtggtcgaggccgccccgcactttcgccaatggttcctgaacaccgtccgcgaaagcacccagctccgcgacgaacaggccagagccgccaccttcgccctggtcgccgacctggacatggccggcgcccgaggcgccgcggtcgccgccctcgacgcggtctccaccggcacccgctga

SEQ ID NO: 6098 - DNA, 336 bp, Actinoplanes utahensis
atgcaggtatcggtcgcgcaccacccaccgaacacggccgtcctcgtcctgcgcggttcgctcgacatcgacaccgcgcccgcgctgaaggccaacctcggccgcctggtcgaacgccccgcaccccgggtcgtggtcgacgtctccggcctcgacttctgcgactcgatgggggtcggcgtcctggtcaccgcccacggccgcgccatggagcgcggcggctgggtgcggctggccgccccgtccggcttcctccggcgcctcttcgacaccctcggcctgtccgactatctgccgatgttcccggatgtggcagcggccctgaaagacgaatag

SEQ ID NO: 6099 - DNA, 1491 bp, Actinoplanes utahensis
atggaccaacctcagctcatccaggagcgcagcgcgccgccggccacactggtgatcttcggcgcgtccggtgacctgacccggcgcaagctgctgccggcggtggagagcctggcccgccacaaccggctgcccgaccagttcgcactggtcggcgtcgcgcggacgccgatgtccgacgagcagttcgccgagagcgccctgggcgaccgcaccctggccgacaagcgacagttggccggtggcgtgcggtacgtgtcgggcggctacgacgacccggagacttacaagcgtctggccgagacgctcgacgagttggacgcgcagcgcggcacgtccggtaaccgtctgttctacctgtcgaccccggcgaacgcgttcgagccggtgatctgcggactcgccggcgccgggctgaaccaggcgaacgagggttcgttcgcccgcctggtgatcgagaagccgtacgggcgggacctggccaccgcgcgcgagctcgacggcgtcgtgcatgccgcgttcgacgagtccagcgtgttccgcatcgaccactacctgggcaaggacaccgtccagaacgtgctggcgctgcgcttcgccaactcgatctttcagccgatctgggaccggtcgtgggtcgaccacgtgcagatcacggtggccgagacgctgggcgtcggcacccgcggcggattctacgagtcggccggcgcgatgcgcgacatcgtgcagaaccacgtgctccaggtgctcgcgctcgccctgatggagccgcccgcctcgttcggcggcgagggcctgcgcagcgagaaggtgaaactgctgcaggcgatccggctgcccaccgaccgggacatcgccgacgccgcggtccgcgggcagtacacgcgcggcggcacccgcgaggagctgatggccggctaccgcgaggagatcggcgtcgacccgctgtcacgcaccgagacgtatgcggcgctgcgtctcaacgtcgacaactggcgctgggcgggggtgccgttctacgtccgcaccggcaagcgtctcccggcccgggtcaccgaggtggccctgcagttccagcggccaccgcacctgccgatcccgaccagccagctcaccgaactggacgcggacgccctggtgctgcgcatccagcccaacgagggcatctcgctgcgcttcggcgccaaggtgcccggccactcgttccgggtccgcaccgccagcatggacttctcgtacgaccagaccttcgtggaagagtcgccggaggcgtacgagcgtctactgctggacgcgctggtcggggacgcgtcgctgttcatccgcagtgacgaggtggagcagtcgtggcgggtcgtcgacccgatcatcgagcactgggcgaacgaccgctcgccgatcccgacctacgaggcggcctcctggggaccggccgacgcggaccggctgatcgggcgtaacggtcggaaatggcgcaactcgatctga

SEQ ID NO: 6100 - DNA, 939 bp, Actinoplanes utahensis
gtgaagtaccggctcgtgacccgcagcgacttcgacggcctggtctgcgccgtgctcctgcggcacctcgacatgatcgacgacatcatgttcgtgcaccccaaggacgtgcaggacggcgtcgtcgacatcaccgaccgtgacatcctgaccaacctgccctatgacgctcgcgcctaccaggtctacgaccatcaccactcggagaccatccgcaacgagggcgaccgcagcaaccacatcatcgacgccgacgcgccgtccgcggcccgcgtcatctacgaccacttcggcggccgggcccgcttcccgaaggtctccgacgacctgatgctcgccgtcgaccaggccgactcggccgactacgggctgaccgacattctcagccccaccggctggacactgctcaactttctgatggacagccgcaccggcctcggccgcttccgcaacttccggatctccaactaccagctgatgatgcagctcatcgacgcctgcatcgaacaccaggacgtccacgagatcctcgccctgcccgacgtggccgaacgcgccagcctgttccacgaatgctcggcccgcttcgtcgaccagctccaccgggtcacccacatggacggcgacgtggtcgtcgtcgacctgcgcgacgaggaggtcatcgaggccggcaaccgcttcatggtctacgcgctgttcccggacgcccgggtgtcggtgcacatcatctggggccgccagaaactcaacaccgtcttcgcctgcggcaaatcgatcctggaccgcacctccccggtcgacatcggcgaggtgatgctccgctacggcggcggtggccacatcgccgccggcacctgccaggtgccccacgacgaatcggaccgcgtcgaacgcgagatcatcgacgccctccgcaccgaacgggtggtgccggtgtag

SEQ ID NO: 6101 - DNA, 1212 bp, Actinoplanes utahensis
ttgggaacagcgctcactctcgtgaccgccgccggggtgctcagcgtgaccgccggtccggcgtacgccggcgtgaccgtcagtccgcccagcgtgccgcagggcagtgggcagaacctgacctaccacgtcgagaacgacggcacccggccgctgacgcgggtcaccctgcagatcccggccgacaccccgatcgccgaggtctatcccctctcggtcgacgactgggcgccccagatcgagtggcagaacctcaacaccccgctgaagacgatccacaacggcaccccggtcacccaggtcccgaagtcgatcacctggatcgcggtcggcggcacctccatcgcccccggcggcgcggccgacctcagcgtcgcgctcggcccgctccccacgctgagcacgatcacgttccagctcaccggcgcgtacgcggacggcaaacccgccccggcgatgcccgccaccctgaccctcaccccggacccgtccggggcgaccgcccacgaccacggttccaccggtgccacggacagcggcacggcagcgggcgcggcgggttccacgggcggcgcggcaggttccacgggcggcgcggcgggctccacgggcggcggttctgcgggcgactccgcttcggccgacgaggacgaactgttccgccaggcggtcgccgaagtcgaacagaacgaccgcggcgcctcggtcctgggcatcgtcggctggatcgtcgcggccctcgccctcctcggcgccggctggctgatcctccgcaaccgccaccgcgccaacgaaacgcccgacgacgaacccgacgaaaccccggaaccggccgccgccaccccgagcggtgacaccacggcttccgctgcttccggcggcacttcggccggcccggccgacggcattccggtcgctgccgcggacagcggcccgggtgccaccgcagacagcgcccggatcgctgccgcggacagcgtgcccggtgccaccgcagacgacgcccggatcgccgacgcggacagcgtgcccggtgccacgaccgacagcgcccggatcgccgtcgccgacagcggcccggccggaggcgccgggatcgcggcggagagtgcagccgcagcgcccgcctcggcggatgcggacggcggacccgaaacgaccgacgacgaccgcgagcccatcccggcgggccgctggagcctcaaaggctga

SEQ ID NO: 6102 - DNA, 228 bp, Actinoplanes utahensis
gtgccggatgatggacggatgcgcgacgtgtcgatcaacggcgagatgatccggctggggcagttcctgaagctggccgatctgatcgacaccggcggcgaggccaaggtgctgatcgcgtcgggtgacgtcacggtcaacgacgaggtcgacacccgccgcggtcgccagctgcacccgggtgatgtggtcgaggtgctcggcaaccgggcccgggtcgtgccgtga

SEQ ID NO: 6103 - DNA, 864 bp, Actinoplanes utahensis
atgacccgaacccgcggcctgctggccgccaccgccatccccctgatcctgatggccgggtgtgcccggccgggtgaggccggcagcatcaccgagagcgccccggcccccaccgcggacgccacggtcctggtccgtctcggataccagggcggtttcgttcctgagatctaccgtttcgttcggttgcccgaggtgacgatctacgccgacggccgggtggtcagcaacggtccggtgccggcggtggcacccggcccggcgctgcccaatgtgcagatcagcaagatcacgccggagcgggcccggcagtgggcggccgacgcggtcgcggccggggtgaaggacggcgccgacttcggtacgcccggcgtggccgacatcccggacacggtggtcaccgcggtcaccgacggccgggcgcagaccgtccacgtgacggcgctgcgcgagacgcgtccggatgatgcgcaggtcacggccgctcagaaagcggcccgcgccaagcttgcggcgtacgtcgacagtctgcgcgccctggccaccgagaccggttcgcccgccccggacgcctaccgccccgagtcggtggccgtgctggcgcagccgtatgtgccggtcgacgacggcctggagcagaagccggtggcctggccgggtccggcactgcccggcgcgacgctctccggcaccgtgcactgtgtggcggtctccggcgccgagctgaccaaggtgtgggccgccgccgccaccgccaaccagcgcaccccgtggacctcgggcggcaagcagtggcaggtgatgttccggccgttgctgccggacgagaccggtggttgcgcggctctgggcaaggcctcgtga

SEQ ID NO: 6104 - DNA, 642 bp, Actinoplanes utahensis
atgctggcagcgcagatcctggtggcgctggtgctcctcgcggtgctggcgttcggcgggatggcggtcttcgcggggcggcggtcgccggtcacgcccgcgccggagccggagcccgaggtggtcgagctggagacgggcgccggcgaggtatgggcggcggcgcagcgtgcggcgcaggcggctgaccaggcgcgcgagcgggcgaccgaggccaatggtgagcgcgaccaggccgaggagcgctatcagcaggcaaaatgggattcctggaccggtccgaaggacgagggtcgcaccctggtcgagcgggccgccctggaggcgtaccgccgcggtgatctctcggtcgaccagctgaaccggatctgggcgcagacccggcccggtgaggacgaggtcgagcggatggaccaggagatcgccgaggcgaagctgcggtacgcggcggcgctgaccgaggcggtcgaggagcggcgggccgcgcacgtcgcggaggtggccgccgaggttctggcggaggaggcgcggctggccgaggagacggcgctggcggcgcgcctggcggcgcaggaggcggccggtctgtcgggactgctgcaggggcccggggagcatcccgggcccccggcaggtcagtga

SEQ ID NO: 6105 - DNA, 369 bp, Actinoplanes utahensis
atgaacaagcccgacgtcggtcacatccccgacgaagcgcccgccgatctcgtgatcgaggacatcgtcgagggcaccggcccggaggccaagcccggcgagtacgtcagcgtccactacgtgggcgtggcccagtcgacgggcaaggagttcgacgcctcctacaaccggggtcaggcgctcggtttccgggtcggcggccagcaggtcatcgccggctgggaccagggcgtggccgggatgaaggtcggcggccgccgcaagctcaccatcccgccgcacctgggctacggcgcggccggcgcgggcggcgtgatcaagccgcacgagacgctgatcttcgtggtggacctggtcgaggttcactga

SEQ ID NO: 6106 - DNA, 732 bp, Actinoplanes utahensis
gtgcgtctcttcgtcgttctggcggccgccgccaccctgaccgccgccgtgccggggacggccgcgttcgcgcacggggcgccgaccacgccgatcagccggtcggcggcctgcgccgggaacgggacgaagacgtcggccgcggcgtgcaaggcggcgaaggcggccagcgggggtttcctcggggcgttcgacaacctgcggatcgcggacgtcaacggcaacgaccgcaaggcggtgccggacgggaagctctgcagcgggggactcgacgcgtaccgaggcctcgatctgccccgcgacgacttcccgtcgacggcggtgcggtccgggcagaagctggccatcgcctaccgcgggacgattccgcatcaggggcagttccggatcttcctgagtaagccgggttacagcccgctgaagcggctgacctgggacgacctggggagtaagccgctcgccgcgttcaccgacccggcgttcagcgacggcgcgtaccacatgtcggtgacgctgccgcagcggaccgggaagcagatgttgtacgtcgtctggcagacctcgagcaccccggacacctactactcctgttccgacctggacttcccggccgcgccggccgtgcagcggtccaccgcggccgcgccggcgtccccggcgtccccgtcgtcgtccgcctcgccggccaccgccacgccgctcgccgtggcctcctcggccctagctagctag

SEQ ID NO: 6107 - DNA, 279 bp, Actinoplanes utahensis
atgagtcgtagtcgttaccgcgcccaggcgttcccgcggttgaatcgccggcggatgctggcactcaccgccgcaggtgtcggggtctcggccgtttcggtcgccgggctcagtctcgccggcgagaactcgaccacgtctgcatcggactcctcgccgctcgtcatttcggtccgggatgccaagaaaggcactttcgacgtcttcgtgggagacgcgaagaagaccgtgaccgacaagaaactcgtcgcccagctgctcaaagctgccggccgctga

SEQ ID NO: 6108 - DNA, 1383 bp, Actinoplanes utahensis
atgtcttcccaccgcgaagcgccggaaatcagcaaggacccggtcgccgacagttctgatctgtacgcgttcgtcagccccgacgatccggacacggtcaccatcatcgcgaactacgtgccgctgcagattccggcgagtggcccgaacttcttcgagttcggcgacgacgtgctctacgaaatccacatcgacgcgaacggcgatgcccggcccgacgtcacgtaccagttccgtttccacaccgaactgcgtaacgaccggacgttcctctacaacaccgggcagatcgagtcgctggacagcaagaactggaaccggcggcagttcttctcggtcaccaaggtcgaccggcacggcaagcagacggtgctggccaacaaactcccgtgcccgccgtgcaacgtcggcaagatctccatcccgcactacgcgaagctggccgagcacgccgtccacaagctgaagtcgggggagaaggtcttcgccggacagcgcgccgacgcgttcttcgtcgacctgggcgccatcttcgatctgggcacgctgcggccgttccagaacaagcacctggtcggcaagacgctgttcaactatgccggcaaggcggtcaacgccaccgacaagacgaacgtgcacagcatcgcggtacagattccgctgagcgcggtccggcgtgacggcaagaagcgggtgaaggcctccgacgcgggcgcggtgatcggcgtgtggacgaccgcgagccgccgcgaggtgcaggtccgggacggctcgaacgtgctggtcggcccgcaggtgcaggtgtcgcggctgggtaatccgctgttcaacgaggtcatcgtcccgatggcgcagaaggacaagtggaacagcctgccgccgagcgaggacaagaggttcgccgaattcgtggccaagccggagctcggctcgctgcttccggtgctctacccgggcctgttcgacaacctggccgccctgaacaaggccggcaaggaccgggcggacctgctggcgatcctgctcaccggcatcccgtccgggatcatcgacggcttccagaacaacaccggcagcctgcaggccgacatgctgcgcctgaacaccgcgatcgccccggccgcgaaacccaacgcgttcggtgtggtcggcggcgacctggccggcttccccaacggccgccggatcgccgacgacgtggtctccatctcgctgcgggcgatcgccggcgccaccgtgccgctggtcgacaaggcgttcaagccggacgccgcggcgtcgctggtcgagcagggcctgagcatcaaggacgtcagttcgggcctgctcaagaagttcccctacctcgggacgcccttcgacggattctcggtgccggcatga

SEQ ID NO: 6109 - DNA, 363 bp, Actinoplanes utahensis
atgagccacgaccaccaccaccatcacacgctggccccgtccggacagggcaccgtgatgctcaacatcggcggccggatcggcgccctgatcatccacacctcggcccgtttccacggtcacgagatcgagatcagctcgtcggccgaccgcgacacacggcagcacgccgcggtccgcgcccgctacgtcggcggcggcgtcacctactgtgtggtcatcgacgcgctggccgagggaacctacctgatctgggccgccgacccggaaccgctggccaccgtcgaggtccgcggcggcgcggtcgctgagtacgcgtggccggagaacgccgtacccgggagaacgcttttgaccgtctag

SEQ ID NO: 6110 - DNA, 984 bp, Actinoplanes utahensis
atgtcggggggtgaggtcccggtccacgtcgcgctgcacaccagcgacgtggatcaggcccgtgccttctgtcgcaggctctactacgacccgctgcgcatcgaaccggtcggcgaccccggccggttcgatttcagcgccgacgtggtcgagctcggcccgatcacggtcggcgaggtcggctacggcaccgacatccgcgtcgcgatcggtgccctggaaacgtcgtaccacgtgctcgtcccgctcaccggcgtgctccggtcccggcaccgcggcaccctggtcgtggccgaccccacccgcgcggtcgtctaccgccccaccggcgacatcgagctggactggcccggcacctgccgcctgctgagcgtcaaggtcgaacgcggcgccctcgaacgcgaactggacgcggccctcgaccagcgcgtcgtctccccgctgccgctcggcgccagcttcgacctggtcgacggccccggccgcacctgggtcgccctggtccgcctcctgctgtccgaactccgcggcccggacgccctggccagccagccccggatggccgcccgctggcgcgacatggtcgtcagcggcctggccctcaccgtcgagcacccctacggcgacgaacccgccggcctccagggcccgcaccgcccccgcaccgtcaaacgggtcctcgacgccctgcacgccgagcccgcccgcccgttcacctcccacgagctggccaccatcgccggcgtcggggtccgggtcctgcaggacgccttccgccagcacgtcggcatggcccccatgacctacctgcgccgcctgcgcctggacggcgtgcacaccgaactctcccgctccgaccccgccaccaccaccgtcagcgaggtcgcctaccactggggtttcacccacctgagccgcttcgcgggcgcgtaccgcgcccgcttcggagttcccccctccaccaccctccgaggccgcccgtag

SEQ ID NO: 6111 - DNA, 414 bp, Actinoplanes utahensis
atgccgcccatgatccggatcgtcatgggtgcgttggttcgcgacgatcagatgctgctcgtccatcgaagtccgagccgccctgtccacccggacgtgtggagcctgggcggcggccacatggagccgggcgagacggaactggccgcgctcgccagggagctggacgaggaactgggcgtgcagatggtgccgggctcggcgatccatctgtgtcggctgcaggtcggccgcggaggggaagccgtgcacttcagcgcctggatcgttgaggagtgggaggggaaaccggtgaatgccgcccctgaagagcacgacgaaattcgatggttccgacccgcggagctgcctcctctcacccccgaaccggtacgcacggcgctgatcgaggcgatgcggaacacccgcgcctga

SEQ ID NO: 6112 - DNA, 579 bp, Actinoplanes utahensis
gtgccaccgcggcggcgttcaccgcggtcgcgcccggcaggtcactgcccgcacccggccccaaacgtcggcttttcgtgggctgaccacgggggatccggcgagtggatctcgacccctactgtcatgggacggtcggcgaaccagccggaatttccccgaggtgcaaggagaaccgtcgtggcacatgtcgacagtgggtacggatcggaagtccgcctgtcggttccctgggtcagaacggtggtcgccgtacagctgtacgtgctcgcggcctacctggcggctgccatcatcccgtacctgtgggccccacggcagtacccgcccacctggctgtgggtggttccggggctgctgctcgggtcgccgggttactacatcacggtatggggtgcgagtctcgccgtaccgctggcactgatcggtgcagccgccagcggatgggccggtctccggcacaccgtgccgccgcgcttgttcaggtggtcgctcaccaccgcggccctgacagccgtgtacgccctcttcaccctgacgtcactcggccacgacatcgccatgttcgtggcggactga

SEQ ID NO: 6113 - DNA, 1368 bp, Actinoplanes utahensis
atgatcccgagttgcgcgaggaaggccgcaccattgttccgtgaaggcttgagaacgagggcctgtcgccccagcccggtggtcctggccgtcgccgcgcttcaggtggccgccgccaccctggctctgcccatcgccactcccgcggccgcccaggccgccgcgccgtaccggaaggtcggctacttctcccgcgccgccgtgaagcccaaggccgagggtggcgcggacttccagatccgcgacctcgacgagaagggttccgcggcaaagctgaccagcctgcactacgccttcggctccatctcggcggccggcgaatgccagatcacgagcgacgaggcccggctggactatcagcaggagtatccggcgacggacagcctcgacggcgtggcggaccagccgggacaggccctgcgcggcgtcttcaaccagatccggcggctcaaggccaagtactcgctgcggacctccatctcgttgggcggcggatccgggtcggcgaacttcgccgaggcggccaggaccgcggtctcgcgggagaagttcgtccgatcctgcatcgatctctacatcaagggcgaccttccgcagctcggcggccagccgcagggcgggatcggggccggcgccggcgtcttcgacgggatcgacatcgactgggagtacccgggggcaaccgggaactccctggagaagcacaactacaccctgctgctgcaggagttccgacgccagctcgacgcctaccggcagggcgccgagggccgaccgtactatctgctcaccgcggcactgcccggcggcgcctacaccctgggccggggatacgaactgccggcgatcttcacctacctggactgggcggtgctgatggcgtacgacatgcacggcgcctgggaaagcccgtcgaccaccaaccaccagtcggcactgcacctgaatgccgccgaccccgacccgaccgatcgcagcgtcgacatctacctcaagaatctcaccgaccatggcgtcgccccgggccggctggtgctcggcgttcccttctacagtcgtggctggaccggcgtcgacgccaccgacaacggcctgttccgtcccggtaccggcgtctccgacggccgggactaccgaaccgtcaaggagtacgtgcacaacggcttcgtccggcactgggacgacaccgccaaagcggcgtggctgttcaacggcaacaccttctggaccttcgacgaccccgccgtgatgacggagaaggccgggtacgcgaaggcggccaagctcggcgggatcggcgtctgggcattgaaccaggacgacgaccagggcgccctgctggccgcgattgacagcggcctgcggtag

SEQ ID NO: 6114 - DNA, 993 bp, Actinoplanes utahensis
atggccgctgaccgccggctcgcgcttcacgcgacgctcccggatcgttacgcccatctcgaggtcatggcctcgactatcgatcatgacggtcggctcgtcgtccttctcgccgatccggcgcagggcttcgtggcggtcccgcacctgaccgagctgcgtccgccaccgctttacgatgcgaccgccctcatctgtgcggggctcgaggttcgtgagatcccgctgaagggcctcgacctgtggttctccggcatcgactcgctcggcgacggcgtcgtgttgtccgccgcccgatgtgctgcacccggcgtctgcgaggaacgctacggcgaaccggtgcccgaggaggatctgaccctcaccgcgaacgtgcgggtcttcgacggtcacggtcgggcgcaggcggcgttctacgccggagacggtatcgagcagctcgtgaccgacgcgcgagggcagatctggatcagctacttcgacgagtcgaactactggtttccccactcggacggcacccgctcgtacggcttcatgatcggtctggcgcggtgggacggcggcggcggcgaaccctggatggtgtcatccggcacccctaccctgccgtggtgcgactgctacgcactgaatgtcggacgcgagcggatccgcgcgtgcccgtatcccgacttcgccgtggtcgagctcgacgcgaacagtgtccgggccgtcgtcgacaaccccatcacccgttgcaccggcctcgccgtcgtgggtgcggagttcgccttcttcgatcagcaccgggccggcgacgggttccggtggggcattcgtcgcggccgtcaggatggggagcgcatcattgagaccggccgcgagcagctggaactgccggacggccggcagccgtcgggctgggctcggggcagggtcggccgtgacgggatgctgtggttgcggatggacggtgaccccggtcgttggtaccggtacgacatcgatgcgtga

SEQ ID NO: 6115 - DNA, 2325 bp, Actinoplanes utahensis
gtgccgccgtcgtcctccgggaccgggcggtgccgccgtcggacaaggctgggcaatacgggtgaagacggcgcgagtggtgccagaatcgcaggtgtgagcgacgacgggtcgccgccgacaggggccgccggacggggccgggcggcgtggctgctggtggcgctcagtgggcccggcgccctgctgatcggattcggcgggccacggatcgcgcccacggcgtacctgatcggggtcctgatctgcgtggttgccgggggtttcggcatcgggaagaacctcggcgcggggcgccggcggccctgggtcctgctgctcgcggcgcaggccggcgcggtggccggcgaggcggcgcggacgctggcgcacgcgacggtgtttccgaacgtgatgctgctggtcagctacctgatgctcggggccgggctgatcgacctgctgcggcgcagccgggccggtgccgacgaaccggcccgggtcgacgccatcctgctgggcgccggatcggcgctggtggtctggtcgctgtggatggagccgtggttcgccggacacgacccgcactgggagaacctggtcgcggcggcgctgccgctggtcgccgccggcctgctgatgatcgtcctgccgatgctgctgctgggccgcaccggcgcgcccgcgatgtggttcttctcggtcagcgcgacggccctgctggccgccgacatcgtgctcgcggtccgcggctggttcgatgccggaccccggaccatcccgctcgccgaggtcggtgcggcggccctgatcgcgtacgcggcgaactccgcctgcatgctccatccgaccgtggtggtactcacccagccggtgccgaaccggtcacagcaactccggatgtcccgcaccgcggcgatcaccgcggcgctgtgcgcgccgaccgtgctgaccgtggtagcacccccgcacggcctgcggttcgcgctggtccgggcggtgttgtcgctgacgctgatcttcatcgcggtgtcccggatcgtccgtgccaacaactcccgggcccgcgccgaacagcgggcccgctggcaggccgaccacgacgcgctgaccgggctgcccaaccgggacctgctgacgtcgaccatcgcggactggcccggcgtgagtgtgctcttcctcgacctggaccggttccggctgatcaacgaccactgggggcacgaggtcggtgacgaactgctgcgcgcggtggcacaccggatcagtgcggaaacccgggccgacgacctcgtgtgccgggtgggtgccgacgaattcatcgtggcggtccgtgccgaggacccggcggccctggccgggcggctgctgacagtgctcgccgaaccggtgccgctgtccgtcggggcggtcgacgtcaccgcctccatcgggatcgcgcactcccccggccggcccgacccggtcgaactgatccgggacgcggacaccgcgatgtaccgggcgaaagatgccggacgccgtcgcgccgtggtcttcgaccccgaactgcgggaccgggtacgcacccggataacgctggaacgcgccttccgcggggcctccggaaacggtgaactcgacgtgcactaccagccgatcatcgatctgccgaccgggcaggtcgacggcttcgaagcgctgatgcgctggacccacccgacgctgggaacggtgtccccggcagagttcatcccggtcgccgaggacaccgggctgatcgtcccggccggcgcctggctgctggagaaggccgcggggcaactccgcacgtggcgcgccgggaacccggccctgcacgtgtcggtgaacctcgccgtacgccagttgtgggaacctgatctggccgaacgggtgcgcgaagtcctcgggcgcaccggactgcccgcggccgggctgtggctcgaagtgaccgaatccggcctgatgaccgacctggacacgtgcctcgacgcgctgcaccagctgcgcgccctcggcgtgacactgtgcatcgacgatttcggaaccggctactcgtccctgagctacctgcagcggctgccggtttccatcgtcaagatcgaccgcgccttcatctccggggtggggctgggcggcgcggacgaatccattgtgcgggcggtactggccatgtcgcgggcgctcggccatcgggtggtcgccgaaggcgtggaaacggcggcgcagcacgactggctgcgggccaacggatgcgatctgggacagggctggtggtacggaaaaccgcggccggccacccaagcggtcccgggctcgtcgcatccgtcgccggcgaccgggtag

SEQ ID NO: 6116 - DNA, 1233 bp, Actinoplanes utahensis
atggctgtcaaggtgcttgcgatcgttctggccggtggagaaggcaagcgcctgatgcccctgacggcggaccgggccaaacccggtgtcccgttcggcggcatctatcggatgatcgacttcgttctctccaacctcgccaacgccggttatctcaagatcgtcgtgctgacccagtacaagtcgcactcgctcgaccggcacatctccaagacgtggcggatgtcgacgctgctcggcaactacgtcaccccggtccccgcgcagcagcggctcggcccgcgctggttcgccggctccgccgacgcgatctaccagagcctcaacctgatcaacgacgagtcgccggattacgtgatcgtcttcggtgccgaccacatctaccgcatggacccgaagcagatggtcaacgaccacatcgcctcgggcgccgcggtcaccgtcgccggcatccgccagccgctgtcgctcgccgaccagttcggcgtgatcgacgtcggccccgacggcaagaagatcaaagccttccgggagaagccgcgcgacgcggtcggcctggccgactcccccgacgaggtctacgcgtcgatgggcaactacgtcttcaccacccgcgccctgtgtgaggcggtgaccgccgacgcgcagaacccggacagcaagcacgacatgggcggcaacatcatcccgatgctggtcgagcgcggcgaggcgaacgtctacgacttccgcgacaacgacgtgcccggggccaccgaccgcgaccgcgggtactggcgggacgtgggcacgctcgactcgttctacgaggcccacatggacctgatcgccaccctgccgatcttcaacctgtacaaccacgagtggccgatcttcaccaactacggctcgtggccgccggccaagttcgtgcacggctacgacgaccggcagggccgcgccatcgactcgatgatctcccccggcgtggtggtctccggcgccctcgtcgaacgctcggtgatctcgccgaacgtgcgcgtcaactcgtgggcccacgtcgacggcgcggtcctgatggagggtgtctcggtcggccgccgcgcggtcatccgcaacgcgatcatcgacaagaacgtcaccattccggagggcgcgcagatcggcgtcgacctcgaccgcgaccgcaagctctacacggtcagcgacaacggggtggtcgtgatcggcaagggacagcggatcgagctttag

SEQ ID NO: 6117 - DNA, 2595 bp, Actinoplanes utahensis
gtgcagcagtttcgcggtgtgcccggcgaaattcgcataccaggtgtggctgtgcacgacgctcgcgccggcggtgccggccgccatggcgagattcacccccatggtgcgcagcgcggcgttcgccccggccagctcggcgggctccgggtacgcggtgacaccctcctcggtgcggggtgcgccgaagcagtgcacccgcacgtcggcgagccgccgcaggtccctggtcaggtattccaggtgcacgccggcgccgccgtacacctccggcggatattcacgggtcaggaggtccacacgcagagccacgccccgcacaatagcccaccgcaacccgcggcgacccggtccggcacccgtccggcaaccgccgtgggctgcaatggccgggtgcgggagtggagcggaccaggagcctggcggtacgtgctggtggccggcgcggtggcggtcaccgtcgcccagctgaccggcagcggcgtgctgttcctgctgatccaggtggccacgatcggggccacactgcgcctgcggctgggcgccggctggtggctgcagaccgtcgcccgggtcgccgcggtggtcgccaccgcgttctggatgtggggcccggtcccgccggccaacaccccgaccggcttcagcctcgtcccgctctatctgttgtcggcggccggcgcggcgctgctcacccggcgcggtggccgccactacagccgggccgagatcagcgtcgaggccggtgcggtggtgctcggcgtggccatgctggcctggtcgttcgtggtgctgccgtatctgggcgcgcccggctaccagcaggtcgacagcgccctggccgcgctgtacgcgctggtcgacatggcgctgctggccaccaccctgcgcggactgacctcccggcacggcgccccggcacggctgctcggcggctccggtgcgctgctgctcggcgcgcacatgctgtacgccgcgaccagctcggccggggtcggcccgttcctgcccggcggcggctcgttcctgctcatccagtacgccggggtgctggtcaccgcggccgcccggcacccccgggcgggcgcgctcggcaccggtgacccccggggcaccgaggtcagccggggccggctcgcccggatcatcgcgatcgccgtgctcgccccgatgctgccgctgctcaccgcccggcacgacgtcgcgacctgggtgccggcgctgctcacctcggccctgtgcgggctgctggtgctgcgcatctgcatgctggcgcgcgacgccggccaccgggccgccgagctgtgccgggcggtcgacgagcaggccgcgttgcagcgcaagctggcctaccgggccgggcacgactcgctgaccgggctggccaaccgggagctgctgctggagcagctggccaccccggcggtccgggaccggccgcactgcctgctgctctgttcgctcgacgggttcaaggcggtcaacgacgcctacgggcacccggtcggcgacgaggtgctgcgccagctcgccgggcggctgctgctgttcgctcccgaggcggtgctggtggcccggctcggcggggacgagttcgccctgctgctcaccgacccggcgggggcggccgacctggccgcgcgggtgctcgacacgatctcccgggtgccggtgtccgtggacgagcgccggatccacctctgcggcagcgcgggggtggccgacggcgtacccggcaatccgccctcggccgtgctgggtgacgcggacctcgcgttgcgcgccgccaagctggccggcggagcccggctggcccgcttcgacgagcggctgcgcgccgagcagagcgagcgcgcgtgcctcgcggccgggctgcgccaggcgctcgccgacgagacgctgttcctgcactaccagccggtggtcgacccggtcagcggccggatgagcggggtcgaggcgctgatgcgctggcgccgcgacggcgagctggtgccgcccggggtgttcatcccggtggccgagcagaccgggctgatcgggccgatcgggctgcgggcgctgcgactggcctgcgcccgggcggccggctggcaccgccgggacggcatctacgtgaccgtgaacgtctccacccatcagctgcgcgacccggacttcgccgacaccgtgctggcgatcctcgccgagaccggtctgccgccggccgggctggtcctggagatcaccgagtcggtgctgatcgatgcggccgacaccccggtcctgggccggctgcgcgagcacggcatccggatcgcgatcgacgacttcggcaccggctactcgtcgctggcgtacctgcggcagctgccggtcgacatcctgaagatcgaccgttcgttcatcagcgatgtcagtttcaccaaggcgatcctggaactcgcgcgcagtcagggtctgatcaccgtcgccgagggcgtggagaccccggaacaggcggccgtgctgcgtgacctgcggtgcgacctcgtccagggctaccatttcggccgtccggccgagcccgcggcgatcgagtcatggatcagagagagcagcgccaccgtcgcttaa

SEQ ID NO: 6118 - DNA, 1602 bp, Actinoplanes utahensis
gtgacccgagtccaacgcctgcgcctcggtctgctgctgtcggtggtcctgatcgccgcactggcgatcggcgcggggttggtccgggccgccttctaccgcgcgtcggcggcggccccggtcaccggtccggccgccgcggtcgccggcaccgtcgcgcagtgcgccgggcagcccgcccgggccgcccgtgagctgcgcggcatgtggctgaccacggtctacaacgcggatttccccagccgcccggggcttggtgaggaccaggtcaaggcggagtacgagcggtggctcgacctcgcggtggcgcagaaccacaacgcgatcttcgtgcacgtacgcccgagcggggacgcgttctggccctccgcctacgcgccctggtcgaactggctgaccggccggttcgacggcaggtcgcccggctgggacccgatggcgttcatggtctccgaggcgcacgcccgcgggctggcgttccacgcctggttcaacccgtaccgggggacccagccggctcccggcggcatcggcaccgacgccgccaaactcgcccccaaccacccgctgcgcctgcacccggagtggcgcatcgcgtatccgaccggcaggaccggccgtttctacttcgatccgggcatcccggaggcgcgtcggttcgtcgaggattcgatgctggaggccgtgcagaagtacgacgtcgacggcgtgcacttcgacgacttcttctacccgtacccggaaggcagcggccaggacttcccggacgccgcctcctaccagcggtacggtgccggaaagtcgaaggcggactggcgccgggagaacgtgaacaccctggtccgcgagatgcacgagcggctcctgcaggtcaaaccgtgggtctcgttcgggatcagcccgttcggcatctggcgcaaccgggccaccgatccgttgggttcgaactccgccggcctggaaagctacgacacgatctacgccgacacccgtaggtgggtgcagtccggctggctggactacgtggccccgcagctctactggacgatcgggttcagcaaagccgactacctgaccctgctgaaatggtggaccgacctgacccggggcacccgggtgcagctctacatcgggatggccgactaccgggtgggcgagccgggagactggagcgacccggcgatgctggaccgggagatggcactgaaccggaaatacgccgcccagggcgagatccacttcagcgccggccaggtgcggggcgaccggctgggtgcggtcagccggtatcgccgggcctactacgccacgccggccctgcagccccgcctcgaccgcctggccgcacccgccccggcgaccccgcgcctcaccacggcccgccccggcccggccggccggctgatcctgacggcgaccgggctgggcgcgacgaactggtcgctgtaccgcaccacgggcggcccggccaccctggtcgccaccggccggtccggcgccgagatcgccgacccgcacccatcgggaaaggccacctactgcctgggcgcggtggaccggtccggcacggagagcccgctcagcccggccctgtcgagctga

SEQ ID NO: 6119 - DNA, 450 bp, Actinoplanes utahensis
atgaatcgcaccaccgttcgggccggcgtgctggccaccgccctgatcagcggcgtgctcggggtggccggcccggcgctcgccgccccggtcaccgacgcggcgccggtcgccgccgccggcaccgccgtcgcgccgatcgccgcgaccttcaacgtgaccgccgggttcaccagctggggtcagaacgtctacgtcgtcggcagcatcccggcgctcggctcctgggacgtctccaaggcggtgccgctgaccaccacgagcagcgccttcccgacctggaccgggagcgtggcgctgccggcgaacacgtacaccgagttccagtacgtggtgaagaacgccgacggcagcgtcgcccgctgggagaagggtttccagcagaaccgcaccacgatcaccccgccgaccggcacctacgtcacgcacgacaccttcggcgcgtactga

SEQ ID NO: 6120 - DNA, 378 bp, Actinoplanes utahensis
atgagcgacgcgaccgccaccgcactggcgcaggaccgggtcatcgacatcaccacgatcgggcgcaggagcggcgagccccgccgcatcgagatctggttccaccggctcgacggccgctattacatcaccggcaccccggtcaagccccgcgactggtacgccaacctggtggcgaacccggccttcaccttccatctgaaggagaccgccaccgccgacctaccggccgtcgcccgcccgatcaccgacccggccgagcgggagaaggtcttcaccgggctgctcgccccgctcaccgagttcaccagcaagccgggcctcgaacaggaggtctgggtggcgaagagcccgctggtcgaggtcaccttcgcctga

SEQ ID NO: 6121 - DNA, 390 bp, Actinoplanes utahensis
atgagcacgatcatcaccttcttcaccgccgcgaacgacgacgccgccgacgaccacggtcccggccgcgacgcggtcgcattcgggaacttcgacatcttcgcctccctggaggagtgggagagcctgctgctgcggcgcgatctggacgacgtcgacggcccggagcagatcaacgacgacgagccgctgatcttcagcttcctgccggccgtcaccaaggcgctggccgcggccgaccggcgcaccctggacacggtcagccgggagtgggtcgcggcacgcgccggggacggcgaggagctggacccggaactcgcccgggagattctggacgccgtggccggcctggcgcgttcccggcgccggctctactgccgggtcgcctaa

SEQ ID NO: 6122 - DNA, 1632 bp, Actinoplanes utahensis
atgagcgccacactgatcgcccgggatctcgccgctgggcacggcgaccaccacctgttcaccgggctggacctggtggtcgcgccgggcgacgtgatcggcctggtcggcgtcaacggggcgggcaagaccacgctgctgcgcacgctcgcgggcctgctgccggccgagagcggcaccgtctccctcagcccgcccaccgcgaatgtcggctacctgccgcaggagcgggagcggcgggccggcgagacggtgcgcgacttcctggcccggcgcaccggggtcgccgcggcgcagaccgcgatggacaccgccgccgaggaactggccgcgggcgctcccggtgccgacgaccggtacgcggccgctctggagcggtggctcgacctgggcggcgccgacctggaggaacgcgcgctcgcgctcacctcgtccgacgtgcggatcgatctggagctgccgacgaccgccctgtccggcggccaggcggcccgggcgggcatggcgtcgctgctgctcagccgctacgacgtattcctgctcgacgagccgaccaacgacctcgacctggacgggctggcccacctggagaacttcgtgcaggggctgcgcggggggctcgtggtggtcagccacgaccgggagttcctcacccgtaccgtcaccaaggtcctcgaactggatcttcatcaacatcagatccggttgtacggcggtggctacgcgtcctatctgcaggagcgggagcgggcccggtcgcacgcccgggagcagtacgaggagtactccgacaagaaggaggagctgctcgagcgcgcccgcacccaacgcgcctggatggacaagggggtccgcaacgcccgccgcaaggccccggacaacgacaagatcggcaagagcctgcgcggcgagaccagcgagaagcaggccgccaaggcccggcagacggaaaagatgatcgagcggctggaggtggtcgaggagccccgcaaggagtgggagctgcggatggagatcgccgtcgcgccgcgcgccggtgcggtggtggccaccctgcgcgaggcccgggtcgaccgcggctcgttcaccctcggcccggtcaccgtgcagatcgactggggtgaccgggtcgcgatcaccggggccaacgggtccggcaagtcgacgctgctcgcggcgctgctcgggcggctgccgctgaccgccggctcggcggcgctcgggccgggcgtggtggtcggcgaggtgggccaggcccgcgggctgttcctgggcaccgagacgctggcgcgcgccttcggcgacgcggttccggaattcaacgacgcggacgtacgcacgctgctcgcgaagttcggtctccgcgcgggccacgtcaaccggccggccgggtccctctcccccggcgaacgcacccgggcggcactggcgctgctgcaggcgcgcggggtgaacctgctggtcctcgacgagccgaccaaccacctggacctgcccgccatcgaacagctggagtcggcgctggcgacctatcccggtaccctgctcctcgtcacccacgaccgccggatgctgtccgcggtcgccacgaaccgccacctcgaggtggccgacggcaaggtcaccggctga

SEQ ID NO: 6123 - DNA, 1788 bp, Actinoplanes utahensis
gtgccgctctcggccggcagcaggcccgcgagcgtgcgcagcagcgtggtcttgcccgccccgttgacgccgaccaggccgatcacgtcgcccggcgcgaccaccaggtccagcccggtgaacaggtggtggtcgccgtgcccagcggcgagatcccgggcgatcagtgtggcgctcatcagtcagtcatctaagcacaggccccggctgaaccttcatgacggcgagtcatcggccgatcacccttgcgtgagaaggctggagcgggtgatggtgcgtgatccgatcacgctcgccgcggtcgcgtggacggcgctcggcctggtgctgctgttcgcgctggccggccactacaattcccaggtccgggtgttctggctgttccagccgccgctcgacctcctggtggcgtattcctcctggcgggtcagccggatcgccaccggagccgtcggtcgtttctggcgcatgctgatggtcacctccgccctgttcctcctgggcgactcggtgcagtccgtcctgtcgctgacccggcagcaccagtggtcgaccggcggcggcgtgatccagtcggtgtgcttcggcaccggcgagctgctgatcatcgtggccatgctgatccacccgtaccccggccggtcccgtcgtgaggcgctggccttctggctggacagcgccacggtgatggtcggtggtgcggtggtcacctggtccttcgcgtccagctccggcccgcaggacgagaacgccagcccgatcggcgcgctggtgggcgccgcggtcgcgctgaccgccggattcgcggccgtcaagatcttcctgagcgggaacgcgccgatgcacaaggcggccgccgtcccgatgatcggctcggcggtggtgatcggggtcagcgtgttcgccgccccgccctcgacgcaggacgggttgccggcgtacgtctacgccctgcgcttcgtgccgtcgctgctgatcgccgtcggcccgcggatccaggagatcatcgccggattcgaccagaccgcgttcggcgcccgccgccggcgcccgtacagcctgctgccgtacggctcgatcgcggtcgtcttcaccaccctgctcgtcgtgctgccgcagggctcgacccggcgcctgtggggcgtggtgggtggcctcggggtgatcgtcgccctggtagtggcccgccagctggccgccttccacgacaacacccgcctgatcgaccagctcgacagcaccctcaccgaactgcgcgagcacgagcagcggctgcgccaccaggccctctacgacgagctgaccgggctggccaaccgcgcccacttccgggaggagaccaccaccgcgctcgaggacgcccacccgggcagcgtcgcgctgctgctggtcgacctggacggcttcaaggcggtcaacgacacgcacgggcacggcgccggcgacctgctgctcgccggggtggccgagaagctgcgccagtcggtgcgggccggcgacctggtggcccgcctcggcggcgacgagttcgcggtgctgctgcgcgactgcacggtgcgcgacgccgagcagaccgcgcagcgcatcctgcgctcgatgaccgagccgatcgacgtcggcgacctcgcggtctgcgcgaacgccagcatcggcatcgcctgcgccgaggagcgcgacgacgtgcgcaccctgctgcacgacgcggacatggccatgtacgcctccaagcaccagggcaagggcacgtggaaccggtatcaggacgggatggccctgaccggtcactga

SEQ ID NO: 6124 - DNA, 813 bp, Actinoplanes utahensis
atgatggagtcgtacgccgcgttcaccaccgatccggccggcggaaacccggccggggtggtccgggacgccgccgccctgtccgacgcccggatgctggcgatcgccgccgacctgggctattcggagaccgcattcgtcacctcgcgcgacggcgaccggtaccgggtgcgctacttcagcccgctcaccgagatcccgttctgcgggcacgcgacggtggccaccgcggtcgcgctggggccgggcgagcatgtgttcctgaccaacgccggtgaggtgccggtgaccgtcgacacccacggggtggccacgctgaccagcgtcccgccgcgcgtcgagccgctcggcgcggacgcggtgagcgcgctgctggcggcgctgcgctgggccgccacggacctcgacccggggctgccgccccgggtggcgtacgccggcgcctggcatccgatcctggccgtccgcggccgggagcggctcgcggacctggactacgacgtgccggcgctgaaagcgctgatgaccgaggccggctggaccaccgtgcagctggtgttccgcgccgatccgcagaccttcgacgtgcgcgatccgttcccggtcggcggcgtctacgaggacccggcgaccggtgcggccgccgcggcgctcggcggctacctgcgggagctcggcctggtcgcggacgacgcgacgctcaccgtgcggcagggcgacgacctgggccggcccagccggatcaccgtccggctggtgcccggcgaacccggggtgcgggtgtccgggcacgcggtgccgatcggtcagtga

SEQ ID NO: 6125 - DNA, 1425 bp, Actinoplanes utahensis
gtgacagagggtcctaccgcgatcatctccgaaactcccgccgacctgccgcgcaccctgggcgagctgcgtgccaccgggcacgagttccgcaccgtgaaagaggagctgcgcgacaacctgctcgacaggctgcgctccggcgagccccgcttccccggcatcgtcggctacgacgacaccgtgctgcccgaggtcgagcgggccctgctcgccggccacgacatggtcctgctcggtgagcgcggccagggcaagacccgcctgatccgcgccctggccgggctgctggacgagtggacgccctacatcaccggttccgagctgcacgaacatccgtatcacccgctcaccccggcgtcgcgccggctggtcgccgaggccggcgacctgctgccgatctcctggctgcaccgctccgagcggtacggggagaagctcgccaccccggacaccagcgtcggcgacctgatcggcgacgtcgacccgatcaaggtggccgagggccgctcgctgggcgacccggacaccatccacttcggcctggtgccgcgcaccaaccggggcatcttcgcggtcaacgagctgcccgacctggccgagcggatccaggtgtcgctgctcaacgtcctggaggagcgcgacatccaggtccgcggctaccagctgcggctgccgctggacctgctgctggtcgcctcggccaacccggaggactacaccaaccggggccggatcatcaccccgctcaaggaccgcttcggcgccgagatccgcacccactacccggtcgacctggagctggagaccgcgctgatccggcaggaggcggcgctggtcgccgccgtcccggagcacctcgtcgacgtgctcgcccgctacacccgcggggtccgcgagtcgtcgtcggtcgacgcccgctccggcgtgtcggcccggttctcgatcgcggccgccgagacggtggcggcgtccgcgctgcgccgggccggcctgcgcggcgagcgggaggcggtcgcccggatctgcgacaccgtgtcggtcacctcgacgctgcgcggcaaggtggagttcgagagcggcgaggaggggcgcgagaccgaggtcctcgcccacctgctgcgggtcgccaccgccgagacgttccgggcccggctcgccgggctcgacctgtccggcttcaccgacctggtcgccgagggggcgatcatccagaccggtgacctggtcagcgccgaggagttgctcacccagatcggcacggtgccggggctggccaaggtgctcgaccggctcgggctgggcgacgcgccgagcccggggcaggccgcctccggaatcgagttcgtgctggaggggctgcatctgacccggcggctggccaaggagatgaccgacgacggccgcaccctctacgggagctga

SEQ ID NO: 6126 - DNA, 1953 bp, Actinoplanes utahensis
atggcacgaaacgtcttccggtacggggcctggcgggacgggccggacccgctcgccccgccctacgacgtgcgggccgcggtcgacgagatgggtgagcgggtcatgcggggcgacagcctgcgcgacgcgctgcgtgacctgatccggcgcgggccgcgggacggccgcgggctcgacgatctgcgcgaccgtgcccggcggctgcggcgggacgcgctgcgccggggaaacctggacggcgcggtgacccgggcgcggcagatgctcgaccaggcgctcgccgaggagcgggacaccctgcgggcccgggacgacatggagtcccggttcaacgaggcggtcctggacaacctgcctcggtccacctcgcaggccatcgcggaactgtcggagtatgactggcagtctccggaagctcgcgacatctaccggcagatcctctccgggctccgccgggaggtggtcgagcagcgcttcgccggcatgcgcgacgccctgcgcaacggtgacttctcggaggtgtcggagatgctgggcgacctcaacggtctgctcggcaagcatgcccgcggcgaggacaccaccgacgcgttccagcagttcatggagaagcacggccgcttcttcccggacaacccgcagaacgtcgacgagctgatcgactccctggcccgccaggccgccgcggccgagcggctgatgcgctcgctgagcccgcagcaacgcgaggaactgcagagcctgatggaccaggcgctcggcgacggcccgttgcggggacagatgagtgagctcaccgacaacctgcgggcgctgcgccccggcctcaactggggccgcggcgagcggatgcgcggctccgaggacctcggctacggcgacgcggccgccgccctgggggacatcgccgacctggacgagctgatcgaccaactgggccaggagcacccgggcgccaccctcgacgacgtcgacgtggaatcggtcgaacgccagctcggccggtccgccgccgacgacctgcgccgcctccgcgaactggagcgggagctgcgccggcagggctgggtggaacgcgacggcgacgggctcaccctgtcgccgaaggcgctgcgccggctgggccagaccgccctggcgaagatcttccacgacatcggcggcaagcgcggcgaccacgacatgcgtgacgcgggcgcggccggcgacctgatcggctcgtcgcgccgctgggagttcggcgacgaccagccgctcgacgtggtccgcacgatcggcaacgcggtccgccgccgggccgcttcgcgcgacgtcgccaccctgcccgtacggctggctccggaggatttcgaggtagccgaaaccgaacggcggtcctccgccgcggtcgccctctgtgtcgacctctcctattcgatgtacgccgacggtcgctggggcccgatgaaacagaccgccctggccctgtcgcatctggtcgccaccaggtatccgcaggacgcgctgcagatcatcggcttcggcaggtacgccatggcgctgagccagggtgagctggccggcaccgagcccaccctggagaagggcaccaacctgcagcacgccctgaaactggcggcccgccacctgcgccgccacccgggggccgaaccggtcgtcctggtcgtcaccgacggtgagcccaccgcgcacctggaggacgacggcgaggccctgttctggtggccgcccaccccggagaccgtccgggccacggtgcgggaggtcgatctgctcacccgctacggcgccacgctgaacgtgttcatgctcggcgacgacccgggcctgcagcgtttcatggacgcggtggcccggcgcaacggcggccgggtgttcagcccggacgccgaggaactgggccgctacgtgatcgacgactacgtcaacgcccgccggggccgccactga

SEQ ID NO: 6127 - DNA, 321 bp, Actinoplanes utahensis
gtggctacttaccaagcgcctgacgggtgggagatcctcggtgacccgagccggcgcgcgatcgtgtcctgcctggccgatgcgccgcgggcggtcggcgagctggctgatcgactgccgatcagccggcccgccgtgtcccagcacctcaaagtgctcaaagcggccggcctggtcgacgacgaggcggccggcacgcgccgggtctaccgtctgaacgcgaccggtgtggcggcactgcgggatcagctcgacgcgttctggaggcaggcactgcagggctatcagcaagccgtctcgtccgaagaggaaaccccatga

SEQ ID NO: 6128 - DNA, 474 bp, Actinoplanes utahensis
atgacccggtccaccacgccgatcgtgctccggcagatcgtcgtccccgcctccgtgcagcgcgcgttcgccgtgttcacccaacggttcggcgatatcaaaccgcgcgatcacaatctgatgaccgcaccgatcaccgacaccgtcctggagccgcgggtcggcggccggatctacgaccgggccgcggacggtggcgagtgcacgtggggtcacgtgctggccttcgagccgccgcaccggctgctgttcagctgggacatcggaccgaactggcaggtggagcccgacccggccaaccgcagcgaggtggaggtccgcttcgtcgccgaggccgacgaccgcacccgggtcgagctcgaacaccgcaacctcgaccggcacgggcccggctgggagggcatccgcgacgcggtggacggcgacaacggctggccgctgtacctgcaccgcttcgtcacggcgctgggctag

SEQ ID NO: 6129 - DNA, 966 bp, Actinoplanes utahensis
gtgcaagcttcgactcatcagatcagcgacgtcggcgaggcccgggaggtgttgcgcaagtacttctacgccgtcgacatggacgtgctgcggaagcggcgggactggacggcgcgcttcgcggtcggcggctgcaccgcggtcaccctcggggatctggatttcggggtggatgtgcgggtcagtgccggggaactcggcgcctaccacgtgaatctcccgctgaccggcggcctgagctggcatcagggccgggacgcgccgcgccgggcgtgggccgggcggtccgcggcggtgttccagccggtcggcgacaccatcgtggaccggtgggacggtgactgccggctgctggccgtgaagatcagccggaccgagctggaaacccacctggagcagttgctggaccgtccagtgcgcggcccggtgcagctcgcgccggtgctcgacacggcgcaggggccgggcgccggctgggcccggctggcccggctgatcgtcgaggacgtgggctgcccggacgggctgaccgggcatccggtgatcggtgcccggctgcgggaggcgctggtcaccgggctgctgctgagcaccgagcaccggtatcgggacccgctggagcggcagaccccggcgctggccgcgcccggcgcgatccggcgggtggtcgaggcgatgcgcgcgcagcccgcccggccgttcacggtggcggacctggcacggatcgccggggtgggttcgcgggcgctgcagcagagtttcgcgcgctatgtggggatgccgccgatgacgtatctgcgccagctgcggctcggcctggtccacgacagcctggccggcgcggagccggggacgacgacggtggcccaggaggcgtaccgcttcgggttcacccacctgggccggttcgccgccgcctaccgggagcgttacggcacggccccctcggagacgctgcgggactag

SEQ ID NO: 6130 - DNA, 684 bp, Actinoplanes utahensis
atgaaaaagcggacccgccgccgtatccccttcgacgaggcgcgcccggagggcgcgaagggagtggagatgacgacggtgaccgacgtgcgggccgagatcgcggcgcagcggcgggagctcgccgcgctgctggcggaattgaccgcggagcagtgggaccgggagacgctgtgtgacggctggcgggtgcgggaggtggtggcgcatgtgacgcagccgttccgggcttcgctgccgcggttcctggtggatttcgcgcgggcgggcgggaatttcgatcggatggcggatcgggtggcccggcgggacgcggcgcggctgagcagtgccgcgttgctcgcggcggtgcgggacaatgtggagcacccctggtcgccacccgggggtggactggtgggggcgctgtcccacgatgtcatccacacgctggacatcgatccgtggcgggaggtgccggtagcgcggatgacgctggtgctgggtgggatgtcgccgcgcagtgtcgggtatttcggggcggatctcgacggggtgcggctggtggcgaccgatcgtgactgggcgcacggtgccggtgaggcggttcacgggcgggcccaggatctgctgatggtgatctgcgggcggcggctgccaccggggctgctgaccgggcatccggccgccaggtacaccggttga

SEQ ID NO: 6131 - DNA, 984 bp, Actinoplanes utahensis
gtggctatcttcggggatgtggaggaggtgctggcggggctgcgggtcgagctgaccggatactgctaccggatgctcggttccgggcacgaggccgaggacgctgtccaggagacgttcgagcgggcgttgcgcgccgccggccgctacgacgaggcgcgcggctcggtgcgcacctgggtgtaccgcatcgccaccaacgtctgcgtcgacctgctgcgcggagccgcccggcgcgccgtgccgctcgacctggccgcgcccggttccgcgggcgagccgttcggtgcgctgctggcgcccggtgcggaggtgcgcccgatccccgacgcgcgggttctcgacctcgcccaggacccggccacgctggtggtgcagcgggagagcatccggctggccttcgtcgccgccctgcagcacctgccgccccggcagcgctcggtcctgatcctgcgcgacgtcctgtgctggtccgccaacgacgtcgccgcgctgctggagagctcggccgcctcggtgaccagcgctctgcagcgcgcccgcgccacgctgcggacggtggccccacaccccggcgacccgctgaacccggccgacgccgaccagcgaaccctgctcgcccgctactgcgccgccttcgagagccacgacatcgccgccctggtcgccctgctgcacgaggacgccaccacctcgatgccaccgttcgcctggtccctgcacggtcgcgaccggatcggcctggctatgagcgcccccgaagccgcctgcaccggccaccgcctgctcccgacggccgcctccggacagccggccttctggcagatgcgcccgacagaggccggccacgtcccgttcgccctggtgatactcgacatcgccgaccaccgcgtggtcaacaccaccacatggctcgacaccaccggccggcacctgcccaccccgcccccttccctgtggtccctgttcaaccgccacccctga

SEQ ID NO: 6132 - DNA, 117 bp, Actinoplanes utahensis
gtgctcagcgaccgtgacacacacatcccggaagtccgggaggcgcggcgtcccgccgaatcaagcgcggcacagcgcgtcgtgaccgatttcggcatgccggatcggttggcgtag

SEQ ID NO: 6133 - DNA, 615 bp, Actinoplanes utahensis
atgtcgtattcgtccatcgagacctccaatcggattttcacgattccgaatgtgatcagcttcatccggctgctcggggtgccgctcttcctctatctgctgctcggcccggagcgcgatgtcgccgcggtgatcgttctcgcggtcggcgggacgacggactgggtcgacggctatgtggcgcgccggatgaattcggtgtcccgtctcggcgagctgctcgacccgttcgcggatcggctgtacatcctggcgacgctgatcgggttcaccctgcgggaggtggtcccgtggtggctgaccggcgggctgctgctgcgtgaggtggttgtgggtgtggcgctgctgattctgcggcggcacggttacgggccgccgccggtgcactacgtcggcaagaccggcacgttcgtgctgctggccgcgttcccggtggtgctgctggccaaggcggtgccgtcgatcgactggtgggccggtccggtcggctggggcctggcctggtgggcgctgggcctgtactgggcggccggcgtgctctacctggtgcaggccgcgcggctgttgcgtgccgaccgggacggtcgggccgcggcccggacggtcacgccgtga

SEQ ID NO: 6134 - DNA, 1197 bp, Actinoplanes utahensis
gtgggcgctgggcctgtactgggcggccggcgtgctctacctggtgcaggccgcgcggctgttgcgtgccgaccgggacggtcgggccgcggcccggacggtcacgccgtgaccgatccggcgatcccgggcggcgctctcccggagccggcgaagccggacgccgccccgcagcactccggcgcgcggcgaccgacacctacctcgcaggagtcgggcacgcggaagccgacacccgcctcgcaggatccacccgcgcggaggccgaacgcggcgacgcccgatcccgacggcacggcggccgggaagcggacctacggtcccgacttcctcaccgcgctgtttcagaatccgctcgatcccgggtatgccgacgccgccgcccgccgcgccgaggggcatgtccgcacgggtgcccgcaagcggctcaccgccggcttctccctgctgaccgtcggggtgatcggtttcctgctggtggtgggctatcagcagacggtcgccgacgagccgggccggacgcaggcgcgggatgcgctgatcaagcaggtggacagccggcgggagcagaccgagacgttgcagacccgggccgatgtgctcgccgagcaggtcgccaggttgcgggctcaggagctgggtggcgccgcggtggccgggatctcgaatctggaggcggcgaccgggctggccgcggtgcgcggctcgggtgcccgggtgcggctggcggacggccccacgtcggtggatgcggtgaccggtgagcgcagcacgctcgggcgggtcaaggacaccgatctgcagctggcggcgaacgcgttgtgggcggccggggcggaggcgatcgcgatcaacgggcagcggttgaccgcgacgtcgacgatccgccaggccggcgaggcgatcctggtggacacccggccggtgaccacgccgtacgaggtgatcgcgctgggcccggacagtctggtcgacaatttccgcaacgggtatgccgggaagttcttcccggcgctggcccagcagtacgggatgtcgttcgagacggagagggtccgcgacgtcacgctggacgccgctccggagctgaagctgcgggcggcgtcgccgagtacccctccgcccgctccgtcgggcagcccgtccgtggccggttccggtgtgccggctgtctctgcgtcggaaggcggccgatga

SEQ ID NO: 6135 - DNA, 333 bp, Actinoplanes utahensis
atgatcgccgtactcgccctgctcgtcggtgttctgctgggcatcgtgttccatccgtcggtgccggcggagctggtgccgtatctgccgatcgcggtgatcgcggcgctggacgcggtgttcggcggattgcgggccaagctggacgggattttcgacgacaagcagttcgtcgtctcgttcatctcgaacgtgctggtctcggcgctgatcgtgtacgtcggtgaccagctcggggtcggcagtcagctgtcggtcggcgttgtggtggtgctcggcgtccggatcttcggtaacgtcgcggcgattcgccggcacctgttccgggcctag

SEQ ID NO: 6136 - DNA, 1098 bp, Actinoplanes utahensis
atgaccgaccgtgaggacgacgggcgtgagctgacgccgccggggttcgacctgcccacggcggggcgcagaccgccgacggcacggccttcggccgctttcgacgagcttgcggggtacgccggtgaccccgccggggatgagcagacggtccgttacccggtggcgccgggcggcgatccggcgggcgacgctgccacccgggcgggtgacccggagacatcgcccacgtcacccgttccgtcgatgtccgacacgcccgagcctgctagtacagaaagtgatcttgatcgcctcagggagagcccgggagaggacccgagagagagcccgggcgaggaccggggagacgtgcggtcgggcccgggggagagcgcggacggcggcgagcggccgcccggccggggtggtctcaagcgaccggcgcccgccggcaccctgatctgggtcctgctcgccctgctcggcttcaccctggtcgtgcagttgcgcagcaacgacgcggacagtggcctgtccaccgcccgccaggaggacctggtccagatcctgagtgacctggaggcccgggacagccggctgaacagcgacatcgaggccctggagcgcagccgccagcagctcacctcgggtgtcgccggccgggaggcggccctggacgaggcgaacaagcgcagccaggagctgggcctgctggccggcacgattcccggccgcggccccggtctggagatcgtgctggaccgggtgaaggcttcggacgtgctgaacacggtgcaggagctgcgcggttcgggcggcgaggtgatgcagatcagcgggtccggcgggaccccggtgcggatcgtggcgtccacctatttcatcgacgccaccggtggtggcatcatcgcggacggtgaccggttgaccgggccgttccggctgctggtgatcggtctgccggagacgatgaggacggcgctgcagatcccgggcggggtggtggcgtcggtgaagagcgacggcggtagcgtgaccatggactcgcgcagcatggtcgaggtgaccgcggtgcgtaaggcggctgcattgcagtacgcccgtccggtttcgtga

SEQ ID NO: 6137 - DNA, 381 bp, Actinoplanes utahensis
ttgattcctgagaatctgcggtacaccgcggagcacgagtgggtgtccggcgacggcaccggccccgtgcgggtggggatcacccacttcgcgcaggatgcgctgggtgacatcgtcttcgtgcagctgcccgaggagggcaccgagctgcaggccggcgactcgatgggcgaggtcgagtcgaccaagagcgtctcggagatctacgccccgatcgccggcaccgtggtggcccgcaacgacacgctgggcgacgagcccgagctgatcaacgcggagccgtacgcggcgggctggctcgtggagatcgccccggccgacccggccgcggtggacgcgctgctcgacgccgcggcgtaccaggcgctgaccgagagctag

SEQ ID NO: 6138 - DNA, 453 bp, Actinoplanes utahensis
atgacgcgcccagacgacgagttccccccactcgacgtcacgtccacgctgaacctcggcgccctcgacgaggtgctcgagggtcccgagaccgacgtggtgcccagccggatgtccggctcgctgccgcccggcatggcgctgctggtggtccgccgcgggccgaacgccggcgcccggttcctgctggatcatgacgtgaccaccagcggacggcacccggacagtgacatcttcctggacgacgtgacggtttcccgccgccacgccgagttccaccgtgacgggggcgtgttcaccgtgcgcgacgtgggctcgctcaacgggacgtatgtgaaccgtgagcgggtcgaggcggcgacgctgagcaacggcgacgaggtccagatcggcaagttccgtctggtgttcatcgccggcccgcggccggagggcgagggcggccgggcgtga

SEQ ID NO: 6139 - DNA, 741 bp, Actinoplanes utahensis
gtgacttcgtcgggggcggccgcgcgcgacccgggggccgagcgtccccagggcgggcgcgagggtgcgctgatgagcatcggggaggtgctggcccatctgcgcaccgagttccccgacaccacgatctcgaagttgcggttcctggaggcggagggtctggtcgacccgcaacgcaccgcctccgggtaccgcaagtactcgtggaacgacgtggcccggctgcggttcgtgctgaccgcccagcgtgatcagtatcttccgctgcgggtgatccgcgagcagctggaccggatggagcaggagccggtggtgccccagcgcccgacgctggtcgcggtcggcgcgcagcgggccaccgatccggccgacgcccggattccgaaggacgatctggtcgagcggaccggggtcgacgaggcgatgctggccgagctggagcagatcggtctggtcgtggcgcgcccgccgggctggtacgacgcggatgcagtgatcatcgtcgaagccgtggtgggcctcacccacttcggtctggagccccgccacctgcgggccttcaagaacgcggccgatcgtgaggtcggcctgttcacccagttgctggcgccgctggcccggcagcaggacccggcggcccgggcccgggccaccgataccgcgcgtgagctgcaggctctctcgcagcggttgcacgcggcgctggtgcgcaccggactgcgcggcgaactgggtcgctga

SEQ ID NO: 6140 - DNA, 504 bp, Actinoplanes utahensis
gtgcgggacggcgacaacaacgaacacggaggcggtgcggtgcgcgagctgagcgtggtcggggttcgggtggagctgcccagtaaccagccgatcgttctgctgcgagaggtcgacggcgaccggtatctgccgatctggatcggcgcggtggaggcgacggcgatcgcctacgagcagcagggtgtgaaaccggctcggccgctcacccacgacctgctgcgcgacatcctggcggcgctgcagcagccgctgaaggctgtcgagatcaccgagctgaaagacaacgtcttctacgccgatctgctgatcggggagaatctgcgggtctccgcccggcccagcgactcgatcgcgctggccctgcgggtgggcgcgccgatccggtgcgccgaccaggtgctgaccgaggccggcatcgtcatccccgacgagcaggaggacgaggtggagaaattccgcgagttcctcgaccaggtccgcccggaggacttcgcgggctga

SEQ ID NO: 6141 - DNA, 549 bp, Actinoplanes utahensis
gtgcacgagcagcctctggagggccccctcgtcggcgaggacggcgaggtcggctatcgcggtgtgacggcctgtcaggcggtcggcatcagctaccgccagctcgactactgggcgcgcaccaccctggtggtgccgagcgtgcgggacgcctccggctccggcacctcccgcctctactccttccgtgacctggtggtgctcaaggtcgtcaagcgcctgctggacgccggggtgtcgctgcagaacatccggcgcgcgatcgacacgctccgctcgcacggggtggacgacctggccgggatcacgctgatctcggacggcaccacggtgtatgagtgtcgctccccggaggaggtcgtcgacctgttgcagggcggccagggcgtgttcggcatcgcgatcggcggagcgttcaaggagatccagggttcgctgtcgcacctgcccgccgagccggccgtgccgcagccggtgggtcaggtccccgaggagccggcggcaggtgacgagctcgccgcccgcagggcccgccgccgtgctggctga

SEQ ID NO: 6142 - DNA, 2289 bp, Actinoplanes utahensis
gtgacgagctcgccgcccgcagggcccgccgccgtgctggctgatccgcagcggcacgagttcatccaggtccgcggagcgcgggagaacaatctccgcgatgtctcgctggacctgccgaaacatcagctcaccgtgttcaccggggtgtccgggtcgggtaagagttcgctggtcttcggcaccatcgcggccgagtcgcagcggttgatcaacgagacctacccggcgttcctgcagtcgttcatgggcagtccggcgcgtccggacgtggacgcgctgcacaacctgagcgcggcgatcgtcgtcgatcaggagcggatgggggcgaacgcgcggtcgacgctcggcacggtgaccgacgcgtacaccatgttgcgcatcctgttctcccggctcggtgagccgggcgcgggcagcgcgctggcgtactcgttcaacgccgaggggatgtgcccgcggtgtgagggtctgggccgggtgtcgagcatcgacgtcgacgggctggtcgaccgggacaggtcgatcaaccagggtgcgatcaccgtgccgaacttcagcgtcggcgggtggtacgtgcgcgggttcgccgagtccgggctggtcgacccggacaagccgctgcgcgagttcaccgagcaggagtgggccgacttcctgcacaagccgccggtgaagatgcgcatcggtggggtgaacacgacgtacgaaggcctggtcctgaaggtccagaggatgtatctggccaaggagcgcgaatcggcgcagccgcacatccgcgcgttcatcgatcgggtcgccaccttcaccacctgcccggagtgcgccggcgcccggctgaaaccggcggccctggcctcgcggatcgccggccggaacatcgccgagtgctccgcgatgcaggtcagcgacctggccgggttcctgaccgaggtcaccgacccggctgtcgcgccggtggtgcgcggcctgcggcacaccctggagtcgctggtcgagatcggcctgggctacctgtcgctggaccgcgagtcgggcaccctgtccggcggggaggcgcagcgggtcaagatggtccgccacctcgggtcgtcgctgaccgacgtcacctacgtgttcgacgaaccgaccgtcggtctgcacccgcacgacatccagcggatgaacgggctgctgctgcggctgcgggacaagggcaacacggtgctggtggtggagcacaagccggagaccatcaggatcgccgaccacgtggtcgatctcggtcccggcgccggcccggacggtggacgcgtccaatatcaggggccggtggcggggctgcccgggtcgggcaccctgaccgggcgcttcctgggccatcgggcagccctgaagaaggcctgtcgggaaaagacgggcaccatcgccatccggggcgccagccggaacaatctgcgcgacgtcgacgtcgacctgccgtccggcgtgctcaccgtggtcaccggcgtggccggctccgggaagagctcactgatctacggttcgctgccgcggcgcgacggcgtggtcgtcgtcgaccagaccgcgatccgcggctcccggcgcagcaacccggccacctacaccggtctgctcgacgcggtccgcagcgccttcgccaaggccaaccgggtgaaaccggccctgttcagcgccaactccgagggcgcctgcccgaactgcaagggcatcggcctggtgtacctggatctggcgatgatggccggcgtcgccggcgtctgcgaggagtgcgagggacgccggttcaccgcccgggtcctggagtaccggttgcgcggccgggacatcagcgaggtcctcgccatgccggtcagcgaggccctggagttcttcaccgagaaaccggcgcgggcgatcctggaccggctgtccgcggtcggcctcggctacgtgaccctcgggcagccgctgaacaccctgtccggcggtgagcggcagcggctcaaactggccgtgcacatgggcggcggcccggccacctacctgctcgacgagccgaccagcggcctgcacctggccgacgtcgaccagctgctggccctgctggatcggctggtcgacgccgggaacacggtggtggtgatcgaacaccacctggccgtgatggcgcacgccgactggatcgtcgacctgggtccgggtgccggtcaggacggcgggcgtgtggtgttcaccggtaccccgcacgagctggtcgccgacgcctcgacgctcaccgcccggcaccttcgggagtacgtgggctga

SEQ ID NO: 6143 - DNA, 1923 bp, Actinoplanes utahensis
atgtgtggtcttagcgcgtttttcagcagcaggccggaggccgggccggtggaccaggcgaccgtggcggcgttcaccgcggcgctggagagcatgcggcaccgggggccggacgactcgcagctggcctacggcgacgggtacatcctcggcttcaaccggctggcgatcatcgaccgggaccactcggtgcagccgctgtactacgccgaccgctggctggtggtgttcaacggggagatctacaactaccgggagctgcgggccgagctgatcagcgcgcacggcgcgacgttcgccaccgagggtgactcggaggtgctggccgccgcgttccactactggggtgaggcggcgctgccccggctacgcggcatgttcgcgttcgtcgcctacgacacccggaccggcaccgtgcacgcggcccgcgacgcgttcggggtcaagccgctgtatctgctggagaccgcggacgggttgtcgctggccagcgaacgcaaagccctcgacccgttcgccgccccggccggcgccgcgctcaacaacgacgcgctcgggcactacctgaccttccagtacgtgccggacccgctcagcctgcaccggcacatccgccggctgccgccgggtcaccggctggtgtggacgcccggcggcggggtccgcgagcaccgctggttccgcccgtcgctgcggccgctgcgcctgcagccggcggccgcacaccggcagatccaggacgcgctgcgcgccagtgtccgcgcccacctgcacgccgacgtcccggtcggcacgttcctgtccagcggtgtcgactcgtccgcggtcgccgcgctggccgccgaggcacagccgggcatccacgcgttcaccgccgggttcgccgccgacggctactccgagatcgacgtcgcccaggacaccgcgaaccagctgggcatcccgctgaccccgacggtggtcagcgacgagcaggtgctggccgagctgccgcggatcgtgcagctgctcgacgacccggtcgccgatccgtcgctgatcccgctgtacttcctggcccgcaccgccagccggtacgtcaccgtggtgctctccggggagggcgccgacgagctgttcggcgggtacaccatctatcgcgagccgctctcgctggccaccgtcgacaagctgccgcccagtctcaagcgcggcctgcaccatctggcgcacgtgctgcccgagggcgtcaagggccgctccttcttggagcggggcaccacgccgatcgagcagcgctactacggcaacgcccggatcttcgatccggaggagaaggcccggctgatgcgcttcacctcggcgccgcacaccgagatcaccgcgcggttgtacgccgagaccgccgacgtggacgaggtggcctccatgcagtacgtggatctgcacacctggctgcccggcgacatcctggtcaaggcggaccggatgtcgatggcgcacagcctggagctgcgggtgccgttcctggaccagcaggtgtacgcggccgcggccgggctggccaccgagctgaaactgccggccgggtcgcgcaccaccaagcacgcactgcgcgaggcgatgcgcgggatcgtccccgagtcggtgcgggaccgggcgaagctgggcttccccaccccgacccggctgtggctgcgcggcgtgatcggcgactgggtcgaccagctgctggccacctcgcagaccgggcatctgctcgacctggagtacgcccgcgggctgctggccgagcaccgggccggggtcgccgaccggtcccgcaaggtgtggacggtcgccatgttctgcctctggcacgcgatcaacgtggagcgcaccatcacgccgcgggccgagaagaccgtgctcagcccacgtactcccgaaggtgccgggcggtga

SEQ ID NO: 6144 - DNA, 2046 bp, Actinoplanes utahensis
gtgcggtgggtgcgggcaggtaccccggcatggaaaagtgagcgggtggagatcgatctcagtgaggcgcaggcaccggtgcggccgcgcttccccgccgccctgctgcgccccgaggccgaggtggtcgcgttccgcggccgccaccgactgctcgacgagctgggcgcctggtgttccggcgccggtttcgcggcgctgctgctgcacggcccggccgggcagggcaagacccgggtggccggccggctggccgcccgcctggccgcggtcggctggggggtgcaccggctcagcgacggtgaccgccccgtcccggacggcaccgtcccgacgctgatcgtcgccgaccgggccgagacccgccccgagcagatcgccgggctgctcaccgcgtgcgccgcccacgacggcgaccgcccgctgcggctgctgctgctcgcccgctccgacggcccctggtggcagcggctgcgcaccgacccgctgctggcgggggcgaccaccgccgagcttgccgaactggacgacgacccggccggccgccgggaggcgtacgccgaggcggtccgcgatctgggcgccgcgctcccccgggtgcccggccagggtggccacctgtggtcggcgatcgccgcccggctcgccgccaccccgcgcgacgccggcggtcacgcgctgaccgtccagatggaggcgctggccgacctgctggacgccgcccagttcggcccggcaccgaccggccggtcggccgccgaccggctgctcgtgcacgagagccgggtctggtcgttcaccgcggcctggcacggcctggccgtcgacgaacggatcctgcacgacgtgctggccgccgcgatgctcaccgagcccaccgaccgtctgctggaccggctggccggtgagcaccgggacgcggtcggcgcctggctcgccgatctggacaccgccggtcatccgctcgccgagcggttctgcgcgctgcgcctggccgcgcgcccggcactcgccgagatcctcgtcgaggacgccccggagcgggtgttgagcgtgctggccgccgcccggcatccggggttgaccgagctgtgtgtccggcacgccgaccggctcaccccggccgtgctgacggtggccgccgccgccgacgagccggagccgctgctggccgctctggtccggatcagcgccgacccggacaccccggtggaccggctcacccggatcgccgagggcctgccccggctgtccccgctggcggccgaggtggcccagtcgatcgccgagcggcaccggcgggccggtgacgaggcggggctggcgctggcgctgagcaacctgtcgatccggctcggcgacctcggccgcgacggtccggcgctggccgcgatcgaggaggccgcggtcatccaccgccggctggccgggcagcagccggagctgtacgaggcggatctggcgcggtcgctgaccagcctgtcggtccggctcggcgcagtcggccagccggagccggcgctttccgcgatcgccgaggccaccgagctctaccagcggctgaccgatcgcgagccggagtcgtaccgggccgatctggcccgctcggcccggaacctggcgctggcgttcggcggcctggagatgttcgcgcaggcgctgaccgcgatccaggagtcagtcgccggttaccgggtgctcgccgtcgagcaacccggggtgttcctgcccgagctggcggcggcgctgagcatcctggcgatcaacctgggcagcctcgacgaggatgaggcgagccgggccgcggccgccgacgcggtgacgatccgccggcatctggccgaccggcggccggacgcgttccggcccagtctggcggccgcgctgaccgacctcgcggtgcgccacatcgtgctcggcgaggccgagccggcgctggcggcgatcgaggaggcgctcaccatccggcaggagaccgggggtgaggacctcgactggtcactgcacgtgaagagcgtgatcctgggaaatgtggagaaccgatga

SEQ ID NO: 6145 - DNA, 708 bp, Actinoplanes utahensis
gtgttgacggtgccgtgcgctccgatccgctcgatcggcagccgactccactgcggaaactgtcgcgtcaacaggtcacggaccgtgtcggtgctcaccgggttcgcgttcaccggcccaccctgccacgcgaagttgccggtccggaaaatgcctgacaaacttgcccggatgtggctgaggcggttgtgggcgaagcatcacgaggcggccaagttcttcatggtcggcggcatctgcttcgtggccaccaccgcggtcaactatctgctgaaactgaccgtgctgcacgacaagccggtcaccgcgctggcgttcgcgaccgtggtcgccaccatcctgtcgtatgtgctgaatcgcgagtggtcgttccgcacccgcggcgggcgtgagcagcatcacgaggcggccctgttcttcgcggtcagcgcgatcggcatcggcctcaacctgatcccgctggccgtctcgcggtacgtgctggagctgcgggtgccggacgtcagccggccggtgcaggagatcgccgacttcgtcagcggcatcatcctgggcacgctcatcgcgatggtgttccggctgtgggcgttcaagcgattcgtcttcccgcacgccgaggcccggccggttgccgcgccgcgccagcgcggcccgcgcacccgggtgacccggcacgaggcgcggcggcccgcgaagaagtcgctctga

SEQ ID NO: 6146 - DNA, 903 bp, Actinoplanes utahensis
ttgtcaggcattttccggaccggcaacttcgcgtggcagggtgggccggtgaacgcgaacccggtgagcaccgacacggtccgtgacctgttgacgcgacagtttccgcagtggagtcggctgccgatcgagcggatcggagcgcacggcaccgtcaacaccgtctttcgcctcggcgatcacctcaccgcccggttcccgcgccacgacaccgaggatctgctcgccgaggcgcgggcggcacgggaactgctcggcgtcacccggttcgccactccgcaaccgctggcgatcggcgagccgggtcccgggttcccccgccggtgggccgtccagacctggctgcccggcactgtggccagcgagaattcacattcaacggcgatcagtctggggtacgacctggccgagctggtccagggtgtccgcggcatggacacccgtggacgcccgttccggggccgtggccgcggcggcgacctgcgcgcccatgacgactggatggccgagtgtttccggcagagcgagccgatgctcgacgtcggcccgctgcgcgccctgtgggccgagttgcgcgagctgccccgcgagtcgccggatgtgatgacccacggcgacctgatccccggcaacctgctcaccgagggtgaccggctgatcggggtgctcgacgtcgggatgctcgggccggccgacccggcgctcgacctgatctgcgggtggcacctgttcgacgacccggtacgggaggcgtggcgcaccgcggtgggcggcaccggtctggactgggcgcgcggccgggcttgggcgttcgtccaggcgatgggcctggtctggtactacgtcgagaccaacccggtgatggccggcctcggccggagcactctgcgccgggtcgcttag

SEQ ID NO: 6147 - DNA, 1788 bp, Actinoplanes utahensis
gtgagtttccggctacggatcttcctgctggtgctggtggtggccggcaccgcgatcggggcgaccgcctggctcacgctcagcctcacctcgcgggagctgtcccggctcaacgccgcccgggaccggcacaaggtggagatcaccaccgcgatccgccggttcgggctgaccaacgggcagtggaccggcatcgacgcggtggtcgcgcaactgtcccggcgcaccggcctgcacatccgggtggagggcgcggacatcacgctggccgactccgacgtgatccgcgggcaggcggtcggcccggtgcagctgcagccgatctcgatcgagccgttcccgggtctggacccggacacccaggcggacgcggtgacgatcgcccaggcggcccgggccgacccgaacgtgatcaccacctcggacctgaaacgcctgaaccggtcgcaggtggaggcgatgatgcgacagcggccggcgctgcccgccggcctgttcacggtcacgccgcgaaccagcgggctgaccaccccggagggcaaggcgctgctgcagctcgcgcagtaccgggccgggctggtcgcggtccgctgcgcggccgagcggcacgagctgaccctgccgcagctgggcaccgagcagctgccgttcctgaccccggagcagttgaccacggcggccgactgcgtgcgggccgggcgcaaccgggtgttcgccgacaccggctggctcgacgagtggtggcagcagttcgtccagtgccgctccgacccgcggtacttcgaccagtgcctggagccggcgttcgcgcagggcgcgtcgagcacgtcgggcatcccggtgaaggtctacttcggcgccggccgcgcccaggatctgcagggtctgggccgaccggcggtgttcggcgcggccgggctgctggtcgccgcggcgctcggcaccgcctgggtggcccgccgggtgagccggccggtgcgggcgctgaccggggcgtcgctgcagctggccgccgggcagctggacgtgcgggtgccggccggcggcaaggacgagctcgccttcctgtccgcctcgttcaacgcgatggccgaggcggtgcagcgcagcgaggagcgccagcggcggctggtcgccgacgtcgcccatgagctgcgtacgccgttgtcgaacctgcgcgggtacctggagggcctggccgacggcgtgatcgaaccgaccccggaactgttcgcctcgctgcacgaggagaccctgctgcagcgccggatcctcgacgacctgcagatgctcgccctggccgaggccggtgacctggcctaccatccggagccgctggatctgaccgagctggccgagacgtcggtgaccgcgcaccgggcgaacgccgcgaacgccggcctggaactgatcctggacgcgcccgaaccggtgctggtgaccgccgacccggaccggatccggcaggtgctcggcaacctgctgagcaacgcgatccgctacaccgacgccggcggccgggtcgaggtcggggtcagccgggacccgctcaccgcgatcctgacggtggccgacaccggggtggggatgaccgcggccgaggtgtcccgggtgttcgaccggttctggcgggccgacccggcccggcagcggaccaccggcggttccgggctggggctgaccatcgcccggcggatcgtcgacgaccacggcggcaacatcagcgcggccagcgaacccgggctgggcaccaccttcaccgtccggctgccggccgagatgcgctga

SEQ ID NO: 6148 - DNA, 705 bp, Actinoplanes utahensis
atgccagccgtgaccgcccgcatcctggtagctgacgacgatccgaagcatgcccagctcatccggctctatctggagcgggatggacaccaggtgctcactgtgggcgacggccgggcggccttggagcagacccgggcgcggcggcccgacctgctggtgctggacgtgatgatgccgctggtggacgggctggacgtgtgccggatcctgcgggccgaatcggacccggcgctgagctcggtggcgatcctgctggtcaccgcccggtcggcggagagtgacatgctgctggggctcgacatcggggcggacgactacctgagcaaaccggtcagcccgcgggagctgaccgcgcgggtccgggcgctgctgcgccgggtgcgtggcggggagaaccgcgaggtgctgcgggtcggtgacctggaggtggacgcgccccggttcgaggtgcgggtggccggggcgacggtccggctgaccgccaaggagttcgccatcctggaactgctggcccgggagccggggcgggtgttcacccgggggcagatcatcgacaagacgttcgggttcgagaacgacgtgtcggagcggaccgtcgacgcgcatgtggtcaacctgcggcgcaagatcgaggagaatccggccgagccgcggtacgtgcagacggtgtacgggcgcggctaccggatgggcgaccggtga

SEQ ID NO: 6149 - DNA, 870 bp, Actinoplanes utahensis
gtggcgggggctcgtcacagagggatggaacggtcttggggtggccgggaacggctgctgtttctggggatcactctggtggctacgggtccggcctggcggttggtgccgtcggggagcccggtcgcggaccggatgccggcgatcgccggagtggcgctgctggtggcggtggtgctgatctttccggtgtcctgggcggtgctggcccgggggcggacggtgggacgccgggtcgggctgatcctggtggcgctggtcgcgggatggtcggtggcgacggtctcggcggggacttacgagacgccgcccagtgtggacgacttcctgcggtggcatctggtcgcggccggcctgacggtgctggcgggcgcggcctggagccgcggcggcgggtggggcggcgtacggctggtcggtggggtggtgtgggtttcgggggtggcggtgattctcgcggtgccggtggtggggcaaccgccggtgccgccgggggcggtgctgccggatggggtggtgagtctgcccgacggtgtggtggcggccgggaatcggctggactgcaaccgggcgcggtgcacccgggtgatcacggtgcgggcggcggggaccggagaggctcgggggctggcgcggcggatcgggaaccatctggcgatggcggacgggtggcggatgcggtggtatccggggttcgccgagcccgacgtcgactgccgggggtcgcaccggctggccgacccgtacgacctctgcctgcaactgcgggcggtcggtgagccggacgcgagtgtggaggtgcggctctactaccgcaatcggcatgatccggtctaccggacggcttcacaggattcgcatatttattga

SEQ ID NO: 6150 - DNA, 1122 bp, Actinoplanes utahensis
atggaacgagcgttcgtcctcctcaaaccggactgcctgcgcacgggccggagttccgccgtcgagtccgtcatcaccgccgagggcctgcgtatcgcctgccgccaccccctcaccctgaccccggccgacacccgcctcctctggtcggagtacaccgacgaaggccacgttctgatgcgcgccctcctcgaccgctatctgtgcacggccccttccgccgccctcctgctcaccggcccgaacgccttcgaagccgcccgccgcgtcaaacgcaccatccgctcccgctacgccaacggccccttcgccaacctcgtccacaccgccgaaaccccggctgagctggcccgccaagccacccacctcttctcccgccccgacctaccgcccgtcgaccacctcgggtacacccactcagcccccagcgacgccgcctcacaccgccccaccgatggccgaccacctgtccgtcacccggcacccgccggtggtccgccgcccgtcgatgggccggcgcctgtcggtggtccgccgcgcgtcgatgggccggcgcctgtcggtggtctgctgcgcgtcgatgggccggcgcctgtcggtggtctgctgcgcgtcggtggtccggcccccgccacatgctccggagagtgcgcacccccgttcctttcctccgacgcgtccccgaacgctccccgacccaccggccgcgacttccgtcaggacgccgacatccccgcactggtcaccgacctctggcccctgctgcaggccaccgacccgccgccgcccccgccgtatcacctggacgaccacgcccagcccacgcaccccgcgacgcgcgacgatgcggccctctacctcggcgcggaccgcgcacattccctggactcggccgtcaccgccatctggtcggcgttacccggtatcaccctcccgcgcgcactcaccctgatgctgtacgccagccgcgtcgacggttacccgatagccataggcagccaccacgccatcgcccagagccaccgcatcctcttgcagcaccagctcacggcctgcggcatcggcccgatacaccagcgctgggcgtcgccgatcgccgatcaaccggcgaagaaacagtga

SEQ ID NO: 6151 - DNA, 1023 bp, Actinoplanes utahensis
gtgctcaccagccggtccaccgacggcgggctgacctggtcgaacccggtcatcacggcaaccggctcactggacaagaactggatcgtctgcgacaacaccgcggccagcccgcactacggcaactgctacaccgagtacgacgtcaccagctccggcgactccatcagaatgaagacgtccaccgacggcggtgccacctggggctcggcactggcccccggaggcagccacgccggcctcggcggacagccggtcgtgctgcgcaacggcgacgtcatcgtgccgtacctgtcgaccaccgacaccatccgctcattccgcagcaccaacggcggcagctcgtggaactcgaccgtcgccgtcgccaccgtcagccaccacgacgtggccggcggcctgcgcgaggagcctctgcccagcgccgaggccgacgccgccggcaccgtgtacgtcagctggtcggactgccggttccgcagcggctgcccccgcaacgacatcgtcatcgccaagtcgacgagcgagaccacctgggccgcgccggtgcgggtgccgatcgacgcgaccagcagcacggtggaacatttcgtgcccggcatcggggtcgacccgtcgacgtccggcgcatccgcgcgcatcggactctcctactactactatccggactcgtcctgcacggcgtcgacgtgccagctcgacgtcggcttcatctcctcggtcaacggcggcacgtcatggagcggcgcgaccgcggtggccgggccgatgaacctgtcctggatcccgaacacctcccagggtcggatgttcggcgactacatctcgacgtccgtcgtcgccgggggcaacgcctacccggtgctgccggtcgccaccgcacccaccgggagcacgctgcatctcggcatgtcggttccggccggcgggctgccggtggtcggcggcgcgaacgctgcgggggcggcgctggcgggacaggcgggcggtgggaactccgcggtgtggcggactgcgcactga

SEQ ID NO: 6152 - DNA, 414 bp, Actinoplanes utahensis
gtgcatccacgtaccaccctgctgagtgcgctggcccttcccgccgccgcggccctgctgctgtggcccgcggcgccggcagcggccaacgccgcgctcacccaggtcagcaccgatccgtacaccgacacccaggcacaacatcagagtgaggtggagccggacacctatgctttcggatccaccatcgtgtcggccttccaggtcggccgggtctccggcggcggcgcgtcgaacatcggctgggcccggtccggcgacggcggcacgacctggacccacggcttcctgccgggcgtcaccaccagcggcggcggtacgttcgggcaggccagtgacgcctcggtggccttcgacgcctcggcggctccaccgtcgacgtgctcaccagccggtccaccgacggcgggctga

SEQ ID NO: 6153 - DNA, 3096 bp, Actinoplanes utahensis
atgtatcgcccggttccggcccaggtcgacctgcccaccctcgatcacgaggtgctccgcttctggcaggagcggaacgtcttcgcggagagcctgcggcagtccgcgggtcgtcccgagtgggtgttctacgagggcccgccgaccgcgaacgggatgcccggcgcgcaccacatcgaggcgcgggtgttcaaggacgtgttcccgcgctaccggacgatgaagggtttccacgtcgcccgcaaggccggctgggactgtcacggcctgccggtcgagctcgccgtggagaaggagctcggtttcagcggcaagcaggacatcgaggcgtacgggatcgccgcgttcaacgaccggtgccgcgagtcggtgacccggcacaccgacgccttcgccgccctcacccggcggatgggctactgggtcgacatggacgacgcgtaccggaccatggacccggcgtacatcgactcggtctggtggtcactcaagcagatcttcgacaagggtctgctggtcgaggatttccgcgtcgccccgtggtgtccgcgggaccagacgacgctctccgaccacgagctggaccaggggtacgagatcgacgtcgacccgtcggtctacgtgcgtttcccgctcacctcgggcccgctggccgggacgacgtcgctgctggtctggacgaccacgccgtggaccctggtgtcgaacacggcggtcgcggtgcacccgtcggtcacctacgtggtggtcaccgacggtagggagcggttgatcgtcgccgagccgctgatcccggagggtctcaccccgaccggcgagtcattcctcggcaaggaactggagcgctggacctatcagcccccgttcgcgatggtcgacgtgccggacgcgcacatcgtgatcctggcgaactacgtgaccaccgacagcggcaccgggctggtccaccagtccccggcgttcggcgctgacgacctggccagctgccgcgcctacggtctgccgatggtcaatccggtgcgccgggacggcaccttcgagccggagatcgaactggtcggcggcatgttcttccgggaggcgaacgggccgctcgtcgaggagctgcggaccagcggccggctgttccggcatgagccgtacgagcacaagtatccgcactgctggcggtgccacaccgcgctgatctactacgcgcagccgtcctggtacgtccggaccaccgcggtgcgggacgcgctgttgcgggagaacgagaagacgaactggcaaccggccaacatcaagcacggtcggtacggggactggctcgtcaacaacgtcgactgggcgctgtcccggaaccgctactggggtacgccgttgcccatctggcggtgcgcggcgggccacctgacgtgcatcggctcgcgagccgagctgtcccacctgaccaaccgtgatctgtccgacctggatccgcatcggccgttcatcgacgagatcacattcgcctgcccgcagtgcgaggcggaatcggtccgggtcccggaggtcatcgacgcctggtacgactcggggtcgatgccgttcgcccagttcggctatccgtaccagaacgccgaactgttcgagcgccgcttcccggcccagttcatctccgaggccatcgaccagacccgcggctggttctacaccctgatggcggtcagcacgctcgtcttcgaccgctcgtcctacgagaacgtggtctgtctcggccacatcctcgccgaggacggccgcaagatgtccaagcacctcggcaacatcctggagccgatcccgctgatggatcagcacggcgccgacgcggtccgctggtacatggcggccgtcggctcaccgtggtcggctcgccgggtcggtcactccgggctgcaggaggtggtccgcaagaccctgctgacgtactggaacacggtcgctttccaggcgctctacggccgtaccgcccagtggacgccgtccgcggcggacccggagcccgcgcagcggtccgcccttgatcgttgggttctctccgagttgcagcagctcatcgcgaaggtcgacagcgcgatggcggcgttcgacccgcacgagacgggcaaactgatcgccgccttcatcgacgatctttccaattggtacgtacgccgtagccgccgccgtttctggcgaggcgaccccgccgccctcgccaccctccacgaagcgctacgcgccgtgaccctgctgatggcgccgatcaccccgttcgtcaccgagcgggtgtggcaggacctgatcgtcgcggtcgatccgcaggcgccgtcctcggtgcacctcgcggcgttcccggagccggacaccgccctggtcgaccacgatctgtccgcgcagatggcgaccacccggcggctggtcgagctgggtcgcaccgcccgcgccgaatccggcctcaagatccggcagccgctgtcgcgggccctggtgtccggcggcgccgacctgccgcccgagctgctttccgagatcgccgccgagctcaacgtcaacgcggtcgaggcgctcgccggttcgttcgtcgacaccaccgcgaaggcgaacttccgcgccctgggccggcgcttcggcaaggccgtccagcaggtcgcggcggtcatccaggccgctgacgcggcacgactgaaggacgatctgcggacgaagggatccgcgaccgtcacggtcgacggggaagaggtcacgctcgccccggacgaggtggtgatcaccgagacgccgcgggagggctgggcggtcgcctcggacgccggcgccaccctcgcgctcgacctgcacctgaccccggagctgcgccgggccggtgtggcccgggacgcgatccggcagatccaggaggcccgcaagggcagcggcctggaggtctccgaccggatccggctgcgctaccgggctggcggggacacgtcgctggccctggccgagcaccgcgacctggtcgccgacgaggtgctggccaccgacttcgcggccggcgacccggactgggccgatccgcgggagttcagcgacgactcgatcggcctgaccttctggatcacccgctcgtag

SEQ ID NO: 6154 - DNA, 195 bp, Actinoplanes utahensis
atggccgtgtcgccggggcagccgaccgagctgaggtatgccgacgtcggcctgaggcgactgaacgtgctctggcccaccgagggctgggagttggtcgccgcggtcgaccactccgccgccgcggcatcagagacttcgtactgcaccaggaaagatgtcgcgctctgcggaacgccttcgacgcagaagtag

SEQ ID NO: 6155 - DNA, 309 bp, Actinoplanes utahensis
atgtacgcctgccggaacagcgccggagaggtgaagctccgcgattccggcacacaaccgtgttccaggacatggacgccgatcagctggaatgccaaaggcgtcgccggcccagcgggcccggccggcgccacgggcgccaccggccttaccggcccgcaggggaccaccggtcttaccggcccgcaaggcgccaccggtcttaccggcccgcaaggccccaccggtcttaccggcccgcaaggcgccaccggtcttaccggcccgcagggtcccatcggcctcaccggtccgcaactagctagctag

SEQ ID NO: 6156 - DNA, 5292 bp, Actinoplanes utahensis
gtgcaggagaggccttcgccggttgcggctcggtcgcaaacaccgcggctgcaaccgccgacctctccggtattccgtgacaaaagagaacaattctcgcttagcctcagtgacgtggggttacgccgggccgccacggccgtgctggtggtggtcctggcggcggtgacgatgctgaccgtcggccacgccggggccgccgtcacgtccaccttccgggaccgcttcgacgcgaacacgaacggttcgatcatcctgcgcggcaactcgaacctgacctgcctgctgtccgggcagcccacctgcccgcaggcccgcaacggcaccgccaccggagcgagcgcgaacaacaacagctacgcgatggcgtacaccgacgtcgacaccaatccgctcaccttcaacgacagcctggcgacgctggacatgccgcccggcagcacggtgttgttcgccggcctctactggggcgcggactcggtctcgccgctgcgcgaccaggtcctgttcagcacggacggcggtggctcgtaccggccgatcaccgccgccacgctgtttcccaacggcagcatctaccaggggttcgccgatgtcaccgcccaggtggccgggatcggcaacggcgtgtacgcggtggcgaacatccaggcgtcgatcacgtccggctcgtatgcggggtggtcgctggtggtcgcgtaccacaacgccgcccaggacatgcgcgcgctgcgcgtgtacgacggcttcggccaggtctccagcggcaacaccaacatcccggtgaccggcttcgagaccccgcacaccggcaccgtgcacgcgaaggtcggcgcggtggcgtacgagggtgatcgcggcacctccggcgacagcctgcaggtggacggccgctcgctgaccgatgcgcagaacccggcgagcaacttcttcaacagcacggtcagtgagtccggtacgccggtgggcggccgcaccccgggctacgacaacaccctcggcttcgacgtcgaccaggtcgacgcgaccggaatgttcgccaacgccgccacctcggccacgctgaccctgaccaccaccggggaccagtactacccgggcgtcctcaccttcaccatcgacctgtacgcccccaacatcaccaccacgccgtcggtggtcgacctgaacggcggcggtctggtgcccggcgacacgctggagtaccgcatcgcggtgcgcaacgagggcaacgacaccgccgacggggtcgtgctcagcgacgccgtcccggactacaccacctacgtgccggggtcgctcaccgtggcggcctcgccggtcaccgacgcgagcggcgacgacgccggatcctatgcggccggcgcggccgggtggacgctgggcagcatcccggtcgccggcaccacctgggtcaccttccgggtcaccgtccagcccggcgcgccacccgggtatccgatcaccaacctggtcaacgtcgcctattccgggcgcagcagcggggtgagcgtcaccgccaccggcgccaccaccgccagcgtcgtgctgcagccgcacgacgacctcgccgccgcgctcgcggtcaccccgccggtcgtgcagcgtgccgccactcccgccgcggtgacctacacggcgacggtcaccgacaccaccggcgacctggaaccggccgccaccgccaccctcaccctgcccgcgggcgtcacgcccgggatgatgccgaccggctgctgggccgccgggcaggtggtcacctgtgccctgggacccgtggccgccggcagttccgcgcatgccacggtcccggcgaccgtgagcgggtccgcggcggcgagcccggtcgccaccctgcggatcggtggcacgggagcggacgcgaacagcgcgaacgacaccgccaccgccacgctcgtggtcaacagcgcgccgaccgtcgtggccgacagcgccgccacgtcgttcggcacgcccgtcacgatcaccgtgaaggccaacgacagcgatccggacgatccgatgtccgccctggtgtactcggtgtccggtccgccgtcgcacggcgtggccgtggcccgcagcgatcagggcatcacctacacccctgccgcgggctggtcgggcaccgacaccttccggtaccgggtggacgacccgcacggcggctcgggcatcgcgaccgtcacggtgaccacgggcaacgcgccgccggtcgcgaacgacgacgtggtgaacacgccgacggacaccccggtcaccgtcgacgtgctgcagaacgacgccgaccccaacggcgacccgctgaccgtcaccgcggtcacccagccgccgtccgccgccggcacggtgaccttcacggacaccgacgtcaccttcacgccggatccggtcttcaccggcacgacgacgttcacctacaccgtgagcgacagcagcggcgacaccgcgacggcggtcgtgtccgtcgacgtggagaacgccgcgccgaccgcggccggcgacctgttcccggtcacctacccggcggcacaggccggcgtggtgctgccggtgaccgggaacgacaccgacccgaacaacgacccgctgaccgtcacggccgccggtcaaccggcggtgggcaccggcaccacgtcgctgtccgccggggtggtcacctacaccgcgccgcccggcttctccggtgtggccacgttccgctacacgatcagtgacggccgcggcggcacggacagcgcagcggtgacggtcgtcgtcgcgaacgcgccgccggtggcccaggcgttcgtgaccacgaccggctaccgcacgccgcgcaccctgaccgtgctcgccgcggccaccgacccgaacaacgacccgttgcacgtctccggcgccaccgcaccggcgcacggcgtggtcacccgcgacccgaccggccggatcacctatctgcccgacgtcgccttctcgggaacggactccttcgcctacaccgtcgacgacggcaacggcgggaccgacaccgccaccgtgacggtgaccgtcgccaacgggcttcccgccgcccgtgacgacgcggtcaccggcttcggcggcgcctccatcacggtcgacgtgctggccaacgacgaccccgatccgaacggcgagccgctgaccgtcgcgatcgacggtccgcccggccacggcggtgcggtggcggggcccggcgggcgggtgacgtacacgccggccgcgcacttcttcggcgtggacaccttccactacacgctcgacgacggcagccacacgctggtcggcgcgaccgtgacggtcaccgtggtgaacgtcgcgccggccgcccgtgcggatgcggcgatcatcgacacgaacaccgccgtggtgctgccggtgctggccaacgacgacgacgcgaacggcgacccgttgacgctgaccgcggtgggcacggcggcgcacggcacggtcaccgcgaacgccgacggcacggtcacgtacgtgcccgccaccggtttctggggcaccgacgcgttcggctactcgatcgaggatccggccgggctcgccgacgcggccaccgtcacggtcaccgtgcgcaacgcaccgccggtcgcggccgacgacaggttctccgtccggccggccacgccggccggactgtcggtgctggccaacgacagcgatcccaacaccgggcaggtcctcaccgtcgcctcggccaccacaccggcgaagggcacgctgacgctgaccggcggagtgctcacctaccgggcgaatcccggcacggccggcaccgacatcttcgactacgtggtcaccgacgacgcgggcgcaacggccacggcgcacgtcaccctgttcatcaacggcgtgccggacgccgtcgacgacgccgtggcggtaccggccgacaccgccgtcgacatcgccgtcaccgccaacgacaccgaccccgaagcgcagccgctgcgggtcaccgcggtgggcacgccgtcgcacggcgcgacccggatcaacccggaccagacggtggagtaccggccggctcccggcttcttcggcaccgacaccttcggctacaccatcaccgacaccgcggacaacacggcttccgcgcgggtcacggtgcaggtcgcgaacgcggcgccggtcgcgcggccggacaccgccgcactgctctccgaccggtccgtgctggtcgacgtgctcgccaacgacagcgaccccaatcccgggcagacgctgaccgtcgtcgcggccggccagccggcgaacggcgcggccaccctcgccgcgggcggcatcaggtacaccccggcagtgggctacgtcggccccgacacgttcacgtacacgatcggcgacggcaacggcggcacggcgaccgggaccgtcgccgtcacggtgtccaacggcgtgccggtggcggtgcccgacgcccgcaggacgccatacgggcggccgatcaccgtcgacgtgctcaccaacgacctggatccggccggcacgctggcggtcacctcggccggggtgccggaccggggcacggccacgttcaccccgggcgcggtgacctacacaccgccggccggtttctccggaacggcgacgctcgactacacggccgtcgacgacgccgggcaccgcaccggcgcgacggtcgcgatcctggtcggcgtgcccccgtcggtgccgaacaagcagaccaccgtgcgcgacggccagctggtgcggatcggactgccggccaccgggcaggacgggcggccggtcagcctcagcggtatcggccggccgcggcacggcacggcggtgatgaacgcggacggcacggtcacctatgtgccggatcccggcttcagcggcaccgacgacttcacctacgaggtgatggacgccgacggcaacgtggcgcaggcgacggtgcacgtgatcgtcccgccgccgccggcaccctcgccggtgccgtcgccgtcaccgtccgggccgccgtcaccgtccgggccgccgtcaccggccgggccgccgccgatgtcaccctcgccgtccgggtcgtccgcgccgtccgcgtcaccctcgtcgtccgcgccgcatctgccccggccgagccggagctcaccgaccccggcggcaccgcaccggaccgcgccgagtggagacacccggccaccgacctcgcccgtcaccggaccggacgccgcggccgtggcgctggccggcctgtgcgtcctcgcggtcggcgccacgctctgccggctcgccggccggcgcaccggccggccgcccaccggcggcgactga

SEQ ID NO: 6157 - DNA, 747 bp, Actinoplanes utahensis
atgtccgatgcttccgggatggacgtgaccgcatacctcgaccggatcggtgccgacgaccccggattgcgcgagctgagccgcgcccaccagcgcgccgtgccgttcgagaatctcagcatccatctgggggagaccatctcgctggacccggacgcgcttttcgacaaggtcgtgcgccggcgccgcgggggtttctgctacgagctcaacggccttttcgcgctgctgctggaagagctcgggcacacggtcgaccgggtcgcctgccgggtgcaccgcggggacggtgttttcggcccgctcttcgaccacctcgccttgatcgtcgacggtgaatggctggtggatgtgggcttcggccggcacaccatctatccgctgcggctcggcgaccgtgcggaccaggtcgatccggaaggccgtttccggctcgtcgacgcccccgatggcgacatcgtcgtgctgcgtgccggcgaaccgcagtatcggctggaacgccgggcccgtccgctcaccgatttcgcaccggcctgctggtggcaacagacctggccggaatcgcagtttcgccgggccccggtctgcacccgcctggacggtgacacccgcatcaccctgagccgccgcaccctgctgcgcaccgtcggcggcgatcgtgtcgagaccgaactgacctccgacgcggatctgctcgccgcgtaccgcacccatttcggcatcgaactggaccgcccgatcggatag

SEQ ID NO: 6158 - DNA, 996 bp, Actinoplanes utahensis
gtgatgacgatcgatgttccgcccggtatggtcatggcccccgcgtcgcgcgcgacgcgggggccagtctccgtccgtcatccggaaggctccgctgtgcccctcgaggtgcgcccgatcaacggccccggcgagatcgacctgttcaactcgctgccctaccagctcaatccggagatcgccggcgacctcgaggccgggcggcgccggccgcaatggctgtggatcgccctgcgcggcggcaccgtcgtggcccgggccggctggtggtcccggcccggcgacgcgctgccggcgctcatggacatcttcgacgtgaccgacatcgatgccggccgccacctgctgcgcacggcgatggccgccgtcccgaccgggcagtacaaccgctatctgccgccggattggcgggagacggcgcgcgcggcggccgaggtgcgcgagtcgctgctggccgagacgggcggcaggctcttcgtcgaacggctgcgtctggaatggcggcccggcacgccgatccgcgaccccggcgaccgcctgcgcttccggcccccgcacggtgccgacgaactgatcggcctgatgaccgcggtgctcgacggcaccctggacgcgttcagccgggacgatctgcgccggatgaccgcgcgcgaggcggccgaacagcagtatgccgaggagctggcgcggtacggcagcccgcgcgactggtggcgggtcgcggtccgggccgacgacggcgagccggtcggcttcgtgatcccggcccacaacggatatcacccgatcatcgcctatctcggggtcgcgccggtgcatcgcggcaacggatacatcgacgagatcctggccgccggcgtgcggatcctggccgatcgggacgtgccgcggattcgcgccgccaccgatctgggcaacaccccgatggcggcggctttcgcgcgcgccggattccgcgccttcgaacacgagatcgccttcacctggccggattga

SEQ ID NO: 6159 - DNA, 1677 bp, Actinoplanes utahensis
atgacggcgttgtacgacgtggacggcgtgcccgccctgcatgctcccggcaccggcccgatgcgtgccgggctgatcttccgggtgggtttcgccgacgagccgctcgcccggcacggcatcacccacctgctggaacaccttgcgctgcactcgctggggatgaccgaccaccacttcaacggcacgaccggggtggagcacaccagcttccacctgaccggcaccccggacgaggtggcgacgttcctgacccgggtcagcaccgccctgcacgacctgccggcgcaccggctgccggtggagaaggatctgctgcgcgccgaggcgaacgggcgcggcatcgacccgaaaccgctgtggcggcacggcgcgatcgggtacgggaccgtgtcgtacccggagtggggcctgcccgcgatcaccgccgatgacctgcggacctgggcggcacgctacttcaccagggacaacgcggtgctgtgggtggccggcgaccgtatcccggccgggctgcggctggccctgccgcccgggcgccgcgagcccgcgccggacccgtcgaacgcgctgccggtcactccggcctggttcagcggcggcgacagcgtggtggcctgggacgcgctcgtcgcccgcggcgcggccaccgaggtcttcgccgacgtgctggaacgcaccatgttccggcagatgcgccaggaggccgggctgtcctacacggtgggtgcacactggcggccgatcggttccggacaggcgctggtgaccgcggtcgccgacgcgctgcccgagaagtccggggcggcgctcggcgaattcctcgacgtgctggccacgctgcgcgccggacggatccatccggacgacctgtcgaccgtcgtgcggcagcgcgcgcaggcgctgtggcaggccgagcagtccggggagcggctcgaggcggtggcccgcgacctgctggccgggctgccggtgcgctcggccgaggcggaattccgggtgtacgaggcggtcaccctcccggagatcgtcgcggtggccgaggcggcgagcgcgaacgggctgctgatggtcccggacggttcgtacggcgggtgggccgggttcacgcacgcgccgaccgcgtcggacaccctggtcaccggcaccgcgtacgagtcgctgaacgacccggcggaacgtctgctggtcggcccggacgggatcagcatgatcgccccggatgcccgggcgaccgtccgctacgcggcatgctcgatcatgcgggcctggccggacggcgcccggctgctggtcggcaccgacggcatccgcatcatggtcgaacccgatctgtaccgcgccggcgacgacgcgatcggctggatcgaccgtgccgtccccgcccacctgcgcgtcgaccagcccccgcgcgacccgtcggcgctgcccacaccggcaccggcccgtccggcgccggcatcggcatcggcatcggcatcggcatcggcatcggcgaagaggttcaacccgaaaacccaacgcacattgtcgtacgtgatgagtggcatcagtgccggcggcgtcgtgtccatgcagcagcacgagccggtcctggccgccctgttccttctgctgctgatcctggtgacgaccggtggccacgtcatgcggcgccgcctacggcaccatatgtga

SEQ ID NO: 6160 - DNA, 528 bp, Actinoplanes utahensis
ttgcagctggggccggccgagacccgccgccgttacgaccggatgctggccgcccacccgcacgactacgccggacaggcgcaatacctgcagagcctgtgcccgaaatggggcggcgactggccgcgggcgcacgcgtgggcggccgaggcgaccgcggccgccccgcccggcgcggcgcaggggtcgctggtcgccatcgcccacctggagaactggctggagctcgacgagcccgaagccaccgcgtacctgcgtgaggaagccgtccgggacgcggtcgcgcaggccgcgcaccgctcggtctggcacgccgatttccgccgggagccgggctgggtgccggccgcgagcgcgttcgcgatggcgttcagcctgatggacgagcggccggcggccggtgccgtcttcgcgatgctgggccgcctggcccaccggttcccgttcagctacctcggcggcgatcccgccgcggtggtcgccggtctgcgggaccggtcactgtcgccggtggggggcgtccgatga

SEQ ID NO: 6161 - DNA, 1407 bp, Actinoplanes utahensis
atgttccggccgcggggttgcgaatcgggtgcgatcggcgatcacccgggttgtcgtgccggccgcggcggcgcgcatcatcatcggatggaacatgtcccggtggtgatcgtcggcgccggcccgaccggcctgaccgccgcgctgatgctggcccgtcgcggtgtcggatgtgtggtgctggagcgcttcccggagccgtatccgctgccccgtgccgtgcacttcgacgacgagatcttccgcgtcctcgccggcctcgggctggcggccgggctgcacgcgatctcccggcccgcgcccggcatgcaactggtcgatccgtcgctgcggccgctcgccaccttcgaccgcgagcccgccggcgagcacggcttcccgcaggccaacatgttcgatcaaccggatctcgagcgcctcttgcggcaggcgttgccccacggagcgcttcgcgccgggagacaggtgtacgacgtggagcagccgccgtccggtccggtcctcgtccgttaccgatcagtggaggggccgggtgaactgaccgccgacttcgtgctcggctgcgacggcgcgaacagcctggtccggtccctgatcgggtccacactcgacgacctgggcttcacccagcgctggctggtggtcgacgcgcagggcccggacctgtccgcgtacccgggggtgcagcaggtctgcgacccgtcgcgggcggccaccttcatgatggtcacgcccggccgatatcgatgggagttccgcctcccggtcgaccggtcggtgccgtcgctgctccagccctggctcagcgggctcccggacccgggggcgctgagcattctgcgtaccgccgaatacaccttccgcggcgccctcgcctcccgctggcgggaccgccgggtcttcctgctgggcgacgccgcccacctcaccccgccgttcatcggccagggcctgtgcgccggcatccgggacgccgccaacctgacctggaagatcgcgttcgtgctgtccggccgcgccgacgagcggctgctcggcacgtacgcccaggagcgtcgcccgcacgcccgcagcatgatccggatggcgatgctgatcggctgggtgatgaccggcggcagccgccgctcggcggcactccgccgttttctgctacgcaccgtcaccagactgccgggcgcggagcgccgggcgatgaacgtcgcgtggccggcgttccaccgtggtccgctggtcggcccgggcggtggccggctctgcccggccgctctcgacgagtcgctcggcgacggcttcgcgctcaccggcggcctgctgatccggccggaccgggtcgtcgcggccgccggccggcacgcccgcaaggacttcccggccgccgccggcatccacgattccggcctgtga

SEQ ID NO: 6162 - DNA, 1509 bp, Actinoplanes utahensis
gtgggccggcctgcatccggtcaccgcgccgaaccgggccgccgaggtgttcagcggcttcctgcgccacctggcctatctggaggtcgagccgaccaccgacccgctgcccgagctgcagtggttcccggccgcggcggcggtgcgctgatgctcgccgacgcgctgcgcggcctgccggacggcttcgccggcaccctcgccctggtcgacggggtcgacgacacgctgacccagggcctggcccgcgccgacccggccgcgctggaggctctcgtcccggcgttcgccggctcgccgctggccgagcgggtcaccgaggcgatcggcaagatcgtggccggcacggtcaccgacgagcacctgctcaccctggccggggcgcgcaccgcgctgctcggcgccgcgcacgacgcgctgcgcgacagcctggacaccgccctaggccgagcccgcgcgccatggtcggccaccccggccgcgaccgattccggtcaggtcctcgccggcgcccggtcgtggctgcgcgagctcgccatcgccggctggcgcggcgtcgaccacgagctggccgggggcgccgggccggccgtccagacactgctggccgacccgggcgcccggcggctcgccgtgctgctcgacggtctcgccgccgagttgcggacggccgcgccggtcgccaccctgccgcggatcccggtgcgccggtgggccgacctgtggacccgcgcgctgctgctcgcccaaccgggccggccggccttcgccgccaccccggtcgacgggcggctgctgctgctcggcgtcgacctgcacgagcatccgacggtgttccaggcgcaggcccacgctctgctggagaccgccgacggcgcggtccgcctggtccgcaccagcgtggccgccgccaaggtggacacgatcagcggcccggccgcgtggcggatgctgaccgccttcccgacgctgcgccgcgcgctggccgagcaccgcgtcgtcgaggtcgccgggatggcgctgacccccggcggcgacctgatctgggacgaggcgcgcgccacggcgggtgcgccggccgaccccttcgcggccgcccgggtgcggctcggcacggccgccgcgctgccggtcaccccgctcgatcggcacccggcggcgctggccgagccggtgctgctggagggctacggccacaccgatcgggcgttcgacctgggcggcggcgtcaccctggcggtcgacctggaccggctgcccgcggccgggccgctcacccccgagctggtcgccgcctcgaccgcctgcctcggcctgctgcgctgggacggacggtggctgctgcagccgctggccgtgcagacgctggtgaagaagaagccggtggccgtgcacggcggcgactgggcgctcggcccgaccgaggcgaaagcggccaaggccgaggccgccgccggcaccgcggtcgacgtgttgcgcgagcgcgcgggaaggctgctgcggaaatga

SEQ ID NO: 6163 - DNA, 1470 bp, Actinoplanes utahensis
gtggctgctgcagccgctggccgtgcagacgctggtgaagaagaagccggtggccgtgcacggcggcgactgggcgctcggcccgaccgaggcgaaagcggccaaggccgaggccgccgccggcaccgcggtcgacgtgttgcgcgagcgcgcgggaaggctgctgcggaaatgagcgctgcggagaatcgccggcaggtgctgtactggcggctgctggcccggctgttcgacccggaggagcaggccaccctggagtccgcctcgatggccgtcgtcgacgacctcgggctgcccgccgcgctgctcgacccggcggtgtcggtggacaccgtcgtgcagcgcttcccgcacctggcggccgagttcgacaccctgatgagcgatcccggagacgaccgggagggcgaggtgcgccgcgccgcgctggtgtcgaaactgctgctcaacgtgttcgccaccgggtccggcagcgtgaccgcggggcagttgcagggctggcaggccgacgccggctggttcgagcgggcgatgggctgcgagcccggccggctgcgcggccgctccggcgagggcgaggacggtctgggccgggtgctcgccgggatcgagggtgacctgatcagccggatgcggctgcgcgaggtgctcgccgacccgcggctggccgggcagctcaccccgagcatgtcgctgatcgagcagctgctgcgcgacaagcacaacctggacggggtcgcgctggccaacgccaaggcgctgatccgccggttcgtcgacgaggtggcccaggtgctgcgcacccaggtggcccaggccggtgccggcacgatcgaccggtcggtgccgccgaaacgcgtctaccgcaacctcgacctcgaccgcaccatctggaagaacctgccgaactggagccccgacgacgagcggctctacgtcgaccgcctctactaccggcagaccgcgaaacgcgtcgagccggcccggatgatcgtggtggtcgaccagtccggctcgatggtcgactcgatggtgaactgcaccatcctggcctcgatcttcgcggggctgcccaaggtcgacgtgcacctgctggcgtacgacaccgtcgccctcgacctcaccccctgggtgcacgacccgttcgaggtgctgctgcacaccaagctcggcgggggcaccaacggcacggtcgcgctcgacctggcccggcccaggatcgccgacccgcgtaacaccgtggtggtctggatctccgatttctacgagtggcagcagcaggccgtctgggacggcatgcacgccattcaccggtccggagtgaaattcatcccggtcggctcggtcagcagcggcggccaccagagcgtcaacccgtggttccgccagcgcttcaaggaccagggcaccccggtcctgtccggacacatcaagaagctcgtcgccgagctcaagaacttcctcgtctga

SEQ ID NO: 6164 - DNA, 1113 bp, Actinoplanes utahensis
atgagtgacatgctgcgcgcccccgccgaggtcaagtacgccgacgagctcgactggctcgagtcggtcgacgacggccccaagccgttctcctggcggctgagcccccggatggtccggctgttcatcctcggctcggaacgcgccgacggcctcgaccgggagatcccgcagaaatggttcggtgaccgcagcttcgtcgagcgggccatcgtcaccctcgcctccgaccgcggcctgctgctgatcggcgacccgggcaccggcaagagctggctggccgagctgctcgccgccgcgatcagccgcaactcgacactggtcgtgcagggcaccgccggcaccaccgaggaccacatcaagtactcgtggaacgtgtcgatggtgatcgccaagggccagtcccgggcctcgatgatcccgtcgccgatcatgacggccatggagggcggcgtgatcggccgcttcgaggagctcacccgctccaccagcgacgtgcaggacgcgctgatctcgatcctctccgagaagtacgtgtcgatccccgagctcgacgacgacaacatcgtcttcgccaagcccggtttcagcatcatcgccaccgccaacagccgcgaccgcggcgtcaacgacctgtcctctgcgctcaaacgccggttcaacttcgtccgcatcccggtcgtgacgaacaggaagagcgaggcggagatcgtccggttccgcaccgaggagctgctgcgccggcacaacatcgagctcgaggtgccgcccaccctgctcgacgtgctgctgcagagcttcgccgacctgcgcgccgcctccgccgcggcgagcagcgacgacgagcggctcgagtcggcactgtccaccgccgagcagatcggcgtgctggaggacgccatcctgcacagcaatttcttcggcgcccgcacgctcacctcgcaggcgctggccgggtcactggtcggctcgctcgcccggcgcagcccggaggatctggcgatcctcaacaagtactggcacggtgtcgtggagccgcgcagcagggagcacagcggcgagtggaccggcttcctggagggcggccgccaggcgatcgccaccctgtcatga

SEQ ID NO: 6165 - DNA, 2016 bp, Actinoplanes utahensis
gtgaaggctgaccggcaccacgatcgtctgggcggcgggacggctcgccgggggtcggggcaacccgacgacgccccggcggcacggtggcggcgcggggctctcgcgacgtactacgtggcgttgaccgtggccaacctgatgctgctcagcggggtcgcccgggtggtgctgagcgggctggccgcggcgaccgccgtgctgctgttcgcggcggcgacgctcggcgcggtccggcggggtttcggccggcctgggcgcgcctgggagaaactggcgtatcttccgatgatcgacgccgtggcgcaggtcgcggtgaccggagagctccatcacacgacgacgctgctgctcaccctcgtcggggtgggcggcgcggtgccggaccggcggatcgcgatgcgcgccgccctgctcgggtgcgtcggctgggccgcggtcgtcatgctgcagcacgggctgcggacgccggagctcggcttctacggcgggcagctgctggtggcggtggtgctcggcgcgatcctgcacgaggcgctgcggcgtcgccagcgggacctgaaatcggcacgggaccagctcgcggtggtcctcgcacgcttcgagagcctgttccaggcctcgccggccggagtggccgtcgccgacgagcacgggatgctggtcgcggtcaacccggcgttctgcgacctggtcgggcagcccgcgagcgaactcgtcggtgccagcgcccacgcctacctcaccccggacggggaggggcccgtcgcgccggagccgggcgacggcgggcacccggcctcggctgccgccggcgccggcgttgccgtcgacggcgggcaggagagtgcggcggggcggtcgatgcggttcgtgcggccggacgggtcggtgcgctgggtgtggctgacggtgggccgcaccggggcgccggaccgcagcgacaagcggcgctggatgctgcttcacctgcacgacgtcaccgaccggcacctcgccgaacgcgccctgcgggaatccgatcggctgctggccgcggtgtccgtggcctcccggcggatccgcacccggcaggacgcccgcggcaccatcatcgaagcggtccgggaactcgccgaggccgactcggtcaccatgctcgaacccgacggcaccgacctggtcgccaccggcggggtcggcgtcccggtgatcggcacccgggtgccgatggacggcacctccatgatcgccgccgtctaccgggatgggcagccggtcttcctcgccgaccccggcaaggacccgcgggtgtcggcggccctgctgcggctcgtcgacgccagctcgatgatgtggcagccggtgatcgccgacgaccgggtggtcgcgctgctcgtggtgagctggcaggcccggatctcctcggtcagcgacctgcgggcccgggcggtcgccctgctcgccgacgagaccgccctcgccctggaacacgaagggctgctcggccggctggaacggatggcgtacaccgacatgctgaccggcctgtcgaaccggcgcgcctggcaggcgggtttcgccgaacttctcgtcgccgcccgcacggacggacgcccgctcaccgtggcgatcgccgacctcgaccatttcaagcggttcaatgacacgtacggtcatctcgccggtgacgaactgctgatcgcgaccgcgtcggccttccgcgcccagctgcggtccggcgatctgatcgcccgctggggcggtgaggaattcgtcgtcgccctcccggacagtaccgcgcaggaggcggcggcgatcctggaccggctgcgcgagtcgacgcccggcacggaaacctgcagcatcgggtacgcggtgtgggacggcgccgagtcctgcgaacgcctgctggggcgcgccgacaccgccctgtacgccgccaaggccgccggccgcgacacggtccgcgccgccgatccgacgggctgcgacacgcagccgggcccggtggggatcacggcggcgagacgttag

SEQ ID NO: 6166 - DNA, 375 bp, Actinoplanes utahensis
atggggctgttcacggtggcggaggcgcgcgcggaactggcccggctgcggcccgtcctcgacgagatcgtcacgctgcgggccgacatggtggagctgtccgccgcgctggtgccgggtggtgagccgaccacgctgggcggcctgcccgagcgcaaggcggccgaggcccgcctcaacgagctgatgaccacgatccaggagtcgggcgccgagctgaagggcgtcgctcccctgctcctggacttctccgccgacctcgacgggagcccggtcctgctctgctggctggagggcgacaccgacctcgcctggtatcaccgccccgacctgggcattgccggccgccgcccgctgccccccgacgccgcctga

SEQ ID NO: 6167 - DNA, 183 bp, Actinoplanes utahensis
atgggcgccggcgagatcgccaagcggctggggctcagccggcagcgtgtgcagcagctcgccgagcgggatgacttcccgtcgcccttcgacgagctggcgatgggccgggtctggctgatccccgacatcgaggcgtggatccggcagcagcggaccggagcgccgccgcccgaccggtga

SEQ ID NO: 6168 - DNA, 471 bp, Actinoplanes utahensis
atgggcggcatggaattcaaggtgcacgcgttgccgctcgatgtgttgaagcgggcgcgccaggacagtgtgggcgggcaaccggaagtcgtgcggatcgtcgcggggggcggcgaaccgctgcgttgctgcctccgcgatgcactggccggcgaagtgttggtgttgttcccctacgcgccgccgatcccgccgagcccgtaccgggaggccggggcggtcttcgcccacgccgccgggtgcaccgggcccgcgggtgacggctatccccacggctggcgggggcggccacaggtgctgcgagcctacgatccgcgtggctggattcatccgaacacccgggtgcacgacgggaccgacccggagggcgtgctcgccgagatgttcgccgacccggacgtcgtccaggtgcacagccggaacgtcgcctacggctgcttcatgttcgccatcacccgcgccgcgacctga

SEQ ID NO: 6169 - DNA, 2427 bp, Actinoplanes utahensis
gtgcttcccgcccagacagaccgcccgcggctccgggtcgtcatcggacacgcgcccgacggcagtcccgtccacctcgacctgcgcgaagccgtcgacggcggtgtggggccgcacggcctgatcaccgggagcctcagcggggctctgctgagatcggtgctgctggggttggccaccgcgcacaccccggacgaggcgtcgttcgtcctggtggacgcgaccaccgacggcacgctcgccgagttggaacggctgccgcacaccgaagtgctgctcgacgcacgcccgttcgcccactccgccacaccaaccaccgccacgccgagcacaaccgcaccgcccgcgaccgccgcaccgcccgccgcaccgcccgtgacctcaccgttcgcggcggtgccgatcgcaccgccggccgcaccgcccgccaccgcaccgctcgcggcggtgccgaccgccgcttccccacctgccaccgcattcgccgccgcggcgcccgggggcgggtcgcttcttccgggcgggagcgggttgtcgctgctgccgcggctggtcgaggtgctggaaggcgaactcgcccggcggaaacggatgctggtggcggccgggtgccggagtcacagcgaatatctgcggcaggtcggcggccgggtgccgatgccggcgctgatcgtggtgtgccatggattcgccgcgctgttcgcggcgagcccggccctgctcgaggtgatccggcagatcggctggctcgggcgggcccgcgggatccacctggtgctggccgattccggcactgagacgccgcaaacgtatgaactggacggttacctctcctaccggatcacccccgggctgctgcggatcggcaccgatcagcggatccccttccagccgcccgcccacgccgcggtcacgatcgaccacgcggcgccggggccggcccacccgatctggcttccgccgctcggcccggcacccgcgctggacgaactgggcggtgccgtcgtgtccgatcctgatcacggcttgcgcttcgccgacgagaccctgcgcggggcgctgcaggtaccgatcgggatcctcgacaaaccacgggaacaggcgagggacatcatctggctcccggtcgccgggcacgtcgcggtcgtcggtggcccgggcagcggcaagaccacgatcctgcgtacgttgacagcttcgctcgcgttgtcccacacggcgcccgaggtgcgcgtactggcgccggaagctcttgactgtcgccggatctccctggtgagggacatccgggacgatctgaagcgggagctgtacgcgcgcctggacgacccgcacggagacacggtgctgctgatcgacgggtgggcggagttctgggacgagcatccgaactggcacgacctgctggtggagatcgcccgcaaaggcgccgggcgcggtgtccacctggtggccacggcgtcgcgctggaccgagttcccgcccgccgtcaccgatcatttcgggtcacgcctggagctccgcctcgacgacccggcggcgtccgccgtgcaccccgccggcgctgcgaccgtgccgcccgcccgcccgggccgcggcatcatcccggcacccggcggctacctgcacttccaggccgcccgcccggtgctgagcagaagccacgggccggccatccacccggccacggccgccacgcgcccgaagccgaccccgaccgacgcgcaccccggcccacccacccgaccggtcccggccaacatggaccccggactgcccacccaatccaccccgaccgacgcgcaccccgggctgcccacccaacccaccccgaccgacgcgcaccccggtgcgccgacccggccggccccggctgccgggcatcctgggctggcggtgggcacggaggtggatctgctggtcgcgctggccaccgatcactgcgcggaatgcggcttcacccatgcgaccgtagctcccgccgcgctgcccgggcggctgcgggcggccggctcgctgttcgccgcggcgctgctgcaggccggtgacctgcggctgcggcccgcgccggcggtgtggtcaccgctggaatacacctgtcacgtccgggacgtgctccgtgtgcagcgggagcgcctggccttggcgctcgccgaggacgagccggtcttcgcgccgatgggccgcgacgagcgggccaccctggacgcctacaacacccaggacccccacaccgtcctgtccgaattggatcaggccgccgcagccctggccgatgctttcgccgcgttggcaccggaggagttgagacgctccgcgacatacagctggccggagcccgccacccgcagcatgctgtgggtgggccggcacacggtccacgagatcgtccaccaccttctcgacatctcccgatccgccgcctga

SEQ ID NO: 6170 - DNA, 1677 bp, Actinoplanes utahensis
atgcaccctgtcgtggacgggcttccccgtctccttgcctggcggcgcgtgcgcgagttcgctgtcccgccgtcgatgatcgaaaccgctaccgcccgccgccttgtcggtgactggctcggtgcctgcgccgcggcccgggtcgaggtgaacctggacctgcgggccgtggcccgccggcacggtcgtgagctggccgccgggatccgcgccgacctcaggcatctcgcaccggacctgctgcgctggcatttcccgcgggtcgagtccgggctgctccggcccggcctcaccgtcgcgctggctcgttacggcccgcggctggtgctggtcgcccgcaccgctccggcctgggccgacgccgaccagcggctgacgctttcgctgtggggcggcaccggcgacgaggctcgcggcgacgattcccgggtgcatccgcacccgcggccgcaccgccggttccgcctcgacctgcaccggcacctctgggatgcccgtcacgccgctgagctgcacgaacgttgcggcgcggccacctggccgggtgacccggacggcttggcgatgcaccgttggcaggcggaggcggacattctgcgccgcgctgaagcggcctacgcacggtccgccgcggcggaggcgtcgtccttcggggtggccggccaggcatggtccgcggcggcggaggcatcgtccttcggggtggccggccaggcatggtccgcggcgacggaagcgccgcccggccactttaggcaggcggtcgccccggccgacgaagcagttttggtacgtcttcacgcgcgcgacatccgtcaactgttgccggccgccggtgcatcggccggcggtggtggtctgctgctgcccgacgccgccacccgggtgccacccgatctggaactgctgcgtgccggcctgatcgaacccggtcacctgcatcctctggtcgccgagtcgctggcgccgggcagtcatgttcgggcggtggctgccggggattccggtccgcggttggtcgactgccgcgggcaacggcatcgcatcgagctcgtcgacggcgtgctgtccgcgatcgatcaccatccggatgagctgcgccgggaggagatcctggtggcgttcggcggcccgccgctgccctgcctgcgggtgatcgacgacgcgatccggcacccggaggatctcgacgacatccgggcccgcctcgatcacggcaatctggccggcgcgatgcgggcggtggagtgcctgctcggcccggctgcggtgctgcgcgacggaccgctgcgtgacgagctggagcgtgccggacagcggtacgtcacctacggcctgtaccgctccggtctggccggccgctgcccgccaccggacgaccccctgccgcgcgcccgccgcaggaagcgcatcgaacgcaacacggccgcgaagaaggacagctacgcggccgcgaagaaggacggcggcacgcccgcgaagaaggacggcggcgcgcccgcgaagaaggacggcggcgcgcccgcgaagaaggacggcggcgcgcccgcgaagaagaacagcaacgcgggcacacaggcaagaacagcacggcggccacgaagacaagaaacgtggccacgacgaaccgaaccggaaactccgcgagcggaggccccccaacgacccctgaggtga

SEQ ID NO: 6171 - DNA, 1167 bp, Actinoplanes utahensis
atgactctcgacatcgccgctgaactgatcggcctgctggccgacacgaccaccgagccgcgtccggacatccagttggaggcgctcaccctggcggtcgccgccgatctgccggtgctgctctggggcgaacccgggatcggcaagaccgccgcgctccaccagctcgccgcctccctcgacctgccgctgaccacggtgatcgcgagcgtgcacgagccgaccgacttctccgggctgccggtgatcggcgccgacccggccacccagggggtaccgatggcgccgcccgactgggcggtccggctcgcgaacagcggccgtggcctgctctttctcgacgagttgtcgaccgcgccgccggccgtgcaggcggccctgctgcggctggtgctggaacgccgggtgggcgcgctcaccctgccgccgggggtgcggatcgtggccgccgcgaatccgcgcggatcggccgcggacgggtgggagttgagcgcgccgctggcgaaccggttcgtgcacctgcagtggacgttcgaccacgaggtggtggtgcgcggcctgggcgggacgtggccgcgggcggcgctgccccggctcgaccgggcgcggctggcgcaagccgtgacgtacgcccgaaaagcggtgaccgacctgcttaccgtgcgaccgaagctggtgcatcagattccgcagtcggagtcgaagcgcggcggtgcgtggccgtcgccgcggacctgggacatggcggtgcggctgatcgcgttcgggatggccgccggtacctcgcgggaggtgctgtcgatgctggtccgcggggtcgtgggggacgggccgggcctggagttgctggccaccctggaccggatggacctgcccgacccggaggcgctgctcgccgatccggtgggggccgtgctgcccgaacgcggggatctgcggcaggccgtcctcgacggggtggtcgaggcggtccggcgcaacccggaccgggaccggtgggatgccgcctgggcggtgctggtcaaggctctggcgacgggtgcgccggacctgctggtggtgcccgccggaaacctggccgagctgcgccgtgacgactggccgctgccggccggcatcgaacagctggccggtgccgtcggcgtggcacggctggcgggccgatga

SEQ ID NO: 6172 - DNA, 1194 bp, Actinoplanes utahensis
atgaggctatcggaagcggacaccgagaagttgtacgcggcgcggctgttcgccgtgcgggcccgcccctacctggcttccgcgctgttcgcgctgaccgtggtcgagtcaccgcgtacgccgacgatggcggtcgaccggttctggcggtgctacgtctcgccggcgttcgtggcgcggaccccgctggcggagctcgcctcggtctgggtgcacgaggtgtcgcacctgctgcgcgaccaccatggccgcggcgaccgctatgcccgcgagcgcgatctgcgcgggccgggggagcggctgcggatgaacctcgccgccgactgcgagatcaacgacgacgtgtacggggacgggctgccgtgcccgcccggggccgtccgtccggtcgatctgcggctgccgccggggctgttgatggaggactatctggggcagttccggctgggccggcataccgacgcgtacacctggttcgattgcggcagcggggcggacggcgcggagcgggagtgggatctcggcccggacggtgcgcatggactcaccgatcaggagcgcgacgcggtccggttccgggtggcccagtcgatcagcggggcgcccgggaacgtgccggacggctggcggcgctgggcgcaggaggcgttccatccgccgcagccgtggcgggagctgctcggggcggcggtgcgcgcggcggcgggggcgcgcggggcgggggaggactacgcgtacggcaaaccggcccggagggcggcgagcctgccgcgagtgatcctgcccgccctgcgtcgcagccccccgaaggtgtgcgtggtgatcgacacgtcggggtcggtgagcgacgaggaactcggcaccgccctgctcgaggtcgccgcgatcgggcgggcggtcggcggacgccgcggtctggtcagtgtggtggcgtgcgacgcggcggccggggtggcgcatccactgtgccgggccgaggggattcccctgatcggcggtggcgggaccgatctgcgggaggggttccgccaggcgctgcggacccggccggacgtgatcgtggcgctgaccgacggctggacgccgtggccgagccggcagccgccgtgccgcacggtgatcgggctgttccggcgccgcgagccgctcacccaatggccgccggaatgggcacgtgtggtaaagataggatga

SEQ ID NO: 6173 - DNA, 2124 bp, Actinoplanes utahensis
gtggtcgcgaacgtgccgttgaccgacgcgctgagcgtccaggcgcagaacaccgcggcggtgctgccgaccacgtacgccgcattgagcagcagcgtcgcggtcgccgtgccgcaaccctcgctgtccgtcctgctgtcctccacggtcagcgacccgacccggcagaacgccgccgcggccggcgacctgatcacctacggctacaccgtgaccaacaacggcaacgtgcagatggacagcatcgcggtcgccgacaccaaaggtgacacggtgacctgcccgcacccgacactcgccatcggtgactcgatgacctgcaccgccagccccgggtacacggtggtgcaggccgacgtcgacgccggggtggcggtcaccaacgtcgcgaccgtcaccaccgtgccggccggcggcggcagcacggtcaccttcacctcaccggccggcggcgtgcaggtggccgccgccgtgccggcgctgcggatcaccgtggcggccagcaccgccggaccggtccggctcggcgacaccatcggctacgactacacggtcgacaacctcggcaacgtcaaactggacaacctcggcgtgaccgacgccaaagcggccaccgtcacctgccccgcaacggtgctgccggccggggccaccatgggctgccactcgtcgtcgacgtcgtacaccgtcgggcaggccgacatcgacgccggcgtgccgatccgcaacgacgcgatcgtcgacgccctcagcgtcgcacccgggcacatgccggccagcgccgagagcaacgcgccggtgccggtcgtcgcggccgcgcccgcactcaccctgaccagcatcccgcacgtgacaccggccgggcacgccgccgccgcgcagaccggcgaccaggtgtacttcacctaccaggtgcacaacggcggcaacgtcaccatgcacggggtggcgatcaccgacaccctgaccgggcccggcacctgccccaacgtgcccctgccggtgaacaccacgatgagctgcacgggcgggccgtcgtacatcgtcacccaggacgactacgacgcggcggccccgctgagcggcaccgcccgggtgcaggcccgcgcccccggcgtcccggtccccggcacgtacgacacggccactgccggcgtgccggtcggcagcggcaacgcggccgccgccctggccaccgcggcgctgcgggtgctgcccgccggccaccaggccgccgtcgaggccggtgaccggttcgccgtcgacttcaccgtccgcaacaccggcaccctgaccatgcggaacatcacggtcagcgacgaccgggccgggacggcgacctgtccgggcaccagcctgcggcccgccgcgtcgatgacgtgcaccacgcccacctacacggtgctgcagtccgacatcgaccggggtgaaccgttgaccagcgtcgccaccctgcgcgggcaggccgggaccggtgcggtccagacctacgggacggccggcacctggctggcggtcacccgcggcgtcccctccctcgacgtccgtgtcgtcggcacggtcagcccggcggcacaccgggacgcggccggcgtcggcgacgggctgacatggaccttccaggtggtgaacaacggcaaccagacgttcaccgcgatcgcggccaccggcaccggcacgatcacctgcccgcaggaccggctcaccgtccgcgaaaccatgacctgcacctccgaccgggggcacacggtgacccaggaggaggtggacgccggcaaggcactcggcgcggtggtcacggtgaccgggaccgccccggacggcccgcaccggttcgggccggtcgacggcacggtggcggtggtggcggccgacccccggctggagatcgcgatgacgacccgggtcaccgcccaggccgacatggtcgaagccgaggaggtcgacaccggggtcaccgcgggcgacctgctgcgctacacctacaaggtctacaaccggggcaacgtgacggtcggctcgctcagcgtcgtccacgcccgcgccccgaagatcagttgcgccaccgggtcctcgcccccggcgccggtaccgactgcgtggccgccgacctgtaccgggtga

SEQ ID NO: 6174 - DNA, 414 bp, Actinoplanes utahensis
atggcactgcgggtggatctgacgttcgactgtgtgcgggcgcaggagttggccgagttctggaaggcggctctcggctatgcggacgagccgcccccgcccccgtttcggacccgcgaggagtgggtggcctccttcggggagcccgcggaggacgcgggcggcggcgcctggctgcacgatccggaggggctcggcccgaggctctgtttcctggaggtgcccgagccgaaggtcgcgaaaaaccggctgcacatcgacgtccgcgtcggtaggtacggcgacccctggccacgcatcctggccaaggtcgaggacctccgggcgatcggcgggcgcgtggtgaccacattcgacggccaccatgtgacgatggccgatccggagggcaacgagttctgcgtggccgcctaa

SEQ ID NO: 6175 - DNA, 537 bp, Actinoplanes utahensis
atgtggcactgtcctcgcatgagaatcgaggcaccgagtaccgccctgatcgccatcgacctgatgccgcgcatcgtgtcgcagaacatgggcccgcactccggcgccgacgtggtcgcgcggtcgctcgccctggccgacgcggtacgagcggccggcggactggtcgtcccggtccgcgtcgagcgccccggcgtcgccgaacagccgcccggcagcggcctcgtccccgagttcacccctcgccccggcgacctcgagatcgtcaagcgcaccatcggcgccttccccggcaccggcctcgagcaagcgctccgcgaccgccgcatcaccacgatcatcctgaccggaatcgccaccacgatgggcgtcgaatccactgcccggaccgccgccgatctgggcttcgacctcatcttcgccgccgacgcgatgtccggcatgaccgagacggagcaccaccacgcgctcacggtcacgcttccccgcttcggcgagatccgtaccaccgcggaaatcctcgcccggctcggatga

SEQ ID NO: 6176 - DNA, 825 bp, Actinoplanes utahensis
atgtccgcgacggtggcgaagtggtccggcatggtggcggtggacgacacgaggctggcggtgaccgacaccggtggcgccgggcggccggtggtctatgtgaacgggcagttctccacccagccctactggcggcgggtggtgcgcgagctgggcccgcagtggcggcacatcacctacgacgaacgcgcccgcgggaggtcggagcggtccggggactactcgttcgcggcatggctgcggggcctcgacgcggtgatgaccgcgcgcggggtggcgcggccgctgctggtggcctggtcctacggtgcggtggtggccgcgcactgggcgagtctgcacccggagcggacgtccgggctggtactggtggacggcgcttttccgtacgactggctggacgacgcggtcgagcagcggatccggaagctgttccggcggatcaaccggtgcgcgccggtgctgcggccgttcgggctgttgccgcggatgtcggcggagcagcaggcggagagcaacatcgagctgggccggctgtcccgggtcgcggagctcggtccggtgctggacgggatcaccgtgccggtgcggtatgtggtggcttccgggacttcactcggcagcaagggggacgagcaggagcagatccgcaccagtctggagcaggtgctcgtgcggaacccgaacatcgaggtgagcgccaaggtgccgagcaaccacggcgcgatcctgcgcaggaatgccgcggaggtcgcggcggcggtgcgggaggtcgcggcgtcggcgggcacgacgggccgaggcggatcgatgtttccactatga

SEQ ID NO: 6177 - DNA, 1116 bp, Actinoplanes utahensis
atgccgcggaggtcgcggcggcggtgcgggaggtcgcggcgtcggcgggcacgacgggccgaggcggatcgatgtttccactatgatccgccgatgatccgtaccgcccgccttctcctccggaccattcgcgacggggccgtgcccgcggtccccgagttcgacgccgagcgtgccctgctcgacaaggggttgtgggagacgcggcgggacgtgctgcgcggggagtgggagtcggcgcgggagctgatcgccgccgccggagacgactgggagctgcgcggtacgcggatcctgtcgctcggtgaactcgccgtggccgacgggcggtggctcgacgcctggcgggaggcgcacccggacgacccggcggccacgctgatgctgtccgcccggatcagggagcaggctcggcaggcccggggatcggcgtcggcggcgcacacgacggcgcagcagttcgccgatttccaccggctgtcggaggagacggccgaggtcgtgcggcgggcgatcgaccttgcggctcccggggacccggtgccgtgggtgcaactgctcggcacgctgtatgccggtccgcggggccgggacggggcgatcgacgaggtgttcgaggagggcaggcggcgcgatccgggcaacttcgatctgcacctgcacatgctcagcctgcggtgccggaagtggtacgggtcgcacgagaggatgttcgcgatcgggcgggaggtggccgagacggcgccggacgggacgaatgtggtgctgctgccactgttcgcgcacttcgagtacgcgatgcaggagtacgggtgggacaagcgctcggcggcggtgctgcgcgactgccggaagtacttccgccggacggaggtgcggcaggaagtggaccggtgcatcgccaagtggcgggccgggacgcccagcatcgggcggctcgggacgtgccggcactgggtggcgctgtattacacgctgaccggacagaggaaggcggcacgagccgcgttcgccgagatcggaaagtatgtggatccggcgcatgcgtgggcgtatttccacccgaaccgggagtacggcttcttccaagggtggcgctgggcgaacggactctga

SEQ ID NO: 6178 - DNA, 1374 bp, Actinoplanes utahensis
atgtcgagcctcgtcgaagtcaccaagcccgctaggcgggacgccgccaccggccgcaccgtcgccatcgtcggcggcggcgccaccggtgcgctgctcgcccgcgccctgatccgccgcacccaccaggacgtggtgctgatcgccccggacgaggtcgccgggcggggtgtcgcctacggcgcggccgagccgtggcacattctgaacgcccgggcgggctcgatgaccgccgacttcgacgacccgctggacctggtccgctggtgcaccgcgcggggccgccccacccagccgtgcgagttcctgccgcgctcggtctacggcgactacctggccgagcggttcaccgaaacggtcctcgagtcggccggccggctgcgtcaccaccgcgccaccgcgaccgcgctgcaccgggagcacggcggctacgtgatcgtgaccgataccggcccggtccgcgccgaccaggtcatcctcgccgtcggcaatccgcccgcggcccggctcccggggatcgacgacgcggcgtactcccatccgctattcatcaccgacccgtgggccccgcgcccggagctgccctccgacgcaccgatcctgctgatcggttccggtctgaccgccgtcgacgtggcgctcaccctggacgccgccggccaccgcggcccgatcgagtcgatctcccggcacggcctgctcccccaggcccacccggtgaacgccccggcccaagtccgcctcgacctgcccgccgatctcaccctgcgccggttgctgcgccaggtccgcgccacggttgacgccggcgccgactggatcgccgtggtcgacgagttgcgtcatcacgccgacgagatctgggacagcttcaccgaagcggaccgggaccgtttcctccgccacgtggtccgctactgggacatccaccgccaccgcatggccccgccggtggccgcgaagatcgccgacctgcgccgccgggaccggctgcgtttcaccaccggccgggtcaccgccatcagcccggatccggccggcggcctgaccgtgaccaccaccgccggtccgcgccacttcgccgcggtgatcagctgtaccggaccgggccgcctgcccggctccgccacggcgaacccgctgctcgccgccctgttccggggcggcggcatccgcaccgccccgcacggcttgggcgtcgacaccgacccggacggccgcgtgtacgacgcgatcggccggatccgccccggcttgtggctggccggcccgctccgccgcggccgatcctgggaggcgaccgccgtcccggagatccgcgcccagatcaaccgcctggtcaccgccctgactctgcagccggccgcccgctag

SEQ ID NO: 6179 - DNA, 1236 bp, Actinoplanes utahensis
atgagtgacatcgacgtcgtgatcaccggatggggggccaccacgccgctgggcggggacgtggacaccctctgggagggcatgttggcgggccgctccggcgcgcgccgcatcgacgaccgggtgcagaactatcggcattgggccgatctgcccaccctgatcggcgccccgatggccgtcgacccggccggggtgctgccccgcgtccaggcccgccggctggaccggtgcgagcaggccgcgctggtcgccgccaacgaggcgtggcagcacgccggcgcgcccgaggtcgagggcgagcggctggccgcggtgatcggcagcggcatcggcggcgtcggcaccatcctcggccaggacgacctgatcgaggagaagggcccgtccaaggtttcccccttggtcgtcccgatgatgatgccgaacggtccggccggctgggtgagcatcgagttcggggcgaaagccggggcgtacgcgacggtttccgcctgcgcgtccggcgccgaagccctggccctgggcgcccggctgatccgcgccggcgaggccgacgtggtcatcgccggcggtgccgaggcgtgcatcgcgccactgacgatcgccgggttcgcccaggcccgcaccctgtcccggcgcaacgacgacccggagcgcgcgtcccgcccgttcgacaccgaccgggacggcttcgtgctcggcgagggcgccggcgtgctgatcctggagcgggccgacttcgcggccgcccgcggcgccaccgtcctggggcgcctcgccggctacggcgtcacctcggacgcccaccacatcaccggtcccgacccgaccggcagcggtcagatccgcgccatccgcaacgcgctgcgcaccgccgacctcaccccggccgacatcgaccacgtcaactgccatgccacctcgacggtggtcggtgacgtcggcgaggccacggcgatccaggccgcgctcaccgacgacgtggtcctcaccgcccccaagtccgccttcggccacctggtcggcgcggccggcgccgtcgagagcatcatcaccctgctctcgatccgggacggcgtcatccccgccaccctgaacctggagaacaagtcgcccgaggtgaagctggacgtggtcgccggcgagccgcgccggaccgacctgcgggccgccatctgcaactccttcggcttcggcggtcagaacgtgtcggtcctcttcaccgcggtctga

SEQ ID NO: 6180 - DNA, 729 bp, Actinoplanes utahensis
atgccctcccagagggtgtccacgtccccgcccagcggcgtggtggccccccatccggtgatcacgacgtcgatgtcactcatcggcttcccctatccgctgcggcgacttgccttccatagttgtatcgcatacaaatttggtgtgtccaccgcagaaccggtccgagcccgcggacggcagacccgcacggcgatcctggagagcgccgcggagctgttcgccggccgcggcgacctggccgcggtgagcgtcgcggagatcgccacggccgccaaagcccacccgaaccagatcacctactacttcggatccaaggacgcgctcttcgtccaggccgcgtttcgcctgctcctgcgcgacgcggtgcgcctggagccggtcggcatgcgccagcgcaccccggcctcgttccggatcgccctggcccgcacggccctggccctgcccaccgtgccgctcgcggtccaggcgatggcgatcagccggatgcggtccgaacttcatgtgcaggcacagcagagtttgactgtcctcttccgccaggccgagggctacctgcggcgcatcctgcaccgccgcgactggatcaccgaccgcccgctcgacatcgaggcgcgcaccttctggatcgccgtcttcggcgcccgcctcgtctcggagagcggcttcggcggccagtccgccgacgtcgacctcgccggcgtcctcaccgtccgccagcgatga

SEQ ID NO: 6181 - DNA, 318 bp, Actinoplanes utahensis
ttgctgggggcggcgccaccgccggtccactaccaccgtgatcatgccggccgggtcttggcgagcgccctgccgctgaacgcctcggcggtggccgccgattacgactatccgacatccgacatcgatgatgtgcctctcttgcagatcaatggcgatggtgtacgggcccgccgcctcgacagtgccgacctgacgtccgtcgggctttcaccgtccaccggctcgtccccggtggagatcgcttcggctcgggtgggcacctggtcgccgacccggtcacggtgtcgtctcaccacgacaagcagcggttgctga

SEQ ID NO: 6182 - DNA, 1134 bp, Actinoplanes utahensis
gtgcagctcacccgcgccctgccggacgccaccctgaccacccggatcgccgagacgatcaaggtgcccgggacgctcccgaagtttccgtggccggcgcagggatcggccgagctgatggtgcaggggttgggccggatcggtggctcgggcgggcagaaggccgagccgatcggcagcgtcgccaaggtgatgaccgcttatgtcatcctcaaggaccatccgctggacggcaccgacgaggggccggcgctgaccgtaaccgctgctgacgtggcggactacaacgcccggatcccggggggccaatcgctggtcaaggtggtggccggggagaaactgagtgagcgggacgcccttgaggcgctgatgctgccgtcggcgaacaacatcgcgcatcagctcgcggtctgggacggcgggaccgtgaacggcttcctggagaggatgaacgacgccgccaaggacctcgggatgtccgataccgattacacggatccgagcgggttcctgcccaccacgaccagcaccgcggccgatcaggtgaagctggcgcaggcagtgttgaagttcgatgtgttcgcccagatcgtggagttgcgcagcgcgcagattccggtggtgggaacgatccagaattacaacgcgctgctcggggtggacggcgttttcgggatcaagaccgggtcgacggatcaggccggtgggaacctggtgttcgcggcgcggctgccggtcggatcgcggacgctggtggtggtcggcgcggtcttcaaccagccgggggcgaacacgccggagcagctcgcggcggtcaaccgggtggtccgcaagctgctcgcccaggtgcgtcggacggtcaaggagtatcagctgctcgcggcgcaggcggtcggcaaggtgacgaccgcctggggtgccgaggcgacggtgacgccggccggcccgctcaaggtgctgggctggcccggcctcgcgattccggtgcggaccacggtcacgaaaccggggccgcgggtcactgccgggcagccggtgggccaggttcaggcttcgggcgtacgcgtcgatctccgggccgacgcggcgacgagtgacccctcgctgtggtggaagctcacccggaaaccgtga

SEQ ID NO: 6183 - DNA, 978 bp, Actinoplanes utahensis
atgagagaagagagtagcgctactgcccgcggcacggtaacagccgggtatgccctcggggcactgggcgtgctggcgttcagcatgtcgctgccgtccacccgactcgccgtgcacgacctggacccgtggttcgtcgcgttcggccgcgcggtcggcgccgccgcactggccgtcgcctacctgacggtcacccgggcgccccgacccaccccggcccagtggcggcggctgccggtcgtcgcgctcggcgtcgtcgtcggcttcccgctgttcacctcactggccctgaccagccagacctcggcccacggcgcggtggtggtcaccgtgctcccggcactcaccgcgatcttcgcggcgctgcgcgcccaggaacgtccacccctggtgttctggctggccagcggtggcggcctcatcgccgtcctcggcttcctggccaccaccggcacggtgcacggcgcgctcaccccggccgacctgtacctgctggccgcggtcgtgctgtgcgggctcggctatgccgaaggcggtgcactcgcccgcgacctcggcggtgcccgcaccatctgctgggcgctgctgatcgcgctgccggccaccctgccgatcaccgtggtcaccgctctgcggcacccgccgcacaccggcccggccggctgggtcgccttcggctacctcaccgtggtgtcgatgttcctcggcttcttcgcctggtacgcgggcctggcccggggcggcatcgccacggtcgggcagatccagctcgcccagccggtgctgaccctgatctggtcggcgctgctgctgggcgagccggtgaccgccacctcgatcggggcggccgtgatcgtgctgggctgcgtggtcgccacccagcggacccgtcacggtttccgggtgagcttccaccacagcgaggggtcactcgtcgccgcgtcggcccggagatcgacgcgtacgcccgaagcctga

SEQ ID NO: 6184 - DNA, 609 bp, Actinoplanes utahensis
atggacgcggtccgggacgccggggcgttcctgatcgaggacgactacgcgcgggacctgacgatcgacggggacccgccggcgccgctggccgccgccgacccggacgggcacgtggtctacctgcggtcgctgaccaagtcggcggcgccggggctgcggatcgcggcgatcggggcgcgcgggccggccggcgcccggctgcgggcggcccggctgctcgacgacttcttcgtggcgggcccggtgcagcaggcggcactggacttcgtcaccggcccggggtgggtgcgccacctccgtacgctccgatcggatctggaaagccggcgggcggcgctggtgcgcgccctggagcggcacctgcccgagctggcgccggccgtgctgccgcgcggtggcctgcacctgtgggttcgtctgccggacggctgcgacgacgtcgcggtcactgccgcggccgccgccgagggcgtcgtcgtgttccccggccgcccctggttcccggccgaggcgcccgcgccgcaccttcggctcacctacgccgcggccccaccggacctgatggacgcggccgtccgtcgattggccagggcgtttccgcgatga

SEQ ID NO: 6185 - DNA, 837 bp, Actinoplanes utahensis
gtgcaatctgatttcggcccccgggccggcatgcgactgggcgatcggtaccgcctgcaggaccggctcggcgccggcgggatgggcgaggtgtggcgcgccctggacgagtccctgaaccggctcgtcgcgatcaagatgatgctgccttcggcagctcaagacccggatttcgtacgtcgtttcgccgccgaggcgatggccatggccagggtcaaccacccggccgtggcgaccgtccacgacgtgcggcaggcgcacgggctgaccttcctggtgatggagtacgtcgacggcgaatcgctggcccagcggctggcccgcgaggggcggctcagcccggcggagacgatgcggatcgtcacccgggccgccgagggcctgcaggccgtgcacgaccaggacatcctgcaccgcgacatcaagccggccaacatcatgctgcgccgcgacggcgaagtgctgatcaccgacttcgggatcgcccggcatgccggcgccgccgggctgaccgcgaccggggcggtgctcggcacgcccagctacctgtcgccggagcaggtgctcgggcagccgtccgaccggcgcagtgacgtgtactcactgggcctggtcgcctacgagtgcctcgccggggagaaaccgttcgccggcgacaacccgtacgcggtggcactgcaacgcgtccggcacgagccccggacgattgggggcgggcgtgccggggccggtactcgccctggtcgagcgcgcgctgcagaccgacccggaacgtcgcttcccgtcggcgctgtcgatggccgaggcggcccggcaggtggacacggcggccgctga

SEQ ID NO: 6186 - DNA, 651 bp, Actinoplanes utahensis
gtgccggggccggtactcgccctggtcgagcgcgcgctgcagaccgacccggaacgtcgcttcccgtcggcgctgtcgatggccgaggcggcccggcaggtggacacggcggccgctgacccgcgtaccgccagccggcggttgtcgaaccgtgccctcgtcgcggcggccgtggcggtcgtggtcgtcgtcgcgctcggggccgcgttcctgccccgcggtgggcacgggaaaccggagccggcggctgccgagccggccgccggcgccctgccggacggcttcgcggcctgcggcgccgggatctgcccggcccagccgatgtgctggagcgggctgacgcagatcggggcccaggcgttgccgccggcggtggcgtattgcccgggcacccacgtgtgggagacgttcgcggtgctccggctgccggccgggccaccggtgatgagcgcggacgcgccgttgatcgagcaggccgacgtggcgaaggcctgctcggcggcggaactggcggcgcacagcatcgacccgggcaggacccggggctggcggcgcgacgcctggccggtgcagtcgggcaccgggtggctgctgcactgcatggcgcagccgaagaccgggtcgtcggtgggggccgcgttccgggcgtga

SEQ ID NO: 6187 - DNA, 492 bp, Actinoplanes utahensis
atggcatgtcgcggggtgtggttcgcactgaccgggtcgcaggatcgggagctcgtcgaggctcccggcgacgcggaggtgcgggcgctggtcaccgacctggaggcggcctgggactgggatttcctgtgcgaggcggacaaggcctgggacgccctgcaccggtgcctgggggacgggacgctgcggttcggcaagcatggcggggtactggcactgaccgtgctgggcggcgggctgcaccacgacgggccggactacatcgtggcgcgggtgcgggccgatcaggtgccggcggtcgccgcggccctggcggcggtggacgagagctggctgcgggagcggtacgacgagatcgacccggaggactaccagggggtgctcgacgacgaggacttccggtacacctggcagtacctgcaggacgcgcgggagttctaccggcgggcggccgacgccggccgttcggtgatcttcacggtggatcagtga

SEQ ID NO: 6188 - DNA, 960 bp, Actinoplanes utahensis
atgtccccatcacgtcgtaccttcctggccgccaccacggccggcgtcctcaccgccggcggcgcactcggcgtcagcccgctcagcgcggccgccgccgagtccagcccggtcgggttcgccagcctcaacggcggcaccgcgggcggctcgtcgagcaccgtcgtcacggtgaccagcgcctcggcgctcaagtcggcgctgagctcgggcacctcgcagaccgtccggatctccgggctgatcacgatctccggcatgtaccgcgtcgcctcgcacaagacgatcatcggcgtcggcgcgagcagcggcgtcaccggcggcggcttcaccctcaacggcgtcaagaacgtgatcatccgcaacctggtgttcaagaacgccggcgacgactcgatcaacctgcaggacggcaccaccaacgtgtggatcgaccacaacgacctgtccaacggttacgacggcctgatcgacatcaaacgcggctcggacttcgtcaccgtctcctggaaccacctgcaccaccacgacaagtcgatgctgctcggacacagcgacgacaacggcgcccaggacaccgggcacctgcgcgtcacctacgtccacaactggttcgacggaaccaaccagcggcacccgcgggtccggttcgccaacccggtgcacgtgctgaacaactactacagcaacatcggcgcgtacggggtggcctccaccgagaacgccggagtcttcgtcgaacgcaactatttcgagaacgtcgaccatcccacggtcacccagaccggcgactcggatcccggcaacctcaaggtgctgaacaactaccgggtcaactcggggaccgaggaggtccgcaacggcggcagtgtcgcggccatcccgtacccctacacgcccgaggccaacagctcggtcaaagccaccgtggtggccggggcgggcaccggcaagatctga

SEQ ID NO: 6189 - DNA, 987 bp, Actinoplanes utahensis
gtgtcccactcccgcatcgtcgccggcgccgtcgcggtgtccgtcgtcctcaccccggtcgccgcccgcgcggcgacctcgttcaccgtcgccgcggacggatccggcgactacaccaccatccaggccgcggtcgcggcgtcgtccgccggtggagtgatcaccatcaaggccggcacctatcaggggcaggtgcagatcccggcgtcgaagtccgggatcaccctgcagggtgcgaccggcatctccgctgatgtgatcatcaccgggaacaagccgcagtccaccgccgggacggctggcagcgccaccgtccacaacctcgcaccgaacagcacgatcaagggcctgaccatgcagaacacgtacggggcggggagccaggcgctggcgctgtacgctgcgggcgaccggcaggtctatcggaacgtgcagctcaagggataccaggacacgttcctgtcgtggggtgggaccggcagctcacagatacgccaatacatctataagtcttatatttcgggcgcggtggatttcctttacggcaacggcgcggttgtcatcgacagcaccaccatcgagtcgctcaacatcggcagcagcgcgaacaacggatacatcaccgcggcggcgaccgacgacagcaacgcctacggcttcctgatcacccggtcggtgctgaaaagcaccgcggcgccgcagaccgtggcgctcggcagatgctggcacgcgggcggggcggccgacgcgatcggacaggtgctggtgcgggactcgagcctcggctcgcacatccggcaggccggggcctggcaggacatgggcggcttctcgtggaggacgtgccggttcaccgaatacgccgacagcggggccggggtgagcaccggaaccggcgaccggccgcagctcagcgcggcttccgcggcgaactgcaccgcacggaggtatctcgccgggagcgacggctggaatccggtccagtag

SEQ ID NO: 6190 - DNA, 438 bp, Actinoplanes utahensis
atgctgaaccgacgggtgaccaacctggtcctgaccgcgactctggcggcggccggactgatggccgtgcccgggcctgcgcccgcggcaaccgcgatccccgggcccgtgcccgccggacccgcgctcgccgcagtgcccgccgctgcgagtccggtgatcgcggcgccggcagccttggattcctcccggcgcgtgggcgtcttcgcggagctttatcgcggccggctcatccatggctggggtggcgctcaaccgtgtgcctacatcgacggggtgtccctgggcctggtgagtcacggcgacaaccgttacagcagcacggtcaacgcctacgaggtcaccgtcggggtccgcgagaccacccgcgccgcggtgcgcagcctggccggcgacgagctgcagccgaccgagccgccggcctactgctcgcggtga

SEQ ID NO: 6191 - DNA, 822 bp, Actinoplanes utahensis
atgggcgtccgcaagaacgcacgcaacctcaccagcaccgagaaggcggcgttcgtctccgccgtcaagcgcctgaaggcacagaccacgggccgtaactacgactggtatgtcaccacccacctgaactatttcgccgccgtcgggggcgtccgctacgcccaccagtcgccgtcgttcctgccctggcaccggcagtacctgatcgagttcgagcgggcgctgcaggtgtacgagccgtcggtgaccctgccctactgggactggacggtggaccgcagcaccaccggcgccccgttcaccgccgacttcctgggcggcaacggctccggcggcaacggcccggtcaccaccggcccgttcgccggcgcgaccaactggcggatcaccgtcagcagcaccaccgcgacgtccctgcggcgcgccatgggcagcaactcgctgcccaccgccgcccaggtcagttcggtcctcggcgtcggcacctacgacgcggccccgtggaacagttcctcgaccagcggcatgcgcaaccgcatggaaggctggaccaccccgaacctgcacaacgcggtccacgtgtgggtcggtggccacatgggtcagcaggattcgccgaacgacccggcattctggctgcaccactgcaacatcgaccgcctgtggtcgcagtggcagacccggtggggcttcgacgccgcccactacctgccggccgccggcaccagcggtgtcgtcgacctcgacgagaccctgcagccatggacgggcgtaaccccggcctccgttctcgaccacagcggcgtctacacctacgcctga

SEQ ID NO: 6192 - DNA, 477 bp, Actinoplanes utahensis
atgtccaccctgagccgtcgggacgttctccgatacgcggccgcggccaccgtcgtcaccggcggcgtcgccggggcgcaggccctgtccacctccagctcgtccgcccaggcgccggccggcgcccggacgtcggccgacccgcgcgacttcgacgtggagtaccgcggcaagcggatcaccggagtgcacggcgccgacactccgggcgcgctgcgcagcgtgtcgggcagccggcagccgcaccaggtgcacatcaacgggcgcaggctggccgtcatgcagatcgagctgccggccgccggcggcggggtcacgctcggcttcatcagcgccctcaaccactacgagccggtcctgatcgacaccgacaagaaccgggacggcctgctcaagctcacccggcgggcggtcgacgcgctgggtgacagcgagctcaccgccctggccggcgcggaccacaaccacgggaactga

SEQ ID NO: 6193 - DNA, 420 bp, Actinoplanes utahensis
atgaatgcaaaggaaacccagaaaatgcgcaagctctctgtcgctgccctcgtcgccaccgcgaccgccctgctcgcccccgccgcggcccaggccgcgcccgccaccaccaccgccctgctcggcacctacggtttcgggcgcgccgcggtgatcggtgacgccgggacggccgccggcgtgtggcgcgcgcccgtcgtgcgcagcggcttcgccggtgacgacctgaccgtcacgttcacgccgcgcaccacgccgcgggccagcgaaaagctcgtctacacggccgccttcaacgaggtcgccgacgcgcaggccgagtgccgcaaggtcggcgcggacggcgtcgcccgccacgtgtgggtgtcgttccggtgccagaccggcttcgtgccgagctacaccctctacgttcgctga

SEQ ID NO: 6194 - DNA, 882 bp, Actinoplanes utahensis
gtgagcatgctcatctatctggactgcgacaccggtatcgacgacgcgctcgccatcgcctatctgctcgggcacccggacgtcacgctggccggcatcggcacggtcaacgggaacaccaccgcaccccaggcggcggcgaacacgctggggctgctggcgctcgccggccgggacgacatcccggtcgcggtgggcagcggcgcgcatccgtacgcggtggcctcggtgcacggcgggaacgggatcggcggagtccgggtgcccgcggggcgcgagcccgacccgcgtaccgccgcaacgcttctgatcgatctcgcccggcggcatcccgggcagttgcacctgctggcgaccggaccgtgcgggaatctggcggcagcactggccgccgagccggacctgccgtcgctgatcgcctcggtgaccgtgatgggcggggcggtgcgggtgcccggcaaccggacaccacgcggcgaggcgaacatcatccacgatccggccgcggcggccgccgtgctggcggcggactggccggtgacgctggtgccgctcgacgtcacgatggcgcaccgatggtcgaccggcgacgtggcgtcgctgcgggccaccgggtcaccattgcacgtggcgctcgcggacatgctgcccgcctatttcgacggctacgccgagcagctcggcgtccgggagatcccgctgcacgacccgctggccgcggcgatcctgctgggcgaggtgacgccggccgacgcgccacggctgtcgatcgccgtcggtccggacgggcacaccgtggagacaggtcccggccccgtccgcgtcgtcctgaccctgaccgcccccgccgccccggccctgctccaccggatagccggctga

SEQ ID NO: 6195 - DNA, 804 bp, Actinoplanes utahensis
ttgcgccgtgagttgcggatctacctgatgttgcggggtgccgcgctgcgcggcgtcctgcaataccgcggcaacctggtgtggatgctgctggccggcgccgcctaccagggcagcggtttcgcgttcgtgtgggcgctgctgcacaccttcgacacggtgggcggctggggtctggggcagatcgccttcctgtacggcatgcggctgctgtcgcacgcgctgtggctcatcaccatggacggggtcgggcagtgtgacagcgcgatccgcgaaggcctgctcgaccggatgctgctgcgcccggcgaacccgctggtccagctcgcctcgtacacccggtcggtgctgccgttcggtgacctgtcgatggcgatcgtgctgttcggggtggcgctcaccgtcacccccgtggactggtcgcccggctcggtggcgttcctggtactggcgatcctcggcggggccctgctggaggcgtcggcggtggtaacggtcgccgggctgtcggtgcgggtgctcgacacctgggcgtaccggatgctggtattcgatgcgatcgacaccctcgggtcgtacccgctgagcgtcttcggcggcggggtgcagcgcctgctgacctacgtactgccggtcgccttcatcgccttcctccccgcgggggtcatcctcgactcgaccggtgggctcgccgtcccggcctggctcggctacctgtccccgctggtcggcgccgggctgttcaccctggcgtaccggttctggcgccggcagctgcgcggctaccagggcatcggcaactga

SEQ ID NO: 6196 - DNA, 852 bp, Actinoplanes utahensis
atgaccttgaacgccatggtgcgacgggcggccggtggctacgggatgcatgcgcggcgggccgcccgggcctacggggcgtatgtgcggacggcaatcgcgatccgtctgcaataccgcagcacgctgttcgcctcgatcgcggtgaccctgatgtggatcgtgctggtcacccgggtctggtcggcggcgtaccgggggcgcgaggtggtcgccgggctcacgctgcaggccaccgtcgtctacctgaccctggccaacctgcaggccatgatcatcaactcgccgatcacctggatcatggcgaaccgggtgcgaaccggggaggtcgtcttcgacgtcggccggccactgggctatccggggcagatgctcgccatgcaggccggtcagtcggtgatccagaccgccgcgatggtgatcgccgcaccggtcgccgggctgctcggtgggctgtcccggccggccggggtgaccgccgggctgctctacccggtggcgctgctgctcggctgggtgatgaacgcgctgctcacgatggtggtcgggatgaccgcgttctggaccgtcgacaatctggggatcgcggtgctctaccgcttcatcgccgccttcctggccggtgccagtgtgccgctgaccttcctgcccggaccgctgcgggcgttcgccgaggcgctgcctttccgattcatcgtgtacgagccggccgccatctacatcggtcaccgcggcgggacggcggccctccgcgggttcgccgtcgcactggcctggatcgcggtcctgggcgtcctcgtcgcggtggtgtggcgccgcgcataccggaaggtcgtggtgcacggtggctga

SEQ ID NO: 6197 - DNA, 738 bp, Actinoplanes utahensis
gtggtgccgtggcgcgaccgcaagcggctggcgcaccggatcggcgtggtgttcgggcagcgtagccagttgtggtgggacctgccgctgatcgagtcgttccggctgatcggggcactgtatgacgtgcccgccgagcggtatcgcagcaacctggcccggctgcgcgagctgctggagctcgacccgttcctgcagacgccggtccggcagctcagcctgggtcagcggatgcggggcgacctggccgccgccctgctctacgacccgccggtgctctacctcgacgagccgaccgtggggctggacgtgctggccaaggagacggtgcgcgggttcgtcaacgaggcgaatcgcagcgggcgcacgaccgtgctgctgaccacgcatgacctcgccgacgtggaacggctgtgccggcggatcctgctcatcgatcacgggcgggtgctctacgacggaccggtggacgggctgatcgcccggtacgcgccctaccaggatgtgctcgtccggctcgacggcgaccagcccgacggcgaccggctcgtcctggccggattcgtcggcgagcgcgagcatgacgggcggtggcggttccgggtgggccgggacgagccggtccaccggctgctgaccgcggccggggacgggcggcagatccgcgacctgtccgtcgtcgagtccaacctggagagtgtcgtccgcgagctgtaccgcgagaggcgcgaggcatga

SEQ ID NO: 6198 - DNA, 999 bp, Actinoplanes utahensis
atgcccgccgggatcgccgacgccttcgggctgggccgggtggtcgcgtgccgtgtcgtgaccaccggcttcatgaatctcacctggcgcctgaccactgataggggcgagttcgccgtcaagcggctcaccgaccggtcaccggaagagttcgaggacatccagaatctcctgccgaggctcgctgagcgcggtttcccggtcccgctcgcgcggcgcacccccgagggctccgccctactcaagatcaataattaccggtacgcggtgagcgactggcgccccggggaacacccctcgggcgccgccctgcccctggacgcctgcgccgggctgggcgggttgatcgcccgtctccacctcaccctgggcgacctgctgcccgcggcccccacccacctggccgacaccccggcatcggtcgacgaggcccgagccgccctccgccactacgccgcactccatcggcgaacggcgcaccccgcgcggatgacgcaccaggaggatctcgccggggagatcgaccggcggctcgtgctgctggacgccatcgccgaccggcgacccgcgccggggcgggtcgggccgtgcgggtggacgcacggggacctgcagtccttcaacctgctcatggcgggcgggcgggtcaccgggatcctggactgggatcggatgggggtccgtccctacgcacaggaggtggtccgcaccgccaccatcctgttcagcgacggcggacgcacggccctggacctggaccgcaccaccgcgctgattcgtgggtactgtgcgcgtcttccgctcacccgggccgccgtgatcgatgcggccgagcggcgccggtggacgctggctaccgaaacgtggcagctccagcgtcatcatgacgacggtgacagcacctgcgaccggctcttcacggcgcgcgggcgattcctgcgctggtggacggagaactgggaggaggtcatgcgagcggtttgcgcaggatgtagttga

SEQ ID NO: 6199 - DNA, 426 bp, Actinoplanes utahensis
atgcgacttcgacttcggcatcttcggcacggctcgcgcatcttcacctggcgagcggagatccaccacgtgcccggcagtgcggactgtcaccggtgcatccgggtccgggcgtggggcgcgggaaagaacggacaggcgctgcaggccgacctgttgtcggttgcctggggcacgccctggtcggcgtgctcgacggacggttcgcacccggggccggccgacatccgggcgatgatcgtctacgcgctgaccgccggctggcaaccggagcggcgcggcgggacctttccgctcaccgaggcccagcacgcggagacgttccgcctgcccgacttcctgctgaccgatcgcctgcggacaccctgcagcggcgacccgaccgagcgggtgatcgccgcccacgacctgcgccagcgcagctag

SEQ ID NO: 6200 - DNA, 627 bp, Actinoplanes utahensis
atgtccggcaccggcgtggccgccatgatggtcgccgtcctgctcctctccgcctgcgctgaacaggcacaacgcaccgtttcccgcgcctcgccgcaggcaccgggatgcgggcacgacgcgccggtcccggacggcgtgacgctcctcgccgaggacgtctgggcaggcggcggcacgacggcgagccggctgcgggtgctgcccgccgaggcgtgctccgggaccgcgcggcgccccgaggagtgcgacacgttcccgtgggcaccggagcgcggtctctacccgctcggcggccgcgcctggctctccgtcggcatggcgaagaacgggaacgacaaggccgatccggtacgcgaagagctgctgttgtacgcccccggctcgcacttcgcgcagacgtccgcgcaagccgccctggactgtggcttcacggtcctgaccgtgctcgacggcaagccggccaccctgcagcgcatcggcgaccggctgaccgagatcgtctacatcaccccgcggtcggtgatcgggatgtccagcgtcgatccgtcggtcggcccggccgatctggtgtggctcgcgggcgtcgccgccgaccggtccgcggcgctgacgtacgcctcctga

SEQ ID NO: 6201 - DNA, 1422 bp, Actinoplanes utahensis
atgcctgccgacacgacgtacctcgaactttccgaggacaccgggagcgcgcacaagttctacgaggtcaccgtggacggcaccgacctgaccgtccgatacggccggatcggcgaccgcggccaggtcaagcagtcctcgttcaccaccccggagaaggcgaaggccgaggcctcgaagaagatcggggagaaggtgcgcaagggctatgccccggcggtcgccggcggccgggcccgacgggccgtctcgcgccggcagatcgtcagcacccggtccaccgccacccgcgcgccgatcctctggcgatatgcgtcgggcagcccggcgttcggcatcttcatcgacgacgacgtgtgcatggtcggcaacgagcgcggcctgatcaccacgctcgggcacgacgcgaccgtgctgcagcggttccagcttcccgacggggtgaaatgcatcgtcgccgacgacggctggatctacgcgggctgcgacgacggcaacgtgtacgacctgtccggcaagatccctcggctggcgtaccggatcgcccccgagatcgacatctactggctggacatccacgacggcgtgctcggggtctccgacgccaagggcggcatctcggcgatcgaccacgaggacgagttcctctggcagcggcccggccgcggctcgtcggcctggatggtccgctgcgacgcgacggccgtgcaccacggtcactccggcggtgtgaccagctacgactggcgcaccgggcgggagatgtggcacaccaagaccgggccggtgctgttcggctggcaggagcgggacacgctgtacgccggcaccgccacccgccaggtcgtcgagctcggcaaggacggtgcgcagcggcagatgtatcagtgcgacgcggccgtctactcgtgcgccaccgccgaggacgggcggtacgtgttcgccggcgacagcgcgtcgtccatctactgcttcgacaccaacggcacccggttgtggaagctgtcgaccggctgcggctcggcctattcgatgcagtaccgcgacgagcgcctctacatcgtcaccaccgacggttcgctggcctgcatcgacgccagtgagacggcgatccgggcggcgatcggcggcaccgtcccgcaggccatcgacgtcaaggcgcccccgcagatgccggcggtcgtcccgtccaccacggtcgaggtgatccacgacgcgaccgacggcgtgctggtggagtgcgtcgaggcgggcggccgggtgcgggtgcgggtgctgtcctccggctaccacgccgattggcaggtgcagttcccgaaggggatccgtgagcccggcagccgtttcgtggtcaccggggtgcgtgaggccgcgcggggtggcttctaccgggcgtacggcgatgtgcgccgtctgctctga

SEQ ID NO: 6202 - DNA, 639 bp, Actinoplanes utahensis
atgaccatctacggacccggcggcgtcgacgtccgggacccacgccgccgcctgcaccccggcgtgctggccctcgtcatcaccgccgtcatcatcatcgtcgcggcgctcgcctacttcatgatgcgctcccccgcggaccccaccgcccagcccgccgccgtcccgtcccgagccgccgccatcgcccccagcccggcctcctcccccagcccgaccgacccgtccggcctcaccaccggctcctggcaggtcaccgccgccgacgaccgcgacacctacctcaccgtggccggcgacttcgccgcgatgtccgaggtcgccgccacgatcacggtcgtcgaaggcctggccgacgacagctgcttcaccttccgcgacgaggacggcaacttcctccggcactacaactaccgtctccgcttcgatccgaaagacgactcggacctgttccgcggggacgccaccttctgcgccgaggacgaccagccgggcaactccttccgggtccgctccaagaactatccggattacttcctgcaccgccgcggcaccaagctctacatcgacaagccctccgaatccgacgacttcgtcgccgacagcaccttcgctctgcacacccccaccacctcctga

SEQ ID NO: 6203 - DNA, 1317 bp, Actinoplanes utahensis
atgagcggattcggcgcggcgaatcgggcgctggtggccggctgcctggccctgaccttgaccctggcaccgaccctgaccggctgttccgccgcgtcgaaaccggacccggccggcagcaccccggacgtgggcggggcggaccgcaccccagaggcgggcagggccgagagcaccccggccacgggcaccctggtgaccaccaccgtgaccggcaccgaccaccggatccaggccccgcccggctggtccgtccagctctgggcggagcttcccggcgcccgcctgctggcctggaccccggacggcagattgctcgtctcccgcccgggcgccggcgacgtcgtcgcgctcacccccggcccgcccggcacgaaaccccggcagaccaccctggtcggcggtctcgaccagccacacggcctggccttccagaacaacacgctgtatgtcgccgagagcgatcaggtcgaccggttcacctaccgggccggcgccgtctccggtgaacgggtcgtcatcgccggcctgcccgatgcgaagagtccggagctgggcggtgcctacgcccacgcgctcaagagtgtcgcgatcggccgggacggcacgatcttcgtctcggtcggttcgaccgggaacgtgtcggcgaatgatcgcgaggcgcgcccgcagcgggccaccattctgcaggctccacccggcggcggcaggccgaccgttttcgcccgcggcgtgcggaacggcaccggcttggcgatcgccccggacggctcggtgtggaccgccgtgaacaaccgggacaacatcgccgacccgagtgacggccaggtcaagcagtcctacgtcaacgatcatccgctggaaccgctggcccgtctgacgccgggacgggatctgggatggccgtactgcaatccggatcttgatcgtcggtttgtccgcgactaccagctcaaccgcgacggagcgaagctggactgtgcgaagctggcgccgatcgagcaggggctgggcgcccattccgcgccgctcgggctgagtttcgcgaccctggcggcgccgttcggacagggcgccctggtcggggtgcacggctcgtggaacaggacgccgccacgtgcgccggaggtgtcgttcttcgcctggcgcaacaatgcgctcgggccgcagcagaccctgctcggcggcttccaggatgcgcggggcaaccgctggggccgcccggtgatggcagtgcaaggccccgaccaggcgctctacgtgagcgacgacctggccggggccatctatagggtgcaggcgacggcgacgtcgtag

SEQ ID NO: 6204 - DNA, 1485 bp, Actinoplanes utahensis
atgcaaccttggcgagaggccaccctgatgcgcaaccgacttcgtgccgctgttctggcctcccttgtggcatgctccggtctgatgggagtcgcgactccggcgcaggccgccgatgccaccacgctggccggccggctcgcgtcggtcaaggtcgccaagacgctcaactactacccgtcgagcgccggctggtcggccatgtggaccaacttcgacccggtcgcgatcgacgcggacatggccaaggcggcccagctcggcgccaccaacatccgcgcgatcgtcttccccgacgcgttcggctacccggcccccaaggtcgagtacaccgagaagctgcgcaagttcatcagcatcgccgactcgtacggcatgaccgtcaagctcaccctcttcgactggtgggagggctacagcgacgcgagccgcagcatcgcctgggcgcaggccatcctcgacccgtacaaggacgacccgcgggtcctcgccgtcgagctgaagaacgagttccagccgaacgacgcgaccgcgatcgcctgggtccagcaggtcatcccggccgtccgggccgccgccccgaccatgccgctgaccctgtcggtcgacggcggcaccggcgccaccggcatggcgcagatcaaggccgcgctggccgccaccccgctggactactacgacttccacttctacggcagctcggagcggtccctcgcggagatccgcaaggcgcaggccgcggtcagcccggccccgatcgtgatcggtgagaccggcctcagcagcggcgccacgagcgagggcgagcaggccgcatacctggcccgggtgctccgcgccgccaccgaggccggcgtcggctcggtcgccccgtggacgctcaacgacttcgcggccggcgccatcccgtcccagtcgcaggtctccgccatccccgcgcagtacaccttcggcctgtaccgcgccgacggcaccgccaagctcgccgccaccgtggtgcgcaccgcctggaccaccggcaccgtcccgaacagctacctcaacctgggcttcgaggcgccggccaacgagctgacctggaaggcgaaccagcccgacgccggcgtcggcacggtcagcaccgacatgccgcgcaacggcaggtactcgctgaagttcgccggcaccacccgcaccagctccggtctgccgtcgatgcgcacctccccgatcaccccagtgcagccgaactaccggtggcgcgccgaggcgtacgcccgcggattcaacgccaccggcatcaccgagatctcgctgagctggttcgacgcgaacggcaagtggctgtccgagaccacctcgaaccggctgccgctcggcaacaccacctggaccaagctggtcgtcgacaccgtcgccccggccggtgcggccgcggtgcagctgcacctgaagtcggcggacaactcgggcatcgtctacttcgacgacgtcgcggtctcctga

SEQ ID NO: 6205 - DNA, 1308 bp, Actinoplanes utahensis
atgcagtcacgcaccgacctcatcgaggacttgatgagccgcttcccgcacgtcccgcgggaagcggtgatcaaggaggacctgctgcgtggcgggctggcgttcgacgacgccgcgctgaccgacaacgagggcggcgacgtcaagccgaagtcgtacttcatcttctccttcgaccaccggacgctgcccgagctgggtgaggcggcgctgcgccggccgccggaggagatcgtgctcaccggcggcccctacgacctgcgccgcaccgtggtctcggtgcggatcaacccggcctcgccgtaccgggtgaagccggacgccgacggccggctgatgctgttcctggacgggcgggcgatcgccgaggtcgggctgccgccgatgcccgactactaccggcacgcgctggccaacggcaagcaggtgatggaggtcgcgccgaccatccagtggggttatctcgtctatctcacggttttccgggtgtgtcagtatttcggcgccaaggaggagtgccagtactgcgacatcaaccacaactggcggcagcacaaggcggccgggcggccctacaccggggtcaagccggtcgacgaggtcctcgaggcgctggcgatcatcgacaagcacgacacgctgaagacgtcgcaggcgtacacgctgaccggcggcagcgtcacctccaaggtggacgggctggccgaagccgacttctacgggcggtacgcgcaggcgatcgaggaacgcttccccggccgctggatcggcaaggtggtggcgcaggccctgccccgcgccgacgtgcagcggttccacgactacgggatccggatctaccacccgaactacgaggtgtgggacaagcggctgttcgagctgtactgcccgggcaaggaacgctacgtgggccgcgaggaatggcaccgccggatcctcgaatcagccgaggtgttcggcccgcgcaacgtcatcccgaacttcgtggccggagtcgagatggccgagccgttcggattcaccacggtggacgaggcgatcgcgtcgaccgctgagggccttcaatacttcatgtcccggggaatcaccccgcggttcaccacctggtgccccgagccgaccacgccgctcggtaggacgaaccccaacggggcgccgctggagtaccacatccgcctgctggaggtgtaccgggcaacgatggaggcaaatggcctgtccagtccgcccggctatgggccggccggtgcgggcaaggcggtcttctccgtcagttcattcatggacagcctgcccgaagaggcgtag

SEQ ID NO: 6206 - DNA, 348 bp, Actinoplanes utahensis
atggttcgggtggacgacgacgacttcatctggtcgcaggcccgccgctggcgcgcccacctcgaccgggtcaacggcaccggcgacaccgagctgacgctgcgcatcctcaagatcaccgaagaggcgggggaggccgcccaggcgtggatcggtgtccaggggcagaacccgcgcaagggcgtcacgcacaccgtcgaccaggtggtcggcgagctcgccgacgtggtcatgaccagcctggtcgcgatcgccagtctcggcgccgacccgcgcgcggcggtcgccgcctgcgccgccaaggccgccggtcatctgccggctgccgatccgccggccacttcctga

SEQ ID NO: 6207 - DNA, 969 bp, Actinoplanes utahensis
gtggacactctgaccgggctgctcgacggggcgcgggcgcgggaggccttcctgctgcggaccgtggtgcagccgccgttcgcgctgcggatccaggacgaggcgccgctcaccctggtcaccgtgctgcgcgggacgaccgtggtgatccgcgacgagccggtccggctgcatcccggcgacgtcgcggtgatccgcggcccggaaccttacacggtcgccgacgagccggacacgccctggcagacgatcatccatccgggtcaggtgtgcaccacggtcgacggattgccccgcgaccatctcggggtgcgcagttggggcgacgccaccgaggccggcaccgagctgatcaccgggacgtaccagctggccggtgaggtcagccggcgcctgctggccgcgctgcccgggatgctggtgcagccggccgcggccaccgaccgcgcgctggtcgggctgctcaccgccgagatgggccgcaccgtcccgggccaggacctggtcctggaccggctgctcgacctgctgctcatctcggtgctgcgggcctggctggccggcccggcggccggcgcctggcaccccgccggccacgacccgatcgtcggcccggccctgcggctgctgcacgacaccccggccgagcagtggacggtcgccgggctggcggcccggaccggggtgtcccgctcgctgctcgcccgccgcttcaccgatctggtcggcgagcccccgatggcctacctgaccggctggcggctcagcctcgccgccgaccggctgcgcacctccgacgcgacgatctccgcggtggcgcgggaggtgggttacggcagcgcgttcgcgttgagcgccgccttcaaacgcgagcgcggcctgagcccgcaggagtatcgccgccagtcccccgaccggcacttcaccgcctacgccccgagcagcaccccgctgctcgtcctggcctaa

SEQ ID NO: 6208 - DNA, 192 bp, Actinoplanes utahensis
atggctgtcgaggtgccgctgaacgaccgcctggcggcggcgtcactgagcgacccggcggcggcgcggcggaacttcgagggcgtgtgggtgccggtcaacgacgtacgcacactcctgacggcctcggccctcgcatgcctcgcgccggcgctgggcctggcccgtcgccccgcgcggatgtcagggtag

SEQ ID NO: 6209 - DNA, 219 bp, Actinoplanes utahensis
gtgaaaccgcgtctcaccacgggtgtgctggtcgccgcgctgatctgcgtggggctgatggcggggatcttcttcgcgttcaccacctcggtgatgcccggcctgcacaccgccgacgaccgcacgttcgtggaggcgatgcggcacctcaacgcggcgatcgagaacggcctgttcggcctggtgttcgtgggcgcgctgggcttcccggccggctag

SEQ ID NO: 6210 - DNA, 855 bp, Actinoplanes utahensis
atggctcctgcacgccgcggcgggtggactcgaggcatgacggagatgacgacagttctggtgaccggcggaacgggcaagaccgggcggcgcgtggtgcggctgctgcgggagcgcggcgtgccggtgcgggtgggttcgcggaccgggtcaccggcgttcgactgggcggtgccggcgacctgggcgcaggcactcgacgggaccggcgcggtgtacctctgctatcagccggacctggccttcccgggtgccgtcgacacggtgggcgcattcgtggagcaggcggtcaagcagggggtgcgccggatcgtgctgctttccgggcgcggtgagccggcctgcgcggcggccgagcgggtggtccgggactccggggtggcctggacggtggtgcgggccagcttcttcgcgcagaacttcagcgaggcgttcttccagcccgcggtggtggccggggagatcgtgctgccggtcggcgacgcccccgagccgttcgtggacgccgacgacatcgccgaggtggccacggtggcactgaccgaaggcggacacgacgggcgcacctacgaggtgaccggcccgcggctgctgagcttcgccgaggtcgccgcggagctcaccgcggccaccggtcgcgagatccgcttcacgccggtgacccgcgaggactaccttgaggcgctgcgcgccgagggtctcccggaggagttcgccgatctcttccagatggtcaccgacggcaggaacgcctacctggcgtacggggtgcggcacgcgctgggccgcgagccccgggacttccgggactacgcccgggccgcagcggccaccggtgtctggtcggccgcgtga

SEQ ID NO: 6211 - DNA, 909 bp, Actinoplanes utahensis
gtgctcgccgccctcgaccgcctaccgggccggatcggtcagcgccgcgggaacggggtgaggccgtcggcccgggcggtcgccgccaccgcgtcggacggcgccgagaagtcggccgcgaatcccgagacccgacgcaacgatcgatgccgtaccatccccgcagagctctacgggggatggacaatcgtgaagatctttgccgtgctggccgtcggcgccgtgctgctcggcggttgcgcccacgccgtgaaacccgctccggtggtgtcctcggcaccggccgacaacggcgtcgccgccctgccggccgagcagatcgtccagcgggcgcaggccgcgctgaaggccgccccctcgttccgggtccggggctcgctgtacccggacggcagccgcttcggccgcgacgccgggaaagggcggctctggcagctcgacatgcggctgtccggcaccgaccgggccggctggaccgcgcagggtcagtcccgacaggacgagctcgtcgtcggcggcaaacggtacctgcggtccagcctggagatcctggcgcagcagatgcgccgcgccgatgcggagaagctgctggcggggctcggcggccactgggtcacgctccgtcccgacgaggatgtctacggcgatttcgtcaccaggacgttcctcgacggtctgctgaccggtggcaccaccctgaccaagggcaccacgcaggtgctcaacggtgtccccgcgatcgccgtgcagtccggtggcaccaccctctacgtcgccacgaccggcgcggcgtacccgctcaagctctcctggaagttccaggccctgtcgttcagcgagttcggcgccacgttcccggagatccaggcgccgccgccggccgacgtgatcgtgcttcccgacaactga

SEQ ID NO: 6212 - DNA, 120 bp, Actinoplanes utahensis
atggtacggcatcgatcgttgcgtcgggtctcgggattcgcggccgacttctcggcgccgtccgacgcggtggcggcgaccgcccgggccgacggcctcaccccgttcccgcggcgctga

SEQ ID NO: 6213 - DNA, 1419 bp, Actinoplanes utahensis
gtgacatctgagaaccgctggcgggcgatgagcgtcgccctggtcgccggcttcatgaccctgctcgacgtcagcatcgtgaacgtggccctgccctcgatccgcgccgaggaacacctcggctccggcgagctgcagtgggtgctgtccggctacgccctgaccttcggcctgctgctggtgccggccggccggtacggcgacgcccgcggccgccgcaccgccttcatcgccggactggccgtgttcaccctggccagcgcggccgccgggctggccaccggcgcgctgtggctgatcgtcgcgcggctggtccagggcgccgcggcgggcgtggtcaacccgcaggtgtccggtctgatccagcagttgttcgagccacacgagcggggtaagccgttcgggttgctcggcgccacgatcgggatctcgaccgcggtcgggccgctgctcggcgggctgctgatccagttgttcggtgccgagcagggctggcgctggatcttctacatcaacgtgccgatcggcctgctggcgatcgtgctgggcgcccgctggatcccggcccgcccgcccgagcagcgcgagcacgagagcctcgacccggtcggcgtgctcctgctcggcgccggcgtgttcctgctgttgctgccactggtccaggaacgcgagtggaccgggaacgcgaagtggctgctggtcgtcgccgcgaccgcggtactggccggcttctgggtctgggaacgccgcttcgcccggcggtccaccccggtggtcgacctcgggctgttccggacccggtcgtacgcgctgggcgccctggtcggcatcctctacttcggcgggttcacctcgatcttcttcacctacacgctgttcctgcagaacggcctgcactactcggcgctgcaggccggcctggcgatcaccccgttcgcgctcggctcggcggccaccgcggcactcggcggccgcgccgtcgaccgcaccgggcgcaccctggtggtcgccggcctggccgtcgtcgctgccggcctggccggcacggttctggtgctgcacgtcgtcgacggcaccgcggccggctgggccagcgtcgtgccgctgctggtcgccggcctgggcagcggcctggtgatcagccccaaccagacgctgacgctcagcgaggtaccggtccgccgggccggcagcgccgccgccgtgctgcagaccggtcagcggatcggcgccgcgatcggcatcgccggcgtcggctcggtcttcttcaaccgtctggccggccacaacggcgactgggggctggccttccgcacctccctgaccgtaacgatcgccttcatcctggccgccctgctcgccgccggcgccgacgtgctggccggccgccgccgggagcacacgatgacgctgcggtag

SEQ ID NO: 6214 - DNA, 807 bp, Actinoplanes utahensis
gtgagtgagctgccgaccggcgcatacgcgtcgggtcaacattctgatcagaattcctcgaaagccgcgcaggtggccgccgaaggcaagcaggccgccggccaggccgtctccgaggtcaaggacaccgcggcagagcaggtgcggcgcgtcggccaggaggcgggcgcccaggcccgcaacgtggccggcgaggtgcgcgacaagctgggcgagcacgcccgggcccagaacgacaagctggtcagcggcatccgcgagaccgccgatcacctcgacgagatgcgcggcgaccggtccggcacccccgccgcggccgtcgtgtcccgggtcgccgagggcggccggcagctggccgactacctcgaccgcaacggccccgaaggggtgctcgccgaggtgcaggacttcgcccggcggcggcccggcgcgttcctggcgaccgctctggcggccgggttcgtggtcggccggctcggtaagagcgtggccaaggccgacgaggccaccggcggcaagccggccggtgacgcctactcgtcggtgacgccgtcgaccgcgcccaccagcagcttcgcgaccaccaccagcaccgactacgccagcgcgaccggcgccggcgcggactacgtgggcaccggcaacgagtacgcctccacgaccggcgcgggcgcggactacgtgggcaccggcaccgggtacgccgccacgaccggcgcgggcgccgactacctgagcaccgggaccggtacccccatcccggtgcaggaggaatacccgatcggcacccgggagccgcggccgtga

SEQ ID NO: 6215 - DNA, 408 bp, Actinoplanes utahensis
gtgaccgcccccgagaagtccgaccaggtcgcgcagacctcgatcggtgagctgatcggcaacatcagcgacgacctgtcccagctgttccgccaggaggtcgagctggccaaggcggagatcaagcaggaggcgaccaaggccggcaaggcggccgggatgctcggcggcgccgggttcgccggctacctggccgtgctgatgctcagcctggccgcggtgttcggcctggacgccgtgatgccggccggctgggccgcgctcatcgtggccgccgtctggggcatcgtcgccgcggtgctgtacgtgaccggtaagaaccggctgaagaccgtggacccgatgccgcggcggaccgtcgagacgatcaaggaggacgcgcaatggctgaagaacccgaccggctga

SEQ ID NO: 6216 - DNA, 660 bp, Actinoplanes utahensis
atggctgaagaacccgaccggctgaggcaggacatcgagcggacccgcgcgtcgctgacccgcgacgtcgacctgctcgccgagaagacgagcccgagcaaggtcgccaagcggcggtggagtgcagtgaaggagaaggtcatgggcagcgccgactacacgcggcaggcggtgggcgagtccacgtcgacggtgcaggacaaggcctcgcacctggccgacgtggcgggggagaaggcgtcgcatctgaccgacgtggccggcgagaaggcgtcgcacctcggcgacgtcgccggcgaacaggcgcaccgggcggccgacgcggtccgtgcggcgccgcaggcggtggcccggcagaccgccggcagcccgctcgcggccggggtgatcgccttcgggctcggcctgctggccggcggcctgatcccggtcaccgaggtggagaagcgggccgggcgccagctcaaggagaacagcggcgacctgaccgaccgggtcaaggacatggcgagcgaggtcaaggacgagctgaccggcaccgtccagcaggccgcccaggaggtcaagggcactgctcaggaggccgtgcagaccaccaaggagcaggcgcaggactccgcgcaccgggcgaccgagcagacccggcacgccgtctcctga

SEQ ID NO: 6217 - DNA, 246 bp, Actinoplanes utahensis
gtgctcacccaggtcaaggaccccggaacggcgggtttcgcggcggtggccggggtgctggtcgccttctggtccgcctccgggtatgtcgcggcgttcatgcgcgcgtccaactccgtgcacgacgtgccggagggccgcccgatctgccgtcaccacccgaagcatcgtgaagtggccggtgctgctggtgccggtcagcctgatgttcgcgctgcggtacgaccgcacgctcaaaaagcatga

SEQ ID NO: 6218 - DNA, 444 bp, Actinoplanes utahensis
atgaaccacgacgatctgctcatccggatccagcggagcgggcggctgcacggccggaacgagagccgccggatcgccgtgaccgtactgggtgtgctgagcgaggtgctgccggccgcggcgtaccgccgcctgaccgcgaccctgccggaggagctgcggcagcggctgcccccggctgagccgggccggatcgtcgagatcgtcgactgccgccggttcctggcccgggtggccgcgcggctctacgccgatggcggcgacgcggccttcctgacccgggtggtgctggccgagctcaacgacggcgcccgcggggtgtcaccggccgagctggcgcatctggtgccgatggatctgcgggccctgttccggtcccggccgctgctgccgtggaccggtgccgccatcgagccggacgtcgcctaccaacgggttctctga

SEQ ID NO: 6219 - DNA, 2157 bp, Actinoplanes utahensis
atgagtatccattaccgctccggccggacccgggccgatcctacggtcagcgccatggcacgcattcaccacagaccctgggcggccgccgccctgaccctggccatgacggccggcggcctggccgtcgccggcccggccgtcgccgacatcctcgaccccgcggcctgtctggccgccgccaccggctcgctggccttcgactccacggtccagtggggcgaatccaccaagctcagctggaccaccaacctggccgccaccaaggtctgcgacggcggcaccccgcagatccgcctgttcgagggcaaccggcgccagatcggcccggtcctgtccgccaccggctcgatgaccgtcacacccaccgaacacaaggcgtggacgctggaactgtcgataggtaccagctccaccaagacgctggcgtcggtcttcccgaccgtcgtcccgtaccccgccgaacccctgccggccggtaccgcggtgaccatcagcagcaacgacctcgccgagcgacgcgagttcctccgggcgatccggacgcccggggcgacgatccagatccccggcgacgtcgtgctcgacctcagcggactcgaccacgtgcaggtcgcccccggcgtcaaggtgctcggcgaccggtcggtcaacccccggggcccgcgggtgttcaccaccacctatccggactcactgctgtggatcggtgtctacggagcgccgtcggacaacgtccggatcagcggcgtccggttcgacggcctggaacccgcggacccgatggcgtcggccgacacccccgacgccaccgcgatctcgatcttctccagccagcacatcgagatcgaccacagcgagttcgcccgctggcggggctttggcgtggccgtctacgaccacgaccagcggatcaacctggacaacgccgacacggtgtggatccacgacaattccatccacgacaatcagcacccggccggcgacgacggccacggcgccggctacggcatcgtgctctacgagagcgcctacgccctgatcgagcggaacgcgttcgacctcaaccgccactccatcgcggccgacgggcaccctggaaccggctatctggcctaccgcaacctcttcgaacgcccgggctacgccgccacgaacggcaagcacggctggccgatcgacatgcacggcaccggatgcgggcaggacgggagcgtctacaactgcggaccggcgggcgcctacgtcgacctgcgctacaacaccgtcaccacgaccggcgcccccgccgtctacctgcgcggcacgccctcgatcaccttcgacgtctggaacaacgtgttcgccgagagcgccgatgacacgctgaagcagaacgagaccgggctcaacaacaagggcggcaacgtgttcagctcgcccctcgtcggcgaccgcaagtactgcgacttcgacggcgacgggaagctggacccgctgctggccagcggtatcggatggtggtaccagtcgagcgccgccgaccgctgggtcttcgtgaaccagtcgtggctgcggctgaccgagatcaccctgggcgacgtcaacgccgacgggttctgcgacatccaggcgggcggaaagacctattactccccgcatacgccggacccgatgccggtggaggcgctcgagacccaggaccaggagacgcttcccaacataccgacgacgacgaacctcaaagcggtgggtggccaggctccgtacacgtggtcggtgaccggattgccgagcgggatcaccgcgacctccaccggcgtgctctccggggtggccaacggtccggccacgacggtcgtctacacggtgaccgacgctctcggtcagaccagcacccagtcgttcacctggctgcccgcggtcacccacgtgccggcgctgctcgggctggacgagtacaccgcctacctttggatcgacagctcgtacctcaacgccgtccgcaagtacaccaacgactgcctctcgcccggcgacgtcgtgaagcagtcgccgcaggccggcaggaaggtgcaggcttcgacggaggtcaccatctgggtgtccacctgcgtctcgggcggaggcggcggcggcccgaaccccaacccgaagccaccgacctggcccaagtag

SEQ ID NO: 6220 - DNA, 2307 bp, Actinoplanes utahensis
atggatactcatctcttcgtcggcactacctacgcggcgtcggaaggccgacttcgccgcggccccggcgtgggtagagtcgcccgccggaggtcccggatgtacacctggaacgatgacggccgatggcccctcgtcgggcgcgaggacgaactgcacgccttcgccggcctgctgagcggcgcacggcggcagggcttcgtgatcagcggcccgatgggcgtcggcaagtcacggctggcggtcgagtgcctgacccgggccggcgcggccgggttccgcacggcccgggtcaactgctccgaggccgccggcaccgtgccgctcggcgccgtcgtgcacctgctgccgcccgacctggacctggccgacccggtcgcggcgttccgccgggcggccgaggtgttcgccgtcgggcgcgacgagccgggatggctcctgctcatcgacgatctgcacctgctggaccgggcctcggcggtgctgctgcggcagctggtcgacgccgggtcgatccggttcgtcgcgaccgtccgggccggtgccccgcagaccgccgcggccgacgcgctgtgccgtacggatgcggtgctgcgggtggatctcgggccgctgcgccgggacgacgtggccgacctgctgcggcgggtgctgggcggcccggtggcccagcagaccgtccgcgagttcggcacggcctccgcggggaacgccctctacctgcacgagctggtggtcgacgcgctgcgccgcgcggccttccggtgggacgggctggtctgggaggccgatgcgccggccggcaccacccggctgcgggaaatggtccggccgctgctggctgcggcgggccgggacctgatcgagctggtcgcgctctgcgaaccggtaccgctggccgaggccgagcgggtcgcgacgccgggcgaactggccgggatggaggccgccgggctgctgcgtgccgaccgggacggcccgcacaccacagtgagcttcgcgcatccgatgtacggcgaggtggcccgggccgacgtgccgctgctgcgccgccggacggtgctgctggagcaggcggagcgggtcgaggggtacgggctgcggaccgtcagcttccggctcgcggccaccggcaccgccgatccggagctgctccgccgggccgcgacggtggcgcggcacgcgcacgactacccgcacaccatcacgctgctgcgtgccatcccgcagggcgtgcgcacggtggccgacgtgctgctgctcgccgacgccctgctgcacctgggccgcggcgcgacggccgagcgggagctggcggccgcggccgggcatcacgctctcgccgaatccgaccgggtccagctgaccatcgcccgcacccgcaacctgtactggcaggacacctcgccggcccgcgctctggcgatcaaccgccgggcccgggcggccgtgaagagcgccactctgcatcacgtcctcgacctgaacgagggctgcctccggttcgtccagggggagatgaccgaagccgtgcgcctactggatcgtctggaacccgaggtcgacgatgccgccgacgtgaccgtctggttcctggccgcgggcctgaagccggacgcgctcgccgccgccggccggaccgccgaggcgatcgagtgggcccggcgggcctaccgggccaaccggcgccatgccgtccgtggcctgctgccgcacgccgcgtcgcacctgacctcgctcggtgccgcccaggccgaggccggtgacctggcggtcgcccgcgagacgctgaccgctgccttcgccgaactgctcgacgccggtgccgcccgtccccaggtgtgggccgcgatgaatctgggccggaccgagctgatcgcgggccggctcaccgcggcccggcactggtacagcgaggctgcgacgctcacccgcgctctcgggtaccggcgcgcgcacgccatcgccacggccggtctggccgccgccgccgcccagcagggcgagccgcggccggacgggatgccggcggacggcacggtcgacaccgatcacgaggtcggccgggcgtggacgctggccgcggccggccacctcaccgaggcccgcgagctgctcggcggcgcggtgggggtggctcgcgcgggtggccgggtcaccgaggagctgtacctgctcaccgagatctcccggctgggcggggcgaagcctgtcgcgcaccgggtggccgagctggcccgggagtgcgacggccggctggccgcggcccgggccgcgttcgtcgccgcgctggccggggacgactag

SEQ ID NO: 6221 - DNA, 183 bp, Actinoplanes utahensis
gtggtcccgctgaccggccgggagcgggaggtggccctgcgggccgccgcgggagcctccagccgtgacatcgcgcgcagcctcacgctctcggtgcggaccgtcgacaatcatctcaaccgggcgtacgccaagctcggcgtgaccggccggcgcgacctgcccggggcgctcgccggctag

SEQ ID NO: 6222 - DNA, 531 bp, Actinoplanes utahensis
atgaccatttcgcagacccccgcgaccttcaccaccaaccaggacctcgatccgatccggctgcgcagggcgttcggcgtgttcccgagcggggtggtggccgtcgccgccgccgtcgacgggcgcctggtcgggctcgccgccagctcgttcacctcggtcagcctggacccgccgctggtctccttctccatcgccaacacctcgaagacctggcccgacctgcgccgcgccgaccacctcggggtgaccgtgctggccgcccaccacggggcgatctgccggcagctggccggggcggtcgagcaccgcttcgacggcatcccggtgtcggtcagcgacgagggctcggtgaccatcgacgacgggctcgcccgtttcgacaccaccgtctaccgcgaggtggaggccggcgaccacaccatcgtcctgctccgtctgcacgccgtcgaccacccggccgaccagggtgacccgctgtcgccgctggtcttccaccgctcggtgttcggccgggtcgccgacgtctga

SEQ ID NO: 6223 - DNA, 2241 bp, Actinoplanes utahensis
gtgcgggatggcgtcacccctacgcatcaccgccgccgtcgccggcgtcctggaggcgtttctcgccgcgccgggcaccgagcggtacggactcgacatcatgcaggccaccgggtatcccagcggcaccgtgtacccgatcctgatgcgcctgcagaaggccggctggctcgccgcgcactgggaggagatcgacccggtcgccgccggccgcccggcccgccgctggtatcgactcaccccggacggactgaccacggcccgcaccgaactcgccgcccaccgccagcgcaacgcgatcggcccggccgtgcggacgaggccgacatgggcctcctgaacaccctgatcgccgccttcctgcgctccgccgcccgccgctggccggccgacatccgcgacgagatggcccgggactggatcgccgaactcggcgccctgcagcagcggccgggcaccgcctggcgccggctgaccttcgcgatcagcctcgccgccaccccgctggccatcgacgagagcggcgccccgcgcggccgctgggagtggatgcgcgccggggtcaccctgcgtaccgtcgtgcgcctgatgctggtcgccgggttcggcctgggcggtgcgtccgcggtccgcctgttcgccggcgacctgttcctcgacgacctcgccgacgacgccgactggctggtcttccagctcaccgtcggcctggtgaccacgctgctgatcaccgggtacgcggtgaccgccgcccggtgggccggctcgcggggtgctcccgagcccggccccagcggcagcctcggcgtcgccgccaccgccgtcctgccgatcgcctggatggtgccgttcttcctggccgtgcacgcggacacggtgttcaccatctgcctggggatcaccgccacctgggcggcgctcaccatcggcctggtggtggccaccgtccgcgcgctcagcgccggccgccgcggccgcgcctggctggtcgccggcctcggcgtcccgctcaccccgatgctgtcggccgcccccctgctgctcgccgacatcgccggctacaacatctacctcatccaggcgctcctggacgtggccctgttcctgctgccgtggaccatctgtgcggtgaccttcggccgggcggcggtgcgccgctggtccaccaccgggcccgcgaccgacgccgtcccggccccggagcaggccgccgtgcagctcggctggtggcagccgaccgccgaacgcctcctgctgctggccctcaccgtcaccgcggcgaccggctgggcgctcgggatgaccgtgctccagccgatgagcgagcccaccggccccgacgcctacggcgagaacaacacctactgggcgcgggaactccgctggggcgccctcatcgcgctggttgtgatcattctggtgtacgtgcggggcgaccgccgggccacccggagcgtcctgctggggggcgtcgcctggctggccgccgacatcgcgctcgaccggatcaacccgaccaccgtgctgctgccggtcgccgccgcgctcaccgccctgctctgctgcgccgccgccggtggcctgcccctcgtgccgcaaccccgcaccctgttcggtgccgccctggtcgccgcgatcgccgccggcctggccaccgacaccgaatcacccaccgacgtcgaacgcggcctcaacctgggcagcgccgcggccggctcgctgctggcggtcgtcgcgatcgtcgcggcggcccgggtcgccgccacggtcagccgccgccggatcgccgccgcgatcccggccggcctggtcgccgccgccaccccgtgggtgctgcgcctgatctacccgcaccccaccgacgcccgcaactacggcacgctggccttcaccgtgctgctcggctccgccgtggtcgccctggccgccccccggccgcggacccaccgcgactggctgcgctacccggccaccgtgctgatcaccacggtgtccgtcccgctgatgttgttcccgctggtcatcgcgtccatcgcactgccgtacggcgcgctgttcaccgccctggccggcaacccggaaatcaacagcgcggacaccgacaacgtcgcggtgatcctggccgtcccgatcggcatcgtgctgggccgcatgctgcgcggcttcgccttcggccgcccccgggccaccgtccggcgcaccaccgagccgccaccgaaagcccaccccagccccgcctga

SEQ ID NO: 6224 - DNA, 474 bp, Actinoplanes utahensis
gtgccgtcggcgcaggtggcgcagctgctggccgagcaccgggtggcggtcgcggtgctcaacgcctgccagtccgccatgcagaccggcagcgaggcgagtctcgcgcaggacctcgtggcagccggagcgccggtcgcgatggggatggcatattcggtcacggtttccgcggcacgacaggcaatgccgattttgtacggtcgtctcgcggccggcgacgacccggtgctggcggcgtggcaggcgcgccgatgcctgcacgacgacaagtcccggcgcggctacttcgagcagcacctggacctggaggactgggtgctgccggtggtgttcgcccagcgcgactcgtcgctgagccggcgtccgatgaccgccgcggagcaggagtcgttctaccgccgccgcgagcaggtgggacgccgcccgggccttcctccagggactggtggagtggcgcgagtcccggggtag

SEQ ID NO: 6225 - DNA, 186 bp, Actinoplanes utahensis
gtggagtggcgcgagtcccggggtagctggccgagcgacgtcgacgagatccggagcaggatcgcgaaggtgcccgtggggacgctcggtcacctggtcgcggagatcgttcccgccgggctgggggacgaatgggagcggatgttcggtgcgggcgcagcagtggtggaccccggcacggattga

SEQ ID NO: 6226 - DNA, 564 bp, Actinoplanes utahensis
gtgaccgacacgtctcagcgcgacgtgatcgacatcctgaccgccgaccaccgtgacgtgaccgcgttgatcggggagatcaagcaggtcgccgatccgatgatccggcgggatctgatcgacaccgcgatcagtgagctggtgcggcacgccgtcgccgaggagatgtacgtctatccggcgatgaagaagcacctgccggacggtgagaagtccgtggagcatgacgtcgaggagcacaaggagctggagcagacgatgaagcggctggaggacgtcgacgtctccagcgccgagttcgacgccgtgctgctcgaactggagaccatcctggccgatcacgtgcaggatgaggagaccgaccagttcccgctgctgcgcctgcacatcccgcgcgaggagctgattgagctgggcaccaaggtggagacggcgaagaaggtggcgccgacccggccgcacccgggggcgccgaacaacgagctgttccacaagctggtcgggccgggtgtcggactggtcgaccggctgcgggacaagctgaccggccgcgccaccaagtag

SEQ ID NO: 6227 - DNA, 366 bp, Actinoplanes utahensis
gtgcgccggctgctgttccttctcgcctcggcgacgctgggtgcgggactcctgatcctgttgagtgcgggtaccggcgccggccggccgttcggcatcgcgttctgcgcgctgctgacggtcggcggcgcggtgggtgcccgccggggtcgcgggccggtggcccgcggggtgcgcagccctcagctggcggcgaacttcggctgcgccctcgggctgtgcgtactcgccacactgctgtggtggtggcggccgtcggtcgggaccggaatgccgatcggcgccttcctgggttgctccgcggtctccgcggtgctgatgatcgtggtcgggctgaccgggcgtcgagcagaaacgggcgaatga

SEQ ID NO: 6228 - DNA, 201 bp, Actinoplanes utahensis
atgattttcaacctgatccgccgcttcgtcatcacgttgatcgcagtgccgctcgccgcggcgggcgcgcgcaagctcggcaacaccctggaggcgcggcgcggcccgaacaagaccagccgcctgctccggcagggcgccgacaccctgcagggcttcggccggcagaagaagcgcagccgcttctcgttcagccgctga

SEQ ID NO: 6229 - DNA, 408 bp, Actinoplanes utahensis
atgaccgacggactcggcccgatgggcgacctgcacctgatcgcggcggcgctgcgggccgaccgggcggacgtggagtcgtacacccgggtgttgaccgccgtcctcggcgacgcgctcccggccggcatggtcgaggtggagcgcaagcggtccctggccgaccggatgggcggccggcccgggacccccgtgtcgctgaccgtgaccacacccgacgagcaactggtgctccggcaggcggcgcacggggtgcacgccgaggtgtgccggatcgtgcgcggggtgaccatcaagcgcagcacggtcgatgtcgacgactggctggtcgccctcgccggggtgctgtcgaagctggccgccggatcggccgccgctcgcgaaaccctcgaccgcctcctcggctga

SEQ ID NO: 6230 - DNA, 825 bp, Actinoplanes utahensis
atgaccgtgccgacccccggcgtccccgatgatgcgatgcgccgcctggcgcagatgcggcccgggcagccgaccagcctgttcacctccgacctgagcgtcaacgagttcctgctggtccgcgaggccggcttccggccgctcgggctggttctgggatcgagcatctaccacgtcggcatccagttcggccgctggagccagaaccgggagctcgaccagctgtcccaggcgatgtatcacgcccgggagctggcgatgacccggatggaggcggaagcggacgcgctcggcgccgacgggatcgtcggggtgcgcctcgacatcgagttcaaggagttcggctccgagctcgccgagttcatcgcgatcggcaccgcggtgaaggcggatgcgcccccggacagcggcggcggctggcgcaaccggcacgaccagccgttcaccagcgacctgtccggccaggatttctggacgctgatccaggccgggtacgccccgctgggcatgaccatgggcacctgcgtctaccacatcgcgcaccagcggttctggcaggcggtcggcaacatcgggcagaatgtggagattccgcaatacaccgaggcgttgtacgacgctcgggagctggcgatgagccggatgcaggccgaagcggaacaactgggcgcggaagggatcgtcggggtgcagatgctgtccaactcgcaccgctggggcgggcacaccaccgaattcttcgcgatcggcacggcggtccggccgctgcgcgccgatcacgtgatcgccaagccgcagctcgtgctcccgctgaccgaccgatga

SEQ ID NO: 6231 - DNA, 897 bp, Actinoplanes utahensis
gtgagcgtcgacgggtgggacgggcgggggctgcccccggtggctcgcgcgcggatcgcccgggccgccaacggcggggtgcggacctcgctgctgtccgcggacggcgtggccggcctggaggtggccggcttcgacaccgtgggcgaggtgctcggcaccaccgtgatgcagatcgggtggaccggatggggtggctgcggctggcgtcccggcgtcaacccggggctgatcgccgggctgctcggcgacccggggcccgcggccgggcggcccagcggcgccggcttcgcgccgtacacgcgggccatccggcacgggcgcgacaccgcactcgaccggatgcggcaggaggccgcggcgctcggcgccgacggcgtcgtcggcgtccggctcaccgagacccggatggacgatcagaaacgggaattcatggccctcggtacggcggtccgcgcccgcggtcgccagcgcgccggcgtgccgttcaccaccgacctggccgcccaggacgtggcgaagctgctcggcgccggatgggtgccggccgggatcgtctacggcctgtccgtcgcgatccggcacgacgactggcggacgacatcgtcgttgtcgtttttcgccggcaatgtcgaggtggccgggtacaccgagctgatcagccacgtgcgggcggtcgcgcgtgacgagttcgcccggcgggtcgccgccaccggcgccgacgcggcactgatgtccgggctgtcgtcccggatgtgggcgatcgaggtcgccgacaaccacaccgatcacgccgccgagtgcatcgtcaccggcaacgcgatcgcccagttcagaaccggacagctcagcaccccgaacagtctgaccatcctgccgttgcggagccctcgatga

SEQ ID NO: 6232 - DNA, 861 bp, Actinoplanes utahensis
atgctcaccaccgtcgactatctggccgccgacagcgtcgacgaggtgctcgccgcgttggcggacggccggacgtcggtgctggccggcgggcagagtctggtcccgctcgtgacccgcccgggcgcgccgcgctcccgcctggtggacatcaaccgggtggcggggctcgacacgctgaccgaggtggacggcttcctgcatgtcggggcgctggtccggcaccgagcgttcgagtccgacgcggtcggcggagcgctcggccagttgctgcgggtggtggtgcgccacatcgggcacccaccgatccgggcccggggcacgatgctgggcagcctcgcgtacgcgcatccggccgccgaatggccggcggtggcggtgaccgtcggcgcgcggctggtgctggacggaccggccggccgccgcacggtgccggccggcgacttcttcaccgggccgttccagaccatccgccggcccgaggagatgctgatcgaggcggagctgccggtgctgccgggcgggaccggcatcggctacgcggaggatcggcgcagcaccacgttcccgcacgcggccgtgctcgcggcgatcacggtgaccgcgggcgcgatcagctcggcggcgatctgtctggtgaactcgggaccctgtccggtgcgcgcgacggcggccgcgacagccctgctcggcagcacgttctcggacgccgccatcgccgccgcggcgcgcaccgccgcgcaggacgacacccgcctgctcgccggcgacgcccggcgtccgggacggcggcaagccttcgaggtgctgacccgccgggccctccggcaggcccggcagggagccggccggtgcgggtga

SEQ ID NO: 6233 - DNA, 240 bp, Actinoplanes utahensis
gtgcgggtgaggctgaccgtggacggcgtgcctcacgacctcgacgtcgagccccgccgcactctcgccggcgtgctcgggatgcccgtctgcccggacggcgcctgcggcgactgtgacctcgcggtggacggagtggagatccgctcctgtctgatgctcgccgtgcaggccggtggcgcccgggtcgtcacggacgtcggtcgtcgccgggctccgggtccccggcgtacggcttga

SEQ ID NO: 6234 - DNA, 1518 bp, Actinoplanes utahensis
atggtgcgtcggacgctggtgtcgatgctgctagccgtggcttcatcggtggcaggggtggcgccgcccgccgcggcaagcccgccgacccccggtaacgcctacgcgaccatcgttcccgcgccggtctccgcacaggccgggcgcggcgccttccgtatagaccgacacaccacgatcaccgccgccggaccgggcgcggccggggtcgccgactacttgggcgagctcctcgggctgccggtcgtacgctcggtccgggccggcgcgatcgtgctcacggtgggcggcggcggggccccggagtcgtaccggctcggcgtcgatcggcgcggcgtgcgtatcgccgccccggacgcgcacggcctgttcaacggggtgcagacactgcgccagctgctgcccacccgcggtccgctgtccgtgcccgccgggcgggtcgccgaccggccgcggttcggccagcgcggggcgatgctcgacgtggcgcggcacttcttcaccgtcgagcaggtcgagcggtacctcgaccagctggccgcgtacaaggtgaacaccttccacttccacctcaccgacgaccaggggtggcggatcgagatcaggagctggccgcggctggccacctacggcggcagcaccgccgtcgacggcgacccgggcggctattacacgcaggcgcagtaccgggagatcgtcgcctacgcccagcggcgcttcatcaccgtcgtgcccgagatcgacatgcccgggcacgtcaacgctgccctcgcgtcctatgccgagctcaactgcgacggggtggcgccgccgctgtacaccgggaccgacgtcggcttcagctcgctgtgcgtcggcaaggagatcacctaccgcttcctcgacgacgtcatcggcgagttggccgccatcacgccggggcgctacctgcacatcggcggcgacgaggcagactccaccccggcggccgactacgcgacgttcatgcgccgcgcccaggccatcgtcgcccggcacggcaaggcggcgtcggcctggcaccagatcgtggcggccggcccgcggccgtcgacggtcgcgcagtactgggacaccacgcccgacaaccccgccgtcgccgccgccgcgaacgccggaaccgggatcgtgctgtcgccggcgaacctggcttacctggacatgaagtacaccccgcagacaccgctgggacaggactgggccgggctcatcgaggtccgcgacgcctacggctgggaccccggcgcctacctcaccggcgtgccggcggccgcggtccgcggtgtggaggccccgctgtggacggagaccctgcgcacgtcgaacgacctggagtacatggcgttcccgcggttgccggccatcgccgagttgggctggtcgccggccgcgacccacgactgggacgtgttccggctgcggctggccgcgcaggccccgcgctggcgggccgcgggcctcaacttctacccgtcgccccaggtgccctgggtggcgtag

SEQ ID NO: 6235 - DNA, 96 bp, Actinoplanes utahensis
gtggctggggcggcgtccgccccggccggcaaggaggagaccggcgaccacaaggacaatatggccagccagttgagccctgaagccgccgggtag

SEQ ID NO: 6236 - DNA, 273 bp, Actinoplanes utahensis
atgccgatgaccagcgtcgtggtcctcatgacagagctcgaagacgcgacgatccgccgcgtcgcggcggaggcgggagtgcccgcccggcagttgcagtactacttcggcacccgcgacgacctgctactcggcgccctcgagctactcaaccgcgacggccgaagcgtcacctacccgggcgccggacgacgctgggtcacagccgtcggctcggcggcggggccctacgaacgcgctcaactgccgatgagcggacatctagctagctag

SEQ ID NO: 6237 - DNA, 1401 bp, Actinoplanes utahensis
gtgaacagaagaacgctccgcaggctcgtggcgcccctgagcgccgcgctgctggccggcgcctggctggtcgctgtcatccagccggccagcgccgccgacaccctgctgtcgcagggccggcccgcactcgcgtcgtccgtcgagaacggcgagtcccccgccatcgccgcggtcgacgggcgctccgacacccggtggggcagccagtgggccgacccgcagtggctgcgcgtcgacctcggcgccgccgccacgatcacgcaggtcacactgcagtgggaagcggcgtacgccaagtccttccagatccagacctcgcccgacgggaccgcctggaccaccatctacagcaccaccacgggcgccggcggcacacagacgctgagcgtcaccggcaccggcaggtacgtgcggatgtacggcacccagcgcggcaccggatacggttactcgctgtacgaattccgggtctacggcacgtcgacggtcaccccgccggccaccgacggccccggctacatcatggcgaacccgccggtcaccggcgtgatcccgtccaccgcgaccccgcccgcacagaacccgccggtcacccaccacgaattccaggcgaactgctcggtcagccgcacgaacctcaccgacgacccgatcgtcttccccggcctgcccggggcctcgcactcacacaccttcctgggcaaccggaccaccaacgccaccaccacactggcgtcgctgcaggccggaggcacctcctgcatcacccccggggacaagaccggctactggatgccgaccctgctcaacggcgacaccgcggtgcagccggacggcccgcaggtcatctactacaagagtggagtgctcgactacaccagcgtccggccgttcccggccgggctgcgctacgtcgtcggcagcccgaacgcgaccatcgacgaattccgcaacaacccgggcgccgtcgaaggcttcgagtgcggcgacagcacccgcaactgggacatcccggcgaactgcgtcgccggatcccagctcaacgtccgactgcaggcgccgagctgctgggacggcatccacctggacacgcccgaccacaagagccacatggcgtacccgatcgtcggcgtctgcccggccgaccacccggtcgcggtgccgatgatcgagttcaagatggcctggccggtcagcggcaccatggccaacgtgcacttcgcgagcgggcgaggctactcgttccactacgacgtgttcaacgcctgggacgggccgacgctcgcggcgctgaccacgcactgcatcaacggtgggctgcagtgcaacccgcgcggtttcgaccagtacaagccggaccggggagccgcgctcaacgagaactacgaactcccgtaa

SEQ ID NO: 6238 - DNA, 696 bp, Actinoplanes utahensis
atgttgcggacgggggcctgctccggaatcgaacagggaaagcgctctccaagcgagagcgattgtttctctcgtgttgccggacgtcaatactcggcattgacatcacggttccggaactggaaactccgcgacgtgagaacacgccgccgcctcggcgccctggcggccgcctgcgggctggccgccgtcaccgcctgcggctcccccaccgctaccaccccacccgccggcccaccgccgggcacccccgcggcaagcttcggcggcaccgacatcgcctggatccagatcaacatcgcgatggacgagcagctgctgccgctgctcgcgctgaccccgagcaacggggcggacaccgggttacgagcagtatctgaccaggtcagggcgctttccgagagggaactcggcacgctgcgcaagctgcacgacgaggccgggctgtccggcgggaatccgcacgaggggatgccgatgcccgggatggtgacgccggcgatgctcgccgcggcgaccgggcagcacggggccgcgttcgaccggaccctcggcgtggcgctgcgggagtacctggagcagagccggcagctggccggcagcgagcagtcggccggtgcggaaacgcgcacgagggcactcgcggcgagcattctgcaaagccgcgcggcggcgctcggggcgctcaagaaatag

SEQ ID NO: 6239 - DNA, 3435 bp, Actinoplanes utahensis
atgagtcaaatatccgcgtccggtccgcgacgccgccgaccgtccctcgtcgccgcggtcgtcgcgctgctgctcggcctcgccgcggtcgcggtggccaccgccgcgaacgccgccgacaccctgctctcgcagggcaggccggccaccgcctcgtcccaggaaggcgccgacgtcggcccgggcaacgccttcgacggcaatgccggcacccgctggtccagccggttcaccgacccgcagtggatccaggtcgacctcggcgccgccgccacgatcagcaaggtcgagctgcggtgggagggggcgtacggcaaggcgtaccggattcagacgagcagcgacgggacggcctggaccgacatctacgcgacgaccagcggcgccggcggcaccgagtcgctgaccgtcagcggcagcgggcgctatgtccggctctacggcaccgcgcgggcctccggctacggctactccctgtacgagttccaggtctacggctcgctcagcaccggcacgccgggcgccgactgcacgacgaacgccgcgcagggccagccggccgccgcgtcgtcggtcgagggagcggacgtcagcgccgacaaggcggtcgacggcaacaccgggacccgctggtccagccagttcagcgacccgcagtggatccgtgtcgacctgggcgccaccaagaccctctgcggcgtggtgctgcagtgggagggggcgtacggcaaggcgtacaagatccaaacaagcccggacgggaccacctggaccgacatcttctccaccggcaacggtgccggcggcaccgaggcgttgacggtcagcggcagcggccgctacgtccggctctacggcaccacgcgggcctccggctacggctactcgctgtgggagttcaaggtgctcaccggcggcgggacaaccaccccgagcacgccgcccacgcaggatccgacgaactacacgacggtctggcaggacgatttcgacggtacgtcggggaccaccccgtccgccgccgactggctgctgcgcaccggcaccgcctaccccggcggggccgcggcctggggcaccggtgaggtcgagacggccagcgcgagcaccgcgaacgtgtccctcgacggcagcggccatctggcgatcagggcgctgcgcgacgcttccggcaactggacctccggccgcctggagacccggcgcaccgacttcgagccgctcgccgggcagctcaccaggttcaccgcggtgctcaggcagcccgacgtggccaacggcctgggttactggccgggcttccgagccaccggcgcggcgtaccgcggcaactacaccaactggccgggtgtcggcgagaccgacatcatgaccgacgtcaacgggcgcagccagctgtcccagacgctgcactgcggcaccgcccccgacgggccgtgcgccgagtacaacggccgcaactccggcttcgcgtcctgcgccggctgccagaccggctaccacgagtactcgcaggtggtcgatcggaccaggaccgacgaggagatccgcttctacctcgacgggcggcagagctgggtggtgcgcgagtcgcaggtcggcgtcgcggcctggaacgcggccgtgcaccacggcttcttcctgcgcctcgacctggcgatcgggggctcgctgccgaacgcgatcgccggcagaaccacgccgacggccgacacgaccccgggcggcgtgctcagcgtcgactcggtgaccgtgtcccgggccaccggcaccacgccgacggccatgaccgaccccgcgatcccggccgggcccagcgtcgtcaaggtgaccggcagccagggcaactggaagctcaccgtcgacgggcagccgtaccagatcaagggcctgacctacggcccgccggcccgggccgccgacggctacctgcgcgacctgaagaacatgggcgtcaacaccatccggatctggggcgtcgacgacaccgataccccgatcctgctgaacgccgcggcccggcagggcatccacgtgatcgtcggggagtggctcaaccagggcgccgactacgtcaacgacaccgcgtacatgaactcggtgaagacctcgatcgtcaaccaggtcaacgcgctcaagggcaacccgggcacgctgatgtgggacgtcggcaacgaggtcatcctcaccatgcaggaccacgggctgtccgcggccgacgtcgaggcgcggcgcgtcggttacgccaagttcgtcgaccagctcgccgacgcgatccacgcggccgacccgaaccacccggttacctcgaccgacgcgtacaccggggcgtggccgtactaccggcagtacgcgccccacctcgacctgctcgcggtcaactcgtacggtgcgatcggcaacgtctacgacgactgggtggccggcggctacaccaagccgtacgtggtcaccgagggcggcccggccggcgaatgggaggtgccgggcgacgccaacggggtgccgaccgagccgagcgacctgcagaaacgcgacggctacacggccagctggaacgcgatcaccgcgcatccgggggtggcgctcggcgcgaccgagttccactacggcctggagaacgacttcggcggcgtctggctgaacaccttcaccggagggtggcggcggctcggatacggggcgctggccaaggcgtacaccggcagggccctggcgaacaccgcgccggagatcaccgcgatgaccgtgtcgaacccggcggcggtaccggccggcggcacctacacgatcacgaccagcacgacggatccgaacggcgacctgatccgctacaacctgatgtactccgacaagtacatcagcggtggcaccggcctgaccaacgtcagtttcaccgacaacggcaacggatcgttcaccgtcaaggcgcccgagacactcggcgtctggaaggtctacgtgtacgccttcgacgggcagggcaacgtcggcatcgaaacccggtcgatcagggtggtgccgcccaccgtgaccggcaccaacctggccaagggcaggcccgccaccgcctccgggtaccagccgaccggcattaacggaccccagctgccgtcgtacgcggtcgacggcgactacggcacccgctgggccagcgaatgggtggacaccgcctggctgcaggtcgacctcggctcggtgcagtcgttcgaccacgtgaacctggcgtgggaggcggcgtacgccacggcgtaccagatccagacgtcgaacgacggcaccacctggaccacggcctacgcgaccaccaccggcgacggcggcttcgacaacctggcgatcaacggctccggccgctacgtccggatcaccaacacggcgcgggccacggcgtacggctactcgctctacgaattcggcgtctaccggcagtag

SEQ ID NO: 6240 - DNA, 477 bp, Actinoplanes utahensis
gtgcccgcgtgcggtacgcatagtgccgtgcacaccgtggaactgctgctcgatgcgggacgggaagacgacgtacgccggcagtgggagctcttgcgggacgccggcctgcccagcctcgccgatcatcggcaccccaccaaccggccgcatctgaccctggtcaacgccgcgtcgctggctgggttgcccgacctggacctgccggtggccgccgcgctcggtccggtgcggatgctcgggagggcgctggtctgggcggtgacgccgaccgaggagttgagggaactgcatttccgggtgtggtcggcgctgccgcaggcgtggccgccgccggaccggtggattccgcacgtcagcctggcactccggtttcccgcggcggcggccgccacgatcactccggcggacgtgcgcggagagttcgtggcggcgcgcagctacgacaccgcaacgcggtcggtgaccggcctctag

SEQ ID NO: 6241 - DNA, 474 bp, Actinoplanes utahensis
atggcggcggcccggcagccggtgagccactgccggggcgggcggtcacccgggcgggtggtggaaagcgcggcgatcggagatcgtgaaggcatgagtctgctgcgaactctcggacaggtcggcctcggcgcggtgctcctcaccgcgggcgccgggcatctcaccacgaaacggcaggagttccaggcgcaggtaccgtcctggttcccggtcgacccggaccgggtggtggtggtgtccggggtggccgagctggcgctggggacggcgctgctggtcacctggcgtcagccggcccggcggcggctgggcaacgtggccgccgcgttcttcgccggggtgtttccgggcaacatcgcccagttcgtcgagcgcaaggacagcttcggcctggacaccgaccgcaagcgggcggtgcgcctgctcggtcagccggcgctgatcgcctgggcccgcgccagcacccggtga

SEQ ID NO: 6242 - DNA, 732 bp, Actinoplanes utahensis
atggcgggggtgcgggtgggattgtgcggggcgagtatggcgctggcctcctatgcgcagcgtttcccggtgctggaggtgcagcagaccttctacgagccgccccgcgagagcaccctgcggcggtggcgggacaccgtgccgggggagttcgagttcgtcgtcaaagcgtggcagctgatcacgcacgaggcccggagtgcgacctatcggcggttgcgcaccccgctgagcgaggcggaacgggccgaggtcggcgggttccggtggacaccggtggtggcgcgggcctgggacaccacggtccggtgcgcgtcgctgctgcgggccggcgcgatcctgctgcagtgcccggccagtttccggccgaccgagcccgccgtgacccggttgcgggaattcctcgcccgggccccgcggccggacggggtgcgactgctgtgggagccgcgcgggccgtggccggacgacctggtccgggacatctgtgcggccggcgatctgacgcacgccgccgacccgttcctgcggccgagtctgacgccgacggcctattaccggctgcacggcgtgaccggcgcccgccacgtccacaccgatgacgagctggcgcggctggccgccatggtggacggcgggccggcgtacgtgatgttcaacaacctggcgcgggccgacgacgctcggcggttccgccggctggtggccggcgacgcgcagcacaccggatga

SEQ ID NO: 6243 - DNA, 609 bp, Actinoplanes utahensis
atggcgacatcaggacagcggcgcggcgccgacaccaaagcggagatccgcagggtggccatcgagctgttcaccgaacgcggctacgaggcgaccagcctgcgggagatcgccgaacggctggacatcaccaaggcggcgctgtactaccacttcagcagcaaggagagcatcgtcctgtcgatcttccaggcgcacctggacgcgctcgacgagctcgtcgactgggcccgtgagcagccacccgggccggagctgcgcgcccaggtcgtcgaccggatggtcgagctcggcgtcggcagcggcatggccgccatgaagttcgcgatggccaaccagcacgtcgtccgcgacctgcaccagcagcaggggcgggagaacgcgttcggcaagatgaccgaactcttcgacatcgtgaccggcccggacgccaccgtcgaggagacgctacgggtccgctcggcgctgctcagcgtcaacatcgtgctgatggcctcgcgcggcctgccggtcaccgacaccgaactcgcggcggtcgcccgcaacatcgcccacagcctgatcgcccccggcccggaccggcccggcgcggtacgcgacgacgactag

SEQ ID NO: 6244 - DNA, 1533 bp, Actinoplanes utahensis
gtgaccccacccacccggttcacccatcgagagatcatggtgaccatgagcggcctcgtgatcgcgatgctgctcgccatgctcgacaacatgatcgtggcgcccgccctgccgaccatcgtcggcgagctgcacggcctcaaccacctggcctgggtgaccaccggctacatcctggcctccacggtcgccaccccgatctggggcaagctcggtgacctgctcggccgccggatcaccttcctcagctcgatcgcgatcttcctgctcggctcggcgctgtgcggcatgtcgcagaacatgggcgagctggtcggcttccgggcgctgcagggtctcggcgccggcggcctgatggtcggcgtcatggcggtgctggccgacatcatcccgccccgcgagcgtggcaagtaccagggcgtgatgatggccgtcatgccggtcgcgatgatcggcggcccgctggtcggcggcttcatcaccgaccacctcaactggcgctgggcgttctacgtcaacctgccgctgggcgtcgtggcgctgggtgtctgctggttcgtgttggccaagcttccgcgcggcgcgggtgcggtgcgcatcgactggctcggcgcggccctgctcagcgtctggatcaccgcgctggtgctgatcaccacctggggtggcagccagtacgcctgggcctccgcgcagattctcggcctgctcgcgctcgcggtggtcgccttcgtcgcgttcgtcgtcgtcgagcgccgctccgccgagccgatcatgccgctgtccgtcttcgccaaccgcaacttcgcgctggccggcgcgctcagcctgatcgtcggcttcgccatgttcggcggcatcaccctgctcccgcagttccagcagtacgtgcagggttcctcggccaccaacagcggcctgctgctgatgccgatgatgctgtccgccatggtcgtctcgctggtcggcggtcagctgatcacccgcaccggccactaccgtgcgctgccgatcctgggcaccgtgttgatgaccgccggcctcgccctgttcgccaccatggacatcggcacctcgcggttcaccaccggcctgttcatggcggtcctcggcgccggcatgggctgcctgatgcagaccaccatgctgatcgcgcagaacagcgccccgatccaggcgatcggcgcggcgaccggcgcggccaccttcctgcgcaacatgggcggctcgctcggcgtctcgctgctgagcacgctctacaccaaccacctgatccacgcgctgggcggcggcgtgccgaccggttcggccgccgggatgaccccggccatgctgcgggccctgccggacaacgtgcggcacctgttcgcccaggcggtcaccgacggcatcggcgccgcgttcacctggggcgcggtcgcggccgcggccggcatcgtggtggcgctgttcatccgccacgtgccgctgcgcggcttcgccgacgcaccgaaggccccggagcaggccgccgaggagctgcaggcggtctag

SEQ ID NO: 6245 - DNA, 1059 bp, Actinoplanes utahensis
gtgagcgagctgctggacatccgccggatctatgtcgagccggccgccgccgaactgccccgcggcaaggagattctggcccggtttcccggggcgcagctggtcgaggtggagtcgcaccaccggattccggagctctacggggatgagacgaacgtcaaccggtgggtgcggatcaaacgggaagcgctggtgctcggggtcaagaagacgctggccgcccggccgaacgggcgcagcgccgatttcatcgccccgtccaccgccaacgggtgtgcgatggcctgcgcctactgttacgtgccgcggcacaagggctacagcaatccgatcacggtcttcgccaacatcgacaagatcaccgggtacgtggcgcggcacgcgaagcgccagggcgtcaagagcgcgccgaacgaatgtgatccggtcgcctgggtctacgacatcggggagaattcggattgcagcgtcgacgcgcggatcagtgacaacgtgcgggatctggtcgagttgttccgctggctgccgaccgcgaaggcgtcgttcgccaccaagcacgtcaaccgggacctgctcggctgggatccccagggccggacccggatcagattctccctgatgcccgcgaaggatgcgaaggtgctggacatccgcacctcgccggtggccgagcggatcgcggcgatcgacgatttcgtggcggccggctatgaggtgcacgtcaatttcagcccggtcgtcgtccgcgacggatggctgcaggattgggcggaactgctcgatcagctcgatgccggaatcggcgatgcggccaaacggcagctggcagccgaggtcattttcctgacccacaatcgggaactgcacgaggtgaacctgggctggcatccgaaagccgaggagctgatctggcggccggagctgcagcagccgaaacggtcgcagaacgggtcgtggaacgtgcggtaccggaccggggagaaaggaagatacgtggctgagctggtcgatctgatcggtgcgcgcacgccctactgccgggtccgctacgcgttctga

SEQ ID NO: 6246 - DNA, 999 bp, Actinoplanes utahensis
atgaccgggaagccgcgtcgcgcctacggtttcgaggtgacccgccgactcgtgctactgatcatcggggcagccgccgtggtgctggtgccgtggagcgtctatctcgccgacaccctgccggaccggtatgcgaccggccagtggcgggcgacatgggtgggtttcgacctcgccctggccgcctgcctggcgatcagcctgcggctcgggctgcgccggcgtccggccgcggttccggtgctgtccgccaccgcggcgctgctgttctgcgacgcctggttcgacatctcgctcgactgggcgtcgtccgacctggccgtcagcgtggtgctggcgctgctggtcgaggtcccgttcgggattctgctactggtctgggcccggcggctgatcagcggcggcatgcgccacacccagctcacgatgcgccacctgcgggcccgggaggatccggaattcgaccggacgatggtcgcgctggaccgtctcggcccggccgactgccgcaccatcgccgccgcggtcggggtcagcgaggcgcaggtggggctgcaactgcgcgaggccgagcagctgaacctggtcgaccggcggcgggacggccggtggctgctgcccgcccatcagaacctgcggctgccgtccctggaggccgcccgggacggcgaggaccgcgagcggttgctgcggttcctcgacgccaagtaccgcagcgagctggagttgctggcctgggcggtcgagcaccacgccgagttcggccggtggggccacggcgagcgcgccgtcacccatctcagcggcccggagctcgccgctttcatccgcgagtatcaggagctcagcaaccggtactgtctgctgcgctcggcgccgggcccggacacgcgggaggtcgcgatccggtggtacgccttcccgaagccggctgatcagcccgccctcgtgtccgttccgcacacgtccggggccacaccgctctccctctcgcgatga

SEQ ID NO: 6247 - DNA, 576 bp, Actinoplanes utahensis
atgtggcggcggcgccggttccgggatcatgtcggtgtgcccgcattgatcgcgcccaccgggcgtgtacgtcagtcgttcctcgccgccatggccgagttccgcgccgaggggcgcgccggccccggcgaccagtccatgatcggccgggagtggcgcgagttcggcgaccggtggcccaccccggagggcttcgccgcctatgtggaccggctgctgtccgagccggtggaggacaccccgcgacccgaggggttcgtgccctccaccaccctgtggtgggtcgacggcgacgagtacctgggccggctggcgatccggcatcgcctcaccccgcagctgctcgacttcggcggtcacatcggctacgacgtgcgaccttccgcccggcgccgcggccacgcgaccgccatgctgcgcgccgccctcccgctggcacgcgcgctcggcatcagctccgccctggtcacctgcgacgtcaccaatgtcggctcccgcagggtcatcgaagccaacggcggcgtcttcgaggatcagcgcgccgagaagctgcgcttctgggtgcccaccacctga

SEQ ID NO: 6248 - DNA, 1494 bp, Actinoplanes utahensis
atgccggtaccggccagctccttggcgtactgcagggtgaccgcgttcaggaacgacttcgacggcgagtacgccgcgctgatcggcccggtctcggcgcccggcgtggactgccgggtcagcgaaccgacgctgctggacacgttcacgatccgcggcgccggcgaccggcgcagcagcggcagcatcgcgttggtcacccggaccaccccgatcacgttggtctccacgaccgtgcggatcacggcgggatcgacgaccgtcggctcctgcggccgcccaccggtcaccccggcgttgttgacgagtacgtcgagacggccgaaccgccgctcgacgagttccgccgcggccaccacgctgccctcgtcggtcacgtccagcggcacgccgaccgcgtccaccccggccgcccgcagcttcgccaccgcctcctcgcgccgcccggcatcccgcgcacccaccgcgacggtgtgcccgagctcgcccaggccggccgcgatctcgtacccgatccccttgttcgcgccggtgaccagcgcgaccctcgtttcgctcatgacccgatcctgtccgcgccggcggccggggcccaataccgatcgggtggcggggtcataccctgtggtcatggagacgcgggagctacggtatttcgtcgcggtcgccgaggaactccacttcggccgggccgcccagcgcctcggcatcgcccagccaccgctgtcccgcgcgatcagccggctggaacgccggctcggcgtcaccctgctcgaccgcgaccaccgcggcgccgccctcaccgaggccggcgcggtgctgctccgcgaggcccgggtggcgctggacgcggtcgaggccgccgaacgccgcacccgccgggccgccgccggacgccccggactggtcctggtcaccaaggccggagccaccaccgagctgctggcgaaactcctcgacgcatacgccgcggaacccggcgcggtgcccgtcgaagtagccctgtgcggcatcgccgaacaggaacgcgtcctgcgcgccggccgcgccgacgtcgccctgctccacctgccgttcgactccaccgcgggcctcgacaccgaagagctcggcaccgagaaccagatcgcggtcctgcccgccggccaccccctgaccacccgcccgcacctgcgcatggccgagctccgcaacctgcccggcctgcccctgccccgctggccacgcccggacggcacctacccggacggtcccggcccggagatccgcgaccacgcccagctgctgcagctggtcgccctcggccgcctctgcacggtcctgcccgagtccgcccgcccccacctgcgcgagggcctggccaccatcccggtcctggacgcacccccggtgaccacggtgatcgcctggccgccacacagccgctcccggccactggccaccctgatccacaccgcgacccgcctgcaccaggcaacgatcaccgggccgtga

SEQ ID NO: 6249 - DNA, 651 bp, Actinoplanes utahensis
atggttgctgcggtctcttccaccgtcgagctgcccgccgtcggcacgccgatgtttctcgtcctcggtgaggggatgaacttccggtcgcgcctcgaggcggtggacggtgaccgtttcacggtcgccgcgccgttggagaccgccggcccggtcgtgatctcggccggtcagcagttcgacgtcttctgggcgccgccgagcacccggatcgtgctcccggcccggctggtcgcggtctccgacgaggcgccgttccggtggagtctcaccgcggcggggctcccgcagcacagcaaccgccgcgagttcgtccgcggtggtggtggcgccgccgtccggttgaccaccgacgacggtgagatcgagggcgccctgctggacatcagcgagggcgggctgcgctgctggatcgacgagccggcggcgctggccgcgggcgggcggatggcggccgccgtcacgctcggcgccgcgggcacgatcgaggtgagcggcacgatcctgtcggtccgcgaggccccgtacggcgatccgggccggcatgtggtgctgacgttcgacccgcgggaaagcgcggcccgggcgatccgccgctacgtgatggagtgggagatcaacgagcgccgtctccaccgggacgccgcctga

SEQ ID NO: 6250 - DNA, 1227 bp, Actinoplanes utahensis
atgtcgcatccggtgcagttgctcggttccgcggtgtcccggtggggcgctgatccgtgggcgctcggctcgtggagcctgatcggccggcacggcggcccgcgggaccgggtcgcgctcggcacgccgatcggcggccgggtgcggatcgcgggggaggccacccacgcgacgcgcgccgggatgacccatggcgcgtacgagcagggccttgccgcggccgcctgggccgcggatcgggggcatgcccgcgtcgcggtggtcggcgccgggatggccggcctggccgcggcccgcgcgctcaccgatggtggcgtcgaggtgacgatctgggaggcgcgggaccggatcggcggccggacagccggggtcgacgtcgccgggggcgccttcgatctgggcgccaactggctgcagcagtacgacgagaacgtcctcgcgcggatcgccgaggacctcggtctcaccatgatcgtgaccgatttcaacgatccgctggtgctgcgcggcgagccgttccccgacggcctcgaggacgatctgcgccggcgtctggcctcggccgcgccggacgcgggcatcgccgacgtgctcgacgcctggctgcgcgatccggccccgtggaccgccgcggagatccatcgtttcgtcgccgccgagatcgtcatggacgccggcgccccgctgtcctggctgagcgcccggcacggcttcgagccgggcgtcggtgagggcgaccgctggatcgccggcggttaccgtctgctcgttcgacacctggcgaccggaatcgacgtacgtcttcggcacccggcccgccacctcctgaccctgccggacggcgtggtcctgaccggtgacgccggcaccctgcgcgccgacgcggccatcgtgacggccccggtgccggtcctggccgccggcgccatcaccttcgacccgccgctgccggagccgcaccgcaccgccctgtcgcggctgggcgccggccgggtggagaaggtgatcctgcggttcgaccggcggttctggccggagcacggctactaccgggtgcacggtccctccgagctctgcatcagcgagtggctggacgccagcgccgccgacggcgtcccgaccctggtcggcctgttcgccggcccgtggctggacgacctgtggaccggcaccgaccgggaggtcgccgcccgcgccgccgaggtgttccgcgccgcggtcgggtag

SEQ ID NO: 6251 - DNA, 423 bp, Actinoplanes utahensis
atgacctcgacccgttggaccgcgggctgcctgacggtcgccgccgtcctcggcctgctcgccgccggcgtcttcctggtcgacgaccaccagcgcggccggatcgtcgaccagggccatcaggtgcgggccgtggtcaccgccgaccacgaggacgagttcgaccactggtacaccgtcgactacccggtacagggcaccacccgcagcgccgacctgcggtatccgtgggtgatcgacaccttcccggtcggctcggagctcaccgtctacgtcgacgcggaccgtccggagcggatcgccaccgcggacggctactccacgccggtgtgggcctccgccccgggcttcctcgccgtgctggcggtcgccgcggcgttcgcctcgaccgcgggcttcgtcagcaaccggaggagctcctga

SEQ ID NO: 6252 - DNA, 1203 bp, Actinoplanes utahensis
atggtcttcgaggtggcggcgttccgtgagcacttcccggccctgcggcacggtctggcgttcttcgacggcccgggcggcacgcagacgccggccgtggtcgccgaggcgatcgccgcgacgatgaccgcgccgctgtcgatccgggggacggtcggcattccggacggcaacgccgagcgggccgtccgggagttccgcgccgcctatgccgacctgctccacgtgccgccggccggcatcgtgcacgggcgcagcgccacccagctcacctacgacttctcccggcatctggccaagacgtggcgggccggcgacgagatcgtgctgagccgcctggagcacgacagcaacgtccgcccgtggatccaggccgccgaccgggccggtgtgacggtccgctggatcgagctggacccggccgccgcgaccctggacctggactcctaccggcgggcgctgtccccgcgcacccggctggtcgcggtcgccggcgcctccaacgtgctgggcgccaaaccgccgctgcggcacctcgccgacctggcccacacggtcggcgcgctggtctacgtcgacggcgtgcacctggtcccgcacgacctggtcgacgtcccggcgctcggcgcggacttcttcgtctgctcgccgtacaagttcttcggcccgcactgcggcgtgctcgccgcccagccggcgctgctggagacgctgcggccggacaagatcctgccgtcctcggacgaggtgccggagcgtttcgagttcggctccctgccgtacgagatgctggccggcgccaccgccgcggtcgacttcatcgccgcgatcgcccccgggcccggatcgagccgccgtgagcggctggcgcactcgatggccgccgtgcacgagcacgagctggccctgcgcgcccggctggaggcgggtttggccgcgctgggcgacgcggtcacggtgcattccacggccgccgaccgcaccccgaccaccctgatgacgctgaccggccgtgatgcccgcgcggcgcaggtccacctcgcggctgtgggggtgctggctccggcggggtccttctacgcgtacgaacccttcaccgccctgaagatcaccgacccggcgctgcgcgtcggcctcgccccgtacaacaccgcggccgaggtcgaccgcttcctgaccgccctgaccgacttcctgtcgtga

SEQ ID NO: 6253 - DNA, 1959 bp, Actinoplanes utahensis
gtgcacagcattcggacaaggctggtcaccagcgtcctggtgaccgtgctgatcgccgtggcctcgctggtgaccatcgcggtggtgatgacgcgctccctggcgttgcgtcaggccggtgactacaccgagcagctggcgatgcgacagtccgcggcggtcagccgggtgatcgacgtggcggtgcacgccaccgaggagctggccggcacgctggcgcggctcaaggagtccggggtcaccgaccgccgggtggtgaccgatctggtgggcgcggcattgcgtcggcatccggatttcttcggcatgtcgaccgggtgggagccgaacgcgttcgacggccgggaccgtgacttccgcaaggtcgcgcccagcgacgccaccggccggctgatcccgtactggtaccgcgacggggaccggctgcggaccgacccgctcgtcgactacgacaagccgggcgccggggactggtatctccagccgaaggcgaacagcaagagcctggtcgtcgacccgtacgtgtaccaggtcaacggcaaggacgtcctgatgaccaccgcgaccgccccgatcctgtccggcggccgtttcctcggcgtggtgacggccgacctggcactggccgacctgcgcaccgcggtgaccgccgagaagccgtacggcaccgggtatcaggcgctgctgaccgcgggtggtgccgtcgtcgcgcacccgctggcggacctgctcggcaaaccgctgtccgaggtgagcgcgcaggtcggcgccgcggtcagtggccagcggccggtgcgctggagcggccaggacccctatctgaagtccgcggcgacggctgtggtggcgccggtgccgctggcgacgggtgactcctgggcgctgctcgtcgcggtgccacacagcacgatcaccgccgccgccgacgacatgcgccgcaacctgctgctggcggcggggctggccttcctggcggccggcgcggtggcctgggcgatcggtaccggcctggcccggccgatccaccggctgcgcgaccggctcgtcgagatcgcggccggcgacagcgacctcacccagcgggtcgaccaggatcggcgggacgagatcggtgagctgggcgcggcgttcaaccggttcaccgccaagatcgcggacgtggtgcggcgcatcggggagaaggccgagggtgtctccgccgcggccgacgcgctgaccggggtcagtgagcggatgcgcggcaccgccgacgacagcgccggacgggcggcgcaggtctcggacaccgccgaccaggtctccgggaacatccagacgatcgcggccggctccgaggagatgaacgcggcgatccgggagatctcggccagcaccatggaggcggcgcaggtcagcctgcgggccgcggaggcggcgcaggccagcacggccagcgtcaccaagctgggtgagtcgtcgaccgagatcgggcaggtggtccggctgatcacggccatcgccgagcagaccaacctgctcgccctcaacgccaccatcgaggcggcccgggccggcgagaccggcaagggtttcgcggtggtggcgggtgaggtcaagcaactggcccaggacaccggccgggccaccggggacatcaccagccgggtggagacgatccagtcggacgcgctcgcggcggccgacgcgatccgggagatcgccgaggtggtggaccgcatccacgagttgcagagcaccatcgccagcgcggtggaacagcagacggccaccacgcacgagatgacccggaacgtcgccgaggccgccggcggctccgcggccatcgccggcacgatcggcgcggtggcggacgcggtccacgagaccaacgtcggcagccaggccaccggccgggccgcccaggaactggccgaactcgccggcgagctgcggtcgctggtcggccagttccgggtctga

SEQ ID NO: 6254 - DNA, 630 bp, Actinoplanes utahensis
gtggtggtgagcgagacgggcctgcggcagcgcaagaagcagcgcaccttcgacacggtctccgagatcgccatcggcatgttcctcgaacacggcttcgaccgggtgtcggtgaccgacatcgccgcggccgcggagatctccaagccgaccctgttccgttacttcgcgtcgaaggaggacctggtcctgcaccggttcgccgaccacgccggcgaaccggcccggaccgtgagttcccgcccggccgggcgctccccgctcgatgcgctgcaccggcggttcctcgacgggctggccacccgcgacccggtcaccggactcaacgacgtgccgcaggtgctcgccttccacgacctggtcttctccacacccagcctggccaccagggtctacgactatcagctgcgcgacgagcggagcctggccgagagcctggcgacggcgacgccggacccgctgacggcgcggctggcggcggcccagatcctggcggtccagcgggtcctggcccgggagaactggcggcgcctgaccgccggcgccaccgccgacgacctctacccggcggcggtcgaggcggccaaccgcgccttcgaccagctccgctccggcctcccgctccgctga

SEQ ID NO: 6255 - DNA, 63 bp, Actinoplanes utahensis
gtggtgctcacccgcgcggtctcccggatggacgtgctgcacacgggtgacctgccggtctga

SEQ ID NO: 6256 - DNA, 567 bp, Actinoplanes utahensis
atgcgcctgacatacgccctcgtcccgattctgatcatgtcgctggccgcctgcggcgacaagaaggtcgccgcgccggccgcgaccccggtcacgaccacgaccacgacgaccgcgaccgccgagtcgggggtcgcccccgcctcggccaagccggtggcggctccgaagagcccggccgtggtgaaggcgaagccggccggctcgtccaatccggccttcggcatccagtacgcgctgctcaagtcgagcaagccggccacccggcagatcacctacgacctgatcgagtggtacgagggcaaggaggccaccaaggcctgcgccgaggacggggtcaaggacaccgacgacgaccagtgcaccggctggtacatccggaacaacaacacgaagctgcgcaccctcaccgtcgacccggacgccaccatcaagctgaccgtcgagggcacgctgaagtccgtcgacctgaagacgttcctggccggcacccacccggacaccgtcatcaagttcaccatcgacgcgaaccggatcgtgtcgctggcggagatcttcctgccctga

SEQ ID NO: 6257 - DNA, 1152 bp, Actinoplanes utahensis
gtgtggcgctaccacccggccctcgacggcctccgcgcgctcgccgtcaccgcggtcctgctgttccacgccggagtccccggcgtgggcggcgggttcctcggcgtcgacgcgttcttcgtcctgtccggcttcctgatcacttcgctgctgctcgacgagcaccggcgcaccggccggatcgacctcggacggttctggcggcaccgggtccggcggctgctgcccgccctgctggcgatgctcgccgcgaccgtcgtggccggacggtacctgctcgacccggacgcgctcggactgctgcgcaccgacgcctgggccgcgctcggctacgccgcgaactggcggatgatcttccgcggcaccgggtacgtggcggtcacggccaccccgtcgccgctgcagcacacctggtcgctggcgatcgaggaacagttctatctgctgtggccgctgctggtcgccggggtgctggtcgggctcgccacccgcaccgcccgccggttgctgctcgccggctgcgccgccggcatcatcgtctccgccctgctctgcgcggcactgttccagccggcggcgccgggccgtgcctatttcggcaccgacacccgggcccaggctctgctgatcggcgcggcatccgctgtgctgctggcccgctccgggcgtgcccggtacgtgggtggcccggtgcccgtcctggccggcgtcgccgccaccgcggggctctggcacctggcgtccgaacaggcccgctggatgtatcacggcggcctgaccgccgccgcgctcgccgccgccctggtcgtcaccggtgtggtcggcgaccccggatccgggccggcccggctgctcgccctgccgccgctggtctggctgggccggatctcctacggcgtctacctgtggcactggccgctgttcaccttcgccaccacggagaccaccggcctgtcccgctggccgctgctggccgtccgtctcgccggcgccctggccctggcggtcgtcagctatcacctgatcgagctgccggtgcgacgcggtctgctggcccgcaccctgccgcgtcacggcccggccgccgtcaccgcggccgccgccgcggcggtcctgctcaccatcggcctcagcacgctgctagctagctag

SEQ ID NO: 6258 - DNA, 789 bp, Actinoplanes utahensis
gtgatcccgccgatcccggccgcgccggcacaccgcaccaccggccggctcccggcgcccacccgcgaaccccgggtcaccttcctcggcgactcggtgtcctggacgatcggcacctacctgcccccgcaccccggcatgtggaccagcgtgcgcgccatccagggctgcggcatcgccaccctgcccgacatcctgcagcagggcaccccgcacaccaactatccgggctgcaccgagtggccgcggcgctggcggcaggcggtgatcaaggacagcccggacgtgtcggtgatcctgctcaaccgctgggagctgatggaccgccgctaccagggcggctatcagcacgtcgggcagcccggctacgacggctacctgaccgaccggctggacctcgcgatccaggccgccgccacccgcggtgccgcggtcgccctgctcaccgccgcgtacacgcaccgcgccgaacgcagcgacggcagcctctacggcgaggaccggccggaccgggtcgacgcctggaacagcctgctgcgccgggtcgcggcccggcacccgggccgggtcaccgtcctcgacctcaacgcggtggtgtgcccggacgggcgatacaccgccacggtccacgggctgcgggtgcgcagcgacggcctgcacttcaccccggccggtgtgcagcaggtcatcgccccgtggctgctgccccggctcgccgccctcgccgtcggcggtgatcgcgggccggcgggtttacccgggtcccgaccgggaaggcagcgctcatga

SEQ ID NO: 6259 - DNA, 204 bp, Actinoplanes utahensis
atgagtaccgaacagcaagccgcgggccggcatcccaccgacgagccggacggcacgcccgcctacgcggcctccctgcgccgtcccggcgaatcggttgccggggcgcccgccgaggagcccgagcccgacgaggcaccgaccggcgccggctacgacgagaacgcggtgtccggcgacagcaccgcctaccgccccgactga

SEQ ID NO: 6260 - DNA, 174 bp, Actinoplanes utahensis
atgaatgatgtcgatcccgagcagtacgacgaggacacccccgggcaggagcgcgtcccgaagcgggacgcgcaggaggcgcacggcggcagcatggcgcccgggctggtcgacgacaccggtcaccgcacggccgagccgttgcccggcgccccggtcgaggagccgcgatga

SEQ ID NO: 6261 - DNA, 234 bp, Actinoplanes utahensis
atgagcaacgcaccggaccggaacgaccccgaccgcgcccgcggcctgatcagtgacgcccagggcgagttcgtccaggagcaccccggcggcgcgttcgacccccgcgcgttccgctccggccaccccgccccgccggccgagccgccggccgcatcgcatccggcgggcgagccgccgatgcgcgggaaccggatggcgccacccggcgaagagtccgccaaggcggaatag

SEQ ID NO: 6262 - DNA, 105 bp, Actinoplanes utahensis
atggctgacgtggtcggcggcgaagccctgacacccgacccgatgtctcgcgacggcgacgcgtgggcgcccggcctgtcgctgacctgcacccgcatcgcctga

SEQ ID NO: 6263 - DNA, 2478 bp, Actinoplanes utahensis
atgccttccgcaccccgccggcggcattccggcccctgctcgcggtgctccgggccggaacgcagaaccgaaacggaggccgatgtgacaaccagccctcctgtccaccccgcaggctccccaggaggccggccgttacggctcaagatgctcatcggcggtgtcgtcgcggtcgtcgcggtggcgggttcggtggtggtcagcgccggcgcgagtgcggcggcgagcaccctcggcgccgcggccgcccagtcgggccgctacttcggcaccgccctcgcggcggggcggctcggcgatgcgacgtacaccggcatcgcgggacgcgaattcaccatggtgacccccgagaacgagatgaagccggacgcgacggaaccgcagcgcggccagttcactttcagcgccggcgaccagatctacaactgggcgacccagcacggcatgaaggtccgcggccacaccctggcctggcacggccagcaacccggatggatgcagagcctcagcggcagctcgctgcgtcaggccatgatcgaccacatcaacggcgtgatggcgcactacaagggcaagctggccgcctgggacgtggtcaacgaggcgtacaacgaggatggcagccgccggcagtcgaatctgcagggcaccggcaacgactggatcgaggtggcgttccgcacggcgcgggccgccgatccgtcggtcaagctctgctacaacgactacaacatcgagaacgcgacgtacgccaagaccctggccgtgctcaccatggtcaaggacttcaagtcgcgcggcgtgccgatcgactgcgtcgggctgcagacccacttcaccggcggcagtgcgctgcccggcaactttcagaccacgctcaccaacttcgccaacgccggcgtggacgtcgcgctgaccgaggccgacgtcaccaacgcgtccacctcgcagtacgccgggctcacccaggcttgcgtcaacgtgccgcgctgcctgggcgtcaccgtgtggggtgtgcgggacagcgactcgtggcggtcgagtgagaacccgctgctgttcgacggttcgggcaccaagaaggccgcctacacctcggtcctcgacgcgctcaacgccgccggccccaccccgagcggcagctccaccccgccgagcgggacgggagagatccggggaacccagtcggggcggtgcatcgacgtaccgaaccggtcgcagaccgacggcacccgcgtgacgctctacgactgcaaccgcggcaccaaccagcagtggacgtacacgtcgaacaggcagctgacggtgtacggcaccaagtgcctggacgccgccggctccggcaactccgcggcgatccagatctacagctgcaacgggcaggccaaccagcagtggaacgtcaacgccaacgggaccatcaccggcgtgcagtccggccgctgcctggacgtctggggcaccgccaacggccagcaggtccagctgtacgactgcaacggccaggccaaccagcaattcacctactccgcccccggcaccagctcgccgacgccgtcgccgagcggcagcacctgcacgctgccgtcgtcgtaccgctggagctcgacgggtgcgctcgcgcagccgaagaacggctggacctcgctgaaggacttcaccaacgtcgtctacaacggcaagcacctggtgtacgcgtccaacgtgtccaacgggtcgtacggctcgatgaatttcaccccgttcaccaactggtcggacatggcctcggccgggcagaacgggatgagccagggcaccgtggcgcccaccctcttctacttcgcgccgaagaacatctgggtgctggcctaccagtgggggccgacgtcgttcagctacaagacctccaccgacccgaccaatgccaacggctggtccagcgcgcagaccctgttcaccggaacgctgcccgacgcgccgtacggggtgatcgaccagacgctgatcggtgacgaccagaacatgtacctgttcttcgccggggacaacggcaagatctaccgggcgagcatgccgatcggcaacttcccgggcagcttcggctcctcgtacaccacggtcatgagcgactcgaccaacaacctgttcgaagcggtcgaggtctacaaggtccagggacagaaccagtacctgatgatcgtcgaggcgatcggcagtcagggccgctacttccggtcgttcaccgcgagcagcctcggcggctcctggaccccgcaggccgccagcgagagcaacccgttcgccggcacggccaacagcggcgccacctggaccaacgacatcagccacggggacctggtccgggagaatccggaccagaccaagaccgtcgacccgtgccacctgcaattgctctatcagggcaaggaccccaacgccggcggcgactacaacaacctgccgtggcgtccgggcctgctcaccctgcagcgctga

SEQ ID NO: 6264 - DNA, 993 bp, Actinoplanes utahensis
gtgcccgtccagactcgacgcatggacgatctggtggccggcaccccggcattgacgcgactgcgctggttgcttgagggactcgacggacggtggcccgtcgacgtcgacgtcgacggcgccttggaccccggattcgcggcggggatcggcggcgcctcagcactgcgggacatcaccggcagccgggcggccgggctcgccccgatccgcgtcgtcggcgtcgacgctgacgggacagcggccacggcccgattccgcacccgcgacgacgacctgtgggtgtcgcacgtcgaggtcggggccgaggtgccacatcggatcacgctgacccatacgcagcgctgggtgccggactatctcacgcccggcctgccggcggacttcaccggcgtgccgatgacatccaggtccggcgcggcgctgatcgtgttcggtggggtgcccggcagcggaaagagcacggtcgccgaccgtgtcggggcggcgttggacgtgccggtgttcgcgctggactggctgatgggtgcactgagcccgttcgggatgcggcaccgcaccgacctcatgagcatcggtgcggaactgctgacgacgctggcctatcgggagctgtccgccggacgctcggcgatcctcgacacgacgagcgaggagccgggggtacgggcccgctgggcgagtctcgcgtcagcggccggcgccgcgttcatcccggtggtctgcgcctgcagcgtggagtctttgcaccgggagcgggtggagacccgggtgcgcggcattcccggctgggctgacgccggcgactggccggacgcgaaggcccggctcgcggcgttcccgccctggccggacgccctgctcgtcgacacggcccgaccgttggaggcctgtgtcgcgacagtgctcggccacatcgatcaccggcgggacgccgatgcgagccggggtcgagcaggctcggtgtcgactttccgtgacaaacggatataa

SEQ ID NO: 6265 - DNA, 543 bp, Actinoplanes utahensis
gtgctggtcggcgtggtcggcgtcgcggcgacagtctttttcggcattcaggcccacggcgactcgaccggcggcagcacacacgccggcccctcggcgactccgccgtcgaagccttcaccggaacacgtcatttatgtcgccgaggtcaaccagtggtgccgggatgcgcaggcacagctcgacagggccggggaagcgccggataacggcatcgccgcccaggttcgatggacaacggcagcggagaacacgttgaaggcactctattccaaatgggctccagctccatatcccgaggaggatgaggagcacatcaaggctatgatgaattcattgaaccgcatacaggtcgatgtcaaccttctcttgaccctattggagcagcagggtcaggccaaaacgcaagccgtctccgatggccttcagaaccaagtgaatgccacaatcgcaaaggtcagtgacgactataacgacatcgacgatgcgatcgtctcctacggcgacctcgcagactgccggagcttcttcacatcccggtga

SEQ ID NO: 6266 - DNA, 387 bp, Actinoplanes utahensis
ttgctgttgtcgggctggcgtaaacccgcagaacagcggtacaacgtttccttctttctgaagcagagcgtcacggcggcacagacgtcagcgatacggacagagctggagaaggtccccgccgtcaaagacctgcgatacgagtccaaggaggaagccctcgcaaagttcaaggaaatgtacaaggataaaccggagatgattgaagcgatagaaaagtcgggttcggataacggcctgcccgtgtcgttccgcctggatatgaaggcttccgatttcgattgtcgaaccatggaggcgatacgtgcgctccccggggtggagcaatacagtgtcgtcatgggatccatcgatgagaacccagtcctgcaggttcgctgccactga

SEQ ID NO: 6267 - DNA, 1572 bp, Actinoplanes utahensis
atgcagataggccgccgggaagagcagccgctcggccagcgcgccgggcaggccgtcgcggcagcccagctcgtgccggtcggggcagacgtggtgccggccggagcgacagcgtgggcacgcgccgcagccgatcatggtgtcgccggtgacccgccggccgagccagctctcgtcgacgccggggccggtggcgatgaccgttccggcccactcgtggccggggcgcagcggatacgacgcggcgccggtgtgcaggtagctcatctcgccggtgaacagctcgacgtcggtgccgcacaccccgacccgctcgatgccgaccaccacctggccggggccggcctgtggctccggcacgtcctggacctcggcccggccgggatcggtgaagacgagcgcgcgcatggtcgccagcgtagagcttgctcccggccacttccgcccgtgggatcaccattcctgacgtgccgggaaaacggtacgtttcctcccggtccggtaagccgggaagttcgcggaaggaacccgatgacgagaatcgacagcaccccgttcggcgaggcacccgacggcacggcgatcgagaagtggacgctgaccggcgcgagcggggcgtcggtgtcggtcctcacctggggtgccaccatccagtcggtgatcgtgccggatcgggacgggcggctgggcgaggtgacgctcggcttcgccgacatgagcggttacaccgacccggacaatccgtacttcggcgcgaccatcgggcggtacgggaaccggatcggcggcggtacgttcaccctcgacgggcaggcgtacaagctggccgggaacgagggggcgaatacgctgcacggcgggctgcgcggtttcgacaagcgggtctgggcggccaccgaggtcacggacggggtgcggatgacgtacaccagtcctgacggtgaagaaggttttcccggcgccgtcgagacggccgtgaccttcagcttcgacgacgagctccggctgcggatcgactatcacgcgacgaccgaccagccgaccgtggtgaatctgaccaaccacgcgtactggaatctggccggcgagggcagtgggacgatcggcgaccatcttctgcagatcaacgccggccattacacgccggtcgacgcggcgctgattccgaccggtgaactggcgccggtcgagggcaccccgttcgatttccgcacgttccacgcgatcggtgaacggctgcgcgacgacgatccgcaattggcgtacgggcggggctacgaccacaattatgtgctcgccgaccgggtggcggcgatcgtccgggacccggcgaccgggcggcagctgaccatcgagacgaccgagccgggcgtgcagttctactccgggaacttcctcgacggtcggctgcgcggcatctccgggcggcagtaccggcagggtgacgcgttcgcgctggaaacccagcactacccggacagcccgaaccagccgcatttcccgtcgacgacgctgcggccgggggagacgtacacgtcgagcacgacgcacacgttcggcgtcttcggctga

SEQ ID NO: 6268 - DNA, 1104 bp, Actinoplanes utahensis
gtgagggcggtcatcgtcgcggcggcggtcgcgttcctcgtctccctgttcgccaccccggtggcgatccgggtcttcaccgcgctcaaggccgggcagccgatccgctctctcgggctggcctcgaacgaggggaagaagggcacccccgcgatgggcggggtcgcgttcatcgtggcgaccctcgtcgcctacgtcgccgggcacttcgcgctgaccacgctgccgaaacggcagatcgcgcaggagaagccgaccatgacggcgctcgtgctgctcggcgtgttcgtcttctgcggggtggtcggtttcctcgacgacttcctcaaggtgcgccggcgcaactccgacggcctgtccgccaagggcaaactgctcggccaggcgctcgtgggtgtcgggttcggcatcgccgcgctctacgtgcggagcaccaacggccagacggtggccagcgagcacatctcgttcatccgtgacctcgactggctggacgtcggcaaggtcggctcggtgatggtgttcgccttcgtggtgacggcgatgtcgaacggggtgaacctcaccgacggcctcgacggcctggccaccggcgcgtccaccctggtgctgggcgcgtacgcgctgatcggcttctggcagtaccggcactggtgcgccgacccgacgtacgcccgccccggccagtactgctaccaggtgcgggatccgctggagatcgcgatgatcgcggccgcggcggcctgcgcctgcctgggcttcctgtggtggaacacgtcgccggcccggattttcatgggcgacgtgggctcgctgggactcggcgcgctgatcggcggactcgcggtggccacccgtaccacgttgctgtcgatcctgatcggtggcctgttcgtcatcatcacggtcacctgggtgatccagatcgtctcctaccggaccaccgggcggcgggtgttccggatggtgccgttgcaccaccacttcgagctggccgggtggagcgaggtcaacatcgtcgtgcggttctggatcgtggccggggtctgcgcggcgatcggcctcggcctgttctacaccgacttcctggcggccgtcgggtag

SEQ ID NO: 6269 - DNA, 492 bp, Actinoplanes utahensis
atgaccgccctcacgggcggccctgcaggagatccggattgcccacggggcacgatcttgccatctgccggcaagcgtcggtgggagcctaggctgggccgggtggagacgaccccggcgcaacggttcgcgagcgcgcgggtggcccggctggccacggtcaccccggacggcgcgccgcacctcgtgccgatcgtgttcgccctggtcggggacgtgatccacaccggggtggacggtaagccgaagcggtaccgcaacctgcgccggctggtgaacatcgcccgcgagccgcgggtcagtgttctcgccgacgggtacgacgaggactggtcgcagctgtggtgggtgcgtgccgacggcgtcgcgacggtcagcgacgagccggagcccgcgctgatcgaccgttacccgcagtatcgggtgtcgcccccgcccggtccgttcctgcgcatccgggtcacctcctggcacgcctggtccgcgacctga

SEQ ID NO: 6270 - DNA, 627 bp, Actinoplanes utahensis
atgacagccgagagtgaccggcgccgcgcgccgggaatgtccaccgaacaacgccgcgagatgatcgtccgcgccgccctgcccctggtcgccgagcacggcgccgccgtcaccaccgcgcagatcgcccgcgccgccgggatcggcgaggccaccgtgttccgcgtcttcaccgacaagaacgagctgttgggcgcgtgcatcgtcgccgccatggactcgaccaccgtgctcggcgagctccggtcgatctccgtcgaccagcccctcgccgaccggctggtcgaggcggtcgacgcgctcgacgcctacttcgcccggatgggcgccgtcgtcggggccgtgcacgcctccggtaccccgaaccggcggccgggcaccgaagccgtcgacccgacccggccggcgggtggtaccggcgaccgggaagccgcccgggccgccacccggcaggccgttctcaacctgttcgcgccggacgaggccaccctgcgcgtcccggccgccaccgccaccgacgccttcctcgccctgttcttcggccgccgcggcgccggccgccacacccccgtccccgacctggtcgacctgttcctgcacggcgcggtcaacaccggcccggcgtga

SEQ ID NO: 6271 - DNA, 390 bp, Actinoplanes utahensis
ttgtccgagagttcgtgccgcatctgccaccgggcgcccgccgcggaggtcaccttccacgggcacgagggcatgatcgtgctgatgcgcttcagccgggtgcacggcccgttctgccgggagtgcggcctcgcggcgtaccgcgacatcaccggacgcacgctgctgcgcggctggtgggggctgggctcgttcttcgtcaccgccggggtgctggtgctcaacacggtgcggcgcgcccggatcgcggcgctgcccgaggcggaccgcccggccaacgaccggacgctcgatccgggaaagccgctgctggaccgccccgccgcgtacggcctgctggtgcccgcgctgctgatcatctacgtggcgttcagcaccgcccggtcgtga

SEQ ID NO: 6272 - DNA, 927 bp, Actinoplanes utahensis
atggtcacccggcccgccgcgctggtcgcgctgatcaccgtggccggcctggccgcgccgcccctggggccggcgatgcgggccacctggcgccggctcacggccggcaccggtctcaaagcccgggcgtacggtctcgattcggtcgtcgaggaggcgctgtacctgaccgggccgttgctcgccggcctgctggtggcggccgggccggcccgctgggctctgctgctgaccgcggccctgctgctggccggcaccctcggcatggtcgccaccccaccggcgcgggaccggcggccacccaccggcgacgacccgggcggccatcggtggctggtggacaccgggccgctgcgctcgcctgccctgcggggcctggtggtgacgatcctggcggtggggaccggcaccagcgcggcgtacacctgcctggccgccttcgccgaggaccgtggcgccccgggagcggccggcctgctggaggcggcgctggccgtcggcagtgtgaccgggggcctgctctggggccgccgcgaacacgcgggccggcgtcacctgcgccatctcgccctgctgaccggtgtgctcgcgaccggtctggccgtcgccgcggcggccgccgggctgctcatgctgggtctcgtcctgtgcctgacgggtacggcggtcgggccggtctatgtggtcgcctatctggccgccgacgacgccgcgcccgacgggtccgccaccgaggccggcacctggctgaacgtcgccgccacggcgggtggggcggccggcgccgcgctggccgggacgatcgccgagtcccggggtcccggcccgggtttcctgaccggcgccgggctgctggcggtgaccgcggtggtgacggccgtacggtcgcgccgggaagcggtgagtgcccccgacgccaccggttga

SEQ ID NO: 6273 - DNA, 282 bp, Actinoplanes utahensis
gtgaccgtccacctgttcgtgatcgtgcggttcgtggcgctgctcgcggccgtcccgttcgcctggggccgagggttgagccggctcgatctggcgctggccgtcggctggtgcacgctgacctgcctgggcaccacggccggtcaccaccggtacttcacgcacggctcgttcaaggccgggcgcccgctgcggatcggtctcgcggtcgccggcagcctggccgtgcagggcgccgtgaaccggcccaccgcggcccggctcgcccgcatcacccgctga

SEQ ID NO: 6274 - DNA, 3273 bp, Actinoplanes utahensis
gtgcgatccggagcggggggagcggctcgcgctgcggatgccgctggtgcgccaggacacccgggtgccgctgccgtaccggctgcccgaccccgcacccacgctgaacatcctggtggtgacggcgcgaccgttcggctcccgcgacgtgggataccggacgatctcgcagccgctgctggacgcgatcggccggacccggctgccggtcaccgtcgacctggttcggcccggcacctgggaggcgctgcgcgagacgctgcggacggccgcgcgcgaccacggccagggctggtatcaggtggtccacttcgacgtgcacggcgggttcgggacggccgaggcgatgacttccggggtgacctccgggcgctacctgttcgagccgggcgagcggcccgccgacgcgcggcagggattcctgttcttcgagaccggcacggtgggccgggcacggccggtgccggccgatcaggtggcgcagctgctggccgagcaccgggtggcggtggcggtgctgaacgcgtgccagtcggcgatgcaggacggcggcgaggccagcctggcgcaggacctggtggcggccggggcgccggtcgcgatcggcatggcgtactcggtcacggtcagcgccgcccaacaggcgatgccggtgctgtacggccggctcgcggccggcgacgacccggtcgttgcggcgtacgaggcccgccggccctgcacgacgtgaaagcgcgtcgcggacacttcgaacaggatctcgatctggaggactggatcctgccggtcgtcttcgcccagcgggagtcccggctggacctgcggccgatgaccgccggcgagcaggaggtcttctaccggcgtcgcgagcaggtgagcgtggcgcccgcggtggattacggtttcgtcggccgtgacctcgacctgcacgccctggaacggctgctgctgatcgatcctgagcgcacccaggtgctggtccgtggcatggccggggcgggcaagtccaccctgctcgcgcacgccggctggtggtggcagcggaccggactgatcgagcaggtcttctccttctcgtacgagcagcgggcctggacggccgagcagatcacccgccagatcgcgcacgagctgctgcccgcgccggagttcgcggcctgggagtcgctgggcccggcggcccggaccggcctgatcatcgaccggctgcgcgccacccggcacctgatcgtgatcgacaacgccgagtcgatcacggccagcccggcggcgatcccgcacgcgctcccggagcgggaacgtgaccggctggcccgcttcctgtccggcctgcgcggcgggcggacgctggtgctggtgggttcgcgggaggccgaggagtggctggcgacgtcgacctttgccggcggcgtccaccacctgccaggtctggatccacaggccgccacggccctgttggagcggatcgtggcgcggcacggcggcagccggtggctgggtgacaccgtcgatgacgagcagcgtaaggcgctgagcgagctgatgcggttgatcgacggctatccgctgccgatgacggtgatcatgccgcagctggccggcacgccgccggcccggatcctcgccgagttcggcagcggcggtgatgccgtcgatccgtcgatggccgctcgtcgtgcgatcgaatacagccatggcaagctcgacccggctctgcaggagtccattctcttgctggcgccgttcaccggtagcattccggttccggtgttgcacatttacgtcaatgagttgcgcgccggcgccggggaagtgaacatcggggaagttgatctggccggtgcggtcgccgagctgcgtagtgtcggcctcgcccgtgcgcatccggagttgactggattcgtggagaccgtacccatcctcccctactttctccggaatcgaatccgcggtgatccggacctggagcgggtgtgtcgtcacgcgcattaccgcctttacgtcgactgtgccgctttcatgcaggatgccgttctttccggtgacccctatcggcgcgcgctcggccgtgtaatggtcaaggccgagtatgcgaacctcatggcttccctccactatgcgcaaggggcgggggagccggtcctgtccgtcgtccgcgccctcaacatgtacctcgatgtggaacatcagcacaacgtccgccgggctctgctggagcaggcgatagagcgactccccgaaccggaaaccgccgacgatcgatgggaattgttggatctgcacaacattgcgggcaacgcggccctgacgcaggggcaactggacgacgcaacttatcattaccagctggaattggacatgaagcgggctctcgggctccgcgagtatgaggccgtcaccctcaaccagctcgggaagattgcgcaggagcagcgccgttttgcggaggcgaagcagtatttccaggactccatcgacatcagcctggagcacaacgaccgcaaatctgcggccacttcctaccaccaactcggtatggtcgcgcacgaggaggggggcctggaagtagcggaagactattatcgacaggccgccgatctcatccgtgagtccggtgctcggcaggaactcgcagccccctaccatcagctcgggatcattttttccgataagggggaatgggatcgcgccaatgaattcttcgaacagtcgctcgccatcgccaccgaattcaacgaccggcacaagatggccttcacgtaccaccagctcggtatgtccgccttccagcagggatcgctcgacaaggcggtctactattaccggttggctctcgatatcgagatcaactctggtgatcgaatcggcgcggcgagcacctaccaccagctcggtctggtcgcggtggcacaacatcgagtcgagcaggcggaacagtactttcagcaggcgctcgacaccttcgtggatctgggcgaactgtccgggtgcgccgtcgtcggcttccagctcggtgatgtgatatgcctctccggccggcacgacgttgctttcgtgcacttcatccggtccatcgtcgcctacagattgagcaggggaatctgggcggtgaatgtgcttgaccgacttcacgaggaggaggggcacccgatcgaccggacactccagcaggcgattgcggacctcgtcccggtggagctgcggggcgagttcggagaggcttttcgtcagcgcgccgccaccccgggtcgaggcccagcggatcggccctga

SEQ ID NO: 6275 - DNA, 960 bp, Actinoplanes utahensis
atggagaaacgggcgacgctcgccgacgtggcgcgggaggcccgggtgtcgcgggcgaccgcctcccgggcgatcaacggggcgtacggcacctccccggagatgcgcgagcatgtgcgcgcggtggcccggcggctggggttcgagccgcacgcggcggcgcgggcgctggcgaccgggcggggcgggggcggccgccgcgagcggatcgagatcctgatcgtcgatccggatccggcggcgatgggcgtcaagccgttctacggccgggtgctggccggggcgatgaccgcggtggacgggcaggacatcgcgctggaggtgcgccgggtggacgtgccgccggccgcggacgacgatccgccgttcggacgcctgctgatcaacatctccggggcggccggggcggcgtatgcgcgccgcggtcggacggtggcgctgggccgctgtgcgccgggggtcacgttcgtcgcgccggacaatgacggcggcgggttccaggccgccgcacacctggtgatgagcggccggaaacgggtcggcgcggtgttcgggccggcgacgccgtgcgcgcgggaacggcgtgccgggttcctgcgggtgatgtccggggccggccgggaggtggtggccgccgacggtgacttcacccgggcccgggcgtacgcggcgaccctcgaactgctggaccgcgccccggacctggacgcgatcttcgcggcctgcgacgtgaccgcgatgggtgtgctgcaggcgttgcgggcctccggccgccgggtgccggaggatgtcgcggtggtcggtttcgacggcagcgccctggccgaggccgccgacctgacctcggtgttcatgccggccgaggatgaggcggccgcggccgtccggcatctgctcgacccggcccggccggcgccgcggcggctgccgacgacgctgaccgtgcgcgggtcgagctag

SEQ ID NO: 6276 - DNA, 2745 bp, Actinoplanes utahensis
atgcgaattccgagacccgcgaccgtggcagcggtgatcctgctgaccgcggccctgacgccggcgccggccggggcggccggtccaccgtcgtgctccggcgcggccgggtatctgggcaccgtgcccagcccggagagtttcctcggcttcccgctcggcatcggccagcagcgggtggtcaccaacgccgagatccgcggctacctggcggccgtcgacaaggcttccgaccgggtggtcagtggcaccatggggaccagcgtgctgggacagccgctcgactacgcgatcgtctccagcagccggcacgtctcccggcgcagcctggaccggatcgccggacagatccgggagctgcgggatcctcggaaactgaaggcggagcaggcgcggcggatcgcggccggggagccggccatcgtctggatcgccgggaacgtgcacggcggcgagaccagtggcgcggacgccagcctcaagacgctgtacgagctggccgcgggcacgtcctgcgcggtgcggcagcgcgacgacaacctgatcacggtgatcctgccgacccagaacccggacgggcgggacgcgaaccggcggcagaacgagtacgggttcgacctgaaccgggactggttcgcgcggacccagccggagaccgacagcaaactggaactgctgcggaaatacccgccacaggtgttcgtggacgcgcacgagatgggcggacagcggtatttcttcccgccggacgccgacccgatccaccacgagatcgcggacgcgccggtggactggatcaaccggatcggggcggcgaacaaggcggcattcggctacaacggggcgtgcagcgacaccgtcaccaccgagtgctatttcaattacgacacgtacgacctgttctacatggggtacggcgacacggttccggcgaccggattcggggcggccggaatgacgtacgagaaaggcagtgcctcctcggtgcaggaccgggtgcagcagcagtacaacacccagtgggcgaccctgggctgggccgcggcgaaccggcgcgaggtgctgaccggctactaccggacgtggagtgacgcggtcgccgagggccgcgccggcaagctggagccgaaccaggtggtgcagccggagaaccaggtgcggttcccggtgcccgacatccgagtccggtcgtatttcctgatgccgggcaggcagctcgccgacgtgcgacggctggtcgaccggctgcggcggatggacgtcgaggtgtacgaggtgcgcaaggcggtcacgatcgcccacgcacggatcttcggcgggcgtacggccgatgaggtcgttgttccgaagggcgcctactggatcccgatggatcagccgcagaagcactggatccaggcgacgctgggcgaggatccgtacgtcccgttcccgtatttctacgacgtctcgtcgtggagcaatccgctgctgatggggatcgacaccgtctacaccggtgacgatgtgcgcccacggggcagcctggtgaccggcgtcgagggcggggcgagcgggcgggggcgggtctacacgtacccgctggattccgcctcggcggcgcagttgaccttccgcctgctcggtcggggaatcgccgcggtccgcgacgggaatctggtgcgggtaccggcctcggcggtcaccccgaccgtcgaccggctggcccgatcgttgggtgtcaccctgacgcccagcgcgcggaccggcgggaccgcgctcaccacacccgacgtcgggctgttccgcggcgccggggtgtccaccacgtccggctcgtacggcgaggcccgctacctgctcggcagccgctgggggctgaacctcaccccggtgaccagcgccgacatcaacgacaacacgcccgcgttcacccggcgcagcgtgctgctggtgcccgacggcagcaacccgaccggtggactgaccgccgccggacaggccaacctgcgggcctggatcggcgcggggcacacctacgtcggtctccgcaacgagggcacccgcctggcccgggccgccgggctgacctcgaccaccgagaagccgcagcccgacgactacctggtgatcggctcgcacctgcgggtcgacgtgaacccggccagcccggtcggcacgggccggccggccgcggacttcgcgttcaacaacggcgacccgatcctcaccccgagcaccaccggcgtgaacgtgctgacctatccgagcgacggcacattctggcacaacggctacacggtgcacgaggacgtgctcaagggcacctcggtggtggtcgacgagccgaccggggcggggcgggcggtgctgttcgcgaacgacccgctgtttcgcgggtacaccgagagcggcatgcagctggtggccaacgcgctgctgtacccggccgggaacccgaagccggcggcgcgcacggcgagaccggaaccggcgagggcggccgcggccgcgcggccggcggcgccgaacctgggcggcgagtggcggccggaccggatccaggtggcggtggccgacctggcccgcacccggagcgtggtgagccggtacacgagcacggcgacggtggcggtagccggcgactcggcctacctgaccatcccgaacccggacggcctgcagttcgacgagcacccgtatctgcgcgacctgatcgccgacctgcgcgccgccggtatcccgctgcgctccatcgtggcctga

SEQ ID NO: 6277 - DNA, 1128 bp, Actinoplanes utahensis
atgcaacggaagcaccatgccctggtcgccgccctcgtcctggtggcgtccgggctcttcgggctgacgctgtccagcccggcgcaggccgacaccaggatctgcgaccagtacgggtcgaccaccatcggcggccggtacgtcgtgatgaacaaccgctggggcaccagcgccgagcagtgcatcacggtgacgggcaccgggttctcgatcgccagccagcagggcaccgggaacaccagcggcgcgccggtgtcgtacccggccgtctactacggatgtcactacaccaactgctccccgggcaccaccctgccgctgcgggttagcgcgatcagcagcgcgacgagcagcatcagctacaccttcgtgtccggggcgacctacgacgcggcgtacgacatctggctcgacccgcggccgaacaccaccggcgtgaacgctcaggagatcatgatctggttcaaccggcagggctcgatccagccgatcggctcccgggtcgccaccgccaccatcggcgggcgcagctgggaggtgtggcagggcagcaacgggtcgaacgccgtggtctcctatgtggcgccgtcgccggtgagcagctggagcttcagcgtcctcgacttcatcaacgacgtgaagaaccgcggtgcgatcaccagctcgtggtacctgaccagcatccaggccggattcgagccgtggatcggcggcgccgggctggccgtcaccaacttctccgcggcggtcgacggcggcggcgcgccgtccggtccgggcaccccgtcgagcccgtccaacccgggcacttccggttgccaggtcacctacgcgccgaacgtgtggaacaccggctacaccgcggacgtcacggtggccaacaccggtggtggggcggtcaacgggtgggcgctcggcttcaccctgccggccggacagacgatcaccagctcgtggaacgcgacgctgagcggcaactccggggcgatcaccgcgcgcaacgtgagcttcaacggcgcgatcccggccggtggcagcacgtcgttcgggttccagggcgcctacagcggctcgttcgccaagccggcgtcgttcaccctgaacggtacggcctgcgcgatcggctga

SEQ ID NO: 6278 - DNA, 1416 bp, Actinoplanes utahensis
atgcgggcggacacaccggcctacgaccttgacatccggaccgacgagaagcggattcgcgccgcgctcgccgacgcggcccggaccccgttctggctcgaggatcccggacggcccgtcccgctgcccgccctgatcggcaccatcgacaccgacctgctgatcatcggcggtggttactgtgggttgtggaccgcgctccaggcgaaagaggcggatccggcccgcgacgtcgtcctggtcgagggcgaggagatcggctgggcggccagcggccgtaacggcggattcgtcgaggccagcctcacccacggccaggagaacggccagcgctacttcggcgaggacctcgcggtgctggaaggcctcgccgaggagaacttcgccggcttccgcgactcgctgacccggcacggcatcgacgccgagtgggaggagaacggctcactcgccgtcgccaccgaacggcaccaggtcgaggaactgcgggcggcgcccggtcgcttctacgaccgggagcagctggccggcatcgtcaagtcgccgctgttccgggccggttccttccaggagaccggcgcggccctggtgcacccggcgaaactggcctggggcctcaaggacgcctgccgcagactgggcgtacgcatctacgagcacacgccggtgaccagactcaccgatcggggcggcacggtccgcgccaccacccggatgggcgtcgtgcgcgcccgccaggtggtgctggccaccaacggcttcccgtcgctgctccggcgcaaccggatgctgaccatcccgatctacgactacgtgctgatgaccgagccgctcaccccggcgcaactggacgagatcggctggcacggccggttcgggatcggcgactgctcgcggcagttccactactaccgcaagagcgccgacaaccggatcctctggggcggttatgacgcggtctaccaccgcggcggcgacatccggccggagttcgaccaacgaccggaaacgttcgcccggctcgccgaccacttcctgcgcaccttcccgcagctcggcgagatcaggttcacccacgcctggggcggcatgatcgacatgtcgacccggctggccgcgttccagggcctcgcgatgggcggcaaggtggcctacgccagcggcttcaccgggttgggcgtggccgcgacccgcttcgccggcgccgtcatgctggaccttctcgccggggccgacacgccgcggacccggctgcggatggcgaccaggcgaccgatgccgatcccgccggaacccatcgcgtaccccgcggtgcaggtcatccggcgggcgatcgcccgcgccgaccgtaacggcggccgtgacggcctgattctcaagaccgccaacctcttcggtttctccttcgattcctga

SEQ ID NO: 6279 - DNA, 690 bp, Actinoplanes utahensis
atggcgaccacgcggggcagttccggcagggtccggcggcggcccacccgcagcggtgtgatcctcgaaccgtccatgatcatcgatgccgcgctgcgactgatcgaggcacccggtggcaacgcactcacggtccgtcgcctcggcgtcgagctcggcgccgacccgtcggccatctaccgctacttccgcgatctcgacgcgctgctgatcgccatcgccgaccggctgatcagcgagacgctcgccgggttcgagtccgggccggactggcgggccgcgctgcgcgagatgggccgcggcgtgcatgattcgatgctgcggcacccgcggctggccacactgcgcgccagccggttcaccgccggccccaacgagctgcgcgccgacgacatcggcatcggcctgctgctgcgtgccggcttccccgcgccggacgcggtgcgacatttccgggacttcatcgacgccgttctcgcattggcggcgatggatgccgcggaattggcgccggggcaggaggaagcggaccggcaggcactcgcccaggcatatgcgacgttctccccggaggaatatccgaatctcgccgcggtccgcgagcaccttccgcagatcgccgtctccgcgttccccggcgtgctcgacaagctggtcgacgcgatcgccgtgcagctgccggcatcgtaa

SEQ ID NO: 6280 - DNA, 531 bp, Actinoplanes utahensis
atgaccgacgacggggacgcccgggcgctgatcctggtcgaagggatcagcgaccggatcgcgctgcgcaccacggccgccgcccggggccgcgacctcgacgccgaccgggtgcggatcgagccgatcggcggagcccacgccatcggccgctacctgcgcgacctcggtccggcggccgcccggctccgggtcgtcggcctgtgcgatcggcaggagcagtggacgttccgggcccacctgcccgccgaccgttacttcgtttgcgaccgcgacctcgaggaggagctgatccgcgcggtcggcgtcgcgtgcgtcgaggaactcttcgccgccgaacgcgacctggaccgcttccacctgttccgcagccagcccgcctggcggggccgcccgatcgaggcgcagatgcaccgcttcgtccgcagctcctcgcgccgcaacctccgctacgcccacctgctcgccgcggccgccgcgcggcgtgacacccggcccggcccgctggcggcgctgctcgacgcagtctga

SEQ ID NO: 6281 - DNA, 471 bp, Actinoplanes utahensis
gtggtgaagccgaccctcgaaccctccggaagcggtgtggacgatcatcagcgagccgtcgctctggcacaccggacccggcggcgatactggcggcagcgcgccctcagcagccggctgctccatcggctcggcgaactgtccgcccactcgctggctggtctcgcggtcgccggactggtcgtggcctggctgatcatcggtgtggtgatcagcttccccggctggtgggagaacgccctgtatgtgaccagctcgctgatcaccctgaccatggtgttcaccgttcagcacacgcaggctcggcaagccgtggcactgcagcgcaagctcgacgaattgctgcgcgccgtgccggccgccgacaaccggctgatcgccctggaggaggtgccggagcgggagttgcaggagcttcaccatcgcgacatcgcttcgcgagagaacacgcccgaagcccagtggccatga

SEQ ID NO: 6282 - DNA, 882 bp, Actinoplanes utahensis
atggggaccacgctgccggtctatcgggccgggttgaacgacagcacgcggtgggagcgattcgagccgcggaccggggacatcgtcatcagcgcgccgtcgaagtgcgggaccacctggctgcagatgatctgcgcactgctgatcctgcaggagcccgcgttgccggcgccgctgaccacgctgtcgccgtggctggacatccggctgcggccgatcggggacgtaacggcgacgctcgcggcccaacggcaccgccggttcatcaagacgcacacgccgctggacgggctgccgcggtggccgggcgtgacgtatctggtgatcggccgggatccgcgggacgtcggggtgtcgatcgaccaccaccgcgccaatctggacggcacggtcttcgagcggctgctgggtggcggcgcggcgcctcggcggccggcgtcccggcgggagcggatcctgcagtggatgcacgacgagcggccgccgaccgtcggcatggacacgctgcgcaccatggttcaccacctcggccaggcctgggagtgccgcgccgacccgtcggtggtgctgctgcactacgccgagctgagcgccgacctgcccgggcagatgcgggcgctggccggacacctggctctcgacgtgccggagagatcgtggccggcgctggtgggggcggccggcttcgacgccatgcggggcaatgccgcacggctcgtcccggacgagcgtctcggcctgttcaccagcgagacggcgttcttccggtcaggccggagcgggcagtggcgtgacgtgctcaccgacgacgacctggccgcctacgactcggtgctgcgctcggtggccgcccccggattcgtcgagtggttgcaacgatag

SEQ ID NO: 6283 - DNA, 840 bp, Actinoplanes utahensis
gtggcagagttactgacggtcggggagttctcccggctgacccatctgacggtcaaggcgttgcggcactatcacgatgccggggtgctggagccggcgctggtcgacccgtcgaccggctatcggtactacacgccggagcaggtggaggtggcccagctggtccgccggctgcgcgaggtgcggatgccggtcgccggggtgcgtcaggtggtgtcggcacccgatctgccggcccgggagtcggtgatcgccgcccacctcgacgtcctgcgtcgggagctgaccgcgaccgccgcggcggtcggatcgttgcgggcgctgctggccggcggggacaccgctgagctgatcttccgggacaccgcggaacagcactgcctcatgatcgacggtgatgtcggccaggacgacctcaccccgtggtgtgccatggcctacccgcggttgtacgccgtcgcgggccgccacggtctcgtgccgcggggtccgtccggcgcgctgtacgccttcgcctggttccaggtcggcggccgcgtgacggccttcctcccggtagccgccctcccggcggcggacgacggagagcagcgtgccgggatcctcggcgagggggtgcggtgggggattctgccggctgggcggcatgcggtcgccgtgcacgccgggccctgtcacgacctggaccgcacctacgccgggctggggcgtcaggtgctggcgcaggggatcggggcgcccggtccggtccgggaacagtacctggtcacgtccgcggacaccgatgacccggatcagttgcggaccgaggtctgctggccggtcgtcgctgcggggtga

SEQ ID NO: 6284 - DNA, 381 bp, Actinoplanes utahensis
atgccgctgtccatcgcgcagattgtcatcgactgtgccgacgcgcagaagctggccgctttctgggcggaagccctggaccggccggtcgacccgggcgccggcccggaattcgccaccatcggtcacggcgccgcctcgaccggcaacgcgccggcgctgatgttcatcgccgtcccggagcccaagcgcggcaagaaccggctgcacttcgacctcgccgcccgccaggtgccggactggcgcagcgaggtggaccggctgctcacactcggtgccacccgggtcgatgaacaccaggctttcggctggcactggatcaccatgcgcgacccggagggcaacgagttcgacctcggcgcgggcgccgccacgtcctga

SEQ ID NO: 6285 - DNA, 1083 bp, Actinoplanes utahensis
gtgacggaacggatcagggagttgctcgacgaggcggtcgccgagcttgagcccgggtatcgcgacccggtcgcgacggtggtccggcgcggccgggccgcccgccggcgcaccatgctggcggcgaccctggccgtgatgctgctggccggcggcctggtcgccggccggcagatgctggccggcccgctcacaccgaccgccgccggaaccgccgattcgcggccccgcctggtcgacggcaaggtgcgggccggcgcggtcgagattccggtcccggcagggtggcgggtggtcaccaacgatgcttcacagccctgcggtgacctgaccgagacgatcatgttgatcgtgcggaacaaccgcggctgccagtacgcgccgatggagatctcggtcgcggccggccgcaatcccggcggcactgtgctcttcaccgccgccgaaccgttctcctccggcgacctgatcaccacgccacgatccgtgacgctcgccggtggcgagccagggtggatgccgtcgtcgccggaggacgcggaactggcgcccggccgcgaggggtaccactactccgccgagctgctgctgccctggtccgacgtgttcatccagttccggacggacggcccgaccgcccggcggattctggagacgttccgcagcacgccccgcgagggcggcgcgctgaaggtgccgaccagggtcggctcggtcgacctgacgatgcccgattcctcgggcagactacggccggccggtcatggcatctcctccgacccgaagaccgtcaacgcggtcctcggactgctgcgcgaacagaccgcggtcgtgcgcgacggcgacgcgtgtgccggcactcagcagttgagcgcccgactgtcgctgatcgcaccgggcccgtccccgtccccgtcgccggacgcgatgtcgttcccggtcagctcgccgaagaccaccaccgtcgtgatcgcgctcggcacgaaatgccaggaggcggtgtcctcggacggcggccgggtgctgctcagcgacaccgccctggcccggttgcagggcctgatggggatcggtgcacggtga

SEQ ID NO: 6286 - DNA, 1398 bp, Actinoplanes utahensis
gtggcgcttcgagatcccggccgaggtgctgcccgaccggccggccgccggcgacgtggccgaccagctcggcaccgccgacctggttctggcggcgttgcgggaactgcccgccgggcagcgcgtggtactggtgctgcgctactgggccaacctgtccgagcaggagatcgccgcccagctgaactgctcgatcggcacggtcaagagccgggccagccgggccatcaccgccctgcgccgcgccgacggccccctggccggcgcgttcgccctggccgacgggccgcgccggtgaccccgccggcccgggtggccggcctggacggggtgcgcggcctactggcgctctacgtggtgatccaccactgctggctggtctgtttccctggctacccggccaacaccggcccgtggtggggcggctggctgatccacggccggctcgccgtggtcgcgttcatcgtcctctccggtttctccctggccctcgccccggccggccgcgggtggcgcctcggtggcctgaccgacttcgcccggcggcgggcccggcggatcctccccgcctactgggcggcgctgctggtcagtctggccgtggcaacactggccggcccactgccgatgatccatcgggccgacgggcggatcgctgtcgtctatgcgttgatgttgcaggacttcgtccccgcgcccgccccgaacggcgcgttctggtcgatcgccgtcgaggcggctctctacctggcgttcccgctgctgatcctggtccgctcccggttcggcgcgctggccaccctgggcgtgtccttcgtgccggtgctgatcgccggtccggccgcgacgaccggcttcacctgggagatggccccgttgttcaccttggggctgctcgccgccggagtcgccggccggccgccgcgcctgccctggtggaggctgaccgcattcgccgccactccggtgatcgccctgatcgcgtggcgtggaccggtctggaccgaacaccactacttctggatcgacctgttcgccgggcccgcggtggcgtcgctgctgatcgcggtgtcggcccgcccggcccggctgctcagcgcccggccgacccgcgggctgggcctcgcctcgtacagcctctacctgctccacgtgccggtggtcgcgctggtcagccaccagctcggccgctccttcccggtgctcgtggcggtcgctgtgcccacggcggtgctgatcgccgccctgttcgccatggtcttcgagagggcacccttccggagagcgggaaataccgaacagggtgaacgagcggaccctcaccacaacgctgcacgagggctggaaaccgactcccggatcatggtcgggcccggagcaggatccctgcgagggtga

SEQ ID NO: 6287 - DNA, 333 bp, Actinoplanes utahensis
gtgaacgcggtcttctcccggcctgagcctcggcgcgcgacgggtctaccggctgacgatcacgtacgaggattccaggaacgaagcgtggaattctgtctctggatcaaggccgtcgggtacagcgcggagccggtcgagtatttcgacgaggtccaaggtggcttggaggtgcgcttcccgcttgtcgcatcgggtggcgtatccgcgccggttgaagccgcgttcgacctggtcgcgccgttggacggcgtccggatcgaacgcgggtcgacgcgacgctcgagcgtcgcgtcgaccggggcgtccccgtcgctgtcgccgtcgcgctag

SEQ ID NO: 6288 - DNA, 1242 bp, Actinoplanes utahensis
atgattcagcgacgtaaggtcatcatcggttcactcggtgttgccgcggccgccaccacggttgccggttgctcctcgaaaaaggacgcgaccacgtccgggggcacgatctggacgcagcccgtggccaacaacgagcagcccgccgcggccgccgcgccggtgcaggtcaccgtcacgccggacgccggggccaccggggtctccccggtgaagccgatcaccgtcgcggtcaccgggggcaagctggaggcggtcaccgtcaccgccggcaaggagaaggtcgacggcgagatcaagcccgacggctcctgggtctccaccgagcacctggcgtatggaaagacgtacaaggtggccgtgaccgccaccgacagcacgggcgccaagaccgagaagtcgtcctcgttctccacgatcaagccgcacgccacggtccgggtcaccttccaggccaacgcgatgagcgcgctgcagtcggggcacacctacggcgccgggcagccggtgatcgtggcgttcagcaaggcggtcaacaaggagctcgccgagaaggcgatcgagatcaagacctcgccgtcggtcgagggcaagttctactgggccgacgacaaaaccgtgcactggcggccggcgaaatactggacggccggctcgaccgtcaaagtcagtgtcaacgccctcggggtcaacctcggcaagggcgtctacggcgagaagaacgcgtcggccaacttcaagatcggccgtcagctgatcaccatcgtcgacaaccggacacacgtcgccaaggtgtacatcgacggcaaggtcgtgcgccgcatgaagtgcagcctcggcatgggcggcaccaccaccggcgccaacggtcagaagatcagcttctggaccgccggcggcccgcacgtcgtgctctccaaggagcgcaagcacgacatgagctcggccagctacggcgtctccgacccgaaaaacccgtactactacgccgccgagaccatcgagtactgcacccggatcacctactccggcgagttcctgcacgccgccccgtggaaccaccagctcggccaggccaaccgctcgcacggctgcatcaacctgagcgtcgacgacgccaagtgggtctacgagaacttcctggtcggcgacatcgtcgacgtcaagaacagcccgcgggaactgccgatctggaacggtctcggcgactggaccgtctcgttcgacaagtacggccgctag

SEQ ID NO: 6289 - DNA, 1524 bp, Actinoplanes utahensis
atggcacgaatccccctgggcatcgccctggcggccgggaccgcggcggcgtccgccctggtcgcggtggctggtccggccgcggcgaaggcacccggcgcggacccggtcgcgcgggccgacgccctggtcgccgcccgaccggcggcgctgcacgccagcgcccacgacggcttcctccgccgtcaggtgatccggtcgcaagggctgacctacgcggcctacgaccggacgtacaagggtctgtcggtgaaaggtggcgacctggtggtcgttaccgacagcgccggccagacgcgctacacctcggtggcgcagaacaacgcgatcggtgagctgacgaccgtaccggcaatctcggagagctccgcggtgaccaccgcccggcagctgctcaagagcgtgtccggtgtcgagccgacccggctgatcgtcgtcacggccgacggccgggcggcgacgctggcctgggagaccacggtgaacgggcgcagcgcgaccggagcgagccggctgaccgtcgacgtggacgcgcagaccggcaaggtgctctccaccgaggagcacgtcaccgaggcgaccggcagcggcaccggctggatcaacggctcggtctcgctgaacaccacgctgtccgggtcgacgtactccctcaaggatccctcgacgaccaacctgagctgccaggacgcctcgacgaacaaggtgttcagcggcaccgacaacgtgtggggcaacggggtcggcaccagcaaggagaccggctgtgtggacgcgctgtacgtggcgcagaagcagaaggcgatgctctccgcgtggctggggcgcaacgggcaggacggctccggcggcgcctggccgctgcgggtcgggctgaacgaccagaacgcctactacgacggcacccaggtgcagatcggcaagaacaccgccggcaagtggatcgcgtcgctcgacgtcgtcggccacgagctgggtcacggcatcgacgaccacaccccgggcagcctgtcgaagggcggcacccaggagttcgtggccgacaccttcggcgcggcgaccgaggcgtacgcggcgaaccccaacgacccggccgactaccaggtcggcgaagaggtcaacctggtcggctccggcccgatccggtacatgtacaacccgtcgctggccggcgacagcaactgctactccagcagtaccccgagccaggaggtgcacgccgcggccggtcccggcaaccactggttctacctgctcgcccagggcagcgccgggaacggccagccggccagcccgacctgcaacggcgcgtcggtgaccggggtgggcatccagaccgccatcaagatcatgtacaacgcgatgctgctcaagacctccagctcgtcctacgccaagtaccgggtgtggacgctgcaggccgcgaagaacctgtacccgggcagctgcacccagttcaacgcggtcaaggccgcctggaacgcggtgagcctgccggcccagtccggtgagcccacctgctga

SEQ ID NO: 6290 - DNA, 756 bp, Actinoplanes utahensis
gtgacctccgcgagcgcatctggcggacctgctgagcggccgcgaggatcacggcggccggcggcctgtctcgtacggcgtcgaccgatgcccggaggccggttgacgcaccgcttcggccggtcgtgggcggggtggtctgccggggtgcgacaggatgactgggtgtgtgcgggggctggtcccggtttgtatgctgctgtcctcatggatgccgaccgcacgccccgcgaacgtctggttgccgcggcccgctcgctggcggccgagcgtggctgggacaaggtgcggatggccgatgtggcgcgggccgcggggatgagccggcagacggtctacaacgagttcggtgatcgcgccggtgtggcgcaggcgctcgccgtgtgggagatcgagcagttcaccggcgcggtccgggagcggctgttcgcggcgggtgcggacgtgcggggcgccgcgtacgccgcgatcctgcacaccctgcgggaggccgccggcaacccgctgatccgctccatcctggacagctccgccgacggcctgttcccgtatctgaccacccgctccgacctggtgctcgcggcggcggccacggtgatccgggagtgggccgacgcgtgcgtgccgggcgtggacgcggcgctggccgccgagtcgatcgtgcggctcaccgtcagccacatcgtgctgccgggggagtcgccggaggcgtcggcggccgcgctggccgaggtgttcgtgcggctactgcgctga

SEQ ID NO: 6291 - DNA, 1386 bp, Actinoplanes utahensis
atggccgatctgggtgccgacccgggcgttgccggaagtggtgaagctctggtgataggtggacatcgtcttctctcgggttctccgtcaggaccgggaacaggctggccgccgggtgtggccgcggaaaaccggacgaagaggggaagacgccagtcaccgtcagtgacctgcggcgatgtgcgcgcccgacacgcaacgacacccgtccgagtgtcagccggtcggggaaaccggccacttgacacgaaggcctattttgtaaaacatctattcatgaccgctgctgtagccgggtcgtggcgtgacgtcaaacgtccgctgtggccactcgccctcgtggttcccgccctgcccttcgccgccctgctgctcgcccgcgccaccggatccgggtgggcgtggtggctcaccccggtcttcatcctcggcgtcatcccggtcatcgacctgctggtcggcgacgaccgcgccaacccgcccgaggaggcggtgcccgccctgcaggcgtcgccgtactaccgctggatcaccttcctgttcctgcccgcgcagtacgccgcactggtgatcacctgcgccgcctggacccggcagcccgggctcggcctggtgctgaccgccggcctggtcaacggcatcgccatcaacaccgcccacgagctcggtcacaagcgggagaccgtcgaacgctggctttccaagatcgcgctggcgcccaccggctacggccacttcttcgtcgaacacaaccggggtcatcacgtccgcgtcgccaccccggaagacccggccagctcccggctcggcgagtcgttctggcgcttctggccgcggaccgtgctcggcagcctccgctccgcctggcacctggagaccagccggcaccgcctccgcggccgcagcccgtggcggctgcacaacgacatcctcaacgcgtggctgatgaccgtcgtcctgttcgccgcgttgaccgccgtcttcggccccgccatcctggtcttcctggtgctgcaggcggtggtcggcttctccgtcctggaggcggtcaactacctggagcactacgggctgctgcggcaacgcaccccgaccggccgctacgagaaggtcgacccgcggcacagctggaacagcgaccggctcaccaccaacatcttcctgttccagttgcagcgccacagcgaccaccacgccaacccgcagcggcgctaccagacgctgcgtaccttcgaggtctcaccgcaacttcccgcggggtacgccacgatgctgctcctggcgctcgtccccccgttgtggcggcgggtgatggaccaccgggtcctcgaccactaccgcggcgacgccaccctggccaacgcggccggccggtcagcgcagtag

SEQ ID NO: 6292 - DNA, 2589 bp, Actinoplanes utahensis
gtgactggcgtcttcccctcttcgtccggttttccgcggccacacccggcggccagcctgttcccggtcctgacggagaacccgagagaagacgatgtccacctatcaccagagcttcaccacttccggcaacgcccgggtcggcacccagatcggccatctcagcggcgacctgcaccagggcgcctcggccggcctccccggggagatcgaccgactgcgcctgctgctggaccgtgcccacgagcgcggcgacctggacacggacaccctggcggccgccgggcaggacctggaggcggcccgcgcggcggtcggcgagtcccggcgcggacgtgccgtggtcgcgctgcgccggctgaacggtctggtcggcgacgtggccggactggccgccccggtggccgcgatcctggccgcggtcaacgggagtggcgcgtgaccgactgggacgaggacgtggcgcagaccttcgtcaaccaggacaacgcctatgtggacacccagatcggggtgctgcacggcgatgcccacttctaccacgtgaccggtgacgccggcccggaggagcagttccgggtggcggtcaactacctcgacgccgggctggccggggaggcccgccgccggatccgggaagcggtgatgaccggcgggctgagctcggccgaggtcgcctaccggtgggcgctcgccgtgctcagcggccgccggctgaccgacctgtcggacgaggatctggccgcgctggaacacgcgttcgcgatggccggccagtatcccagcgggcgctggtggcggtcggtcgcggtgatccagggcttcgtcgacgccctgctggcgctcgggccggacggccagcccaacccggtggcgtgcgccgaggcgctgcgcgggcacgccgccctgccgcccgaggaccggctggagatcgagagtcatctcggccagttcctcgcgcacatcctgcgcgacgacgccgaccagcgcaccgacgagcgggtccgggcggcgcggctggccggggaccgccgggaccgggtgcccaagttcttcgagccggacccggcgccgccggtgcgcaaggtgccgctgcagaccccgccgggcagcgcctggcggccggtcgccggcggcgccgcgatcgccgcgctggccctctggacgttgctcgccgagctgggcgaggtgagcatcctggccacgctggcggtgaccgcgctgctcggcgcgggcggctggttcgccggccggcagctgctcgaacgggcctacctggccagccggcgggcggccaaggaggccgaactgacccgcggggagcgcgccccgatcgaacgaccgggcaaccaggcgccccaggagggtttcgcggacgcggtcagcggcctgatcgatgccgcgttcgcccggcggcagcccgccgatcacagccgggacgctttctggcagcagacctggggattgcgggccgcgctctacggcgacctggtcgacctgtacgcacacgccggggtgccggcggccacactcgcctggctggtcaacttccacgccggggagatcgcccggcgctggcgggccggtggcctcgacgaattccgccgggaccggccggccgccccgctggcctccccggagttcgccggtgggctggcggcgctcggcggggccgcggtgatcgccgtgctgaccctgctgaacagccacttcttcggcatcgtggtgaccgccggcctgctgtacctggccacccgggtgggccgcggcggcgccatggtgctgtacggcgagcggcggcggatcaccctggacaccgccgagtacgcccagcgcttcgacgccgagaccgccgcacaccagcgccgggtcgcccacctcgccgaccggcccaccgacgtggagatgggccggtggctggccctcgacctcgcctacttcacccgggcggtcctgctggactcccggctcaccggccgcgacgtggtcacccaactggtgctcaccgaggcggccgcgggcagcgtgcgggcccggatcctgggtggaccgttccggcattcggcgtacacggtgctgctgttcctgctcaccgagggcggggtgcgccgggtgcaggcgcggctggaattcgcgtccgggaagttcgtcggcgagcggcgggacaacttccggtacgaggcgatcgtctccgcccacgtccgcgaggtcggggtccgcttcgacgacggccggccccgggtgctgaccgacgacgagtcgtatgcgttggcccgcaccgacaaggtggtccgccgggaggccctgctgctgaacctgatcgacgggcagaagatcccggtgctggtggaccacttcgacccggcgacggtcgacaccggccgcgaagatccggaccagctggcccggctcgccaaggacagctccggcgtctccagcgcggtccacgtcctggaggcgatcgccgtcgagggccgggagtggatctcgctggagcgcacccggatgtaccggcgactaccccggcgccgtacggtgccgggccagccgcagggccgggaactgcacgccccaccggtcaggtggtga

SEQ ID NO: 6293 - DNA, 225 bp, Actinoplanes utahensis
atgcctgacgcgagccgcggcatccagcaggagggcctggtggtcgagtgcctgcgcaacgccaccttccgggtggagctgccgaacgggcacgtggtgctcgcccacatcagcggaaagatcaggaagaactacatcaagatccttccgtacgaccgggtgctggtcgagatcagcccgtatgacctgaccaggggccggattctctaccgctaccggaactga

SEQ ID NO: 6294 - DNA, 783 bp, Actinoplanes utahensis
atggaaacaaatacttctgacgtgatccgggtgtcggagcggcattggcacgctctcgtcgacgatgaggtggccggccggggccaggtgtcgcgacggcccgacgggcgcgcgttcgtcagcgtcgacgcctggcaggcgggcgtgttccggcggctggccgagacgatgctcgcggagctgccgcggccgctctacacggtggtggacgaggccgatctcgagctgctcaccgcctgggaacggttcggtttcggcccgcgccggcgggagtgggaatatgtcgtacccaccagtggcggtcgggtgacgccgccgccgggagtgaccgtcgggcccgccgaggcaacctccttgcagcggttgtacgccgtggtaagggccgaggtcgaggcgggcatcgggtggcagaacatgccggccgaggtgctgacccggccgctggaaccggcccgctacctggtcgcgtccatggacggcgagagtgtggggctgacccgtctcggcccgatgccccggcgcccgcacatcggcctgatcgcggtccgttcctcgcaccgcggccgggggatcgggcgggcgatgctggccgaggtgctcgccgacgcgcaccgatgcggcgtcgccacggcatcggctgaggtcaactcggccaacaccgctgcggtcgcgctgttcgacgggttcggcggccgccgggccggcagcaacctcgagctggtcctgagggggccactcaccggcagcgagccgcgggcggcgttgagggggcggcatgcctga

SEQ ID NO: 6295 - DNA, 750 bp, Actinoplanes utahensis
atggagtcgcaccacgaccacggccacgggcaccaccacaccccggagcccgcctggcccgcccccgccgagtggtccgcgcccagccccgcctccgcgcccgactggccctcgccgtccccttcgaccgattgccccgcggcggacgtgtctgcgtcgcccgcgtcgaccgattcccccgcggcggaccggtctgcgtcgcccgcgtcggccgattcccccgcggcggaccggtctgcgccgcctgcgtcggccgaatcttccgcggcggacggatccgctccgggcccgatggaatgggtgatcgcaccgcccttcaccgacccggccacgccgctgaccgacaccggctcgccggcctggaacaaccagccggccccggccccgtggccggaatacacccccgccccatggtcggatgacgcccccgccggcggtgccgctcccgccacctccgggcaccacgctgtgcccgccgaatggcgaaacaccggcaccgtcacccccgcggccggaactcgccgcgcgaccctcgccctcctgctggccgccgccgccgtgcccttgtccctctgcgccttcggcctcccggcgggggccgccatcctcctcggcgccctgcacctgcgccacaccaccagcggcgccccgggccgccgccgcgccatcaccgccatctgcctgagcgcggtgctgctcctcccgtcgatcgtcctgagtatcgggttctggtccgccacctctgcgtga

SEQ ID NO: 6296 - DNA, 2163 bp, Actinoplanes utahensis
atgacacgaagaaattcttcccggagatcgatcgtcgccggactcggtgtcctgggtgtggccgtggccgccggtctcatggcccccgcatccaacgcgtccgccttcgccgcgaccagcccggccaatgtggtcgccttcctcacatcgatcaccggcggcaagattgtcagcggggtgcacaacaaggggttgaataatccgacggagtacacggccgagatgcagtccatcaccgggaaaacgccgggcctgtggggcagtgagctggggttttccgccggcgacatcccgaaccggcagaagatgatcaaccaggccaaggcgcagtggtccgcgggttcactcgttgcgctgacctggcaccagtgccgtcccgatgtcgccacctgtgagttcgacactggcgataatcctattgtgggcagcgagctgagcgatgccgagtggtcgtcgcttcttaccgacggttcgtcgttgaacaacgcgtacaaggcgaagatggaccagctggttccgtttttccagcaattgaaggacgccggcgtgcccgtgttgttccgtcccctgcatgagatgaacgacggctgggcctggtggggtggccgttccgggtccggtggtagcgcgaagctgtaccagctcacgcacgactacttcttgtccaaggggctgacgaacatcgcctgggtgtggaacgtcaaggacaccggcagcgcgagcggggcagcagcctactacccgggtgacaattacgtcgacgtggtcacgctcgacccgtggaacaacaacttccccacttcggcctggtactcggcgatagtgaacatcgcgcatggtgttaaaccgatcgccttggcggagctgggcaacacgccgagcgcggcaacgctggcgagtcagccgaactggacctatttcatgatctggtcggaatacatcgcccagtgcgggtgcaactcgaccatccggtcgaccttcagcaacgctcgtgtgctcaaccagggtgatttcaccatcgccacggatggcggcaccactccaccgacaagcccgccacccaccggcggcacgggctccatcaagtccagcagcggcaaatgcgtggaggtggccggggcaagcacgaccaatgggacggccgtgcagatcaacgattgcaacggtggtcccgcgcagtcgtggacggtgggtaccgacggcacgattcgtgctctcggcaagtgtctggacgtgacagggcaatatacggccaacggaacgaaaatccagctctgggactgtaaccggcagaccaaccagaagtggaccgtgcggccggacggccacatcatcagcgcggcttcgggccgggccctggacgtcccggcgggtagcacgaccaacggcacccagctgcaaatctgggacgtcaacaccaacgcctggcagaaatggaccctgtcgggaggaggaagcggacccaccaccggcccgacgaccggtccgacgacgccacccaccgggccgggcccgtacaccccggcccaggtactgtccggcatccagaggaacatgacggctgccaggcaggtcaactccaagccgcacatcaacaccatgacgcgggcccggaacgtcaacgtctaccaggtggcgtcgggcgtgtacgcctacacctccggcatggccatcgacacggacggcagcgaccccgatcccgaccccgaccaccagggcgagaccaccttccgggacagcaacggtcagtccctgggcgctcaccacgtgccgttctacgtcctgggtgacgactgctgggaccgcgtctcgccctgcccgcacttcttctacgaagagcacggcatctccgggcggcagttcgcgctggccttctaccaaggcaaggtcatcggcgccatcttcggtgacacgcagaccgcgaacgaccagaccacctcggacaacgactcccgcgagctcggcgaggcgtcggtgaaggcggcctcgctgctcggcatccccagcagcggcaccagcggcggcgtcgacaacggcgtaaccgtggcgatcttctccggttcgtcctggatcgtgaacggcaccaacgccgacctgaacgccaatgcccaggccatggtccagaaggccctcaacagcctcggcgccggcatgggtcgatag

SEQ ID NO: 6297 - DNA, 390 bp, Actinoplanes utahensis
atgtcgggcgacaccgctgcggacccggtgagcgtcgagctgcgctgctccttctgcgcccagccgagctccgaagtcgagaagatcatcgccgggccgggcgtgtacatctgcaacatctgcgtcgacctgtgcaacgacattctcgggtccggcgacgacgacccgctcgcatcggctgcccgcatggccgctcgggagaacgggatgaccgacgcggaaatcctcgacctgcttccccgcatcgtggcggtcggcgcccagtccgaggcgagcatccagcggctggtcacgatcctgcgcaaccggaaagtcacctgggcgcggataggcgccgccctgggcatcacccggcagtccgcctgggagcgattctccggcgaacagtga

SEQ ID NO: 6298 - DNA, 1431 bp, Actinoplanes utahensis
atggcagcacgcagggtttggggatttctcgggggcaccacggttgccgtcgcgctcgcagcggtgacctacaactccaccttcgggaacgtcttctacgtcctcctgtacggcgcgctgaccagtgccgcctggctggcgatgcgccgggtgccggccgggccgcagcgccggccgtggctgctggtcgccgtcacgcagaccctctggttcgccggcgacgcgaccgagctggcctactactacctggcgaaggtcccgccggtcggcctgtccgacgtctgctggctcggcgggtacgcggtgctcaccgtggcgctggtactgatggcccgccgccgggcccccggccggctgcgcggcgcggtcctcgacgcgctcaccctgaccgcggcggccgccctggtcagctggcagttcctgatcgagccgtcgctgcggcagggctactccacgggggcgtcgatcatcccggcgctctacccggtcgccgacgtcgtggtgctcgccgcgctgctgttcatcgccctgtccccgggcacgcgccaggcgccgacccgcctgctgttcggcgcggtcgccctctacctgtcgatcgatctcatcaccaacatcgggttccatttcctgtcggacgggctggtggcccgcgccggcagcctgatcatgctgggcaacgccctgctgaccgccgcctgcctgcacccgaagcgcgacgagctgacccgctccagcgcccaggtccgggtgctgcacccgtcccgcgtcctgttcctcggcgtcgcgttcctgaccgcccccgtcctcaccgccgtccaggacggcctggccaagaacgcggtggccaccctgctcgccaccgccgccagcacgatcttcgtgctgacccggttcaccctggccgtgcgcgagcaggagcgggcccaggcgcagctctcccaccaggcgcaccacgacccgctcaccggcctggcgaaccgcgccatgctcactgacgagatggaccgcggccgccccaccggtgtcgccgtgctctacctggacctggacggcttcaagcaggtcaacgaccgctacggccacgaggccggcgacctggtgctgaccaccgtcgccaaccgcctgtccgccgccgtccgcggcaccgacctggtggtccgcctcggcggcgacgagttcgtgctgttctgccccgacctgccggcgccggacgccatccggctcgccgagcgggtggtcgccgacgtggcccggcccatcccgttccagggcagccagctggacgtcggcgccagtatcggcatcgccgcctacggcgccggcgagcaggcccacgagcgggacgcgctgcgcgccgccgacgccgccatgtacgaggcgaaacgccagggccgcgggcgctgggtgctggccactaccctggcggcgtga

SEQ ID NO: 6299 - DNA, 1722 bp, Actinoplanes utahensis
atgagcatccagttcgagaccggcggcgtgcccggcgtgttcgtcgcgtcggccggtccgctgcgggccggcctgatcttccgggtcggggaggtcgacgagccgctcgcccggcgcggcgtcacccggctgatcgagcacctggtccggcacgctgtgaccgatgcagatcaggatgatgcgaccgcgccggacctcaccgagttccacaccgaggggtccgccgagcaggtccgcgccttcctggccggggtctgcgccgcactgcgcgagctgccggccgaccggctggcggtggcgcgggacctggtgcacgccgagtacgccgcccgccacgacggggcggccgccgcgatgccgatctggcggcacggcgcccacggctatgggctcacggcgtacccccggttcggtctggacggccttcaggccgaagatcttaaaatctggacgaacgactattttgtacgcggcaatgcggcgctgtgggtgagcggcccgcacctgcccgccgatctgggcgtcgacctgcccgccggggaccgccggccggcgccggccacaccgaccctgccggccactcccgggtatttccccgggccggacggcgtaatcgtgtgggacgccgtggtgccgcgcgagaccgccgccgtcgtcttcacccagctgctggcccgcgcgctgcatcgcacgctacgcgtggacggcgggctgtcctacaccgcgacggccggctacgcgccgcgcgccgacggcaccgcgctgatcaccgcgctcgccgacggcctcccggagaagcaggacgccgtgctggccggcctgctcggcgtgctggaccggctgcggcacggcgacatcgacgaggcggagctcgccacggtcgtcaccctgtgcgccgacgggctgacgcaggccgccgggcagggcgccggggcgcggtcgcaggcgatcgacctgttgctggggcgtccgccggccgagccgaacgagctgctgtcggagacccgtgcggtcacccgggcggacgtgacccgggtggcgcgcgcggcgttcgcggccggtctgctgcagaagccgggccgcccggacaccggaccgcccggctggactccggccccggtcgcctccaccgccccgatcgacggcgacgtcttcccgtcgctcgccgacccggcccggacccgcgtgatcatcggcgccgaaggcgccagcatggtactgggcgagaccgccgctaccgtgcggttcgacgcctgcgccgccgtgctggcctggccggacggcgcccgccggctgatcggcgacgacggcgtcacggtccacctggaaccgacgatgttccaccgcctcgccgccgcgatcccgactctcgacggtcgtgtcccggccgggctgcgggccgcgatggccgtccgcgacccggcggccgtgccgcagcctcagctgcggctgcccacgatcaccgcgccggcgccgccggccggcgccttcaccggcccgccgccgtcccgctggacctggcgcggctacctggtcaacctggtcctctgcgtcggcgtgatcgccgggttcgccaccggcgccctcgacccggcgcaggtgcgggccccgtccggctcgcatccgctggacaacctccccgcggtgctgatcgtggtggccatggtgggcgcccgcgccgtctgggccgcccgcggactgctgcgcctctaccgacactga

SEQ ID NO: 6300 - DNA, 1002 bp, Actinoplanes utahensis
atgggccggccgaccgggactgacaccctccgcggtgatcacctatgctctgcgctcgtgctcgacagcctcgccgtccgcctctccccctccgcgccctatccggaggcccgggccctgctccgcgacagcgatttccgggccgccgacgccgccgacccgcaggcgcgcacccggctcctgcgcctctacgcggcccaggcgaaacagccggtgccggcggacccggcggatccgaccgcgtcggcggttcgcgccttccagctgatcgagcagggctggaacgtccgcggcggcggccgggcccggaccgtgacggcccgccagttccgggtgttccaccggtacctggcggaggcggagcgcgtgctgcacgccgcgctgacccgcacgccgcacgacctcgcgctgtggacggcgagcctgctcaccgtccgcggcctggagatggggctggaccacgcccgctaccggtacgcgtgcctgtccgctttcgatccgcaccacctgccggcccagtcgcagctgttgcagcagctgtgccccaagtggagcggctcctggccggaggccgaggcgttcgtccgcgccgccatgcgcgccgcccccgagggcgcccacaacgcggtcctgctcgtcgactactacctggagaaggccgacttccgggggctgcgggcggacatcgaggaggccgccgggcgttcggtgtgccaccccgcgttcgcccgcaccgtcggctgggtccaggtggtcaactcgttcgcgctggcgttcagcaaggtcggcgaccgggcgaacgcgcggcggatgttcaccatgctcggcccgtacgcgtcggagtatccctggtcgacccagtcggccgaggtcacggccgcgttccgacaggcccggatgcgtgccttcggcctctccggcgggctgcccgggatcgccgacctgctgctggtcgcggccgcgccggcggtcggcgtcgtccgccgctacgtcacgagatag

SEQ ID NO: 6301 - DNA, 642 bp, Actinoplanes utahensis
gtgagggtgcacaatctcgcggtttcgctggacggtttcgccaccggtgaggggcagaccctggaggcgccgttcgggcatgccggtgggcggctcatgcagtggttcttcccgacccgcgcgttccagtcgatgaacgggcaggacggcggcagcgagggcgtcgacaacgcgttcgcggccgcgtgggggccggggatcggcgccgagatcatgggccgcaacaagttcgggccgcaacgcggcgcctgggagaacgaggagtggcagggctggtggggcgacaacccgccgttccacaccccggtcttcgtgctcacccaccacccgcggccgacgctcaagctggagggcggcaacgtcttccacttcgtggacgcgtcgccggccgaggtgctcgcgcaggcccgggaggcggccggtggcctggacgtccgcatcggcggcgggccgaccacggtccgtcagttcctggaggccgacctgatcgaccatctgcacgtcgccctggtgccgatcatcctcggccggggagtacgcctgtgggacggcctggagagcctggaggaccggttcaccgtcgagtccgttgcctccccgagcggcgtcacccacctgaccttcacccggcgcccggcgtag

SEQ ID NO: 6302 - DNA, 462 bp, Actinoplanes utahensis
atgaccgacacctggtggtacgacgatgaccagctcctgcacgccctgagccgagccgtggccgcaccggaccgcaccccgacggaggtcttcgaggccgcccgcgccgtcttcacctggcgcaccgtcgacgccgaactagccgaactcgtccacgactcggccacccgcccgcccgagctggccggcctgcgcgccgaggaggccgacctgcgcacgctcagcttcgaggcgcccgacctcaccatcgagctgggcgtcgccccggccgccctgctcggtcagctcgtcccggccgaaccggccagcctcacgctgcgcctggcggacggcaccaccaccgccgtcccggtcgacgaggacggctgtttccgcatcgctccgcggccccgcgaccgtttcacgctgacctgtgaaacgccggcgggccgccgcatcgtcaccgcggccctgaccctctga

SEQ ID NO: 6303 - DNA, 627 bp, Actinoplanes utahensis
atgaccgccgtcgaccgcccgcgcgcgggcctgccgccggaaccggccgacctggtctcgctcgtcacggccgcggccgccggcgacgaagcggcctggaacgccctggtggcgcggtacgcctccctggtctacgccacctgccggcgctggcggctgaccgaggccgacgccgccgacgtgagccagacggtgtggctgcgcctggtggagaacctgtcccggctgcgcgagccgcaggccctgcccggctggctgaccaccacgacggcccgcgaatgcacccggctgtaccactgccggcagcgcgaacacccggaggatgtggagtcccggctggcccgcacccccgccgacgacgacggcccggtcgaccgggacctgatcgccgcggaacgcgacgccgccctgcgcgccgccttcgccgaactgccggagcactgccgcagcctgctcggcatgctgatgcgcgacgagcccgtcccgtacgccgagatcagcacccggctgagcatgccgtgcggcgcgatcggcccgacccgctcccgctgcctggaccggctgcgccgcaacccggccctgcgcgccctgctcaccgacgccgaaggcaacgaggagaagaaatga

SEQ ID NO: 6304 - DNA, 894 bp, Actinoplanes utahensis
ttggtccggccgagcgctgcccgccgacgccgacgtcctgcccgaggtcgagggctcccccggggccgccgcactctgcacgacggcctggcccggctcgacggcgaccgcgggcgcggcgccaccgtggcggtctgcgacacccggctgtggggcgacggcgcgctggccggcgcctacctcgccccgccggccgcgctgctgcccccgcccggcccggacggtgtcgccttcaccgccgggcacgccctgttcgtcaccggcatcgtgctgcgcagcgcgcccggtgccgccgtggtcgtccaccccaccctggacgaccacgcccgcggcaccacctggcagttcgccaacgacctggtcgccctcgccggccgcggggtggacgtgatcaacgtgtcggccggcttcttcaccggcgacgaccagcccgccctcgcggtcaccacggcgctgcggctgctcggcccgcggaccgtggtggtcgccgccgccggcaaccacggcgagaacgagcaggacggccggcgcccgatgtggcccgccgcgtacgacgaggtggtggcggtcggcgcgctcaccccgcagggcatgccggcgacgttcagcccggacgcaccgtgggtggacctgctggcgccgggtgtgaacgtggtcagcaactacttcggcgacgcggtgtcggtggtcgacccggacacccccggcacgaccggccgctatccggggctggcggcctggagcggcacgtcgttcgccgcggcctgggtctccggcctggtggccgcccggatccggcccggcgagacggacgccccggcggcgctgcaccggctgctgcaggacaccgcggccggcaccaccgcgacgatgatccccaagtggtcggcatga

SEQ ID NO: 6305 - DNA, 1080 bp, Actinoplanes utahensis
atggggcgtgacccggtcgctgagcggctctgcgacgaggcgctgtcctccgtcgacgcgcagccccggcgggcgtggggactcgccgagcgggccctgcggaccgctcagcgcgccggcgatccggagtccgcggcggtggccgaacgggcccgcgggctggccgccctgcacctggccgacctggacaccgcactgcgctgcgaacggggcgcggtccggctggccgagcgggccggcaacccgacgctcgccgccgaggcccgaatgaccctggcgttcgtgctgggccgccggggccggaccggcgacgccctcgccgtgatcgaccaggcccgcgccgacctgcacggggtgcagcgactgcgggccaccgcccagcgcggcgcgatcctgcagcacgccggccggctcggcgaggccctggacgcgtaccgggagacgctgccccggctgcgcgcggccggcgacgcggtgtggacctggcgggtgctcaacaaccggggcgtgctcaacgtccagcggtaccggttcgccgaggcgctggccgatctgcaggacgccgaacggctcagcgacgcccaggacctgcgcctgctcggcgccacggtgcgggagaacctgggcttcgcgctcagtcggcagggcgagatcccggcggcgctgcgctacttcgaacaggccgagcagcggtacggcgtactcggcgtcaacgtgagctcgctgctgctggaccgggccgagctgctgctcgcggtccgcctcgcccccgaggcccgggtggtcgccgaacaggcggtcgccgagctgacccgcacccgcggccggttcaaactgccggagggacacctgctggtggccaccgcggcccagctcgccggggactgcggggcggccctgccggcggcccgccgggcggccgccgccttcgcccggcagcagcgcaccgactggagtgcggtcgcccggctggtcgccctgcgctgccggctcggcctcggcctgaaggtcgcggtggccgacctggtccgggtggcgcgcaccctggagacggccggctggcggctgccggcgctctag

SEQ ID NO: 6306 - DNA, 1020 bp, Actinoplanes utahensis
ttgacggcgctgctgggcgaggcggcgatcatcgagtacgtggagtccgccggccggctgttcgccctgctcgtggcggacggccgggtgctgctgcgcccgctcgggccggccgcccggatcgccgggccgctggaacgcctgccgttcgcgatgcgccgcgcggcctgcgggaccggacgcggcccggaagccgccgggcagctcctggccaccctgggcggccggctcgacgacttcctgatcggcccggtccgcgacgcgctcggggaccgcccggtggtgctggtgccgaccggcaccctgcagtcgttgccgtgggggctgctgccgtcactgaacggccgaccggtcaccgtcaccccgtcggcgacgctgtggtcccaggccgccggccggccgcgccggaccggccgcccgctggtggtcgccgggcccgacctgcccggctcggtgaccgaggcggcacagctgggccggctgtacccggccgcgacgaccctgaccggcagcgccgccaccgccggggcggtactggccgcgctcccgcacgccgacatcgcgcacctggccgcgcacggcagcttccggcgggacaacccgctgttctcctgtctgcggctggccgacggcccgctcaccgtgcacgacctgcagaccctgcccgcggtgccggaactggtggtgctcgccgcctgcgacagcggcctgtccctggtctgccccggtgacgaactgctcggcttctccgcggcgctgctggcgctgggcgcccggtcgctgatcgcggcgatgctgccggtgcccgacgaggcggccgcggagctgatggccctggtgcatcagcggctcgccgccggtgagccgccggcggtggcgctcgccgcggccgggcgggagctgacccgctccggcgggccggccgagcgggtgaccgcggccggcttcgtctgcctcggcgccggactgcagccgatcaggtgcggaaactccgggtcaggtcgttcagcgcctgactga

SEQ ID NO: 6307 - DNA, 1578 bp, Actinoplanes utahensis
atgcgccccaactttcgcgatttgtcgctcggtttccagctgtgggccggtttcgggtcgctcgccctgctgatgatcgtgctggcggtcagcgccgggcaggtccgggcgaacgtcgaccggcaggcccgccaggtggtcgagcagatcgaccccaaggcccgctcggtggcgctgctgcagttccggttctccgacgcgtacggcctgcagaccgcgtacaccgcctccgaccacgaactcaagcacggcttcttcaccgaggccaaggcgaaggtgtacgcggtgctcgccgacgtgcgcaagtcggcctcgaacgacgcgcagcgacagcacgccgccgatttccaggccggcctcgacgacttcatgacgatcgacgaccaggtgtggacggccgtgcagcagggccggtacgcccaggccacgcacatcagcaacgtgaccgagtcgggtccgtacctgaaggcgatggacgccgccgccaagttcgacgactcggtgaccgccgaacgtaccgccgcactggcgacgttgacccggacccggagccacgcgacggtccgcgacctggtgctggccaccggcgcggtgctgctggccctgctcgccgccacgctgctcacccgctccatccggcggccgctgcagcgggtggtcgcggtggtggaccggctcgccgacggtgacctgacccagcgcaccggggtgcggcgcggcgacgagatcggccggatgagcgcctcgctggaccgggcgatcgaccggatcgccgggacggtcaccgggatcacctcgcacgccgagcaggtcgccgccgcctccagcaccctgaccggcatgtcccaggccctgcaggcggacgccgaccaggcgtcgcagcagatcggcatcgtcgcggacagcgccgccgacgtgtcccgcaacctggacacggtggccgccggctcggagcagatgggtgccgcgatcgccgagatcagtcgcaacaccaccgaggccgcgatggtggccagcaccgcggtcgacacggtcggtcaggccggcgccacggtgtcccggctcggtacggcctccgccgagatcggcgaggtggtccggaccatcaccacgatcgccgagcagaccaatctgctggccctgaacgcgaccatcgaggcggcccgggccggcgagatgggcaagggcttcgcggtggtcgcctccgaggtcaaggatctggcgcaggagacggcccgggcgaccgacgacatcaccgcccgggtgggcagcatccagtcgcagaccggggcggcggtccagtcgatccagcagatcaccgaaatcatccagcggatcagcgaggcgcaggacaccatcgccgccgccgtcgaggagcagaccgcgaccaccggcgagatgaaccggggtgtcgccaacgccgccgtcggcagcggtgagatcaccgagaacatcgcgggcgtccgcgatgtcgcggaccgcacgcgcgacagcgccgaccattcgcggcgcgccgccgacgagctgacccggctcagtcaggcgctgaacgacctgacccggagtttccgcacctga

SEQ ID NO: 6308 - DNA, 582 bp, Actinoplanes utahensis
gtgcccgctccgtatgcggcgtcgcgacgtcggtggttcatcgcggtgctcgtcctcctggtggtgctggccgtgctgaccggcatcgcgctgcacaagctgtggaaccggccccaggcctccggcgcgacgccgacggtcaccacctccttcggcaccccgtcgacacccccgtcgtcatccgcgtcggcggtggccggcgccgcgccgcagaccgcgtcgacccaccgggtcagtgggacgacggcgccggtggtgaccaggacgaccccgtccgggccggtgatcgtctacttccgggtcagtcagcagccgacctgcccgtccggtaccgaccaggtccagtacccgggcaccccggtcaccctcgcatggaaggtcaccggcgtcgacaaggtgacgctgtcggtggacggcccgggcatctacgacacgtacgacgccaacggctctgccgagatcaacttctcgtgcggcggcgaggcgaactcgtaccagtcccactcgttcctgctgaccgccgccggcaagacccggaagctggtcgtgaaggcgcgggtcaacgagatcgcccacacctga

SEQ ID NO: 6309 - DNA, 798 bp, Actinoplanes utahensis
gtgttcgtattcggggacgatgacccaccgcggcggctgcggctgcccggggtgctggtgctggtggtgatgacggccggcgtggtcgcggtgctgtggggcccggcccggcgggtggatccgccggacgttgcggcaccgccggccgccgtcagcgaggcggagatccgagccgctttgatcaagtcgtaccgggagagattctccaccggcggctacggctgttcgaccgcggtgctgatctccgtcgagggcgcccggcccagcccggcggagctccggcggatggtgcgcgagagccagctccgggattgcaccgccgagatcggcggtgacccacggcgggtgttgctgtccccgccggacggatgggacagccgggccgagcagatcaccgccgcgctggacggcgttctctgcccggcgggcaccgcctgctcggagtgggacccgaacaatccggaggagcctcagcccccggacggggatccgaacgatccggccgagcatcatcggccctcggatggggatccgagcgatccggccgagcatcatcggccggcggatgccgatgtggccgcggtccggcgggcgctggccgcgatcggccatcccgaggccgaggtgaggctggtgcagcccggggacggtggcccgtcgcagacggtgatgtacggcgtcccgctgggacagcaggcgtgcgcggtctcctacgcggccatcggccggcatcccagccggctcggcgccgtcggggcgctgaccaccggccgatgcctcgccccggcgacgggctga

SEQ ID NO: 6310 - DNA, 1440 bp, Actinoplanes utahensis
atgagtgccgcagtcctggaagcacccgccgacaaggtgcacgccacctcgctccgggccgtctggcccgccatcctggggctgtccgtggtcttcctggtggagatgctcgacaactccgtgctcaacgtggccctcccgaggatcgcccgcgagctgaacgcgtccaccgccgacctgcagtggatcacctccgggtactccctgctgttcggcggcctgatgatggccttcggcgcggtcgccgaccgctacggcacccgccgcatgatgctgatcggcctgtccctgttcaccctcgccaatctggccgtcctgctggtgcgcacccccggcgagctgatcgcggtccgcgccgtcgtcggcgtcaccgccgcgatgaccgcccccggcaccatggcgctctgcttccgcctgttcgacgcggagaacctgctgatgcgcgccacctcgctgatcgccacggtcggcctggtcgggatggccgtcggccccaccgtcggcggcctcgtcctgcaggtcctgccatggcagacgctgctggtgatgaacgtcccgatcgccgtcctcgcgctggtctgcatccgccgcggcatccccgccgacgacccggccgcccgcaacagcaccccgctcgacctgcccggcgccctgttcggcaccgccaccatcatcctggccctgtggaccgccaccctcgccgtcgaggacggctggtcgcaagccgccccgtggctggccggcctcggcgccctcgcctgcgccgccgccttcgtcgtccgcgagcgccgcaccccgcacccgctgttcgacttcgccctgatcaagcgtcccgcggtcggcgccagcctggcctacgaggcggcactcggcctcggcatggccgccgtgtcgtacagcgcctcgctgcagttgcaggtggtctggggttggtcccccgccgaggccgcgctcggcaacctcccgcaggtcgccgtgatgctggcgatcggcccgttcgtcgagaagatcgtcgaccggctcaccacccggatcgccgccccgctcggcgccggcgcggtcatcggcggcctgctgatctacgccctgctcggccgctacgactacgtctggatcgccatcgctttggccctcacggccgccggcatgcgggtcgtcgccaccatcgccggcgtcaccgtgatgcgcggcctccccgaggaccagacctccaccggcgccgccctcagcgacaccagtcaggaggtcgccggcagcatcggcatggccgtcatcggcaccatcgtcgccgccgcggtcagcggctccctcaccggcgtcgacaccagcccggccgccgcgcacaccttcgagaacgcggtcacggtgtccaccctggccctcaccgcgatctgcaccatgctggtcgtctgggccgcccgccgcgccgccaaagcctga

SEQ ID NO: 6311 - DNA, 720 bp, Actinoplanes utahensis
atgcggaacacggatcggcgcgcggacgctctgtccaaggaacggatcatcgaggccgccgtcgagatgctggatgcggcgggggagagcgggctgaccttccgggcgctgagcgcgcagctcagtaccggggcaggcgccatctactggcatgtggcgaacaagggcgagctgctggtcgccgccaccgacacgatgctcgccgcggcgatggcggtcgaggacgcgccgcgggcgccggccgcggcgatccgggccatcgcgctcggcgtgttcgacgccgtcgaagcgcatccatggatcggcgaccagatgacccggctgtccgggcagtcgtcgacgctccggatcttcgaacggatcgggcggcacgtgcaggccctcggcgtgcccgaggcggcccagttcgacgcggcgtccgcgctgctcaactacatccagggggtggcggcgcagaacgcggcactgtcccggtcggtgacgcaggggacggaccgggccgacgtgctcgaaacggtgtcggcgatgtgggccagcctggacaccgacgacttcccgttcctgcggacgatcgccgggaaactgcgcgaccacgacgaccgcgagcagttcgtcgccggcatcgatctgatcctggccggcatcgagagccgctggccggccgggccccgggggcttccgcgagacgttggcggcgatcggcaccctgatcggtgttga

SEQ ID NO: 6312 - DNA, 771 bp, Actinoplanes utahensis
ttgtcgatcgagcccgataccgtcccggacatgggcatcaggtactcagcgctcctgcgatggggcgccgcactcgtcaccgccggcgtggcgtcggccggctgtgggaccgtctcgctccagggcgagtatccggcgcgcgacgccgagcaggcggcacggcggctcaatgacgacttcggttaccgtgaccgccttcggcaggcggagtacatcgccgccaccgagatacccaccacggcacagggcggcaacagcgaggtcggcgagacaccgctggcctggtccgggcgggtcttcgccgacgagaaggccaccatcgacatccgcttcgcagtgcgatcgcccgattcggcgcccaccgaggagttgacccggtgctaccgctacacccttcagttgtaccgctacaccagctatgacgaaatcgcctgcccggcggtcgcaacgccaccggcgccctcggcctcgccgccgctgaagttgccgcccgacgccgaggcccgactgagcgccgcgctccgtgacgccacacccgaaacacttgccggccgcgtccgagccgccttcccccatgagggcatcacggtggacaccgtcaccgacaagggcaccctggtcgccgcggtgggtgtagccgccgagcgcgaatgcaccgtcgtgatccggaaaacggacggtaggacgacgccggtcgccttccgcgccaggcaactcgaacccggcgagacgggctgccgaaccagcctgtacacacacccggcgcagtag

SEQ ID NO: 6313 - DNA, 534 bp, Actinoplanes utahensis
atgatcatccgaccgatgcgccccgacgacctgctcgccgttcaggacatcgagcgctccgccggcgagcagttccgcgacatcggcatgcccgagatcgccgacgacgacccgttcaccatcgacgagctgacccgctacctgcgcaccgggctcgcctgggtggcggccgaccccgatgatcgacccgtcgcctacctgatcgccgacccggtcgacggctgtctgcacatcgagcaggtgtcggtcgatcgccgccacgcccgccagggcctgggccgccgcctgatcgaccacctcgccgcccacgccgcggccgcgcggatcccggcgctgaccctgaccaccttcaccgaggtgccgtggaacgcgccgtactatcgccggtgcggtttccggcagctcggcagcgccgagatcactcccgggctgcgcgccgtccgcgcccacgaggccgcgctgggcctggaccgctggccccgcgcctgcatgcgccggaccgtggagtggtcaccggccggaagcggcacctga

SEQ ID NO: 6314 - DNA, 1209 bp, Actinoplanes utahensis
atgttggttatcggcctgtcggcgcgatgcgcgctccggtcaggacgtcagcgcgtgccggatgggcggaagcagatgtcgtacgctgccggcgtggtcagcctcgctaccgtgatcaagcaatggggccggatcgggtgtctcggcttcggcggccccccggcgcacatcgcgttgttccgccaactgtgcgtcgaccggcggcagtggatcgacgcgcgggagttcgaggacgccatcgccgcgtgcaacctgctgcccgggccggcctcgacccagctcgcgatctactgcgcgtggcgggtccggggccgggccggcgccctggtgggcggcctcgcgttcatcgtgcccggcctggtcgccatcctcgccctggccgcgctgttcctcggcgacccgccgacctgggtgcgggccgccggcgcgggcgccggatcggcggtcgcggcgatcgccctgcagtccggggcgatgctcgtcccggccagctggaaacgggcggtacgcgtgcggtgggcggcatacctgctgctcggcgcggtggcggcggcaaccgtcgggccgtggctcgtactggtcctgatcgcgtgcggcatcgccgagatcgccgcccagcgcctgcccgtttctgatcagcgaccggcgccgctggtcgcggtcttcggcggcgcggcgctgctcccgctggcgtggaccgcgctgaaggtcggcgcgctctcctacggcggcggcttcgtgatcatcccgctgatgcaggccgacgcggtcgggcagcaccactggatgaccgccgcggagtttctcgacgcggtcgcgctcgggcagatcacacccggcccggtcgtgcacaccgtcgcggtcgtcggctacgccgccgccggcctgctcggcggactgctggccgcggccgtcgcgttcagcccgtcgttcaccttcatcctgctcggcgcgcaccgcttcgaccggctccgcggcaaccggcgggtcggcgccttcctcgacggcgccggcccggccgcgatcggcgccatcctgggatccgcggtccccctcctgcgcgccctcaccgagccctggcagtacgcggtcttcgccggcgccgccgcgctcgccctcgccctgcgccgcggtccggtcctcaccctgctcgcggccgccaccgccggcgtcgccatcgtcctggccggaggtccactcccgcgatga

SEQ ID NO: 6315 - DNA, 327 bp, Actinoplanes utahensis
atgccggacgtcgcactgccgccgttgtccgctgccgcctgggctctggtgggcggatcggtcgtcgaggcgctcgaactcgccggtgcactgcgccgggcgaaggcgctgccgtggaagcgtcccggcgagccgagacttcccgcatacctgctctcggtggtcctccggctcgccgccggagccgggctggccgccgtcttcggcgcggacggtcagctcggcgggccgttcgcggccggctcactgggcatcaccgctccgctgatggtggagaagatgctcagacaggtcggcaaacccgaggtcgaggacggcaccgcctga

SEQ ID NO: 6316 - DNA, 858 bp, Actinoplanes utahensis
atgccggccggggacccgtcgttcggccgtcaactgctgttggctctggccagatccacgcccgcgttccacccggcccgggaggctcggcgggctgacagcacgctcctggacgcggtcgctcgacgcaccccggccttcaccggcgaccagccccatccggacccggtcccgttccgcggcacgttcgccttcgcccggcccaccatggcgcgccgcgggtcgcgatcgctggccccgctgctggccggcctggcaacggtgctgttcgcggcggtcggcagcgcggtgctggtggccggtgcgggcggccaccagcccaccctgccccttcccggcctcaccgacgcgaccggcaccgccaccaccggcggcccgccgcctgacgcgagtgcctcacccaccggcagcgcggcggcccagggcgccgccatgaaccagttgctggaccgcagcagcgcatcccgggccgagctgaacgccgcgatcatcgcggtgctcgcctgcgagaaggtggacgacgccgtcagcagactgcaggccgtgggcgtcgagcgcgacgaacagcggtccacgctggcgagcctggacctctcggccatcccgtccggcgaagcggcgcgggatgcgctgagtgccgggctcacgcactcgctgaacagtgacgtggcctatgtgaaatgggcccgggaaagaaacagcgccgggtgcgccgacaccccggccgccaaggtctaccggcaagccgctgatcacgagtccgcgtcctccgccgtggccaaagagcagttcctggccctgtggaacccgatcgccgtctcgctggggctgccgtcccgcggtcgccaggacctctga

SEQ ID NO: 6317 - DNA, 96 bp, Actinoplanes utahensis
gtggtcggcgcgggcgcggtcatcgccaaggatgtgccgccgctgagcgtggtgaccgccaccagtttcgtcgagcgcaaacgcctcggcgagtag

SEQ ID NO: 6318 - DNA, 2127 bp, Actinoplanes utahensis
atgtccgctcaccctggagccgtcccggtgaccacgccacctgaacctccgccgttgccgacggctcaggcgcttcaactcggtgcccacaacgtccagtacaacttctccggcggtgcggtgccggttacctggccgtgccgggccggggtggtgccgccggaggcggactgccggcagagccggccggccgaccagacgctggccaggccgtcggcatcgcgcgagggcacggtcgctcaggtggtcaccggcatgggcggagtcggcaagacgcaactggtagctcacctggcgcacgacttgtggcggaaacgcgaggtcgatctcctggtgtggatcaccgcgacttcccgacggaacctggtagccggatatgccgaagccgcgctgagggtgttcggcatcgaggagggtgacgtggaccgtgccgctcagcggttcctgacctggctcgccgagccacacggccaccggtggctgatcgttctcgatgatgtctcggacccggcggacctccgatacctgtggccgccggctgaagccttcggccggacggtggtgaccagtcggcgccgggacaatgctctgtgggccgggcgacaactgatcgagctgaccgtgttccgtcctgccgaggccgaggtctatctgaaggcgaagctggcggcccgcccggcagctctcgacggcgccgccgaccttgccgccgctctcggtcatcatccgttggctctcgcccaggcggccgcctacatccttgaccgcgggccgcgaacgtcctgctccgcgtatcggaagctgctcaccggccggcggcgccggctgtcagacctggccccggacgccctgcctgaccagcagggggtgccgatgtcggcgatctggactctgtcgatcgagcaggccgcgcgactggccccggtcggcttggcacagccggtgctcgaactcgccgccctgctcgatccgaacggcattccgatcagcatcctgacaaccacgtcagtctcagcgttctgcgccgagcgggtcgatcgcgagatcgacgccgacacgatcgatgaggcgctgcgcctgttggctcggttcaatctgctgtccctcgacgatgcgaccgagaccgctcacatccacgcaatggtccaacgggccgtccgcgaaacactgactccggacgcccgtcggcgtctgtcgacctgcctggccgacgccgtcttcgaacagtggaggaccatgcgccgacgagaggatgcgatggctgcgaatgtgatcgcactcgtggaagcaaccgacctggatctgtgggacccggagggcaacctccatccggtgctctaccgcaccctgcatcgcatcgccggtgagggcgagcaaccgtcgacgagcttcctcgaccacctctaccgtagaacggtcgagcatgtcggcatcgaccacctgagcacgctgcgactccgcatctacctcgccgtccgtcgtggcgcttcaggcgacatgtcgggcgcggtcgacgacttcgaggcgctggtcggggattgtgtccggacgcttgggcaagatcatgatgaaacgctgaacgtccgccgcaacctcggcgagcacaaggcgcgcgccggagacacgatcgggggaatcgccgacctggaggcggtgttggtcgactgcttgcgcattcagggagccgaccacccgaacaccctcggtgcccgcttcaacctcgcgaagtggcgcggccacaccggcgacccactgcggagcgccggggaattcgacaatctggtggcggctctcactcgggaactcgggccggacgacagcaacaccctggcggcccgatggaacgctgccagcttccgaggaatggcgggggaggggcggccggccgtcgaaatgttcaccgcgctgactcgcgactatgttcgcttggcgggccggaatcatcccgtcaccctcgaggcccgccttgaactggcgaaatggcgcgctgtcgccggcgacacctcggatgccatcgctgaccttcgcgctctggtggaggacatggtgcgggttctgggcgcggaccacgcccagaccaggaaggctcaggatgatctcgacggcttggtgaattcgcctatctga

SEQ ID NO: 6319 - DNA, 264 bp, Actinoplanes utahensis
atgacactgccccggcccggtgacatcctccgcgtcggcagcgcggccagcgtgcagttccggaaacccatcctgctccgggtcatccaggtgcatgactggacgacgtacgacggctggatctggataagcgggtactccatcgacccggccgggcgcgcgatcgagcggcgcaccatcttcgtgcagttcgacggcctgcggacgatccccgcgaaccggttgccgatcgcggacgcggcggaccccgcctccgcggaatga

SEQ ID NO: 6320 - DNA, 855 bp, Actinoplanes utahensis
atggcgcgcccgatcggcccgaccatcccgcgctggcagctcggcgagcagttgagtcagctgcgcacctccgccggcaagtcgcagcaggacgccgccaaccgtctgggctgctcgatcagcaagatccagaagatcgagggcggcgaggtcggcatgaaaccggtcgagctggaagccctgctcgtcctctacggcgccccggacgcgctgagcggccagttgcaagagctgcgcaccctcggcgcccagcgtggctggtggtcgaaatacggtgccgtctccgctccgttctccacctttctgggtctggagagtgccgccaccaaaatcaggatcttcgagccgctcatggttcacggtctgctccagaccgaggcttatgcccacgccttgaccgaggcctccaatccctcgatgccggatactgaagtagaccgacaagtccggattcgcctggagcggcaggaccgggtcttcctggaggagccgccggagatctgggtcgtgctcgacgaggccgttctccgccggcagatcgggagtccgcaggtgatggcggaacagctcaaccacctgctgcgcctgccgaagcgggtgaccgtccaggtggtcccgttcgccaacggcagctacccgggcacgctgggcgccttgacgttgttcgagttcgcggaagagttgcacagtccggtcgcctacgtggaatcccaggcaggcaacctttacctcgaacgggaagacgatctggcgcggagtaacgtctccttgaaccacatcaccgcggcggcactcagtaagcaggagtcccgtgagctgatcgccgcggtcgcccgccagctcgtaccgcagtag

SEQ ID NO: 6321 - DNA, 219 bp, Actinoplanes utahensis
atggacaagtaccacgtcaatcttgccgacgcgcagtggcgcaagtccaccaagtccaacgccaacggcggatgcgtggagatcgctcaggttgacggcttcgtcgcgatccgggactcgcggaatccggatcgtgagccgctgatcttcgacgccaccgagtgggactgcttcctcgacggtgtcgcgaagggtgagttccccgttccgcgcccctga

SEQ ID NO: 6322 - DNA, 2247 bp, Actinoplanes utahensis
atggctgcgacgctgggctcccgcaagcggaagatcgatcggaccgtccggatgacggtgttcctgatcggtgtgctggtgctgatctccagcgtggtgacgagcgtgctcgcggtgcgccgcggccgggtcgacgcgcaggaccacgcgctcgacgtcaccctggggcgtcaggtggaggctctgcagaactacttcgagcgggcccgcgcgatcgacgcggtgctcgccgacaacccggtgttcagcgactactacgcggcacccgccacccccgccaagctgcgccgggtcaacgaggcgctcggctacctggagaccctcttccccgggcggatcggtgaggcctgtttcatcgacagcagtggcaccgagatcgcccgggtcgtcgacagcaccccggccggccctgacgacctgtcgcgggacgaggacgacaacgccttcttcgcgcccaccctggcgctcgaaccgggccaggtgtaccaggccaaggagtacgagtcgacggacacccacaacgcggtgatctcgaactcgacgaccgtgcgggccgccgggcacaccgggatcgtgcacttcgagatcgccctggacagtttccggatggccggcaccaccggctcgatcgccgcgtcgatcgtcgacgcgcagaccggccacgtcctggtcgacacccgcaccggcagcatccccgccgccctgccgcccggcgccggcgatcacggtgtgaccacgctgggcgggcggcggatcgcgtaccagcggatccacgccacccgcggcaacgccaacgactggtatctcgcggtgtccgcgcccgccttcggccgcggctggacccacggtctcagcatcggatcgctcgcgctgctgctcggcgcgctgctgatcatcctgatctccgccgtcagcggctggcggtatctgaccgcggtccgccggtcggccacctacgaccggctcaccggcctgccgaaccgcaccctgctcgccgaccgtctcggcgccgcactggacggcgggcagcgggccgccgtgctgctgttcgacctgcagggcttcaaggatgtcaacgacctgctcggcacccggcacggcgacctgttgctgacccaggtcgcccggcggctgtccgcggcggtgccgtccggcgcgctgctggcgcgggtcggcgccgacgacttcgcggtgctgctgcccggcggcgacctcgccggggcgcaccgggtggccgacgacctgctgcaggttctgcggccggctttcaccctcggcgacgtcagcctggacgtcgaagtcagcgccgggatcgcggccgggccggggcacggcgacgacgcggagaccctgctccggcacgccggcagcgccctgcaactggccaccgaacaggccaccggtgtgcacgagtacgagcccgggcaggacgccgacccggcgcaccggctgcagctgctcgccgacctgcgccgcgcgctggacaccgacgaccagctcacggtccactaccagcccaagatcgagctggacggggagcgggtggccggcgtcgaggcgctgatccgctgggagcacccggaccggggccggatccccccggacagcttcatcccgatcgccgagaccaccagcctcatccacccgctgaccacccgggtcctggagatcgccgtccgtcaggcggccgcgtggcgccgcgacggccggctcctcccggtcgccgtcaacctgtccacccgctgcctgctcaacccgagcttccccgatcagatctttcaattattgcggtcgtacgacgttccggccgccgtgctggagctggaagtcaccgagagcctggtgatgaccgacccggagcgctgcctcgcggtcctgcacgccctgcacgcgggcggcatccggctgtcggtcgacgacttcggcaccggccactcgtcgatgagctacctgcagcgcctgccggtcgacgagttgaagatcgacaagtcgttcgtccaggggatggcgaccagccacggcgacgcggtcctggtgcggacggcggtcagcctcgggcacaacctgggcctgtcggtcgtcgccgagggtgtcgaggacgcgacggcggtcgcggcgctgcgtgaactcgggtgcgacatcgcccagggctaccactacgcccggccgatgccggccgccgacttcgaccgctggcacgccgcgttcctggggaagcaggccgccgacctgcaagttgcacagtaa

SEQ ID NO: 6323 - DNA, 981 bp, Actinoplanes utahensis
atgagaccgaagctgctcgcggccctcgccgccctcaccgtgaccctgccgatcggatcgtccgcgcaggccgcgcccgaccccgcgccgaacgggcggatctcgctcgccgacctgcgggaggcgacgctcgacgtcccggcctggcccgcggacaacgtgcggggaccgtctgggcgcctgcacttccaccggggtcaggtgccggtcgagggagggagcgtggcggaggggcaaccgccgtacggtgactcgatcctgatcctgtcggtcgcctatggcgacgtcgatcatgacggtgcggacgaaaccatcgtcacgttcggttgtctcatcgagggcggcagcaaacaggtcgtggtgtacgaccgggacgccaccggcgcgatcatctccctcgggcgggtggcggcgaccaccggaccggtccgggacatccgcgcggacagcccgaaggtgaccggcggggtgctgaccacggccgtcgccgactatcagcggtgctgcgacgaccgtacgccgcagatctggcagacccgcggctacgccctgcggagcggcaagttcgtgcaggtcagcggcccacgaaggatgccggtcaacccgcacgtgacggacgcgtcgatcaccgccggtccgctgacgctcgggccggagaaggacggtttccggtacggcacgaccatcgtgaccgtgacccgtcaccggggtgcgcgaccggaacagttcaccctctcgttcttcccgccggagggcctggaacgctccggcgccggctggccgaaggtcaccgaggagccggactggttccgggtgacggtcccggccccgccgtccgacgacaccgtcagctacccgttcaccttccggcgcccggccgcggccaccggcggtgagctggacatcgagctgggcacggtgccggagatgggcctcgccgtcccgtggaccgcggacgcggcggcgccgattcgtccgtag

SEQ ID NO: 6324 - DNA, 996 bp, Actinoplanes utahensis
gtgctggccgctctcgcggacgccaatcaggggcatgcggagagttatgggcgggacccgttgaccgcccgcctgcaggacgtcttccgcgaccatttcggcccgaccgccaccacctatccggtggtcaccggcaccggggcgaacgtggtggcgctgcaggccgccaccgaccggtggggtgcggtgatctgcgtcgacaccgcgcacatccacgtcgacgagtgcggcgcgccggaacgggtcggcgggctgaaacttctgccggtgccggccgtgcacggcaagctgaccgtggcggcgatccggcgggaggcgtggggtttcgacgatgaacaccgcgcccggccgcaggtcgtgtcgctggcccaggccaccgagtcggggaccgtctacaccccggacgaggtgggcgagatcgccgcgttcgcgcacgagcatggcatggtcgtgcacctggacggcgcccggatcgcgaatgccgccgcccatctcggggtgccgctgcgggcgttcaccaccgacgccggagtggacatcctgtcgttcggcggtacgaagaacggcatgctgttcggggaggcggtggtggtgctcgatccgcggctggatcgggggctggagcatctgcgcatgtcgtcgatgcagctgatgtcgaagatgcggttcgcctccgcccagttcctggcgctgctgcagggtgatctgtggctgcgcggcgcccggcacgccaacgcgatggccacccggctggccgaccgggtgcgggacctgccggggctgacgatcgaccgcccggtgcaggcgaacgcggtgttcgcgcggctgcccgcggacgccctggccacgctgcacgagcagtttctcttccatgactggccgagtggcgaggcgcggtggatgacgtcgttcgacaccaccgcggcggatgtcgaccggctggcagacgccatccgggcggcgtgcccaaatcgggtgaattactcccaacggtga

SEQ ID NO: 6325 - DNA, 414 bp, Actinoplanes utahensis
gtgactcagaagtcgctgcggctggtcggctactgggacgatccggcggcgccggacggctggccggatgtccgcgacttcgtgtgcgcagacgtcgcggcgcaggagcgggacgcggtcatcgcgtatctccgttcggggaccgtggtcgtcgccatgtccggtatttcggtgtgccacctatgcggggtgggcaacggaagcacggaactgaccgacggcgaacatctgatctggccggcgggcctggtgcactacgtggagtcgcatgatgtccacctaccggaggagatcctcgcgatcactcgtcgaggccctgctcggcccgtcgaccctcgtgcgttcgagcgggcgttgctggagacgcacgaactgaccgtcgacgaacagtggtggcgagcgctccggaggtag

SEQ ID NO: 6326 - DNA, 402 bp, Actinoplanes utahensis
atgggggctccggtggtcacggtgtgggtggacggttggcagctggaatgctgcggagagccgttcgcggtgggccaggaggtttcctgggtgctgcgggatctcgatcgcgagtggttggcgagtttcctgggcggtggcctggccggcagtgtcgacaaggcggaggagcatcacgggaacgagccggaaggcgtgccgccgacggtcgggaccgtggtgtcgatcgaggcggtgcactgccggtacgccccgctgtcgccggacgtcaacgggctccatccggtcgccgggtccgggaccacggtatcggtgcggaacaccgcggtggcggggcaggaccggggtgacctcacgttcgtcggctacctggtggggttggccgtggacgagggggcgtaa

SEQ ID NO: 6327 - DNA, 525 bp, Actinoplanes utahensis
atgggttctgagctgggcgctgcctccttgacctatcgggaggtcggtgccacccgggctgagtcgatgccggagggctacgggcacgtgacgcgtgacgtgcggttgggagacggcccggaggtcttccggcgggccggggccgccctgctcggctggcggatgcatgaggaggccgggctcaccgtggtccacgccgacgggcgggccgcggccggggtcaacgtggtcctgcgggtcggcgggagcctgatcggtctcgccattccgtgccgggtggtgtacgcggtcgacgaaccggatcggtgtggcttcgcctacgggacgctgcccggtcatccggagacgggtgaggaggcgttcatgctggctgtcaccgggaccggagaggtccgcttccgggtccgggccttcagccggccggcgtcgctgatggcgcgcgtgggcggcccggtcacccgcctggtccagcagtatgcgaccgatcgctatgtcaccgcgctgcggcgcctcgcccaccggtag

SEQ ID NO: 6328 - DNA, 576 bp, Actinoplanes utahensis
atgttcatcgccgccagcgtcctggctctggtggcgctcgcctccaacgtgacgacggtgagccagctggagggtagggcgaacaccctgttggccgctcggatgaccctcagcgagctggtcaacgcgggagcactctgggccgggctgggcgtgctgtccgggtggctcgtccgcggccgcgcccaggccgtcgtcgccggcatcatcgcactgctcaccgcctgcgtggtgcactacggcgtgggcctcgccctgggcatgttcgatgcgggcgtctgggcggacaactcctcgtggttcctggccgcggtgatcctgggcggaccgctcggcctggtcggcgcgatcgcccgtcggccggacggctggggcatcggggcccggctcgtcgtccccgtcggagccgtgatccagccgttctacctggggttgttcaccacccccgcggccctgccctggccggaccgcgcggccgatttcatcaccgggctgacactggtgacagccggcgcgacgggcggcttctggatcctggccaccggccggcgacagcgcggcagtggcgagccgtga

SEQ ID NO: 6329 - DNA, 600 bp, Actinoplanes utahensis
atgggaacaatctcccggcaacggccccttcggcgcatccgtccaaagtcgatgattcatataccaaagtttcggcatcgggaccggacgaggccgtggcggccttatagaatcgggctgggaaacggcgttgcaaggctaggaaagtgcatggaaaagcagcggaaacggcgattggctcgtctcgggggcgcgctggtggtcattgtcgtcgtcgggctggccggggcctgttcccgcggtgagcagacgtcggcggccgcctcggtgcggccggccgccgcgaccgtcgccgtcccggcgactccggacccggcgaccgcgacgccgacccgggaggcctcccggaaaccggccaccaggaaggctccggccatggtcagggtgcccgacggggtcgggcgggactaccagtcagcccaggacatctggcgcgccgccggcctgatcgtcgccccggccaaggacgacaccggcgcccaccgcctgccggtgatcgacgcgaactgggtcgtgctggcgcaggaccgcaaagccggctccagggtccggaagggctcgctgatcaccgcgacggtgaagaagtacagcgacgattga

SEQ ID NO: 6330 - DNA, 393 bp, Actinoplanes utahensis
gtgaaagcattccgcgaagcggtcgaggcgcgcgacagcgccgccatcgaagccctgctcgccgacaacgtcgtcttcaccagtccggtcgcccacaagccctatcccggaaagccggtcaccgccgcgatcctgcgcgccgtcctgcgcgtcttcgaggatttccggtacgtcacggaactggccggctccgacgagcgcgaccacgccctggtcttccgggccaccgtcggcggccgggaactcaccggctgcgacttcctgcacctgaacgccgacggcctgatcgacgagttcatggtcatggtccgtccgctgtccgccgcgcaggccctggcggaggccatggccgcccagttcccgcagatccagcaggaggccgcccagggctga

SEQ ID NO: 6331 - DNA, 381 bp, Actinoplanes utahensis
atgagcattcccgcggagatcatcgcgagcaagcagatcagcctgaccacgttccgcaaggacggcacgccggtccccaccgcggtctggcacgtggcgtccggcgacaccatcaccacggtctccgccgcggccgccggcaaggtcaagcggatccgcaacaacccgcgggtcgagatcaccgcctgcgacgtccgcggcaacgtcccgcccggcgcgcagaccatcgccgggacggcggtgctgctcccggattcgcagaccgacgccgcccggcggctgctggagagccgttacgtcacggcccggatcggtggcacgctcgcccggctgttccacatcaagcgcccggccgccatcggcatcgtcatcaccgtgtga

SEQ ID NO: 6332 - DNA, 441 bp, Actinoplanes utahensis
gtggccagcgacctcgacgacatcgaccggcgcatcctcgccgaactcacccgggacgggcgcctgccgatccggcagctcgccgagaccctgcacatctcgcgggccaacgcgtacgcccgggtgcagcgtctgcgcgaagccggcgtgatccgcggcttccgcgccgagatcgaccacgtcgcggccggcatgacgacatcggcgtacgtcaccgtcaacctgcaccaggccgaatggcgcgaggtcggcgaacgcctccggcacctgcccggcgtcgtgcacatcgccctggtcggcggcgaattcgacgtgatcctgctggtccgcgcccgggacaacaccgacctgcgacgactcgtcctcgacgagatccagggcatgcccggagtggtgaacacccggacccttctggtcttcgaggagttcgacctcgcctga

SEQ ID NO: 6333 - DNA, 1080 bp, Actinoplanes utahensis
atgacgcctgacccccgccggctcttgccgtccgacagcccggtgaccctgatcgctcccagcggcgccgccgtcggcgaggtgcccgaagacgccgtgctgctccgttcgctcgccgcgctgatcaccgcgcggcggctcaacgaccaggcgtacgccctggtccggcaggggaggctggccgtctacccgtcgtcgcacgggcaggaggcctgccaggtggccgcggcgcaggtgctggacgcgaccgactggttgttcccgacctaccgggacacggtcgccgcggtggtcaagggtgtcgacccggtggaggcgctcagcctgctcaagggcgattggcactgcgggtacgacccctacgagcaccgggtggccccgcacgccaccccgctggccacccagctgccgcacgcggtcggggtggcgcacgcggcccggctgcgcggcgagccgaccgtggtgatggcgatgtgcggtgacggcggcaccagcgagggcgacttccacgaggcgctgaacttcgccgcggtcttccacgcgccggtggtcttcttcgtgcagaacaacgagtacgcgatcagtgtgccgctgtcccggcagagcgccgccccgtcgctggcccacaagggcatcggttacggcattcccggcgagcgggtcgacggcaacgacgtggccgcgctgctcagcgtgctgggcgcggcggtcgcccgggcccgggccggcgaggggccgcagctggtggaggcgcacacctaccggatgcaggcgcacaccaacgccgacgacgcctcccgctaccgcgacgaggccgaggtcgccgcgtgggtggagcgcgatccgatcacccggctccgcacccacctgcgggatcggggtgcgctcaccgacgagatcgaggccggtttcaccgcggacgccgagcgggcggccgcgcacctgcgcgacgggctgcatcgggacgtcacccccaaccccgacgaccttttcgcgtacgtctatgccacccccaccccgcaactgcgggaacaggccgcgctggtcgccgacgagctcagccgggaaggagccctctga

SEQ ID NO: 6334 - DNA, 993 bp, Actinoplanes utahensis
atggccaccgtcgtccacgagaaactgtccatggcccaggccctcaaccaggcgttgcgcgacgcgatggcggacgacccgacggtggtgctgttcggggaggacgtcggtgcgctcggcggggtcttccggatcaccgacgggctgaccgcggagttcggcgacacgcgctgtttcgacacaccgctggccgagtccgggatcgtcgggatggccgtcgggatggcgatgaacggcatgcgcccgatcgtcgagatgcagttcgatgcgttcgcctatccggcgttcgagcagatcgtcagccacgtggcgaagatgcggaaccggacccgcggacgggtgtcgctgcccatggtgatccgggtgccgtacgccggcgggatcggcggggtggagcaccactgcgactcgtcggaggcgtactacgcgcacacgccggggctgaaggtcgtcgcgccggctacgccgggcgacgcgtacgcgctgctgcgggccgccatcgaggatcccgacccggtggtcttcctggaaccgaagaagctctactggagcaaggaggagatcgagttcccggtccgtgcgcccggcatcggcagtgccgtcatccgccgcgcgggcaccgacgcgaccctgatcgcttacggaccctcggtgccggtggcgctggaggccgccgcggccgccgaggtcgagggacgcagtctgcaggtggtcgacctgcggtcgatcgtgccgttcgacgacgccacggtgtgcgccgcggtcgcgtcgaccgggcgggccgtggtggtggccgagtcggccggcttcgccggggtgtccgccgaggtcgtcgcccggatcaccgagcgctgcttcaccagcctggccgcaccgatccgccgggtgaccggcttcgacatcccgtacccgccgccgaagctggagcacttccagctgcccggcgtggaccgggtgctcgacgccgtcgacgacctcaactgggagcagtga

SEQ ID NO: 6335 - DNA, 651 bp, Actinoplanes utahensis
gtgatcctgttcaccggcgacgtcggcggcccggcgcaggatgccgcgctcgggccccggctgctccgcgacggcctcggcgacgcgcgggacatcctgcgcgtctactcgccggcgccgaccgcggcgttcagccgccgggacacgctgcggccgggttacgaccgtgcgctgctcgcggtccgcgcatccgatttcgacccagtcgtacgtccccagggcggcagcctcgcggcataccacccgggcagcgtggtgatcgaccacgtgcaccgctcggggccggaggcgcccgccccggccgaacgcttcgagcggtacgcggcgatgcacgcggccctgctggccgggctcggggtcgacgcccggatcgggccggtgcccggcgagtactgtcccggcgagtacagcctgcacgtgggcgcggccaagatcgccggttcggcgcagcgggtcacccgggacggctggctgttcagcaccgtgatccaggtccgcggcgcggatcggctgcggggcgtgctgacacccgcgtaccgccgattgggttatgacttcgatccgggcaccgtgggggcgatcgaggacaccgcgccgggcctgaccgtggaggcggtcacggcggcggtgctggcggcgtacgaggtttga

SEQ ID NO: 6336 - DNA, 984 bp, Actinoplanes utahensis
gtgcctttgaaagctgaactcaccagcgcagacctcctcgagatccggcagaccgcgctcggcgaggcggacccgctcgggctggccgccgacctggccgaggccgcggagaacgggcggctcgccgatcccgccgacgccggggccgcgctcgtgctcgccgccgagatcgcggagacgcggtcgcggttcgaggccgccctgcgctatgcggagcgggccgtggaaacctacggcgaccggcaggacagcccggccgccggcgcccgtgcggtgcgcgcccggctgctgttccacatcggtcgcggcgacgaggcgatggccgagttggaggcgttgcggccgaccctggagcagtatccggacgcgccggcgtatctgagcgtggccctggagatcggcggccggctacgggtcgccgagcagtggctgagcgaagcggtgcaggcggccctggccgagcgcgggccggagccgtccgggccggacgaggccgggcagttgctgttcctgctgcagcagcgccaccgggtgcggcacgcgctgaacctcccgcacgacgcgcacgacaacctggcgcaacgactggaggacaggctcgccggcgccggcgcgacgaccggggaccagctgctgttcttcccggagagcgagctgggcaaggtgctcgccgagtggccggggctcgcggacgcgtacggcgcggactggaccgcgcaccgggcccggctggaggggctgctggcccggttgtccgccgccggccaggcgaacctggcggcgctgcgcggctcggccgagggcctgcgcaaggcggccggccgcgacggtgatccggccgacgccgaggtccgcgcccggtacgcgcggcagatcgccacgggcagcgggccgatcccgtggcccccggagcgcaacggggcgtgctggtgcggatccggcaccaagtacaagaagtgctgcctgccgcgaggccgcgcctag

SEQ ID NO: 6337 - DNA, 3453 bp, Actinoplanes utahensis
atggcgagcggtgtgatcagcaggacagtggtgacggccggggcagtcgtgctgctggcggcgatggtcgccgcgccggccgcggcccggtcgccgggcagccgggtggtacagctcgccgccgggaacggtcacacgtgcgcgttgctcagcgacaccggggcctactgctggggccggggcgccgagggtcagctgggcgacgggagcaccgtgtaccggtcgggcccggtggcgatcgccgcaccgcacggggtgagcttcacccagctcaccgccgggcaggcccacacgtgtggggtgggcagcaacgccaaggcctactgctggggcatgggcgactacggtcagttgggtgacggcgccaccgcgaaccggtcgagcccggtcgcggtcgccggcccggcaggcgtcggtttcaccgagctcgccgccggcgaccgccacacctgtgcgctgggcagcgacaccaggacctactgctgggggatcggcaacgacggccagttgggtgacggcgccaccgcgaaccggtcgagcccggtcgaggtggccaccccgccgggcgtgagcttcaccgagctcgccgccggcgtctaccacacctgtgcgctcgccagcgacaccggaacctattgctggggcatgggcggcatgggtcagctgggcgacggcggcaccgtgaaccggtcgagcccggtggcggtcgccgccccgcccggggtgaccttcacccagcttgccgccggcggcttccacacctgcgggctgggcagcgacaccaggacctactgctggggcctcgacgagaccggccagctgggcgacggcggcaccgcgcggtggtcgcgcccggtggaggtggccgtcccggccggggtgacgttcacccggctcaccgccgggagcaaccacacctgcgcgctgggcagcgacaccaggacctactgctgggggtacgggtactacggccaggtgggcgacggtggcaccgtgaaccggtcgagcccggtggaggtggccgtcccggccggggtgaccctcagccggctcactgccggctggtaccacacgtgcgcgctgggcagcgacagcacggtctactgctggggactcaacgagaccggtcagctcggtgacggcagcatcacggaccggtcgtcgccggtgggcatgccgccgctcccgtcaccggccgggccgctgccgccgaccggcgtgtccgccaccgccggggaccgggagatcgcggtgtcgtggacggtcccggcggatctgggcagcggggcgctgaccggctacaccgcgaccacctcgcccggggggaacagttgcaccagcgtcacgaccgcatgcctgatcaccggtctgaccaacggcaccgcctacaccgtcgccgtgaccgccaccacgaccgtcggcacctcggcggccagcgacccgtccgcgtcggtcacgccggtcgccgggccgctgccaccgaccggcgtgtccgccaccgccgacgaccgggagatcgcggtgtcgtggacggtcccggcggatctgggcagcgggacgctgacccgctacaccgcgaccacctcacccggcgggaacacctgcaccagtggcaccgcgacgacatgcacgatcaccggtttgaccaacggcacggcctacacggtcaccgtgaccgccaccacgaccgtcgggacctccacggccagcggcccgtcggcgccggtcaccccggtcgcgggtccgttgcggccgagcggcgtgtccgccaccgccggcgaccggcagctcgtcgtgtcgtggacggttccggtggatctgggcagcgggaggctgaccggctacatcgcgaccacctcgcccggcgggaagacctgcgccagcgtcaccgcgacgacatgcacgatcaccggtctggtcaacggcacggcctacacggtcaccgtgaccgccaccacgaccgtcggcacctcggcggccagcgatccgtccgcgccggtcacgccggccgccggtccactaccgccgaccggcgtgaccgccaccgccggcgacgggcagctcgtcgtgtcgtggacggctccggtggatctgggcagcgggaggctcaccggctacaccgcgaccacctcgcccggcgggagcacctgcgccagcgtcatcgccacgacatgcacgatcaccggtctggtcaacgacaccgcctacaccgtcgccgtgaccgccaccaccacggtcggcacctcggacgccagcgtcccgtccgcagcggtcacccccgccgccggcccgccggcgccgaccggcgtgaccgccaccgccggcgacaaggcgatcaccgtgtcctggatctcggcggacaccggcgggcagacgccgacgaaatacacggccaccgcctccccgggcggaaagacctgcacgatcagcagcagcagcagccacagcgggctctgcacgatcaacggactgaccaacggcaccgcctacacggtcaccatgaccgccaccaccaaggccggcacctccccgctcagcagcccgtccgcgccggccaccccggctgccgtgccgccggcggaccggccgcagccgccggtggtcaccgccgtgaaaccgcagagcgaggccatcgcggtgtcgtggcagcccggttcgctgggcgccggcacgctgctcggctacaccgcttcggcggccgcgaccaacgacccgtgctcgtccgccagcaccccgtgcatcaccaccagaaccaccgggaagctgggtgccatccacctcaccaccacgacggccgacccgtcgacctgcaccagtaccgacactgacgcccaagcctgcaccatcaccggcctgaccaacggcgtcagctacgccatcacggtggtcgcccacaccaccgccggcgattccggggtggacctcagcgggccggtcgtcaccgtcaccccgggcgaccggaccctggtccacggctcgcgcttcaccacggccgtcacggccaccgatccctcaggcatcggccgttcctacctgaccggcgcggacggggcaggactgcccttctcctaccccagcgccaccgtgccggccggcgcggacggcgaccggaccgtcacctggatcgtgctcgacagcctcggcaaccagagcaccgcctcgagcaccgtgatcgtcgacaacaccgcgcccgcggtgacgttcggcaaggcgccccgcaacggtgccaggatcgccaggaccaccacgatcaccgcggccgccagtgaccgcaacggtatcgcccgggtgcagttgctggtcaacggcaagccggtggccgacgacacccgagctgccttcgccttcgtcctgaacccggcgaagtacgggaggaagttcaccgtgcagatccgcgcctacgaccgggccggcaactcgcgatccaccagccggcgcacctaccaccgctga

SEQ ID NO: 6338 - DNA, 507 bp, Actinoplanes utahensis
atgctgagggtcatgaccgacgaggcgcagccgcgctggctggacgacgaccagcgccggacgtggatgaccctgatcggcctgatggcccgcctgccggccgcactggacgtgcagttgcagcgcgacgcccagctcacccacttcgagtaccaggtgctggccggcctgtccatggcgccggagcacaccctgcggatgagcgccctggcggccttctgcgagggctccctgccccgcctctcccaggtggtgacccgcctggagaaacggggctgggtccggcgcaccccggaccccgccgacggccgttacaccctggccgtcctcaccgactcgggctggcagaaggtcgtcgagaccgcccccggccacgtcgcggaggtgcagcgcctgatcttcgacccgctgacccgggcccagcagcgccacctgcgcgacatcggccgccgcatcgtgcgcaccatcgatcccgacgacccctgcctcaccgacgatccggactga

SEQ ID NO: 6339 - DNA, 1755 bp, Actinoplanes utahensis
atggctcgacgacctgttccggtgggggcagtcgatgccgaaaccgcggggcatcgtgatcgtctcggcgcactgggagaacgcgcccgcggcgctgtccggcagcgcggccggcaccccgctctactacgacttcggcggcttccatccgcgctactacacgctgccgtacgccagtccggacgccaccggcctggcccaccgggtggccgggacactcggtcggaccgggccggtgcaccagttcgtgaaccgcggtctcgaccacggggcgttcatcccgatgatggccatgtacccggcggccgacgttccggtcgtgcagctgtcgatgcccagcctcgacccgcaagcgctgctcggcctcggtcagcggctgcgcgcattgcgggacgagggcattctcgtcatcggctccggattcatgacgcacagtttcgcggtgatgcgcgatcccgcactggtcgggcacacccgggccttcgacgcctgggcggcggacgcgctggcccgcggcgacgtggacgcgctcaccgattaccgggcgaaagcgcccggcgccgacgtcgcccatccgaccgccgaccactatgtgccgctgctgctgaccctgggcgcggcggcggatccggccagcgcggtgtcggccatcgaccggatcgcgttcggcaactcgatccggtcggtcagcgtcgcgtgagtggccggtccgggccgccgatcgtcgtcatcggggccggtcaggccgggctctccgcggcctaccacctgaagcggcgcgggctggaattcgtggtgctcgacgccgcggacgggcccgggggagcgtggcgggaacgctgggaatcgctgcggatggcgaccgtgaacgggatcttcgacctgcccggattcccaagagcgcaaggggatccgcaggagccgagccgcacggcggtgccgcggtacttcgcggacttcgaacgggccaacgggctgcgggtgcggcgtccggtgcgggtgatcgacgtacgggagaagggtcttgatctggtcgtggcaaccgaccgcgggcaatggtcggccgcggcggtcatcaacgcgaccgggacctggaccaatccggtgctgccacactatccggggcaggagaccttcgccgggaggcaactgcacacccgggagtacgtgtcggccgaggagttccgcgggcggcgggtcgccgtggtgggcggcgggatctccgcggtgcagcagctcgaggagatctcccgggtggcggcgacgttctggtacacccggcgcgagccggtcttccggaccgacgccttcacgccggaggtggccggccgggagacgatcgcgaaggtcgtcgccgacgtggaagccggccgaccgaccggcagcgtggtgtcctacaccggactggcctggacgccgtacgcgctggccgcccggcagcgcggcgccctggagcgccggccgatgttcaccgcgatcgagccgcacggtgtccgtgcggccgacggatcgttcaccagcgtcgaggtgatcctgtgggccaccggcttcaaggcggcgctcgcgcacctcgacgggctgcatctgcgcaacgcccgcggcggtatcgcgatggccggtacgcaggtggccggcgagccgcgcgtacacctgatcggtttcggcccgtcgcagtcgaccgtgggcgcgaaccgggccggccgggaggccgctgtcaccctcgcgcgacacctggcggcgagatccgggcattga

SEQ ID NO: 6340 - DNA, 1452 bp, Actinoplanes utahensis
atgtcaggtgccgcatcgcgatgggttgccgcgttgacgctcgcttcggtgtcggcgttgctgccgacctcggcgcaggccgcgcccctaccggcagcgtccacctgcgccggtgacaccgggacggccgcggaccgggtcgtcgccgaccggctgcgcccgtcgatgaccggccggcgcctcggcaccgcggtcagcccgcgggccgtcgcctgcgcccgggcgatcatcgggatcgtgcagcagcgcggcctcgggccgcgcgccgcggtgatcgcggtgaccacggcgatcaccgagagcaccctgaccaaccacgtggtgtcgaccgaccacgacagcctcggtctgttcgagcagcggccgtcgcagggctggggccgggccgcgcagctcgtcgacccggtctacgcgaccaacgcgttcctgaccgcgatgctccgcaaattccccggcgacagctggatgggcggcgacatcggcgcaatctgccagcgggtgcagacgtcggcgctgcccggggcgtacgcgttcgaggtccacgacgcgcagctcatcgtctccgcgctgtgggcggtcgccccggatccggcaccggccgtgcccaccgcggcggcgaccgcctccgcctccgccgcggcgtccggtccgttcaccaccgcgctggcctcggcccggccgcagctcggcgcgctgaacggccggcacggcctggcgatggccgactggaacggtgacaagcaccccgacctgatgatcatcaacggggtgggcgccgccaccggcaagaccgaaatccggatcatggacggcgcgacgaacttctcccgcctcctgctgatcaccgcgaccgcgctcggccccaccgacgagcgccacgcgtacgcggtcaccgactacaacggcgacggcaaacccgacctggtcgtcacccagaaatccggcaccgccagcggtcacaccgaggtgcgcgtcgtcgacggcgcctcgaacttccagcgcctgctcgtcgaaacggccaccgtgctcggcccgaccgacgaccgctaccagttctcggtcgccgactggaacgccgacggccaccccgacctgctcgccacccagaccaccggcaccgccagcggcaaggtcgaggtgcaggtcctcgacggcgccacgaacttccagcaggcgtcaccggccgtggtcaccgcacagccggccggtgacggggtccgggtcgcggtgaccgactggaacggcgaccggaagcccgacctggtcaccacggtcaagaccgacctgagcgtgctcgacggggcggccgggttgaccaagaccctcgccacggccaaggtgccgggcgacagccgggagcaggtgctgaccgactggaacgccgacggcaagcaggacctggcggcggtgcagaccgagggcaccgcggagatctccgtcctgggcggctga

SEQ ID NO: 6341 - DNA, 930 bp, Actinoplanes utahensis
atgcccatgaacacctcggcgccttcgtcctgctccccgacggtatccgcacgacctggctaccggccagcccttaccgtccagttccaccaggtcaggctccccgcgtcgcccgtcacaccgagaccggcgccaccacctggtccacaccactgccgcccgcggagctatcctttcccggcgtcgtcgaagcgggcatggataccggctgcgaaccacgtccaaagaagccgtggcggccgacccggccgacccgtcagcgccttccaactcaccaaacgcctgtgcgacctgggcctcaaccccgcacagtcccgctccaccgcactgttcgacctcgccaccgaactggccgccgcgatcctcgcccggatgctgggcatccacatcagcgtcgccgccgcctggcaacgcgccagcgccggcgactggaccacctacgccgccgacgtcagccgccgagccgacaccatcggtaagatctccaaggaaacctgggcgcacgtgcacaactaccgcttcaaacgccaaaccaacaagatcggcatcttcgccggcctcaccgccgaggccttgaggcaaagcaccctacccgtgaaggccgatcacatcagcgatcacatctggctggatacgtcccacgtcactgacggtttccgcggcacaccactgaggctgagccagaacgaagtcggatggctgcggaccggactgctccacgtcgccgacgacatcacgcgcgccgaacccaccgcccacgtcaccgtcgtcatccacgcactggagatcatcgaagtggactacatcgagccggccctcgctctcgccatcgctggttgggcagcccaagagttcggattcaccgaccgccccgccgacatccgactcgatgaccagaccaaccaatacgtcgtctcctggacaggttga

SEQ ID NO: 6342 - DNA, 1542 bp, Actinoplanes utahensis
atggtgatcccgccgagcgcgaacacagcggaccagatcccgatctgcagcggcgtcagcccgaccacatccgcgccgaacagcacgatgtacgaggtgaccatcgagtcggcgatcccgagcagcagaaccgcggcgaacagcgcgagcgagggcacgcaccgttcgtatcggctggaaccatcgaaggaaaccgatttcccacgaccgggggcgacgcccgtcacaatccgcccaaatcgcaaaaacggctgcgccgcggggatagcgtcgaaaccgatgcacccgatcctcgtcgtcgccgcgagcctgctgctctgtgcgatcaccgccgccctgctccgccgccacctccggcccgcggtcgagtccgcctgccgttccctgatcccgcacctgcctggcctcgtacgccgcgccgcacgctggtgccgccgacatgtcgacccggcggtgctgcgatccggcctggtcaccgcggtcgccgccggcatcgcctgggccgcggccggcaccctgcacctggccggcccggtcaccgcggccatctccgccaccctgtccgtgcagctcagctcgcacgcctcggtccgcgagggcacccagcgcctgatcggcaccctggccggtctcggtctgaccgtcgccgtgtggggcgtcttcggcctcaccccgtggacgatcgccgcgatcaccggctgcggcctggccgccggacgtctgctgcgcctcggcgagagctcggtgacggtgcccgccacctcgctcggcatcctggtcggcggcagcgccgtcaccgaggcgtacgtctgggagcggatcgccgccaccgccctcggcatcgtggtcggtgccatcctgtccccgctggtcggcggcatgaccccgctggagcgcgccgcgtggaacctggaccgcctgtccggtgagattgcccggctgctcgccgccctcggcgacggcgtgcgcgacggctacacccgggagcaggccgagcagtggctggcccggtcccgcgacctcggtgccgacttcgacgaggcggccaccgcggtcgacgacatgatccgccacgcccactggtcgctgaccaccccggtcgccaaggtcaccccgctgcgcgacaccctgcacgccctggagcacggggtgcagcaggtcaactcggtggcccgctcgatgttcgacgccgcggccaccccgcacgccccggtgatcccggccccgatcgccccggtcctgaccgccgccgccgaggcgttcgccgaacgctccgacgaccgccgccacgagaagctcgagtcgctgcgtgacgcccgccaccagaccctgcgcaccgtccgcaccgaactcgacgacaccggcgtgctggtcctcaccgggtcgatcatcaccgacatcgaccgcatggccggctccctggcccgctcggccccagccctctccatcggcctgcgcgagccgggccccggcatcccggccgtctccgaggtcctccccgccgtccgcctgatcctcaagaagacctcgtcccgctcgtag

SEQ ID NO: 6343 - DNA, 1878 bp, Actinoplanes utahensis
atgtcgttcgaccatcgcgcgctcttctgcagcgccccggtggccatgctcgtgctcgatcctgaactggtgatcgtcgaagtcaacgacgactatctgagcgccaccatgcgggagcgggcggacctgatcgggcagtcggtcttcgccgccttcccggaaaaccctgccgacccgggagccggctcggtcgcccagctcgcgagctcgctggaccgggtgcgccgcgacggcgtcgccgacatcctgcccatccagcagtacgacatcccgcagcccggcggcggcttccagatccggttctggtcggcggtcaacgcgccggttttcgccgcggacggcacggtctcgctgatcattcaccgggtcaccgacgtcaccgagtacatgctggccaaggaggggcacgccctgcgggtgctgaccggcgaactcgaatccgagatcttcgcccgccggcaggcgcaggagcggatcaccatgatgcaggcggtcgccgacagcctggtcgtcgcgatcatcgccggtgacccgaccgggcgccccgcgatgtgcaaccaggccgccctcggcctggtcggcgacctggtgcgaggccgggcgctggagcagtggccggagccgctgcggccgctgctcgcccgggtgctgcacggcgaggtcgtccgggaggccgaggtggagctgcgcctgcccgggcggccccggcagatcctgcggatgaacgcccgcccgctcaccggccagccgagcctcgccgtggtcgtcgggctccgcgacgtcaccgcccgccggctggcgtcccggctgcaggagggcgagctggagatcacccacctgatcgccaacggacagccgtccaccgggacgttgcggcgggtgatggcgatcgccggcgcctccatcggctggcaggccaccgaattctgggccgtcgacgaggtgacccggacgctgcggcgcgaggcgcactggggagagtcggcgcgctccggcccggacctgccggcccaaaccctgcgcggggccgggccccgatgggaggacggggcgctggccgtcccggttccggccggcgccgaacctctcggggtgctggtctgctacgccggggatgacgacgtaccggaagaattgcgggccgcggtggtgaccggcatcggcgcgcggctgggcgaatggctgcagcggcgtcgcgccgaacggctcgccgccgaactcgcccgcacccgcgacgaatacatcgcgctggtcggccacgaattgcgcaccccgctgaccagcatccaggcgcacaccgaactcctgctcgacgaccccggcctcagcgacgaccagcgggacgcgctgggggtgatgcggcgcaacaccgagagcctacggaccatcgtgctgcgcctgctcgacgtggccgggctgcgctgggggcacatcgagctgcaccgcaagccggtggacctggccgtgctggtgcgggaggcggcggccgggcacagcggggtggcgatcggcgccgtcgacccactgatcgtcgacggggaccggggccggctcggcgaggtgctggacgagctgatcggcaatgctcgggactgggcggctgagggcaccgtggtcacggtgggggtgcacgccgatgggggcgcggcggcggtgaccgtgacgaaccgcgggacgccgatcgcggcgcacgaacgcggccggctgttcgatctgttcttccgcggtgacgcggcgcggcacggcgggatgcggggcaacgggctggggctgaccgtggcccgggcgatcgtggagcagcacggcgggacgctgacggtcggcgagccggacggcgggatgaccaccttcaccgtccggctgccgttgaccgcctaa

SEQ ID NO: 6344 - DNA, 171 bp, Actinoplanes utahensis
gtgacgctcaccgtcccgtccccggcgaaggtcatcgccacctggaacacgaccgcgagttacccgaacgcgcaaacgctggtcgccaagccgaacggcagcggcaactccttcgggctgacgatccagaccaacggcaacgggacctggcccgcggtttcctgcggttag

SEQ ID NO: 6345 - DNA, 675 bp, Actinoplanes utahensis
gtggcccaacgtttcgtgcagcgggagctgaccatgcgcatcatgctcgccgccgtggccaccgtgctgaccgccgccaccgggttcgtggcggtcgaggtgaccgccgcgcaggccgccacctgttcgggatacgtcgggctgaccttcgatgacgggccgaccgccgggaacacccagaatctgctggccaccctgcgcgccaacgggctgcgggcgacgatgttcaacgagggccagcatgccgcggccaacccggccctggtcaaggcgcagatcgatgccggcatgcaggtgggcaaccacagttacacccatccgcatctgacccagcagagtcaggcgacgatcgatgccgagatctcccggacccaatcggcgatcgccaatgccggtggtggcacgccgaagctgttccggccgccctacggggagacgaacgcgacgctgaaatcggtcgagcagaagtacgggctgaccgagatcatctgggatgtcgactcgcaggactggaacggcgcgagcgtcgatgcgatcgtggcggccaatgcccggctcaccaacgggcagatcatcctgatgcacgactggccggccaacacggtggccgccattccgcggatcgcccagggcctggcgagccggggcctgtgcgccggggtgatctcgccctag

SEQ ID NO: 6346 - DNA, 990 bp, Actinoplanes utahensis
atgcccgacgctcccacgtcatcccgtccccgggcccggctcaaagccaccctcgccgccgcctgcacggtggtcgccgccgtcgccggcaccatgctggccagcagcccggcgcacgccgacaccaccgtcagcagcaatcagaccggcaccaacaacggctattactactcgttctggaaggacagcggcaacgtcagcatgaccatgggcgccggcggtcagtacagcacccagtggagcagcgtgaacaacttcgtcgccggcaagggctggtcgaccggggcgcgccgcgcggtctcctactcggggtcgttcaatccgagcggcaacgcctatctttcgctgtacgggtggaccaccagcccgctcgtcgagtactacatcgtcgacaactggggcacctaccgcccgaccggcacctacatgggcacggtgaccagcgacggcggcacgtacgacatctatcgcacgcagcgcgtcaaccagccgtcgatccagggcacggccacgttctaccagtattggagtgtccggcagtcgaagcggaccggcggcaccatcacgaccggcaaccatttcgacgcctgggcgtccaagggcatgaacctcggcaccttcaactaccagatcctggcaaccgagggctaccagagcagcgggaattcgaacatcaccgtgggcggcacgggcggcagcaccggcgggggtggaagcaccggcggcgggtgcaccgccacgctctccgccggccagcagtggagtgaccgctacaacctcaacgtcaccgtctccgggtccagcaactggacggtcacgctgaacatcccgtccccggccaagagcatcgccacctggaacaccgcggcgagttacccgagcgcgcagaccctggtcgccaagccgaacggcagcggcaacaccttcggcgtcaccatccaggcgaacgggaactggacgtggcccaacgtttcgtgcagcgggagctga

SEQ ID NO: 6347 - DNA, 555 bp, Actinoplanes utahensis
atgagcattgccatcccgtccagcctggtgccggacggctccggcgtaccctccgtctgctcccggcacggagaagcccccgccgtgcagaagccggtcaaattctggtccaagccgccggcctgggccctgatcctgatcctcttcggcgcgctgccgtacctcatcgtggtctgggcgctccgcaaagaggtccgctcacaggcctggccgttctgctcggagtgcgtcaagctgcacaagaaccggctgctcatcggcctcggcctgatcgccgtgctcccgatcagcctggcgttcccacgcggcgactcgttcgggacggtggtcctgctggccctcgtcgtcgccctcgccggtgccgccgtcctcgcccgaggctcctaccggatgctgcccggtggcgtggtctcccgcgacggagcacaggtggacttcccgaactcccacccggccttcgacgccgccgcgcaggcggcgtaccaccaggccgcccagcggtacgcggcgtggcaggccgggcagcacgccccgtaccaggcgccgcaggcctga

SEQ ID NO: 6348 - DNA, 948 bp, Actinoplanes utahensis
atggcgttgaaggtgttccagccgatcccgtggctggatccgctgctgtccacgccgggccaccgcggtcgtgcaagcccttctcgtcctgcatcgcgtcgaagccaaccgctacgcaggatgaaaaggctcggtgcagcagagcctgcatatggtgaaggcatggatttcgccggatcggtgcccgcgaactacgatcgctacctggggcctttgctgttccagccgttcgcccgtgacctcgcgtcccggttggccgaccggtctccctcccgggtgctcgagctcgccgccggcacgggcatcgtgacggccgaggtggcgcgggcgttgcctgatgccgtcatcgtggccaccgacctcagccaggccatgctggacgtggcagccgcccgcagggagacggccggggtgcggttcgaggcggtcgacgcccagaatctgccgttcggcgatgacagcttcgacgcggtctgctgccagttcggcgtcatgttcctgccggacaaggcgcgcgcctacgccgaaatgcgccgggttctgcgccccgggggcgggctgctgttcaacgtctgggagcgcatcgaggacagcccgatcgccgccaccgtcgaggccgcgctgcagaactgctttcccgacgatccgccgcagttcctatcgcgggtcccgcacggctatcacgacgcgacggcgatccgcgacgcggtgcgcgcggcggccttcggtgaggtggatgtggtgacggtttcgctgccgagcgtttcgccctccgcgggcgacgcggcgatcggcttctgccagggcacgccgatccgccacgagatcgtcagccgcggtggcgacctggcggcggtcaccgagagcgtgcgtgcagctctgaccgacaagttcggcaccggggaggtgcgcgccgacatggccgctctggtcgtgaccgcctgctga

SEQ ID NO: 6349 - DNA, 2703 bp, Actinoplanes utahensis
atggtcgggcgcgagcgcgagctgcgccgcctggcccagctcgccgccgcccgggaaccggccgtcgcggtgatcgccggcgagcccggcatcggcaagacccggctggtgcaggagctgctggccaccctgccaccggagacggtggtgctggtcgggcaggccgagcccggctccctgtcccggccctacgaggtgctgctcgacgcgatcgacggccggcccgaagtggacgaggaccagctggccgcgctcgccgatccgcggcgcagcccggtgcaacggctgcacaccggcctggcgatcgtcgcggacctgatcggcgactcgcccgcggtgatcgtcttcgaggatctgcactgggccgactcggagagcgcggcgctgttcgagcggatcgccgaccagcacggcccgcggttgctgatcgggacgtatcggccgggtgacgtgacccgccggcagcccgtggcgagcctgctggcgcagttggagcgccggcatgcggtgacccacgtacggctggatcggttgtccccggcgcagaccgcggccctgctcgcggccgcgaccggggccccggcgccgctgcgcgccgcgaccgcgttgcaccatcgcaccggcggcaacccgttcttcctggaggagcttttgagagccctgccggggtacgacgtggagggcctcgtcgagcaaccgctgccgtggagcctcgccgatgtgttgcgccgtcaggtcgacgacctcgacccggtgagtcaccggatcgtcgaggcggccaccgtgctgggccaccgcatcccgttcgacctgctggccgacgtcaccggggccgacgaggacgagctgatccgggtgctgcgcgacctggtgacccgcggggtgctggtcgagtcgggcgacgacgagttcgccttccggcacgcgctgctgcgcgaggcgatcgccgaccagatgctgagccgccagcgccgccggctgcacgaggccgccctggacagtctgctgcgcggcggcggctccgacccggccatggtggcccaccacgcgcgcggcgccggccgctacgacgacctggtccaggccgcccgcgacggcgccgggctgtacctgtcgatcggctcggcgtatcaggcgttgcagctggccgagatggggctcgacgaggtgcccgacgatccgggcctgctggcctccgcggcccgcgcggcgtggctggccggcctgctcgacgacgcgctgcgctacggccgccgatggcgtgacctggccaccaccagctcggaccgggccgagtcgctgtatctgctggtccggatcgcctgggagtcccgcgacgccgccgagatgcgcaccctcaccgaggcgatcgcaaccctgatcgcccagctcccgccgggcgccgaccaggcatgggcgatgaccgcgatcgcccagtcggcgtacctgcgcgacgaactcgacgacgccctgctctggtgcgaccgtgcgctggccctggccgacgaattcgagctgcccggggtgcgcctggcggcgctggtcgagaagggctccaccctcaccgaacgcccgcagaccgccaccgagggccgcgccatgctgtccggcctgatcgacgacctggaggcggccggcgaatgggtgctggccgcccgcgccctggccgccctggtcgtcggcgtcccgcccacctccccgatcgaacacgccgaaaccctggaacggatgcggatcgacgccgagcgcgccggcttcgagtccctggccgtcgccacgtactaccaggggcgcgcccgcctggcccagcgcgccggcgacctggacgccgcgatcgccgccctggaggagggccgcgagcaggacatcgggtatcggcggcggggccgctgggccgacttccacgcggtgttcctggccggtttgtatctggaggccgggcacctggaccgggtcgagcagatcctcgccgacctgcgcgagctgccgaacaacctgccgacggcgatcccgggtctgaccttcaacctggcctgccgacggggtgacctgccgggcgcttcgatggccctgaacgacctgttcgccgcactggccggacagtcctggcgcagtggtgaacaggcgcacgacctggtgtcggcggccttggagctgggcctgccggcggagcggctggacgagatggtggcgaccctgctggacgcggaggtgtgggacgcgtaccggacgctggtcgacgcccaggtggcggaggcacacggccggcacgctctcgccttggacggctacctgtcgatcaccgatgcgcacatcctgggaccggccgcccgcggcaccgtccacgtcggcgcggcccgctgcctgctcgccgccggccgccccgccgaagccgaggtccacgccaaggcggcggcgacggccctgtcccgctggcacggctggcgggtgacccgcctggacgaggtccgcgcccggctcggcatgacaccggtcgacgcttccgcggtgaccgggccggcggcactgaccccgcgcgagcgcgaggtggcggtcctgatcagcgacggcctgaccaacacggagctggcccgccgcctctacatctccccgaagacggccgccgtccacgtctccaacatcctgcgcaaactgggcgtctcctcccgaaccgaggtcgccgacctggtcaacggcacctga

SEQ ID NO: 6350 - DNA, 255 bp, Actinoplanes utahensis
atgtgggcaccgcgtccggacggcgagcatgggtctgtcggcaagcgagggagacagaccatgttgttccatccgttcatgatgctgggactggcccgggagcggcggcacgagctgatcgccgaggcggaccgggagcggctgctggccgcggcccggcggtcccggagggcgggaaaacgcggcgcggtgcgcgggcggcccgccggtacgctttcggcgtgcgaaccttccgtggcggtgccagcccggtga

SEQ ID NO: 6351 - DNA, 2670 bp, Actinoplanes utahensis
atgctgttcgaccagctccgccgccgccggccggtcgcggccccggcggactcccccgtccaggagcttccccggtggaaactgaccccggagcggcgcgaccgctaccggcatgacgtgttcgagcaggaactggacgaggtgctcggcgccggctcgctggcggacggcaccgtctccaccgacttcctgcgccgccgctgcctgcgcgagcgtgacgccctcggcacacccgcgcaggatgcctggcagatcgtggatcgccgactcgtcgaccgcgcgcgggtccgcgaccggctcgacgccggcgccctgatcgcctacgagtgggcgttcacccccggcctgcgccggctcatcctgtccctgggcatggcgctgtggctcctcgccttcgcctacgccggcccgggtgagcatcgcctggactacgccgaccccgtgctgctgtgggcggccggggtgctcgtcaccggctcggcggcggcttcgatcgccgagttccgcggcgtgcgccacccgggcctgttcgtcacccaggcgttcgcgacggcgctggcggccgggctgaccgcggtcgccggcatgcaggtcaagaccgtggcgatccagcagtccgggctggtgccggtcaccgtggtgatgatcaccacggtggtgctggcggtcctgctggtcgccttccaatcctggggacacgtcgaccggcactggtcgaccgcgcggctggccgacctccgggtcccggtcgtcaccggcgcgatcctgatcggcctgatctcgctgaccgctctcggcaccatcctgatcctcggcgccgggacggcgaaccggcgcctcgacgtcgtccggccggaactctggctcgccgtgcccggcagcgtcatcctgacgctgaacctgctcgccggactcttcggttactcctcgacaccgttcgagatcgtcgacagccgctggcggaccgcggaacgggagtggcgcgagatgctccgcaaccggatcctgctgccgctgctgcgccggatggtcaacgacgcgaggccgtcgtacgacaccaccctctacgtgacccggccgcatgggctcagccaggcgttcgacccgatctacgaggtgcccaccagggcccgggagcggctggagaagatcctcacgatgctgcccggcggcagtgtcggcctggccgggccgcgcggcgtcggcaagtcgacgatcctggcctcgttctgcgagcaccgcgccgaatccgccggcaccatccgggtcctggtctccgcccccgtcgactacgcgccccgcgacttcctgctgcacctgtacgcgcagatctgccgcgccgccctcggcctgcacgacggacaccggccgccgccggacccgatccactggctgtccgcccgccgcccgctctgggccggctcgctgctggccggcctcaccggcgccgccgggctgggcatcctgatcctcagcggcagccagtaccggctgggcaccagccagatcatcgcggtcatcatgctgctggtcgccaccggcctcggcgcacatctggccgcccgccgcgcgccgcggccgagctccggttacgcccccgaggacaccctgcgggacgcggcgctggaacggctgcgcgagatcgaataccagcagagcatcgccggcgaatactccggcgccgtcaaggtggtgccggccgggctggagtcgtcactcaaacgctcgaccggtttcgtccggcaacagctgagcctgcccgagatcgtcgactcgctgcggcggttcctgaagctggcggccgcgcagccccggccggccggcggcccggccctggtgatcgggatcgacgagctcgacaagatcgaggacgagacgcgcgcgcagcagttcctcaacgacatcaagagcatcttcggggtggccggctgccacttcctggtgtcggtgtcggaggacgcgatggcctcgttcgagcggcgcggcctgccgttccgcgacgtgttcgacagcgccttcgacgagatcgccagcatcccctacctggccttcaaggagagttcggacctggtcggccggcgcaccacggagatcccgattccgttcaagggactcgccttctgcctctccggcggcctgccccgcgacctgatccgggccgcccgcaccatggtggagatctccgagaagggcagccgggacctgcccgccatcgccgcccggctggtggcccgggacctgaccggcaaggcggacgcggtcgccgccgcgatccgcaaggtcgacgccgaaccggccacctcccggctgatgctctggtgccgtgcgatcgccggccggatcgccgacgacggcgacttcaccgcggcgatggacgatctgaaatgcatcgacatgtggggccgtgaggaggcgaaccgggcggcgctgcgccgcctggcccgggagatcaccgcgtacgcctactactgccgcaccctggtcggcttcttcgccctgccgcagtccgccggcatcctggccgcttacgacgagctggccgcgatccgccgggcgatggccgcgaacccgctggtcggctggacgctgaccagcgagttccggcagcgccgccggatgcccgaggtgtatccgccggacgcgctgaccgtgcttccggccaaggtctag

SEQ ID NO: 6352 - DNA, 1422 bp, Actinoplanes utahensis
atgaccacactccgctccgcctgggtagccctcgccggcctgtccgcagtgttcctgttcgagatgctcgacaactcgatcctcaacgtcgccctgcccaccatcggccgcgagctgcacgcctccaccatcggcctgcagtgggtgaccggcgcgtacgcggtcgtcttcggcggcctgatgctgctgttcggcgcggtcgcggaccgcttcggccggcgccgcaccatgctggtcggcctgatcctgctcggcgtcgccagcctggccaccgcgttcgtcaccaccgccggccagctgatcgcggtccgcgcgctgatgggcgtcgcggcggcgatgaccacccccggttcgatggccctggccttccggttgttcgcccgcgacgatctgcgggtccgggccaccacgctgatctccactgtcggcctggtcgggctggcggtgggacccaccaccggcggcttcgtgctgtccgtcgccccgtggcagacgctgctgctcatcaacgtcccgatcgcggcgctggccttcgccggggtgcgcaccggcatcgccgcggacgaccccgccgacctgcaccgcgccccggtcgacgtggccggcgcggtcctgtgcacgctgaccgtcgtggtcgcgctcatcgcacccaccctgttcgtcgacgagggtgccggcggctggcagccctgggcggccaccgcggccgccgggctcggcgcgctgctgttcgtactgcgcgaacacaccgccgcgcacccgctgctcgatctggcgctggtcgcccggccgctggtcgccaccggcctggcctacaaggccgccgccgggatggccgtcgccggcctcggctacctggtcaccctgcagctgcagctggcctggggctggtctccggcgcacgccgcgctcggcatgctcccgcaggtcgtcgtcctgatcggcggcggcgtctacgtcaacccgttcgtcacctgggccggcctggagcgcgccgcctggctcagctcgctcgccgtcgtcgccggcctggccgtcttcggcgtcttcagccgcttcggctacctctgggtggcgctcgccctggtgctcgtctcggccggcctgcgggtggtcggcgtggtcgccgcgatgaacgtgctccgcggcctcccggagaaccgcaccacgatcggcgccgccctggtcgacacttcgtccgaggtgacctcgggcgccgggatcgcggtcaccggcacgatcctggccgcggtcttcaccggctcgatcaccgccgggcagtggaccgcacagcagacgacccagttcgccaccgcgatgacgaccgccggcctggtgctgaccgcgatggccgcggcgctggtcggatgggcgatcgtccgaacccgggcggctcggacggcgctcagctccgtccgatga

SEQ ID NO: 6353 - DNA, 729 bp, Actinoplanes utahensis
atggcaccgaccccgcaggaacgccgcgccgctcgtcaccagctcggcggagcgccgtccgcccccgccgcccggcgcggtccctccggtggccgcaagaagccgatcaccgtcgacgcgatcatcgacaccgccttcggcatcatcgagaccgagggctacgaggcgctcaccatgcgtcgtctcgcggtcgcgctggagaccgggccgtcctcgctctacgcccacgtggtcaacaaggaggacctcgacgagctgctgatcggccggctctgcgcggagatcgagctgcccgagccggacccggccgggtggcgcgcccagctgatcggcgtctgcacccgtctgcgtgatcagttcctgcgctatccgggcatttcgcgggccgcgttcgccgccgccccgtcgaacctcgacacgctgcgggtcagcgagggcatgctcggcatcgtgctggccggtgggatcgcgccgcaggtcgcggcgtgggcgatcgatgcgctgacgctctacgtcaacgcgtactgcctggaggtgtcggtcgccgagcggcggcgggctccggacggcgactgggtgctcacccgggccgagatgatgcggcggttcgccgcactgccggacggctttccgcacaccaagcggtatgcggccgagctgaccggcgggacggtgcaggaccgcttcgcgttcaccctgaacctgatcatcgacggcattccgggatga

SEQ ID NO: 6354 - DNA, 1707 bp, Actinoplanes utahensis
gtgggcctcccgcgcgccgttccggcagacattcgtcccgcagggtccgcgcgtggcgttcaggaatacccgcgtaccgccgaattaggctttgtgaccatcctcaaccggatgcggctgggcatgcggctggccgccgcgttcgccaccgttgtggtgttgctgctcgtcgtcatggccgcggctctgatcaccgcggcccgccagggcgccgccaccgaccggatcgcccagacgcagaagttcgtcgcgctgatgaaggacgccaagttcgccgccgccgatttcaacggctggcagaccgcgtacgccttcgacgccctgcgcggggtgcccgacgccgccaaggacaccgggtcctcccgcaagtcgttcctcgcctcgctcggcaagttccagagcaccgtgtccgccgccgccgacgccgccaccagcgagcccagccgtaccgaactccggcgggtcagcgctctcgccgacgacttccggaccgccgacacgcagatcgcccagctgtacgaccagggctccaccgccgcgacaaggaccgccaacggcctggtcatcggcaaggagatccagatcttccagcagatcggcgagcacctcgacgcggtcgtcgccacggccggcaccgacttcaccgccgcccagcacagcgccaccgaggcgaagaacatcggcgcgaccgtcatctgggcggccggcgtgaccgccgcgctcatcgccgtcgcgctcgccgtcatcgtcacccgctccgtcaccggtccggtcgaccaggtccgccgccgcctcatgctgctcgccgacggtgacctggccaccccggtcacggtcaccggccgtgacgagatcgccgacatggccggcgccctgcggcagagtgtcaccgccctcggcgacgcgatgcgcaccatcgacacctcggcgacctcgctggccgccgccaccgaacagatgaccaacacgtccgcgcagatcgccgcgtccgccgaggaatccgcggtccaggcgcaggccgtggccgccgccaccgaggaggtgtcccgcaacgtggcgaccgtctcggccggcggcgagcagatgggcgcctcgatccgcgagatcgcccactccaccagcgaggccaccgccgtggtcgccgccgccgtgcaggccgcccaggcggccaacaccacgatcaccacgctcggccagtcgtcccgggaggtcggcgaggtggtccgcaccatcaccgcgatcgccgaacagaccaacctgctggccctcaacgcgaccatcgaggcggcccgggccggcgaactcggcaaaggcttcgccgtcgtcgccggtgaggtcaaggacctggcccaggagaccgcccgggcgaccgaggacatcacccgccgcgtcgaggcgatccgcaccggcaccgacagcgcggtcaccgcgatcggtgagatcgccacggtcatcgcccgcgtcaacgacttccagacgaccatcgcctcggcgctggaggagcagacagccacgacggccgagatgaaccgcagcgtgtccgacaccgcgaccagcaccgaacagatcgcgaccaacgtggcgacggtggcgcaggcggcccagcagacgaccgagggggtggcgcagacccaggaggcgaacgcggagctcgcccggatgtccagcgacctgcgcgtcctggtctcccggttccgctactcctga

SEQ ID NO: 6355 - DNA, 2058 bp, Actinoplanes utahensis
atggacccgtcgccgcgcagcgtggtgcgggaggagtgtcgattcgtggccgatccgccgttgcccgcgccgctgctggccatgctcgacagcgatccgcaggggtgggtgctggcccgggcggtgcgcgacgagggcgacatcgccgacttcgccatcgtctacatcaacgaggccggctgccgcctggtcggccggccgcgcgcggagctggccgggcaccggtatcgcgagctgtggccggagacggtgcacgacgggaccctgccgttctaccggaaggtggtcgagaccgggacgccggcgacccggacggtgtactacgaccgcccgtcggtcaccgggcacttcgagctgcgcgccgggccgtacggggacggcctgctgatccgcttcgtcgacctgcggcagatgaccgtgtcaccgggcggcatccggctgtacgacatgctcgacacggccttcgacggcttcaccgtcctgcggccggtcaccggccccgacggcccgatcgtcgacttccgctgcgagtacgtcaaccagctcggcgcccggctgaccggacgttccgcggaggacgtgatcgggcacctgctgagcgagatctcgccggagagctgggacgacggcatgttcgagcggtaccgggcggtcgccgacggcggcgagccgtgccggcagcagctgtcctacccggagatcggccaggtgtgggaggtcaagatcggcaggtccgggctcgacgcggtggtcgtgtcgttccgggagatcaccgaacacatcgaccggcagcggcagctcgcggccagtgtgacccgcgccgaacacgccgccgcgcgggcccgtgccctggaaagcgtcaccgaggcgctggtcgcggccagcaccacgacgcaggtgtacgccgcggtcggatcggtgctgcggccctccgccggcgggcagggcctgctcgtcctgctgcggcaggaccggggcctgcggctggcctaccacgcggggtacgagccggacgtcgtcgcgcggctgcgccacctgccgctcgaccacccgtacccggcgaccgccgtcgcccgcaccgggcgttcccgctacctgacctcgccggcccagctgcgcgcggcacagcccgacccggccgtcgccgtcccgccgggggagcggcaggcgtgggcgatgctgccgctgaccgtcgccggcgacgtgctcggcgtcctcgtggtcggctaccgcgacggccgcgacttcgacgacgacacccggtccacgctgaccgccctggccgggctggcggcgcaggccctgcagcgggccatgctcttcgagaccagcatgtcgatcgccgccgagttgcagcacgcgctgctgccggccagcctgcccgtcgtgcccggactgcggcacgcggcccgctacctgccgtggacccgtggtgccgaagtgggcggcgactggtatgacgtcatcgcggtgcgcgacggccggatcgccgtcgtgatcggggacgtggcggggcacaacgtggccgccgcggcggcgatggggcagatccgggacgccctgcgcgcgtacgcggtcgccgggctgtcgccgtcctcggtgatgcggcacacccacgacctgatccagtcactgcacctcgacaccatcgcgacctgctgctacctgcaggtggacgttgccgtgggcacggtcaccgcggtgctcgccgggcatccgtccccggtgttgcgcaccacgaacggtaccggcctggtcaccttgccgatccagccgccgctcggctcgttccggcggatcgcctaccgggacaccagcttcgacctgccgcccggagccactctgctgctctacaccgacggcctggtggaggactcccgccacccgatcgaccgggggctgagccagctgtgcgccgcggtccgggccgcccccggcgacgaccccaccgcgatcatcgaccacgtgctcgccgccggcgtcgggccccggccccggcgtgacgacatcgccgtgctgtgcctgacccgggacgcggaacagcccgaaacccggtga

SEQ ID NO: 6356 - DNA, 1776 bp, Actinoplanes utahensis
atgcgaagaaccgacaggcgtccaggatcgccgaaggtgaaggcgatccggctggtcgcggcggcggtgacgctggccgcgagcggaatcctgaccgtcacgttcgtctccggcggtggcaagggcaccgccgacgccgccaccagcctcggtcagtatgtgccgatcgagcaggtgcggccgaatgtcgcccgggtccggacgtcgccgggcggctcggcgggccggttccgggtggactgcggcaccaaccggaaccggaagttcagcccggacaacccggtggcgcagcccgggatccgcaacggcgcggagcatgtccacgacttcgtcggcaacctggcgatcaccgccacctcgtcggacgccgacctggacgcgtccggcacgacctgccgcgacggcgacaagtcggcgtacttctggccggtggtgcgcatcgaccggtcggtgcgcgacggcggcgcggtcgcgcaggccctggccgggacctcgccgacggtggtctgcccgccggtgcgggaccggcttccggcggtcccggccggcgccaaggccgcggtggaccgccagctggccgaactggaccgtctggaggccgacgcgggacggcaggtgctggccggccggggtgtcaacgtcgggctgaacaccaccgtgctgcagtccctgcgggctcgccgcgccgccctgctcaccgggatcggcgacaccatgcgggccgccggggcgcgccggccggacgggatggtgtcgctggccgactgcgacgtcagctacgacggcctgcacgccgcgctgcacggcgaccaccgggccggttcggtggccaccccgacggtgcggtgcccgggggtgcgcgacaagctgcccggcgtgcccgcgaccgcgctcgacgaggtcgaccgcaacctggccgagctggatcggcagatctccgaggcgaaccagcggctggtcggcgatccggccgtcggcgccaccgcggtcctgggtccactgcgggccaagcgggccgcggtcctggaccggatcgccatcgccatcgggcgcaccggcccgcgcccggccggcctggagcagctggccggctgcaccgtcgacgcggccaccggcgggacctcctcgccggcacccggcagcggcgtcccctcggcggcgaccggcagcggcgcgccctcgccggcgcccggcagcagcgccctgcccgacccgcagggcccgaacctcgaactgcccggcaacaccggcggtatcgtccgcccggcgaaggtgctgatcgaataccggggcaacgcgaccgcgaaggtggtgccgatgccgaagttcctgcgcgcgctgaccggggacgccaaacccaccagccgggggccggccaacgcccgggccgcctggacctgctccggattcgccgaccggctcaccgaccggtatccgatctgcccggccggcagccgggtgcagcgcgtccacgacttccccggctgctgggacggcaggaacctggacagcgccaaccaccgcagccacgtcgccttcgccgaccgggccaccggcgcctgcccggccgggttcgtcgcgatcccgcagctgcgcgtcaccatctcctacgacatcccgcgtgacgtgcaggtcaacgggcagtacgcgctggactcgttcccggaggagaaccacaacccgttctccgaccacgacgacttcatcaacgtgaatgccgcccggaccatgcagcgcatcgccacctgcatcaaccgtggccgcaactgcgcctga

SEQ ID NO: 6357 - DNA, 654 bp, Actinoplanes utahensis
gtgacatcgacccggttgacgatcgacgtgtgggccgacgtgctgtgcccctggtgctacctcggtgagcagcggctgagcgaggcgatcggccagtccccgcacgccgccgagatcgacctgcgggtgcacaccttccagctcgacccggacgcgcccgccgaggtcggcaccaccctggcgtacctggcgaagaagttcgggatgccggagagccaggcccggaccatggaggaggggatggcggagaaggccgccgccgacgggctcacctacgtggtggaccgcccggcgggcagcaccttcgacatgctgcgggtgatccagctcggcaacgcgcacggcgtcggctgggagtacctgcgggcgctgcaggccgaggtcttcggcggcaacttcgacgcctacgagcacgagacgctggtccgtgtcggtgtcgccgtcggcgtgggcgaagcggagatccgcgacgtcctgacgtcggaccggttcgccgaggaggtccgcgccgaccacgacgcggcggtgggtctgggtgcgcgcggcgtgccgttcaccgtactcggcaatcgtctcggtgttcccggagcggtcagcacccggcagtacgccgccgccatcaagcaggcctgggcccaggtcgatgccggctga

SEQ ID NO: 6358 - DNA, 633 bp, Actinoplanes utahensis
gtgcgcgcggcgtgccgttcaccgtactcggcaatcgtctcggtgttcccggagcggtcagcacccggcagtacgccgccgccatcaagcaggcctgggcccaggtcgatgccggctgaggacggtccgctgcggttcgtcctggtggacgacgcggagtactgtgacgcgcagaccggccggtgcgcgccgggcgaggtggtgacacaggtggatctcaacgagttgtcgacctctgtcctgccctacgtgtcggcggtcgccggcgcctacggcagcgcggtgctcgacaaggtgaaggacgcggccgccgaggacggcgccgacgcgaccgtcagctggggccgcaagctgctcagccggctgttcgccggcaagcgtggcgagaaggtgtccgacgcggtccgggagctggccgccgacccggccgacgaggcgtcgctggcgctggtccgcgcgcagatcctgaaggcgctgaccgaggagccgtcgctcgccaccgaagtgcgcgagctactgcaggcggccactccggccggcgaccagtatcaggtgatcatcacccggagccagggcatccagatcggctcccgcaacactcagacgaatacgtacccgccgctcggcgactga

SEQ ID NO: 6359 - DNA, 366 bp, Actinoplanes utahensis
gtggccatcatggtgtgggtggataaggcggactggaactgttgcggcgatccgttccgggtcggctcgcgggtcgactgggagctccggcgtgacatcgacgcgcggtggctgggcgaggtgctcggttccggcgcggcggtcggcgtcgacgcctatcagtatcaccacggcggtcccgacgcggtgatcgagccggccagcgcaacggtgacccggatccaggcggttcatgcccggcccgatccgcggaccggcacggtgccgggctccggggtgctcaccgagctgcccgaggtcacccggggcgtccccgatcgtggtgatctgacgttcgagggcttcctggtgcggctggaggagtag

SEQ ID NO: 6360 - DNA, 1341 bp, Actinoplanes utahensis
gtgagcgcgcggcacgcctgggtcgacgcgtccgccggggtggccggggacatgctgctcggggcgctgctcgacgccggcgccgacccggcggtggtgcaggcggcggtcgacgcggtcgttcccggctcggtgcgcatcagcgcgtcggaggtgacccgggccgggctgcgggcggtcaaggcgcacgtcgaggtgctggtcgccgagccaccgcaccgcacgtgggccgggctgcgcggcatgctcgacgactccgggctggtggtcgccgtgcgggaccgggcggtcgcggtgttcgcccggctcgccgaggcggaggcgcgggtccacgggatcccggcgggtgacgtgcacttccacgaggtgggggcgctcgactcggtcgccgacgtggtcggggtgtgcgcggcgctcgacgatctcggggtcacctcggtgtcggccggcgaggtggcggtcgggtcggggtgggtgcggggcgcgcacgggcagctgccggtgccggtgccggcggtggcgcagctcgcgctgggctggcgggtgtccgcgggtggctccggcgagttggccaccccgaccgggatggcgctgctccgcgcgctggcggccacctgcgaggagttgccgtcgatgcgggtcgaggcggccgggaccggggcggggggacgggatcgggcggagcgggccaacgtcgtacgcgtcatcatcggacagcgagaagaagcggaccgggcagagggcatgcttggggaagcggaccgggcagagggcaagcttggggaagcggaccgggcagagggcaagcttggggaagcggaccgggagaagatcgtcctcctggaggccaacgtcgatgatcttgacccgcgcctgtggccgggcgtgctcgcccgactcctcgccgccggcgcggccgacgcgtggctcaccccgatcctgatgaagaaggggcgcccggcccacgtcctgtccgcgctctgcgcaccggaccaggtccccgggctacggcgacacctcttcgaacagaccagcacgctgggcatccgggaatccgtccggcaccgcacggtgctggcccgccacgtcgtccggatcggcgagatcgccgtcaagatcggtcacctcgacggggtgatcgtgcaggccatgccggagttcgaggacgtggccgccgtcgcccgccgcgaaggccgcccggaacgggtggtgctacaggaagcgctggccgccgcggccgccgccggcctggtgccgggccggccctcgccgcctactcctccagccgcaccaggaagccctcgaacgtcagatcaccacgatcggggacgccccgggtga

SEQ ID NO: 6361 - DNA, 783 bp, Actinoplanes utahensis
gtggaacatcccacttccaccggcccgggctcgccgcttccgcgggatcggacacggtgtagaacgggtgcatggacgacgccgagcgggacgaaacggtggtacgggtgggtcgtgactgagccgctcgactatgccgacctcgacctggaccgggcggcccggcgcggctacccggaggcggtgttctgtgccgggaagacatcggcccaggtcgccgggatcgccgcggcggtccgctcgcgaccggaggtgaccaccctgttcacccgggccgagccggcgcacgcggcggcggtgctgggcgagctcccggatgcccggcactaccctgacgcgggcctgctggcctggccaccggaccccgcggcgccgaccggcgggctggtggtcgtgatggccgcgggcacctcggatctgcgggcggcgcgcgaggcggagctgaccgcccgccatctcggccgggccaccgaactggtggtggacgtcggggtggccggcctgcaccgggtcctcggccgtctcgagctgctgcgccgcgcccgggtcgtggtggtggccgccgggatggacggcgcgctgcccagcgtggtcgccggcctgatcgcggcgccggtgatcgggctgccgacctcggtagggtacggcgccgcgttcggcgggctggcgccgctgctggccatgctgaacgcctgcgcgccgggggtcgcggtggtcaacatcgacaacgggtacggggcgggccacctcgccgcgcagatcgccgcggagccggccgcatga

SEQ ID NO: 6362 - DNA, 516 bp, Actinoplanes utahensis
atgcgatcgaaattgtcggccggcgccgtggtggcgctggccttcctgattccggcggcaccggcggtggcgcacaccggcgcgcccgccggcaccaagaccaaccggtcggccgagcgcaaggtctaccgggacctccgcgaaatcgtcaccatcgatccggacaccgccacctccacgcaggtgcggctcgtggccaaccggatcctgttcgagtcgacgagggaggcgctgccggtcctgcccgacgcggtgcaggcagcgatggacggcaccgaggcgcagttgcggaccttcctgaagacgggcctgccgaacgcctgggcgacggcgctgcggatctcggtggtgcggacgctcaccgacgccggcccccacgtctatgcggccgcgcagcagacgctcgacaccgcgaagatcgacgcctacctgacgttcctcaacgtcgacctctacaccgcccgtgagctggacctgcgcgttccgccgcggcacgtcccgcagcggcaggtctga

SEQ ID NO: 6363 - DNA, 108 bp, Actinoplanes utahensis
gtgttccgccgggccgggtcagccgccggtcaccagcatgatgcccagaccggccgcgacgccggcgtggcgggcggcggcgagccgcatgatctgatggcccgatga

SEQ ID NO: 6364 - DNA, 510 bp, Actinoplanes utahensis
atgaacgcatccggtccggcggcccggcaggccgagctgcgactgcgggtcgccgagcatctggagcccggcgagacgctgcacgccgcgctgtggatcgcccgcgacccgggcctgccgctgatctcccggctggcgccgggcatgccgggcagcccgccgccgggaccggccggtggcatcgccgccgagctgtaccgccacctgccggagcacaccgtcgccgccaccctggcgctgaccggcgaccggctgcgcctgctgctgctcgacggcgagttccggccgccccgacgccgccttttcgggcggtccgagccggcgccgctgccaccgctggcgccggtctgggagtgcccgcgggccggcctggccaccgcggccgccgacgagccggcgggcagcctcaccctgcgtttcgccgacgggtcggcgctggcggtggccgccccggggttcaccgccgtcgcgttcgccgaggcggccggtcggtcgggtgccggcggttga

SEQ ID NO: 6365 - DNA, 1881 bp, Actinoplanes utahensis
gtgggcggcgcgatctcgacggtcggcggcaacgggtggtgggcgcgcggtggcgacggcggtgcggccaccgcggccgagctctaccacccgggcggggtggccgtcgatccggccggcacgatgtacatcgccgactcgggcaacaacgtggtccgccaggtggccgccggcatcatcaccaccgtcgcgggcaccggcgtggctggcggcacaccggccgacggcgggctcgcgaccagcggcaatctctccgacccggaggacgtcacggtggactccggcggggtcctctacatcgccgacaccggccaccaccggatccgcagggtggccggcggtgtgatcaccaccgtcgcgggcaccggcgtggccgggtcgctgatgaccggcgtcgcggccaccacgttgctgagctcgccgtacgggatcgacactgcgaacgggatggtgtacgtcgcggacacgggcaacaaccggatcctgatgatcaacggcgccgcggtcagcgtcatcgccggcaccggcacggccggcacctcgccggacggcaccgccgcctcgctcgcgaaactgaacgcgccgcgggacgtgaaggtcgacgcgtccggtgacatctacgtcgcggacaccggcaaccacctggtccgcaagatcagcaacgggacgatcagcacggtggccggcaccggcgcgctaggctacgccggcgacggcgccctggccaccgctgcgctgctggaccagcccgacgggctcgaatccgacaccgccggcaacctgtacatcgccgacggcaacccggccgccgcgggatacggcggcagcgtcctgcgccgggtcgacaggcacggcgtcatccacaccatcgccggcaagtaccagagctactcgtgggccggcgacggcggctccggcaccgcgaacgccgcccgggtgcacacccccgggcggatggccatcgacgccaccggcaccctgtacttcccgtccagcggtgagctgcgcgtccggcagctcacgctgcagacctcggcggccatcttctggacgtcgaacgccaccctcggcgcgaccggcgccgtctacggctgggaattcgtctcccgcaccgccaccccgatcgccagcatcaccgtcgcactgcccaccgccaccaccggcgccggcctgtacgtggtgagcgccgtccacctgcccggcaccgggaccgtctcgctcagcggcacgaccctgacgtacaccctggcctcgccggtgaccgtgccggtcggccggcacatgtacctgtcggtcgccggcttcaccaacaccggcaccgccggcggctacggcaccaccatcaccacgcgcgcggccggcgccgccaccatcgacgtgtcccagtccggggccgtgacgttcacgacggcgacgccggtgctcgtcgtgcccaacccggccacgacggtcaccgcccctgcccaggtggtgctctacgtcgatccgatcacccagggcgacaacagtgtcaccgccgcgctgaccgtgaagtccaacgcgaccaacggctacacgctgaaggtcgccggcaccccgatgagcggcacgtacggtgcgctcaccccggtctccggcgggctcgccagcccggtgaccggcggcggattcggcgccgggcggttcggctacgcggtctcggtcagcggcgccggcaccttcgccggaaccgccggaagctacgccggctacacctccgccggggaggtggcggtcaccgccggcaggccgaccgcgatcggcggcgacacggtgcagatcaccaaccgcctgaaggtggacttccagcagcgggccggcgtctacaccggcacgctgaacttccgggtcaccgggctctga

SEQ ID NO: 6366 - DNA, 966 bp, Actinoplanes utahensis
atgtcattcagcacgagccggcggctggcgacggtcgccgtcgtgaccgccgcagcggtcgccggtatggcagtcccggcgtacgcggccggcacgctcaccggcgtgggctggtccacctcgcaaccccagccaggcgccaccggtgtgcgctacacctggacgttcaccaccgcgacgaccggcacgatcaagcacgtgttcctcaccgtgccgacgggcaccggggtgcccggctcgatcaccgtctccgacctgtacgggctgaccaccggcaccgccacgctgaccggcagcaccgtggatttcgtcgtgaccagcgccgcgagcgtgagcgccgggaccggggtgctgatctcgctcagcggcttcaccaacacctcgacggcgggtgcgtacagcagcgtgatcagcacccaggacaccgcggcgccgaccatcgacacggcgaccggcaacacggtcaccttcaacgacaccagcaccgcggtgaccgtggtggtggcccagtcgacggcgttcagcagcaacaccaccggcttcaccatgctgatggatccgtccgtgccgagcctggcgacgcagaccaaggatgtggtgctgaccgtggcgacgaacgccgcgaacgggtacaccctcggcaccaggatcagccagcagccgctgggccaggcgcgcggcgccaccctcccggcggtcgccggcagcgtcggcagcccggtgacggccggcaccgacaccttcgggtacacggtcagcgcccacaccggcgtgggcaccgtccagggctcgatgggcggtggctacgcgggatacaccacggccggctatgcggtgccgttcgccgcgttcggacccaccaacggggacaccgtgacgctgaccaaccaggcgaagatcgactacctgctgaaggccgacacgtacggcgcgagcatcacgtactccgtcaccccctcgtactga

SEQ ID NO: 6367 - DNA, 633 bp, Actinoplanes utahensis
atgagaaaccgcaaccgcgcactggtagccgcagtgatcacgaccctcaccctcccgttcggcaccccggcgcatgccgccaccgatgccggcgcggcggccgccgcgatcaccgtcgaggtgatcgccgccagcggatccgggtgcgccccgggcaccgcctcggtggtcagcaacggcgacgacaccggtttccgggtccggtaccgcgacttcgtcgccacggccggcggggacgccgacgtcgtggaccgccgcaagaactgccagctcggcgtcctcgtgagcatcccggacggctggaccgtcgccatcgcctcggccaactaccgcggccgggcgagcctgcggtccggggcgaccgccctgcagcgcaccagctactactggcagggatcctcggcgaccgcgcgcaaggacgtgacgttcagcggcccctattccggcctctggacgacctgggacgtggcgccggtgctgacctacgccgcctgcgggtcgcagagcgtcctgaacgtcaacaccgaactgcgactcaacgccggctcctccaccggcaccagcacgatgtcgatgaacaccaccgagggcgacgtcgacaccctgttcaacttcagcctctccccctgctga

SEQ ID NO: 6368 - DNA, 651 bp, Actinoplanes utahensis
atgaaattcctgttaacccgcggatgcgttgcgctcgcggtgctggcgtcgtcgttgttcctggtgtcgccggcttccgcggcgatcgtcttcaccgatccgccgccccccgacgcgatctccatccagctggtcgccatggcgggctcggggtgtgccccgggcaccgccgacgtggcgatctcgccggacaactccgcgttcaccgcgatctacagcgcctacctggcgcaggcggggccaggcgtcccggtcaccgagaaccggaagaactgccagctcaacgtgctggtcaacgcgccgtccggctacacgttcgcgatcgccaaggtggactaccgcggttacggattcctgcagcgcggcgcggtcgcccagcagcgggcgaactactacttccagggcatgtcgatgggcagctacgccaaccacccgatcgccgcgccgctggacgacaactggatcgccaccgacgaggtgccgatcgcggcccaggtcttccgcccctgcggcgagcagcgcaatctcaacatcaacaccgagttgcgggtcaccaagggcacctcgaccgacgtcagctacgtgaccatggactccaccgacggcagcatcgagacgatctaccacttcacctggatgcgctgccactga

SEQ ID NO: 6369 - DNA, 1242 bp, Actinoplanes utahensis
atgaccggccgccgcgatcacctgacccgctccgcacccggctgcccgggtcggcgcgaatctcgccggacggccgcctgggccaccgtggccctgctcgcgaccggcccgctcgccgcctgcagcccggcggcggacgcgcagcgccccgcaccgccggccacgccgtcgccgtcgccgtcgctgttgccgcagtccccggcggcggccgggccgatcctgcccggcatgccaccgccgctcgacccgtcggacgtctacgccgccgaccggcccggacacgtcgcggcggtcgcggtgcacgacccggcgctggtctacgtgcccaatctggggagcgacacggtgatggtgatcgacccgcggacgtaccgcgtgatcagaaccgtgcctgtcgggcacggtccgcagcatgtggtcccgagctgggatctgcgcaccctgtgggtcaacaacaacgccggcagcacgctgacgccgatcgacgcggcgaccgggaggttcgggaagccgatccgggtcgacgatccgtacaacctctatttcaccccggacggcaagttcgccatggtgatggccgaaacgcggaaggcgatcatcttcagtgacccgcacacgatggccgcacgacacgtcctgccgatcgggtgtcgcggtgtcaaccacgccgacttctccgccgacggtcgctacttcatcgccacctgcgagttctccggtgagctggtcaaagtcgacacggccgcccagcgcgtggtcggccggctgcagctgcccgggcacgccatgccgcaggacatcaagatctcgccggacggccgcacgtggtacgtggccgacatgcagaccagcggcctctggatcctcgacggtgaccacctgaccgtccgctccttcctgcccaccgggtatggcgcccacggcctctaccccagccgcgactcccgccacctctacatcgccaaccgcggcgaaggcagcatctcggtgctcgacttccacaccggtcgtctggtcagcaagtggaaactgcccggccaggccagtcccgacatgggcggcgtctccgccgacgggcgggtgctctggctgtccggccgctacaaccgcgaggtctacgccatcgacaccggctcaggccggctgctggcccggatccgtgtcggtgcggaaccgcacggcctctgcgtctggccgcaaccgggccgctactccctcggccacaccggcatcctgcgctga

SEQ ID NO: 6370 - DNA, 840 bp, Actinoplanes utahensis
atgggtgtcccccatccgtggggggtccctccgcggtggaaagtttcagggttctctcatccggtcccgcctactgtccggtgcatgcaacgtcgtcatgctttgcgcgcggctgccgcgctcactctcagcgcggtcgccgggtgcgacgccaccgaaccggcgcacgtcgcaccacccgccgccgaaggatccccgcagcggccggccaccgcgccgtccgggaaacccggggcggacctcccggatgaggtgcagcacggcccgcgggaccggtccggcgtcgccctgaccttccacggtcagggcgacccacgccaggtcaccgcgcttctcgaccagctgcgccgcggcgccgccccggtcaccgtcctggccgtcggcgcctggctcgacacccagcgcgccctcggccgccggatcctcgccgagggtcacgaactgggcaaccacacccagcaccacgcggacatcaaaagcttcacgtcggcgacggcgtacgccgagatcgccacctgcgcccgggtgatccgcgccgtctcggggtcggccggccgctggttccgtccgtcgcagacccggttcgccaccccgacgatcaaagcggcggcccgccgcgccggctaccccacctgcctgtcgtacgacgtggactcccgcgactacaccgatcccggcacgcccgccatcgtcgcgaacacgctggccgccgtacagaagggatcgatcgtgagcctgcatttcggccacgagcagacgatcgcggcaatcgccccgctgctcgccggcttgaaggcacgcggcctgcgcccggtcaccgttgcggacctgctgggatga

SEQ ID NO: 6371 - DNA, 96 bp, Actinoplanes utahensis
gtgatcagtggggtgctcaacgcgtacaccagggaagatgtttttttcttcgcgacgcaggcaaccttttccgctccgcggaccactcagcggtga

SEQ ID NO: 6372 - DNA, 1644 bp, Actinoplanes utahensis
atgccgatctcccgactcaccccggggctgcaccgtcgtcccacgcgtcgccgtgccgtgctggccggcggccttgccgcggtagccgcggtagccggtatcggactgctcggcggacagccgttcgcctctgccgaggccaacatcagcttcgacaacggctcgggcatgagcttcgtggtggacgccaggaacggcaacctgacgtcgctgcagcacaacggcaccgaactgaccgcaccgggccgggccgccgggcagatcgagtcggggtggaagtcggctgccgtcagcagcaggaccttcgccgacaggtcgatcctcgtcacggtcgacgagcgcgaggtcggcgagacgcagtattactacgcccgccggggcgacaacacgatctacatggccaccgacatccgccagccgcagaaccccggcgaggctcgattcatcacccgcctcaaccgttcgctgctgaccacctcgccggtggccgcccggacggccggcacggtggcggcggtggagggctcggacgtcttcaagttcgccgacgggcggaccgcctccaagttctacagctcccagcggctgatcacgcagcagccgttcggcgccagcggacacggccacggcgcctacctcgtcccgggcaccggcgagatgagttccggcgggccgttcttccgcgacatcgaggtcaacgacaccggcgacgcggtcaacatcacctactgcatgaacagcggccacacccagaccgagccgctgcggctcggcctgcagggcccgtacgccctggccctcaccgacggccccgccccggcgcggcacagcctcgacttcctgtccgcctacattcccgggctgctctccaacgcccagcgaggcggcgtgcaggggacggccaccggatcctggaacggccagcgagccaccgtcgcgcttgccggtccgaacgggcagtactggagtcaggtcaaggccggccggttcctgatcggccacatccgccccggcacctacacggccagcctgtacgcgggtgaactcgccgtgggcgtcgccaaggaggtcaccgtcaccgccggcgcgaccaccacggtggcgctgagcggcaacgtgccggccgccggcacgctgttccagctgggcgccttcgacggcaccccggccggtttccgcaacgccgacaagatcgagacgatgcacccgtcggacccgcggatggccccctggaacgtgggcacgttcgacatcgcctcgggcgccgcgaacttcccgatggccgaattccaggcggtcaacgcgcccctggcgatcaggttcccgttgcgcgccgtccccgccaagggtgtgcgcctgcgggtcgcgaccacgctgaacttcgccggcggccgtcccgccgtcgcgatcggcagctaccgatcgccggtctccgcctccccggcgccccgtgacctgaagtctcgcggcgtcacccgcggaacctggcggggcgtgaacaccacctacgtgttcgacatcccggcggcggccctgaaggagggtgccaacaccctgtccctctcggtggtcagcggcagcaccggaaccaccttcctcagcccgaacttcgtcttcgacgccctcgccctcgacccggcgtaa

SEQ ID NO: 6373 - DNA, 846 bp, Actinoplanes utahensis
atgcaaactcgttccctcggtgacgtgcgggtcagcgcgatcggtctcggcggcatgccgatgtcgatcgagggccgcccggacgaggaccgatcgatccggacgatccacgccgctctggacgccgggatcaccctgatcgacaccgcggacgcctaccacatcggcgcggacgaggtcgggcacaacgagtcgctgatcgcccgggccctggccgcctacggcggggacacctccggggtcctggtcgcgaccaagggcggacatcggcgcccgggtgacggcagttggaccgtcgacggatcgccggactacctgaagcgggcctgcgaggagtcactcaagcgtctcggtgtcgacgcgatcggcctgtaccagttccaccggccggacccgaagacgccgtacgcggactcgatcggcgcgatccgcgacctgttggacgccggaaagatccggatggccggcatctcgaacgccgacccgaagcagatccgcgaggcacgcgacatcctcggtggccggctggtgtcggtgcagaaccagttctcgcccgagttccgctcgtccgggccggagctggagctgtgcaccgagctgggcatcgccttcctgccctggtcaccgctgggcggcatccgggcggccggctcgctcggcggcgccttcgcccgggtcgcggagaagcacggggtgagcccgcagcgggtctgcctggcctggcacctggccaagtccccggtgtcgatcccgatccccggcgccagccgcccggagacgatcaccgactccgcggccgcggacaccctggagctgacccccgaagacctggccaccctgccgtag

SEQ ID NO: 6374 - DNA, 2283 bp, Actinoplanes utahensis
gtgcgcggtctgcgggcgtacgcgtggtgtggctggctgggagtcgtggcctgcatcatgctgctcagcccgcccctgggcgaggccggtcgggaattcgcctacgccggggtcggtctcggttcggcgatgtgcgtcctcgccggcatccggctgcgccgggccgcgcgcccgcgcgcctggctgctgctggccgcggggctgagctgcgggggcgcagcgaacgcgatctgggccgtcgagctcagcctgcggtcggctccaccgcgcttctctgtggtcgatgtgctctatttcgcgatgtatccgctgctcgcggccggtctggcggcgcttccggagcgctcgccggaaggctcccggtggatcggggtttccgaggcgggcatcgccgcgtgcaccagcgccaccctgggatggctcttcgtctacgacccgtacgtgctggaccggccggaagcggtcgtcagcgccaacgccttcgcctaccccatcctcgacgtcctgctggtggccgtcgccgtacgcctgctcgtcgcggcgcgccggctgcggccggcgcacgtggcgctggtggcgatgacgctgctgatgatcgtcgcggacgcctcgtacgtcgtgtcggtggttgtcggtggcgcctggtcgggttcgccgtgcagctcgctctgctggctggccgccttcgcgctgccgggcgtggcggcgctgcatccggcggtgtccggccgtggggcgagcatcagcgtgcgggccggcggctggcacgccaccgcgctgcaggcggtactggtgctgatcggcccggccgcgaccggatacgccctgatcctggactcccgggaaggccacctgaccgtttacgacttcatcgtgccggtcgccgccaccgtcgtcatctcgctgctgctcgtggtccggatgggcaacgggcagcggcagctgcagcggcatgccgagaagctgggcaccgcgctcgccgagcaggccgcgctgcagcggtcgctgcggcacgtgaacgagcacgacgcgctcaccggcctgccgaaccgccgtaggctgcagaacctgatcacgtccggtacgccgtacggtctgctcctgctcgacctggacggcttccagaacgtcaacgaccggctcgggcactcggccggcgacgacctcctgcgcgtgatcgccgaccggctgggtgccgggctcgccgacgccgacgtgctggcgcgcaccggcggcgacgagttcgcggtgctggtacccggcgccgcgccggcgacggtcacggcgcgcgccgaagccctgctcgcgacgctgcgggaaccggtcacgatccacggccacgtgctgtacgtgacggcgagcatcggggtgcggctgcccgagccgacggccgatccggcgcacctgctggacgacgccgacctcgcgctgtacgccgcgaaggcggccggcaaggactgcgcggtctggtacgacgccggcctgcgcgaccggcagaccgagcggctgcgcaccgtggaacggctgcgcggcgctctgcgaaacgacgagctagccgtgttctaccagccgatcgtcgacctgctcagctctcgcacggtggccgcggaggccctggtgcgctggttgccaccgggcgaggacccgatcggcccggacctgttcatccccgcggccgaggacagcgggctgatcgtgccgctcggcgagtgggtgctgcgtcgcgcctgcgccgacgcggtcgactggcaccggcgcgacggcatcaccatcgccgtcaacgtgtcgccccggcaactgcacgaccccgagttcaccgccaaggtcagacgatgtctggccgagaccggcctgcccgcgggtgcgctcaccctggagatcaccgaaggcatcctggtcggcgggggcacccagaagagccaggcactggcccacctggacgcgctgcgcggtgacggggtgcgcatcgcgatcgacgacttcgggaccggttactcgtcgctggcgtacctgcgcgacctgcccatcgatgttctcaagatcgaccgatcgctgatgccctccgacgacaccgacacccgccggaccgcgctggtgcgggccgtcgtggacctggcccgcggtctggagctcaccacggtcgccgagggtgtcgagaccgccttccaggccgggctgctggtcggcctcggctgcgagcgcggccaggggtaccacttcgcccggccgatgcccggcaccgctttctcaccacgccaggagccggtaccgcaggcggggtga

SEQ ID NO: 6375 - DNA, 825 bp, Actinoplanes utahensis
atgtccaggacgtggttcatcaccggcacctcccgcggcttcggccgggagtgggccgaagccgccctcgaccgcggtgaccgggtcgccgcgaccgcccgggacgtgtcgtcgctcgacgacctcgccgccgggtacggcgaccggatcctgccgctggcgctcgacgtcaccgaccgcgaggccgccctcgccgcgctggcccgggccgccgggcacttcggccggctcgacgtgatcgtcaacaacgccgggtacggccagttcggcatgatcgaggagatcagcgagcaggaggcccgcgcgcagttcgagaccaacgtcttcggcgcgctgtggatcacccagggtgctctgccgtatctgcgggcggccggcggcggcaacatcatccaggtgtcgtcgatcggcggcatctccgcgttccccaacatcggcatctacaacgcctccaaatgggcgctcgaaggcttcagccaggcgctcgcgcaggaggtcgccgccttcgggatcaaggtgaccctggtcgagccgggcgcgttcggcaccgactggggcggctcctccgcccggcacgccaccgcactaccggagtacgagagtgtccgcgcgcaggccgccgaggcgcgcaggggtcgggccggcaacccgggcgacccggaggccacccggtcggcgatcctcaaggtggtcgacgccgagaacccgccgctgcgcgtcttcttcggcaacgcggcgctggccatcgcgaccgccgactacgagtcccggctcgccgaatggcagcggtggcagccggtctcgatcgaggcacagggcgcctga

SEQ ID NO: 6376 - DNA, 138 bp, Actinoplanes utahensis
gtggacatgcatctcgaaaccgctgacttcgtcgctccggtcctggccggtctggccggcatgctgggtgtctacggcgccgaggacgtcctgggccggctccggcgccgcggctggtgcccgcgccgctggcgttga

SEQ ID NO: 6377 - DNA, 804 bp, Actinoplanes utahensis
ttggcgcaccgcgccgcggtcgcggcggtgcagcgcagcctggacgggccgaaaacggtggtggtcgtcaacccgaagggcggggcgatcaagaccaccaccaccctgatgatcgcccgcacgctcggcatccaccgcggcgggtacgtgctgggctgggacaacaacgagacccgcgggacgatgggctggcgggccaatccggcccggcacaccaacaccgcggtggacctgctgcgggatctggaccggttcgccgacgtgcgcagcgcccgggtgggtgacctggacaactacgtccggtcgcagggggacgcgcagttcgacgtgctcgcctccgacgaggacgcggagtcctcggccagcatcgacgcgacggcgttcaggaatctgcaccggacgctgagccgcttctaccgggtgatggtggtcgacaccggcaacaacatgcgggcgagcaactgggaggccgcggtcgccgaggccgaccagctggtgatcgtctccacggtgcgcgaggacaccgcacagagcgcggcatggatggccgacgcgctgaacacgtccggccgcggcgccctggtcgcgaacgcggtcaccgtgctcgccgacccggccgcggtcgccgaccgggcgctgcgggcccgcctgcaccggcatttcggccagctcacccgggcggtcgtcgacgtgccgtacgacccggcactgatcggtggcgggccgatcgcctacgacgcgctctcgccggccagccacgcggcgtggctgcgggccaccgcggccatcgccgagggcctctga

SEQ ID NO: 6378 - DNA, 399 bp, Actinoplanes utahensis
gtggaccgagatacgtgccgctcaatgtctcgtaaggtcaggctgaccgcgagggacggcgcgtacgtcgtcgccctcgcggtgttcgagacgaacctcgtccgggaggccctgcgggtgatcacccagctgcagatctccccggaccggatgctggtccagttcggtttcgcgaaagcggagctcgccgagctggccgagcgtctgaccccggcggtgaccaccggcgccgagctggcggtcacccaccgggaactgcgcatgatctacctggtgctccgccaggtgccggagatgttcggcaccgaggaggacttccacctgcggctcggtttctacaccgagcaggcccgcgggctggccgcggcgttgctggccgcggtcgaccggaccgcctga

SEQ ID NO: 6379 - DNA, 2295 bp, Actinoplanes utahensis
gtgaacgtggcgcgggccgcgatcaaccaggccaccgcggcgaagtcgaacgccgagctgaccaggtcgtcggcggacgcgtcggcccaggaggccgggatcgcgtcgttccagagccggatcgccggccgggccgcgctcaacgcccgtgtctcggcgctcgccctggccgatccggccgcgtcggcgatcgacgtggcctcggcgtacgcaccgaccgacaacgacgcggcgatggccgtcgacatcgcgaacaacgcgatgctgatcggcaccgagcagagcgcccaggccgagcagcacgccgtcgacgcggacgccgcggcccagcacgcggcggagatggcggagaaggcccaggagcagatcaaaccggcctaccaggcggcacagaaggcggccgccgaggcggcccgggcggtcaaggcgtccaaggtggccatcgacgcggcgatcggcgcggccaaggaggccaacgccgcgatcaaggcggtcagctcggccaccgaggcggcacgggtggccgcgtcgtacgcgcagggcgccgagcggatggccgtcgaggccgggcacgacgccggggtcgcgcggcaggccgccaacaacgcccgcagctacgcgaacaccgctgacaaggccgcggacaacgtccagaagatcgccaagcaggtggacgcggcggccaagtcgggcaagctggtcgccgactcgatgaagtcggtcgccaaggagatgaccaccctcgcgcagaacctgaccggcgcggtggaccaggtcgcgcagctgcgggacgccgagaagcgggcccggcagacgtcctggatcaagacctggcaggaccaggccgacaagttcatcgacaagatgttcgacgacccgtcggtgcgtgactacctcaaggggatcacccagggcgcgatcggcaccctcggcggggtgtggctggccgggctgtgcgccttcggccccggcggcaactcccccggcaacacgccggactccgaggaagcctgcgacatgctggtcgacggcatcaagcagacgatccagaacccgggctcgctgatccacctggaggagtggaagaacggcgagtacgccaagttcttcggcctctggacgttcgacatcggctcgctggcgatcggcaagatcggcaaggcggcgcagggcatcaagctgctcgaggacggcatcccggcggccatcgccaagctgctcgacggcgagctgctggccggcatcaagacgttcggcaccgaggcgatggacgcggcgctcaagaagctcggcgcgatcaagctcggcaagctgatcgagatcgccgtcgacttcccgaacaagttgaagttcagcaacatcgagctcaacctgatgaagatcgtcatcgacaagcggggcttccccgccgtcgaggatctcgtcaagaatctgcccgagggcaagaacctgatcgaagagctggagaacctgctcgagatctgcaagcgggacagcttcgccccggagacccgggtgctgctcgccgatggcacgacccggccgatccgggacgtccgcaccggcgaccgggtgctggccaccgacccgctgaccgggcggaccgccggtcgcacggtcaccgacctgcacctcaacctggacaccgacctggccgacgtctcggtcgccacgggcggggagctgcgcaccacgcagcaccacccgttctgggcggccggctcacaccggtggaccctggccggtgacctggccgcgggtgacacgctgcgcaccccggcgggcggcaccgtgccggtcaccggcgtgcagcggtacgacgggtcccggtggatgtacaacctgaccgtcgccgacctgcacacgttctacgtgctcgccggtcgtacgccggtcctggtgcacaactgcggggagttcgacgacgagaccggcggcctcaccgacgcggcgatggatcggctggagaaggcctacggcaacgaggtggccgccggcgtcgaccacatggtggagcggatgcacgacggcacgccgagcgccgcggaccacgacatcccgggcctcggccacgatcccgataagatcggccagtacctgaagggctgggtcggcaagatgacgcacaaggacacccagacgggggccaaggtcgccttcgacccgagccgtggcggggtgctgatcgtggacgtgggctaccgcatccacgcctacaagtacgccgcggacgtcttcgacacggtgaagaacaacaaaggtggaccgagatacgtgccgctcaatgtctcgtaa

SEQ ID NO: 6380 - DNA, 2205 bp, Actinoplanes utahensis
gtgccgtcgccggcgcgccgtggaccagcagagcaggaccaccatcgcgagataggtggcgaagtacaccgggtcgccgtaccgggtgcccgtcgtcacggccgccgccacggtggcgacaccggtcatggcgaggtagagcgcgagcatccggtggttcatggtcgcccgatcggcccggcgggcaccggattcaggactcggcgcgccctgcccccgaattgcaccccggcatcgccggagggcggtgccggtcattcatccacttcaaagtatccttcctgcgtcgcttgtctgatctacgggggtttcatgttcagcgaccatattcgcgcgcgatttttacccgggcggctgaccaccgccgccgtgctggcggtgctgaccgtgctgccgcaggcggtgtcggtgccggcccaggcggcgccgcggccggcggccgcggcccggccgttgaccctgtcccaggtcgtcgagatggagcgggtcgccgagcaggagcgggaacagcgactgctcgccgacggcccgatcgacgacgtcgagctcaaccggatgctgatccaggatctggccgactacgacgcggacgcggaggtgcgcgcggcggccgccgcggtgctgctgaccgacgaccccgccgagttcaccgctttcctggacaacgcgctgccggtgtaccgggcggcggccgaccggcggcagaagctggccgacgagaccaaccggttgatggtggccgagtgggcccgtaccggcggcccgatcctgcgggagcgggcggcggcggcgctggccaccggcaacgccacgaagatcgccgatttcgtcgcggtgggcagggacgcggcggtcgccgccgacaagcaggccgagctctccgcggcgcagcaggccgcgctgatcaaggcgcgggtggagcagatcgtcgccggcggcgggtacgaggtgcgcagcgccgggcagatggcgctggacagtgaggacccggcggtgatcgccgagttttacaacaccggctacaaggcggccgcggcacgcgacaccgacgctcaggcgcagatcgaggcggctctcgcggcgcgtaccaaagcggccggtgatctggctgatctggcgtcccgggccactcaggcggcgcaggcccgcacgacgatcatccgggccagcgtgtcggcgacgagctcgctgaccgtcacggccaactcgatgctgctgacgaaccggtacgccaagcagggtgacgcgatctacgcggcggacctgccgatccgcaaggccggcgggaagacgcacaccgccgacctcaccaggctgcacaccgacacctgcgccgaggcggccaccaccgcgcgcaacgccggtcaggtgaccgcgcaggccgatgtcgccgccaccgcggcgcagacgctggtccagaccggcctgtcgcacggggtcgcctgggccgaggtcacacaggcgcagaaggacgcgggcgcggcggcgaagctggccgccgacacggcctgcagcgccgccgaggcgaccgaggccgccgccaaggcgctggacgccgaccgtaacgcgacggtcgagatggccaacgcggtcaagtaccggcaggccgcggagcgcaacctggcggaggcgaccaagctcgccaaccaggcggagaagctggccgcggcggcgaaggccgccgaggccgccgcgcacacccagcggctgcgggccgaggatgaggcgcagcaggcctgggcgaaggccgacgaggccaaggagcactacgagcgggccgcggcgcagcgggacatcgcgcgcaaccagatggcggtcgcgctgcagcagcagacggtcgcgatgggcgcggcgcagcgcgcggtggaccagcagaagatcgccgtggcgaagggtaccgccgcgaagagcgcggcggacgaggtcaacgcgtccgccaagcggttcgaggggctcgccagcgacgcgcggacgaaggcggccgacgccaacaagtggatcaatgagcgcaacacgatggagttgagccggaccgcgcacgcggccgacgccatcgcgaagaagggcacggcggagggcgactacgccgccgagcaggtaaagatcatcgacgcgcagctgcccgggatccgcgacgccgagacgcgttcgcggcaggcggcgaacagcgccgcggcggcggccgacgcggcggccgtggcctag

SEQ ID NO: 6381 - DNA, 618 bp, Actinoplanes utahensis
gtgccggccgtgacgatcgacgaacaacagctacgcacggccggcccggtctcgctcgcggtgaaggttccgcagatcaccgccatgttctgggtgatcaaggtactgaccaccgggatgggcgagaccgcgtccgacttcttcgccaagaccatcgacccgccggtcgcggtggggatcaccgggctggcgctcgcggccgcattgatcgtccagctcaggtcccggcgctaccggaccggcgtctactggttcgccgtggtgatggtgagcgtcttcggcacgatggccgccgatgtcctgcacgtcggcctcggcatcccctacccggtgtcgaccgtcgccttctcgctggcgctggtcgtcgtgctggtcacctggtacctcagcgaacgcactttgtcgatccacaccgtgacccacggccgtccggagctcttctactgggcgaccgtgctggtcaccttcgccctgggcaccgccgggggcgacctgaccgcgaccaccctgcgctggggctacctgccgtcgggcctggtcttcgccgcggccctgatcgtggccctggtcggctacctcggcagccggcgcgggccggcggttcaggccgcggcctga

SEQ ID NO: 6382 - DNA, 378 bp, Actinoplanes utahensis
atgccgcccggccgggtgttcatgacggcgctgctgggcagcctggccatcctgctgggcggccgcctcttcgacaacgtcggagacgcctggggaaccaccgtcctgttcgtgctggtcgtcctggcgacctcggccttgaccgccgaactcacggcccaggcgcagcgggaccggggccgctgcggcgggtgggcgcgcatggacaccggcatcgtcctggcgctcatcgtgctcgccgggctgctcctgacggcgtccgccatcggcgtcaggtcggcgggcacgcagaccgccgcggagcgtttcaccgtcctatacgtcctgctggcggggtatttcgggttcgtgcggctccggaccatccgcgggcgctga

SEQ ID NO: 6383 - DNA, 750 bp, Actinoplanes utahensis
atgacagcgacgatgacgccggggcaggccacgatcgacacgttgcactcggtgctgcgctcggaagcgatccagccctccttccaaccggtggtccggctggcggacggcgagatcgtcgccttcgaggcgctggcgcgtttccgggagcaccacttcgccagtccggaccaggcgttcgcggctgccaacgcggccggcctcggcgtcgagctggaactgctcgccatgcagcgggcgctggcgtcgctggacggggtgcccggtgacgcctacctgagcaccaacctgtcggtggaggcgatcctggacccgcaggtccaggagacgctgctggcgaacgcgcaccgccgtctcgcggtcgagctcaccgagcacacccaggtgcacgattacccgcgcctggtcgcggtcaccgagcggttccgcgccgcgggcatcctgatcgcggtggacgacgccggcgccgggttcgccagcctcagccacatcctgcagctgcgccccgacatcatcaaactcgacatcacgctgaccagcggcatcgacaccgacccggtgcggatggcgctggcccggtgcctcgccggcttcgccaccgacatcaacgccgtgctggtcgccgagggcatcgagaccgccgccgaacacgagaagctgctggagctgggagtacggtttggccagggctatctgctcggccgtccggctccgctcccgcgcattgcccactccctgaacgcagaatga

SEQ ID NO: 6384 - DNA, 180 bp, Actinoplanes utahensis
ttgaacatcgcgacgcacgctgtccgcatgacgaaatcccccctcgccgccgccgagcccgcccgttccgccgtctccgtccgcgacgcatgggagccgctgttcgagatcctcaacggcgcgccggcccgcgacggacgcggcggccaccgccccacggtcacccgccactcccggtga

SEQ ID NO: 6385 - DNA, 660 bp, Actinoplanes utahensis
atggccaggtggaacctgagctgcgacgattcggctgagcaccgggcagtttcggcgtgtcacgatggtggggtgagcgcttctcctgcccgcctgaccgccgcccgcagcgccggcctgctgctggccggcgcggtactcggggccggcctgacgccggtgcccgccctcgccgacggccccggttacggcggcaccgcgaacgccctcaccgtcgcctggaacgccgggtccgagcagcgaggcgtggccgtctacgcggtcggcttccgcagcggctcgcccgtccaggtgcgggtgggaggggaggccgagcgcagcgtcaccgccgacccgtccggcgcgatcgacatggtgctcaccgccgcgaccacgaccgctaccgccgcgaccgttgcctccgccgccgtgaccaccgccaccgccgccgcggccggcaccatcgtgctggtcagcggtcacaccccggccggcgagctgcgcaccctggtcggcgcggtcccgccggaggcagccgggatcggcgtcgcccagctcgtgccgtgggccgccacgctggtcggtctgggcggggccgctctctggctccgccgccgctatgccacggtcgccgccgggcagttgagccgttaccgccaccccgcccgccatcgcgcctga

SEQ ID NO: 6386 - DNA, 2325 bp, Actinoplanes utahensis
atgagtttcgccgcccgcacgctggtcgaggccgtcgccggcccggccgcgatcgccgacgagcacggccggatcctggtcgccaactcccgctggcccggccccgccgaaggcgagccgctgaccgccggcgacccgggatgtcccgcccacggccggctgcccgagctggtccgggcggcccgacccgggacgaccaccgcaccggcctgtcactgcggccccgattccgccgccacggtccgggtcaccggcctggagagcacgtgcggcgcgcaccggcggctgatcaccgtggagaccgcggtggccgtcgacggacggcagcagttcctggcgctgctcggccacgaggtgcgcaccccggtgaccaccgtggtcgccgccatcgatctgttgcgtgcgcagagtctgccgcccgacgtccgggagacggtcgacaccgtgcaccgggcggtgcgcaacctgcgggacctcaccgacgacctgctggatctggcccggttggaaaccgggtcgctggtgccgcgggtcgcgcccacagcggtgcgcgacgtcctggagagcgtgctcgaaccgttgcagcaggaggcgcgcgaccgggggctgctgttgctggccgcgcccgcgcccgaactgccggcggtcgtcgaggccgatgccgaccggctccgccagatcctcgccgccgtggtcggcaatgcggtccgcttcaccgaacgcggcgaggtggtggtgaccgcccggcccgacggcaccgaccactaccgcctcgaagtcgccgacaccgggccgggcatcgcggccaccgaccaggaacgcatcttcgaaccgttcgtgcaggccggctactcggcggcacgccggcacgagggggccgggctcggcctgccgctcgcccggcggctcgccgcctgcctgggcgggaccctgaccgtcagctcggaacccggacgcggttcccgcttcgcgatcacgctgccgttgcggccgctgccgggcccggtcccgtcggcgctgccgctgaccgggcgccggatcgggatcagcgcgccgacctcccactcccggcaggcgctgtcctggctggtcacggccggcggggcggaagccgtcccgctcgacctcgacgacctgaccaccggccggcccggtgtcgacaccgtgctgtggtgcgacgacgcccacgacccggcggccgtggaccgggccgagatgatcctggccgcgctgggctccaccgggcgggcgctgttgctgagcggcaccgacccgcgcaccggcgtggtccgccggcccggcctgctgagcgcgccggtcaccctcgaccggctcgtcgccgcgctcaaccagcagcgcaccggcgtgcggggcgcgccggtgaccctgccgccgctgcccgccggccggatcctgctcgccgaggacaacgaggtcaaccgcaccgtgctggcccgcatgatcagcctgctcggcgtcgactgcgacaccgtcggggacggggcggccgcggtccgcgagctgctcggcgacaaccggtaccagctggcgctgatggacatgcagatgcccgggatggacggcctggaggcgacgcgccgggtgcgctcggccggttgcgtcgtgccggtggtggcgctgaccgcgacggcgctgcccgaggaccgcgcccgatgcctggccgccggcatggacggctacctgaccaagccgatcaccctggtggagctgcggcgggcgttggcgccctacctgacccccacggagccggccgcgccttcgtcgcccgccgcgccgacatccactccggccgcgccctcttcgcccgccgcgccgacatccactccggccgcgccctcttcgcccgccgcgccctcttcgcccgccacgccttcttcgcccgccgcggacggtgcgccggtcgcggagccggaaggcgccggctcgccggccgcaccggtctcggagcccggcgccgaggtgctctcccgggcccagctaagcgacctggaagcccagctggaaggccgggaactggtcgcgatgaccgtcggcaccttcctgaccgagctcgacggccgccggcaagccatggccggcgctcttgccgaatcccgccatgaccggctcggcgcagtcgcacacacgctgaagtcgtccagcgcgctcctcggcgcccagcccttggccgacgcctgcgcccgagtggaacgcctggccgccgcggcggtggacatcgccgtactggccgccgcggtgagtgaggtggaccgcgccgccggggccgccgcgatcgccatggccggctacctcaacgagagctga

SEQ ID NO: 6387 - DNA, 327 bp, Actinoplanes utahensis
gtgctctacggcgaccagtacgccggcgccaccaccctggtccggaccctcgccgtggtcgccggcgtcacctcggtggtgaccgtgctgaccaacgccgcgctggcccgccactcccgcgccacctggctgccgtgggcgggcgtcgccctcgaggtcggcctcattcagctctggcacggctcgccgctcgcgatcgccgcctgctcggcggcggcgctgctgcccaccctgctggtggtcgcggcgaccgagatccgcgcctggacgcgccggttgcccgcgccggtcgagggcagccacctcaccgaaggggtccccgcatga

SEQ ID NO: 6388 - DNA, 894 bp, Actinoplanes utahensis
gtgcagttcgattccggccgcggccgcggcttcctgctccgcgccgccggcccgatcgcgctggcggtggcggtgcagagcgccggtaacctcgcctttcacgccctggtcggccggcttctcgagccggccgcgtacggggcactgggcgccgtgctggccgccatggtgatgctcggcatcccgctcggcgcgctgcagaccgccgcctcggcgcacgcggccacgcacggcgccgggcgggccaccacgttgcgcagcctgcgagcggtcacgctgtggacgctgcccgccggactgctcacactcgccggcgcgccgctgctgagcggctacttccacctcgacgggctgggcgaggccgcgcagctcgccccgtacatcttggtggcggcgctgctggccaccgcgcgcggactgctgctcggcgaccggcaggtgtccacggtcgccggctcgtacctggcggccaccgtcgtacggctggctctgggggttgccctgaccgtgcccttcggcgtggccggcgccctcaccgcgacactgttcggcgaggtcgcggccctggtgacggcggcccgccgactcacccgccgtccggatcccgggcccggcgtccggctgcggccgcgggccgtgggcggcgcggccgtcgcggtgaccggcctgttcctgttctccaccgccgacctgctgctggcccggcaccacctggccgggaccgcctccggcgcatacgtcgccgccgcgaccgtggccaagacggtgctcgccctgcccgccgcggtcatgtcggcggtgttcccccgcctggccgcggcgcacgaccggcccggtcgggcccgcgcactgcgcaccgcggtcgccgcggtcggcgggccgctagctagctag

SEQ ID NO: 6389 - DNA, 1500 bp, Actinoplanes utahensis
atgaccgataagttgctgaccccgttgccgagccgggcggacgtgctggacaccctgaccgcggtcctcaccgacgccggcctgccgtgggcgtggcagggcgcgaccggtgcgccgcagcgctggtgtgccggcaccgggccgagcgatctcgacgtctggtgcgccgggcccggcccggtggccgcgctgatgagccggtacccctgcgcggtgatcgccgcgccggcggacccgcgccggctgcgccacaccagcctcgcggtgctgaccggcagcggacccgcgatcgtcgacgtgacccacggtgacctgcgtgtcgggccggttctgctggtcccggcggccgaggtgacccacgatccgggcagttgccggctgaccggcgcggccgccgtcgccgatctgctggtccgcccggttctgcggggccggatcccggaggtcggccggctcgccgaggctcggggagcctgggccgaggcggacgcggcgcacctgtcggcgctggccggacggctgacccggcagctcggcgcccgggttacggcggatctgatcgcggccctgcggggtgcccgacccgatccgggcctgccgcgccgggcccggctgcgcctggccgcccgcagtctcgggccggggaccatcggtgccacctgggcgcagcggcacggcgtgctgccggccggccggtccgccgggccgctgggtctgcgcacgcgcggggtggtggtcgccctggtcggtaccgacgggtccggcaagtcgacggtcgccggggcgctgcacgaacgactgcgggaccacgggttcgccacagccacggcgtatttcgggatggcccgcggcaacctgcccggagtggccctcgcccggcgtctgctcggcgtcggctccacagcgccgcagacggggaccgctccgcaggatcgaggcactccgcggacgacggccgagcggacgacggccgagcggacgacggccgagcggacgacggccgagcggacgacggccgagcggacgacggccgagccgatgacggccgagcggacgacggccgggccgctcgatcacgcccggttgcggcggatggcggcctggttctacgcgggggagtacggctggcggtacctgcgcacggtcgcgccggcgctcgcccggcggcaggtcgtgatcgccgatcgctgggtgtacgacctgcgggactccccgtggccgggctcggcggcggcccggctggccgagcggatgctgcccgcgcccgacctgctggtgctgccggacgcgccggctgaggtgatccaccgccgcaagccggagcgtcgcctggacgagcagcgcgcgcagcaggagcggttccgccggctgctcgccgaacggccggcccgccgcgccgagctggtggtggacacctccggcgaaccgggcgccggcctggccgccctggtcgccgcggtgatcgaggcggcccacgcgccccggcggcgacgccggtga

SEQ ID NO: 6390 - DNA, 768 bp, Actinoplanes utahensis
atgtcccgtccggccttggattccggccggcgcggccgatcagaggtcagtaacgatccacccgtcaccggaggtgccgtgtccaagccacgtgcgctcgtcgtcgaggactcgcccgagttcatgatgatctgccgtcacctgctggagaaggagggcttcgaggtcctcgccgccggtgacggtgcggaggcggtggagcgcgcccagaagcagcggcccgacatcgccatcctcgacctgggcctgccggacgtcgacggcatcgaggtgtgccgccagatccgccagttcaccgacgcctacatcatcatggtcaccgggcgcaccgacgaggtggacaaggtggtcgggctctcggtgggcgccgacgactatgtcaccaagccgttctcgccgcgcgagctcgcggcccgcatccaggcgatgcggcgccggccgcgcgccaccacccaggcccggcgcgaggcggtccgggaatacggcgagctgcggatcgacctcgaggtgcgggaggtgtcccgggccggcgaggtgctcgagctgaccaagatcgaattcgacctgctggacctgctgtcctccgcgccgcgccgtaccttcacccgccgcaagctgctcgaggacgtctggggcgacaacttcttcggcgacgaccacatcatcgacgtgcacgtcggtaacctgcgccgcaagctcggcgagtcggcctcggcgccgcggcacatccgtacgctgcgcggcgtcggctaccgcttcgagccctga

SEQ ID NO: 6391 - DNA, 438 bp, Actinoplanes utahensis
ttgaggtacgaccgccatgctcagtgcatgccgacctcgcagctcaccgcccccgccgccacgctccgcccggccgccgccgtcgtaccgggccccggccgcggcgccgtcgacctgaccctggtgctgccgctctccgggcccgccgccaccctgcgctacctgatcgagcgcctggccgaggcgctctacgcccagtgcatcagcttcgagctggtcgcggtggccgacaccgatgtcgccgagctcagcgacctgccgctggcccgtaccgtgcacgccgcccggctggaccgggaggcgtcgtggcaggccggcgtctcggccgcggagggccggtggatcggtttcctggacgtcgccgactgtgccgagctcgacgcgtacggcttcatcgagctcctgcaccaggcccgggagagtgccgtttccgcctga

SEQ ID NO: 6392 - DNA, 1611 bp, Actinoplanes utahensis
gtgctacgacggcgtcgcgcagatcgagtcgctgcgctgcctgcgccgcgacgtctacgacaagctgggcgggcacgacgagcggatggtcttctccgaggacaaggatctcgacctgcgggtacgcgcggccggctgccgggtcggccgcacccgcaacttcctctaccacaacgagggcgacctgcggctgtcccgcacgctgcgcaagaaactcgggtacgcggcgaccgccgacgtgttcgcgcgcgtgcatccggaggcgttccggtggcaggccaacatcctgcaccggttggctctctacctgcgcaacgcccgctatctgcggacccacccgctgctgtacggcgggatgtggctgatgaagatcagcgagttcgccttcggcgcgatcggccacctccgcggccgggcgctcgccacggtccgcccggcggtccgcgcgtgacccgggtcgcccacgtcatcgccgagttctcggcccgcgaggcgatggggcgtaccgtgaccgagaccgtgcggcgggtgcccggcgagcatcacctgatcaccacgcacgtcgtcgacggcgccgaggtcttcgccggcgcgcacgagctcggcggcccgctggagacgttcccgctgggccggtccgccccgctgagcgccgcgctcgccgggatccgccccgatctggtgcacctacacgccggcgcgctggggccactgatggccctgcacccggcgctgcggccgtacccgaaggtgctgacggtctacgcctggccgacgctgcccggcccggtcgcctggcgccgcagcggcctggccgagatgtggtcgtcgaatgtgctacggccacgggtggcgctcaccaccgtgctgccggtgccgctggcggccgcggccctgcgccgggccggcgtgacgaccgtgctgactcccgacccgcgggtggccgaccgcctgggccggcccggcggcccggcgatcgtccgctacgcgtgtggcgctccggacgacgaccgccgggcccgcttcgacccggaccacccggtgatcgtcttcgccggccgcgccgagacggtccgcggcctggacaccctgctcgacgcgttccgggcggtgcgcgccgaggtgccgggcgtgcggctgcggctgctgctcatcccgcggcccgaactccccgccatcctggcccgggccggagccgccggggacgcgatcgacgtggtcaccgacccggtgccggacctgctcggcgagttcgccgcggcgcaggccggcgcgtggccgttcaagttcgactacaccacctcgccgccggcgatggccctggtcgaggcgatggcggtgggcctgcccgtggtcggcaccgacgtcgcctgcgtccgggcggtcctcgaacccggcgtcaacggcctgtcggtgcccccggccgacccgcgcgcgctggcccgggccctgatccggttgctcaccgacgagccggcgtggcagcggtacgcccgggccgggcgcgcgtcggcgcgcgaccacatgggctgggaccgggcgacggcgctgacggccgacgcctaccggtcggtcctcggcggtcttgccgaccggctgacctcgggatga

SEQ ID NO: 6393 - DNA, 3261 bp, Actinoplanes utahensis
atggacagaagacgactgctcggcgcggtcggcgttctgacgacaatggcgacgagtctcgtcgccacgccggccgcggccctctccgccctggccgcgccgaagaacctgacggtggcccgtgccgccgacgacgtgcaccagatcaaggtcggctggataccggtcaccggtgccgaccactacgcgatcgacatcctggccggcgacgtggagacggttctcgacctgccggccacggcgaccggctacacgatcgacgcgccgaacccgtgcaccgcgtacaaggtgcggatcggcgcggtcgacgcggccggcacggtcgccaacaccggcttctggtcgctgcgggcgctgacgccgagcgcggtgatgggcatggcgcccacccgcatcgacgagggcaccaccgcggtggccacctggcgcgagccggcctggaccggatacacgccgctcaccggctaccactcggtgttcacccggctgtccgacggcgccgtgctggccgaccagacgagcaccggcctgtcgttcacctacccggggatcgacccgagccgggcctacacgctggcggtgaccacggtcaaccagtacggcgcctgcgtgaccgccaagtcgctgctcgaccggttccggccggcggacccgaccgacctggtcgtgaagcggctcgcggaggctccgggcaccgtctcggtgagctggacgccgcccgcgaacggtcccgcgccgaccttttaccaggtcggctacgggatcgacaaggtcaccaagacgctgaagctggacacctcggtgaccgccaccaccctcgccctcgccaccgacaaggcctggatcgtcgaggtgaaggcctacaacgacaacggcggcagcagcgcggtcagcggctccgtcccggtcttcgaggcctccggcagcccgccggcaacggacgcgacctggccgtccaccagcaccgtcgtggacaacggaccggaccggaccccgccgagcatcaccgccacgctgtcccagaagccggtgaacggctggttccggacgccggtcaccatccagttcacctgcgccgacgacagcggcacggtcgccgtctgtccggcgccgatcctggccaacaccgacggcctggcccggcgtttcgccggcaccgccaaggacgcggccggcaacaccaccaccaccacgctcaccctcaaggtcgaccagaaggctccgtcgatcaccgccacggtgctcggcaccaagaacgcggccggctggtacaccaccgcgccgaccatccactacacctgcgccgacgagacctcgacgatcgccagctgcccggcggacaccgtggtcagcgccggcaaggcggaccagaagatcagcggcatcgcgtccgacaaggcgggcaacaccgcgacggccaccgtcgtgctcagcgtcgacccgaccacgccgaagatcaccgcctcggtcaccggcgacgtgtcccccgccggctggtacaccaccgcgcccaccgtgcacttcagctgctccgacggcacctccggggtggtggcctgcccggccgacgtgtcggtcagcgccgacggcgccggccagaaggtcagcggcacggtcaccgaccgggccggcaacacggcggccacctcggtcaccgtgaacgtcgaccaggcggcgccgggcgtcaccaccacggtctccggagccaccgccaacgccggcggctggtaccggaccgcacccacggtgcacttcacctgcaccgacgagacttccggggtcgccacctgcccggctgacagcacggcagccgccgacggcgccggacaggtcctggcgggcaccgccaccgaccgggccggcaacaccggcagcggctcggtcatcgtgaacgtggacgggaccgcacccaccatctcggccgccgtgctcggcgccaccgccaacgccggcggctggtaccacgacgccccgaccgtccacttcacctgcaccgacaccggatccggcgtggcgtcctgcccggccgacatcccggtcggcaccgacggcgcgggtcaggtcgtcaccgggaccgcgctggacgcggccggcaacacggcggccacctcggtcacggtcaacgtcgaccgcaccgcgccggccatcaccgccaccgtgctcggcgccaccgccaacgccggcggctggtaccacgacgcccccaccatccactacacctgcaccgacaccggatccggcatcgcgtcctgcccggccgacaccccgctgaccgaggacggcaccgcccgcaccctcaccggcacggccaccgacctggccggaaacagcgccaccgtcaccaccacggtcagcctcgaccgggtggcgccgagtatcggcaccacgatcagcggcggcacggcgaacaccaacgggtggtacaacaccgccccgacgatcacgttcacctgcgccgacgaccgctccggcgtcgccgcctgcggcaccggcaccacggtcggcaccgacggcgccggacagaaggtgaccggcacggtcaccgaccgggccgggaacaccgcgagcaccggtaccacggtgaacctggaccgggtcgcgccgcagatcaccgccacggtgaccggcagcgcgaaccgggccggctggtacacggccgccccgacggtgaagttcacctgcaccgacgaccgctccggcgtggtcacctgccccgccgaccaggtggtcaccgacggcgccgcccagaagatcgccggcaccgtcgccgaccgggccgggaacaccgcgagcaccggcaccacgctcaacgtcgaccgtcaggccccggtcgtcaccatcgccggcgcgaccaacggcgcggtctacggcccggacgccgcgccggtggtcacctgcgtcaccgcggacgcggtgtccggtgtcgccggcaaggccaccctgtccgactacgagagctacggcaagcacacggtgatctgctccggtgccgtcgacaaggcgggcaacgcggcccccgcggtccagctgacctacagcgtcaagccgacgatcgagtggctgatcgcgctgacccacaaggatctgccccgcgcatcggcggtcacgctcaagcagctggacgccgacctgatgggacaccgctggacggcgtacacggctcgggtgacggcgctgtcgctgggcgcgaagccggagttgacggtggccgacgcgacgacgctggtctactgggcggtgatgctgccgttgtactactga

SEQ ID NO: 6394 - DNA, 858 bp, Actinoplanes utahensis
atgaaccgccacgacgaaaggcccacggtgtcgaacaacgttgtgtcgcccggcaccgagctcgccgagctccgcgccgagctggaccgggaacgtcgccgcaacaccgagctcgagcgcacagtggcggagctgcgcacgttcgccagcgacgtcagccacgacctcaaggccccgctcgccggcatctgcggctacgcccagctgctggaacacctggacgtcggctatccgcgcccggccgagtacgacgagttcgtcaccgagatcacccgctgcaccgtccgcatgcggcagctgatcgacgacgtgctcacctacgccacgacgcaggagtctcggctgcacctggccccgatcgatctggccgcgctggtcgacgacctggtcgcggacacggccgagctggtccgcccggcgccgcaggtgcgccgggacgcgctgcccgccgtgcggggcgaccacggcatgctgcggcggctgatggagaacctggtcggcaacgccatcaagtacgtgccgcacggcgagatcgcccgggtgcatgtcgcggcccggctgctggacgacgacatggtccggatcgaggtgaccgaccacggcatcggcatccccgacggacagcacgaggcgatcttcgaggagctgcatcgggcgcaccccgacgcgtacccgggaaacggtctcggtctgcccatctgccgccgcatcgtgcaacgcctgggcggcgccatcggcgccgacccgcagttccgcggcggcgcgcggatctggttcaccctccccctggccaccacaccgggcgagccgcccgtggtggccgctcccgagcttgacctgagccatacccccgcctga

SEQ ID NO: 6395 - DNA, 1860 bp, Actinoplanes utahensis
atgggatatgcggcgcgcactctcgtcgaggcgatccccgtcgccgcggcgatcctggatcccgacggccgcgtgctgctcgccaaccggcagtggtccggtggcaacggcgagctctatccggccgagggtgggttcctcaccgccgcgcccgggccgtgcggcgcccaccgcggcgtgctcgaggcggtgtggcgggccacccccggcgccggcgcggcggagctgtgctgccggtgcgccgaggacatcgtgcacacgctgcgggtggccccgttgaccgggcccggcggcgaggaccagcggctggtcaccgtcgtcgccgagcagtgccgggacaccgcgcggtcgcagttcctggcgctgctcagccacgaggtgacgaccccggtcaccaccgtcgtggcggccgtcgacctgctccgggcgcagcagctggaccagggcgtccgagagatcgcggacgacatccactactcggcgaaggccctggagaccctcaccgagaacctgctcgacctggcccgcctggagaccgggcggctgaccctgacccgcgagccggtgccgatccgggaactgctcgaaggcgtcgtgcagccgctgcagtcgcaggcccgcaacaagggcatcctgctgctggccgcgcccgcgccgcagctgcccgcgacggtggccggcgacccggtccggctgcgccaggtgctcacggcgctggtcggcaacgcggtcaagttcaccgcgtccggcgaggtggtcgtgctggccgagccggccgccgacggcagcctcctggtcaccgtctcggacaccgggccgggcatccccgagccgcagcaggcccggctgttccagccgttcacccaggccgactcctcggcggcacgccggcacgagggcgccgggctcggtctggcgctggccgcccggctggtcgaccggatggacggcgccatcgaggtggaatcccggccgggcgccggggcgctgttccgggtccgcctgccgctgcccgcggcgtcgccggacggcgacgggcaaccacggccgctggctcgccgccgggtcgccgtgatggcgccgtccgaccgttcggtacgggccctgacctggctgctggcgagcgccggcgccgagccggtcccggtgacgttcgccgatgtcacgggcgctctgccggacgtcgacacggtgctgtggtgcgacgacgcgcacgatccggcggcggtgcggcgcgccgacacggtcatcggtgcgctcggtccggacggacgggcgctgatgatcagcaccaccgacccgcgcaccgggatcgtccggcggcccggggtgctgaccgccccgctggtgctgcgccggctggtcgccgcgctgaaccgggagcgcaccggggtccgcggcgcgccggtcaccgtgccgccgctgccgggtggccgggtgctgctggccgaggacaacgacatcaaccgtacggtcttccgccgcatgatcgagctgatgggcgtcacgtgcgacgcggtgcccgacggtgccgccgcggtcgaggccgttctcggcggcgacccgtacgacgtggtgctgatggacgtccagatgccccgcaccgacgggctggaggcgacccggcagatccgggcggccggctcgccgaccccgatcctggccctgaccgcgaccgacccggccgacctggcgctgtgcctggccgccgggatgaacgggcggctgagcaagccgatcacgctgcccgagctgcgcagcgcgctgcggccgtacctgacccccggcgccgaccccggcgtcgaccacctgatcacccgcttgcagaccggtgacgagaagtcccgggtgatggcctga

SEQ ID NO: 6396 - DNA, 588 bp, Actinoplanes utahensis
gtgggcaagcttgacccggaggcgttccgctacccggtcggcatgccgcactctcgatgcatgctcaagctcgccgccgcccgccgcatcgtcgccgccatgctgatcctgctcggcgcctgcgcctcgctgctggccgtcgccggcccggccgcggccgcggtctccagcagcaccgacaagctggtgctgacctgggccgagggtggcaaccagctgcgggtcaccgggttcgggtaccgagcccgggacctggtcgaggtgcggctcggcagcagcccgatccagcagacccgcggcgacgagaacggccggatcgaggtcgacgtgccgcagtcgctggtcggcaccggcgcgtccggcaccagcatcgtgctggccggtcgctcggcctccggagccgcccgggtgctggtctccgcggttccgccgcaggcgaccggacgcggcccggtcgaggtcctgccctgggccctgggcgcgctcgccgccgtcacgctcgggctgggtgcccggttgcggcgccgcagcggtcaccccgtcgcggctcccggtggttaccgcggccgccgccggctcgcggtctga

SEQ ID NO: 6397 - DNA, 3954 bp, Actinoplanes utahensis
atgtccggaggtgtgcgtgtcgctagaccacgccgcgcccggcgtgcggacggcaccgggccggcaccggcgcccctggcacctgccggagctggccgaccggctgtgccggcgcgcgctcaccgtggccgccgggctgttcgccgcctgtggcccggcgcatgccctcggcctgaccgatctggtgttctggaccgtgctggtcgggctcgggctggccgctgccgcggtgcccctgggcctgttcggcctgcggcacggggacaccgcggattgatcaggggcccgctgaaccgggcggccctgctcgccgcgcggccgtatctgatcgtgctggcgatcgacgtgctcatcgtcagccgctggttccggaccggcacgttcatcgccggcggcgacatgggcgcgttcatcaggcgcggctgggcaccggagatgacctggtcctggaatcaccagctgaccggcgccgggtcggccggctacaccatggcgcgggccttcgagttcctgctgatctggctgtgccggcaggtgggcctgaccgagtactccgcccagtggctcttctacacctgcatctacgggctggtcggcttcggtgtggcgtacctggccggcgcgttcgtgcgctccgggccgggcatcgtggtggccgggtcgttcggcatgctcaacgggttcttcctgacccggctgccgaacccgctcaacgtgatctcggtggggtcggtcgcgttcgtcaccggcgtcgcgatgcgggtcgcccagggccggcgtgttccggccccgatcgccgggttcgcgctgatgccgacctcgttcctgagcttcaacccgccgatgctggtggtcgcctacgcctgggcggtggccggcaccccggccctggccgcgctgctgctcggccggcgggcggcgggccggctgatcaaatggttcgtcgcggcggtgccgtgggtgatcggtctgaacgcgtggtggctggtaccactggcgcagagcttcgtgggcggtggcggcgccaccgcgaacgcgaccttcaccgacccgaccaactggtcctggtcgcaggtgaacaacctgccgccgaacatcctcaccatggtggcgaactgggcgtggttcctgccgcagtacctgccgttcgccgccgacctggaccggccgtggtggatctggatccggtatctgctgccggcgctggtgttcgcggccccgctgctggctccgcgtcggttgcgccgggtcgcgctgggcctgctcgcggtgatcctggtcttcgtcttcctggccaaggggctgcgtccgccgctggccagggtgaacctgctgctgtacctgcacgcgcccgggttctggctgttccgcgagccgatgagtaagctcgggcagctgctcgtgtcgttcttcggggtgatgctcgcgatcggggtggccgggatgccggccgtggtccggcgggtggtgccccgacggcgcccctacgcctacgcggcggcggccatcccgttgctgctggtgctggcctaccccttcccgatctacaccggcggggtgatgccggacgagcgcccgagccagccgtcgatgcacgtccgggtggcgcagcagtggtgggacaccgccgcgcgcatcgatgccgatccgcgccccggcaaggtgctggtgctgcccctcgacgactactaccagatgccgaccacctggggtttcttcggtgcggacagcatcgcgaacctgttgatcaagcatccggtggtgcagccgaaaccggagggctacttcggtgacgtgcccggcttcgccgcccacctgcggctggtcgaggcggcgctgctggccggggacctcaccgcggtgccgaagctgttggacgcgatcggcgcgagccgggtgatcgtgcggcacgacctggtccgcggcctgccgaaccgctatttcgccgacgaccggctgctggccgccgcgatgacccgggtgcccggcgccaccctggagagcgggggcctgctcgacgtcttccggctcggcgacggtgccgacccgacggtccggacctacgatcgggtgctggacgccccggcccgccccgaggccggcgccgcggtgctcggcacggtggacacccggaccgcgatcgcggcacgccgggacacctcggtggccgcggccagtccccaggtcgacgaccacccggcggtcaccccggacgtggtgtactggccggtcccggcggtcgacgaggggtccccggtgaccaccgtcgacgtgccggcgggccgctacacggtcgcccagcgggcccgggccgccccggcgctggtgccccgggtggacggcggtgacctggtgctggccgacccgaccgtggtgaaggtggacgggcggccggtctcgcgccgcccggagctgcgggtgccgctgccggccggccgtcgagtcctggcgatccgggcgggcacccggcgtaccgtgtcggtggatgtcgcgaagccggcgccggtgccggtcggcgcggccaccagcctcaccctgctggccgccgccgcgaagccggcgaaggtcagcggattcagcccggtcttcgactgcaacagctacgagccgcggccgtggcgcgagctcggcctctccgcgaaggtcagcgacacgaagcagggccggaccgtcacgctcgccgccgccgaccacgccgcctgcacccggctgatcgtcagtggcgcgtcgcccggggagatctaccgggtccgcctggagtatcaccgggtgtccggcgcccggccgcagatctgcctgtggcagtccggcgccgccggctgcgagctgtccgcgcggccctcgctcagcgacgactggatcccgtacgagggtgtggtgaccatggacgccggcggcgagctgcagatcatcctgcacgccgacgccatccgcagactcggaccccggaccgtcaccgagtatcgcggcgtccaggtccaggcgctggagcaggtcggcagccgggaggtgtggccgccgtcggtgccggagaccgccgtcgagctcaccgcgggccggcacgagctgcgtgtcgacggcgggcaggcgggctcggtgctgtccccgttcgagccgctggaggactgctaccgctacgacgaccagaccgccgagcaggccgggctggccgccgaggcgcagaccggggtggacggggagaccacgtacaccctgaaggcggtcagccacctggcctgcatcggggcgaccgccggggtcctcggcgcctcggccctctacgagctgtccctgcaggcgcgcagcgtcgcggtgcgcaacccgaagttctgcctgttcctgcgcggacccgacctgtgccgcaagctgccgtcggtggccgtctatcagggctggacccgctacgagacgttcatcccgccggatccggacaccgtcgagacccgtctctacctgtacgggctgcgcgatctcgccggcaagcagcagtcccaggtggagtacaagggcgtccggctgcgtccggtggcctcggcctcggccgtcgtgctggtccggcagaccgccgcgacgccggcctcgtcggcggactggacgcggcacgatccggcccacttcgccggcacgctcaccgcctccggacccaccatgctggccctggccgagagcgcggcgcccgggtggcggctgaccggcatccccggcgcgacgaaggtgaccctgcagggctggatgagcggctggcgactgcccggcggcggcgggttcgcgctgtcctacggcccggcccggatcgcccgctacgccttctacctgctgccggtcacggtcgtggtggccggtgcgtacatgtacggggtccgcctgcccgccggccggccaggtgactggaccgcccggcaccggcggcgccgccggctcccgtggcggctcctgaagtggccccgccgatga

SEQ ID NO: 6398 - DNA, 1014 bp, Actinoplanes utahensis
atgaccgccctcgtgcgccggctgctcggcgagcgatcccggcggcggatgcggtgggcccggcggcacaccgtgctctgtgcgatcgggttgctggtggcggtcctggcggcagtggtggtcagcacgccggcgagccgccgcctgatcgtcgggccggacacggtgaccgtggtggccgtcggtgacatggcgtgcgacccggcggacccggacctcaagcgggccacccgggagcagggtgaccggtgccgtcagcaggccgtctcggacatcgccgtggcgctgcgcccggacgccctgctggccctcggcgacgtgcagtacgagatgccgaccgccgaggcgttccgcaccgtgtacggcccgagtttcgggcggctgcgcgaccggactgtgccggtctacggcaaccaggagtacaaggtgcaggacgcgtcgtcgttcaccgcgtacttcggcgaccgaatcctcgacaagcgtggctactggtcgcagcagatcggccgctggcacgtcgtggtgctcgactccaactgctccgcggtgcccggcggctgcggctccgggtcaccgcagcagacgtggctcgacgccgacctggccgcgacctcgagtcgctgcgtgctcgccgcctggcaccatccacgctggtcgaccggcatcgccggacccgacgaccggaccgcggagctgtatcgcaccctgtaccggcgccgggtggacctggtgctgtccgggcacgaggcggactaccagcgcttcgagccgctgaacccggacggggtggtggacccggagggtgtccggcagttcgtggtgggcaccggtggccaggcgcactaccgcccggagggcaccgccgccaccggtgccccgccgggcgcgtacgcggactacgaccaccacggcgtgctcgcgctgacgttgcgccccgcctcgtacgactgggcgttccatccgctggaggccggccgggtcaccgaggacgagggttcggcgcgctgccactga

SEQ ID NO: 6399 - DNA, 1266 bp, Actinoplanes utahensis
gtggccggggcgggccgccggtgtcgcgcggcgggcggccggccaccaactgcccggttccgccgttgctcggtcatttgtgccagtatcggcaatccaccggcgtcgcggggtcatatccccaacgttctcaacccggtgccgtcccggccgatctccccggtcatgcgcatcctgatcctgaactggcgcgacctcagccaccccgcgtccggcggcgccgaggtgtacaccgagcaggtgctgcgccgctgggcggcggccgggcaccaggtcaccctcttcgccgcggcggtggcggggcgcccggcggacgaaatccgcgacggctaccggatcgtccgggccggcagccggttcaccgtctaccgggaggcacggcgctggtggcagcggcacggccggggccggttcgacgtggtcgtcgacgagaccaacacggtgccgttccaggcgcacgagtgggtcgacgacggcgcgcggacgatcgcgctggtccaccagacctgcgaggagatctggcacatcaacgccccgccgctgctggcgcacctgggccggcaccggctggagccgaactggctgcggcggctgggcggcagcccgatcctggccgtttccgagtcgacccgggaggccctggcccggttcggcgcgcacgacgtgaccgtggtgccggagggctacgagccaccccacccgctgccccacccggccaaggaggaccggcccaccgccgtgttctgcggtcggatggtgaactacaagcggccccgggacgtgatccgggcggtgctgctggcccgcgccgcggtccccggcctgcggctgtggatgctcggcggcgggccgctgctggaccggctggccgacgaggcgccggacggtgtcgagttcttcggccgggtcagcgaacaggacaagcacgaccggatggcccgggcccacgtgcacctggccgccagcgtgcgggaggggtggggactggtggtcaccgaagcggccgcgctgggcacgccgacgatcgcgtacgacgtgccggggctgcgcgactcgacccgggcggcgcacgggatcgtggtgccgccacacccggaggcgatggccgaacggctggccgacgcgctgccgggctgggtgcgccgggcgcccgaaccgctgccctacggcggcgcgcactcctgggacgaggtcgccgccgcgctgctcaccgccgtcgagcgggaggcccgctgccctcgcggcccgatgcgggtggcggcctga

SEQ ID NO: 6400 - DNA, 2130 bp, Actinoplanes utahensis
atgaccgagcaacggcggaaccgggcagttggtggccggccgcccgccgcgcgacaccggcggcccgccccggccacccggctgaccctggagtccacgctcgtcggcctggtcatcgggttgctggtggtggcgccgtggacccgcccgggttatctgctgctgctcgactgggtggccgggccgcacaccgcgctcacccccgggctctacggactcgatccggcggcgctcgacgccctgccgtaccggctggtcacgcatgcgctgcgggccgtcgtcggggcgggcgcgaccagctggctgatgatcctggcgtacttcccgatcgccgccgggggcgtgtccggcatcgccggggggagccggtggcggcggcacccggcggcggtgttcgcctgcgtcaacccgttcgtcgtcgagcggctgcatgccgggcacgtgccgttcctgctctcggtcgccctgctgtgcccgttgaccgcgtcggcgctgcacgcccgccggcgcggcggctggttcgccgcccgcccggccggttggtacgccctggccatctcggtcggcgcgcacgccgcctggctgggcgggatggtgctgctcgccgtcgcgttgctgccccggcccggccggcgacacctggcccggaccgccgtcatcgtcgtctccgccggctgcgtctacgcctatgccgcggcggtcgtcgccaccgcgattctcacggtccgggtcagcgacgaagatcttgaggtgtacgcgacgtacgccggcgcctcgggtctgaccgcgaccgtcgccaccctgcgcggcttctggcggggtggctcggacagcagtccgcagctcgctctgggcgtggtgcccggcgtgatcctggtggtcgccaccgtcgccggattgatccggctgtgccgccgggaccgtgccgtcggggcgccgctggccgccgtgaccgccaccgggctgctgctcggtgcgggcatcaccgggccactcggtccggtgtaccggatcgccttcgacacgctgccgctcttccatgccatgcgggagcagcagaaatgggcggcgctcgcgatgatcggctacgcggtgggattcggcgcggccgccgaggcggtggccctgcgctgccgggccgggcgtccggtggcaccgcgggcggtggcggtcggggcggcgctcgccctggccgggatgacggccacggtgagtgggtcgctgttctggggcctgggcggcagcgttggggtgagtcactatccgccggcctggtacaccgccgaccggatcatgggggacggcgacgagtcgatgctgttcctgccctggcaccagtaccaacccttcaccttcaccgcggcacgcagcgtggcgacgccggccggcgccttcttccggcggccggtgctcagcagcgacgcggtcgagctgggcccggtgcggagcaactcgtcgtcgtaccggatggcgtatctggatcggttgatcgccgccggtggcggcgggagtttcgggcggctgatcgctccgctgggcgtgcgctacgtcgcgctggcccgcgaccgggagagcggcacctacgcctggctcgaccggcagccggatctggaaccggtgctgcggaccgccgccctcgacctgtaccgggtgacggtcagcgggatcggccgggtggtgagcgcccgggacggggactatgccgcgctgctcgcctgggccgcgcgggggcggctcggtacggaggcggtgatctccggggccggcggcggaaccgtgccgtccgcggcgtcgggtggcctgcggcgcgtcggctcgacccgctggcgggtggcggcgggtgaggccggctgggtggtgctgcccgaggaatggtcggcgggctggacggcgggggatcaggtcacccggcgcaccgtcgcggggacggtcgcggtccatgccggttcgggggccttcacggtgcgttacgcgccgtggaagtggttacggctgggtcttgccgcgtcgttgctgacgctggtggcgctgctgggcgccggtctcgtggagcatcggcgggagctgtcgccgcggttcagacggcggcctggcggtagtggccgccgaggtgccggcccaggatcgtga

SEQ ID NO: 6401 - DNA, 480 bp, Actinoplanes utahensis
atgagcatcggcaaaggtgacctcgcgcccgacttcgcacttgcggaccaggacgggacgctgcgcaggctgaccgatctggtcgccgacggacccctcgtcctgttcttctacccgggcgcgatgaccaagggctgcaccgcggaggcatgccatttccgcgacctggccgccgagtaccgcgccgccggggtgcagcgcgccggcatcagcagggacccggtggccaagcagaaactcttcgccgacacctacacgttcgactacccgctgctttcggatccggaatcaaccacgattgcggcgtacggggtgaagcgcaagctgaatctcggacctctcagcaccaaacggatgaccttcgtgatcggcaccgaccgccgcatcctcgacgtcatccacagcgaactcgacatgaaccagcacgccgccgacgctctcgcggtcgccgtggcggcccgggcacagcacgggtcataa

SEQ ID NO: 6402 - DNA, 1242 bp, Actinoplanes utahensis
atgccgcgccggcgcagctggtcgctgatgccggcgagcaggcgccggcgttcggcgcggtgccggtcgaggggcgcggacacgggcgccatcgtagcccggccgccggggtccggcagagcgccgatgtgttctcccgcacggcgggaacaccgccggtgggcggcggcgtttccttctcctatgaccagcactttctcggcgaagccgcgcctgtcgattctggacctcgcaccgatcacgcccggtgggaccgtggcgcaggcgttcgacaatgcggtggccctggcccgggccgccgaggagtccggctacgagcgggtctggtacgccgagcatcacaacatggcacggatcgcgtccagtgcgaccagcctgctgatcgggcatgtggccgggcggacgtcgacgatccggctcggcgccggcgggatcatgctgcccaaccatgcgccgctgacgatcgccgagcagttcgggacgctcgcctcgctccatccggggcggatcgacctggggctgggccgggcgccgggcagcgaccaggtgacgatgcgcgcgatgcggcgcaacccgatgtccgccgacagcttcccgcaggacgtgctggagctgcagggtttcctgggggacgagtcacgggtgccgggggtccgggcgacgccgggcgcgggcacgcacgtcccgctctacattctgggttcgtcgatgttcggggctcggctggccgcggcgtacggcctgccctacgccttcgcctcgcatttctcgccgggtctgctgtacgaggcggtcgccgcctaccgcagcgagttccagccgtcggcgcagctgtcgcagccgtacgtgatcgccggcgtgaacgtgatcgccgcaccgaccgcggagtccgcccgcgagcagttcacgatcacccggcggatccgggtgcgcggcctgatcagccgttccaccggcccggcgggcgccccctcggcggccggctccaccgcttccaccgacttcaccgacgaggagatcgacgagttcctgaccacgccgaacgggcggcagatcggggcgatgatgacctactcggcggtcggcaccccggacgaggtccgctcctatctgacctcgttcgccgaccgggcccaggccgacgagctgatcgtcgcccaccagtcgacgcagatcgccgaccgtctggagtcggtccggctgaccgccgccgcggtgctgggcgccccgctgccctcgtga

SEQ ID NO: 6403 - DNA, 660 bp, Actinoplanes utahensis
atgacgacatatgtgctggtgccggggttccatctgggcggctgggcgtgggatgcggtcgccgggccgctgcgggcggccggccacgaggtgcaccaggtgtcgccccgcctggaaccggggacgacggtcgacgaccacatcgcggagctggtcgccctggtggagaagctcgacgacgtggtgctcgtgggccacagctacggcgggctggtcatcaccgcggtcgccgatcagggtgccacccacgtgcgacggctggtctacgtggatgcgggaccgctgccggacggcatgtcgcaggccgacttcaccggcgagccggtggtgccggtcgacgggatgctgccggtgcccgccgaggcgccgccgtccgcgaccggcttcgactgggcgatcgtccgggaccgcggacgaccccagccggccgcgaccgcgaccggcccggtgcggcacggcgaggcgtggcgggacattccgcgtacggcaatcctctgttccttcccggcggcgcggctgcgggagatggcggcgaacctgccggcgttcggtctgatggccggcgccgggtggacgtaccgggagctgcccggcgggcactggccgatgttctccgcgccgacggaactcgcggcgctactcgccgaggtcggcgggtag

SEQ ID NO: 6404 - DNA, 516 bp, Actinoplanes utahensis
gtgtggcccgtgccacagtcactcggcaaggttctcgggctcctggagctgctccaggccgcgcccggcggggtcaccgtcggccacctcgccgaccggctccaggtcgacgagcggaccgtccggcggtatgcggggcagctcgccggcctcggcatcccgatcgagggccggcgggggcggcacggcggctacacgctggcgcccggctaccggctgcccccgctgatgctgaccgacgaggaggcgctcgccgtcctgctcgggctgctcgccgcccgccgggccggcctgaccgtcaccgcggaggcgaccgagaccgccaccgccaagatccagcgggtgttgccgcacgcgctgcgggcccgcaccgatgcgctgctggccaccctggacttcaccgcgacccgggcggtgaacccgtcgaccccggacaccggcatcctgctcaccctggccgccgcggcccgggaccatcgaccggtcacgttcacctacaccaagctagctagctag

SEQ ID NO: 6405 - DNA, 297 bp, Actinoplanes utahensis
gtgccggccggcttcgacccggccgcccgggtcgccgagggtctggccaccggcgcctggcggcacgaggtgtcggtgctgctcgacctggacctcgacgaggcccgccggcgcatcccgcccaccgcggccaccctgcaccgcaccacgcacggcacccggatgacggcccgcgccgagcgcctcgacgggatggcccgcatgctggccggcctcggctgccccgtcacggtcgagaccccggacgcgctgcgcgccgagctgcaccggatcgcggcccgcctgcgcgacgcctga

SEQ ID NO: 6406 - DNA, 1176 bp, Actinoplanes utahensis
gtgatcaggagggtgcgcaggtcgtcgacggtggcgagttcgtcgtcgccggatcgggacgcgccggccgcggtgttggcgaggaccaccgcgaactccagcgcctcctcggtgtcaggggcaaagagcaatttgactcctcactcaggcgggcctagcgtcaggggcgttgccaacttagcccatgacgggggagccatcgtgaaactgtcgccgcagtccgccggactggccgcggcggtgctctccgccgcctccttcggcacctcgggcgcgttcatcaagccgctgctggaggccggctggtcgccggccgccgcggtcaccgcgcgggccctggccggcggccttctgctgctgccgctggtgctgttctcgctgcggggaaactgggccgcggtctggcgcggccgcgggcggatcgccgcgatgggcgtcgtcgcggtggcgttcacccagctcacctacttcgccgcgatccgccgggtgccggtgtccacggcgctgctgatcgaatatctggcgccgctgctgctggtgctcggggcgtgggcgacgacccggcggctgccccgcccggccgtgctgctcggctcggtcctcgcgatcggcggcctcgtcctggtgatcgggccgggggcgctgcaggcggtcgacccggccgggctgctgctcgcgctcggtgcggcggtcggctgcgcggtctacttcgtggtcgccgcgcgccccgccgacggtctgccgccggtcgccctggccgggctcggcctgctgctgggcggcgtgatcctcggcgtggttggggcgaccggcgtggtcccgatggccgtggcgaccgggccggtggcgctgctcggcacgtccacgccgtggtggctgccgctcggggtggtcgccctgttcggcaccgccatcgcgtacggcgcggggatcttcggcggcagccgcctcgggtcccggctcgcctcgttcgtcggcctcctcgaggtggtcttcgcctcgatcctggcgtggatcgtggtcggcgagcgcctcaccccgctgcagatgctcggcggcgtgctgatcctggccggcatcgccgccatccccgccgagccggccgttcccgtcgtcgccgctgatcgggccggcgtctccggcccgaaggtggcgcgcagcggcgccccccggtag

SEQ ID NO: 6407 - DNA, 732 bp, Actinoplanes utahensis
gtgaccaccgcgcaacccgagccggccgtgcccggcgcggatcgccaggtcgcccggctccagccggccgggtcgtcgttcggcggcttcggcttcgcgcacgccgagcccgaagtgctgcacgacgtgatggccgagatcaacaagttcctgatggtgtacaagttcggcctggccgagatcggcacgaagatcaacatcctggccgaggagctggcccaccgcggtcgcggcaacccgatcgagcacgtcaccccgcggctcaagacgatggccagcatcaccgccaaggcccgccggatcgagtgcccgctcaccgtcgacgacctgcgcgcccggatccgcgacatcgccggcatccggatcgtctgcggcttcgtccccgacgtctacaccgtcgcccggatgctcacccgccagcccgacgtgcacctggtcaccaccaaggactacatcgcccagccgaaggcgaacggctaccgcagcctgcacctgatcgtcgagatcccggtcttcctctccgaccaggtggtcgccgtcccggtcgaggtgcagctgcgcaccgtcgcgatggacttctgggccagcctggaacacaagatctactacaagcacgacgcggacgtgcccgccgcactccgcgccgagctggccgccgccgccgaggacgcggcccgcctcgaccagcgcatggagcggctgcaccaggagatccacggcccgcgccactga

SEQ ID NO: 6408 - DNA, 801 bp, Actinoplanes utahensis
atgccggcgctccgccgcgatccgccctggtcggcggaatcacaggtattgcgacagatcaggaaaaaggtgcggcacgctgtggtgatgacagtgcggagatgcgcagcttcaacgatctgttccgccgtagcggtgctggccgccggatcgccggccgcggccagcggccccccggccctcgccggcgacccgtaccacggcaagtgcggccgcgactcctacggcgtcaacaccacggtcatcaccgaccacggccacctgcacctgaccgaccccgccaccggcaacgagatcggcgacgcctacttcttctacacgcccagctgccacggcttcttcgtcacgagcctgacccgcggcgacaggtactacaccagatcgaccgtgtgggcgagggaccgcaccggcccggtcgccggcttctcgtcgttgtatccgggcaacggcatcgcctggacatacgtgctgggcaacatggccggccacgccgcgtgcgccgaaatcgccgtgaccacgccgcacggccgacccgtcaccacgatcgacctcggctgcaccgcggtcatccaggaccaccgcaccgtcggtgttcccgtctgggccctcccgcccggacgaagcgatgcgccggaatccttctccgcccgcactctggccgagggggcccggggatcccggcggtgcagcgcgggatccgccgggacgccggtcagttgcctgcggtcaggtagtcgagtaaccagccggtcagagcgcgggcaatgccggccaggacaccggagatcacggcgaggctga

SEQ ID NO: 6409 - DNA, 2667 bp, Actinoplanes utahensis
gtggattccggtgtcgacggctgccgaccggtgcgcgcaggcggcccggcgcggcactatggatcggcgatggatgccgacgggtcccgaccagaagtccgccgtgccaggccggtggaacgcgtcgccctgccgcccgggccgatccgcgacctgcgggagatgctctaccggctgtacgcggaggcggactgtccccggatcgaccggttggccgaggcgattctcgcggacgacgcgctaccgggatcgccgcgcaaagacctgatcatcaagatcatcagcggtgatgggctggcgtcgcagcaagacaccgtcacggttgccgtgacgctggcccgagaggcgggccgcgacgacaccgcgccggtggccgagcaggtccggcagctgtggatcaccgcccggaccgcgccggcgcgcagcgacgacagcgtggtacgggtcgggcgggtgcccaggccggcggcctggttccaggacagatacgcccaccacgctctgctccgggcggcccgggccggccgcagtgtggtgctgacccaggtgctgtccggtctcggcggggtcggcaagacacagctggccgcccagttcgcccgcagcctggatgcggccggcgagctggatgtgcttgcctggatcaccgcggccaatcggcaggcgctcgtcgcgggttacgccgacaccgcccacgccctgcggttgtgcggcccggaaaccgagcccaccgcggccgctgaccggctgctgtcctggctggaacacaccagccgacgctgcctgatcgtgctcgacaacctggacagcccggccgacgcgaccggcctgtggccgccggacaacccgcgtggccgcacgctcgtcaccacccgacgccgggacgcgatcctgcacaccgacaatcgcaccatggtccccgtcggcctgttcaccccgcccgaggccgctgactatctcactcaggccaccggcaccaccgagccgcgctccgcggtcgactccctcgccgccgacctcggcctgctcccgctggccctggcacaggccgccgcgtacatccgtgaccacgggatcgactgcgccacctaccggcaacggttgcgtgagcacggcctcaccgcgagattgcttccgcccgatgacggcctaccggatgatcatcgcaccatcgtcgcggccatctgggacgtctccatcaccgccgccgacaaccatcggccccgcggcctggctcgccccctcctggaggttgcggcgctgctcgaccccaacggcatccccgacgccctgttcaccaccaccgcgatcaccgcccacctgggccgggccgggatcaccgcgccggacccaccggcgatcatcgacgggcttcacaacctgcaccggctccacctgatcacccatgacgttgacacccacgccgtcggcatccacgcgctcgtccagcacgccacccgtgaccggtgcacccccgcccggctcgctcccctcgcccgcgctgccgccgacgcccttctcgaaatctggcccggcgtcgaccgtgaccccgtccacacccagacactgcacgccaacaccaccgccctacgaacggccaccggcgacgccctgttcacccctcaagtacacaggctgctgtttcaggccgcccgccggctcggaaacaccgggcaggtcgccgctgccgtcatcgccgccgaacagctgctcacttcctgtctgcggatattgggccccgatcacccggacaccctggccagccggcacaacctcgcctggtggcggggtgaggccggcgaccgggccggcgccgccaccgcatacgaacagctgctcaccgaccaactacggatattgggccccgatcacccgggcaccctggcgacccggcacaacctcgcctggcggcggggcgaggccggcgacccccatgccgccgaacggctgctcgccgacccgtcgccggtgctcggcgcgccgaccgcggccggccctcgcagcctcgcctggcggcggggcgagggcggcgaccccgtcggtgccgtcaccgcctacgaacagctcctcgccgacaggctgcgggtcctcggccctgaccaccccgacaccctgatcacccggcatggcctcgcctggtggcggggcgaggccggcgacccggccggggctgtcaccgcctacgaggaactgctcagcgaccggctgcgggtcctcggccccgaccatttggacaccctggctacccggcacaacctcgcgcagtggcggggcgaggccggcgacccggtcggcgccgccgcggccaccgaacacctcctcaccgatcagctgcgggtcgtcggccccgaccatccccacgcgctggccagccgctacaacctcgcccagtggcggggtgagtcgggcgacccggccggcgccgtcaccgcgtacgagcaactgctcgccgaccaactgcgggtcttgggtcccgaccaccccgacacgctgatcacccgctatcaccttgcccactggcggggtgaggccggcgatcccatcggcgccgctgcggcgaccgagcacctgctcgccgatcagcttcgggttctcggccccgaccatccccacaccctggccacccgtcaccgccttgcccgctggcgtgaccgaaggccggattga

SEQ ID NO: 6410 - DNA, 699 bp, Actinoplanes utahensis
atgacagctgaaccggtacccgccggcggggatgcccgccggctcctcgacgatgtgaagtcgctcgcccatcaggtgcgggtgcatcagcggctcacctggatagcgctgctgatcctcggcctggtcacgatggtgtccatcccgttcgactactacggcatgatcgtgcactgcgtggcgtccggtgacggccaggcgtgcaggttcgagcggcgcggcatgctgctctactggccgccggcgctcctgctggcctatgcggcgatcgcggtgagttacgtgcgggccgcccgggagcgcgggctcggcgcgcgggtcatgccgtacgtggtgaccggtgttgccctcgtcgttgcgttcctgacctcgtgggtgctgttccgggtctacctgaacgggcacccgctgcccgacccgccgcacccgatgccgtgggcgctgctgttcctcgaccgtctgatctcaccgtggggcaccatcggcatcgcactgctggtcctggcccggctcgaacgcaacctgccgctgctggggttcaccctggtctacctggcggtcacgctgatcccgatcgacttcggctggcacatgaacagcgacacccgcaccgtgtggatcccgcagcaggtgatcgacggcatgctgttgctgctcggctccgccgggttcgcgtgggtcgcccggaggcagcggtga

SEQ ID NO: 6411 - DNA, 348 bp, Actinoplanes utahensis
gtgggtcgcccggaggcagcggtgaccgccgccgcggagactccggaacatccggtcaacggcctcgacgacatcgtccaccagcgggtcaggctcggcatcctgaccatcgcccacgaggcccgccgggtcgagttcggctacctgcgcgcccagttgcagctcactgccggcaacctgtcgcagcacctcggcgtcctcgagacggcgggcctggtcgacgtcgagaaaggctatgagggcaaacgcgggcgtacgtgggtgaccctcaccgccgcgggcagcgccgccctggccgccgagatcggccggctcaagcagctcatcgcccgggtggagcagcgatga

SEQ ID NO: 6412 - DNA, 954 bp, Actinoplanes utahensis
atgaccacgcgacggtcgctgctgaccgccctggccgcggccccgttccccggcgacgtcccacggttcccgcggctcaccctgccggcgccgaccggaccgttgccgatcggtaccgtcgcactgcacctggtcgacccggccggcggccgcgagatgatggccggcgtctggtatccggcccgggacatccgccgctacccggtcttcccgtggatgtccgatccggcgtggcgcgcgctgctccgactggtcgacctggaggcgccggtccgggcgccgctgaccgccacccgccgcggcgcgccggtgctgggggagcggctgccggtgatcctgtattcgcacggcaacgacagctgccgggccgagaccacgatcaccgtgcaggagctggccagccacggctatgcggtggtcaccgtcgaccacaccgggaacggggtcagcgagttcccggacggccggatcaccctgcccaccgacgacgacttcacgccgtgggacgtcccggccggtggccctggtgaccggagtgggcacacggtcggtatcggcgtcggcatcgccaaccggctggatgtccgacgagatcggcaccggcctggcccgagggccacaacagcgccatcatcgtcggatgacgacgcgacctcccacgctgcgcgacgccctgagaagctgcgtccacaccggcgagaagatcggtttcacgctgctcgacggccgccagtttctcggctgggccgccgatgtcgacggcgaccgggtgctgctcagctgggcgccgagcccgatgttcgccatgtcgaccgacgatgcccagtggaacccggacgacgagtgggtgccgctgagcgcgatcgccgccgacaccgcggcccgctacgacgaggcgtcgcggcgttggaggccgtgctgctgacccgcggtgtccgcccaatagcagaatga

SEQ ID NO: 6413 - DNA, 498 bp, Actinoplanes utahensis
atgaggaaaattgcgggctccgccgcggcgatcaccgttttgttggccggaacgccggcgaacgcaacacctatcgatccatattacacgctcatcaacgcgaacagcggaaaatgtctttcgattggcgcctccaacacgaccagtggagcggctgccattcaatggagctgctggggcggcgatgatcagcgctggtacctgcgcaaatccaccgctggaacagttcgactggtcaacgtcaacagcggcaaatgcctggccatcggcgcctcgaacatgtccgacggtgcaacggcgatccagtgggattgtatcaacatcgatgaccagcgttggtatctgcgtgacgcccaaggcgcgaagaaactggtggcccggcacagcaggaaatgcctttcggtgggcgcctcaagtacggctgacggagcgaccgctattcagtggaggtgcggggacggcgacgatcagcgctggtacatgaactatcacgcttag

SEQ ID NO: 6414 - DNA, 2124 bp, Actinoplanes utahensis
atggacgccgccggatgtcggcagccacgggggcggccgacatccgggcgtccgggcaccgtcgttcggccgtcaccccgtctatacgatcgccatcgagtgccatcgaaacgggggaacgttttgcgaagactactgtccatggtgggcgtgaccgctgccgtgctgagcaccgtcgtgggtgtccggctcgccgtcacgcagcagccaccgccgcggccggcggtgcaggccgcggccaccgcacccgacgggctgggctaccagcgcgagaccgtccgcatgctgacctggaacatctgcggggaggccggcgggagccgcggcagttcctcgtactgtccgtggcggtcccggccgcaggccaaggccgccgccatcgagaccatcatccgcgagcgcgatctcaacgtggtcatgctggaggaggtctgctatccggacgaggccgccggccgcggcggtgaccgcaacgacctgtcaccgctgatggccgcgctcggctccggctggacctatcgcaccgcggtcgtggcccgcccggacggccgatccgactgccgcggcggcgacctggtcggcacgatcggcgaggtgatcgcggtccggggcacgatcacctcgtccacggtcacgccgctgctggtcgccggcgacccgagctactacccggacgccgacgagaaacgcacctcgaacctgctctgcgtgcgggtcgacggctggcagaacacgccgtgcgtgacccacctgctgcacaccaccgacccggagtacgcccgcgagaccgcgtcgctgaagcagaagatcgctgccgtcgccctgccggtgctcggcggcgacttcaacaccatgcagggctcggccgcgacctcaccgatccggccgctgttcgacacgtacccggaatgtgaccagcaggcctactcgcccggcgacgcggtcaacgagatgacgcatttcaacagcgaggacgccgcgccgacggtctcccggcagaagctcgactacgtcttcgccacctccggcttcgcctactgcgactcgctcaccgagttcgccgacaccgacgccaacgtcgcggccgcggacgacccggcgggcctgtcggaccatgcgccgctcgtcgcgttcacccgcgggcagtcgctgacctggaagttcgacgagaccagcggtgccgccacggcggacggctcgatcaacgggctgtccggcacgctgtcggacgatgtcacccgctccgccgagcgggtccattcgctgcgcttcgccggctcgggaacggtcaccagcggcgtcgacggcaccgtcaacaagttcgacacccgccgcgcgctcaccgtctcggtgtgggcgaaaccggacgcggcgaccgccgccggctcgctgctcaaccaggcggacaacaacggccggccgatcgacctgtcctacaccggcggcagatggcggttcgcgatggtcacggccgacgccgagggcgccgcgtccgaccaggtcaccgcccccgcgcagaccggtgtctggacacacctggcggccacctacgacgcggtcgccggcacgatgggtctgtacgtcaacggcaccctggccggcaccgcgacgcacaccagacgcgtcccgagcggcaccccgatcaccgtcggcgacgggtatcggggcggcctcgacgacctgcagctcttcccgtacgcgctgagcagcaccgagatcaccaagctgcgcgccgcgcagaccatgctgcccgccgtgccgaccggcacggtcaccgtcccggcgaccggcaccggcgaccccggctgtcaccagaacggtggttacggcaaggtgccgtcgctgaccccacggctgaccgccgtcgtcaaggacgacgatccgacggccgcggtccgggccgacttctccctctgggacaacaccgacccccaccagccgcagccgatctacctgggcggcccgggctcggccagcgacttcgtgaccggcacgggcaccgtctcggtgccggtgccggccctgctcgacggccactcgtacggctggtacgtccgcgcctccgacggtacgaacgtgtccgccaccgccccggtctgccacttcgtggcgacctcctcctga

SEQ ID NO: 6415 - DNA, 2952 bp, Actinoplanes utahensis
atggcactcgatggcgatcgtatagacggggtgacggccgaacgacggtgcccggacgcccggatgtcggccgcccccgtggctgccgacatccggcggcgtccatggtgcagtgccgcgcttggcaaaaccttggcgggccgctggcggagtcctcctagacttcggctcgtggacttccagctactcggtgcggtgcgcgctgtccacaatgggcaaaccgtgcccctcggccggaagcaggaacggtgcgcgctggccgtcctggcgctcgacgccgggcggcccgtccccgtcgcccgcatcgcggacctgctgtggcacggcgacccgccgcaccgggcccgcggcgccatccaggcgatgatctcccatctgcgggccgcgttccgggccgtcgacccggagcatcactacatcgtcggcggggaggcgggatacctcctcgacgtcgcgccgcaggccgtcgacatcaaccggttcaccgccctggtcagccggggccgggcaaccgacgtgacggagacccgggcggacatcctggcccaggcgatggccctgtggcgcggcccgctgctcggcgacatcgcggacgacgtgctgcgggcccggctcagcccggacatcgacgaactgcacctgcaggcgcgggaggactggctcgcggcccggcttgagctcggtgaccacgacgaggtgaccgcccggctcaaacgcctggtcgacgagcatccgctgcgcgagcgcgcccgccggttgctgatgctgtcgctgtaccgcggcggccggcgtcaggaagcactcgccgtgtaccgcgacacccgcacggtgttcgtcgaggaactgggcctggaacccggaccggagatgcagcacctgcaccggaccgtcctgtcggcggaggcggccacgcccggtctcaccgtcgccgacgccccggtcgcgcccgccgagttgccggccgacctcgccaccttcgtcggccgcgagccccaggtggcccaactcgacgaggtgctcacggccgtcggccggccgtccgcgcccgcggtgatcgcgaccatcagcggcagcggcggagtgggcaagacgtcgctggccgtgcactgggcgcagcgggtgcgaccacatttccccgacgggcagctgttcgtcaacctccgcggcttcgacgcctccgcggcaccgatgagcgtggaggacgcgctgcgcgggctcctgcactccctcgggatgcgcccggaccggatcccgccggcgaccgaccggcaggcggcgctgtatcgcagcctgctcgccggcaagcggatgctggtcgtgttggacaatgcccgggacgccgaacaggtccggccgctgctgcccggcgcccccggctgcctggtgatcgtgaccagccgcaaccagctcccgggcctggtggccaccgacggcgcgacacccgttgcgctgggcctgctcgggcatgccgagggccgtcggctgctgcggcggcggctcggcggcgaccggatcgacgccgacaccggcgccctcgaccggatcgtcgaccggtgtgccgggctgcccctcgcgctggcggtcgtggccgcccggatgtcccagagccgccggctcaccctcggcgacctggccgcggagctggccgagtcacggaccgcgctggacaccctgggaaccggggaccgggcgagtgacctgcgctcggtgttcgcctggtcctaccaggcgctcagccggcccgcggcccgcctgttccgcctgctggggctgcaccccggcccggacgtctcggtgcacgccgccgccgccctcgccgacctcccgatcggccaggcccgccggatcctcgccgaactgacccgcgccaacctgctgtcggagcccacctacggccggttcgccgcgcacgaccttctctgggcgtacgcggtgggactcgccgaatccggcgaaccgccgcaggagcgccgagcagcccggctgcggctgctggagcactacgccgcgatgaccctgcacgcggccgagttgctcctgcccggccgggtcggatcgattccgctggtcgcgccgcagcgtaccgccgctgagcaggtcgacgacctgaaggacgcggtggcctggttcacggccgaaagcccggtgctgctgcggctggtgccggccgcgctgtcgaccggccaccaccggcaggcctggctgctggcctggggattgcgcgactacctcgaccaccggcggcagtgggacctccagatcaccgtgcagcaggccggcctggccgcggccgtgcacctcggcgactggaccgcgcaggcccacgcccaccgcaacctgggccgcgcgttcaccgagcagggccggatcgacgacgcgcggcacgcctaccggcaggcgttcaccgcattcgccgcagcgcgggaccaccacggtcaggccagcgtccacatgtccatggggctgctcgcccaacggcatcggcaaccccatcagtcgctgcaccactacctggcggccctgaaggccttcgagcagatcggcgacccgtcgggccaggcgaacgcgatgaacaacgtcgcctccggctacctcgaactcgaccagcacgaccaggcgttggagtacggtctgcgggcgctggacctcgcccacaccaccagcgcgtgggcccaggccgccatcctgaacacggtcggctccatctggcgccggcacggaaaacaccatcgggcggtcgagtgctacagccgctgcgtggcgctgatccgcagcgtcggcgaccgattccacgaggccgtggccctttgcgacctggccgacgcctgcgccgccgcgggcgacgagacgtcggcggcgcaggcccggacccaagctttggagatcgtcgggcacctcagcgaatcggacgccgcggtgatccgcacccggctgaatggcggctcgccttga

SEQ ID NO: 6416 - DNA, 102 bp, Actinoplanes utahensis
atgggggcaatcaaaccgtggcacctgttcctgtgcctgatcgtggtactgctgatcgccggcgtggtggtggccgtggtcagtgcgggacggagaaagtag

SEQ ID NO: 6417 - DNA, 1632 bp, Actinoplanes utahensis
gtgcgttcgtcgcggctggggcacgatgacgcggtgatcaagtcgtggtggcgagaccggaagtctgttcctgcgccggcggatccaccggcggccgatccggtgcgggcggccgttgcggaagccgctcgtggcgggtgggaaccggtcggccatctcacgacgttgctcgcggaggttgccgccaccggtgaccgggagtcgggctgcgcggcgctggcggtcctcgccgggtggccgcgcgtcgtggtgcggctggatgagaacgcacggcgcgcgtggtggcgccagccgcttccggcatcgccggctgaacgggtggtcacccgggcgatagccggcgcgtacgaggctccgctcgcggtggcactggccagcactcatggtgacggacgggtccgcgagcgggcggttaccgcgatgctggccacaccgtcggtggaactgatgccgttgctggtgttgcggaccggtgactgggttcgctcagtgcgtgaccgggcccgtgccggtctggcattgctgctcgccgacgatccggccaggtatctgggcgccgtgctgccggtgacgacagcgatcgaccaacgctgccgtggtgcgttcgtcgtgacccaggtgaaggccgccttctcggccgcatcgcccaccgaccggcggcttctgatggcgtcatcccccctcgcctcccggcgcttcgcctgccacctcgccctcgacgggggcttgctctccccaccggaactgctagaccttgccgagtcgggcccggacgcgccggtacgggctcgcgctgccgaggcggcctgccgcgatgccgtctggcggcgccgcctgaccgcattgcaccgactggcccgaagccgccggccagaggtgcggtccttggcgctgaccggactgatccgcaccggcaatgacgccgacgtggcgtcgcacctcgccgatccggcaccgctggcacgggcgttggcacgcgacgcggcccgccgtgccggcgtcgacgccgtcgcgtggtaccgctccgccgtgctcgacgcaccgacgccaccggcgatcgccggtttcgccgaggccgccccggcgcgggaatcggcgctgctccaccccctcctgaaccatccggaggcgaagatccgcgccgcggcggtacgggctttgcgtcagctcgacgcgaccgaggccgcacgggtcataccgctgctgcacgatccgtccgcgcaggtgatccgcgaagcagtcgtcgcgttgcggccgatagtgaagctggtcgacgcggaccttctctggcagctgctcaccgacgccgggaccgcccagcgccgcggcggctaccgcctgctcaccgcagggaccgtcgcaacatgcctgcgagccggactcatcgccgcagctgatccggacccgaagcttgccgcgcgggcccgagccgacgtcacgcgcctcgcccgcgacgccaccgcatcggcctggcgcgccggcgcaacacccgagctggtcatcacgacccgcgagcgcaccgaactcaccgccctgctccaccacgccgcgccggccctccggcccgacaccgtggacagactcgccacctggctccacaccacccccaccacggaggcattgacgcggtga

SEQ ID NO: 6418 - DNA, 240 bp, Actinoplanes utahensis
atggcaccaccgtccggcccggtccgcgccgcggcgaccgacggcgcggccggcgcccgcatccgcctggcgcgccgcgaggcaggactcacccagcagggactttcggcggaggtgaaggtgagccggcagaccatcatcgcgatggagaccggcgactacgccccgtcggtctacctggccatcaagatcgcccaagcgctgggcgtcaccgtcgaagccctgtggggcgacacctga

SEQ ID NO: 6419 - DNA, 504 bp, Actinoplanes utahensis
atgacggcttcactggttgaccgcgtcgtgcggtggaacctcgacatcgacggccagctgtacggcgacgaacgcgagcgctaccgctcctacgaggggatcgtcaccgccgccacgctgcactcgatcctcatcccctgggcggccggcatcatggtgtggccgctcggccggccggccgtgctgcccctcgcggtcgtcctgttcctgctctgggcgccgatggtgctctgttccgcctatgtggctcggcgcaaggcgggcgtcgatccgcgcggctggagtgcgaaacggaccctgatcgcgacgctgagcgtgactccgtacgccgtgttcgtcgtcggcgcgatgtatgccttcgatcccgcgggtgacgcctggatcggtgcgatcgtcggcagcgggttcggcgccatgctatgcctcctgatgctgggcagggcgcgacggcggcaggcactcgccgccgccgaggcactcgccgccgatgaggacgaggactga

SEQ ID NO: 6420 - DNA, 801 bp, Actinoplanes utahensis
atggtcgacaccgatgcgctgctggccgcctacgacgctcacatgcggtttccgaccggcgccgtcccggccgggatgagacacgagtacgacggggtgctcctgcggatcgtcggcgggcatgtcgggcgcatccgggcgccgcgcgacgtcggtgtcaccggcgccgggctcgaccgcctgatcgcccgtcaacgggactacttccgggcccgcggtgaaggcgtcgaatggaaggttcgctcccacgaccggcccgcagatcttccggaacgcctggtggcagccgggttcgtggcgggggagccggcatcggtgctgatcggctccgccgaggagatggccggcgatccggtcctgccggacggtgtcgtgctgcgccggatcagcgcggccggggacctgcgccggatggccgagctgcagagcgaggtgctgggcgaggactgctcctgggtggccgcccatctcgccgcccgggtgtcagccgatcccgatcagctcaccatcctggccgccgaagccggtggccggttcgtctgcaccgccctggtggagtactgcccgggcaccgacttcggggcactgctcggcggcgcgaccctgccggactggcaggggcgggggctgtaccgggccatgatcgccgctcgggcgcgggaggccgtcgcccgcggattccggctgctgcatgtcgacgcatccgcggccagcgcgcccatcctgcgtcggtgcggcttccacgagatcgccgtctcccggcactaccagtggacgccggaacacccggaagcatcgtag

SEQ ID NO: 6421 - DNA, 486 bp, Actinoplanes utahensis
atggacgaggcttcgtggtacggcccgccgcgggacgtcctgggccggacggtgccggtccagcaattcgtggtccggaccgggcacgtggtcgtcgcggtgccgcacctggtcgcgttccgcgagggctgcctcatcgtgctgctggtgaccgtgcgccgcggggggctcccgatggcggcctgggacaaccggctgggcggtcaccgcgccggaatgcccgacccggagggcctgacctgcgagattcaccttcgcggcggtacgtcggagccttcccggctcgtcgaagccggcgccgagtcgtccagcgacgaccgggagtaccgcggcgagctgagattctggctgcggccgctcccgcccccggcgccgttcgacctggtcgtcgccgggccgggcatgggtgtcgaccggagcgtcgtcacgctcgacggcggggcggtcgtccgggcggccgcccgcgccgcgccgttctggacctga

SEQ ID NO: 6422 - DNA, 456 bp, Actinoplanes utahensis
atgcccgtcaccgtcaccacccgcatcgcggcggcccccgaggcagtctgggatctcgtcgccgacatcacccggatgggccagtggagcccggagacgacccggtgccgctggctcaccgaaccgcccggcccgcgcgtgggggcccggttcaccggcgccaacgcccaccgcggccgccggtggcgcaccgtgtgcaccgtggtggcggccgaccgcggtcgcgagttcagcttcgacgtggtcggcgccggtttcctcgccgtggcgcggtggacgtacacgttccgcccggtcgacggcggctgcgaggtgaccgagacctacaccgaccgccggggcccggccctcaaattgttcggcatcgcggcgctgggcatcaccgaccgcgacgcccacaaccgccgcaccatgaccgagaccctggcccggctccgcgccgccgcgcaggcgtga

SEQ ID NO: 6423 - DNA, 1617 bp, Actinoplanes utahensis
atgacggagacggtggaccggcccctggccggcgtgcgtgaggcgatcgagcagggccgcacggccctgggcatcgagctggggtcgacccggatcaaggcggtgctgaccggccccggccatgcggcgatcgccaccggcagccacgactgggagaaccagttcgtcgaccgcacgtggacgtactcgctggaggccgtctgggccggcctgcaggactgtttcgcggcgctggcccgcgacgtccgcgagcgccacggcgtcgagttgcgcaccaccggcgcgctcggggtgtccgcgatgatgcacggctacctcgccttcgacgccgacggggagctgctcaccccgttccgcacctggcgcaacaccgacaccggggacgccgccgaggcactcagcgagcttttctcgtacaacatcccgcaccgctggagcatcgcccacctgtaccagtcggtgttgaacggtgcggagcacatcggccggctggcgcatttcaccaccctcgccggatacgtgcactggaagctcaccggggagaaggtgctcggcgtcggcgacgccagcggcatgttcccgatcgacaccaccaccggcgggtacgacgcccggatgctggagcagttcgacaccctggccgccggccgcggcctgccgctgcccctgcgcgacctgctgcccgccgtgctgcccgccggcgagcgggccggcacgctgaccgaggccggcgcccggctgctcgacccgaccggcgccctgcagcccggcatcccgctctgcccgcccgagggggacgccggcaccggcatggtcgccaccaactcggtcgcccgccgcaccggcaacgtcagcgccggtaccagcatcttcgccatgatcgtgctggaaagcccgctgagccgcgtgcaccccgagatcgacctggtcaccaccccggccggcgacctggtcgccatggtccactgcaacaacggcgccagtgagctcgacgcgtgggccggcctgttcaccgagttcgccgccgccctcggcgtcccggcggacagcggcaaggtgttcgagaccctgttccgcgccgcgctgaagggcgccccggacggcggcggcctgatggccttcaacaatctctccggcgagccgatcaccaggctgcacgaggggcgcccgctgttcctgcgcgagccgggcagctcgctgacgctcgccaccttcatgcggacccagttgtacgcggcgctcgccaccctgcgcatcggcatggacgtgctgcagaaggcggaggcggtccagctcgaccggatgttcgcgcacggcggtctgttcaagaccgagggcgtcgcgcagaacctgctcgccgccgcgatcgacaccccggtctcggtcggtgacctggccggcgagggcggcgcctggggcatcgcgatcctggccgccttcctgaccggccgcgccgacggacagaccctcgacgactatctggccaccgcggtcttcgccgacgcccgcctggacaccgccacccccgatccggccgacgtcgccggattcgacgctttcctgcggcggtacgtggcggctctcccgattcagcaggccgccgtcgagcacagctga

SEQ ID NO: 6424 - DNA, 1911 bp, Actinoplanes utahensis
gtgctgtcaatcagatctggtcgatccatgggcgtcggggccctggtcgccggcctcaccaccacgatggtgttctgcgccacgccgacggtgccggtgctcgcggccgggtcggccgccacggccgcggcgtccgccgtggatgatcacaccaacgtcgccacggacgaggacaaggtcaaggcggccgccgcgatcggcgtcaacccgggcatcgacctgctcgtcctggacgaccagggcttcgtcttcgccatctaccagcgcgccgaggccgggccgtacgtgaaggccgaggcgctgcgcacctacctgtcgtcggacccgcacgccgcctacgacttcatcgtccgcggcatcttcgtcgcggccggcgacgacgcccaggccaagatcgccgagacggccgcccgggcccgccggagctcggtggcggtcaccgtcgggctggactcgtccgacatcgcgctgatcgagaagaacgaccgcgacttcatcttcgcggtgtggcagcgggtcaccgccggcagccacgtctggaccgccgcgcagacggcgatcgccgacggcaccggccaggccgagtgggacgccttcctgaacaccggggcggcggccgccgccgagcaggatctgcgcgacgtgatcatcgacggcgacgaggcgcaggccgcgaagctgcgggccgcgcgactcgtcaccgccaagaaggcgctgctgcagctgttgctgttgccggtgaccgacgaggtcgtcaacgcgccggaccggcagtacgtgctgttcgtccacaacaacgccaagggcaccgaggtcttgctggcctcgcaggcggccctcaacgcgccggacgacaagctggcgcaggcgctgaccgacttcatcttcaccggcggcgcggccgccaacaagcgggacgaggacgccgccgccgccaaggagctggccggctaccgcgaccgcgtcaccgccatccgggacgcggccaaggccgacggtttccagccgaacctggtcgacgccgccaaccgggcgctcaccgacggcaccctgctcaccctgcagaccttcctgctcaagggccaggacgagccccgggccacggacgaacagtggcgcgccaccttcttcaaggatttcaacggcgaccgtaaggccgacctcgcgggtatcaccagcggcggcaacctgttcctctacaccggcagcggtgccggcaagctgaccgccggcggtgccatgtgggccaccgacggcagctggggccggatcaaggcgatcgccgcggccgacttcaacggcgaccgcaagaccgacgtcgccgcgatcaacagcgtcggcaacctggtgctgtacgccggtaacggcgcgggcaagctgaccaacgcgggtgccatgtgggccgccgacggcagctggggcaacttcaaggcgatcgccgcgggtgacttcaacggcgaccgcaagaccgacatcgccggcatcagcggcggcggcaacctgatcctctacgccggcgacggcgccggcaagctgaccaacgcgggtgccatgtgggccaccgacggcagctggggccggatcaaggcgatcgccgcgggcgacttcaacggcgaccgcaagaccgacctcgccgcgatcaacagcgtcggcaacctggtgctgtacgccggcgacggcgcgggcaagctgaccaacgcgggtgccatgtgggccgccgacggcagctggggcaacatcaaggcgatcagcgccggcgactacaacggcggcggggccgtcgacctcgccgcgatcaacagcgccggcaacctggtgctgtacgccggcaacggcgcgggcaagctgaccaacgcgggcgccatgtgggccaccgacggcagctggggcggcatgaaggcgatcagctga

SEQ ID NO: 6425 - DNA, 486 bp, Actinoplanes utahensis
atgctacggcgcgagatcccggtcaccgcggtcctggcctgcctggccgcgttcgccggcacgcgacccgcgtacgccggcaacgagatgatggtcgagcggtgcagcggtgacgtctacatctcctccgcctacaacgaccggtttccgccggccggcggcatctacctgaaacgctccggcgaggcgttcacgccctggtcgccccccatgccggtcgccgggcacaccttcatccgctggtggtgccactcgaccaccggcaactggctcgacccgggcacctggcgcatcgacggtgtcaacgcgcacgtggactgcgactacgacagctgcagcctcggtaccggagcgacccggttctacaccttcgacgtcaacgggtggaccgccgagaggtcccggtgcggcgatccggccaccgccgccatctccgcccggctggggccgcagcgcctgctgctcatcgaatgccgcccatactga

SEQ ID NO: 6426 - DNA, 852 bp, Actinoplanes utahensis
gtggacaaccgatccgaggtgcgggacttcctgacgtcgcgccgcgccaagatctcaccggagcgggccggcattcccgggggtgggcagcgccgcgtgccggggctgcggcgcagtgaggtggcggcgctcgccgggatgagcgtggagtattacgcgaagctggagcgcggccagctggccggggtgtcggccggcgtgctggaggcgatctcccgggcgttgcagctcgacgacgccgagcgggtccacctgctgcgcctggcgcaggcggcgaacggcagcagccggttggtccggccgcagcgccggccgaaggcgtgggtggtgcggccgagcctgcagtggtcgatcgacgcgatcaccgtgccggcgacggtggccaacgggcggcaggacgtgctggccgcgaaccatctgggccgggcgatgttcagtgacctgttcgccgatccggtcagcccgccgaacttcgggcggttcatcttcctggacagcgcggcccggcggttctacccggattgggatctggccgcggacatgctggtggcgaacctgcggaccgcggccggcaaggatccgcacgacggcgagctgcacgagctggtgggggagctgtcgacccgcagtgacgagttccgccgccggtggggtgcccacaacgtgcgcacccacggaaccggcgtcaagcagtttcggcaccacatcgtgggggatctgagtctggcgtacgaaagtctcgacctgcgcgccgagccggatctgacgctgaccgtctactccgcggagccggggtccacgaccgcgcacgccctgacgctgctggcgtcgtgggcggcgacatacgtatga

SEQ ID NO: 6427 - DNA, 1068 bp, Actinoplanes utahensis
atgaacagcacaccggagggcatcattctcaccgtcaacgcgatcgccgcgacctcggccaccgacccgctcgtgcgcaccaccgtcgagcggcgcgacctggggccgcgcgatgtactgatcgaaatccgctacgccggcatctgccactccgacatccacaccgtgcgcggggagtggggtgacgtcgcgtacccgctgaccgtgggtcacgagatcgtcggccgggtcgccgaggtcggtgccgaggtcagccgccaccgggtcgatgaccgggtcggcgtcggctgcatggtcaactcctgccgggagtgcgacaactgcaaggccggccaggagcagtactgcaccggcggcaacgtgggcacgtacgccagcgtcgaccgggacggcacgatcacccagggcggctattccacgcacgtggtggtcgacgaggacttcgtgctgcgggtgccggagagcatcccctacgaggcggcggctccgctgctctgtgccgggatcaccacgtactccccgctgtcgcactggaaggccgggccgggcaagagggtcgcggtcgtcggcatgggcggtctcggtcacatggccgtgaagatcgccgcggcgatgggcgccgaggtcaccgtgctctcacagacgctcagcaagaaggacgacggcttgcggtacggggcgcagcactactacgcgaccagcgacccggccactttcgaaacgctcagcggaaccttcgacctgatcatcaacaccgtcagcgcgccgatcgacatgggcgcgcacctgcgcctgctgcgcctggacggcaccctggtcagcgtcggggccccgccggagccgctgccggtgccggtgttctcgctgttcggcgcgcggcgttcgttcgccgggtcgagcatcggcgggatcgccgagacccaggagatgctggacttctgcgccgagcgcgggatcgccccggagatcgagctgatcggcgccgaccaggtcaacgaggcgtacgagcgggtgctgaagtcggacgtccgctaccgcttcgtgatcgacgtcgacaccctgcgctga

SEQ ID NO: 6428 - DNA, 1200 bp, Actinoplanes utahensis
atgacgcagcggatcgcgagttccacctcgccgctgttcgagaaggcggaaccgtccgcctacttcagcgacgacgactaccggcgcttccacgaacgggccgccggatacgaccgggacaaccggttcttcaccgaggacttcgaggacctgcgcgcccgcggctatctgcgggccgcgatcccggccgcgctcgggggcggcggcctgggcttcgcggcgctggcccgcgagcagcggcggctggcctactgggcgccggccaccgcgctcgcggtcaccatgcacctgtactggaccgggccggccaccgcggtgaccgccgcgggtgtcgaggacctgggctggctgctgcgggacgtggcggacggcaaggtgctggcggccgggcacggcgagcgcggcaacgacctgggactcgacgacgcgaccaccctcgcggtgccgcaggaggacgggtcgtggctggtcaccggacgcaagacgttcacctcgctctccccggtctgggacaagctgggcatccacgcccgcgacgactccgacccggaacacccgcggatcgtgcacctgttcgtcgaccgggacgcgcccggggtgcgcaccgagaggacctgggacgcgctcggcgtccgggccacggccagcgatgacacgatcctggagaacgtgcgggtgccggccgcccagttcgtcggcgcgcacgcgatcggtcagccctatccgccgtacatcctcggcatcctgcagtggtatctgccgttggtggccaacgtctatttcggcatcgcgcggcgggccctggacctggccgaactctccgcccaggagcgcgggtcgctggccctgcccgggcagcggcacgccgacaagccggccgtgcagcggcaactggggcaggccgagatcctgctcgacgcggcctgggcgctgctcgagcagaccaccgccgacctggacgccggcgtcgaccacggtgactggtggacgtcccggctgttcgccgccaaggagttcaccaccggcacggcacggcaggtggtggacatcgcggtacaggtggcgggcgcgtccgcggtcagccggaccaacgagctggaacggctgtaccgcgacgtgcgcaccggcaccctgcacccgccgaacagcgacgcgatcctcgacgtcgtcgggcgcaccgcggtcggatcgctgccctga

SEQ ID NO: 6429 - DNA, 1332 bp, Actinoplanes utahensis
atgagtgtgctcgatgccatcggcgacaccccgctgatccggctgacccggatcaccgccggcctgaccgccgaggtccatctcaaggcggagttcctcaacccgggcggcagcgtcaaggaccgggccgcgctggccatggtgcgggccgccgaggcgtccggcgagctacgcccgggcggggtgatcgtcgagggcacctccggcaacaccggggtcgggctcgccatgatcgccgcgcagcgcggctatcgggcggtcgttgtggtgcccgacaagagcagcgccgagaagatcgcgacgctgcgcgcctacggcgccgaggtggtgatcaccatcggcggggtgacccgcgaggacccgcggcacgtctcgcaggtcgccgcccggctcgccgagcagaccccgggcggctggctcgccgggcagtacgacaacccggccaacccgggtgcgcacctggccaccaccggcccggagatctggcggcagaccggcggccggatcacccacttcgtggccggggtgggcaccggcggcacgatcagcggcgccggggcgtacctgcgctcggccggcccggtcacggtgatcggcgccgacccggagaactcggtctacggcgggggcgacggcagtccgtactacgtggagagcatcggccactacgtgcacccggacacggtcgaggacgtctggccacagtcgtaccatcggcaggtcgtgcaccgcatcgagcggatcagtgaccgggagtcgatcgagaccacccgccgcctggcccgcgaagagggcatcctggccggcgcgtcgaccggcacggcggtcgccgcggccctgcgggtggcccgcgacctggggccggacgacctggtggtggtgctggccccggactccgggcgggcctacctgtcgaagtacttcgacgacggctggctgcgccgggccggcttcccggcgccgaccgcacccggcccgctggccggtgggttgccgctcgccgtcccgcttcacctaccggccgattcccgggtacgggacctcggcagcgccccggtcgcgctgctggtcctcccgcgccccgggcagaccaccccgcacccgtcgcccggggacgtgctcggcgtcgtgccggccgtcgcggtcgccggggccgcaccggacgcgccactggccgccttcgcccagccgctgcccacggtcggcgccggtgagccggtcgccgaggcgatcggccgcaccccgcccgaggccggctggctcgccgtgctcaccgacggccggatcaccggcctcaccccacgacccgtcccggcacccgccaccacctaa

SEQ ID NO: 6430 - DNA, 762 bp, Actinoplanes utahensis
gtgggccgtcctgcgcggccgcgacgaaccgcagcccgccgcggccggtggcctgaccgtcacccggtcctgggccgggcagcagctcacgctcaccacccccagcggcgcgtgcgacgccccgctggtcgccgcatacgagaagggcttcttcaccaaggccgggctcgacgtcgtgctgaagaaggccggcaccgacgaggacatcaccgcggcggtcggctccggcaagtacgtcgcctccaacggcatcttcttcaactacctgggcccgatctacaacggcaccccggtcaagctcagcggcggcctgcacctcggctgcctcgacctctacgtccgcaacgacggctcggtggcctcggtcgccccgctcaagggccggaggatcgggtcagcaacctgcagggctcggccacctacttcttctccctcgacctgctcgccaccagcgcggcgctgctcgaggtccaggatgcggcgatcctcgtggtcgccaccccggccgcccgcggcgcctactccggagccctcaaggtgctgctcgaccacctgccggcgaacgcgctggccggcgtggtcgcggtgccggtcgtcgccgcggaggcgcagacccaggcggacgccgccgaggcggtcctggcccggctgctcagcgaactgggcgcggacgtcgtcgacttcggcctgaccgccgtcggcccggaactcaccgagcccgcctcggtcgccgcaacctacgccgcggccatcatcggctga

SEQ ID NO: 6431 - DNA, 579 bp, Actinoplanes utahensis
atgaccaccaccgtgcgacgtcgcaccgacgatcagcagttccggctgcagctggagagcaacgccatctggaaccggatggtcacccccggcgaccgcctccccgacatgccactgctcgaagtggacctgggcccgatccacctgaaccgactgcgcgacaccggcccggtcgtcctgctgttcttccggcacgcgagctccccggagtgcgacgccgccctgcacacctaccgcgacgcgctcgtcccggccctgaccccgctggacgcccacctggtcgccgtcagcccgcaggagcccggccgcctggaggccgtcaagcgccgccacgagctggacttcttcgtcaccgccgacccccggcacacgctgatcgacgccttcaacatcggcttccgcagccccgacgcgcaaccgatcctgggcaccggccgctccgtcctgccgttcgccgccacggtcgtcgccgaccgcaccggcgtcatccgcttcgccgagatcaacgccgactggtccacgcccaccgccccccaccgcatcatcgaagcgcttcgcccacccctgaccacccgctga

SEQ ID NO: 6432 - DNA, 1017 bp, Actinoplanes utahensis
gtgagtgatcggctggaggctcactatcggcggctgatgtgggcatatccgcgggactaccgcgagcggcacggcgtcgaggtgatcaccacgttgctggacatggcggcggacgaacggcatcggccgagcccggggcaggcgctgcacctgatcctctgcggtctccgccagcggttccggctgccggcccggcgtccgctcgcgctggccggagccctgctcgccgcggtgatcgtgggcgggttcggcggggtggccggcacctggttgggctggcggacggccgcggggattccggccgaggccgccctgcgatccctcaacaccgcgatgatcggcacgtcgacgccggccgaggtccaccccgaggagtcggcgatgaaggggccgggggtggcgctcatcacccacgggggcagagactattcgcccgggcgcatccgggccgcgctcaccgccgccgggtggcggacaacggcgtaccgggagtttcccgtcggcgagcacgagcacctcttcaccttcgccgccaccaggggccggctgaaactcgacggcagcggcctggtggtcgacagtgccgagggcgccttccagaattcgtaccggaccgacgtgtggccggtggagcccgcggtggtgcgcccgctcaccgttgccggcatggccgggggagcggtcgtcgggtggctggtggccgcggctctcgcctaccgggtgcggcgggggacccgggcccggcggctgttggcgagcggctcctcggcggtcgcgctctcggcggcggcggtgcccgcgttcgtgcacggctgtgcgacctgtcaggtgctcgtctatgccgagggctcgccggttccgtacatcacctacggtccgggcgacggcatcccggcctggcccgggacgatcgtcgccctgatcgccctggcggccgccctgggcgtgacgtggcggcgtcgcggcgccgcggcgtccgtggccggcccggccggcatggaggaggcggccggctga

SEQ ID NO: 6433 - DNA, 1140 bp, Actinoplanes utahensis
atgcgtatcgactttgcccgatcggtcaggtcgcgtctagggatcgagtgggagatcgcgtgcgtcgaccgccgcagtggcgagctggccgccgcggcccccgagttgctcgccaaggtcggtggagcggccggttttccgcacgtcaccggggagctgctgacgaacacggtggaggtggtcagcgccccgcaccatcgggtggctcgcgcggtcgacgatctggaccggctggtggagcagctcgccggggtcgccgagccgatgggggtcgacctgatctcctcgggcacgcacccgttcagccagtggttccggcaacgggtgacgcccggcaagccgcgctacgacacgctgatcgaccgcacccagtggtggggccggcagatgatgatctggggtgtgcacgtgcacgtcgcggtggaggaccggcggaaggtgctgccgatcgtggacgggctgctgacgtacctgccgcattttcaggcgttcagcgcgtcgagtccgttctgggcgggggagacgacggggtacgcctcgaatcgcgccctgatgttccagcagttgccgaccgccgggctgccgccgcagctcgccgactgggcggcctacgaggcactggtcgccgacctgcggcacaccggggtgatcgaggagctgaacgagttgcgctgggacatccggccggcgccccggtggggcacgatcgaggtgcgcaccttcgacggtatgccgacgctgcgcgagatcggtgcgctcgcggcgctcacccagtgcctggtggagttcttctcccgggagctggacgccgggcggacggtgccccggttgcagccgtggttcgtgcgggagaacaagtggcgggccgcccggtacgggatggaggccatcgtgatccgcaccgcggccggggacgagcggctggtcaccgaggatctggtgggtgagttgctgccgcggctggcgccggtggccgagtcgctggggtgtgtggcggagctggccgggctggcggagatcgtcgagcacggcgccagctaccagcggcagttgcgggtggcggcggcgaacgcgggtagtttgaaggcggtcgtgtcgtcgctcgtccgcgaactgcgtgacaacctcctgcatcagtag

SEQ ID NO: 6434 - DNA, 297 bp, Actinoplanes utahensis
atggcgtacgcgtacaccgccgtgacggcggagagcgaggtcgccgcgctcaccggtgacctgatccggttcgacaccaccaatgccagtgacgacggcggcccgggcaccgaacgtccggccgcggagtacgtcgcggagaagctcgccgaggtcggctatgaggtgacgtacgtcgagtcgggcgcccgtggccgcggcaacgtgatcgcccggctgaccggatccgatcagcagcgaggggcgctgctggtgcacggtcacctggacgtggtaccggccgatgccgccgagtag

SEQ ID NO: 6435 - DNA, 690 bp, Actinoplanes utahensis
gtggggccgcggcgcggtcgacatgaagggcagcctcgcggtcagcctggccgtcgcccgccggctcaaacgggagaacgtgacgccgccgcgggatctcgtcttcgcctatgtcgccgacgaggaggccggcggcttccacggcgcccgctggctggccgagcatcgcccggagctgttcgacggggtgaccgaggcgatcagcgaggtcggcggcttctcggtgaccgtcggggacggcgcccgggcgtacctggtggagaccgccgagaagggggtcgcgtggatccggctgctggcccgcgggacggccgggcacggctcgctgctgcacgacgacaacgcggtggcgaagctggccgccgcgccgtgctcggcccggggatcgacgtacggtgggacagtcttcccggggtcgagaccgatttccgcggtacgttggtggatgcgatggccgcggcgatcggcgccgaggacccgggggcgcgcctgctgccgtacatgctgtcggccagcaccgatgccaagagcttccagcgtctgggcatccggcatttcgggttcgccccgctgcgcctgcccccggagctggatttcaccgcgctcttccacggcgtcgacgaacgggtgccggtggccgcgctcaccttcggcacccgggtgctggaccgcctgctgcgtaactcctaa

SEQ ID NO: 6436 - DNA, 699 bp, Actinoplanes utahensis
gtgccgaagaattcccatgtgctcgatcaggcctcctgggcctccttgaccgggccgcacgcccacttcgcgcagggcgacgggcgggcgctgcgctacccggccgaggtctccgggatcaccgcggcgccgccggtgcaggacgaccgggtctgggccgacctggccgccctggtcggcccggccggggtggcccggttgtcgtgcgacatcgcgccgccaccggccgggtggaccgtcgaataccgcggcgaaggcgggcaactggtggccaccgacgcgctgcgctccgaacgcgccccggaggtggtgacgctcggcgcggacgacgtaccggaaatgctcgacctggtcgcccgaacccggcccggcccgttcgagcccggcacccaccgtctgggcgtctacctgggcatccggcgcggcggccggctcgtcgcgatggccggcgaacgggtgcacccgccgggatggaccgagatcagcgccgtctgcaccgacccgcgacaccgcgggcagggcctggccggcgtgctggtgcgggcggtggcgcacggcatccgtgagcgcggggagacgccgatgctgcacgcctccggcggcaacgtcgacgccatccgcctctacctgtccctcggtttcgcactgcgccgcacccggcagttcacggtgctgcgcgccccgcgggacgccggctga

SEQ ID NO: 6437 - DNA, 1479 bp, Actinoplanes utahensis
gtgtggtctcaccatcgtccaacggctgccgctgtcatcgtcgttgcggggtgtgcggcagccgcggccgtcatggtcaccgaaaacgatccgcggcgagcgctcgtcgcgtatctcggcctcgctgtggtcaatgccgccgctgtcatggtcgttcggttccgatcgcatgccggcttcgagctgaaggaactggtggccggcgccattctggccgtccttctccccggcctggtctccctcgccacccgggcctggcaggcgagatgggatgtcggtaaagacaagacgatcttgtacatcctggtcgggtcagcggcgttgatctgttacgtcggtaaaccggcgtatcggatgatggccgctgccgaacgatcggcgaacccgcgggccggcgtgagcctcatggttctgcccatcgccctgttctgcgccttcctgctgacgggcacggcggtgctgttgcttctcggcacgaggatcggcttcgagcccgcgcacagcggagcgccgccgtcggcgacgtacgcgcggacctacgtcttcgtcgcgtgcgcactggtcgcgctcgtggctgtttcggccgcgcggttgagccaaccgaccgctacctgtagtgacgcctggaaaccgaatcccgccgccctcgcgctgatgtcgatggccgtggtgtccgtgatcgtggcggtggcatgcgagacggcggtcgcgcggacgccggtggcatggccgcttcgcctgtatttcttcgtcctctccgcggtcatcgggctcctgtacggcgaggaggtggtcagcacgccggtgcgactgcacgtccttcggcccgaatggccgagctgggtgctcggaagcgcatgcggagcgatgatggggtcgtcctgctactggttggcctgctatcggatgtggacctccggcggccacctggccgacatctcctccgcggtgggggccctcggcgtactgtggctcgtgttcgtggtcgccgccgcggtggtctacgtcttcgccttcgcctccgatccgtcgcatcagcaactgaccgcgaagagcgctgcgagcaacacctttcaggggcaggcgctgtacgccggcctcgtcaccgtcgtgctgttcgtgcccagtcagatcggtggtcggctcggcggagacatgttggccgatctgccggcgatagcgtctttttgtggattcgcggcactcctgtggggagtctactcattcaccaccaagcgcaacggggaacatctggcgtcggagatgacgcgcacgattccccaggccggcatgagaaccggcactgccgcggaggcggcggagctgacggcgaagttccggcagcgcttggcggagcacctgaactggcagaaccacctgggccgcgcgattctgatcctgtccctggtgggcatcggagccgctgtgcaccgcgtcaaggaggaggtcgccgcggaggcgggactcgacacgacctag

SEQ ID NO: 6438 - DNA, 654 bp, Actinoplanes utahensis
atgagacctgaggtacggagggcggccgtcgtggccgccgggacgtttctggccggcttcggtgccatgtacggctttcacctgtgcgcggacggcccccacgagcttcgcggcctgttcacctacgagtccgcgacctggggagacgccgtgctgctcccgacgatggccgcctgcctgtcgctgtcgctctccggcctggccgccgcacggcacgaaagggcgatcgccggcatgggggcggtattcggtttctccatcggggtcgccagtcaggtcggctggctgatggacccccacccggcgctgaactggacccttcctcgaccgcatcacttcactgcggccggctggtaccacgcggcttttctctcgggcgcggcggccgctttcgccggcgcgtcggcactcgccctcaccagggcgatccggtcgccggccgtggcaccgtccgtgcgcaggtcactgatctctgccggtgcggcaaccgttgcgttcgccggcctcgtcctctacgacaacgtcgcgacgagatctaccgcggcttcgagattcaccggagcggcaggcctggcgggcgccgcggggctcgccgtgctggccctcgtgtcgatgcgacggagtgggaaccggaccggcaacgcccgcggctag

SEQ ID NO: 6439 - DNA, 294 bp, Actinoplanes utahensis
gtggccaagggctattgggtcagcgcctaccgcaccatcgccgacccggcgaagctggccgcctacaaccagctggccgggcccgccgtccgggccgcgggcgggcggaccctcgtccgcggcggccgggtcgccgcacacgacgacggggtggccgagcgcaccgtcctggtcgagttcgacagctacgagcaggcggtcgccgcccacgagagcgcggcctaccaggaggcgctggccgccctcgcggacggcgtcgagcgggacttccgcatcgtcgagggcctcgactga

SEQ ID NO: 6440 - DNA, 954 bp, Actinoplanes utahensis
atgtcagaccagtccgcccagccggttctgcccacccgtaagcgcagccgctggccctggatcgccgctgccgccgtcgtcgtcgtggcagccggcgtggtcgtcggaatcgtcgccaccaaggacgactccgccgacgccaccaccgggggcaccaaggcgcagaccgtgcgcatcggtgtcgccgacgcgtccgcgccgtactggaagacctacaccgacctggcgaagcagaagctgaacgtcaccgtcgagctggtcaacttcaacgactacagccagccgaacccggcgctcaagcagaagcagctggagctcaaccagttccagcacatccagtacctggcgaactacaacgtcaccgccaaggacgacctgcagccgatcggcgccaccgcggtctacccgctgccgctgtactcgctgaagttcaccaagccggccgacttcccggcggacgccaaggtggccatcccgaacgacgcgatcaaccaggcccgcggcctgctcgtgctgcaggcggccgggctggtcacgctgaagaacggcggcagcgccttctccagcaccgccgacgtcgagtccaagaaggtcgacgtggtcaccctggacgcctcgcagaccgcgggcgcgctgcagagcggctcggtggtcggcgcgatcgtcaacaacaactacgccaccagcgcgaagctgccccgcaccaacgcgatcttccaggacgacccggccagtgacagcgccgcgccgtacgtgaacatcttcaccgcccgggccgccgacaaggacaacccgacctacctgaagctggccgagctctaccacgacccgtcggtggagaagggcgtccaggaggccaacggcggcgtcgcggtgctgcgcaccgtccccgccgccgacctccaggcgctgctgaagaaggtccaggaccaggccgtcgccgcgggcaagtaa

SEQ ID NO: 6441 - DNA, 1014 bp, Actinoplanes utahensis
gtgacttatgtacgtcttcagcatgtgaccaagacgttcacccggggccgccgcgggccccgggtggccgccctcgacgatgtcagcctggaggtggccaagggtgaggtgttcggcgtcatcggccactccggggccggcaagagcacgctgatccggctgatcaacgggctggagacaccgaccagcgggcaggtctgggtcggtgaccacgacatcgccgcactgtccgagaaggatcgccgtggcgtgcgccgggagatcggcatgatcttccagcagttcaacctgttccggtcgcgcacggtggccggcaacgtggcatacccgctgaaggtcgccggggtcgagaaggccgaacgtgaccggcgggtggcccggctgctcgacttcgtgggcctgctggaccgcgcccacgaccacccggagcagctgtccggcgggcagaagcagcgggtggggatcgcccgggcgctggctaccgacccggcactgctgctcgccgacgaggcgaccagcgcgctggacccgaagaccacggccgaggtcctcgacctgctccggcgggtcaacaaggagctcggcgtgaccatcgtgctgatcacccacgagatggacgtgatccgcgcggtggccgaccgggtcgcggtgatggacgccggccggatcgccgaaagcgggccggtgtacgacgtgttcgccgaacccgccagcacgacggcggccgacttcgtgcacgacgcgctgcgggaccgtccttcggagcggacgctggagcgattgcggcgtacccaccggggccggatcgtgaccgtggcggtccgtgaccggaccgccctgtcccgcgtcttcctcgaccgtcaggtcgccgcggagctgatcttcggcggcatcagcgagctgcaggaacgggcggtgggcagcctcaccttcgagctgaccgggtccgccgacgggatcgacggggcgctggccgacctgcgcgccgccggcgtctcggtggaggagcactga

SEQ ID NO: 6442 - DNA, 660 bp, Actinoplanes utahensis
gtggacgaattcctcaccaacctgccggtcttccgggaggcgatcgggcagaccttctacatcgtgagcatctcggtggtcgcgggtgggctgctcggcctggcgctcggactgatcctgtacgccaccaggcccgggagcctgctcgccaaccgggcggtcttcctgatcgtgaacatcctggtcaacatcgtacgaccgattccgttcgtgatctttctgaccgcgatccagccgctgatgctcgccacgatcggcacgacgatcggcaccgacgcggtgaccttcgcgctgtcgctggcggcggcgttcgcggtcagccggatcatcgaacagaacctgctcgccgtggaacccggcgtgatcgaggcggcccgggcggccggcgcccggccgatcagcatcctgctgaccgtggtcgtgcccgaagcgctcgggccggtcatcctcggctacacgttcatcttcgtcggggtggtcgacatgtccgcccaggcgggactgttcggcggcggcgggctcggtgacttcgcggtcacctacgggtcgcagcggtacaactggccggtcgtctacatcacggtcgcgacgatcatcgtgatcgtgcaggccgggcagttcctcgggaacttcctggcgcggcgggcgctgcgccgataa

SEQ ID NO: 6443 - DNA, 1581 bp, Actinoplanes utahensis
gtgaccaccgaaggacccgccgcctgggcgccgctgcggatcgccgccttccgcgcgctctggctcgcgctgctggccagcaacatcggcacctggatgcagaccgtcggcgcccagtggctgctcgtcgaacactccggctccgacacgctggtcgccgtcgtgcagaccgccagcaccctgccgatcgtgctgctcgccctgccgtccggggcgctcgccgacaccttcgaccggcgccggctgctgatcttcgtgcagatcttcctggccgccgtcggcgtgctgctcaccgtgctcacccaggccggccggatgccgcccagcctgctgctcaccctgaccttcgcgctcggcgccggtcaggccatgaccgcgcccgcctggcaggcggtcatccccgagatggtgccgcgcagccagctcgcctcggcctccgcgctcggcgcgatcagcatgaacctggcccgcgccgtcggacccgcggtcgccggcgtgctgatcgcgcagaccggcaccgcggtcgtcttcgggctcaacaccctgtcgtacgcggtcttcgccctggtcctcgtgcgctggcgcccggccgcaccggacccggccgccgtgcccgaaccgttcggcgcggcgatgcggtccggcagccgatacgtgcgccattccccggtcgtacggcgcatcctgctccgtgcctcgctgttcctggtgcccggcagcgcgctgtgggcgctgctgccgctggtcgccgaacgccgcctcggcctcggctccggcggttacggcgtcctgctggccgcggtcggcgccggagcggtggtcggcgccctgctgctgccccggatgcgggcccgctggtcgatgaaccgcctgctgctgatcgccggtgtcgtcttcaccgcgatcctggccgtgctcggcctggcccgctccgagatcctggtgatcatcgtgctggtgccggccgggatcgcctgggtgatggtgctgtccaacgtcaacgcggcgatgcagctcttcctgccgaactgggtgcgtgcccgcgggctggccgtctaccagatggtgttcgccggcgcgcaggccgtcggcgcgctcgcctggggcgccctgtccgacgtgaccgggctgcccgcgacgctggtcgcttcggcggtgctgatgctggccggggtggccacgctgggccgctggccgatgcgcgacaccagcggcctcaaccgggatccggccgtgtactggccggagccgcacctggaactcgaccccgacgagcacgacggaccggtgctggtgatggccggttacccgatcagcccggaccgggagaccgagttcgtgtcggcgatgcacgacgtgcggcgcagccgcctgcgcaccggcgcggaacgctggggcctgttccgcgacggcgaacggcccggccggttcgtcgaggtctatctggtccccagctgggacgagcacctgcggcagcactccggccggctgaccggcaccgaccaggccatcgaggagcgggcgctggccctggcggacggtccgcccgaggtcagccacctgctgtccgaggacgtctag

SEQ ID NO: 6444 - DNA, 681 bp, Actinoplanes utahensis
atgatcaactcgcagccgctcccggccgaacgtgtacttgagatcgccgccccgatgctcaacgaggtgggcgggaactggcgactcgccgagggtccgatgctgcgctccgggtcgatgggtgtccggctactgcccgcggacaacgccgaccccaggcatctggacctggagatcctgctgaacgccgaccgcccggacgtgccgacgatcaccgactgcaccctgggtctcgccgcggatccggtggagggagcccggcaggcgatcggcgcgtggatcgcgaccactgtggtcaccgtgctggagatggtggagcagcagggccggctcgcgacccacatcgccgccgacgaggagggcgccttccccggctggcacaccatcgtcgggggaatcaccggctggtccgtcgacgactcaccggtcaagcagcagtggatcgccgacgagatgccgtggtcggcgctggccccgatcatcgcgccggcgctggaccggccgcacctgaacggcatccgcctgctgatcggtcagggcggtgacttcaccgaatgcgaggtccggatcaacggccgccgccacgagccggccgaggccgccctggcagcgctggactggccgcgcaccgagcagttcggcctggctcgcaccttcctgctgctggtggggcagcactag

SEQ ID NO: 6445 - DNA, 171 bp, Actinoplanes utahensis
gtgctgatctgggccgggcatctccggcagcactccggccggctgaccggcaccgatcaggcgatcgtggagcgggcgctggccctacttgttcggcgtgcgactgacaatgggactcgcccggccgctagggctatcgcggagcgtggattcggctcaggtgattggtga

SEQ ID NO: 6446 - DNA, 459 bp, Actinoplanes utahensis
atggcgcaccagggattatttcccgcacaccgctggatactcgctgcttcctgttgcctggcctgggccgctctcggtggttgtaccggcgacgacaaatcagtctccgcgccagcaccttcggtgaccaccgtcccggtggaagctacgttgcccagcctggcgccggctggcctgaagcagcaggccatcggtcatgacaacgtcaccggcggctggaccgccgacttggccggggacggccctgtcgacatcaccattgtctgtatcggcggtggtgacctagccgtcaactatcacaacccgtcacgccctctagggtcattcaaactgccctgcgacggaacgacgtcgaaaaactacgatgatgccgcaccgtcgggccccatcaccgtgacgatcaaacctgatggcgaccagcgttggtcggcgcgcctcgccagagggccgagatcgtga

SEQ ID NO: 6447 - DNA, 633 bp, Actinoplanes utahensis
gtgttcgggcgcggggtggtgcgtaccgcgagcggttacaccctcaccccgggcggggacgcgcgggtgcgcgcggccaccgcctacgtggcggcccaccgcgcggcgctgcccggtggcgaccggatccgggtcgtcttcaccggcggctggccggaggcgagcgccggagccgcaccaccgccggtcggcgcgcgcgagggggatctcatgctgcgggccgcccgcgcggccggcctggacgagcacgctgagctgtacgcggagacgcgctcgcgcagcaccctggagaacctgctgcacaccgtggaggacgggctgctgagtggatacgccttcgacgcccgggctccgctcggtctggtgacgcacgcctggcacctgccgcgcgtccgcttcctggccggccgggtgctgggactgaccggcccggcgctgcgcgacgtcccggcgcacggcggcgaggtgcacgacgaccggggcgcgctgctgctggcccggctgggcttcgccggcgcccgcgccgaccggctgttgcgccgcgaacgggggatggtcgcggtcggccgtctggcccggcgggtgatcaatggccggcctgggtatagacgccgcaccgtcggacagcagtga

SEQ ID NO: 6448 - DNA, 723 bp, Actinoplanes utahensis
gtgccgtacgtcgttctactcccggtgttcaagccgggaccgcacctgtccgaactggtcaccgcgctgctggccgacggcccgcggccggcggaggtggtgatcgtcgacgacgggaccggtccggccgccgacgcccggctcgcggagctggcggcgcggggctgcacggtgctgcggcttccggcgaaccggggcaagggcgtcgccctcaagaccgggttccggcacatccgctcccggtttcccgaagcggatgtggtctgcgccgacggcgacggccagcacagcgtcgccgagatccgcgaggtggccgaccgctgccggcccggccgcgtcgtcctgggcgtgcgccgcttcgaccggatgccgccgcgcagccggttcggcaacaccgtgacccaggccgtcttccgggcggcgaccggccggaccgtctcggacacccagaccggcctgcgggcctaccccgccgacctgatcggggacctgtgcgccgtgccgggggagcgcttcgagtacgagatgaacgtgctgctgcactgcgcggcgaccgatcacccgatcgacgaggtgccgattcccgccacgtacctcgacgacaacgccggctcgcatttcagcgggctggccgactcggcgcggatctatgtcccgctgctgcgttatgccctgctcagccgggtggccccggcgagcacggtgccggccgagcgccggtag

SEQ ID NO: 6449 - DNA, 1347 bp, Actinoplanes utahensis
atggtggatgcgcagtggccggggatccggcgcagccgtgcggccgttccgttgctggtgttactgctggccgtgctcagcgggtgtgtggcggtgcgggtgtcgagcgggcaggacgacagcggtgcggcgccggctgccgggtccgccgatgcggacgcgctggtgaccaaggcggtcaaggacgtcgagcggttctggacggccaagtacccgtcgctgcgccgcggcagggcgttcgagccgatcacgggtgggctgcacccgtacacccgatcggatccgccgccgccctgcggcggtgcgcaaacggcgtatcagccgaacgccttctactgcccggacggcgatttcatcgcctgggacgcgcagacgctgatcccgcggctgctgcagcagttcgggccgctgctggtcgcggtggtcttcgcgcacgagtacgggcatgccgtgcagagccggctgggtgtcaccgggcagccgaccgtcgtgctggaacagcaggcggactgtttcgccggggcgtggacggcggacgcgctggccggccggtcgccggcgttcaccgggatcacccccgagcagttggacaacacggtggccgggctgctgctgctccgcgaccagccggggacctcggcggcggccgagcaggcgcacggcaacgcgttcgaccggatccgtgccttccaggacggggtggagaagggcgtggccacctgcgcgggatacgacgccgacaccattccggtgaccgaggtgccgttcaagagccggcgcgatgccgccaacggcggtgatctgccgtacgccgatgccgtcgccgacctggccgacgacgcccagcagtactggtcgcggaccttcccgcagctcgcccaggcgcagtggcaggcggtgcgggtggagccgttcgagggcacgccgccgcagtgcgccacgccggacagcaccgcgggcgggtcggccttctactgccaggacggggacttcgtggctttcgacaacgcccggctggggccgcagctgtaccggaacatcggcgacaacgcgatcggcatgctgctcggtgacctgttcgcccgggccgcccaggatcggcgggggcgcagcaccaccgaccgggccgggcagctggcggtggactgcctggccgggtcgtggaccaacgacctgctcaggcgcccggagggagcgagtctgaccctctccccgggtgacctggatgaggcggtggcggcgttgctggccctcggccgagccggtgggaagtccgggaccagcgccttcgaccggatcgcggcgtaccgcagcggggtgctgcagggggtgtccgcctgtagctga

SEQ ID NO: 6450 - DNA, 1410 bp, Actinoplanes utahensis
atgcccgttctcctcggcatcatcctggccggcgcggccggcgccgtcgcggtgacggcggcgacgccggcgcgggcggcggccgggtgccgcgccgactatcaggtcaccaactcgtggcagggcggcttcggggcctcggtgaccgtcaccgacctcggcgacccggtcaccgcctggcagctgacctggaccttcccggccgggcagagcgtcacccagctctggaacggcacggtcagccagtccggcgcccaggtcaccgtcaccaacgcgagctacaacggcacgatcgccaccggcggaaccgcgtcgttcgggttcaacggcgcctggagcggcagcaacccggcgccggcgtcgttcgccctcaacggcacgacctgcaccgggaccgtcccgtcgatctcgacctcaccttcggcgtcaccgtcggcctcgcccccgacgtcacccggcgggctgccctgtgacctgtacgccgcgggcggcaccccctgcgtggcggcgcacagcaccacccgcgccctgctcagcacctacaacggcgcgctctatcaggtccggcgcgcgtcggaccacgccacccgggacatcggtgtggtcagccggggcggcccggccgacgcggcggcgcaggacaccttctgcgcgggcacgtcctgcgtgatcaccgtcctctacgaccagtcggggcacggcaacaacctgggctaccaggggaccggcggaatcggcggcgcggacaccgcggccggcgccacccgggaggcggtcacggtcggcggcagcagggtctactcgctctacatcaacgcgggcaacagctactggcgcaacgggtcggcgtccgggatcccgaccggcagcgcccccgagggcatctacctggtcaccagcggcacgcacgtcaacgggggctgctgcttcgactacggcaacagcgagaccacccggcgggccgacggcgccggcgcgatggacgccatctacttcggtacgagctgctggttcggtggctgctccggcaccgggccgtgggtccaggccgacctcgaatacgggttgtaccccggtggcagccggacctggaatccccatcagcgggccttcccgagcagattcgtcaccgcgatgctgaagaacaacgggacctcccggttcgccatcaagggcagcaacgcccagtccggcgcgctcaccacgctctgggacggcgccctgcccgcgggctacagcccgatgcgcaaacagggcgcgatcatcctcggcagcggcggtgactgctgcatcgacaacaccaaccagagcgcgggcaccttctacgagggcgccatcgtcgccggatacccgagcgacgccaccgacaacgcggtccaggccggcatcgtcaccgccggctaccgatga

SEQ ID NO: 6451 - DNA, 1545 bp, Actinoplanes utahensis
atggcatcacgaccgcgtctgcgaggcattctgcccgccgtcggcggcctgctcgcggcgatgatcaccggcatcgccccggcgcaggccgccaccaccgggccgtgcgacatctacgcctccggcggcaccccctgcgtcgccgcgcacagcaccacccgggccctctacggcgcctacaccgggccgctctatcaggtacgccgatcgtcggacaacgccacccgcgacatcgcgccgctcaccgcgggcggggtggccgacgccgccgcccaggactccttctgcgccggcagcacctgcctgatcaccgtcatctacgaccagaccgggcgcaacaaccggctcacccaggccccgcccggtagtttccaggggccggcggccggcggttacgacaatctcgccaatgcgaccaccgcgccgatctcggtgggtgggcacaaggcgtacggcgtgttcgtcgcccccggcaccggataccgcaacaacaccaccaatggggtggccaccggcgatcagccggaaggcatgtacgccatcttcgacggcacccattacaacggcggctgctgcttcgactacggcaacgccgagcgcaacagccgggacaacggcaacggcacgatggaggccatctacttcggcaacatcaaggtctggggctacggcaccggcaccggcccgtgggtgatggccgacctggagaacggcttgttctccggcgccaaccccggctacaacgcgaacgacccgagcgtcagccaccgcttcctgaccgcgatcatcaaaggcgagcccaaccactgggcgatccgcgccggcaacgcgcagtccggcggcctgtccacctactacaacgggagccggccgaacgcgtccggctacaacccgatgaagaaggagggcgccatcatcctgggcatcggcggggacaacagccacggcgcggccggcaccttctacgagggcgtgatgacctccggctacccgtcggacgccaccgagaacgcggtccaggccaacatcgccgcggccgggtacgcgacctccggctccgggggtggcccggtgatcaccccgggttcgaccatctcgctgcgcgccaccaccgcgtgctgcacgacccgctacatctcgcacagcggcagcacggtcaacaccgccgtggtgacctccggcagcgccgcggccgacaaggccaacgcctcctggatcgtccgggccggcctggccaacagctcctgcgtctcgttcgagtcgcgcaacacctcggggaactacctgcggcaccgcaactaccagctgacactggccgccaacgacggcagcgcgctgttcagccaggacgccacgttctgcccgcaggccggccgcaacgggcagggcaactcgttcgcctcggtcaactacccggaccggttcatccggcactacgcgaacaacgtctacatcgccagcaacggcggcacgaacgcgttcgattccgccacctcgtggaccgacgacgtcagctgggtggtcagcaccccctggactccctga

SEQ ID NO: 6452 - DNA, 240 bp, Actinoplanes utahensis
gtgcctgggtatgcggcgcttcggaccattcgccagaggaaggacactgcgatgaccaacgttcagcagccggagttgcggcgcagcggcgagtccccgaccaccaagcagcgcaccgaggacgcgcacccgaccgaggctccgcacggcagccacgacaaatccgggaaccgggcgacgcccgcggggcagacctcgccgtacggaccgtccgggaagacggccgacgacggctcgtga

SEQ ID NO: 6453 - DNA, 1125 bp, Actinoplanes utahensis
atgaaactcgacttcgtccgtccgctcgtcgaccgtaccggctcatgggtgtcggtctatctggacgcgacccgcgccggggagaacgccgatcacgaggtcgggctgcgctggcgcgccctgcgcgagcggctgaccggggacggcgccgacagcgccaccctggacgccgtggaggcggccgtcaaggatcatccgtaccagccgggccggtacggtctggcggtgttcgcccgcgacggcgaggtggcgatggtggagacgacgccggctccgccgcccgtcgacgaggcggtcaccggtgcgctgccgcacctgatgccgctgatcgcgcagcgcggtgaacagatcccgtacgtccgggtgctgaccgaccgcaccggcgccgacctggacgcgctgtcggtcggcggggccacacggcaccgcgaggtgaccggcggcgccaccttcccgctgcgcaaggtgcaggccggcggctggtcgcaccggcgttaccaccaggccgccgaggagtcctggaagcgtaacgccggtgacgtggcggccgcggcggccgatctggcggacagcgcgggcgccgaggtgatcgtcgtcggtggtgacgtgcgcgcggtgcagacgttcgcggggcggctgccccggcgctggcaggaccgggtggtgcggaccgacgccgggtcgcggcacgccggggcggacgagtctccgctggacgacgtgacgatccaggcgatcgccgaggtcgccgaccggcacacccgggaggcggtcgaccggtacctggcccagcggggcgacggcacggccggcgccggcctcaccgacgtggtgacccggctgcagcgcgggcaggtggacaccgtgctgctggtcgacgacgcctcgtcgaccgacacggtgtgggtttcgccggacgatccgacgctgatctcggtcgacgaccacccgttgcgggaggcgggagtgccgagcccgcagcgggtgcgggccgacgccgggctgctgcgtgcgatcgcggcgaccggcgcggacctggtgctggtggcgccggaggaggtggcgctggagcacggcatcggtgcggtgctgcggtacgcggatgccggcagcgccgcgcgatga

SEQ ID NO: 6454 - DNA, 1002 bp, Actinoplanes utahensis
atggcacatccgccgatcgagccgtacgcgaccggaatgctcgacaccggggacggcaacgccgtgtactgggagacctgcggcaacccggacggcctgcccgcgctggtggtgcacggcgggcccgggtcgggatgctcggtgggcatgcgccggtcgttcgacccgcagcggcaccggatcatcctgttcgaccagcgcaactgcgggcgcagcacgccgcacgccagcgaccccgcggcggacctgagccggaacaccaccgagcatctgatcgccgacatggagcggctgcgggagcacctcggggtgcagaagtggctggtgtccggcggctcgtggggggtcacgctgtccctggcgtacgcgcagcggcaccccgaccgggtcagcgggctgcaactggtcagcgtcaccaccgggcggcggtccgaactgaactggctctaccggggaatcgggcgggtcttcccggaggcgtgggcgcgtttccgcgacttcgccggggctgcggaataccggctgccgaccgacaccgagccgccgatcgaggggctgctcgcgtcgtacgcgcacctgctcgaagatcctgatccgcacgtgcgccagcgggccgcgaccgagtggctggcctgggaggacgcggtcatctcgatggagcacaacggcaagcccggccaatacagcaaccggctcgacgacgcgaaggtcgccttcgtccggatctgctcgcactatttcgccaacggctgcttcctcgacgacgatgtcatcctgcgtgacgcaggcagactcgccggcatccccggtgtcctgatccacggccgtgccgacctcggcagcccggtgctgaccgcgtgggagctcgcccgggcctggcccgacgcggaactgatcgtcatcgaggactccgggcacaccggcagcaccggcatgcaggaggcgctgcacgccgccgccgaccggttgcacgagcggatcaccacgccggtgcgggcatag

SEQ ID NO: 6455 - DNA, 870 bp, Actinoplanes utahensis
atgcagatccgtccgttcgcccgcggtgatcgcgagcaggtcaccgccctggtcaacgcccacgtcgccgccgtcgtgccggggctgtcggtgtccgtgcagaccctgctcagccagctggaacgcgagcccggcgagaccgtggtcgatccgtgggtgacggcgcgggtcacgatcgtcgccgaggaacggcagcgggtggtcgcggccgctcatctgctgcggtacgacggcgccggcgactaccgggacgccggtgagatccgctggctggtgtgtcgtccggagcacgtggacgcgggggacgccctcgcgctggccgggcacgcgctgttccggcggtggggggtggcgcggcgtctggccgacggtgggttgcccgccccgggggtgtacggcgtaccggcgcaatggcctcatgtgcggggaatctatgagcgggccggtttccggcagaccggccgcaccgagaccgtgcacctggcgcgggtcgcggacctggcccggcaggccgtgccgctgcccggcctgaccacccgacgcacggtcggcgggaccggcacccggatcgccgcgctgcgcggtgcggagcagatcggctacatcgaggtggacaccgacctggacggcggaccgcggatgtcccgggccggctgctgggccgacgtcgggaacctgtggatcgagcccgcctgccgccgtcggggggtcggcagctggttgctcgggcaggccgccgactggctggacctgggcgggacgacccggctgctcgactacgccgacgagggggaggacgggtacgccggcttcctgaccgccgttgggttcaccgtcctgaccagcaccggccggcgcttcacggcttga

SEQ ID NO: 6456 - DNA, 753 bp, Actinoplanes utahensis
atgatcaagtcccgcttcgtgatcccggccaccgtcctggcgctcaccggcatgctgccggccgccccggcgttcgcctcggcatccgatccgtcctgggagagtgtccaggtcaccggcgtcggtgaggtgtacggagagcccgacctgctgaccgccaacttcggtgtcgagaccaccgcgcccacggtcgccgccgcgctggaccgggccgacaccgccgccacccggatgcgcgacgcgctcctgcgtgccggactgacccgcaccgacctgctgacctccagcgttgacgtcaaccaggcgcgcgacaacgacggcaaggccaccggctacaccgtggaccaggggatcaccgcggaaatccgcgacctgccgaaagccggggcgatcctgtccgcgaccatcgccgccggcggtgacgcggcccggctcaacggcgtctcgttcagcatcgagaacgacagcgcgctgctcgccaccgcgcgcagcagggcgttcgccgacgcgaaggggaaggcggaggcgtacgcgaagcaggccggccggcccctgggccgcgtcgtcaaggtcaccgagtcggccccggacctgccggcccccggcgaccagatccgggcggtcagttccgccatgttccccgccgactcaccggtcccgatcgaacccggccgccagcggctgtcggccaccgtgacggtcgagtggctcttcgccaggaccccggccccgaaggtcgccgcccgagggtga

SEQ ID NO: 6457 - DNA, 537 bp, Actinoplanes utahensis
atgcgccgggcccggcggcaccgcgccgacggtgaccgggaaggcgacgccgggtcggggaaagtgcggtggccggtcggcggtcaacgccgtccgggcgtcctgaccgaggtgtgggaccgggacgacgtgctcagcaggatcgggtacccgctgccggtcgccgtccggcagccggtcaccgccgactggtccgtcgagcgcaccgcgggcctgcgggttcaggcggccgacgtcctgcgcttcgtcgggccgggccggacggtgcaggtggagccgttcaccctgccggccgggctcgccccggacaccggcatcgccgagatgagcgggatgctgccggacgagcgtgcgggtgagctcaccgagcgggacggtgaggtggtccgtcgcgcgttctgcctggatgccggcgagcagcacgagttctacggttacgtggcgaagcccggtcatctcatcgccgtcacctgcaggtatgacgacccggccgaccgggactgggccgagcgcgtctggcggtcggtgggacggtag

SEQ ID NO: 6458 - DNA, 651 bp, Actinoplanes utahensis
atgcacgatcaagatcaacttccgatggcgctgtacgacgtgatccaccgccgccgcgacgtccgcgccgagttcaccggtgacccggtgccgccgcccgtgctcgaccgcatcctgaccgccgcacacgccgcccccagtgtcggcctgtcccagccgtgggatttcctgatcgtccgcgaccgcgccctgcgcgaggcgttccacgaacacgtgtgtcacgagcgtgaggtgttcgccgccaccctcgacggcgcggccgccacccgcttcgcccggatcaggatcgacgggatcctggagtccaccctgtccgtcgtcgtcacctacgacccgcggcgcggtggcccggccgtcctgggccgccacgcgatcgccgacgccggcctctactcggtctgcctggccatccagaacctgtggctggccgccaccgccgagaacctgggcgtcggctgggtctccttctaccgcgagccgttcctgcgggatctgctcgggatcccgcccgccgtccgcccggtcgcctggctctgcctcggcccggtcagccgcctgcaggagacccccgacctggaacgccacggctggcgccaccgccgcccgctggccgacgcccgccacgagaaccgctggcgcgcctgctcctga

SEQ ID NO: 6459 - DNA, 1257 bp, Actinoplanes utahensis
atgccgcgcataggccgggttgcgctccaggtcgggcacgtagacgtgcgcgaccgtccggctgcggacccgccagcggaccccgatccaggccggctcctcatacgtctcgggcagcccccggcagatcgcccgcagccgcccgagaatctccggtggcacgtctgcgggctcggacatggacccgaccctatccgagcccggcaccggtctgcgcgcaccgcgcctgctggaacgcctggttaccggcgaggaacttctcaaccggagggcacccagccggacatgcttggattgctggtcatggccccacctttgcagcgccgtgccggaaatcccggatcgcgcatcctgagcgtcgcctcgtatcgcccgcgcaccgaggtgggcaacgaggcgatcgccgccctgatcgactcgagcgacgagtggatccgccgccgctgtggcatcgagtcgcgccgccgcgccgctcccgacgaggacctggtcatgatggccgcggcggccgcttccaaggccctggccggcgcgggcgtcgatccgtgcgacgtgtcggccgtcctggtggcgacgatgtcccaccgcggccgcgcggccaccgtggcacccctggtcgccgacgcgctgggagccaccccggcggccgcgatggatctggcagcggcctgcgccggattcccgtacgcgctggcgaccgccgacgcgctcgtccgcagcggctccgccggctacgtggtcctggtcggcgccgaacgcatgaccgacatcgtcgacgagcatgaccgcggcacggcgttcctcttcggcgacggcgcgggcgcggtggtcatcggtccggcgcagacgtgcgggatcggcccggtggtgtggggcgccgacggctccggaagcgcgttgctgcagtacgacgaggcaggcatcctgcgcatggccgggcccgaggtcttccgctgggcgaccgccgtcgttcccgacctggcccggcgcgccctggacgcggcgggcatctcggcggacgaccttgcggcgttcatcccgcaccaggcgaacctgcgcatcatctcggccaccgccaaggcactggaactcggcccgcacgtgcgggtggccaccgacatcacgaccaacggcaacaccggcgcggcctccatcccgcaggccatggcggcactgccggacacgacgggtcccgccctgctcgtcggcttcggcgccggcctctcgtacgccgcgcaggtcgtcaccctgccctga

SEQ ID NO: 6460 - DNA, 615 bp, Actinoplanes utahensis
atggtcaagaccaccgaggaaccacagccgtggaccgccgcgaccgccagcgcgtcgctcggcggcggcccggcccggacctgccgggtctcgcgggaaagcgacggcacgctccggctgagcctcaccgggttcgccatgatcggtgtcgacgtggccctgctctggacacagaacggtgccggcttcagcatcatcggcacggtggtgcccccgcccgccggcgccgtgcccggcgtgtacatgcgggtggacacgaacatgggcgctgtcgaccggcgccgctcccggcgcgtctcggtgcaggtcccggtcgtgctgatcctgccgtcgggtcagatgttccccggtctggcgatcgacctgtccctgggcggggcacgcgtcatcgtcgatctcgacgtcgacgacctcggcgaggaagcgctgatcgacatggtggacgggctggcccccggccagtcggtcaccctggagatgctgctgccggacggccccgcggacatcaactgtcacgtgcgcggcagcgacgaacccggcgacgtccgcctggtgttcgtggacgtggacgccgaggtgcaccgccggctcgacgccttccagaagacccagtga

SEQ ID NO: 6461 - DNA, 447 bp, Actinoplanes utahensis
gtggcccgccggcgcacccgaagcgatcatgacagcgtgaagcagtaccgggacctcggcgaccctctcgacggagccgacgtcgtcctcatcggtctgttctcggccagggagaaacggtacgagaccacgctcgacgagatcgccgccctggtcgaggcccgcggtggccgggtggtggcccggtacgtccagcgccggggcgcctccgaccggtggaagcggcgtcccggcgggtcgcggcgcatgtcccagccgttctcccgccgtaccctgctgacccacggcaaggtccgcgagatcgcccgggcgtgcgcggaggcggacatcgacgccgcggtcttcgtgaacaccctgacgcaccgccagcgcagcgtcctggccgggatcctcggctgcctcatcgtgagcggcgacgacctgtcgatccctggcggaaccggctag

SEQ ID NO: 6462 - DNA, 1470 bp, Actinoplanes utahensis
atgctccgaagactgctgaccgtcatggctgcggccgttctcaccgcgaccgcgctggtcgccggccccggcacggccagtgccgccggcaccctcccctgtgacatctacgccggcggcggaaccccctgtgtcgccgcgcacagcaccacccgcgcgctgttcggcgcctacagcggcccgctctaccaggtgaagcgctggtccgacggggcgaccggcaccatcggtgtgctcggcgccggcggctacgcgaacgccgccgcgcaggactcgttctgctccggcacgtactgcacgatcgtcaagatctacgaccagacgtcgaagcacaacgatctgaccatcgcccccggcggcggtgcgaacccgaccgccgaccagggcgcgaacgcggccgcgctgccgatcaccgcgggcggccaccaggtgtacggcatctacctctcggccggcaacggctaccgcaacaacgccaccagcggcgtcgccaccggcagccagccggaggggatgtacatggtcaccgagggcacccacgtcaacgatcggtgctgcttcgactacggcaacgccgagacgaacaacagggacaccggcaacggtgacatggacgcgatcaacttcggcaccgagtgctggttcacgccgtgtgccggtggcccgcgggtccaggccgacctggagaacggcctcttcgccggcggcaacggtgtcaacacgaccaacaccgggcgcggcagcgcgttcgtgacggcgatgctgaagaacaacggcaccacgacgtacgcgatcaaggacggcaacgcgcagtcgggcagcctggcgacccgatacaacggctcgctgcccacccaggcgggctaccagccgatgaccaagcagggcgcgatcatcctgggcatcggcggcgacaacagcaacggctcggtcggctcgttcttcgagggcgtgatgaccagcggttacccgagtgacgccacggagaacgcggtccaggcgaacatcgtcgcggtgggctacaccaagagcgtgaccttcccggtgagcggctccagctaccggctgaccaacgtgaccagcggcaaggtgctggacgcgaccaactgcggcaccgcgaacggcacccccgtgcggcagtggacctcgctgggcaacacctgccagcagtggcggttcaccagcgtcggcgccaaccggtggaccatcaccaacgtcaacgccggcaggaccctggacgcggtcaactgcggccaggcactgggcaccgcggtcgacctgtggcagtcgctgggcaacacctgccagcagtgggcggtcatcccggccggcaacgggaagtacgaactggtcgtcgagaacagcggcatggtgctcgacaaccagaactgcggcaccgccgacggcaccccggcccggctgtggatgtggctgaacaacacctgccagctctggtcgatcacctcctga

SEQ ID NO: 6463 - DNA, 1449 bp, Actinoplanes utahensis
atggatcaggacgaagcaccggttctcgcggcgatcgagcagtaccgggacgccggcgacatcaccttcgcgctgcccggccaccggctcggccgcggcatcgacgaacggaccgcgggggtgctgtcccgcggggccttcgcggccgatgtgatcaccgcgaaggaggcggccggcgcggccgagacgttgtacgccgacgcggccggcgcccgcgacgcggtcttcaccacctgcgggtcgagcatctccatgcacaccgcggtgctcgccatgaccggccccggccgcaaggtcctcaccgaccgcaacgtgcacaagtcggtggcggcctcgttgatcctggccggtgccgaaccggtctggctgcgcccgcgctgggatcaccggcggcagatcgcgcacccggccaccaccggggacgtccgggccgccctcgacgccgacccggagatcggtgccgtactgatcatcacgccgaccgagtacgggtgcggggccgacgtcggcggcatcgccgcactctgccgcgagcggggcatcccgctgctggtcgacgaggcctggggcgcccacttcgcctaccacgacggcctgccgacagcggccgtgcgggccggcgccgacctcgtcgtgcagagcctgcacaaggccggcggcggcctctgccaggcctcggtgatcctgctcggcggcgacctggtcgacccggtcgacgtgcggctgcgcctcgacctgatcaccacgaccagcccgtccgcgctgctctacggctcgatcgacggtttccgccggcacatggtggccagcggggagcggatcctcgacgccgccctcgaccgggccgaccggctgcgcgaacggttgcggcagacgcccggcctgaccgtgatggacgcctcgatcgtgcacgaggacggggtggccgagtgggatccgctcaagctgagcgtggacgtgtccgggctcggcatcaccggataccaggcgcgggactggttgcaggcggagaagcggctgaccgtgcagctcggggatgcccgccgggtggtctgctcgctgacgtacgccgacgacgacgccgcgatcgaccgtctcaccgaggcgctggaagagctggcggccaagccaccggccgcggatcggcccgccccgcacctccccgacctggagaagctgaacctggagcaggcgatgggcccgcgggaggcctatttcgcccgcaccgagcaggtcgccgacccggccgggcggatcagcgccgagatgatcagcccctatccgccgggcgtcccggcggtcctgccgggcgagcgcttcaccccggaggtggtcgactatctgcgggccggcctggccgccgggatgaccctgcccgacgccgccgacccgacgctggcgaccttccgcgtcgtggtcactccccggcccggtcccggcgcagcgtga

SEQ ID NO: 6464 - DNA, 1494 bp, Actinoplanes utahensis
gtgatctaccgtgccggtgtgtggaatacgcagcgctggttcgcctccgtcctggtcgccatggtcgtgctggtgctgggcgcctcggtggtcggcgcgcacctgctgaaccggaccgccgcggtctccaaccggctcagtgaccggatctcgccggcccgcaccgcggtggtgcagctcgacggggcgttgcgcgagcaggaggcggccgtgcacggtttcctgctcagcggcgtcaccgacttcgccgactcgtatcagcaggcggtcggtgccgaacggcaggacgaggcgcggctgcgggagctgatcgacgaccagccggccgcgctggccgacctgaccgcggtcgaggagcaggccgccacctggcgcgccacggtcgccgagccgctgatgcaggcggccacgaccggcaccggcgacgccgtgcgggcccgggcggcgttcacctcggtccggacccgcctcaccgacctggacaaccgcctggtcggggcgcgcgccgccgggcgggacgcgctgagcgagtcgcgccggatccgcgacgacgtcttcctcaccctgatcggcgggctcctgctgttcatcgtggcgatcggggtgctgctgcggctgatcgtgctgggcccgctggcccggctcggcggcgaggtgcgccgggtggccggcggcgacttcgagcaccgggtgaccccgcgcgggccggccgacgtggtcgcgctcgggcacgacgtggaggcgatgcgggagcggctggccgacgcgctcgccgagagccggcagcagcaggtcacgctcagccgggtgaacgccgacctggagcagttcgcctacgtcgcctcgcacgacctgcaggagccgctgcgcaaggtggcctccttctgccagatgctgcagcggcggtacggggagatcctggacgagcgtggccgcaggtacgtcgagttcgcggtcgacggcgccacccggatgcagcgactgatcaacgacctgctgaccttctcccggatcggccgggtctacgacgggtgggagccgatcgacctgaacacggtgctggaccgggccgaggacgcgctggcgatcaccatcggcgagaccggggcgcagatcgtccggccacagctgccgaccgtgcccggcgacagcacgttgctgagcatgctgtggcagaacctgatcagcaacgcggtgaagttccggcacccggaccggacgccgcgggtggagatcaccgtcgagccggacggcgacctgtgggcgttcaccgtcaccgacaacgggatcgggatcgacgcgtcgtacgccgacaagatctttgtgatctttcagcggctgcatcagcgcgacgcctatccgggcaccggcatcggcctggccatctgcaagaaggtgacggagttccacggcggcacgatcgccctggacccggagcaccgcgacggcgcccggttcgtggtcacgctgcgccgggaccgggccggggagtga

SEQ ID NO: 6465 - DNA, 1518 bp, Actinoplanes utahensis
gtggagattgcacagcccggccgcggtgcccggcgactcggtttcgggatcgcggcggcactgctcacgaccgggctcatgggaaccgggccggcacacgccgccacgccggtgccgccacccggccccggttggctcgacgccggcggtgcgaacgtcgccgtcccggtgatcaaggacgcggccggcgccaagctgaagaccaccaaggtcgacacggcaagcctgaccggtgccgggatcggcgttgcgctgatcgactccggagtcgcgccggtgcccggactgagccagcccggcaaggtcatcaacgggccggacctctcgttcgagtcgcagaccccgggcctggagcacctggacacctacggccacggcacccacatggccgggatcatcgccggttcggacccggccaacgggttcgagggcatcgcccccgggtcgcacctgatcagcctcaagaccgcggccgccgacggtgcggtcgacgtctcgcaggtgatcgcggcgatcgactgggtggtcacgcaccgcaacgaccccggcatgaacatccgggtgatcaacctgtccttcggcaccgactcggtccagcccgagctcgtcgacccgctgtcctacgcggtggagtccgcctggcggcagggcatcgtcgtggtgaccagcagcggcaacgacggcgcggcccggatgaccatgccggccgccaacccgtacgtgatctcggtcggcgccgcggacaccaacggcaccgccgaccggtccgacgacaccgtcgcctcgttcagcaaccgcggcaccgccacccggcacccggacctggtggccaccggccgttcagtcgtgtcgctgcgcgatcccggctcgtacatcgacaccacgtacccgacggcccgcgtcggcgaccgattcttccgcggcagcggcacctcgcaggccgccgcggtggtctccggttcggtcgccctgcttctgcagcagcgcccggcgctcaccccggaccaggtcaagcgcctgctcatgcagaccgccgacccgctggcggtggccgacccgatcggcggcggcgccggtcagctggacgtcgccggagcggccgccgccgacgtgccgcgcaccgcggacgtcacccaggcctggccggccgcgaccgggctgggctcgctggaagcctcccggggcaccgcccacgtcgtggacggcgtcaccggcctcgcgctcaccggcgagcgggacatcttcggcatgccctgggtaccggcgacctgggcggcgaccgcccggatcggtagggcgtggaccggcggcacctggaacggcgcggtctggaccggcaccggcttcgtcggtagcacctggccggtgaccacctggaccgggcggtcctgggcgggccgctcctgggccggctcggactgggccgggcgctcctgggccggcggcacctggaccggccgttcgtgggccggcggcacctgggccggacggtcctgggccggtcgcagctgggcctga

SEQ ID NO: 6466 - DNA, 2451 bp, Actinoplanes utahensis
atggcgaaaaggcggcgactgacgccgaacgctgcggtcctcaccctcgtcgcggtcctcaccatcgtggtcgccttcggagaggccgccgcctggctgctgttcggcccacccacccccggcggcctgcacgtcccgctgctgatcaccctgaccgtgctgttcgccctggtggaacgcttcaccgtcaccttcccggtgcgccgcggcgcgcacgcgatgacgctgagcgaaatccccctggtgctcggcctgttcctggtcccgccggtgctgttgatcccgatccggctggtcggggcgctcgccggtctgatcctgctgcgcgggcaccggggcggcaagctcgccttcaacaccgcgctgtacctcacccaggccaccgtggccggcgtcgtgttccacctgatccgggccggcaccgcaccgtacggcccggtcgcctggggcgccgccttcgccgccgccttcgccgccgacgtggtgtcgatcgtgctggtcaccgcggtcatcgcggtgcacgacgacagccaggagtggcgccggctgctgaccgccgacgtcaaacaggtcttccagatgccactggtcgcggtcaccaccaccctcgcgctggtcaccgtgctgctggtgcgcgagcaggtcctggccgtgctgctgctcggcgtgctcgccttcgccgcccaacgggtcttccaccggtacgcccagcagagccgcacccaccagcaggtggaggacctctaccggttcgcccagtcactggacggcctgaccggcgccgacgaggtggcccgcgccgtcctcgggcaggtccgtgacctggtccgggccgaggaggcggtcctgatcgtgcccggcccgcagtccgaggtctggacgagcatgcggttgtacgggcgggaccgctaccgggtcgaggcgacccccgccgacgcatggtggctgcccgcccgctccggcaccccggtggtccgggacaccgcgatcgcggtgccgctgcgcctcgacgaatccaccggcgtgctgctggtcaccggccacatgtcggagatccccgcgttcaccgccgaccacgtgctgctgctgcaggcgatgtcctcgcacgccggcgccgccctgtccgccgtccgcctgctggaccggctcacccacctcgcctcccacgacgcgctcaccgacctgcccaaccgccagcgattccaggccgacctgcaggccgccaccgaagcggccggcgcgaccggcggcacggtcggcgtcctgctgatggatctcgatcggttcaaggacgtcaacgacgcgctcggccacgacatcggcgacgacctgctgcgccggatcggccggcggctgcgcgactcgttcgccgggctcggcgtcgtctcccggttcggcggggacgagttcgcgctgctggtgcgcgacgccggcagcgaggcggaactcgtcgcgctggccgaggaggtacgccgtaccgtcgagaagcccgcggccgtcggcgatctgatcctcgcggcgcaggtcagcatcggcgtctgtctcgcgcccgagcacggccgggacgcggcccgcctgctgcgccgcgccgacctggcgatgtacgccgcgaaagcggcgcaggccggcgtgcgcgtctaccgccccgacgacgaccgggacaccgcccgccgtctcaccctgatggccggcctgcgcaccgccgtcgacaaccacgaactgtccgtcgtctaccagccgaaggtcgacccgcgcaccggccgggtgctgggcgccgaggcgctcacccgctggcagcacgacggccgcccggtcccgcctgacgagttcatcccgctcgccgaacgctgcggcctgatcggcccgctcacccggcacgtcctggaaaccgcgctgaccgaatgcgccacctggcgcgccgccggccacgacctcagcgtcgccgtcaacctggcccccggcctgctgtcggtccccgacctgaccgaccgcgtcgaccaggccctgcgccggcacgggctgccaccgtccgcgctcaccctcgagatcaccgagaacggcatcatgtccgaacccgaacacgcccgccgcgccctggacgccctggaccgtctcggcgtcaagctctccatcgacgacttcggcaccggccactcgtccctgggccgcctcgcccacctgccgatccacgaggtgaagatcgacaagagcttcatccgccacatcgacaccgaccgcaaccgtcgcgccgtcaccgacgcggccctgcaactggcccgcgccctggatctgcaggtcgtcgccgaaggcgtcgaggtggaggcggaactggactatctgcgccgcaacggctgcgacgcgatccagggttacctgatctccaagccgatctcggccccggccttcctcgactggctcaccgtcacggtcccgacctcgctggcggtctga

SEQ ID NO: 6467 - DNA, 534 bp, Actinoplanes utahensis
atggatctcggcgtcagcaggcgtggctacggctacgacagaggcgcggcgaccctctacatgttcggcatcatcctggtgccgttcctgatcttcatgaccctcgccggcgccgtcgtcgccttcgtccccgccgagcaacgccaggacggcggcggcgccatccgcttcctgctcctgctgctgtgcttcggcagcctgctggtcggcggttactccgtgtggttcctgcgcgtcgccggcaccgaccgggtcgcgctgttcacggtcttcgacaacggcctcgcctacggccacgtcgccgaccccttcaccatgcgcctggccgccccgcacagcgtcctgatcccgtggttcgacatcaccgaactccgcgaacgcggccccggttccagcgtgctccgcgccctgctgcccccgggccgccgctaccgcctcgacatcgtcacccgagaccaccgggtgctgaccctcaccggtgccatccagaacgctcgcgaactcgccaccgtcctgcgctcccacgtcggctga

SEQ ID NO: 6468 - DNA, 1041 bp, Actinoplanes utahensis
atggtggccgagcttccgcggatggacagcgtgacgccgatcttgcgggtcgccgcggcgcgtctcgacgacggcgacgcggctttcgtcgccgacctcggcatcgcgctgtggctccggtaccggtgggagaccgccccgccgcaggtcacggaggccttcgagcagctgctccgcctgctgctcgggcggccgggcgtcctcgaccaggccgtccgcctgctgtgcgtcgcgggggaccgccgcacggagcgggttgccgcgtcaatgatcgccgcccggcagcccaccgcggacctgggcgtggtgttccgcgccgatgcgccggcggagttgcgcgcctgcctcgcgcaggagctggtgctgcgcggagccgagatcgaccctcgatgggtcgaccccacccacccgctcggatggcttccgccgtccttgacatctctcgacgcgtctcctgctcttccggtgcaccaggacggccgcgttcacctcgaaacgcccgaactggagggcgagcgcgtgcacgggcacggtggggtgccggagtggcgggagacgacgacctccgaccggtcggccctgctcggcgcggcggtggccggctgggtgcggcgatccaacggccgcatcgaggcgcggacgttcgccttcgaccgggccctgtcgccggacgcggccgccggcgcgctggtgagcatcggcttgcacagcaccgagggaatgacggcgggcctgctcacctgctcgccgtcgcaggcctgggagcggttgttcatcgccgccgcgtacggcgccgcctacgaacccggcgaggcgggagcgtacggccggctgtacgcctggcggtcggtcgccggcctggtcggcgcaccggctgacacgccggtccacgaggtcgcggcggtggcgcacggctgctcctggtattcgttcgccggcgcgacccgctggttcgaggacgtcgtcggggacctcggcctggcggcggtggcaccggaccgtcggggcctggcggtgctcgccgccaccgacaccgactga

SEQ ID NO: 6469 - DNA, 192 bp, Actinoplanes utahensis
atgaccccgatcggcggcgacatccccaagttcctttcggtggtggaatccgccgacgaccgggtccgggtggaggtgaccaacccgcacctggtcaccatcggcgagctgaccgccgagatccgcgacggcaagatcgtcatcaccaccgcgtcggccgatcacctggagttcgtggtcatccggccgtga

SEQ ID NO: 6470 - DNA, 201 bp, Actinoplanes utahensis
gtggtggcgctggcgcgctgggggccggacaccctcatcccggatctcacgccgcacgcactgcccggccaccgggtcaccgcgagccggcacgaggtcatcgacccgtacatcccggtcatcgtcctcgcggcccggaccgcgacggcgctgggcgtgatcgcggtcgcgacccggcggccgcggatcacggccggatga

SEQ ID NO: 6471 - DNA, 798 bp, Actinoplanes utahensis
atgacggcggcgctgctcgtcgccgccgcggtcgcctacctggccgcggtccgggccggtcggcggcgcggccggggctgggcggacgagcggaccgcctgctggctggccgggctgaccgcggcgggcatcgcgctgatcgggccggtcgccgcggccgggcatcacgacttcgccgcgcacgcggccgggcacctgctactcgggatggcggcgccgctgctgctggtgctggccgcaccggtcacgctggcgttccgggcactgccggcgcggtgggcgcgacggctggcccgggcactgcggagccggccggtccgggtggtcacccatccggtgaccgcggcggtgctggacgccggcggcctgtggctgctctacggcaccgggctcctggcgggtcgccatcccgggctggtgcagctccacattctgggcgccggctacctgttcgcggcggctgtcgtcggggtggacccggcgccgcaccggccggggcgcgcggtgcgggcggccgccctgatcgggttcctcaccgcgcacgcgattctcgccaagttcctgtacgcgcatccgccggccggggtgctcctgcgggaggcccgcaccggcgccgaggtgatgtattacggcggggacctgatcgacctggcgttgatcgtcatcttctggtggcagtggtatcgcgccggcgacagtggacgccggtggccgcggccgccggcgccggcggcgtggcggctcccggctgaacggccgatgccgagccgaagtctagctagctcccgttcggggtga

SEQ ID NO: 6472 - DNA, 435 bp, Actinoplanes utahensis
atgtcccgcaccgtgctctccggggcgctgctcggactgggtgtcgccggattcgccgacgagacggtgtttcaccagctgctgcactggcaccacttctacgaccggtcgacgccggcggtcgggctggtgtccgacgggctgttccacgcggccagctggttctgcaccgtggcggcgctgttcctgctcgccgacctgcgtcggcgcgcggcgttcgaccggcgatcgtggtggggcgggctgctcaccgggacgggggccttccagctgtacgacggcacggtgcagcacaagctcatgcgcctgcaccagatccgctacgacgtgaacctgacgccgtacgactgggcctggaacatcatcgcggtcctgctgctcgcggccggcgtggtgctgctggcgcgctcccgccgccgggtcgtcccggcatga

SEQ ID NO: 6473 - DNA, 2679 bp, Actinoplanes utahensis
atgccgctgcgcagcgtcgccgtccttgccgccaccatcctctcgctgcccggcgcgctcccggctcacgccgctgccgccgccgcgcccaccacgatcaccgtcgggaacgcacgcttccaggtgctgtcgccgacactgatccgcaccgaatactccgccgacggccgcttcaccgacgcggccaccttcaccgtcgtcggccgcggcgcgttcccgcgggccgccaccgtcgtccgcaggtcgctcgcggacggctggctgaccgtcgacacgggcgctgccacgctgcgatacctggtcggttccgggccgttctcgcaggacaacctggtggtccgcctcaagtccggccagcagcaggtcgacgcggcgccgtgggccggcccgtcgtgcgcgctcggcgtgctgtgtgaggcggagaccctgcgggcgccggccaccgcgaccgaccacggcgggtacaccggaaccgggttcgcggccggtttcggcgccgtcggggacgggctcgcgttcaccaccgcggcgaccacggccgggacctaccaactggacctgcgctacgccaacgcacagggcgccgacggccagaacaccacccgcacgctcagcgtgatcgtcgacaacggcgccgcccagcgggtcaccctgccgccgaccggttcctgggacacctggcaggtcgccaccgccgcgatcaccctcggcgccgggcaccaccagatcgccatcgcgcacaccgcggccgactccggccaggtcaacatcgacagcgtcgcgatcgtccggcccggcgacgcgtaccctccggtgccgacggccaccgcctcaccgtgcgcctacggcagcctgtgcgaagcggacaccggggtgctgaccggtggcgcgaagcatgccgccgaccacaacgggtactccggcgcgggtttcctggccgggctggagcacgccggagcgggcgccgcctacacgatcaccgggatcccggcggccggcgactacacggtgcagctgcggtacgccaacttcgaggccggcagccagccggtccagtcgcggacggtgaccgtcaacgggacgtcggcgaccctgccggcgaccagcggctgggactactggcgcacggtggccatcccggtgcgcctcaaggcgggcaccgacacggtgacgctgggctgcccgaccgacgccagctgcaacatcaacgtggacacgatcgcggtggccgcgacgggcacgccgctgaaggccccgcacgcgccgctcggcggataccgtcgcggtctcgacggggtggacggcggcgcgctgaccgcggcgggactgctgtacgccgacggttgggcgctgctcgacgacagcgcctcggcgcgcgcggtgcccgaacaggacggctacgtcttcgcgtacggcaaggacttcgcccgtggtcttcgcgaactgggcaccctcaccggaccgaccgcgctgctcccggaatgggcgtacggcgtgtggtactcggagtactacgaccggaccgcggccgacttccagcagcggatcgtgccgcgcttcaggtccgagggcgtgccgctggacgtgctgatcgtcgacaccgatttcaagtcgccggacacctggaacgggtgggagatcgacccggccaagttccccgacccgcagggcttcctcgattgggtgcacgggcagggcctgcacctgtcgtacaacatccacccgagcatcaaggacaccgacccgaagtacgcccaggcgcaggcgatcgcccagaacaagatcaagaacggggtgttcgactggggtgacccggaccagctggccgcgtacctgtggctgcacaacgacctgaagcaggacttcgcctggctcgactggtgctgcgacggctcgtactcgtccaaggcgggcgtcaccccggactcgtggatcaaccagcagtacgccggccgctacggtttcgcgttctcccgcggttacggctcgctgcagtccggcggttacagcaacccggccgcggtgcccaccggaccctgggccgagaagcgcaccaccctgcacttcaccggcgacgccatctccgactggcagacgctgcgcttcgaggtcggttacaccccgggcgagtcggcggcgaccgggctggccgcggtcagccacgacatcggcggccacaccggcggcctgcagcagccgggcagcgaaccgggcagcaccagactgcccgacgacctgtacgcccgatgggtgcaactgggcaccttccagccgatcgaccggctgcactccaaccacagcgaccggctgccctggcagtacgggccggacgcggcggcctccgcgaagaagttcctgcagctgcgggaacaactgcgcccctacacctacgccgcggcgcagacggccaaccggaccgggatgccgatcaaccgggcgctctacctcgcctatccggacagcgcggaggcgtacgcgtacgccggctcggaatatctcttcggctccgactacctggtcgcgccggtgacgacggccggcaccaccgcgaccaccacggtctggttcccgcccggcaacacctggaccgattacttcacccatcagacgtacgcggggggaacgaccgcgcagatcaccaccaccctgtccaccatgccggtcttcacgcgcggctga

SEQ ID NO: 6474 - DNA, 351 bp, Actinoplanes utahensis
ttgggcatccggagcgggagcgcccggtctatccggagcaggtggcgtcattgcgggccgcccacgggttgccgggtccggcgtcgcgggccggcgagatggtgcgacctgctgtcccgcagtcccgagttcgcccggttgtgggaggcacaggtggtcggccgccggttcgaggagcacaaggtgctgctgcatccgcggatcggggcgatcgaggtcgactgtcaggtgttgctgaccgaggacgggtcgcagtcgctgctcgtcctcaccgcggcgccgcgcagtgaggacgagagcaggctgagactgttgaccgtgcttggcaccgagccgttcagccgcgcgtga

SEQ ID NO: 6475 - DNA, 384 bp, Actinoplanes utahensis
atgaagaaggtccttgtcgccgtctcctcctcgctgatctccttcggcaccgccgcgccggccgaggcccggcaggtcgcccggcccgccgtcgccgcggagtcccgctccgcggcgggtacccgggcggcggcatacctgcggtcccaggccttctcccgctccggcctcatcgaacagctgaaggacgacggcttcagcaccggcctcgccgtccacggcgtggacgagcagcacaccgactggaaccagcaggccgcctggatggccatggaatacctggaaacggaggccttctcccggtcggccctcgtcgagcagctggaatacgagggcttcacctcggcccagaccgcgtacggtgtcagggcggcgggactgtag

SEQ ID NO: 6476 - DNA, 900 bp, Actinoplanes utahensis
atgaacctccatgtcgcggaaccccgccggcccgggctgcgggtcgaggtgacggcaggacggcgtcttctcctgcgccagggcgatcgggtggtccttctcggccgccagcgggcacaccatcgcggcgtgcactattgccgaacagggcggtacgagtcgccgctgccgccgatcaccgctcggcaggcccgcgggcggtggcaggccggcaatgaatcgggctggtgggcagcacgctggacctaccggtacgcagcttggttacggaccgcgttctacggcccgctgcatgccggctcctggacactcgcctggggcatgccggagtggacggtcccgggacactggagccgtctgcacgatgtcgacccggaccagggccacattacctggttcggctacggcgatccgtcggaggacgctcgagacatcctgccgctgcgacgcctgtccgccgttgacgccgaccgggtgaaggcataccggcggcagcaccgcgagggaatcctgccgccggtcctgttgtggtgggtcagcgggctggccacgctcctggtcgtcgacggccacgaccggctcaccgcggcgctggccgaaggcgccgttcccgatgttgtcgtcctcgcgcccaccgctgatccacgatgggtctcggccgttcaacgccaccccatccgggaatatgagcagcgcatcgcacatctgcggaacggccccaccgatcctttcaccggcgacggcatcgcgcacgcaggtcaccgcctcgccgcgaacctgagccgcatcgccctgaccgagggacgcacgcgagcatggccgatgctgggcgggcgccccacgtgggatcacctggtggccgagttcgcccccggcagcccgctggaacaggagcgatga

SEQ ID NO: 6477 - DNA, 663 bp, Actinoplanes utahensis
atgatattgccccggctggacagcatgcgaaatacgcggcagctccggatgtatggagcgctctgcgtagtgcgcctggcagaggtggcggcactcggcgatttcccgtatcgggagtcgctcgaccggtaccttgacggactgttcgacgaacgccgcggaagtcctgatgatcgcgagtgcctgatgcgtgccaggagattcctgttcggcgatgacatcacgctgatcaagtattatcagagcatcaccgtcgaaatcgccctgacgatcggcggagacgagccgtcacgtccgttgagtgcacgtggaatcctgttctcgactctgaatccctggtcgaatctcgacggtctctgtcgtcacgctactccgccgcagttcgacgaggatcacttccggaatcaggagatgcgactgcaggacgacgatatcgcggatatcgtccactctcccgacacggcggattcgtggactccgttgaagagccgcgcacgactgatcggcgaaagggtggccgcgtcgctgaacggcctttctcaggagctgcgctggccggaagagcgagggatacccggattccgcgtcgcgaccgctgacgagcaggaggaagagcgcctgtcctcactcgtcgacaacgacgcgccggccgaccacgggtga

SEQ ID NO: 6478 - DNA, 699 bp, Actinoplanes utahensis
gtgccgccacctctgccaggcgcactacgcagagcgctccatacatccggagctgccgcgtatttcgcatgctgtccagccggggcaatatcatcgcagtttcaccatagctgcaagaatggccatgtggacggtcgccgctacagtcacgccgtggatgttgactggaatgcggagctggtcgaccaactggagtcgcactggcatgctcagcttcggccccggctgaacggactgaccgatgatgagtacttctggcaacccgttcccggttgctggacgctcagtcgccgcggctccgaggagttcgtcctggactatgcccacccgctgaacggccccgcgccggttaccaccatcgcctggcggctcgcgcacctcctcgacgtgttcgggccgccggccacgcctcacttcgagggctcacctgggggccagactgccatgacctacccagggacggccgcggcagcgctacgccaactcgacggggggcacgatgcgtgggtccgcgacctgcgcagtctcggagcgacgggcatcatccgggcgcaaggcgcaatctcaccgcctgagtacgcggaggcgccgatggcaaaactcatcctgcacacccatcgcgaggtcatccaccacggcgccgaaatctgcctgctgcgagatctctaccttgggaaaggtggcctgagcggtctatga

SEQ ID NO: 6479 - DNA, 96 bp, Actinoplanes utahensis
gtgaccgggccgacggccggcgcgaccggcagggaacagaccggcgaccacgaggacgacatgaccggccggtggggtcccgaggccgcccggtag

SEQ ID NO: 6480 - DNA, 690 bp, Actinoplanes utahensis
gtgtcgcggtgcctggtcccgccttcgtgccacttccggcccgcgccgcccgccgcgggctcgccggggccgcagcatgaggtcgtccacgtgacgacgaccgacctggagagccctgtgttccgacgtttcctcctcatccccctggtgctcgccccgctggcggcatgtggacaggtgaccggcgcggcagcgacaccggagccgggtgcttcgtcgagcgcggccaccgcgacgaaggtgatcccggccgcgaagacgcagccggcctccggtcatggttccgccggctcggcgcaagcgggcggcaccaccaccgcggcgctcaccggcacccaccacgcgttcctgaccgcggtcgatcccgccaaacacacgatcaccttcgatctcgtcgactggttcgagggcgccgccgcgaagtcggcatgcaagcaggacggagtgacggagaccgccaacgactggtgcgtggggtactactaccgcaacaacagccacaagctccggaccctgcacgtcaagtccggcgcgccgctgagggtgatcgacatgagccacggccccgttcatctggtgaccgccgacctcggcaagttccagacatcgctcaaggcgaacggaggcctgttcgtcttcaccgtcaccaacggcgacatcaccaaggccgacgaggtctaccagccctga

SEQ ID NO: 6481 - DNA, 1356 bp, Actinoplanes utahensis
gtgcgccccgctgcgcggctgacttccgggccggtccgtctccatggtcttccgcggggcgatcggtgggcgctcgccggggtgctcggcctggtcgcggcggccgcggtggtcggggcggcactcggcggggcggggcatcccgtgctcgcgccggccgcgccgatcttcgggcacgtgcggccgcacatcgggccgggaacgccgctcgccctggccgtcgcgatcgcggtgatccgctgggggccggccctggcggcgaccctgccgtggcggcggctgctggtcggcgcctggctggccgcggtcgcctggacgttctccctcgcgctgatcgacggctggcagcggggggtggccgggcggttgaccacgcagttcgaatacctgagcgaggtgccgcgggtcaccgacatcccggccatgctgcgcggcttcaccagccacatcctgctcaactcgccggaccactgggccgagcacgtgtccgggcacccgccgggtgtgctgctgaccttcgtctggctggaccggatcgggctgggcgggggtgcctgggcggccacggtgtgcatcctggtcggttgcctgatcacggtggccgtcccgagcacgctgcgctccctcgactccgacggtgcggaaaccgctgcccgggccgcggtccccttcctggtgctgttcccgggcgcggtgtggatcggcgtttccgccgacggcatgttcgccgggatcggggccaccgccgtggcgctgctcgcggccggcctcgcccggccgtcccgccggcgtctgctgctgggcggggcgttgctcgcctggtgcgcctacctgtcgtacggcctcgtcctgctggtcctgccggccgcgaccctgctcgtgggccgccaccgcaggtggccgctgctgatctggccgatcctcggcgcggccgcggtcgtcgccgccctgaccggttacggtttcgcctggtgggagggctaccacctggtcaagatccgctactaccaggggatcgcgaccgcccgcccgtacgcctactggatctgggcgaacctggcctccctggcctgcgtcgccggcccggccgcggcacccatgctgcgccgcgccgcccttgcgctccgtgccgcccgggggccggcggcgtggctgtgcctgggcgggctggcggccgccctggccgccgacatctccggcctgagcaaggccgaaaccgaacgcatctggctgccgttcgccgtctggctcccggccgccgccgtcctgctgcccctgcgcgaccgtcgcttctggatgtgcctgcaggccgccaccgccctcctggtcaaccatctgatcctcaccacgtggtga

SEQ ID NO: 6482 - DNA, 1575 bp, Actinoplanes utahensis
gtgcaccggcaggccggtgtcccggcggatccggtgggccaggaccgcgttcgccagccgggcgtgggccggccacgcgccgggcacggtcggccggcggcgtccgcaggccaggtccagctcgccggcgcggacccggtcggcgagcagcggcagctcggccggatccagcgaaccgtccgcgtcgatcacgcacaccaccccgtcggccgggtcggcggcgagcagcccggcgtgcacggccgcgccgtagccggggtgcggcacgtcgatcacccgggcgccgagccggcgggccacgtccgcggagccgtcggtcgacccgttgtcggcgacgatcgcgcggaagccgggcggcatccggtccagcagccacggcagggccggggcctcgttcaggcagggcagcaccacatcggtcatggccggaaagttagcgctggtcagggcccggaaatcttacgaagtgcggacgtcgccgacagttcttacgaaccgctgacggatcggcgcgggccggtgtcaacggcggctcgcggacctagcgtcgctgccgtgacgcacattctcgtgaccggcggggccgggttcatcggctcccacgtgaccgcagcgctgctggcggcagaccatgacgtatccgtgctggacagtggtcccggcgaggtgccggccggggtgcggctgcaccgggccgacgtccgggacccggaagcggtgcgggccgcactgcgcggggtggacgccgtggtgcaccatgcggcgctggtcgggctcggggtcgggccgcaggacctgccggactacgtgggcagcaacgacctgggcaccgcggtgctgctcgcggcgatggcggcggccggggtccggcggctggtgctggccagctccatggtggtgtacggggagggcgcctactcgtgcacgacgcacggaccggtgagccccgcaccgcgggcggccggggatctggccgccggccggttcgagccgtcctgcccgcgatgcggccggccgctgctggacgggctggtcggcgaggacgccgtgatggatccgcgcagcgtgtacgcggtgaccaaactcagccaggaactgctggccggggtgtgggcgcgggagtgcggcgcttcggtggcggcgctgcggtatcacaacgtatacgggccggggatgccgaaggacacgccgtacagcggggtggcggcgatgttccggtcggcgctggagggcggccgggcgccgcgggtgttcgaggacggcgggcagcggcgcgacttcgtccacgtcggtgacgtggcggcggcgaacgtggcggcgttgcgggcggagcggccgggattccgggcgtacaacatcgcctcggggcatccgatcaccatcggcgcggtggctgccgcgctgtccgaggccttcggcgggccggggccggtggtgaccggcgagttccggctcggggacgtgcgccatgtggtggcgtcgccggcccgggcggctgcggagctggacttccgggcggccgtcctgccgtctgtcggcttgaaggagttcgcgtgcgccccgctgcgcggctga

SEQ ID NO: 6483 - DNA, 804 bp, Actinoplanes utahensis
atgatccagctgctggtgatggcgaaagccccggtgcccggccgggtcaagacccggctctgcccgccgtgcaccccggagcaggcggcggcgatcgcggccgccgcgctggccgacaccctggccacggcgtccacgctgccggcccggcggcacacgctggtgctcgacggggaatacccggtcccgccgggctgggcgtgtgtccggcagcgcggcgacggcctgggggagcggctggcgaacgcgttcgccgacaccgcgctgcccggcgtcccggccctgttgatcggcatggacaccccgcaactgaccgctgccctgctgcgggccgcggccacgaggttgcgcaacgagggcgcggtgctcggcccggcccgcgacggcggctggtgggccctcggcttaccgattgcggcgtacgccacggtcctgcccgccgtgcccatgtccaccgccgagaccggcgagctgaccctggccgccctgcgcgcccgcggcgtcgaacccaccctgctcccgacgctgcgcgatgtcgacaccgccgcggacgccaccctggtcgccgccctgtgcccgcccggcagccgcttccccgccgccgtcaccacggcgggcctcaccgcggtgggcctcaccgcggcgggcctcaccaacgcgggcctcaccgcggcccccggccgggccgcggcctcccccgccggcgtcggggcggacgacgaactcggcggaagccggatcgcggacggtgcgggatccggcggggaccgggcttgcgctgctacgactggggtgccggcgtga

SEQ ID NO: 6484 - DNA, 315 bp, Actinoplanes utahensis
ttgcgctgctacgactggggtgccggcgtgaccgcccccgcgatcgcctgtccaccggccgccctggacatctacgaccgggcgctggcccgggccgcgaccggcgccgggaccacgctgctggtgcgcgacccggccggccggacgaccaggttcgacgccgccgactggtgccgtgaccaccggcccggcgacacccgcctgctcgaccgttgcaccggcgcgaccctggacgtcggttgcgggccgggccggctcaccggcgccctgctgcgccgcggccgggccgccctgggcatcgacgtcactagctag

SEQ ID NO: 6485 - DNA, 216 bp, Actinoplanes utahensis
gtgcacgccgaactcgcggctccggggaccggcagctggtccggcgcggccaccctgcacaccccgggcgagccggccggcgccccgctgcgctgggcccaggtcgccgccgacgacctggccgccgtcgcccgcgaggccggcctgacagtcctcagcacctggaccgaggagggacgatggttcgcctcactgaccggtcggggcgcccggtga

SEQ ID NO: 6486 - DNA, 1422 bp, Actinoplanes utahensis
atggttcgcctcactgaccggtcggggcgcccggtgaaccggttgccgcgcccgccggagccgctgcgacgtgccgtggcctggctcctggcgccacctgccagcctgcgccgcggccctttccgcccggacgccttctccggcgatcggcgttccaccaggctgaccggccagctcgggctgctgctcggcgccgcgttcgccatctgcttcgtgaccggcctgctcagccacctggcccagcatccgaaccggtggttgccgtggccgcccggccccgccgggctctaccgctgcacgcagggcctgcacgtcgcgaccgggctcgccaccgtcccgttgctcggcctcaaactgtggtcggtctatccgcggctgttccagtggccgccggtccgcggcctcggccacgccgcggagcgcgcctcggtcgccgtcctggtcgtcgccgcgctgttccaggtgctcagcggtgtcctgaacatcgcgcactggtacgccccgatgccgtttttcttcaccaccgcccactactggatggcctggctggccgccggcgccctgctcacccacatcggcgtgcaactcccgatcacccgcgaagcgctccgccgtcgccgcagcgacccggcgatccccgtcggcgccgccgactccggcagccccgtcgactccgtcgactccggcagccccgttgacgcggccatccccggtggcgccgccggccctgtccaccccgccggccctgtccaccccgccggccctgtccaccccgccggccccgtcgactccgccagccccgccggccgcaccgacgccgccgggcgccgtgaggttctggtggccggtgccgtcgcggccggcgtgatcacggtcgccaccctggggcagacggtccggccgctcgccgggatctcgctgctcgcgccacggcgcccgggcaccggcccccagggactgccggtgaacagcaccgccctcggcgccggggttcgcgacgccgccctggaccccggataccggctgaccgtgaccggtttcgatcgcacggtctcgctgagtctgcccgacctgcatgccctcgaactgcacacctcggtcctgccgatcgcctgcgtggagggctggagctccacgggcacctggaccggcgtaccgctgattgatcttcttgcaatgatcgccgtgactccggacgggtgcgaggccgtcgtcgagtccctgcagagcggtggccgctatcggacatcgatcgtgcaggaggggcatctcgccgaccgccggaccctgctcgcgctccgcctcggcggcgaacctctcgccccggatcacggcttcccggcccggctgatcgccccgaaccggcccggcgtgctgcagaccaaatgggtcaaccggatcaccgtgcggagggccggatga

SEQ ID NO: 6487 - DNA, 405 bp, Actinoplanes utahensis
atgagacgtgtgctgatcgctggcggtctgattctcatggcgtacgcggtgggcggcgcactcctggacgaccaggtggacctggccggcatcgcggtgttcggcctggcggttctcatcctgcacgacgtggtcttcctgccactggtgctgctggccggccggctgctgccccggctcaccccgacgctgcggatcatcacgaccgcctggctggccgtgacgatcgtcgcgctgccgctcgtgctcggattcggacgcgaccccggaaatccgacgatcctgcccaggtcgtacggcaccgatctgatcgggatcctgatcgggacggccgtgaccgtcctcgcctgccgtaagggaatcgaaagactctcggacgggcgccgccggcgtccgcctgggtag

SEQ ID NO: 6488 - DNA, 417 bp, Actinoplanes utahensis
gtggtgacccaccaggtgctggtcgtcgacgacgacccgacggtcagcgacgtcgtgcgccgctacctcgaacaggacggctgccacgtgcgactggccgccgacggactgtccgcgctcgccgccgtcgacgcccaacgccccgatctggtcgtgctcgacctgatgctcggcggcctcgacggcctcgaagtgtgccgccgcctgcagcatgaccagcccggactcccggtcgtcatgctcaccgcgctcggcgaggagagcgaccgggtgctcggcctcgaggtcggcgccgacgactacgtgaccaaaccgttcagcccgcgcgaactcaccctgcgggtccggtcggtgctgcgccgcaccgccccggccgccgccccggccccggccctgctgcgcgacggcgacctctag

SEQ ID NO: 6489 - DNA, 150 bp, Actinoplanes utahensis
gtgtggggctggcagttcggcgaccagtccacggtcaccgtgcacgtccggcggctccgggagaaggtcgaagccgacccggcccgcccggcgcggctggtcaccgtgtggggcgtcggctaccgctgggagccggccgccgatgcgtga

SEQ ID NO: 6490 - DNA, 1014 bp, Actinoplanes utahensis
atgcgtgacatcctgctgatcggcctctactcgctggccgccggcaccgccgtcggcgtgtgcggcgccggcctgctccggctgctccgcggccgatcgatcgccgtgcacgtctgcgtgctgctcggcatcaccatcaccgcggtcgtcgccggggtcaccacggtcgcccgggcgatgttcctgtccgcccacgacatgcaggtcgtgctgctcaccgtcgccgcctcggccctggtcagcctggctttgggcatcgtcttcggccggcgcctggcggccgccgcggtgtgggccgccgaagcccgcgaacgggaacgccggatggaagccggccgccgcgaactcgtcgcctgggtctcccacgacctgcgcaccccgctcgccggcctgcgcgcgatgaccgaggccctgcaggacggtgtcgtcgccgaccgggccggcgtcgccgaataccaccgccggatcgcggccgaaaccgatcggatgagcggcctggtcgacgacctgttcgaactgtcccgcatccacgccggcacgctccggctgaccccggccagcctgcccctgcgggacgtggtctcggacgcggtcgccgcggtcggcccgctcgccgccggccgcggcatccgggtcgtcgccgcctgcgacagctggcccacggtgaccgggggagtggccgaactcaaccggatcgtcagcaacctgctcaccaattcggtccgctacaccccggcgaacggcatcatcgagatctccgccggcggcgacacccgcgaggtgtggttcgccgtctcggacagctgcggcggcatccccgaggaggacctgccccgcctcttcgacgtcgccttccgcggcagccgcgcccgcaccccggacgacggcgcgaccggcgccggcggcggcctcggcctggccatcgtccgcggcctggtcgaagcccacggcggccgggtcggcgcccacaacatcaccggcggttgccgcttcgaggtccgcctgcccgcctga

SEQ ID NO: 6491 - DNA, 1377 bp, Actinoplanes utahensis
gtgggccaccctggccaggacactctccgtctggctcctgcagcgacgctccgatgtgacgatcacgataaccggtccgggtggccgcaagatacaggtcaacgcgaagcgcaccaaggacccggaggcacttgtccgccaagtgctcgacgcgagcgcggaatcgcagtgatccgtctaccggatccccagcgctcctatgccgtcctggtcggcgtctggtcctacgacgcggatgagatcctcgacctacccgcggtggagaacaacctttctgcgctgcgaagggttttgaccgatcccgaccggacggggctgcccgcggaacactgcatcaccgtccgtaacccgcgcgacgcgcgcggagttttccggaaactgcggcaatacgccgcccgcgccgaagacaccctgctgttctacttcgcgggccacggcttcaccggcgaccgtaacgagctttacctgagtctgagcgaaacacatccagacgagttgccggtgagcgctatcgcctacgacgtggtccgccaactggtcagggaaagcccagcccgcaaccgggtcgtcgtgctcgacacctgcttctccgggctcgccgtgcaggacatggcgggcaacccggcagcgacggtcctcggccaggtcggcatcgaaggcacctacattctcacctccaccgaacgaaatgccccggcgctcgccccgcccggtgcgcgatacacggccttcacaggtgaactgttgcggctgctcgtcaacggcgtgccggaggccccccgcctactcacgttcgccgaaatctttcggcacctgctgacagccatgctggcccgggggcttccggtcccgggccagcggggaaccggcaccatcgaccagcttgcgctgacccagaatgcatggcaggaccgcgctgccggcccggccatcggctcgaggccggcccatccgtacaagacaggcgcaggcggactgcgaatccgccgggcagtattcgacggcatcgtggcgcattgcctggcggttcatcccatcacagcgtgcggcctggtcgcgggcccgatcggttcgaaccggccggaacgtttcattccgatgtggaacgccgccgcatcgatgacattctacgagttcgatccgcaccagcagcttgccgtctggcgagagatggatgccaacgatgaggagccggtagcgatctactactctcacaccgctacggaagccttcccatcacgaaccactgtcgcgttcgccggcgagaagaacgcgcactacattatcgtgtcgacccgcgatcccgacgccgtccaattccgatcgtttttgatccgggacggtgaggtaaccgaggagcctgtcgaggtgatctaa

SEQ ID NO: 6492 - DNA, 639 bp, Actinoplanes utahensis
atgagggccgagacaacacgactgcgggccgacgcccagcgcaaccgcgaccagatcgtcgccgtggcccgcgtcgtgttcgccgagatcggcccgggggcgccgatggacgagatcgcccggcgggccggggtcggcgtcggcacactctaccgccgcttccctgaccggggggctctgctgcgcgccgtggccctggagagcctcgcggcggtcctggccgacgcccacgccgcgatcgaggaggagccgaccgcctgggacgccctcacgcggatcgtccgccgggccgtcgacctgcggttcagcacacacgtcaccatgatggacgagcacacgcggcaggccctgcgagaggcacccgacttccggcacacccgcgccgcggtgctcggcgtggtggagcacctggtcgagcgggcccaggccgagggctcgatgcgctccgacgtcggcgccggtgacgtgttcgcggtggtgtctctcctgctcaaaccgccaccgagccggtccgcggagatgtccgacctgctgatgcggcgctgcatgacgctcatcctggacggcctgcactccggcgggcagagcgtgcttcccggcgacccgatcagcgtgaccgacctccacctggattcctga

SEQ ID NO: 6493 - DNA, 1188 bp, Actinoplanes utahensis
gtgactgctcccgccctgcagaccacccgacgctgcccgtatgcgcccccggacgagcacacccgcatccgggacaccggatccggaatctcccgactcactctgcccagcggccaggtcgcctgggcgctgagccggctcgaacacatccgcgccatgctcaccgatccgcggttcagctcggaccgtcagcatccgaacttcccccggttcacccgcgagcaacccggcttcgacctcatgcgcccatcgatcatccagctggacccgccccagcacggtcccgcccgcaaggccgtggtcggcgagttcaccgtgcgtcgcatggccgccctgcgcccccgcatccagcagatcgtcgacgaccacatcgacgccatgctggcgggtccgcgtcccgccgacctcgtaccggccctcgctctgccggtgccgtcgctggtcatctgcgagcagctcggcgttccgtaccgtgaccacgagttcttccagagccacagttcggccctgctgagccgcgccgtcacggccgagtaccggcggcaggcggccacggagctgcgcgactatctcaaagacctgatcgccgagaaggccgccgacccgcccgacgacctgctgggccgtcagctcgcccagggcaacgaccccgaggacgtgctgtcgctggccttcctgctgctgatcgccggccacgagaccaccgccaacatgatctcgctcggcgtggtgacactgctggagcgcccggcggacctggcggcactgcgcgaggacccggcgcgtacgctccccgcgatcgaggagttgctgcgggtctacaccatcgccgagttcgccaactcccgcgtcgcggtcgaggacgtaccgatcggcggcgtgaccatccgggccggcgaccccgtcctggccctgagcaacgccgccaaccacgatccctcggccttcgacgaggccgaagagatcaagctcgaccggggcgcccgcaaccacgtcgccttcggcttcggcatccaccagtgcctgggccagaacctggctcgcatggagttgcagatcgtcttcgacaccctcctgcgccggatcccgacgctgcggctcgcccaacccgccgaccggctgccctacaaggacgacgccttcatctacggcatccacgaggtgccggtgacctgggaggacgcatga

SEQ ID NO: 6494 - DNA, 201 bp, Actinoplanes utahensis
atgaccacgatcgtggcggacctcgaccgctgcgtcggagcgggccagtgcgtcctgaccgaccccgacgccttcgaccagagcgagcaggacggcaccgtcgtcgtcctgcgggacaccccggcggacgacgaggccgtcgagcgggcacggacagccgtcgacatctgcccgagccgggccctgtccctgacgaattag

SEQ ID NO: 6495 - DNA, 435 bp, Actinoplanes utahensis
atgcatctgagcccacccctgcggcactggcatccggcccgcgacagcaaacggttgatctccgagttcctgcacacccccagcgagctgatggtgctggccggggtctggctgaccgccgcgccgctgcttttcgaccatcaggcggcggtggtggcgtacgccggttggagtgatgtcctgtcgggccttgccctggtcgtcctggcctatgtgcgcgccgtggatccgttcggcaccgactgggtcaatgcggtgaccgggctggtcgcggtctgggtgatggtctcgccgttcgtgcgggggtacaccggttcgacgacggcgacctggaacgatctgatcaccggcgccgtggtgatcgggttgagtgccgcgagctggcacttccggcgcagcgaagcccgtcgtcaggggatggagccgccggaatga

SEQ ID NO: 6496 - DNA, 255 bp, Actinoplanes utahensis
atgacatcgaccatcaccccgtacgaggacggcccgctgatcgtgcgcggcgacttcgagctgcgcaccccggacggcgacgtgatcgacccggcgcgcgccacgatcgcgctgtgccggtgcggcaagtcggcggacaagccgttctgcgacggcacccacaagacgttccggttccgggccggaaccggacgcgacaacgacccgccggcgctgctgacccagggcggccagccggctccagaagggcgctag

SEQ ID NO: 6497 - DNA, 1086 bp, Actinoplanes utahensis
atggtgaggacggtcggggtcgaggaggagttcctcctgctcgacccggccaccggggtcaacctgccggtggccggtcgggtggtggccgcgctgccggagtcgctgcgtcggcgcagccgccgcgaattccggcccagcatgctggagatggtctcggacgtctgcgtcgaggccgacgacctggcccggcaactggcccagaaccggggcgcggccggcgcggcggccgccaccgcgggggtcctgctggtcgcggtcggcgccagcccggtcgccgagccggaccgggaaccggacgacgacccgcggttccgggcgatcaccgacttctacggcccggtcgcccgggacccggcgctgtgcggctgccacgtgcacgtcggcgtcgacgatccggagcacgccgtcgaggtgtgcaaccgactgcgccccgacctgccgctgatccaggccctgtcggcgaactcgccgctctgtgagggagccgacaccgggtacgccagctggcgcagcgtccagttgcggcgctggccggcactcggcccgtggccgcacgcggggtcggtagcggaggtcgaggagacggtggcggcgctggtcgcggccggcgagatgatggacgccagcatggagctgtggtgggcacggccgtcccggacgtttccgacggtcgaggtgcgggtggcggacgtgggcccggcaccggccgacgcggtgctgctcgccatgctggtccgcgggctggtggagacgtccaccgaggggccgatggtcagcgatctgctgctgaccgcggcgcacgggaacgcggcgcgcagcgggatgggaggcacgctgctctgtctgcgcaccgggcgggcgcgcccggcgtgggacctggtgggcgagatggtggaccggatcgcgccggccctgcgcaaggcgggggatctcgacgcggtcgtcgccgggctggaccggatccggcgtgaggggaccggggcggaccggcaacggcgtctgctcgcggcaccgggcacgacgatcccggcgatgctgcgggcgttcagcgtgtcgcccggagaccgtccggcgacggcctga

SEQ ID NO: 6498 - DNA, 924 bp, Actinoplanes utahensis
gtgaccgcactgctggaactcgggcaggcgctgaaagcggccggctacgagttcaccacggtcacgccggccacccacgcgcgggtcaacgcgcggccggccaacgcggaggcgcacgacctgcgggacgtgttcggctggagccggccgttccggcccgcggtgctgccggccggcctgctggagctgctgcgggcggccgacgccgtcgaggcggatggggaactgctgcgcagccgggtgcggttctcgacgtacgacggcgatctgttcctgcactccgcctttccgaccgacgcggcggactcggtgttcttcggcccggacacctaccgcatggcggacgccgtcgccgcccacctggaaagccgggcggaaccggtggccagggcggtggacatcggttgcggcaccggcgcgggcgcgatcacgatcgcgaagcgggcgcccggggccgaggtcctggcggtcgacatcaacgacacggcgctgcggtacgcgcagatcaacgcccgcctcgccggcacccccggggtcacgccgcggcgcagcgacctgctcgaccacgtcgacggcgacctcgacctgatcgtgtcgaacccgccgttcatggtcgacccggccgggcgcacctaccgcgacggtggtggcgccgacggcaacgacctgagcctgcggatcgtcgacgcggccgccaaacggctcgccccgggcggcgcgctggtgctgttcagcggcaccgggatcgtcggcggccgggacccgctgcacaccgccgccgccgaacggctgtccggaaccgacctgacctggacgtaccgggaggtcgatccggacgtgtacggcgaggagctggacggcccggcctacgcgcacgccgaacggatcgcggtggtgctgctgaccgccacccgcccatggtga

SEQ ID NO: 6499 - DNA, 825 bp, Actinoplanes utahensis
atggcgcataaagcgggcgacgcagggcatccgggccgcatgactttcgcagtggtgaccggagcgtccagtggaatcggctacgaactggcccggcaactcgccgaacacggctacgacctgctgatcatcgccgaggatgagggcatcgaggaggccgcggccgacctgcgccgggacgggcgtaaccaggtcaccgcggtccgcgccgaccttgccgaccgggccggcgtggcgcaggcgtgggcggcggtcgaggcgaccggccgggacgtcgaggtgctggccctcaacgccggccggggcatcggcggagagttcgtcggcggcaccgagctggccgatgagctgaacgtgatcgacgtgaacgtcacctccaccgtgcacctggccaaactggcactgcccgggatggtcgcccgcggctccggccgggtgctgttcacctcgtcgatcgcgtccatgatgccgggcacctaccaggcggtgtacaacgcgtcgaagtcgttcgtgcagtcgttcgccgaggcggtgcgcgccgaactcaaggacaccggggtgacggtcaccgcgctgatgcccgggccgaccgagacaaacttcttccaccgggccgagatggacgacacccgggtcggatccagcccgaaggacgacccggcacaggtcgccgaacagggcatccgggcgctgctggagggtcgggagaaggtgaacgccggctcgctgaagacccgggcgcaggcggtggccagcaaggtgatgccggacagcgccaaggccgagatgcaccggcggatggccgagccgggctccggatcgtga

SEQ ID NO: 6500 - DNA, 1359 bp, Actinoplanes utahensis
atgcccgacgcggatcccggtaaacccgccgatcgaactccgtcgctaccgcccgcaacctcggggagcgctcctgcccctggcggacgcccgcctggcgcacgtctcggtgcggaccctgaccggtgccttcgtggcggcgaccggggtgacaccgctgcagtaccaacaggatctacggatggggcacgccgagctgccgctggccaccacggaccgggcggtggagcaggtggcgcgggactgcggatatgcggatccgcggcattttcggcggcttttcacccatcggtacggggtgtcgccgcgggcgttccgggcggcggtggcatgatgcggcgcctgctgcggatcgtgctcgctctggtcgccctctccggcggcctcatcgcgatcccggactacgccgtggccacggctccggagccacagatcgtggtcgtcccggcgttcaccgatcccgccgcggcggcggaggcccccctgcgggagctggtgaaccgcgtacaccgtcgtggtggtctggtcatgagcgtctgctccggcgccaaggtcctggccgcgaccggcctcctcgacggccgccgggccacatccttctgggccgacctgcccggcctgcgccacgaccacccggccaccacctggctcgccggcacccgctgggtcgaggacggcagcgtgctgaccacggccggcgtcagctccggcatcctcggcgccctgcacctggtcgaccggtacgccggtcccgccgaggctgcccggatcaccgcccgcctccactacccggacgccccggttcccggacgccacctctcgctcgccgactacccgtacggcctgcacgcggtgctgccctggttccagcccacctacggcctgggcctcaccgacggcgtgcccgaaacagacaccgccgcggcggccgagctgtacggcggcgtcggcttcaccgcccgcgtcgtcccggtcggcgaccaccgcatcgtcaccaccgcacacggcctgcggctggtcgccaccccgatcggcgacgcgccccacctggaccggctgatcgtgccgggcgtgaccgcgacgacgctgaccggcgcccccaccttcctgccgcggaccgcggcccggcccggcgactcggcgttcgacccggtcctgcgcgacatcgcccgcaccgacggccgggcgaccgccgtcacggccgccaagtacatcgaatacccggtgcccgacctgcccgcctccggccgcccgtggcggctcatcctgctcacgttcgcgctggtcaccgtcgtgatcgcgattgcggccggtcgatggcgcataaagcgggcgacgcagggcatccgggccgcatga

SEQ ID NO: 6501 - DNA, 453 bp, Actinoplanes utahensis
atggtcacccaccgcagcggcgccggcgatgccctggcggcccgcagtccgcttcgtaccgcggccctcgtcgtctccgtcgtctttctgctcgtcggcgtgctcggcttcgtcccgggcgtcaccaccgactacggcgacatgacgttcgccgggcaccactcggacgcgcacctgctcggcgtcttccaggtgtcggtcctgcacaacatcgtccacctgctgttcgggctggccggtctggcgctggcccgcaccgtccccggcgcgcgccggttcctgatcggcggcggcgcgatctacctggtcctctgggtgtacgggctggtcgtcggcgacgacgccgcggccaacgtcgtgccgctcaacaacgccgacgactggctgcacctcggcctcggggtcggcatgatcgctctcggcctgctgctgtcccgccgcgccgagcgctga

SEQ ID NO: 6502 - DNA, 2118 bp, Actinoplanes utahensis
gtggtgcaagagatctggccgggcaacagctatccgctgggcgcctcctacgacgggacgggcaccaacttcgcggtgttcagtgaggtcgccgacggggtggagctctgcctgttcgacgacgccggcaccgagacacggcaccggctgtgctcggtggacggcttcgtctggcacgggtacctgcccggcgtcgccgccggcacgcggtacggataccgggtgcacggcccgtacgacccggccgcggggctgcgctgcaacccggcgaagctgctgctcgacccgtacgccaaggccatcgactcggacatcgactgggacgagtcactgttcggataccgcttcgacgatcccgaggcgcgcaacgacctcgacagcggccggcacatgatgaaggcggtggtggtcaacccgtacttcgactggcgcaacgaccggccgccgcgcatcccgtaccaccagacggtgatctacgaggcgcacgtcaagggactcacccggctgcatccgggggtacccgaacacctgcgcggcacctacgccgggctcggccacccggcggtgatcgaacacctgacccggctgggcgtcaccgcggtcgagctgatgccggtgcaccagttcgtgcaggaccaccacctggccgagcggggcctgagcaactactggggctacaacagcatcggcttcttcgctccgcacaacgcgtacgccgcctggggccagcgcggcgagcaggtccaggagttccgggcgatggtgcgcgagctgcacgcggccggcatcgaggtgatcctcgacgtggtctacaaccacaccgccgagggcaaccacatgggcccgacgctgagcttccgcggcctggacaacggcgcctactaccggctcgtcgacgacgatccgcgctattacatggacaccacgggcaccggcaacagcctgctgatgcgcaacccgcacacgctgcagctgatcatggactcgctgcggtactgggtgaccgagatgcacgtcgacggcttccgcttcgacctggccgccacgctggcccggcagttccacgaggtcgacaaactgtcggcgttcttcgacctgatccagcaggacccggtcgtctcccaggtgaagctgatcgccgaaccctgggacatcggcgacggcggctaccaggtgggcaacttcccacctgcctggaccgaatggaacggcaagttccgggacacggtccgcgacttctggcgcggcgaaccggccaccctggcggacttcacctcccggctgaccgggtcggccgacctgtaccaggacgacggccgccggccggtcgcgtcgatcaacttcatcaccgcgcacgacgggttcacgctgcacgacctggtgtcgtacaacgacaagcacaacgaggccaacggcgaggacaacaacgacggcgagagccacaaccggtcctggaactgcggcgtcgaaggaccggccgacgacccggacgtggtggccctgcgggcacgccagcagcgcaacctgctggtcaccctgatgctgtcgcagggggtgccgatgctgctggccggcgacgagttcggccgcacccagggcggcaacaacaacgcctactgccaggacaacgagatctcctgggtcgactggtcgctggccgagtcgaacgcgtccctgctgaccttcacccgccggctgatcatgctgcaacgccggcacccggtcttccgccgccgccggttcctgcgcggcgccccggtgcacgaggccggcgaggcgctgccggacatcgcctggttcacccccgacggtaccgagatggccgacgagcactgggaggccggccacgcccggaccgtcacggtgttcctcaacggcgacgcgatcaccgagcagggccggcgcggcgaacggatcgtggacgactcgttcctgctgatgttcaacgcccaccacgaaccgctgcgcttcaccgcccccgaccccgggttcggcaaggagtgggccgtcgaggtcgacaccgccgacccggccgcggaccacgacgagacgctgacggccgccgagggcgtcgacctgcccggccgcagcatcaaggtcctgcgccgccgcgtctga

SEQ ID NO: 6503 - DNA, 258 bp, Actinoplanes utahensis
gtgcgcacgctgatcgtccggggcggctgggcgggccacgagccggccgccaccaccgactcgttcctggatctcctgcacgaccacggctgtgacgtacgcgtcgccgacaccctggacgcttatcgcgacccggtcgcctacgacctgatcgtccagtgctggaccggcgcccggttcaccgccgagcaggaggccgcgccgcacgatcaccggccgcgggatccggtgggcgggtggcagagccggcgaccgtga

SEQ ID NO: 6504 - DNA, 2379 bp, Actinoplanes utahensis
atgccgcgagcgccgcgggtggaggtccgacacatcggtcggagttttcctcacgccaccccgggcgaggccgatggtgacttccggacccgccctgcgagaagaacggcacgcccgatgcgcctgaagtcccgctccacccgcgcggcgcggctgctcgtcgccgccgcggggctgtggttgctcgccggtgtggtgttcggggtcgccggggtctgcatgccggtgccggtctgggggctgtggccgatcggggtcgcctcggtggccacccaggtcgtcgccgcgctgctcgccgcggccaccggggtcggggcgtgccgcctcttctggcgccggctgtcgatcgcgttcaccctgctcgggctggctgtcatcagccagacccgcgacgcggtgcagcaccccgggcaggtgatcgcgatgggtccgctgaccggggcgctgtactccgccgcggtgtgtctcgccgtggtcgccctggtccggctgcccggcccggtccgtagccggcgcgcgtcggtcgccgtctggctggacatcgcgatcgtctcggccgccgccgggatgatcgtggtgcagggcctgatcgttctgccgtccccggtgccggacgggccgctggccaccacgctgcgggtgatcgtggccgcggtggccagcgccgcggtgctggccatcgtcaaagccgggctgaccggcgccggcgcggtgccccgggcggcactctggttcctcaccccggccggcctgctcgggccggtctcgctggtgctcgccgccgcgttccggtcctggccgcacctgaacagcacggtcgccgcggtgctgccgctgggcgtgctgatcaccctgtccgccgcggcacagacccgggccaacctgacgtgctccgacacccccgacacctgggaggcgccgggcgaggtcgcccgccgcgccgggatcagccgggtcccgtacgttgcggtcggcgccaccgtgatcatgctgctcgcggtgacgctgcgcaccggctacctgccggccgggctggccgccggcgcggtggtgctgatcgtgctggtcctcgtccgtcagcacgcggcgctgcgcgacaacagtgtgctcgccgtccggctggccgaccaggccaggctcgacgacctcaccggactgccgaaccgccgggcgttcgtcgacgccctgcaggggcgcaccggcgacaccaccgtcgcggtctgcgacctggacgccttcgccgccctcaacgaccggctcggtgacgccaccggcgacgcgatcctgcggcaggccgccgagcggatcaccctgaccgtgggcggtacggcgctggtcgcccggctgctcggcgacgagttcggggtgctgctgccggccggccacccgctcgcggacggcgacgacctggccaccgcgctgctgcacgccttccaggcgccgctgcacgacctgctggtcacggtgaccgtcgggtcggccggcggccgcggtgccgccgtccccgacctgctgcgccgggccgagctcgccctgcaggccgcgcagcgggtcggcgccaaccggcaccagcaccacacgcccgacctggacgcctccgcccagcaccacgccgacctggccgccgcgctgcgtcgcggcctggaacgcggcgagttccggctggtctaccagccgatcgtggagttgccgctgggcaccctgcgggcggtcgaggcgctggtccgctggcacccggacggcggcaagccggtgtcgccggccgagttcatcccggtcgccgagcagaccggcatgatcgtcgaactcggcgcctggatcctcgacacggcctgcgccgacgcggccgtctggcagcgccggtacggcgccgccgcaccgcggatcagcgtcaacgtctccgcccgccagctgctggacccggaactgccggccctggtcgccgccgtgctcgaccggcacggcctcgctccggaccaggtcacctgcgagatcaccgagaccgcggtgttcgccggcggcccggccctgcacaccgtcaccgcgctgcgcggcctgggcgtcggcatcgccctggacgacttcggcaccgggcactcgtcgctgaccctgctgcgcacctgcccggtgaccaccctcaaggtcgacaagtcgttcatcgacgagctcaacggcagcccgcagcaggaggcgatcgccgcgtcgctgagcggcatcgcgaccaccctcgggctgggcgcggtggccgagggcgtggagacgcaggagcaggccgaccggctgctcgacctcggctaccgctacgcgcagggcttccacttcgcccggccggcgccggccgccgacatcgacgcgtccctgctggcggccgtaggctga

SEQ ID NO: 6505 - DNA, 1920 bp, Actinoplanes utahensis
atgtcgcggggacttgcatatctggatctgctcgcccgcgaggccgccctcgtcgagttcgagcggccgctgatcgccgcccgggccgccggtgcccccgccgccgagctcgacgacctggagcaggcgaaactgctcgcgctgcgggtgcgggcactgctcgaacgccgccgccggcgcgaggaggagctgtccgcgctgtacgacacggccggcgacctggccgggctgcgcgacgtcgacgcggtgttgcgggccatcgtgcaccgggcccgcaccctgctgaacgtcgacgtgtcctacatgacgctcaacgaccaagagcgcggcgacacgtacatgcggatcaccgacgggtcggtcgccgccagcttccagaacctccggctgccgcccggcgccggcctgggcgggctggtcgcgctgaccggcaccccgtacgcgacggcgaactacccgaccgacgcccggttcgcgcacaccaccgacatcgacatgggggtcggcgacgagggcctggtcgccatcctcggcgtgccgatgcggctgggctccacggtgatcggcgtgctgttcgccgccaaccgggcggagcggccgttcgcccgcgaggaggtcgcgctgctgctctcgctggccgcgcacgcctcggtggcgctggacaccgcccggctgctcagcgagacgcagaccgcgttggccgaactgtccgcggccaacgccaccatccaggcgcacagcgcgtcggtggaacgggcggccgccgcgcacgaccggatgaccgccctggtgctgcgcggcggcggggtcgacgacgtggccgccgacctggtcgacgtactcagcggcgcgctgctggtgatcgacgcgcacggccgcacgctggccaccgcgcgcacccggggggtcgcggcgaccctgcccgagccggacgggagcacggtggacgaggcggtggcggcgtcgcgcggggagggccgcagcgtacgccgccatgatctggtcatcgcggcggtcgtggccggcgccgacaacctgggcgccctggtcttccgccccgacccgggcccgctcgccgccgccgaccagcggatcctggaacgcgccgcgcaggtcaccgcgctgctgctgctgtttcgccggaccgtcgcggaggccgaggcgcaggtccgcggcgacctgctggacgacctgatcagccggccggtgcgcgacccggacgcggtgcgcgaccgagccggacggctcgggctcgacgtcgacgcgccgtacgtggtggtggtggccggcgaggacaccggcgacgggctgcggcagcgcgcggtctcctgggcgcgcaccttcgccgcggggcggcgcgggctcgcgatgagccgtgacgcccgggtgacgctgatgctgccgggggaggatccggccggcaccgcccggcaggtggcccgcgagctgagccgggcgctggggcggccggtcaccgcgggcggggccggcccggtccgcggcgccacggcggtggcgcccgcgtaccgcgaggccgatcaatgcctgagcgcgctgatcaccctcggccggtccgggaccggcgcgggcaccgaggagctggggtacgtcggtctgctactcggcgagcgccgcgacgtgaccggcttcgtgcacacggtgctcggccccgtcgtcgagtacgacgagcgccgcggcaccgcgctgaccaccacgctggaggtctacttcgactgcggtggcgggctggcccgggcggccgacgcgctgcacgtgcacgtcaacacggtcacgcagcggctggaccgggtggcgcagctgctcggcgacgactggcagcatccccgccgcgtactcgatctgcaattggctcttcgtctgcatcgcctgcgcgcgccgctggcggtcgaccacacctag

SEQ ID NO: 6506 - DNA, 1389 bp, Actinoplanes utahensis
atgcacatgtcgaccaccacacgtgccccgatcgtcaaggtcgtcttcgcttcgctggtcggcacggccgtggagtggtacgacttcttcctctacggatccgccgccgccctggtcttcggcaccctgttcttccccaaatccgacccggtcaccggcaccctgctcgccttcggcacctacgccctgggcttcgcggcccgcccgctcggcggggtcgtcttcggacacttcggcgaccgggtcggccgcaagaggatgctgatcgtctcgctgatgctgatgggcgccgccaccgtcgcgatcggtctgttgcccacttaccctcgcatcggcgtcggcgccccgatcctgctgctcatctgccggctcgcgcagggtttcgcggtcggcggcgaatggggcggcgcggtgctgatggccgccgaacacggcgacgacgcccgccgcggcttctggtcctcgtggccacaggccggtgtggcgctcggcaacctgctcgccaccggcgtgctgtggctgctcgccctggtccagtccgacgaggccttcaagagctggggctggcgcatcccgttcctgctcagcgcggtgctcgtactggtcggcctgtgggtgcggctgagcatcgaggagtccccggtcttccgggaggcgctcgccgcccgggcggaccgaccacaccggccgctgctcgaagtggtccggagatacccgcgggagatcctgctcgcgatgggcatgcggctcgccgagaacatcgggtactacctggtcaccgtcatctcgatcacctacctgaccacgttcgccgggacctccgcggacaagggcaagatcctcaccgcgctgctgatcggctcggccgtccagttcgtgctggtgccgctgctcggcgcgctctccgaccggatcgggcgccgcccgctctacctggccggcgcgatcggcatggcgatctggtcgtacgtcttcttcgggctggtcggcagccgcagcgaaccgcggatcgtgctggcgatcctggtcggcctgatcctgcacagcctgatgtacgccccgcaggccgccttcttcgccgagctgttcggcacgtcggtccgctacaccggcgcgtccgtcggctaccagctcgcctccatcctggccggcgcgctggccccgatcatcgccctcaccctcctcggcgacgtgcaccacccgaacaccacggcggtggccgtctacatgaccgtcgcctcggtgctcaccgtgatcgcggtcctcgccgccaaggagaccgcccgcagttcgctgagccacgatcgcggtttcgaggaggcgccggcgccggcctccccgggggtgccggccggcagcacggtacgggggtccggcagccggtggtag

SEQ ID NO: 6507 - DNA, 594 bp, Actinoplanes utahensis
atgctcttcggcggcccggtcgtcatggccgggccgctgctcgcggtgctgatcgtcgacgggctcgggctgccgccgccggcctacgggctggccctgggggtgccgtgcgtcggcgggatcgtcggatcccggctggcaccggtgctggtgcgccgattcgggcagcggcgggtgttgctcgccgccggggtgctgcgcaccccgtggatgctgctgtatccgctcgcgcggcacgggaccgccggtctcgcgatcgtcatggtcgccgacacgctgacgctcacctgcgcgggagtcttcaatccggtgttcgccacctatcggatgaacgtgaccgccgacgcgtacatgacgcgggtacggacggcatggggggtcagcgccaagaccgtgcagccgctgtgcgtcctggccggcggtgggctggccgcactcgtcggtgtgcggaccacgctgttcctcgccgggctggcctgcctggcgagcggcgtgctgctgccgttccgttcactcgccgacgacggggatcaccgggccggcggcgccggtctctcggtcccgcggaggtgtcgtacccccggggcaggatga

SEQ ID NO: 6508 - DNA, 1080 bp, Actinoplanes utahensis
atgcaccggcgacacccgacgacggctgccggcctgatcgccgccgccatcgtcagtgccatcgtgtcggcgccgacccgggcggcggccgcggacccgctggtgccggccaccgaccggcaggtgacgttcgtcgtcgacggcaccacgacctacggcaccgtgcacgttccggcgcaccatgccgggaaacgcctgccggccgccctgctgctgcccggcagcggaccgacggaccgtaacggtgaccagctgccggctttccccgtgcacaccctgacccggatcgcggatgtgctggacacccagggcgtcatgtcgttgcggttcgacaagtacgggaccgggcagaccggtctgggcgccttcaccggccgtctcggagagctcgactacccggcgcagctccgccaggccgcggccgcgtacgcactgttgcacggtcagccggaggcggaccggcatgcgatgctgctgttcggtcacagcgaaggcggcctgtcggcgctcctgctcgccgcaacggtgcgtccgcggccgagcggtctggccttactggagccgctggaccaacgcttcctcgaccgggtacgcggtcagcagtggtggaggatcgaccaggctcgcgccgccggcgagatcacgcccgagcaggcgaggcaggacaaggccggggtcgctcgcgtcatctcccagtttcgggccggccggcccgtcgacttcggcggcctggatcccggcctggccgctgaactgaaactgttcgtgaccgggtatgtcgagcggtacatgcggtccatagacgccatcgatcccgcccaggtcgccggcgacctgccgcaccacctgcgcaccctgatcacctgtggcaccgacgacgtgaacgtgccgtgcgagtccaccggtgccctggtcgccaccctgcacaagatcggcagcaccgggccgggcctggttaccctcccctccgtggatcatgagctgcacaccccgggcgctgccgtggacgggccgctggcacctgccgcggtagcggcgatcaccaccttcaccgcccggtggtcgcaccaggagtgctga

SEQ ID NO: 6509 - DNA, 231 bp, Actinoplanes utahensis
atggatttcgacggtagagccacctcccggatgacggctggccttccccagaccctgcacagcgggctgacgccgttgggcgagatcgagcaggcgacgaagatcgccgccgggttgaaggtgccgaggcacggctggcgcaaggcggtggtcaccatcggcgtcgggctactcgcgctggcggccgcggccatcctggtcggcttgctgctggccgacgcgcagcattga

SEQ ID NO: 6510 - DNA, 819 bp, Actinoplanes utahensis
gtgggaaagtcggaacagtctgcgtcctacacccggcggctccgcccacccggccgccagcatgcccgcccgcccggcacgtggggtctctggacgccgccggtggaccgctccggtcgtaccgtcaaggtcgccctcgacgcggaacgcgttgaactgaaggtggtcgccaccgagcgcgcctgccgcaggctggacctggaacgccacgccggccagacccgccgggtctacttcctggacacgcccgacctggccctcgaccggcacggcctgatcgtccggatccgcgacctcggcggccggccggacgacgcggtggtcaaactgcgcccgatgggcgcgcacacgctgccgaaatggctgcgccgcaccaaccgtctcgaggtcgagatcgacgcgatgccgggtcggcgggtctgctccggctcgctcaaggtccggctgggccgcgacgtggtcagccgcaccgtcgccgccgggcgtcccctggccaagctgctggcgcagccgcagcggcggctgctgtcggcctgcgggccggacggggtgtccctcggcgacctggtcgtcctcggtccggtcgaggtccgcaagcagaagttccagccggccggtttcgaccgtcaactgtgcgcggagcggtgggccttcccggacggctccacgattttggagctgtccacgcgctgcccggtcggcaaggcgcccgaggtggcggcccggctcaccgacgtcctcgcggcgcacggcatcaccccggtcgagccgcagcacaccaagagcgacctgacgctgcgctatttcagctgcctgtag

SEQ ID NO: 6511 - DNA, 1926 bp, Actinoplanes utahensis
atgaccacgacggatgggaaaccggcagaggtttcggagaagcaggcgcggcaggtggccgaggccgcccgcgaatccgagtggcgcaagcccagtttcggtaaggaactgtttctcggccgcttccagctggacctgatcgatccgtggccggccgcgccggaccggcccgacgccgacgaattcctccgtaaactcgacgcctacgtccgccacgacatggacggcgggcagatcgaacgggacgcgcgcattcccgacgaggtgttccaggaattggggcggctgggcgcgttcggcatgaagatcgacaaggattacggcgggctcgggctgtccaacctgcattactgcaaagcgctgaccctggtcggttcggtgaacggggcgaccgccgcgctgctgtccgcgcaccagtcgatcggcgtgccgcagccgctgaaactgttcggctcggccgcgcagaagaaggcgttcctgccccggctggcggcgggcgaggtgtcggcgttcctgctcaccgagccggatgtcggctccgacccggcccggctgggcaccaccgccaccccggtggacggcggcttccggctcaacggggtgaaattgtgggccaccaacggcacggtcgcgaccctgctggtggtgatggcccgcgtgccggagaagggcatcaccgctttcgtcgtggagggcgatgcgccggggatcaccgtcgaacgccgcaacgcgttcctcggattgcgcggcctggagaacagcgtcacccggttccacgacgtgttcgtgccggaggagaacgtgatcggcggcctcggcaagggactgcggatcgccctgaccacgctgaacaccgggcggctgtcgcttccggcgatgtgtgtcggcgccgggaaacgggcgctggcgatcagccgggaatggtccgcggaccgggtgcagtggggccgggccgtcggcacccacgaggcggtggcgaagaagatcgcgttcatcgcggcaacgacgtacgccatggaatcgatgttggatctctgctgtctgatcgccgacgacgcgcgcaacgacatccggatcgaggcagcgctggtcaaactgttcgccagcgagatggcctggcagatcgccgacgagctcatccagattcgcggcgggcgcggttacgagacgggcgattcgctgcgggcccgcggcgagcgcggcgcggaagccgagcagatcctgcgtgatctgcggatcaaccgcatcttcgagggttcgaccgaaatcatgcacctgctgatcgcgcgggaggcggtcgacgcgcacctgtcggtcgccggggacatcatcgacccggacgccggcctgacccgcaaggcccgcgccggggcgcgcgccggcaggttctacgcccggtggctgccgactctggcggtcggccgggggcagaatccgatggagtacgcggattacggcccgctcgccgcgcacctgagatacgtggagcgggcatcgcgcaaactcgcccggtccacgttctacgcaatgtcccggtggcaggggaaactggagcgtaaacagggcttcctgggccggatcgtggacatcggcgccgaattgttcgcgatgtcggcgacctgcgtgcgggcccacgcggaaaaggaccggcagccggccgggctggaattggccgacctcttctgccggcaggcgcggctgcgcgccgaggcgctgttcgccgctttgtgggacaacaccgacacgctggacgtgaaggccgcccggcgggtgctcgacggacgctacgcgttcctggaggagggtgtggtcaacccggcctcggacgcggcctgggtcgctccgtggcagcccggcgccgccaccgtcgatgacgtgcgacgccggatcccgcccgcgacctcaggtaatgttcaggaggcatag

SEQ ID NO: 6512 - DNA, 825 bp, Actinoplanes utahensis
atgccacacccgttgagcatgatccgccgcatgtccgagctcgtcgagccgatcgggacggtgaccttctcggcgatcccgaacgaggagttcctggccgtcggcatgcgcaactactgggacggctacttcgccggccgggccgcgccgctggggcgggcgccggccgaggtggtgcacgccgtcttctacaacttcgccgagggcgaggtggcgcggcacattccgtgggtgtgggggaaggtcagcccggaggaggcgttggtcctgcgggaacggggcagtgccgccgcgctgcggggactgatcggggagctcgcccactcccccgcgctgccgcgggtcaacgagctggccgagcgggcggcgttgagcgcgccggtcgccggccggccgctgtacgccgggctcagggcgctcgccgtgccgcgggagccggtcgcccggctgtggcatctcgggacgctgctgcgcgagcatcgcggcgacggccacaacgccgccctgctggcccacgggatcggcggcaccgaggcgcacgtgctgctcgcgctgaccctcggcatgcgggccggggagttcggccggctccaccacctgcccggcgcgcagctcgccgcggtggtcgacgggctgcgcgagcgtggcctggtgaccgcggccggcgggttcaccgacgcggggcgtcagctccgggaccggatcgagatcgtcaccgacgagctggcggcaccggcgtacgacgttctcgacgcggacgagctggacgagctgatcgccgggctggagccgttcgccgcggcgattcgggccggcgaccactag

SEQ ID NO: 6513 - DNA, 1188 bp, Actinoplanes utahensis
atgccgacggccaggaactcctcgttcgggatcgccgagaaggtcaccgtcccgatcggctcgacgagctcggacatgcggcggatcatgctcaacgggtgtggcatcggtcagctctcctacggtcccggcggtgccgtccggcccgcctctcgcccccgctacgaatgctccgccccgcatccgacaaccgccggccacttctttgtccgaccacccccgggtagcctgcggtcgatggccggatctgatcgtccagggcgggaaacgcaaccgctgacgctgcgggtgatgacgccggagtcgttccggcggcgccgcgccgaaatggtcatgcggtatgccgtggcgggcggcgaagcagcggaggcggccgccgcccgccagatcgacgcggcgctcccgggcggtccggacacccccggggagttgctgcggtcagcctggtccgggccgcacgaggtcggctggatctgggcctcgatgccgggccgggtggtgccggacctggcctggatcgacgaactggtcgtcgacgagggcttccgccggcgcggattcggcgaggcgatcatgcgggcgacggaggccgcgctggcggccggcggcgccacccgggccgccctgaacgtcttcggcggcaacgacggcgcccggcggctgtacgagcggctcggctacacggtcaccctccaggagctcaccgccgtcccgtacgcgtcgccgcccggcccggtcacgctcgtcccactggccggcccggccgcccggatcgaggcgtccgtcgccgcgacagcggcggagttcggcctcggcccggtccaggcccgggagcgggtcatggcccggcagacaccggcgacggtcaacgccgcggtggtggccggcgggcgggcggtcggctgggtctcgtacagtccgcgacacttctcccggccccggtccggcggcatctaccggctcgacatcgacccgccgtaccgatccgtcggctacgggacggccgccgtccgggccgtcctgacggaactcgccggcctgcccggggtcctgacgagcgtgccgcggcccgccgtctggctgcaccggctcggattccggctgtcggcccagcacatggcccacgagctgccgacgggcggaaagcggcgacgccgggccgggtcggcgggtgaatcgtgcacatag

SEQ ID NO: 6514 - DNA, 432 bp, Actinoplanes utahensis
atgtcgctgagccagatcatcctctcgtgcggacgggcgattcagctcaccgagctgcggatgtcttccacctacgcaacgatgctggagggctatccgtgccggcccgtcaacgacatgagagtgagcggcctccggcaacaggccgaacgtgcgtttcccgccacgccggtccacctggttccaccctcccgcgactacccggatcaggcagccggcgccttcggccccgtcgaggtgttgccttccgtggcctgtctcggcgcgttccgctcgacggcgatcgccgccgagctcgaccccgcgctgcaccggtccgccctcatcgtggtctggttccaggccgtcccggatgtcccgtccggagaggacgccgaccctgcgcttcgcggcatccgctgggcggaggtggctgaggactacgagctctag

SEQ ID NO: 6515 - DNA, 1050 bp, Actinoplanes utahensis
atgtgcccggtggcgccggtcaggaagaccttcatggtggagctcctcagtcgatccgatgtctcgccccacagcctgccgcgcctcagcgttcgccaccaacgaacagttccgattcgttccatcgccaaaggcgattactctggccgggtggaacagcgccaactggaatacttcgtggccgtcgccgaggaactcaacttcacccgggccgcccagcgcacccacgccgtccagtcgacggtctcggccagcgtccgcgcgctcgaacgtcatctcggcgcgcccctgttcgaccgcagcaccacccgcgtcgccctcaccgcggccggcaaggcgctgctgcccgaggcccggcgggcgctcgacgccctcgaccaggcccgcgccacggttaccggcctgcgcgcggggctgaccggcagcctgcgcgtcggcaccctgtccggcctgaccgccatcgacctgccggccctggtcagcgacttccgcacccggcatcccggcgtgcggctgagcctgagcatggccgccggcggcaccgacgggctgctcgccgcggtccgcgcccgcgacctcgacgtcgcgttcgtcggcgtgcagacggcgagcgtccccgacctgcagctcgacccgatcgccaccttccagccgcgggtcctcgtcccggccgggcacccgctggccggggcgggcacggtcaccccggccgggctcgccgacgagccgttcatcgacctgccacccggcttctgcaaccgcatccgcaccgaccacgacttccgccgggccggcatcgcccgcacgatcgccgtcgaggtcagcgacataacgaccattccggggtacgtcgaggccggcatcggcgtcgccctggtgccgccgctggccgccgaggtcggccgccgggtcgccgcgatcgacctggacccaccggccgcgccctggaccctggccgcggccagcctcggcaaccccactgcgaccccggccctgcgcgccttcctcgacctggtcgccgcccacgtggtccgccgggaccgctattag

SEQ ID NO: 6516 - DNA, 870 bp, Actinoplanes utahensis
atgaaggtcttcctgaccggcgccaccgggcacatcggctcggcggtcctgcccgccctgctcgccgccggccacaccgtcaccgcgctggtccgttcgccggagaaggccgcccccggcgccgaggtggtcgtcggtgagattcaggaccacgagggggtacgtcgttgggcggccgccgcggacgccgtgatcgccaccgcgtcgccgggtgacgcgtcgagcagcacggtggagacggcgttcgccgaggcggtcctcgacggtctgcggcccggcgccacgttcctgcgcaccggcggcgtctgggtgcacggctcggcgccggacatcaccgaggacaccccgcgcaacgcgccggacctggtcgcctggcgggagaagctcgactcccgggtgctggccgcgcccggcatccggtcgatcctgatcgagccgggtctggtctacggcaaccacgccggcatcccgaacgtggtgttcgccggtgagcgcgccggcgacccgcccgcgctgcgcctggtcggccccggcacccagcactggaccagcatccacgtcgacgacctggccgagctgtacgtggcggccctcgaccgggcggcgagcggctcggtgtatctcggcgtcagcggtgacaacccgacggtccgtgagctgggcgaggccgcgtcccggcggctgggcctcgacggccgggtggtcgccgaggagccggccgcgctggtcgagcggctcggcggattcggcgcggcgctgctgctggaccagcaggccaccggtgcgaaagcgcgtcgcgagctgggctggaagccgtcgcgccggaccctgctcgaggagatcgcggccggcgggtacgacccggcgtaa

SEQ ID NO: 6517 - DNA, 747 bp, Actinoplanes utahensis
atgatcgggaactgggtcgacggcgtggaacgggtggcggtgctcaccggtgcggggatctcgacggattccgggatccccgactaccgggggccggccggcgtctggaccctcgatccggcgctggagaaggcgttcacctaccggtcgttcctggccgatccggccgcccgggccgcgttctggcgggcctaccgcgggcacccggcctggcgggcccggccgaacgtggcacaccgcgcgctcgccggcctggaacgctgcggtgtcgcggtgcgcgtgctcacccagaacatcgacggcctgcagcagcgtgccggatccagcccgcgcaaggtgctcgagctgcacggcagcatgcacgaggtggtctgtaccggctgcggcgtgcgcaccccgagcgggccgacgatggcccgggtggaggccggtgacaccgatccgcggtgcaccgcctgcggggcggtgctgaaactggcgatcgtgttcttcggcgaacacctcgacccggacaccaccgggctcgccgagcggatcgccgcgaacgcccagctgatgctggtcgtgggcagttcgctgcgggtcgagccggtcgcctcgctgtgcgcggtcgccgccaacgccggccaccgggtggtgatcgtcaaccgcgatccgaccccgtacgacgacctggccgtcgaggtcatccgcgaaccgatcggcaccgccctgccggagatctgcgccgccctccgcggggcctag

SEQ ID NO: 6518 - DNA, 186 bp, Actinoplanes utahensis
gtgggctgccgcccggcgccgggcttcccgggcacgggtctcccgccgatcggatctccggccgatcgcgtcttctcgccgatcgcggcgaagagctcagccgcgggtcaccgggcggggatcgccgccgccgggtcgccgtcggccacctcggcgtcggccggcgccgcaatcgacggtcattga

SEQ ID NO: 6519 - DNA, 918 bp, Actinoplanes utahensis
gtggtcggggtggggaacaacacctcggcgctggtgcaggggatcaacttctatcgggcgaccgggagcctgaccggtctctgccgcccgcacatcgaggggctcggtgtcggggatgtcgaggtggtcgccgccttcgcgatgtccgacgccaaggtgggcgccgacctgcacgacgcgatcttcgcgccgccgaacaacttcccgcggatcggtggggagctgccgccgtccggggtgaccgtccagcgggggctcaccggtgcggacgggatcgagcggatcgccgaggcggtgcggggcgccgaggtggtgctctattcggcgccgagtggccgggcgggggtggccctcgcgtacgccgaggccgcgctggccgcgaaagcggcgttcgtcaacacgaccgcggatccggtggcccgccacccggagctgctgcaccggttcagcgcggccggtgtgccgctgatcggggacgacctggccagccagttcggcacctcggtgctgcaccacgcgctgctgcggctgctggacgagcgcgggttgacgttggacagctcctatcaggtgaatctgggcggcaccgaggacttccgcaacctggtggacaacccggagagcaagctgcggtcgaagacgaacggcatcggcaccggccgggtggcgatcgcgcccctgggatacctgccgcacctgggggcggagaaggtcgcccacctcaacatcgaggcgcgggggtgggcggggacttcggtgagtgtcgacgtacggctgaaggtcaatgatccgagcggcgccgccggtgtcaacatcgacctggtgcggctggcggccctggtctcgcggcggggccgcgggggtttcccggcggaggcggccgggctgctgaagtcgccgcccgggacggccgtctag

SEQ ID NO: 6520 - DNA, 693 bp, Actinoplanes utahensis
atgccgaaagcggtggtcagcgaggatcggcggcgtcgccggcggcccacccgcagtggtcgcgttctgtccgaacaactgatcatcgatacggcgttacgcctgctcagagagcacggcagcgccgccctgagcgcccgccggctgggcctggccctggactgcgaccccagcacgctgtaccggtatttccgcggcatggacgacctcaccctggcgatcggcgacaccctcatcgggcaggccctggagggctggcgtcccaccggacagtggcgccccgacctgcgccggctcggcctgcgcatccacgccgcctatgtcgcccacccgcaggccgccgtgctgaccaccagccgggtcaccggccgggccaacgagctcgccgccgacgaggcggtgctcggcgtgttgcggaccgccggcctcccggtgcccgaagcggtccgggcctatcacgtcttcatcgaccagacgctggctttcgccgccctcgacgccgcgtcgctggccctgcccaacgccgcattgcgcgccgaggacgaggtgtggcgctccacctacggtcacgtgcccgcggccagccacccgcacctggccgaggccggtccgctactggccaccgagatggtgaccagcgcctatccgtccgcgttggacctgctgctggacgccgtcgaagcccgcctctag

SEQ ID NO: 6521 - DNA, 1248 bp, Actinoplanes utahensis
atgcgtgtcctgctggtgggagcaggcggcgtcggcacggcgatcacccggatcgcggcgcggcgcacgttcttcgacgagatggtggtcgccgactacgacctgggccgcgcggaggccgcggtcggttcggtgggtgacccgcggttccgggcggcgcgggtggacgcgtccgaccgggcggccgtcgtcgagctgctcgaccggaccggttgtgacgtcctgctcaacgccaccgacccgcggttcgtgctgtcgctgttcgaggcggcgcaggacgccggcatcacctatctggacatggcgatgtcgctgtcccggccgcacccggaagcgccgtactccaagaccggtgtcaagctcggcgacgcgcagttcgccgagcacccgacgtgggccagcaagggtgcgctggccctggtcgggatgggtgtcgagccgggactgtcggacgtgttcgcccggtatgcggccgacgagctgttcgacgagatcgatgagatcggcgtccgtgacgggggcaacctgaccgtcgacggctacgatttcgcgccctcgttcaacatctggacgaccatcgaggagtgcctcaacccgccggtggtgtgggaggccggccgcggctggttcaccacgcccccgttcagcgagccggaggtgttcgacttccccgaggggatcggcccggtgcagtgcgtcaacgtggagcacgaggaggtgctgctgatcccgcgctgggtcggcgcccgccgggtgaccttcaagtacggcctgggcgaggacttcatccggaccctgcgcacgctgcaccagatcgggctggactccaccgacggcgtgatcgtgcccggcccgaacggcccggtcaccgtctccccgcgcgacgtggtggcggccagtctgcccgacccggccacgctgggcgaccggatgcgcggcaagacctgcgccggcacctgggtgcgcggggtcaaggacggcgagccgcgcgaggtctacctgtaccacgtggtcgacaacgagtggtcgatggccgagtacggcagtcaggccgtggtctggcagaccgcgatcaacccggtggtggcctgcgagctgctggccaccggcgcgtggaccggcgccggcgtgctcgggccggaggcgttcccgcctcgcccgttcctcgacctgctcaccgagtacggctccccgtggggtctgcgtgagcaggcggtgtccgcaccggtgggcgccacggtccactag

SEQ ID NO: 6522 - DNA, 1167 bp, Actinoplanes utahensis
atgaggcggcgttccctcgccgacgtcttcagccggcgttacgacgagttcttccgtgaccgcaccccgattcccttcgagatcctgacccgcgacggcgccaccctcgcctacggcgccggcgggtccactccggccgagttccgcatcgtggtccgtgacgacacgggccacgatgcgctggcctccctggaccagttgcaggtcgctctggcctacctgcgcggagacatcgacatcgagggcgacctcgcggcggcgctgaccatgcgccggttcttctccgacatccatccggtcgccttcgtgggccggtgggccccctcgctgtggcacggcaaggccggccacgaccggcgggccatctcgcagcactacgacgaggagtcggacttcttcctcaccttcctcgacgaacggcaccgctgttacacgcagggcgtcttccacggcgacgacgagcccttggaggacgcggtcacccgcaagctggacatcgccctcgacgacatcggggtgaaaccgggcgaccgggtcctcgaggtcggcggcgggtggggcgcgttctccgagcacgccgcccgtcgcggcatcgacgtcaccacggtcaccctggccgtggagtccgagcggttcctcaaggacctcttcgagcgggaacgtcttccggtcaccgtcgtccgggagcacattctgcagttccgatccgatcagcggtacgacgcgatcgtgaacatgggtgtcaccgagcacctgcccgactacggcgccaccctgaagacgtacgcccggctgctgaaacccggtggccgggtctacctggacgcgttggcgatgcgccgcaagcacaccgcctccaccttcttcaagcagtacgtctatccgggccggtccgccccgctgctgttgcaccagtatctgcagcaggtggcccggtccccgttcgacctgctcagcgtgcaggacgatcggcacaactactatctgacctgccgggagtgggcgaaacgcctggacgcccggcgggaggagatcgtcgcccgctggggtgaggagctctaccgccggttccggatcttcctgtggggctcggcgtccgggttcgacacccggctggtgcaggcctaccggtggacgctgcagtacaacccgtcggcgaccgcctga

SEQ ID NO: 6523 - DNA, 672 bp, Actinoplanes utahensis
gtgcccggagccactggactgccgctcgcccccttcctggcgtcccgcgccgacaactacgacgggttgcgcctggtccgcccgtccttcgtgccggagctggtgctgcacctggccgacgacgcgatcgtgctggaggcccggctcgaggcgcaggccggtacgtcgtaccacccgttctggaccaacgcctgggccggcggtcaggcgctggcccgctacgtcctggaccatccgcgcctggtcgccggccggcgggtgctcgacgtcgcctgcggcggcggcgtcgcggcgatcgccgcggccaaggccggcgcggcgagcgtgaccggcaacgacatcgacccgtacgcgtgtgccgcggccgcgatgaacgccgacgcgaaccgggtgcggctggccacggtcgagggtgatctgctcggcggggacgccggtgacgccgaggtcgtgctggtcggggacgccttctacgacagcgccctggccgaccggatgggcgccttcctgcgccgggcggccgatcgcggcgcggagatcctggtcggcgatcccggccgggggcacgtgccggcgtggctgcgggagctgaccacgtaccggatcagtgggctgggcgccgcgcaggacgccgcgatcaccgaggtttcggtgctcggcgtgttacggtga

SEQ ID NO: 6524 - DNA, 204 bp, Actinoplanes utahensis
atggccaccggcaccgtcaaatggttcaacagcgacaagggcttcggcttcatcacccaggatgacggcggcccggacgtgttcgcgcacttctccgcgatcgccacctccggcttccgcagcctggaggagaaccagcgggtggagttccaggtcacccagggcaccaagggactgcaggcggagaacatccgcccgctctga

SEQ ID NO: 6525 - DNA, 1350 bp, Actinoplanes utahensis
atggaccgccccctgagggttgccgtcatcggagccggcccggccggcatctacgccgccgaccacctcatcaaagccaacccggacgtcaccgtcgacatcctcgacaagctgcccacgccgtacgggctgatccgctacggcgtcgcgccggaccacccgcggatcaaggagatcatcaccgcgctgttccggatcatggacaacccgcgcatccggttcatcggcaacgtggcgtacggcatcgacgtcaagcccgaggaactcaaccgcttctacgacgcgacgatcatcgcgaccggcgcggagaaggaccggtcactcgacatcccgggcatcgacctgcagggcagctacggtgccgcggacttcgcgagctggtacaacggccacccggacgtaccgcgcgactggccgctggaggccagggaggtcgcggtgatcggcgccggcaacgtcgccatcgacgtggcccggatcctcgccaagaccgccgacgaactgctggtcaccgagatcccggacaacgtgtaccaggcgctcgagcgcagcccggtcaccgacgtgcacctgttctcccggcgcggcccggcccaggtcaagttcaccccgcaggagctgcgcgagctcgaccactcgccgaacgtcgaggtgatcgtccacccggagggcatcgagttcgacgagggcagcctcgaggcgatgcgccagacccggcacgtcaagatgtgcgtcgacatcctgcagaactgggcggtccgcgacccgcgggaccggccgcgccgcctgcacctgtacttcctgcaggccccggtcgaggtgctcggcgaggacggcagggtggtcggcctgcgcaccgagacgcaggagctgaccggcgacggctgggtccgcggcaccggcgagttcaccgactggaacgtccaggcggtgtaccgggcggtcggctacctcagcagcgcgctgccggacctgccgttcgacaccaagaccggcaccatcccgcacgccgccggccgggtgctggacctcgacggcgaccacatcccgggcatgtacgtgaccggctggatcaagcgcggcccggtcggcctgatcggccacaccaagggtgacgccggcgagaccgtggccagcctcctggcggacctcgactcgctgccggcggcgccgcagcacgatccggccgaggtcgtcgcctacctggagcagcgcgggctgccgtacaccacgtgggccggctggcagaggctggacgcgcatgagatcgcgctgggcgagccgcacggccgcaagcggatcaaggtcgtcgcgcgcgacgagatgaccgggatctgcaacaactcctga

SEQ ID NO: 6526 - DNA, 450 bp, Actinoplanes utahensis
atggcaaacaccgagcgcgtcctggatgtcctgatcgtcgatgacgatgacgccgacaccctgatgatcgaggaggcgctgctcgacgtggagccggccccggccgtgcaccgggtctccgacggcagcgaggcgatcgactacctgcgccgccaggggccctatgcggacgcccgccgccccgacctgatcctgctggatctcaacatgccgcggatgggcgggcacgaggtgctcgccgaggtgaagaacgacgaggcgctcaagagcatcccggtggtggtgctgaccacgtcgaacgcactgccggacatcaccgcgagctatgcccggcacgcgaacgcgttcgtcaccaagccgatggatctcgacggtttcgaggccgcggttcgcaagatcaggaagttctacggcgagaccgcggtccttccgggggacaaggaatcgtga

SEQ ID NO: 6527 - DNA, 648 bp, Actinoplanes utahensis
atgagacccggcatcgacatcccggacgcccgcggccgcaccggcctcgaccggatcgggcgcgacctgaccggcaaccccgacgtggtggtgcgggacgtggaggtgttggcgaccgcctggcacgtgctgcgtcgcaccacctacgactaccgtcgctcggatggcacgtggagccgggagcagcgggagacgtacgaccgcggggacggcgcgaccgtgctgctctacgacgacgagcgggagacggtgctgctgacccggcagttccgctatccggtgtacgtgagcggccacccggacgggatgttcctggagaccgcggccgggctgctcgacggggacgatccggcggcggcgatccggcgggaggcggccgaggagctgggagtggcgatcggtgagctggagcgggtgttcgcggtgtggacgagcccggggtcggtgaccgagcggctgcactgtttcgccgcgccgtacaccgcggcgtcccgggtggggccgggtggcgggctggccgacgacggggaggacatcgcggcggtggagctcgccctcggacaggcgctggagatgatcgggaccggcgagatcgccgacgcgaagacgatcttgctgttgcagtggttcgcgctgcggaaacgatag

SEQ ID NO: 6528 - DNA, 759 bp, Actinoplanes utahensis
atgctggcggcggagcgacgcgacgtcctgctgcaccggctgcggaccgacggcaaggtggtggccaaggaggtcgcggccgccctcggcgtccccgaggacacgatccggcgcgacctgcgggagctggccgcggccggtctctgccagcgggtgtacgggggagccctgcccgtgtcgcccgccctggccgactacgcgacccgcaccaccctggccaccttgagcaaacagcgggtggcggccgccgcggccgcgctgatccgacccggttccacgatcctgctcgacggcggcacgacggcgctggcggtgaccgcggccctgcccgccgacctgcgcgcgacgatcgtgacccacagcccgaccgtggcggccgccctggtcgcgcacccggcggtcgacgtccacgtgctgggcgggcggctgttcaagcactccgcggtgacctgcggcgcggccaccgtggcggcggcactcgcggtgaccgccgacatcttcctcctcggcgtcaccggggtccacgaggcggccgggctgaccaccggcgacccggacgaggcggcactgaaacggatcctggcgtcgcgggccgccgagacgtacgtgctggccagctcggagaagatcggtgccgcctcgccgttcacggtgctgcccacgtcggcggtcggcggcatcatcaccgacgccgcggcgtcccaccccaccctgcaggccctccgggccgccgaggtggccatcctcgccgcaccgtga

SEQ ID NO: 6529 - DNA, 1320 bp, Actinoplanes utahensis
gtgccgcctcgccgttcacggtgctgcccacgtcggcggtcggcggcatcatcaccgacgccgcggcgtcccaccccaccctgcaggccctccgggccgccgaggtggccatcctcgccgcaccgtgaggcgatcctccccacgcgacgtccgaggcgccatcggaatggcctcgacgccgatccgtcccccgactgtgggacctcttgccgccgactcgaaaatgccgttcacggggcccgtgaagctgtttccggccgggggggtggacggtcggcgtgccgggacgcggcgcggtgcgggcgggaggtggtgaccggtccggggaacaggccgacgctatgctggcgcgggccgatgatgggggcgggattggcgcggacgacggtgcaggatgtggcgcgcgcggccggggtctccgtgtcgacggtgtcgcgggcgctgagcggtgggacggtcagcgcggaaacgcgggagaacgtcatcgaggtggcggcgcggctcgactaccgggtgaatcgggccgcccgggggctgatcaccggtcgtaccggcaatatcgggttgatcgtccccgaccttcggaacccgttcttcgcggatgtggccaaaggggtcagtgcgcgggcccgggccgccgactgcggagtgttcatcaccgacaccgacgaggacccggtggccgagctggaggcgatcgcgacgctcgggcgcaacaccgacggcctgctgctctgctcgccgcgggcggccgacgcggatgttctcgccggcgccgacccggcgacgaccgtggtgctgcaccggcggatcgccgggatgaacgcggtggtcgcggacatcggcgacggcatccggcaggcgctggtgcacctgcaggctctgggacatcggcacatcgcgtacgcggagggacccgccggttcctgggccgcccgcgaaagggttgccgcgctcagcggagcgaagtccctcggccgggtggcgcccaccttcgagggcggtctgctcgccgcggacctgctgctcgccaccaccgccaccgcggtgatcgcctacaacgacctggtcgcgctcggtgtcctgcaccggctcgcggctcgcggggtgagcgttcccgggcagctcagcgtggtcggcttcgacgacgtgagcctggccacgatgagccacccgccactgaccagtgtggccgtgccgaaggaccgggccggcgcgatcggtctcgatctgctgctcgggcgcagcggggtcggcggcgacgtggtcctgccgaccagcctggtggtgcgggcctcgtccggcgtcgttcccacttga

SEQ ID NO: 6530 - DNA, 1134 bp, Actinoplanes utahensis
atggtgggtgcgtgctcatcacacccggacccggcgccgcccgccttcgtggccgcgccgggcgcctccggctccgcgctgcccgagtcggcgccggtgttggtggcgccgtcggcggcggtgtcgccgtccccgtccaccgcggtcaagggatcgacgctgccgaaacccgggaatcccgccggccgggccgccgttccggcagcggccaaggcggtcgacacgagccggccggaccgtacgatcggctcgggcaccccggcgagctgcacctccgccgcggtcgtcgccgccgtcgcggccggcgggatcgtcaccttcaactgcggtccggcgccggtcaccatcaccatgaccgccaccgccaaggtgaagaacgcgcacaccgccctggtgctcgacggcggcgacaaggtcaccctcagcggcggcggcaagcggcggatcctctacatgaacacgtgcgaccgggcgcagggctggaccacctcgcactgccaggatcaggacacgccgcgcctgaccgtgcagaacatggcgttcaccggcgggaacagcaccggggaccggaccgagggcggcggcgggggagcgatcttcgtccgcggcgggcacctgaaggtggtcaactcgcggttcaccggcaacaggtgcgaccggaccgggcccgacctgggcggcgccgcgatccgggtgctcgaccagggcggtgacaccccggtgtacgtggtgggcagcacgttcaccggcggcgtctgctccaacgggtcggcgctgagcagcatcggcgtctcctggaccgtgctgaacagctggttctccggcaacgcggcggtcggcaagggcgccaacccggcccgctccggcaccccgggcggcggcagcggcggcgccatctacaacgacggcgaccggatgacgctgaccatcgacggcaccgtcatcgagaacaaccgggccgccgagggcggtggcgccgtcttcttcgtcagcaacgaccgcaccggcacggtggtcatccgcaactcccggttgcacggcaacccgagcgccggcttcgagaccaccggcctgcccggcatcttctacctcggctccggcaacccgaagatctccggctcgaagctgtcctga

SEQ ID NO: 6531 - DNA, 1455 bp, Actinoplanes utahensis
atgatcacggcgatggtgcccgatatcgtccggcggcggctgtccaccctggacacccggatcgacccgtactcctggctggtcaccggggtgatcacggtggtcgccgggattctgcgcctgaccgggatcacccagccgcgcaagctcgtcttcgacgagatctactatccgaccgacgcctgggacatgctcacccacggtgtcgaatgggacgagaagagcgacagcgcggggtacgtcgttcatccgcccctgggcaaatggctgatcgccgcgggcgagaaggtgctcggcaacaccgagctcggctggcggctgccgaccgcgctggccggcaccctgatggtcctgctgctgatccggatcgcctaccggatgttccactcgatggtgctggccggcgccgccgggctgctgatgaccctggacggcttccagctggtgctgtcccgcacgtcgctgctcgacatcttcctcggcctgttcatcctggccacgttcggcgccatggtgatcgaccgggaccactaccgccgcgcccagctgcgcgcgctggagaccggctcgttccggtacacgccgtggtggctgctggccaccggcgtcctgtacggcctggcctgcgccgtcaagtggagcgccctgttcttcctgccggcgttcgcgctgctgatcgtcgtctggcgggtccaggcccgccgttccgccggccgcaccagcccgatccgccgcggcatcgccggcgatctcggctggggggtgttcagcttcgcgctggcgttcggcacctacctggccagctggaccggctggctggtcaccgacgacggcttctaccggcactggcgggccgccaacggcatgggcgagccgccgttcctcggcgccctgctcaacctgtggcactaccactcggaggcgtacggcttccacagcaacctgaccaccccgcacccgtaccagtcctggccgtggcagtggctgctgctgggccgcccggtcgccttcgactggaccaccccggccggctgcggcgcccccagctgcgcccgcgagatcctgctgctgggcaccccgctgctctggtggtcgttcctaccggccctgatcgccctgatctggctggccgtcgcccggcgcgactggcgggcgtacgccatcctggccgtcaccgcggccggcctcctgccgtggttctggttcgccgccaccgaccaccgcacgatgttctcgttctacgtgatgcccgccctgccgttcctgatcctcgcggtcgtctacgtcctcggcgccatcgtcgcggcgcagcgggccgcaggaatcgcgctggccgcggcgtacgtggtgctggtcgcggtctgcttcgcctacttctggccgatcttcaccgaccagcccatcccgtacgacagctggtccgaccgcatgtggctcggcaaccgctggatctga

SEQ ID NO: 6532 - DNA, 714 bp, Actinoplanes utahensis
gtgccgggaacgacggttcggtgggtcgtggtgtgcacggcggggttgacggttctgtccgggtgcagtccttccggggacgcgccgccgcggccggtctccggcggggccacggccggtagctcggcggccggtgggtcggcggccgcgaaggccgtcgacgcggcctgtacccgggcggcgaaggtcctgatcgtgcggacggccgccggggaggcgttcagcccggcccggctgaccatcaggcgcggggccttcctggccttcgtgaaccggacgacggccgcgcatccgctgcggtccgcgccggatgccgggatggtcaccagcgtcgtcgacgccgacgagcggcaggtcgtgcagttccccaaggccggcaccttcacggtgcacggcgggggcgcggcgctgcggctcacggtggcgggggagagcgggtgcggcgccccggagccggccctcacgatcaccgccgccgggcggttcacgccggcggcagcggaggtcgccgcgaccgggaacttcgcggtggtgaaccggtccggtgcgccgcaggccttgcgctgcacgccgggggcgaacaacgaccacacccggctggaggccggcgagacgcagatcctggcgttggacgagccggggcggtaccgctgcgccagcgtggagcacccggcggcgtcggtgacgatcaccgtgacggccccggcccgctga

SEQ ID NO: 6533 - DNA, 1539 bp, Actinoplanes utahensis
atggcggaggctgtcgcgctgcacgaggtggcgctgctgctgcgggcgggcgacgacgtggcggtggccacccgcgacctgaccgccggcgagacgttccaccacgccggcgccgcactgatcgccgtcaccgccgttccccgcggccacaagatcgccctgcgcgggctggcggccgggacacaggtgcacaagtacggccaggtcatcggacgggcgacggaagcgatccgggccggggagcacgtacacgcgcacaacctgggcatggacgcggtcgagcacgactacgagttcgcgacggcggtggcggcccttcccggcgcgtcctcggtgcgcaccttcgaggggttcgagcgggccggcggtaccgtcgggacgcggaacttcgtcggcatcgtgacctcggtgaactgttcggcgtcgacggcgcggatgatcgccgaccagttccgcgggccggtgatggacgcgtggccgcacgtggacggcgtggtggcgctgtcccacgactccgggtgcgggatggtgccggccagtgagggcggccggatcctgcggcggacgctgcgcggctacgcgacccatccgaacatcggcgggctgatcgtcctcggtctcggctgcgagatgctcggcgtcgagacgctgctgagcgagctggacgcgccggccgacacactgatcgagcggctgaccattcaggagaccggcgggatccgggcgaccgtgcgggccggggccggcgtcgtccgggaaatgctcgaccgcctcgaccagcggcgacgcacgaccgtgccggcgtcgaagctgatcctgggcctgaactgcggcggctccgacggctactccgggatcaccgccaacccggcgctcgggcacgcctcggacctgctcgtggcccagggcgcgacgtcggtgctggccgagacaccggaggtgttcggcgcggagcacctgctcacccggcgcgcggtcagccgcgcggtggggcagcggctgctggaccggatcgcctggtggcacacgtatgtcgaggccggcggcggcaccctggacaacaacccgtcaccgggcaacaaggccggcgggctgaccacgatcctggagaagtcgctgggcgcggtcgcgaagggcggcgcggcgccgctgtccgcggtctacgagtacgccgagcggatcagcgggccgggcttcgccttcatggacacccccggctacgacccggtctcggtgaccgggctggtcgccggcggcgccacggtggtctgcttcaccaccggacgcgggtcggtcctcggcggcaaaccggcgccggtcatcaagatcgcgacgaacagcgagacgttcgagcggatgcgcgacgacatggatctcgacaccggcggcatcgtcaccgggaccaccagcatcgaggcggccggcgccgagatcttcgagacgatcctggcggtcgcctccggccgcccgaccgccggcgaggacctggacctgggtcgcgacgagttcgtcccctggcagctcggggcggtgacctga

SEQ ID NO: 6534 - DNA, 3756 bp, Actinoplanes utahensis
atgtcgggtgtgctgatcgggatcggtctcagcgcgttgagcaacgcgatcgcggacgccttcgcggccaccggcgcctatcagcacaaccggcgtgatccggaacgggtggcgctcagcgcggtcgccgcccgggcgctgtccgcggcgttcgccgacgcccgacgcgccgacctgaccgcctcccccgagtggatctccgcggtggccgccgagtggcgaccggcgttctcgcccgacgtcgtggcccggttgatgtcggtgatcgccacgccgtcggccgcgaaccagcaccgcttcaccgaggtcatccggaccgccctgaccgatgtcggcttcgacctggccctgctggagcagacgctgtcggtggagaggttcgccgaggcgcttccccggcatctgtggccggagctcaagcgggccgcgatcgccggcgccgcgctgcgcgacctcgtgcagcagttgctgagccagcgggccgagtatcgggagtcggcgcaggacgcgtccgagccacgcgagcaccggcacgacatgctgacctatctgcgggagacgctgcgggacgcgcggggagcggttcccgcgttcctgccggacgaccgctcggcaaacctgcaccagcgggtccgcgtgcggctcaagacccgggtcgccggccggaacgccgatccggacggcgaccgcgcctatcagccaccggtggagtacgccggcctcgacgagcacgctcccgcggccgaacggtcctgggacgaggtgcgcacctgcgccgaccggatcgtggtgctcgccgacccgggactcggcaagtcgtggctggtgcgcaccgagacgatccggctggccatggcggccctcgccgccctcgacgaggaccacgcggcggtcattccggtgccgatccgtgcggacgcgctggcggagggtctccggtggtcgatcggggaggcggccgcccggcacttcgccgcccggggacggctcgccgagcggtcccgggcgtacttcgccgagcaggtcgacgccggcaccgtgcacctgctgatcgacgggctggacgaactgcccgacgcggccacccggcagcggttgcgcgccgcgctcagcgactggtcccgccgtcccggcgtccggcggtggctggtgacgagccggatcgcgggctacaccggcctcgacacgcgcgacaccgaggagatcgaactgctggggctgaccaccggtcaggtcgagacgtacgtgcgcgcctggggcctgcccgaggcactccgcgaccggctgctcaaggccgtcgccgatccggcggtgtccggcatggcgcggatcccgctgctgctggccctgctgtgttcgctggccggcgcggaccaggacatcccgcgaaccagggtggaactctacggccggatcctgcggtggttcctgcagcgcccgcaccgcggcgccgaccggtccgaccgggagaaccagaccctgttggacctcgtgcaggaggtggccacccacttcgcgaatcgggacgcgggctgggccgacctgatgccgcacgatgcgctcaccagggtgatccggcagtcgccgagactcggcgatctcgcctgcacgccggaccggctgatcgagcagctgtcggtggagctggggctgatcgtgccggagggcgacacctcccggggccgccgcgcccgctacctgttcgcgcaccggaccttcgccgagtacctggtggcctgccacctggccaccctggacgagcaggaccgatgggcgatcatcgaacggcacctctggttcgacccggagtggctgcaggtgatctcgatgctcgggggcctgctggacgacggtgggacgcgccggctggtggagcggttgtgccgggtggacgacgacgtcctgcgacaggggtggctgatggcggtccgggtggtctccgaacacccggaggccgacggcgttctcaccgcggagagccggcggtcgttgcggcgcacgctggccgcggtggtgcgccatccctacctgcgatggtcggcggtgaccgcgctgcgcggcgttccggtgctcacgccggccgcggcggccgaactgctggcgctcaccgaggcggacgacccggatgtccggcacgccgccgtgcagagtgtcgcgagcgtcgaggatccgtcaccggtcgcgcatctgctcgcccgactcgacgacgaggacgagcatgtcgccgcggaggccgccaagtccctggccggacggcactcgccgggggtcctcgacgcgctgctcgcccgggccggcgccgaccggcgccgggtcgccctggcgtgcacggagtcgctgcgggcgctgccggaggcggtgcgcatcgccgccgtccggccgctgctggccgcgggccggccgacggccgtccgggccgccggctgtgccgttctccgtggcgccgggccggcggccgcggacctgatcctcgcgggtctcgcggacgaggacatcgacgtccgggccgccgcggcgcaggcggtgaccggcccgctggatccccgggtcgaagcggccctgctgcgccgcctggaggcctacctgaccgagtccgcggcgggcgccgacctgaccgtgtggaccggcgacaccggctaccgctcggacctggacgcgcaggccgcccgcgccgcgctcgaccgctgcgcctcacaggcccccggcttcaccgcggccttcctccggcaggtcgtcgaccgcggcgacagcgtcgaccggttcggtcgggacaccgggcccaccgcgcccacggccgacctggtcgacgagctggtgctgcgcctgagcgacggcggcgcgcgggccgggagggcggcacggctgctgcgggccatgcggccggacggcatcgacgacgcgctgctgcgcctgctcgacaccggaagtccggcggtcgtcgcggaggtgctgacggcggcgcgcggccgccgcgacgagcgcctgccgcaccgggccgccgagctgctcgcccacccggacgagaccgtccggcgcgcggcgctggagctggtcatcgacgcggatccgccgggcctggaggacctgctgctgcgtggcctgcgggacgagagcctccgcatccggcacctcgccgccggcggctgcgccggccgccacgacgatcgactggtgtccgcactcctggaacgcgtgcgggatcccgacgagggggcggacgtcgtcgggccggcgatcagcgcactgggcgatcgggaggagccgggcgtacgggaggccctgctcgcctgcctgcgtggggagaccgggggcgaaccccggcctcgtccgatgctgtaccccgggcgggcggtcgacgtgaccgcggccgccgtcctcgcggtggccgagccggagaccgtcctgagcgagatgacggcgcgcgccgggatcaccgacggctaccggggacgcgaggtcgccggggccctccggcggtgtccggcgcccggcaccgtggagttcctggtgcggatgcgccgcgaaggggcgcggaagacccggatcgcggcgcacaacgcgctgctcgcgcgcccctaccccgaggacctggtgacgctcgtcgacctgttggacggcatgccgccggagatgcggcaggacatggtcgtggtcgcggcggcgctcgccgcccggcactaccgcaagctcgccgacgccgaccggcgacgggtgcgcgggcggttgacggcggccgtcgcggcggccgcaggatag

SEQ ID NO: 6535 - DNA, 519 bp, Actinoplanes utahensis
atgcccagggctctgctgacctacggcggtccggccgtggtggtcggcctggtcgcggcagctgtcggcagtgcgttgctggtgcgtgacgaccgggaccgccaccccgcggagtgcgggccggacccggccaccgtgcaggcgatcggcggcgagtcgatcctgcggcaccatccggaggccagccatctcaacgagctcagtccggacggctatcagtgcggggacagcccgatggccgcggtcagccgcagcctgatcggtccgctctcgcggtccgaggtggtccgctactacggacggctggcggaggcgtccggctggagacgtttcgacgggagccggcagatctactcggcgtccaagacgaccgccggcggctgcccgtggtggttcgtgatctccccgggccagaacgagtaccacctccaggtgttctatctgccggccgggatcccgcaggacaggtgcgtgtggaagtcgcaggagccgctgctgctcggcctcccgccgaagtag

SEQ ID NO: 6536 - DNA, 609 bp, Actinoplanes utahensis
atgtcgcaggttgcgccccgccgggtgccggctcgtgccgatgcctggcggcctcaggatgaggtgctgaacggcctgatccacaagtgcatcgagcaggcgtaccgtcgcaacgccgagaccggcagcatggccgcgttcttcggcggcgtcatcgtgttgatcatcctcggggtgatcatgtcgacgggcaccggcaacccgctgctggcgatcgtcgtggtggtgctgctggccggcagcggcctgatgtacgcggggatgaacgccccggcgccgaaggtcgacccgatccggatcctcgacgtgctcggcggcccgggcaacctgccggccggctacctggtgtacccggcggcgtggcgcgccggcatgccggagttcctcaacaaggtctcggaccggcaggtggcggtcgcggcgcggctctgccgggagcacccaggctcggtggccgacctgatccggctggtggcgaccgccgagcagcacgcgcacgagcacgcgtacggccgctcggtgaccgagggggacatctaccgttacgcgcaccgcgcgaccgtcgagtgggcacgactcgctcccgccccgatgatggcggcccactga

SEQ ID NO: 6537 - DNA, 693 bp, Actinoplanes utahensis
atgcgctggctccgagggatcgggaaacgacggattccgcaggatcccgcccagcagcaggtgatgctgcgggagttgcggcagcggttcggcccgcatgcggggcgccggttcgcggcccagtcggagcaggcggccgcgttgctggccgggccggacgggctggtggtggcggcgacggtgttgcgcgagttcgccgacgcggcgttcgccgacgtggctcagcaggccgcggcgctggggctgacgccggatcggcgcaactaccggccggtgtgggaggccgccgggaagcggttgaggtcgccgttgttcaccggcctggccggttttcacccttatgtgcacgtcgccgccgcggtgagcgtggtcggcgggcaggccgcgcagacggtccgactggtcgatcccctgccgctgctgacccacatgttcgaggtcctcgatctgacgctggccggctgggagttcggccgggtgctggtcgatgtcgacggcgccaccctggcggtcaacctgatccagggtgcgacggcgatccgtggggagatgtccgatccgccgccgctgccgcagccggcccggacgcagatgcgcagcaaccggagtgtgaacgtgctcgatcccacggtgagccggatcgtcgggcagtggaaccccggcaagcagatgcgcgagtgcctgctggcgtga

SEQ ID NO: 6538 - DNA, 180 bp, Actinoplanes utahensis
atgagtttcctggacaaggcgaaggacttcctcgacaagcacgacgagcaggtcgacaaactgctggacaaggccggggaacaggtggaccggcggaccggcggcaaatacagcgaccagatcgacaaggcggtcgacgaggcccagcgccgcaccggcgccggcgacacccagccctga

SEQ ID NO: 6539 - DNA, 768 bp, Actinoplanes utahensis
atgcaccccctcgccgaccggctgcgcgcagccctcacggccggccgatcggtcaccctctccgccggggacgtgccgctgttcacctactcctacggcgccgcccagcccgagctgcgcgacctgcgcaccctcgacggcgccgcgctcccctcggcggtcacctggacgccgccgcacgccgccccgggcgccgccacccacgtcgcgatcaccgacctgtcgtcctccgacgacagcgcgacggtcgcccaccacctgcgctggccggccttcgacgagtggcgttcactgaccgcctcgctgtccggcgccggcgcctggacgctgctcttcgagaacaccgtcaccaacgtctccggccgccgcctgctcctcgacggccgctccctggccatgcccaccctcgccgcgcccgccgcggcgccgaccgcctggcatgccgcccacggcgacgacttcaccctggtggccgtcgacgacgccgccaacctgcagcatccgccacgctggtcggccggtctgagcccggccccgttcggtgccaccggcgtcgtcgtcggcgtcgaccgcacgatcgccttccgctacgcgctggtcatcgccccgcccgggcctcccccggacgcgttggccggcctcggcctgaacgcgctggccggcccgtcggtcgcccgcccgcatcgctgccatggcgaccactcccgtgccaccccgacccgcaaggcccggggccgcgccctgacccgccgccgcgacacccactga

SEQ ID NO: 6540 - DNA, 300 bp, Actinoplanes utahensis
atgaccaccgcgctgacgctgaccaccgggcagcaacccgacggcgcgccgctgctcgccgcggccggtgagatcgacatgagcaacgcggacaccttcgccgcggccctgagcgcctcggccccggcggccggccgtccgctgctggtggatttgaccgcggtcgaatatctggacagtgccggcctggccgccctgttccgccacgccgaccggatcgaggtcgtcaccggcccgctgctggccccgctgctcgccgtctccggcctcggcgacctcaccacggtccacagccgctga

SEQ ID NO: 6541 - DNA, 4041 bp, Actinoplanes utahensis
gtgagcgacgtcttcgcagcggacgccgaggtcggccgggatcttgccgcagtcgactgggcggccaccccgctcgggccgccggatgcctggccacagagcctgcgcaccgcggtcagcatcctgctgtcgtcgcgcttctcgatgtggatggcctggggtcccgagctgaccttcttctgcaacgcggcctaccgccgcgacaccctggcccgcaagtatccgtgggcgctgggccggtccgcgcgggaggtctgggccgagatctggcccgacatcggcccgcgcatccagaacgtgctcgacaccggtcaggccacctgggacgaggacctgctgctgttcctggaacgctccggctacccggaggagagttaccacacgttctcctacagcccgctgcgcgacgacgccggcgcgctggtcggcatgctctgcgtggtcagcgaggagaccgaccgggtgatcgccgagcggcggatggcgacgctgcgcgacctcggctccgacccgagtgtgatccgcaccgagcaggagaccctggccttcgccgcccgccagctcgaccgcaaccgccgcgacctgccgttcaccctcacctacctgtacgacgaggccggccgcgcccacctgcgcgcggccaccgggatcgagccgggccacccggccgcgccggaaaccgtcgaggcggaccacccgtacgccggtgccaccgagtcgcggctggtcccgctgaccggggccggcctgcccaccggcgattggaccgccccacccgagcaggccctggtggtgccgctgcagccgttcgggttcatggtcaccgcgctgaaccgctaccggccgatcgacgagccctaccgcggcttcgtcgagctggccgccgggcacgtggcggccgggatcggcagcgcccgcagctaccaggcccagcagcggcgcgccgaggaactggccgagctggaccgggcgaagaccacgttcttctccaacatcagccacgagttccgcaccccgctcaccctgatcatgggcccggtcgacgagctgcgcacccggctggccggcgccgatcagccgatccgcgacgaactcgacgtgatccaccgcaacgggctgcggctcggcaaactggtcaccgcgctgctcgacttctcccggctggaagccggccggatgcaggcccgtttcgagccggtcgacctcgccgccaccaccggcgaactggccagcgtcttccggtccgcgatcgaacgcgccgggctgcgtttcgaggtggactgcccgcccctgcccgagccggtccttctcgaccgcggcatgtgggagaaggtgatcctcaacctgctgagcaacgccctcaagttcaccttcgagggcgccatccgggtgacggtcgccgccggcgacgacgcggccgtgatcaccgtggccgacaccggcatcggggtggcacccgaggagatgccccggctgttcgaacgcttccaccggatcggcaccgcgcggtcccggtccaacgagggcagcggtatcggcctggccctggtcaaggagctggtcggactgcaccggggcaccgtcaccgcggacagcgaaccgggcgggggcaccaccttcaccatccggctgccgttcggcgccgcgcacctgccggccgacgccgtggtcgcgtccggctcggcggccgcgccgtccaccacggtcgagcccttcctgcaggaggcgaaccgctggctgcccggtgacccgccacccgaggagacgccgatcacccggctcgacggggccaccgccgacgtcctggtcgccgacgacaacgccgacatgcgcgactacctgacccggctgctgcgctcggccgggcaccgggtcaccgcggtcggcgacggccgccaggcgctcgacgcgatccgcaccgacgcgcccgacctggtggtcagcgacgtgatgatgccccggatgaccggactggagctggtcacggcgctgcgggcggacaaccgtaccgccggggtgccggtcctgctgctctccgcccgggccggcgaggaggcctcgatcgagggtctcgaggccggcgccgacgactacctgttcaaaccgttctcggcggccgagctgctggcccgggtccgcgccaacgtggagctggcccggctgcgcaaccaccacgcccgctggcgcaccgcgctggtcgactcgctgcaggaggcgttcttcgtctgcgacgaggacggcgcggtcatcgagatcaacacggccttcaccgacatgatcggtttcggtccggaggatctgccgtacgcgccggtccacccgtggtggcccgaccgggagtccgatccggaggcgtacgccgaggtcgccgacgccttccacctgctcatgcaggctcaccagggggaatacacggtcccggtcaagcaccgtgacggccaccggttgtgggtggccgcctcgttcaaccacgtgcgcgacccggaaagcgggcggcgggtcatcgtcggcaccttccgggacgtcaccgacgagcactacgcgatccagcgggagaccgcgctggccgcgctgagcatgcggctctccggcgccgacgacctgtccgacgcgctcaccggcgccctcgacgaactgcgcgggctgtggcaggcgtcggtcgtgctcggcgccgtcttcaccggcgacgccacccccgcgctgaccaccaccgacccggcggtcacctgggcgggcgccccgcaggaccggatcgtcgcgctgcgcgacgggccgccgctgaccgcggtcgccacccccaccgaaggcgccgggatcgccctggagcacccggacggcaccctggtcgtctggatcgggctcggcccgcgacgcccgttcaccgagcaggacgagaccctgctcgcgctgctcgccgggcacctcggtcagggtctgcgccgggtgcaccagatcgaccagcaacgggagaccgcgctcgccctgcagcgcgccatcctcggcccggcgcaactgcccgccggcttcgcggtccgctacgagccggccacccggccgctcaaggtcggcggcgactggtacgacaccgtcccgctgcccgacggccggatcggcatcgtcgtcggtgactgcgtcggccacgggttgcgcgccgccaccgtgatgggccagctccgctccgcctgccgtgccctgctgctgcaggactcccgcccggcccgcgccctggaggctctggaccggttcgccgccctgctgcccggcgccagctgcgccaccgtgttctgcggggtgctcgacccggcgaacgggcacctgacctactcggcggccggccaccccccgcccatcgtggcgctggccgacggcaccgtcgagctgctcgacggcggccgggcccggccgatcgggatccgcccgcaggacgagcggcgcgaggccgaatacgcgatgacgccccgctccaccctgctgctctacaccgacggcctggtcgagcgccgccggcagccgctgaccgccggcatcgaacgggtcgccgacgcggtccggaccggtcggcgtactccggtcgaggagctggccaccgaggtgatggaacgcctcgccccggccggcggctacgacgacgacgtggccctgctgctgtaccgccagcccggcccgctggagatcgagtttccggccgagtcgtcccggctcgccccgatccgcagcgctctgcgcggttggctggaccgctgcggcatcgacccggtcactgcgcagaacgtgctggtcgccgccggggaagcgtgcgccaacgcgatcgagcacggccaccgcgacctgaccggcggcctgatccggttgcgcgccgcggtcaccgccgacgcgctgcgcctgatcgtgtcggacaccggtcgctggcgggtcccccagccggacgacaatccccaccggggccgcggcatcatgcttatgcgcgctttcatgggcgaggtcaccatcaccaccggcaccgccgggaccatcatcgacatgcagacaaggatcgtgtga

SEQ ID NO: 6542 - DNA, 1521 bp, Actinoplanes utahensis
atgagcgagctgatcgacgcccggctggtctccgggaccgacccgaacggcggctccggcgaggccaccaaggggacccagcaggacatctatttcttcacctcgatcgaggatttcccgcccggcgtcggtgatctgagcctgacgcacgacgatgcgcagggattctacgactacgtgaaacagttcaacacgcccaacggctggtacagggacgccagcgtggggcagtggatctacgaggagacctacgacaactacctggacgactacggcttcgacgcggccaaggtggtctatcactccgggcacggcggaatggcgagcaacggggtgttctccattccggtcggcaacgactggggcggcgaccactggaccagttccaatgacatgcggctgggcaacgaatacgcccgttacgtgttctggtcgacctgcgaatcggtgcgggtcaagggcgggcagtcgccgatacggacctggcagaccgccaacctcgggctgcggatgattttcggatacgagacggtcagcgtcgacaacggcgactacggccgtttcttcttccaggagtggaacaagaacaagtcgttcagcaccgcgttcctcgacgcgtcctggcggatcagccacggccaggagccggcggtgaccgcgtgcggcgcgacccaggccgaggccaccgatcggctgttcaacgaacggctcttcgacgccggccgggccagcaccacctggtggtggtggcgctggtacgaccgggccagcctgcgtgcccgcagcctggacgtgccggccggggtccgctcggcgaagttcgccgcggccagcgcgcgtgacctggccggcgcctggaccgaccggttcggcggcgaggcccggctggtgctcggcgcgaacggcgcccgcgaggtcaccctggccggcaccgccgtcagcgacgcgcggctcaccgacgagcaggcggtcgcggccgcccggcaggcgatcgagcggtaccggctggccgagcatgccgacctggcgctcgaccacatccgttacgaccggcacgccggggccagcgccgacgagcaggtcgacgaacaggtgcgcgagcggagcgtgggcttcgtgcagctgatcgacggggtgccggtggtcagcccggacggcgggcggctgcacgtgcgggtcgacaacgagggcacggtcaccgggatcgccgactccacccggccggtcgccgacctgcgggacgcctccgcggcgccgccgcggccggtgccccggcagcggaccggcgtcgacgcggtgtcgaacctcgacgaactcttcggcgagtcgctgcagcggcgcctgcgccgggccgcggccggcgggcgggtgcccagcgcggtgcgggtggtgccggactcgaccgaggtcggctacgcggtgcacggcgacggcgcggtgctggtggcgcggcgcgaggtcgaggtcgacttcggcggcgggctggccaagcggtacgtgctggaggagcccgtcagctga

SEQ ID NO: 6543 - DNA, 2184 bp, Actinoplanes utahensis
atgagactcgtcccccgcctgctgtacgcaaccctggccaccgtcgtgctcgccgtcatcggcacccccggcaccgcctccgcggccatcaccggcaccaccatcgccgcacccggcggcacctgcgtcgacgtcagcggtgacgacaccggcgtcaacggcaccgccgtccagctctgggcctgccagagcaccagcgccgaccagcactggacgtggagcggcaccgcgctcaccacgatcggccgctgcctcgacatcaccggcggcggcaccgccaacggcaccgcactccagctgtgggactgcaacggcaccggcgcgcagcagtggaccccgcaggccgacggcagcctgaagaacccgcagtccggccgctgcatggacgcgcccggcggggccaccgccaacggcacccggctgcagatctgggactgcaacggcaccggcgcgcagaagttcaccgtcggcacccccaatccgggcacctgcccgacctactccgacaccccggacctcggcgccaacgtgcacatctacgaccactcgatgaccgacgccgccatccaggcgtcgctggacagcgtgttcaacgcgcagaaggacaccaacaccgcgcagttcggcacccggcgcgacgcgctggtcttcaagccgagcaccacgccgtacaacgtcggtgcgaacatcggcttcaacacctcgatcctcggcctcgggcagaacccggacgacgtgcggatcaacggcgcggtgacggtcgacgcgttcaacgccggcgacgccggcaacgccacccagaacttctggcgctcggccgagaacctgtcggtcaacaccaacggcggcaccaaccggtgggccgtcgcgcaggccgcgccgtaccgccggatgcacgtgatcggcggactcaacctgttcccggccagctacggctgggccagcggcggctacatctccgacaccaaggtcgacggcaccgtcgaatccgcctcccagcagcagtggtacaccaaggacagcacgctcggctcgtggagcggctcgaactggaacatggtgttctccggtaccaacggggcgcccgcgacccacttcaccaccgacccggcgtccggcccgcgctacaccaccctggccaccacgccggtctcccgcgacgtgccctacctgtatctcgacgcggccgggagataccgggtcttcctgccctcgctgcgcaccaacgccagcgggcccagctgggccggcggcagcaccccgggcagctcactgccgatgagcaacttctacgtcgccaagcccaccgactcggctgcgacgatcaacgcggcgctcgccaacggctgcaacctgttcttcacgcccggcgtctaccacgtcaaccagacgctgcacgtgaccagggccggcaccgtggtgctgggcatcggctacccgacgatcatcccggacaacggcgtcaccgcgatggacgtcgccgacgtcgacggggtccgcctcaagggtctgctcttcgacgccggcaccaccaccagcgacaccctgctcaaggtcggcccggccaagtcgggggtcgcgcacgccggcaaccccaccacggtccaggacgtgttcttccggatcggcgggatggccgccggcaaggccaccaacagcctggtcgtcaacaccaacgacaccatcgtcgaccacacctgggcctggcgcgccgaccacggccagggcatcggctggacggtcaacaccgccgacagcggcctcctcgtcaacggtgacaacgtcctggccaccggcctgttcgtcgagcattaccagaagaacgaggtggtctggaacggcgccaacggcaagatcgtcttcttccagaacgagatgccgtacgacccgccgaaccaggccgcgtggatgaacggcagccagaacggctacccggcgatcaaggtggcgaacggcgtcaccacgttcgaggcgtggggcctgggcagctactgcttcttcaacgtcaacaacgcggtggcgtccgcacactccttcgaggtgcccgcggtcgccggcgtgcggttccacgacatggcggcggtctcgctcggcggggtcggcaccatctcgcacatcatcaacaacaccggggcggccgcgaactccgccaacaacaactcgtacctggtcagcttcccgtaa

SEQ ID NO: 6544 - DNA, 411 bp, Actinoplanes utahensis
atgagcgacaccaagcccaccgtcctgttcgtctgcgtccacaacgccggccgctcccagatggccgccggctggctacgccacctcgccggcgaccgcgtcgaggtccgctccgccggctccgcccccgccgggacgatcaacccggccgccgtcgaagcgatgaacgaggtcggtatcgacatcaccgaccagaccccgaccaagctgacctgggacgccgcccgggagtccgacgtcatcgtgaccatgggctgcggcgacgcctgcccggtcttccccggcaagcgctacgaggactggaagctcgacgacccggccggcaagggcgtcaccgctgtccgcccgatccgcgacgagatcaagacccgcgtcgaagccctgctgacagacctgttcccggccgcttga

SEQ ID NO: 6545 - DNA, 732 bp, Actinoplanes utahensis
atgccttctctcgcaccctggcggcggctgctggccgagttcctcggcaccgcgctgctggtcaccgccatcgtcggctccggcatcatggcgtcccggctctcgccaggcgacgtcggcctgcagcttctcgagaactcggtcgccaccgcgttcgcgctcgccgcgctgatcctcaccttcggcccgatctccggcgcccacttcaacccggtcgtatccgcggccgactggtggctgggacggcgcacccgcaccgggatcagtggcgccgatctggccggctacaccatcgctcagatcctcggtgcgatcggcggctccatcctggcgaacctgatgttcgacctcgccccggtcaccttctccgccagaagccgcgccgccgggcacctgtggctcggcgaggtcgtcgccaccaccggcctgctactgttgatcttcgcgctcggccggtccggcagagccgccgtggcccccgccgcggtcggcgcgtacatcggcgccgcctactggttcacctcgtcgacgagcttcgccaacccggccgtcaccatcggccgcgccttcaccgacacgttcgccggcatcgccccggcctccgtgcccgggttcgtcaccttccaactcgtcggcctgctcgtcggcgtcggcctgctgctcgccctgtaccccgacgccggcagggcggcggacgacatcgtcgtcgaccaccccgccaccgcgccctga

SEQ ID NO: 6546 - DNA, 486 bp, Actinoplanes utahensis
atgaaggccgagtcggatggcggtttcgtcgagctcatcacacggattcgaaacgtgtcgaatccgatgactgtcgaagccaaggttgcacgcggcttcgatatctgtcaacctcgacccatgtcgaaaccaccggtcgtgtccgtcgccccacagacgccctgctgcacgccgatggcgcaacagcggatccccgcccccgccgccgccaccctcgcgcaggcattcaaggcgctgggcgacccgatccggctgcagctgatgtcgatgatcgcctcggcgccgggcggggagatctgcgtctgcgacctcaccccggccttcacgatctccgggaccaccatctcgcaccacctgaaggtgctgcgcgaagccgggctgatcgacggcgaacgccgcgccagctgggtctactaccgcccccgcccggagctgatgcgacagctgtcgaccctgctctcggtcgacgaatccgtgccggcctga

SEQ ID NO: 6547 - DNA, 1326 bp, Actinoplanes utahensis
gtgcagctccagccgggtcgccgggaacgccgcccgcttcggctcgtgaagcaccccgccggctcatcggtgcccgccgaccggcgcgccggcgggcaccgacggtcgtcaccgcccggtaaccggaccctggtcccggcattggcgatcacccagaccatcggctacggcaccctctactacgccttcgtcgtgttcctcgtcccgatcgctgccgacctgcacacctccaccaccgccgtgaccggcgcgttcaccgcctccgtgctcacctccgcggtgctggccgtgccgctcggccgccggctggaccgccacggcggccgcacgctgatgacctgcggttccctgctcgggaccatgctgctggtggggtggtcgcacgtcggccaggtgtggcagctgtacgccgtgcagatcggcatcggcgtcgcgtcggcggccagcctctacgaagccgccttcgccgtgatcatcgcctggtgccggccggagcgccgctcgcgggcgctgcttacgctgaccgcggtcgccggattcgccagcaccatcttcctgcccctgaccggttggctcaccgaccagcacggctggcgcaccaccctgctgatcctcgccggcatccacgccatcaccgcgccactgcacgccgccaccgtccgacggccaccagcagccacgaacctggtcacccggcaccgcgacgtcgatgcctcagtcgttcgggccgcgctggccgatcgcgcattctgggtgctgacggccggattcaccacgcatgccatggcgatcagtgcctacaccgtactgctggtcgccgccctcaccacgtggggccacccacccgccttcgccgccaccatcgccggactcctcggcgtcctgtccgtcaccggacggctgatcaccaccagcctgcaaagccgctaccggaccaccaccatcaccgccggcatcttcgcgatccaggccgccgcggccctgctactgcccgcagtcggcgccagcaccggtggcgccatcgtggcggtggtcgggttcggcctcggcttcggcgtggccaccatcgccaaacccgtcatcctcgccgagcgctacgacacccgtcgctacgccactctcgccggcgtcctggtcgcgccgatgaccctcgccaaagccggcgcaccgctgggcgcggccaccctgcaccgcaccacaggcgggtacacgtccgtgttcacggccatcgccgtctgctgtgccgtggcggctgccgcaatcggagtctgcttcccgggtccccgcgatcatgacatcggcggggacggcgtccacgacgaatag

SEQ ID NO: 6548 - DNA, 678 bp, Actinoplanes utahensis
atgcgcgcccgcctgctgaccaccgcctcgatcctggtcgtggtgggcgggtgcggcaccgcgcccggcgcggtgaagccggccgggctgacaccggcggccagcccccgggtgagcacgtcggtaccggtgtcgccgggggtgagcaccgggtgggagatcaccgtctactacaccgcggtgcagcgtttccacaccggcgcgcccacccgggtaaccggctgcgaccggctggactgctcgaacggcaaggacgacctgggttcctacccggccgacttcgtgcaggcggtcaaggacgagggcaccggccagaccgccgacggtcactacctgaactggtcgtacgacgtcggctattggctggacagcgaaccgcgcgacaccgacggggaccggctgcgaccgttcgtgtcggcggccgccgatccgaacgtgctgccgcacggcacccgcttcacgatcgaggactgcggctcgcaggatgacggttccgccccgcaggaggcggtctgcgccgcgctccgggacggcgcctgggaggtcaccgacgagttcacgccggggctgggcgggtcgaagcacatcgacgcctacatcggcccggagaccggcgcgggtttcaccggctccgactggtacatcacgctgacccgggcgaggatcagcatcgggtga

SEQ ID NO: 6549 - DNA, 1056 bp, Actinoplanes utahensis
gtggcaatgacagacgtgatcttcggcttggacaccttcggtgacgtgccgcaggacgacgcgggcgcaccgctctcgcaggccgccgccctccgccgggtcgtcgacgaggcggtgctcgccgaccagctcggcgtcgacgtgatcgcgctcggcgagcaccaccgcccggagtattcgatcaccagcccggagaccgtgctcgccgcgatcgccggccgcaccgaacggatccggctggcttccggggtcaccgtgctcagctccgacgacccggtccgggtcttccagcgcttcgccacgctcgacgcggtctccggcggacgggcccaggcgatcctgggccgcggctcgttcaccgagtccttcccgctcttcgggtacgacctgagcgactacgacgtgctcttcgaggagaaactcgagctgttcgtccagttgctcgacgagaagccggtgacctggagcgggacgacccgcgcgccgctcgtcgacgcggacgtgttcccgcggaccgagtcgggccgcctggacacctgggtcggggtcggcggctccccgcagtcggtggtccgcaccgcccggcacggactgccgctgatgctcgcgatcatcggcgggccgccggaccggttcgcgccgttcgtcgacctctatcggcgggccaccgcgcagctcggcacggtcgcacaccccgtcggcatgcactcgccgggcttcttggccgacaccgacgagcaggcccgcgagctgttctacccgcactacagggtgcagcgcgaccggatcggcgcgtcccgcggctggccgccgctgcgccgcgcggaattcgaggcggagatcgaggacggttccctgtacgtcggtagcccggacaccgtcgcccggaagatcagccgcgcgatccgggcgctggacgtgggccgcttcgacctggtctacacggtcggcgcccagccggtcggcgcccggctgcgcgccgtcgagctgttcggcgccaaggtgatcccgatggtccgggacatgctcaccgggtccgggccgctcgccacatag

SEQ ID NO: 6550 - DNA, 774 bp, Actinoplanes utahensis
atggcggcggtacgccgatgccggccccgccgatccctgcgtcatgatcggtacatgagcgagttcccggccggtgacaccgcgagggcgcgactgctcgatcagcgggcgctgcacgcctcctcggtgggggcgaacaacgcgatgaaccgggaccgtcggctcaccggcgtcaacagctacgcccgggtgctcggcttcgatccggtgggccacctgaccgggccggaccccgcctggctggacctgtgctgcggcagcggccgggcgctgctgcaggccgccggccggctccggggcgcggcgacgctgatcggcgtggatctggtggacgccttcgccggggccgccgacggggtgacgttcgtggcggcgccgctggaggactgggcgccggaccgggcgttcgacctgatcacctgtgtgcacgggctgcattacgtgggcgacaagctgggcatgctggtccgggtggcccgctggctggcgccgggtgggcggttcgtcgccgatctcgatctgggcggcgtgcggctggcggacgggcggccggccgggcgccggctcgtcgggcggctgcggcaggccggcttcgactacgacggccgccgccgacggatcagctgcaccgggccgcgcaagtgggagattcccggcgagtatctgggtgccgacgaccgggccggggccaactacaccgggcagccggcggtggactcgtactaccggttcgccgggcgcggaccgacgggcataaacgtgtcgacgggatag

SEQ ID NO: 6551 - DNA, 780 bp, Actinoplanes utahensis
atgcccatcgagcagtccgcgacgcatccggtcgagtggtggcagcagttccagaccgctaccgagcggttcgacgaggccatcctgaccaccggcctgaccgagctgttgctgcccaagatcgtgtcgcagctgctgcagcgggaggcggacatcgcctccgacatcgccatcgcgtaccgcaacagaccgggcagcgagggccttcgcgaccgctacgacaaggcggcggcccggctccgcgagaccatcgagcggctcgcggaccgggacgtcgaccgggccaccctgctcgaggccgaggcggtgtcctgggtgatcggcggcgactacgcgcgcgcggccgccgagatcgaaccccgggtcggcgcggtcgtcctgctgcgcatcttcgtgtccgcgttgcgggtcgcgcagctggacgtcaacgtcaccgcgaatctgctgaacgccggccgcaccccgaccgaggcgatccacgccggccggctgctcggccgctacggctactggccggagtggctgcgggacctggtggtcgagcacgcgctggccggcacgctgaacgacgacttcgtcgccgccctggacatgtgcgcgttcgccacgctgcgctccacccaggcccgcttcgcccgcagcctgctgcgcggcgaaccggcggcgatcaccaccgcggcccgcaccctggagacgatcggcgagacggagatcgccgcccggctgcggcagggcgacatgaaggcggtcgccttcgccgcccgcttcgccgccgtctga

SEQ ID NO: 6552 - DNA, 738 bp, Actinoplanes utahensis
gtggggaatccgctgggcagcgccgggaacgacggcaggcccgggatgcgggacaggtcgtccgcggtcggccggtgcggctcgacgccgaccccgacgcccaccccgatcgcggcggccaccaggccgacgacgcccgctaccagcagcgtgcgccaggatttgcggttgtcgatgtccatcgcgccacacagtccccttctgcccgagaccggaacacaggtcccggaccataccggacatcgacgcatcacgttgtcccatgccggaataccggcccggcgccgcgacttggcgacagacatgaccaccgatttcgatccgcacgcgctgatcgcgggaagccgcctcgggattctcgccaccctgcgcagggacggccgcccgcagctgtcgccgatcctgcccttctacgaccgggacgccggaacgatcttcgtgtcgatgaccgagggccgggccaagaccgccaacctgcgccgcgacccgcgcgggtcgatctcggtgaccagcgccgacggccggtcctgggcgaccgccgacggggtcgccacgctgatcggcccgggcaccgacccgcacggcccggaggtggaggcgctggtcgactacttccgccgggcggccggcgagcacccggactgggcgcagtaccggcgggtaatggtcgacgaccggcgggtgctgctcgcgctgagggtgacgcacgtctacggacaggcgatcaccgcggattga

SEQ ID NO: 6553 - DNA, 1284 bp, Actinoplanes utahensis
atgacgacacggttgcggcgacgcctgatgtggtgtgccgggacgctcggcgtgtccggcttcctgctgctgatcgcgccgacaccggcgtacgcggcctgcgcgccctcgtatcaggaggtgccgggacagccgccggccggcgatgcgagctgcggtggcgacgcggccgcggcggccggcgtggtgctcctgctggccggggcggtcggctcggtcgccgtgccgctcgcccgggccgcgggtctgcaggccgggggtgatccgccgatgagcggcccggagaccgcttccgagctggcccatgtgctcgaaggcacggccgagccgccgccgaccgtgcagctcaataggagcggtgacccgtacgacagcaggaccggccggttcgtcacgaaagagaccgacggccggctgcgcaaggcggctccggtccgggtgacggcgtatccgcgccccgccgatttcccgatgatggaccgggcggtcgaccggtacgccgtggccgacggcgcccggacggcgacctacacccggccgctgccggccgccaacggggagacgctggaggggctcggcccgaaactcgaggcgatcctccgagccgccgagccggatttcaaggtcgacaagacggcctacagcagcggccggcggtacgagatgctgaagcaggcggcacgacagctgttcaacaacggcgactaccgcacccccaaccgggccttcgccgcattcctggaggccgccgacctgttccgcgaacagctgcagcccctttccgaggccggcaccgcgctcggcgtcgccggcgaggagtgggtggtggcacaggtgctgaaggttccgccgatcaccgtctccggcaccgggaccgcgaagtcacgggagttcgacagcgtcatcgtgagtgactggcccgaggagtggggtgccacctcggcggggccggtcctcatcctgtgtgagtccaagggacccacccccggtctcggggcggcgaaggtccgactgcccgacggtacgtggacgcgtgcccagcagggcgaggtgcactatctgggtcgcacgctggcagtcgacgccaagctcgcgaccgccctggacgccgtcccgggccgccgggagctgatccagcggctggtcgacgcccgcgccatccggtacatcaaggtgcgcacgctggaaaccggccggatcgtcgtccacgagttcactctcgatccggatgttctgcgatccttggtgctcaagcttcccgagacagcggagtccccgtcatga

SEQ ID NO: 6554 - DNA, 516 bp, Actinoplanes utahensis
atgagtttcacccggaccgacgatgcggccgtacgcgacctgctgaccgccctgcgtgacgtcccctggcactggcggctcgacgagctcgacgacctggccgcccgactcggctggcagatcaccgaccgctgggacaagggcgccgagttcaccgtcggctggccgctgcccagccggggcgcgctgctcaccttctggaagggcggcggccggcagatggacttcgacctgaccgcccgcaccgacgacaccccggagaccgacgccgccgccgacgacgccttcgccgacttcgccgcgatcgccaccgacgtcctgggccgtcccgaccggaccactcccggcatccaccccagcgtggcgtggcgcaccgcggactccaccttcgagctcgccgtcttcctcggcaccgtcacgctgacctggtcgtcgaacgcctaccagcagttcctccgggacaccacggtggccgacccggccgacgacggggacggggacggggacgacgagtga

SEQ ID NO: 6555 - DNA, 432 bp, Actinoplanes utahensis
gtgaccgccgacccgtggaccgccctggccgaccgcctggcccggctcctcacccgccgggaagccgacgacttcctgatcctgcacgccggcccgtactacgtgcagtgctatcaggggccggccgagttgtacgccgaggccctcgccaaccgctccgacttcccgccggtccgcctccctgcggccgccgagcaacggctgcgtgacctcggctggcagcccccggacggccccgacgagaactggacgacccgcctgccgttcccggcctcgcaccgccaggcccgcgccctcgccgaccggatgctcaccaccctgcgggaggtctatcaggtcggcaccatcaccgacctgcggtacgaggccaccaatgcccgcgccgggacaccgtggaacgccgcgcccctcggcctgctccccgccgggtga

SEQ ID NO: 6556 - DNA, 1092 bp, Actinoplanes utahensis
atggtgtcctccccgcccaggtcgtggtcgagccacagctcgtccaggcgatgttcccggagccggtcgagcagtgccaccccggccgcgctgctgcgggccacctcggcggcccggccgtccacgaacgaccgcaggtcgtcgatcagcacgatcatgcggtcattatccggcggccgatgtggaaagatcacggtggtgaatctggctgatgtcaccgaccggggttccgtcgtccgcctcaacggcgtcgacctgttcgtccgtcggttcggcgaccgcgacctgccgccgctggtggtcatccacggcggccccacctgggaccacagctatcttttgccggccgccgccgacctggccgacacggctcacgtcgtcctgttcgacctgcgcggctgcggacgcagccagcgcaccgccccgatcggcgacctgcccgacggcgcactgcagccgccccggctcgccgacgacgtcgccgcgctcatcgaggcgctcggcagcggtcccgccgacgtgctcggcttctcctggggcggccggatcgcgatgcgcgtggtcgagcagcatcccggcgtcgtccgccggctcgtgctggcctcgaccacggcgtacaccgacttcgacgacgagttggcggcgtccgccgactaccgggcgcggcgccggctgtgcaccgcggtgggcttcgacgacccgctggtcaccggaccggacggcgcgctgagccgcgcgatggcctacggcgacgccccgctgcaggtgtggcggctcgaccggctcgacgactggcaccgggtgctcgcggcggtccggttcaccagcgactacaaccggctgtacacctcgggcgcgctgctgcccggcggccccgacgacgccgaggcggtcctgcgcgactggggcggcccggtgctgatcctgcacggcgcccgggagatgggcttcccggtcggcgtcgcccgccggttgcacgccgcgctgccggccagcaccctcgtcgaggtgccggaggccgcgcacatggcacacttcgacaaccccggggtgtggctggccgggatccgcgacttcctgcgggccacgtga

SEQ ID NO: 6557 - DNA, 495 bp, Actinoplanes utahensis
atgtatgtgatcagggaacgcttcttcgccatcggcgacgacttcgacgtgctggacgagaacggcgcgaaggtctaccgggtggacggcaaggtgctcagcctgcgcaacaaggtggtcatcgaggatccggccggggacgaggtggccacggtgcatcggcacctggtgtcgctgcgaccgacgtacgagatccggatcggcggcgagaaggccgccgaggtccgcaagaagctcttcaccccgttccgggacagattcaccatcgacgtgcccgggccggacgacctggagatgaagggtgacctgctcgatcacgagtatgtgatcgagcagggcggcgaggaggtggccgcggtctccaagcgctggctcaccatccgggacacctatgcggtccgggtggccgcgggcatcgatccgctgcttatcatcggcagtgcgctggcgctcgatctcgcgctggagcgcggtgtgcaggacgacgaggactga

SEQ ID NO: 6558 - DNA, 1653 bp, Actinoplanes utahensis
atggcggtcgcccggtcgatgagccagggcatggaggccagcgcaacgcccgccggcgccgcggcgcgcggcgcggcgctggaccgcgccctgaccacgctcgaggaacaaccgcggtacgggatgaacctcgacgagtggatctcccgggcgatcgacctggaggccgccgccgaccggctgggccgcgctgacctggcgttgcgcgcgcagctggtgcgggccgacatcgtcggccggcgcggcgacgtgatcagcagcggacggatctgccggcacgtgcaccgatgggcggtcgagcacggcgaccagcgtctgctcgcgctcagccacctgcggctgtcgccgtatttcgggcagctcggcgactatccgaccgccctggagcacgcgctcggcgcgaaccgggcgacgtccgcgctgggcggggcggcctcggcgtacctgcgatggcggtgtgccatggcgctcgccgacgcgctggccgacgtcggtgacctggacggcgcccgggcgcggtatgccgaggcggcccgggtgtcggtgatcctgggcgacatccgggcgcggatccgggtgttcaacaacctggcgtacaccgagttccaggccggtgggaccgacgccgcgcaggaggcggtggagcggctgctgcggctggccgccgaccacgagttgaccctggactacaacacgctggacacggtcgcgtcggtgcagctggccgccggtcggtacgcggacgcgatcgccaccctgcagccggcgctggacgacgccttcgccgcggcgtacgaggaggccggctcccgcgcccagggactggtcacgctctgccaggtgtatcggctggccggggatctgaccagcgcgcaggacgccatcgaccggtgccgggcgctgtgcgagagccgcggcctgtccggggtggccgtcgacgtgcgccgcgagcaggcggagatctgggcggcggccggccggttcgccgaagccctcgacgagtacaagctgttccacgccgcggcgatggcgttgaactccggggagcgggacgcccgggcgcagaccctgcacgcgatgtacgaggcggacgaggcccgccgggccggtgcccgggcccgggagctgtccctgcgcgacccgctgaccggcctgttcaaccggcggttcgtcgacgcggaactcccggtgctgctcgcccaggcgatcgagacgcggaccccgctgtcggtcgcgttgatcgacctggaccacttcaaacggatcaacgacacctgttcgcacgaggccggtgaccgggtcctgcggatggtcgccgatctgctcaccggggtggccgggctggcccgggaggcgttcgcggcccggctcggcggcgaggagttcctgctggtgttgcccggcgcggcggcgggcagcgcgttcgcctgggcggaacggctgcgcgaggcggtccgcgggcacgactgggcgccggtcaccggggacctgccggtgaccgcgagcatcggggtggccacggtcgcgcccgatcgggacacccaggaggcgctgctgcgccaggccgacgtgcatctgtacgccgccaaggaggcgggccgcgaccggaccgccgacggctcagccacgatgccggcccgccaggcgtcctga

SEQ ID NO: 6559 - DNA, 1200 bp, Actinoplanes utahensis
gtgactcccgcttctcccatcgtccgtgccctcaccctctcgatcgccgcttcctcgctggccaagggggtgttgttcgccgtcagcgcgctgttcttcacctccgtgctcggcctgtccccggccaccgtcggcctcggcctgaccctcgccggcgggtgcggcatggccgccgcgttcggcgccggctggctggccgaccgggccggcgcccatcgggtcctcgcggcggccaccctggtgcagggcgtggcgctcgccgcgtactgccgagccggtaacccgatgtccttcttcgtggtcgccgcggccgcggtcggcgcgcagggcgcacagcggaccgcgcaggcgacgctcgtcgcgctgcactgcaccggtccggaaaggatcaccgtgcgggcgcgtctgcgggtggtcaccaacgtcttcgtcgggctcggctcggccgccgccaccgccgcgctcgccgacggcaccgccaccggctaccggatcgccatgctcgcggcgtccgcgctggtgctggcttcgatcatgccgctgcgcggcctgccgccacgtcgggccgcgagcacctcccggccgtcgatgcggacaccgctcaaggatggacggtacgtcgtcatcgccgccctctacgggctcctgaccgtccagttcggcctgctcaccgtcgggatgccactctgggtgaccggtcacacgcgcgccccggccgccacggtcgcgctgctgctcgtgctcaacacggtcctggtcgcggtcttccaggtaccggcggctcgtctggtcacggacgtgcgcacggccgggcgtaccgtcctgtgctcgtcggttctcctggtcctgacctgcgtcttctatgccgcggcgggcccgttgccggcggcggccgcggtcggcgtgctgatcctggcggtgctgacggcgagcgctgcggaggtgctctccgaggcgggtgcctggtcgctggcgttcgagctcgccgatccggccagtccgggtggctaccagggtgtcagccagaccggtttcgcggccgggacgatgctcgcgccgctggtggtgaccggtaccgggatcgcgcacggcgcaccgggctggctgctgctcgccgcgatgttcctgaccgcgggcgtcggcaccgaccggctggcgggcgtggcctcaggacgcctggcgggccggcatcgtggctga

SEQ ID NO: 6560 - DNA, 990 bp, Actinoplanes utahensis
gtggccgcgaacgatgtagcgttccgcttcatggtggtgcggtatcagctcggcggacgggatctcgggcgggtgcggttcgcggtgtcgcccctgcacgagctggtgctgtcgctgcacgcgtggcgcgatccggggcggtatccgctgcagctgccgtggatccgggagatgcgtggggcgatcgacgggctcgacgcggagctcctgatccagctcgtcaatgatgaattgtggacaccggatttcctcacgccgcgtccctggtcgcccctgacccggctggaggacgagtgggaggtggtacgtcgtacgcccgccgtcgttgttgatcgtgaattgcgcgcactgcacggagggttgcccgcggcgttgcgcggagacgacgtgctcgcccggatcgtggacgcgctgaccggatactgggagatctgctttgcgccgcactggccgcggatgcgggcgctgctggaggcggacgtgacctaccgcggccgggagatcgcgcagcacgggctggcccggatgctcggcgggctcgccgggcgggtccggctcaccggcgacaccgtcgaggtgttcccgcgcgcggcgctcgattacacggcgcccgcgaccgacggtctgacgctggtgccgacgatgtggacgaccagcgccgccgtgccgttgcgggccgaccggccaccgatgatcagctatttggcgcggggactcggcaccctgtgggagccgcagccgctgcccgcgcccggagcactcgccgggctgatcggggtgccccgtgccgggctgctggtccagctcgcggtacccgcgtcgtcgaccgagctggcggcgcggctcggcgtgacggtgcccgcggccaaccagcatctgcgggcgttgcgggcagccgggttgctggtcagcgcccggcacgggcggtcggtgctgtatcggcggtcggacctcggggaccggctggtggcgtcctcagccgccggctag

SEQ ID NO: 6561 - DNA, 1272 bp, Actinoplanes utahensis
atggcccaccaccaccgaacggccgggtgccgcgtcgaccgtggccaggaccgcggccagctgatcggcgagggtcgccgagctgttgccgtcgccctgacccggcagggtgaccggcaccgggtgacggccccgggccgtcaggccggcggcgacaccggtccacgccgtcgggtcgagccagagaccaccgagaagcacgatctgatccgcattcatggaggcaccgtagaggggattccggacgatccgcttccggtaccgtcctctactgttctcgttgtgccgaccggacccggccccaccgcgcgggccctgcgcaccctggagatcctgcaggcacgtccggggatcaccgccggccgactggccgcgctgctgggggtgaccgatcgggcggcgcggcgctacgtcgagatcctgcgcgaggcgggcataccggtcacctccgtgcgcgggccctacggcgggtaccggctcggccgcgggacccggctgccgccggtcgtgttcacccaggaacaggcactggggctggtgatggcggtgctggacgggcagccggcggccatcgacgcggacgacctcgtgggggaggcgctgagcagggtgatccgggcgctgcccgggcgtgtgggggagcaggcggcggcgttgcgggcctacgcctcggcgacgccggaccggaacgcggtgcgggctgacccggcgatcaccggcgagctggtcgccgcggtggccgagcgacggcgggtgctggtgggctaccggagtgagcgtgggcgggagcaggagaccgaggtcgacccctgggcggtggtggtccggtacgggcgctggtatctgctgtgccactcgcaccgggccgcggccacccgaacattgcggatcgaccggttgttcgcggtcgagcggttggagcggggattcatcccgccggaggggttggatccggtcgcggcgctggaggcgaacctgggggccgggtggaaatatccgacatgtgtgcggttccatgcgtcgctcgcggaggtcgccccgtggatccgggggccgatgggacgcctggaagcggacggggaccggtgcgtgctgatcgggaccacccggaatcccgcgatgtacgcacaggagtggctggcggccattcccttcgacttcaccgtggagggtggtcctgagctgcaggccgcggtggccgcggtcgccgcgcggttcggtgcggccgtctcgccggccgccgcgcccggcgaaaatgtcggggggtcctga

SEQ ID NO: 6562 - DNA, 327 bp, Actinoplanes utahensis
gtgcagacaccagcgatggtcggcgcggcgcgggagcgtgcgcgcgcggccggattcacgatgtcgtccgaggacggctgcgggcggttgctcgccggggcggtgcggcgcggcgggagatggatcgatctggacaacaccgtcgcggcgtcgacgcccggcggtgtgctgctggtcgacgacctgcagccggagcagtgggggagtgcggatcatgagcggttcaccggtgaggtggcggcggcgttgcgcgggcatccggggctgaccgcggtggagatctcctggagcagtggtgtgatcctgtgctcgcggcggggtgcgtga

SEQ ID NO: 6563 - DNA, 558 bp, Actinoplanes utahensis
atggtcgggttcgagatggacgcgggtgcgctcagtgaggacgagcgggctttcgtggcgacgacgcggtcggcgctgtctgccgacgtgtccggattcgtcgggcgggtcggtgggcggctgctcgtgggggtgtcggtcgtcgaccggatccccgggcggcatccggtgaccgtgctgatgatcggcgtgcactacggcgacgggcaggtgctcggcggtcggctggatcacgaggactacgcactgctcggcgaggcgcgcttcgaggcgggcggtccggccggtgagctggggcgcgcggcgggcgagtggttggctgacgtgctgggccggccggtggctctgtactgctggatgcgggacgggcaggcggtcgcctgtcagtaccggttcgcggacaccggcgaggtgctgctgcggtcggggacgccgcggccgggggcgcccgacatcgtggtgccgatccgcggcgatgtctcgggcattccgctgccggtgggtgccgtgctgtccggggagcggccggccgtcaccggggtctggcgggaggggtga

SEQ ID NO: 6564 - DNA, 828 bp, Actinoplanes utahensis
atgggaacgcgggacgccgggatgctgtcggtgggcgaggtcgcccgccgcgccgggctgaccacgaaggtgctgcgcaactacgaccggctgggcctgttcgtgccgcggatggtctccgccgacggctatcggtggtacgccgagagccaggtggcgaccgccgtcaccatcgcccggctgcgcgcgctcgacgtcccgctgcaggcgatccgggccctgctgaccggggccggcgagcaggaggcccggcgcctgctcacccggcaccgcgcggcgctgcaggcccgtgccgaccggatccgccgatccctgcactccctcgaccacctgctcgacgacgaacgaggaatcaccatggcgatgaccgcaccccagccgccgaccgtcaccgaggagcgggagctggcgcgcaccctgttcaacgacacctggtcgttgatcgagaaggagtcccgctcccccgccgaggacgaccgcatgatccacatggcgcacgcctcccgcttccactgggacaacgccggcgacgaccagaaccgggcgatcggcgaatggcagtgctcccgggtctacgcgactctcgggcgggccgagcccgccctctaccacgcccagcggtgcctgacctacgccgaccgcccgggcgccgagatgtggctgcaggcgagcgcccacgaggctcttgcccgcgcccaggcgatcgccggggacctgccggccgcccgcgactcccgcgcccgggccctcgccctggtcgacaggatcagcgacccggaagatcgcaaggtcgtcatggccgacgtcgacaccctgcccatcccttga

SEQ ID NO: 6565 - DNA, 1332 bp, Actinoplanes utahensis
atggatgaacgccgctatctcgccgccgccgccgtgtgcgccgcgacgctgctcgccgtcaccgcctgcggtggcggcggcaggtcggccaccggcgacgacggcaagccgaagaccgtgccgaccacccgcggggagggtgcgaccctcaccgtgtgggtgatggacggcgactacaccgacgccaccctcaaggcgatcaacaaccaattcacccaggcgaccggggcccgggtggacctccagatccagcagtgggagggggtcaccaccaagatcagcacggcgctctccaccaccggcaccccggacgtgctcgacctcggcaacacccaggtgcccgggttcgcggccaacggcggcctgctcgacctgaccccgtacgccgccgacctcaagcagggccaccggtggctggccgggctggaggagccggccaccgtcgacgatcacctgtacgccgtgccgggcttcgccggggcacgcgcggtgatctacaacaagaagacctgggcggccgccggcgtcaccgcggcgcccaccacgtacgcggagctcaccgctgcgctcgacaaactcggggcggccaacccggcggccgacttctcgccgttctacctgcccgggcagtactggtacgcgggcatgcagttcatctgggacgccggcggcgacatcgccggcgacgagggcggcacctggaagggcggcttctccagcccggccgggcagaagggcctggccgacttcaagaccttccagaacacctactccagcaaggcttcacaggccctggacacgatcaccccggaccagaaccaggtgttcgccgacggcaagaccgcgaccatcctctccacggccggctcgatcggtctgatccagaaggacaaccccaagatcaaagccgaggatctgggtacgttccccctgcccggcgtctcgggccgagcgcagccggtgatgctgggcggctccgactggggcatcgccaccaagagcgacgccgcggatctcgccctgcagtgggtgaagatcgcgtccagcccgtcggtgcaggacaggtacgtgttcggcaacgacggctggatcccgaacagcaccgagggcatccaggccgcccagcccggcctcaaggagcagcagaagggcttcttcaccgcggcgctgacctccaaggccaccccggccgccgcccagtggcccaccctggagggcgacaagagcatcaaccaggtgttcgccacggtggtctcgggcgccaggtcgccggccgacgccggccgggagttcgacgcccacctggagtccaccctcgccggcggcaagtga

SEQ ID NO: 6566 - DNA, 981 bp, Actinoplanes utahensis
gtgaccgtcgtgcccgtcaccaccgtgctccaggacgcggccggcgccacgccggccgcaccacccccgctcgccgcgcgcccggcccgacggcggcgcaccctggccccgttctggctgctcagcccggccggcctggtgctggccgcggtcaccctcgcgccgctcggcttcctgatcttcacctcgttcaccgactacgaccagcgcaccctgttcaccggcacctaccacttcgtcggcgcggaccagtacgccgagctgctggccgacccggcgttctggacctcgctggtgcgcaccgtgctgttcaccgtcgcgatggtggccggcagcgtgctgatcgggatgggcgtctcgcacctgctgacccggctcgaccgcggctggcgccacaccgtgaccgtggtgctgatcgtcgcctgggcgatgccgaacgtggcctccgcactggtctggaactggctcttccagcccggctacggcgtgctcaactgggcgctcggccaggcgcgggtcttcggcgacaccaccgatctcaactgggcacaggaccccgcgttggcgtacaccgcgatctggctcttgatcgtctggcaggcggtgccgttcatcgcgctcaccgtgaacgccgcggagacccaggtgccccaggagcatctcgaggcggcccggctcgacggtgcgggtgaactcgcggtgtaccggatcgtcaccctcaaccacctgcggcccaccctgctgctggtcaccatcctgtcggtgatctgggactacaacgtgttcaaccagatctggctgttctcccgcggcggacccggcgacgacaccgccacgctcggcgtcttcacctacaagacggcgttcgtcggcttccacatcggtcagggcgcggccatctcggtggtcaccacggcgctgctgctcgcgctgaccgccgtctacatccgtggcctgctccgctcgggggaggacctgtga

SEQ ID NO: 6567 - DNA, 828 bp, Actinoplanes utahensis
gtgagccaccgcggacgccggatcgtcaccaccctcgcggcggtcttctgcctggtctggatcttcccggtctactggatggtcaacaccgcgttcaagccgcgctccgaggtgagcacgaccaccccgcacttcgtgccgatgcacccgaccctggccaacttcagccgcgcgctgggtcaggaccagtttctcaccaacctgcgcaacagcgtcatcgtggtcgcggtgaccgtgctgctctcggtcgtgctgggcaccttcgccgcggccgcgctgtcccggttccggttcgccggccggcgaaccgtcatggtggtcatcctggccgtgcagatgctgcccggcaccgcgctgctgatcccgatgttcgccatgttcaacagcgtcgacctgctcggcacgtatctggcgctgatcctcgcctacgtggccaccgtgctgccgttctcgatctgggtgatgcgcggcttcttcgtcgccgtcccggccgaggtcgaggaggccgcccacctcgacggcgcgtccacctggcggaccctggtcagcgtgctgttcccgctggtcgccccgggcgtcatcgcgagcagcatcttcgcgttcatcgccgcctggaacgactacctgttcgcctacacgttcatgcaggaccagagccggtacacgctgccggtctggctggcgtcgttcagcaatccgcacaccggcaccgacttcggcgggcagatggccgcctcggcggtgttctccgtgccggtcgtcgtgttcttcctgttcatccagcgcaacctggtcgccggaatgtccgccggcgccgtgaagggctag

SEQ ID NO: 6568 - DNA, 1593 bp, Actinoplanes utahensis
atgtcagcggacacggaaatacccgactcccaggccgtgctggccgccgccctggacgcctacctggccttcgacgccaccggccgggtggtggcctggaatccggccgccgagacgacgttcggctacccgcgggcgcaggcggtcggccgctcgatcgaggagctgatcgtggcccccggggcgcgcgaggccggccgggcggagctcgcgttgctgaccagcggccagccggggcagacccgtaaccggcggcggcaatggtccgcctggcacgccgacggccacgagattccgatcgagatgacgctgaccgccaccgactcggccaccggccggttgttccacatcttcgcccatgacatcaccgccgagcatcgggccggccggttcaccgcggtggaggccgccgtcgcccgcgggctcgccgaggcggactccagcgacacggccgccgagcgggtggtcgaggccctcggcgtgaagatgggctggccggtgaccgagctgtgggtggtcgacgacgacaggcagctgctgaactgtctggcccggcacgtcgagccgggccggcggctgcacaacttcgccgtcgacacgctggagctcggcgtcgcgctgcccggccgggtctgcgccgagggcactccgcagtggatccccgacctgaccgccgacaccggttcgctgcgcagccgcgccggcgcccgcatcgggttgcgggtggccgtcggcgtcccgctctgcaccggccagcacgtgttcggcgccctctgcgtctacggcaaccgggtcgaggatcccgaggacaccctgatcgccctgctcagcggcctcgccgcccagatcgggcagtacgtgcagcggcgccgcgccgaggagctgaccatcgagctggcccgtaccaaggacgagttcctcgccatggtcacccacgagctgcgcagcccgctggcggccatcaccggcaccgccagcctgctcgacgacgagatcgacgacctgagccccgacgagcggcaccactacctgcggatgatcacccggaacgccgagcgcctgtcggtgatggccgaggacctgctggatctggcccggctggagtccgggagcctgggcatcagccccgtcggcaccgacctgtgcgagatcatccggcagtcgttgcaggcggtcacccccgcggacaaggacctgacgatcgtcgcccggctgccggaacgcctggacctgtacgccgacccgggccggctccgccaggtcgccgacaacctgctgtcgaacgccgtcaaatacacccccgagggcgggacggtcaccgtgaccgccgcgatggacgacagtgcggagacggtcacctggaccgtcgccgacaccggcatcggcatcccgtcggccgagcggccccggttgttccgccgcttctaccgcgcctccaccgccctggaccgccgcatcccgggcaccggcctgggcctggtcatcgcccgggcgatcgtcgaacgtcaccgcggcaccatcaccctcgcggaccacagcggcccgggcaccaccttcgccatcgagctgccggtcaaaccggcccccggctag

SEQ ID NO: 6569 - DNA, 2169 bp, Actinoplanes utahensis
gtgccggaactcgacgtcgcggtgctgacttcgccgcaacggctgcgagccgtggcgagcgcacgccgggagttgccggtcctgccggtgccgctggacggcatggcccggatggcggcgcggatgctgcggacgccgatggcggtcgtcaccctggtgcagggcggcgaggaggagttcctcggcctgttcggactgccggagccgttcgccgccacgcggcgcgccgcactgcagttctccctctgcgcgttcgtggtctgcgccgacgacgtggtcgcggtggacgacacgctcgccgaggaaaggttgcgcgagcatccggtggtccggcagtggggggtccggtccttcgccgggatcccgctgcacgacaccgacggccagccggtcggtgcgatcaccgtcatcgacatcgcgcaccgctcctggaccgcgccggacctgacccggctcacgtacatcgccgacatgctcggcccgatcccggcgggcaccccgtccgccgaggcggccatggacctgctgtgcaccgaccaccgcggcaccggcccgcagccggccgccggcgtcgcggcccaggcccaggtgcagcaggcgttcatcgaggcgctgctcgacagcctgcaggtcggcgtggtggcctgcgaccgcgatcgccgcccggtcgtggtcaaccggatgatgcggcacctgttcggcctgcacgacggcatctcccgggaggaggcactgaccgccggcctggcccgcgtgcaccacctcgacggcactccgatcgcccccgacgaactggtggtgacccgggcgctcaacggcgagacggtgcgggacgccgcatcgatgctgtgcacccccggcgcaccggaccgctacctgttggtcaacgggcaacccctgcacgaccacgacggcaaccgtctcggcgcggtctccaccgtcctggacatcaccggccggcgccgcaacgaacgcttccgcgactgtcagctgcgggtggcgcgcatcctcaacagcagcgacacggtggagcaggcggcaccgcggctgctgtcggccgtcggcgaggcgctgggctggcagcacgtcggactctggctcatcgacgacgtcgccgacgtcgcccgcccggccggccactgggaggcccccggcgtacacatcgaggatctgatcccgcaacggctcacccgcaacgaccccggcctggtcggcaccgcctgggccaccggccggccgatctggatcgccgacctcgccacgaccacctccaccgacccgcggctgcgtgacttcatcgccgccgccgtccaccgcgacctgcggaccgcggtggcgatcccgatctgcgagaacgacaccgccctagccgtgctcgtctgcctgagcgccctcggcgagcacgacgacgcgccgctgatcggcctgctcaccgacatcgccgaacagatcggccggctcctggcccgccgccgggccgccgaactcgacctgcagctggccagcgccaaggacgacttcctcaccctgatcagtcacgagctgcgcaccccgctgaccacggtgctggcctgcaccagcatgctcgccgacgacccgcaggtcgacccggacacccggcagatgctggccacggtcacccgcagcaccaccgcggtgcaacgcatcatcgacgaactgatcgacctggccggcatcgaatccggccaccacccgctccacaaacgcgccaccgacctggtcaccgtcgtcaccggcgcgctcgccgccgccccacaccccgacgacatcgagatccacaccgatctgccgccgtccctggtcgtcgacggcgaccccggccggctgcgccagatcgtcgaccatctgctgtccaacgcgatcaagtacagcccccgcggcggcgacgtgcggatctccctgtccgccgaccgcggcgacgtcgccgaactcgcgatcaccgacaccggcatcggcatccccgaagcggaccgcgccggcctgttcacccgcttccaccgggccggcaacgcccggcacaccgccgtcaccgggaccgggctcggcctggccctggtccgggcgctcgtcgaagcccacggcggcaccgtcacccacgacccggcgcaccaccccggcacccggatcaccgtgcgtctgccccgctga

SEQ ID NO: 6570 - DNA, 699 bp, Actinoplanes utahensis
atgacgatcaccttcatcaccggggccaaccggggcctcggccgcgagaccgcccgccgcctgctcgaactcggacacaccgtcatcgtcggcgcccgtgatccactgctcggcgccgcgaccgccgcggcactgggcgcccggttcgtccagatcgacgtcaccgatgacgcgtcggtggccgccgcggtggcggccgtcgaacagcacgagggctcgatcgacgtcctgatcaacaacgccggggtgcacgggccggtcggcgatcccggcgccctgaccgccgccgacatgctgggcgtcttcgacgtcaacctgttcggcgtggtccgcaccacgaccgcgttccttcccctgctgcgccgctcgccggacccggtgatcgtcaatgtcagcagcgcgatgggctcgctggccgccacccacgacccggcacgaccggaggcgggtgtggtggctcccgcgtacacgtccgcgaaggcggcgctcaccatgctgaccacccagtacgccaagggcctgcccggcatccggatcaacgccgccgatcccggctacacggccaccgacctcaacggcaacagcggcccgcagacggtcaccgagggcacggacgcgatcgtcgcgctggccaccgagggtccggggcacggttccggtcggttcgtcgaccggcacggtgagatcacctggtcctga

SEQ ID NO: 6571 - DNA, 870 bp, Actinoplanes utahensis
atgacgacggagggggcagggctcggcgcgacgatccgcgcctggcggaaccggctgtcgccggccgcggcggggctgccggcccggcgggcgcgccggaccgccgggttgcgccgcgaggagctggccgagctggccggcctgtcggtggactatgtcgtccggctggagcagggtcgggcgaccacgccgtcgtcccaggtcgccgcggccctggcccgggcgctgcagctcagcgtcgcggagcgggaccatctgttccggctgtcgcgcctggcgccgccggcggacgaccggatcagcgaccacatcccgccgggcgtgcagcgggtcgccacccggctcggcgatgccgccaccgccatcttcgccgccgactggcagctgatctggtggaaccgcggctgggccgccctgttgggcgatccggcggcggtgccgccggccctgcgcaacttcgcgctcgacacgttccccacggcgcccggcgcgacgccacggctgtcccgatggcccgtcctctcccgcgacggcgacgccacgaaagcggcgatcgtggccgacctgcgcggagccaccggccgtttcccgcgtgaccggaggctggcgcatctgatccgggacctcaccggcggcaacccggaattcgccgagctgtgggcgtccggcgcggtcggcgcccatcgggaggaccgcaagaccgttcaccatcccacggtcggcccggtcacggtcgactgtgatgttctcagcggcggggggaccggcctgaagatcgtcatcatgaccgccacgccgggcagtccggacgagacgaaacttcgcttggccgcggttgccggctcgcagctggaggactcgcaccggtag

SEQ ID NO: 6572 - DNA, 621 bp, Actinoplanes utahensis
gtgtacacgtatctggactcggtcgtcgatgagtcgcctgcccccgctgcgccctaccgcacaccggtcagcgccgagccgctcaaggtgtatcagaagcggccgttcctgatcggcctcggcagcgtggcgctggcagccgttgtcacgctgtccgttctgtacacgggcgccctgggcgacaacggcaggctctcggaccagaacaacggtctcgtcgcgcagagcaccgtgctcgcccagcagaagcacgcgaccgagcaggagctcgcgagtacccagacgcagttgacgagcacgaaggacgatctgcagaccgccaatgacgacctggcatcgaccaggagtgagctgaaatccgcccaggccaagctgagctcggcatccagtcagatcggcgactgccagcacgcggtgaccggcctcctgacggcgggccagaccctggcggaggcggggaagctgacggccgaggcgatgtcctacctgatcgacggcgactacgacacggcgacaccgctcatcgaggaggggacggcgaaggtcaggagtgccacggcctcgatcaagtccctcaaggcggagatcggttcctgcgccacctcctcctccgcggcctga

SEQ ID NO: 6573 - DNA, 834 bp, Actinoplanes utahensis
atgcgtaccgtccctctccgctccggcaccgtcgagtacgacgacagcggtggcgccggcccggttctggtcttcctcaccggcatcctggtcggagcgaccctctggcggcatgtcgtcgccgacctgcgcgccgatcaccgctgtgtcgtcctggaggtgccgctgggcgcccaccgcctgccgatgaacccggacgccgacctcagctcccgcggcctggccggcctggtcgccgagttcctggacgccctcgacctgcgcggggtgaccctgatcggctgcgactggggcggcgcgcagctggtcgccgggtacggtttgagcagccgcctggcccggctggtgctgctgccgcaggagtcgttcgacaatttcccgcccggcctgcccggcaaggccctccaccagtcgtcgaggatccccggcgcgaccttcctggccctgcagacgctgcggatccgcggcctgcgccgctccccgatgaacttcggcctcatgtcgaaacgcccggtcccggccgacatcatggacgattggttgcggccgtcccgcacctcccggccgatccggcgcgatcttcacagatacctgcgtacgacgagggccgccgagtatctcgacgcggccgcgctgctgtccactgtcgaccatccggccctggtcctgtgggcgccggagtcccggatgatgcgcgcggccaacggcgcccgcctcgccgagatcctgccgcggggccggctggtcgaggtcccggacgcgttcaccctcatcccggaggaccagcccacccggtgcgccgcccacctgcgtgagttcgtcgccaccacctga

SEQ ID NO: 6574 - DNA, 996 bp, Actinoplanes utahensis
gtgctggacgggaacagcctggtgcaccgggcctaccacgccagtgacggttcgccggagccggcgccggcgctgcgcggcctggtcggctatctcgcgcgggccgccgcccagcttcggccggacgcggtcctggtcggcttcgactgcccgcacgattcggcccggcgcaccgaccacccggattacaaggcgcaccgcccggccaaaccggccgagctgacccgccagctgcagatcgcccccgacctgctgcgggccgcgggagtcggcacggtcgtgccgccggcctacgaggcggacgacgtcctggccagcagcgccgccctggcccgctcgctgggctggcagtcggtgctgatgaccagcgaccgggacgcgttcgcgctgatcgacgacaccacctcggtgttgcgcatccgcaacggcggcttcgaccggtcggtcctggtcgacgcggcgtcgctggccgcggcgtacggcgtgcacccgtggcagtacaccgacttcgccgccctccgcggcgacccttcggacaaccttcccggcgtacgccgtttcggggctcgcaccgcggcccgcctgctcaccgcgttcggttcggtcgacgcggcgtggcaggccgacgtcgcggcgctccgcgaggcggtcggcgagctggccgcgacggcgttgctggagccggccgcccgggaggccgtcgaccggaacaggcgactgatgcggatgcgccacgacctgccggtgcccagcctggagacagcccggctgccgctggactacctggtgatccgccgcgccctgcgcgagcacggcatcaacctgggcccgtcgctgtgggccctggtgggcggcgacgccccggcgccgtcgctgctggagcaggagccgcccgagccgccgcccgcctgggccgccaccctcaagccgcgggttctgcacggctcgatgtccggccgccgcgaccccatcccgggccagaccgcgcttttctga

SEQ ID NO: 6575 - DNA, 798 bp, Actinoplanes utahensis
gtgcagcgcaccgccctggtcaccggagcctcctccggcatcggcctcgccaccgcatccgccctggtcaagcgcggttaccgagtgctcggcacgagccgcgacccggccacggtgacccagcccgcggccggtgtcgaatatgtcgccctcgatctcacctcggacgcctcgatcgcagcgctcgccgatctgctgggcggcgtcgacgtcctggtgaacaacgccggggagagccagtccggcccgttcgaggagctgccgatggacgcgctgcgccggctgttccaggtgaacgtgctcggcccggtgcggctggcgcagctggcgctgcccgggatgcgcgggcgcggctacggccgggtggtgatggtcggatcgatgctggcctcgttcccgctggcctaccggtcgtcgtatgtggcgaccaaggccgccgtgaaaggtttcgcgaccgcggcccggcacgagtattcgccgttcggggtgtggctgaccaccgtcgaacccggctcgatcaacaccgggatcagcgagcggcgcaccaggcacgtggcggacggttcgccgcaccgggcggacttcgaccggatgctgaccgcgctggatcgcaacgagaaggccggcatctccgcggagacggtcgccgcgaccatcctcaccgcgatcgaggcggagagaccccggcagcggtacgcggtgggcagcaacgccccgctggtcttcgcgctgcgccgcctggtgcccgcccgcctggtcgagaccatcacccaccgtaggcacgacctgcgccgctga

SEQ ID NO: 6576 - DNA, 720 bp, Actinoplanes utahensis
gtgaagctcatcaagacgaccaccgtcgcggtggccgccggcatgctcctgctcggagggtgcggcgacaagaagaccgacgcgccgaaggcggacgccaccaccacggcctccgctgccaccgacctcaccgcgctgtccgccgacgagatcctgacccgagccaccaaggcggttcacgacgccaagtcgttgcacatcaagggcatcgagaacggcgagggcggcgagaagatcgcgatcgacatgaagcagtccgggaagaacgtgctgtctcggttgaccgtcaacggcatgaacgtcgagttcctggtagtcgacggtgtgcagtacgttcgtcccgatgcgaagatgtacaagacgctgaacctcaagttgccggcggccgtcaccgccagactggccacgatgtggatgaagccgaccgccggggacagggtcttcgccccgatggccgagggcatgaccatggacaatatgctcaagccggacggcacggtcaccaagggcgagaccaccacggtggacggcaaacctgcgatcgccctcaagtcggccgacggcgatctgctggtcgcgaccaccggcgagccgctgccgctgaaactgatgggcggcaaggacggcggtgccatcaccttcagcgagtacggcgcggacttcccggagatcaaggcgccggccgcgagcgaggtctacaacctcccgaagacgagctga

SEQ ID NO: 6577 - DNA, 1800 bp, Actinoplanes utahensis
atgtccccatccccacgcgctcgccgggcccgccgcctggccggcgccggcgcgctggccgcggcggtgatcgccgggctcgccgtcacggtcgccaccgcgcaggcggcgacactgttcagcgccgatttcgagtccgggtcgaccggcggctggtcgaagtcgggcggcacctggtcgatcgtcaccgacgggtcgaaggtgctgcagcagtccgacaccaccagcgagcgggcccgcgagttcggcggcaccggctcgtggaccgactatgcggtgcaggcgcgggtcaaggcgaccgcgttcggcaccggtgccggcgtggtcgcgctgaccgcgcgggcggccggcgccaccaggatgtaccggctgtcgctgaccgggtcgaaccgggtgcagctggaagcgatgaacggcggtgccgtcacggtcctggccagcctcgcccagaccatctcgaccagcaccttctacacgctgcggctgacggtcagcgggaccacgatcagcggcacggtgaacggcaccagcgtcggcagcgtcaccgacccgtcgatcgccggcgggcggatcggactgctcaccgagcacgcggccggccggttcgacgacatcgtggtcgacgacagcgggtcctcgacgccgtcgagcggcggcccggccccgtccggcagcagtcccgcgccgagcccgggcaccagcacgccgccggtgaccggggcgctgtacgtcgccccgaacgggaccgacggggcggccggcacggtgtcctcgccgaccacgctcacctcggcgatcggacggatcggcgcgggcggcacgatctatctgcgcggcggcacctacagctatgcgcagacggtcgtgatcccgcccggcaacaacggtacggcggccgcggcgaaaacgctctcggcgtaccccggtgaggttccggtgttgaatttctcggcgcagaccgagaatccggcgaatcgcgggctgacgctgaacggcaattactggcacctgtacggaatagtggtggaacgggccggcgacaacggcgtcttcgtcggcggcagcaacaacaccatcgagcgggtggtgacccggttcaaccgggacagcgggctgcagatctcccggatcgcatcggacacgccggccgcccagtggccgtcgaacaatctggtgctcagctccgaatcgcacgacaacgtggacgccggtggtgagaacgccgacggtttcgcggcgaaactgaccgtcggcaccggcaacgtgttccgctacgcggtgtcgcacaacaacatcgacgacggctgggatctgttcaccaagaccgccaccggcccgatcggcccggtcaccatcgagaattcactgtcgtacgacaacggcacgctgaccgacggcacccaggctgccgccggtgaccgcaacggttacaagctgggcggcgagagcatcgcggtcgaccacatcgtgcggcgcagcatcgcctaccacaacggcaagcacggattcacgttcaacagcaaccccggttcgctggccatctcgaacaacctgagcatcgacaacggcgcacgcaacttcaacttcgacggcggtacgtcggtgttccgcaacaacacgtcgtgccggttcagcagtggcacgaacgaccggatcatcggcgactcggacagctcgaaccagttctggtcggggacgaacggctcccggtgcgcgacctacagcggggcgctggcctggtcgttcagcgcgaccggggggctcctggtgaccatcggggggaggacggtcacgctctga

SEQ ID NO: 6578 - DNA, 861 bp, Actinoplanes utahensis
atgtcccgaccggtccccgccgacctactggaaatcaccgatgcgctgctccccggcgccccgctcgactccgcacgcctcgccgagcacgggaacatgcaccacgtggtgctgcttcccggcatcgccgctgtgcgcgtcagtaagcgggccggtgctgccgccgagttgccgcgccgggtcggcatacttcacgctgtcgcggcggccggcatgccgttcgccgtgccggagccgatgaccgcggtcaccaccttcggcgaacgggcggccgtcgcggtctcctggatcgacggcgcgtccctgccggaaggcaccggagatccgacggtgttcggtccgctactggacgcgctccgcgaggtgaggatctcgccggagctcgaagccgcgctccaccggccacgccggcgcgccgatgacggttcaggctgggccgacatcctgaacaaccaggtcataccacggctgccggcgaggtggcgggacagggtccggcagcgatcagacgaacttctggcgatcgaggaggtcccggccagcctcgtccacggcgacctcggcggcggcaacgtccatttcggcgcggacggcacactgaccggggtcctcgactgggacatggcgatcctgtccgacccggcgatcgacgcggcgctggtcgcgacctggcacggctggcacatgctccgcgcggcgaccgacgagcagatctaccggcgcgccggggcgtgggacgcagccgtcggagccgggcacctccacgcgatcctccgcggccgacccctgtcgaacgtcgacggcttcgtccggtccgtcatcgcctggcttgaggaccccggccggtgccgtgaccgctga

SEQ ID NO: 6579 - DNA, 4590 bp, Actinoplanes utahensis
atggccggcgggaatgccgtcggcggccagcgggtccagtgccgggtcgacctccggctcgccgtagagcggcgccgcgtaccccgcgatcgccgccgcgggcgagggcagcagtgcgcggtccggattgccgctcgccagattgatcgcggcgtcggaggcggcgtgcccctcccccgcggaccgcggcacgcccagcacgacggtgccgccgcgacgccgcgtctgcaccaccccggcggccgcgagctgggcataggcggccgcgacggtgttccggttgacgccggcgcgggcggccaggtcgcggatggcgggcagcgcgtcgccctcgctgagcgccccggtctggatcagcgcgcgcaccgagccggcgatctccgcggcggtgttcccctcgatcacaccgcgcaccctaccagttatgtcctaggacaaaatacgggcgctcattgttccgcaccatcggccgatcatgacggtatgaatgtcgggcaccgggcgcggctggacgaccagccgacggagctgctcgcccgcgccttcgaccgcagtccggtcccgaagctggtgctcagcctcaccgaggccgagtacgggcagttcagcgcggtcaacgacgccttctgcgagctggtcggctacccgcgtgaggagctgctcggccagtcctgcctgatgcttctcgaccaggacggcctgggcccggtcaccgaactgttcgccgcgatggtgcgcggcgagctgagcgtgatggcgatggagcgggtgctgatccgccgcgacggctcgcgggtgtggatcgtcagccagaacgtgctggtccacgatcgggacgaccacccccgcctggtcgccgagatcgtcgagagcagcagccgaccggcgctggccggcagtgaggcccggttccgcacgctggtcgactcgtcaccgatcgggatggcggtactcgacccggacggcgcgtggctgcgggtcaacccggcggtctccgcgatcctcggctacaccggcgccgagctggccgggctcaccctgggcgggctcacccacccggacgagcgggcggactgcgcggcgatgctgcgggacctggcccgcggcgcgcgaccgggtttcgagggccatttccggtacgtcggcaaggacggccgggtcctctggtgccggctgacggtcaccccgttgcacgccgagtccggtgccccgctggaactgctcgcccagctcgccgacgtgaccgccgagcggcgcagccaggaactgctggtcgaggcggagcaggccgccgcgcgtgaggccggccggctgcgcaccacgatcaccgtgcagcgggagatcaacgcggtggccgagaaccgggacgccctggtccggctgatcgccgaccggatcctgcaggtcatcccggccggccgcagcgcctcggtgcacctgctggaggacgattcggggatgctgcgcccggtggccgacgccggcatgacgctgcccgcggtgccggtcaccgagtcgctggccggcgtggcgctcacctccggcggcaccgtgcgcagcgacgacaccgccggcgacccgcgggtcaacccggtgatcgcccgggccaccgggatgggctcgctggtgatcgcgccgctgcgggcacccggcgccggaccgttcggcgtgctgatggtcggcagcgaccggccgtacgcgttcgacgacggcgacgagcggcaactgaccctggtggcggattcgatcggcagcgcgctgcggcacgccgagaacaccgcggcgcgggccgcgacgctggccgccctggaacgtgagcagcaacgcctggcccgcagcgaacgccagttcgccgaggtcgccgacaacagcccgatcgcccggatcgtgctcggcctgcgcgccggcagacgcggccggatcctgctcaccaacccggcgttctgcctgctcttcggctatcccgacgcggaggcgctgggcatgcacttcgaggtgctgctcggcggcccggacgccgacctggagcgcagcctcgacatcatggccgccggcgactatccgcgcggcgcccgcgaactggtgctgcaccgcaaggacggcaccccgctggtggtcaccgcgcactcgtcggtgatcaccgacgagaacggcccggccaccgtggtgatccagctgctcgacgtcaccgcggaacgggccgccggacgcagcaccgaacgcgaggtccgccggctgcgggccaccctggccgtgcaacgcgcggtgaccgaggcggccaccgaccgggcggcggcggtacgggtcgtcgccgatcgggccgtcgaactgttcccggccgccgacggggccgcggtcgagctgatcgacggcgaccagctggcgtacgtggccaccgccggcacgctgaccccgttcaccggcacccggatcccgcggtccgggtcgctcagcggcatcgcgctgagcaccgacgcgcccgcgcactgcccggacaccaccaccgacccgcgggtcaaccaggcgatgtgcgccaaactgggtatcggcagcatgctgatcgcgccgctgcacgccgaacacgaggtgatcggcgtcctcaaggtgtcggccgcggccgcgcacgtcttcgacgacaccgacgagcagcagctggccctgctcgccgacagcctgagcgcggcgctgcggcacgccgacgacgccacccgcaatgccgaggcgctgcgccgggtggagatcagcgagcggcggttccggctgatcttcgacaactcgccgctcggcctcaccctgtgcagcctgcgcaccgaggacttcgggcggtacctgcaggccaacccggcgatgaccgcgatcaccggatacacccaggacgagctgcggcagatgacgttcgccgagctgacccacccggacgacgtggcgagcacccgcgactacgcgcggcggttcatcgccggtgagatcgaatcggccggcatggagcggcgctacgtgcaccgcgacggccacaccgtctgggtggcgctgcgggtcgcgctgatcgtcaacgacgacgaccacgcccgctacgtcgtcatccaggtcgaggacgtgaccgcggcccgtgaggtcgacgcgcagctgcgccgctcggcccggctcttcgagttgattccggccgccgtggtcgtccgcgacccggacggcacgatccgctggtggaacgacggcgcgacgcgtctctacggctggccgctgcccgccgccgccgggaagcgggcccaccggttgctgcacaccaccttcccgtacgggggcagcgtggccgagcagcaggaggcgctcagccgcgacggttactggaacggccagctggaccacatcaccgcggacggccggacggtcaccgtgctcagccgtcaggtcctgcaccacctcgacccggatcacgcgcaggtgctcgaggtcagctcggacgtgaccgccgcccgggccgccgaacaggccctggccgaaagcgagcagcggcttcgcgcccagttcgccaacaccggcgtcggccagatcatcgtcgccctggacggcgcgctgatccgcgccaaccgggcgtacgccaccatgctcggccgcaccgacgacgagctccccgcccagtacgacgagctgctgtacccggacgacctggtcacccaccggagcctgctggccggcctgttcgccggcgacagcgagtcctacaccaccgaggcccggctggcccacgccgacggacactgggtgccggtcgaggcgaccatctccctggtccgcgacccggccgggcacccgaaactgatcgtcggggtgctcgccgacatcaccgcccgccgcgccgccgaacaggcccgcgacgccgcctccgccgccctggccgaacgcaacaccgaactcgaagccgccaaccagctgaaactcgacatcatcggcatgctcggtcacgagatcggcaacccgctgacctcgatccgcggcaacgcggaaatcctgaccgacgactggccggcgctcaccgacgaccgccgcggccgggccatcgaggcgatcgcccggcaggctggcgcactggacgagatcgtccaggaggtcctggccatggtcaccatcgagtccggcaagatccgcgccgatcgccgggcgctgcgggcccgcgaggagatcgaccgcgcccagtgggcggcgcagggcagcgaaccggtgccggtgtccggaccggacgccgtcgtgctctgccaccccgggcacctgcagcagatcctggtgaacctgctgtccaacgcccgcaagtacggcggtggggccaccgccgtccgcgtcgccgagaccggcggccaggtggagatcaccgtcgaggacgacgggccgggggtgcccggcgaattccggtcgcggctcttcgaacgcctggcccgggcggaccgcgacgcgaccacggtgaaggggaccgggctgggtctctacatcgtccgcggcctggcccaggccaaccacggcgacatccgccacgaaccgaacccgtccggcggttcccgcttcatcctgtccctggagtctgcgaccgctgcgtga

SEQ ID NO: 6580 - DNA, 846 bp, Actinoplanes utahensis
atgttccacgggctcagcgccttcccgctcacgccgatcgccgacgaccgggtcgacgccgacgcgtacaccgggctggtcgcccggctcgccgccgcgcgcgtcgactcgatcaccgcgctcggctcgaccggcagctacccgtacctgacccgggcggaacgcgccgcgacggtgcggctcgcggtagcggccgcggcggacatcccggtcttcgccgggatcggagcactgcgtacgtcgcaggtgctggccgccgcggccgacgcccagcaggccggcgcggcggcggtgctgctggcgccgatgagctaccagccgctgaccccggacgacgtgtacgggctgttcgaggcggtcgtcgcggaactgtcggtgccgctgatcgtctacgacaacccgggaacgacccacttcaccttcaccgatcagctgtacgcggacatcgccgccctgccgcgggtggcctcgatcaagattccggggccggcctccgccgcgcgggtggccaccctgcgcgggctgctgccgccgcacgtggcgatcgggatctccggggacgcgcacgcggcggccgggatcgggaacgggtgcgacgtctggtactcggtgctcggcgggacgcttccccgggcggcgcagtcggtgctcgccggcggatcggaccggctggcgccgctgtgggacctgttcgcggcgcacggaagtctgcgggtgatggcggcgatcgccgaacagctggggctcgcccggcgctcctgcctgccccacccgctgcgcgggctcgacgacgcggcccgcacccgcgtcgccgccgtggtggacgcattggacctcgccgggtga

SEQ ID NO: 6581 - DNA, 429 bp, Actinoplanes utahensis
gtggggccgaccgtcgtggccgcggtctcggcgtggtccggcccggccgcggcggcactgctgctggccggggcgaccgcgctggccgcggtgctggtgcggatgctgctgtacgcgccgcccgccgggacgccgtccgaggtgccccggcccgggcggacactgaccctgatggtccggtcgggcaccctgcgacgcaccctgtacctgaccgtgacggtcgccttcgccctggccgcgctgccggtcaccgcggtcgcggcggcgccgatgtaccgggtcgccgcggcggcggccggggtgctgaccgccgcctacgggctcggcaatctcgccgggtcggcggccggggtgctgaccgccgcctacgggctcggcaatctcgccgggtcggcggcggaccgcaggcttgccagacgcgtaacctga

SEQ ID NO: 6582 - DNA, 360 bp, Actinoplanes utahensis
gtggacgaggtggccggggcgatcgcggatccggtgcggcgggagatcctgctgatgctgcgcgccaccccgctgaccgccgggcaggtcgccgaccggtttgcgatcagcaggccggccgtgagccggcacctgcgggtcctgcgggaggcgggactggtccgcgacaccgtcgagggccgccggcgggtctacacgctggtcaccgagccgctcgacgagctcgccggctggctcgcccggctgacccgcccgtccggctggcagcaccggctcgacgccctggagaccgaggtgcaccgcacccggcgcgagcggcgcgccgccacacccgaccgttccgcgaaggagtccgcatga

SEQ ID NO: 6583 - DNA, 480 bp, Actinoplanes utahensis
atgagcccgaccccgaccggccgtctcctcggcgacgacctggtgctgacccgcacgttccgggcgccgatcgacgacgtctgggccagcatgaccgaatccgatcgcaccgcccgatggttcggcccgtggcggggtgagcccggcccgggccgtgtcatcaaggtgcagatggctcacgaggagggccggccgtggatggacatgaccatcgacgcctgcgagccgccccgccgcctcgccgtctgcgccggcgaggagaccgaccgctggcgcctggaaatgaccctggccgaggccgccggcgtcaccaccctcaccttcacccagcacctcaccacgctggacggtgtcggcgaggtcggccccggctgggagtactacctggacgccctggtcgccgcccgtgccgacgcgccgatgccgagcttcgacgactactacccgtccctgaaggagcactacgagtctcagcgctga

SEQ ID NO: 6584 - DNA, 537 bp, Actinoplanes utahensis
atgctgcggccggaaactgaccgcaatggctgccaggctggcggtatggacagtgagatcctggcggcggcgccgggcggcggcgcggcactcaacccgttcgtgatcgtggacgacgcggccgggttcgtcgcgttcgtcgtggcgaccttcggggtgcgcgagacggtggcggcccggaccgggatgccggacgggaggctgatccacgccgaggtgcgcctcggggtggtcgacctgatggtggcggaccggctcgacggctggccggcccggcccgggctcttccagctgtgggtgcgggacgccgccgcggtcctgcgccgcggtgcggcccgcggcgccgaagccgtcacgccgccgacgccgttctacggtgagcggaccctggcccggatgctcgatccctggcagaacctctggtggctgtacgagccggcacccgggcagcccgaccccacgccggcctgggcgggcggcccgggcacggtcttcaggaccctggaccgtgccctgaaggggctcggtcagcgctga

SEQ ID NO: 6585 - DNA, 810 bp, Actinoplanes utahensis
atgagtcaggacatcgctcgcgaactgggggtcacccccaccttcgacgccaccgcggagatcacccgccgggtgtcgttcctcgccggtgcgctcgccgccagcggcacccgcgccctggtgctggggatcagcgggggcgtcgactcgtccaccgcggggcggctctgccagctcgccgtcgagcagtcccgggccgccggccacgacgccgagttcatcgcgatgcggctgccctacggtgtgcagttcgacgaggccgacgcccagaccgcgctcgccttcatccgccccgaccgggtcctgaccgtcgacgtgcgcccggccgccgacgccgccctgcaggccctgctggccggcgggatgaccacccgggaccacgcccagcaggatttcgtgcacggcaacatcaaggcccgcgagcggatgatcgcgcagtacgcggtggcgtcggcggtcggcgggctggtcgtcggcaccgaccacgcggcggaggcggtcaccggcttcttcaccaaacacggtgacggcgccgccgacctggtgccgctgaccggcctgaccaaacgccgggtccgtgccctggcggcggcgctcggcgcgcccgacacgctggtgcgcaaggtcccgacggccgatctggagacgctgcgccccgggctggccgacgaggacgcactcggattcacctacgacgacatcgacgacttcctggaaggggccgaggtcaagccggagatcgccgacgcgatcaccacccgcttccacctcaccgcccacaagcgccggctccccgccgccccggcctga

SEQ ID NO: 6586 - DNA, 564 bp, Actinoplanes utahensis
gtgatcgacactgcgcccggggccgacctgcatcccgggctcgacctggccaacagccggctcgtggccccgggcggggtggtcaccgatctgctggccacgccggcggaggcgggcgactggctgatcgcgcgcgggctggcgccggccggggcacgactgcaggaggtgtgcgcgggccggctgcgcgcgttgcgcggggccgtccgggagctgctggacgcatccgtgcgcggcggcgagccgccccgcgccgccctcgacgcgatcaacgcggcgatcacccgggtgccgaccgcggaggagctgcggtggagctccgcccgggggctccaccggtcggcgccgcacccgacggaccaggtggtggaccacgcgttggggatcctggccgcggacgccgccgacctgctgaccggcccggacgcggaccggttgaccgcctgcgactccagcccctgccagcgttacctgctgcgcagcgggcggcggcagtggtgctcggtgcgctgcggggaccgggcgcgcgccgctcgcgcctacgcccgccgcgccggtcggtag

SEQ ID NO: 6587 - DNA, 729 bp, Actinoplanes utahensis
atgatcaacgtccagacggccggcggcccgaccgcgctcttcgagtacgccgggctccgcctgctcaccgaccccaccttcgacgagccgaagagctacctctcgccgagcggcacccgactcaccaaactcgccccggccaggatccggcccgccgccctcggccggatcgacgccgtgctgctctcccacgaccagcacgccgacaacctcgacgactccggtcgcgccctgctcgccgacgtcccggtcacgctcaccaccaccgatggcgcccggcggctcggcggcaccgcgcgcggcctcaccccgtgggagtcggtgaccatcggcgacgtcacgatcacggcggtcccggcccggcacggcccggagggctgcgagccggtcaccggcccggtcatcggcttcgtgctgaccgcggaggatcagcccagcgtgtacgtcagcggcgacaacgcggccctggaaatcgtcgagcaggtcgccgaccggctcggcccgatcgacgccgcgatcctgttcgccggcgcggtccgcaccgacctgttcggcggcgccctgctcaccctggacagcgagcaggccgccgaggcggcccgcatcctcgacgcccggcaggtcgtgctggtgcaccacgacagctgggcgcacttcaccgagggtcgcgacgccctggagaaggcgttcaccgccgccggcctgcgcgaccgggtgcagttcggctga

SEQ ID NO: 6588 - DNA, 468 bp, Actinoplanes utahensis
atggataccgcgagtagctggaccgcgcggcaccgaacgcggaccgcagacacccgggcaggcaccggacggctgtctgctcctgcaggactacgacctgggtacggtcggcgtgctgccgccgctcgacgtggtggacgcgatgacccgggtggtggtggacgcgttcgggcggccggctgcgacgtgcgggccggcagccggttgccgtacctgatggcgaaggccgggatcggcgcgccggacggcaccgacgtggccggccggcggctcccggtcgggcaggacacgccgatcctggagagcgtctaccgcagcctgctgccggtcgcgtgtgcgcacggcatcaccaccccggaggagtcggcgcggtcgatcgcggagctgcaccgcgcgaccgccgccgccccggaccgccatgtcctgctgccgctgctgaacggcgcctggcgggtcaagggggtctga

SEQ ID NO: 6589 - DNA, 1068 bp, Actinoplanes utahensis
gtggagctgctgacgatcggcgcgttcgcccgggcggcgcggctgacacccaaggccctgcggctgtacgacgaggtcggcctgctgccacccagggcggtcgatcccgaatccggctaccggttctaccacccggaccagctggaccgggcccggctgatcgcccggctgcgccgcatcgggatgcccctggccggcatccggacggtgtccgacctggaacccggggcggcggccgacgcggtcaccgcctactggcgacaggtcaccgcggacaccgcggcccgcgcgcaccacgtcgcccgcctcgtccagcacctgtcccaggagggcgtcaccatgccgaacacccattccacgccggccatccgctacgccgtacgctgcgaccagggccacgtccgggacaccaacgaggacgtcgcccacgccgacgaccggctgctcgccgtcgccgacggcacccgcggctccggcgccgccgccagtgccgccgccgtcgacgcgctgaagagcctcgacccggccggccggcccgccgccgaactgctcgcgctgctggccgcaaccgtggacggcgtcgaccgcgcgatccgcgccaccggcaccgccgacgaccggcccgccaccaccctgaccgcgttgctgttcgccggcccccgactcgccctcgtgcacatcggtgacaccagggcctacctgctgcgcggcggtgaactcacgcagctcacccaggaccacacctgggtgcagagccaggtcgcggccggcagactcagccccgcccaggccgccacccacccgcaacgcgcgctgctcacccgggcgctcggcggcggcccccagccggtcgaagccgacctcgccctgcgcaccgtccaggccggcgaccgctacctgctctgctccgacggcctgtccgccgtcatcggccacgacgacctgcacaccacactgaccgaaaccgccacccctgaaccggccgtcgaccgcctcatcgacctcgcccacgcggcgggcgccccggacaacatcgcctgcctcatcgccgacgtcatcaccacctga

SEQ ID NO: 6590 - DNA, 807 bp, Actinoplanes utahensis
atgccgaatccgacgcgcctccgacggctgcgacataatccggcgatgcgggaaagatcgaagtggatcgtcgtcggtgcggtgttggtggtcctgggtggcgcggcggccggcacctggcgataccggcagcacgtccagcgtcagccggactggcagatccaccacacggcggtgcccgacgcggcgaagaaggtcgacgacgtgctcgccgggttcgaccgcgaccacctctaccaggccgccgactacctgcactcggccggccggcaccccggcgtgcaggtcctgtcggtcaccgggcagacccactggcagaccggtgtcaccctgaccctgcgggtcaccggccacggcgtggcccgcggcttcgaccaggtcatcctccagcagcgcgacgtgccgatctgcttccgcctgacgatgggcccgaaggacgacagccgggacgacgacatcgactgcccgaccggaccgccgctggcagtgccgcgggacccgaccctggacggcgtcgacccgcgcctgcaggcggcgctgaacccggtcggcccggacgagcccgccgtccgggccgcggtcgccggcctgaaactggacccgggcatccggcaggacttcgccgcccacgacggcgtcgtgggggtggcgctgcgcgccggccggtacgactgcgtcgtcgcccgggtggtcgcccggggcgacgtcaccctctggcgaccgtcgcccacgcagctggcgccgggggagctggactgctcggccgggctcgccatgaccagcgggttcaacacctccccgcactga

SEQ ID NO: 6591 - DNA, 324 bp, Actinoplanes utahensis
gtgcgaggcttcgcgctgctactggctctggccgtcgccgtgctggtggccggtctcacgttcgcactggtggccgcgatcgggcgcgcggcccgtcgccgggcggtccgcgccgcccggtggcggccgcgccacttcggccgggacggcaccacggtggtcaccgtcagcctggtggctctcgacgggcggatactcgacgagtacgtcgtggagcgcatcgcggccgcggaacccgactggaccgaccggttcctccgcgctcaccaggtggcggaggaacgcgcgttccacctcaacagcgccgataccggccggcggtag

SEQ ID NO: 6592 - DNA, 1008 bp, Actinoplanes utahensis
atggcaacacagcggggacacggccagccggcgaggcgcatcgcgccgctcgtcagcgccggagtggtcggaatggtggtgctggtggtggctctcacggccgccttcggcggattcgacaagaccaccgggggcgaggtcggggtcgtccgcaacggcggctggttcgacaacaaccgggtacgtcaggtcatccagcccgcttcgggtctgacctggaccgggttgtactcgaccacccacaagtacccggctcagcagcgcttctacacgatcacctcggacgcccggcgcggcgaccgcaccggggtcgacgtggtgaacaccccgtccggcgacggcgtggacatgggcatcgagggcaccgtctatttcaccctgaacctggacccgacgacgatgaccaccttcgacaacaagttcggcacccggcagttccgcggcaccgacggcaccctgcggtacgcgtacgacggtgacgagggctggagcagcttcctcgacgccatcgtgcggccggtgatcgacaacgacctgcggatccagatcagcggcttccgatgcgccgaactggtctccagttgcgcgctggtgcagaacggcgctcagggcaccgcgaacgtcgggacgccgccggcggccgccacggggcagaacaacaactcgaacatcgccaaggtgcaggacgcggtcaacagcagcctggcgaaggatctggcggacatgctgggcggcgccttcttcgaggacatcaagttcaacctggcccgggtgaccctgccggccgccgtgcaggacgcggtcaacaaggcgcaggccgcgtacgccgcggtgagcgaggctcaggcgagggtcgctcaggcgaaggccgacgccgacgccaacaagacccgccaactcggctacaacgcgtgttcggcgtgcgcccagatcgacatcatcaaggcgctgccgccgggcgtcacgacctatgcgcccggcgcgggcgccgcggtaccgctgaagtag

SEQ ID NO: 6593 - DNA, 636 bp, Actinoplanes utahensis
atgccgaatcctggcactgtggataccaggctcgcggcggcctccctgccgccgcccgcaccagagatcgtcatcggcatgatccgacacatcgcagcggcagcctgcaccatcgccgtggccaccggcgcctacggctaccaccaggtccgcgacgccgttccgcaccgggccggccacttcccggtcgccagccccgacgtccacggcagcttcccgcctgcctacctggccgacgccttcggctgcgccggcgacaacgtgcagccgcgcctcacctggtccgccgccccggccgcgacccgcagcttcgccgtcaccatgtacgacccggacgccccgaccggcagcggcttctggcactggctggcatgggatctgccggccaccaccgacaccgccggcagcacgctcccctccgccgcggtcaccggcaccaacgacgccggcaggaccggatacctgggtccgtgcccgcccaccggcgacatcccgcaccactaccgcctgacggtgtacgcgttggacgtccccaccctgtccctgcccgccaccacgccgccggcggtcgccatgttcaccatgagcagccacatcctcgccagtggcgccatcaccgtcaccgcgaggcgctga

SEQ ID NO: 6594 - DNA, 978 bp, Actinoplanes utahensis
atggtgcaggctgccgctgcgatgtgtcggatcatgccgatgacgatctctggtgcgggcggcggcagggaggccgccgcgagcctggtatccacagtgccaggattcggcatcgacacccggcgggcggctcgccatgatggggcggtgacgggtgagcggcgggtcgagctggccggtttcctgcgcgcccggcggggcgggctgaccccggccgacgtgggcctgccggccgggccgcgcaggcgcacgccggggctgcgccggcaggaggtggctcagctggccgcggtcagtgtggagtggtacacgcggctggagcagggccgggtcgggatgcccggcgcggcggtgctcgatgcgctggccggtgcgttgcggctcggcgaggcacagcgacgacacctgcacctgatcgcccgcggcgaggcgccggtgcagcggcacgaggcggctccggtcagtcgctcactgcgggtggtgctcgacgggatgccgctgctacccgcgtacatcatcgatttccgttttgatgttctggcctgtaacgccgcggcgagggcactgttcggcgaccggttcggggcggagaacgtggcgcgccaggtcttcctcgacgccgggctgcgcacgtcgcagctggactgggcgcagatcgcccgggagatggtcggcaacctgcgggccaaccaggcgcggcacccgcgggatgcccggctgcgcgaggtgatcgacggcctgcggcgggagagcgccgagttcgccggctggtggggtgatcagacggtggtcgagcgatcacacgggcgcaaacggatccggcatccggtcgccggggtgatcacggtcgactacgacgcgctggcgacccgggacggcagcggccattcgctgttcacggtgaccccggccggcccggccgacgagcgggcactgcgcctggtgatcgggcagcacagccgggcgttgctggcgtga

SEQ ID NO: 6595 - DNA, 390 bp, Actinoplanes utahensis
gtgtgctttgcgctgatctcggcgagcgtgccggcggcccggatgaccgcgcggctgggtgtcgagccggatgaggtgcgggtgcggggcagtgagcagaccgcgccgatggtggtgccggtcgcgcacagctgggaggtgcactgccgcaagcccgatctgaccgtggacgagcagatcgggctgatcgtcgaccggctgtccgatcatgccgcccggatcggtgacctcgcggccgagctggctgagcgggacggtgacgagggcgggagcctgctgcaggtggtgcggtgcgtgaccggcggtgatccgctcggctggcatctggatgcgcggctgctggagttccttcgtctcacccgggccgagttggacgtcgacgagtcataa

SEQ ID NO: 6596 - DNA, 600 bp, Actinoplanes utahensis
atgaacgggttatcactatgcagtggcctggtttacgaggacagatcggacgttcggtatgtcacagtccgctaccccggacagcgtgacggctactcgcggccggtagcctcccgcaccatgcgtggatccaccatcgcagctgtcgccacgttcacccttctggcgatcaccggctgcgcgaacagtgacaacacccccaccaccgccaccgcggccggggcggcgaacaccgcgggcctggacaagggctccgcgggcgcgtgcacggtggccgatcaggccacccgcggcgagaacgggcgcgacctcgacctggccaccgccaaggacatcgtcgccttcggccgcacgtcgcgcagcaccatcgtgaccgcggccaccgacgtgctcagcgccgcgctcgacaaggcgcaggccgctgccggtgagccggacgagctggtgctcaaggccgaggtgggcaacgcgatcctcaaggtgcagacggtctgcaaggaccccgacgcggtcaaggcgagcatcaccacgcccagcaccggcggcgcgggcggctccaacgagccgaccaggtcggtcaaggacggccagatcaaatag

SEQ ID NO: 6597 - DNA, 294 bp, Actinoplanes utahensis
atggttcccgtggagactgaggtgaccccggtcgtgctcgacggcggcgaccgccgctgcgtgctgttgttgatcgagttgcggcggctgatcgcgaccctgccggcgggcgccgtcgtgcacctgatcgccaccgacccggccgccccgctcgacctgccggcctggtgtcacctgaccggtcacccctacctcggcccggtccccggcgaccgccccacctacgccgtcgaggtcgccgcccacgccacgtccaccgacgccacccgtccctggcacccggaggcggggtag

SEQ ID NO: 6598 - DNA, 717 bp, Actinoplanes utahensis
atgccgccgctactcccgatcggcttcactgaccgcgtggacaaccagcaatccggcacccggatcaccagcatggacagcgaagtcggccggagcggacgcgtccgcgtcgcggtcctcgccggcgcggcgatcctggccctggccggcgccctctacgtgctgcgccgcccgctgatgatggtcgtcccggcatgcaccggcggccagtggaccatctgcctcaccacggtgaacggcgacctgctgctcaccgtggccgccctgccggtggccctgctgctggtcgccgcgctcgcccaccgccgccggctcgccggcactccggccgcctggcggctgtcgctggccgaggtcggcctcgtctactggaccgtgccgtgggtgtggctcaccctgcagcccggcccgggtgccggcgtcgtccccggccgggtcagcctggtgccgctgcgtgacctgctcacgatggacaccggtcagatcgtcggcaacctgctgatcctggccggcctgggcttcttcgccccgatccggttccgggcgctggcctcggcgccgcggatgctggcgctgggcgcggcctgctcggcgctgatcgagaccgcccagtacgcgttccagctggaccgggtctcgtcgatcgacgacgtgctgctcaacgcgaccggcgccgccctggccgcgctggcgtcccggcgctggtggcgcgcctga

SEQ ID NO: 6599 - DNA, 333 bp, Actinoplanes utahensis
atgaccctatgcccgatcccgctcccgggacagccggcggacacgcccgagtcgacggaaccaccgtggcggccgacctgccagctccccctcaggtgcggaccacggaccggtgagcagccgggaagggtccggatcgaggccgcggtgggcggccagggcgacggcgaaccgctgtgccggcagcagctgggcgagcggttcatggcggtcgcggtggtcggcgtcgacgggatcagcgcccgcggcgggctgaccacgcacgacgagatcgaggcgaacaccaacgccacgatgatccgccgggccgggaccgaggtggtggtggtctga

SEQ ID NO: 6600 - DNA, 381 bp, Actinoplanes utahensis
atgacgagccgcatcggggacatcatcgtcgactgccgggatcctgagctgctcgccggtttctggtgcggcgtgctgggctaccggatcttcgcccgcgatgcgaccggcgtggcgatccgcggggcgacgagcagcccggacatcctgttcctccacgtcggcgaccggaaggcgacgaagaaccgcctgcacttcgacgtctgtcccacggaccgcggtcaggacgaggaactcacccggttgctcgcgctcggcgcccggcggtcgagcatcatcggcagcggctcctgggtggtcctggaagatccggaaggcaacgagttctgcctgatggccaaacggatcgccgccgagcctgctcccttccacgacgcctag

SEQ ID NO: 6601 - DNA, 585 bp, Actinoplanes utahensis
gtggacgagaacctcgggctgcgcgaacgcaagaagatggccacccggatggcgctgcacgaagccgccgtccggctggccgccgagcgcggcgcggacaacgtcaccatcgacgccatcgcggaatcggcaggggtctcccggcgaacgttcacgaactacttcgcgaacaaggaggaggtcttctactaccgcgaggcccaccggatgcgccggctgtgcgcctcgatcagcgcccagcccaccggcgacccgtggaccgtgctgaccggcgccgccctggagctgatgaccgaggccgccacggacccctccgacctgtggctgaaacagcgccgcgaactgcaccgggacccgcaccacctggcccaccagatcgccgcgtacacggcgatcgagaaggagctcgccgccctgatcgccgaccgggtgaccgggccggacgccgacctgcgcgcccgggtcctggtcgcccagttcatgacggcgttccggtccagcgtgcagtactggatggagcatccggagacctcgctgccggaaactttccgcaaggtcaccgcgatggtcgcgaccgtggcctga

SEQ ID NO: 6602 - DNA, 1491 bp, Actinoplanes utahensis
atgtcagccgcggaaccgggcgaacttctcgatcgcggccggggtcaccggggtgaacaggttgaccaggccgccgctcgggtcgcgcagcagggtggaccggttgccccacggcatggtggtcggcgccagcagcacctcgccggcggcggggacggcgtcgacgtcgtcgaccaggaattcggtgatccgctcccccgcccggatggacggtggcacggtcgcggcgccggcgatcgcgagggtgccgctgccggtgacgatctcggcgaagtccgcggtgatccggtgcgcgggcaggccggtgaccttctcgtagaagtcgatgagccgggcgacgtcggcggtgatcacgcgttgcgaaacgaggttcatgccgagcaggctagggccgatactggacagcttccgcccactattgtcaagggcgtgaccaggcccaccgcccgcgtgctgaccctgctggagctgctgcagtccggcggcctgcgcaccctcgccgacctgtccgagcgcctgggcgtcgacgcgcgcaccgtccggcgctacgtccagcacctggtcgacctggacatcccggtcgagtcggtgcgcgggcggcatggcggctaccggctggcccgcgggcaccggctgccgccgctgatgttcaccgaggaagaggcactcgccgtgctgctgggcctgtccggcgactcgacgagcagcgccaccgcggccgccaagctgcgccgggtgctgcccgcgccactgcagcgcaagctcgacgcggtccgcgagtcactgaccgtcaccacgccggccgcggccgccccggacggcaccatcctgctgaccgtgtcggcggcgctgcgcgaccaccagccgatccggatcacctacggcggccgggagcgcacgctgcacccgtacggcctggtccggcaccatgaccgctggtatgtcagcggcctcgacccggagatcggcgcggagcgcaccttccggctggatcgggtcgaggcggcccgcccgctgcccggcaccttcccgccaccctccgatttcgacccggccgcgcggttgctggccggcttcgccacggccgcttaccggcacgcggtccgcgtgcgcgtccaggccaccgcggaccatctgcgctcccggttgccggccggcctcgcggtgatccacgacgacggcgccgactgggtacgggtcgacctgcacgccgagcgcctcgactgggtcccggcgctgctggccgccgtggaccgcccgttcatcatcgagcagccgccggagctgcgcatcctggtcgccgagctggccgaccggctggccgccgcctcccgccggccggagcatccacgtccggtcacgccggcccgacgccggccccggtcagacgccgccgatcagaccgggtcgggcgtctcgtctccgctgccggggtgggccgcgggctccaccagcccggcatcgcggccccggccggcagggccggactga

SEQ ID NO: 6603 - DNA, 765 bp, Actinoplanes utahensis
atgttagggttccggcgcttaagggggagtccagtgccgaagctgaatcagatcatcgcggtggagaagggcgtcaagagcaaggctttcgccgatctcagcgacgcgcaccacgccgtgcagaagaccgggccgctggccggcatctcgcgcacctatcagccgaaggacgaggagggcgagcagctgcccgccgagtcgacccgggtgcagatcaaggccgaggagatcctgcgcgacgtcggcgccacgctgacccggctcttcgacgtgaccgccaccaaggactggacgaacggcgtggcccgcgccgacgtggtcgtcgacggccggacgatcgccgcccaggtcccggtgacctatctgctgttcctcgagaagcagctggtcgacctgcacacgttcgtcaagaagctgccggtgctggacgccgccgagtcgtggctgcgcgacgactccacggacagctggcggaccgagccggtgcggaccaaccggaccaagaaggtgccgcgcaaccacgtcaaggcggaggccaccgacaagcacccggcccaggtcgaggtgtactacgaggatgtgaccgtcggctactggacgacggtgaagttctccggggcgctgccggcgaagcgggtcaacgagatcctcgaccgggtcctggccctgcagaccgcggtcaagttcgcccgcgaggaggcgaacaacaccgaggccgtcgaccagcgggtcggcgcggccgtgttcggatacctgttcgggtaa

SEQ ID NO: 6604 - DNA, 606 bp, Actinoplanes utahensis
atgcgacgaggacggcttctcacctggatcggtccggcggtcgtcatcgtgatcgtcgctgtctatgccggtggcatgctgctcggccgctggcgcagcccggccgatgcgcacgcggccggcagccgccaggcgtgtccggagtcgaccgacccggggcaccgcaaagcggagaccgagctgtgcccgctgatcaaccggcccgagatcctcaccctcgtcgacgcgtcggggacggtcaaaggcatcagcacgtcgtacgacccgcacggcgagtggtacgagtgcacggtgacactgccgagcggctcgctgcgcctgaacgtctggaagggtcgcacccggctcgcggactaccggaaactgatcccggaggcgcagccccgcaccgtgctcggccgccccgccgcctggtggcccgactccgcggccatccaggccatcccggtgaaggagtcgtcggtgctggtggcctgggaccgcgccgacaccggcgggatggtggagatctccaccatccggaccgagctcgatcccgccgaccaggccccgctcacccggatcgccgagcgtcaactccccggcctgccgggctggccggcctga

SEQ ID NO: 6605 - DNA, 951 bp, Actinoplanes utahensis
atggagacgcgccgggacgtcatcgtgcgggccgcgacgctcgccgacgagttgggcttcgagctgttctcggtggccgagggctggggtctcgacgcggtcgcggtgctggccgagctggccaccgtcacccgccggatcaccctggtcgccggggtcctgtcggtctggaaccggaccccggccacgctggccatggccgccgccacgctgcaccagctgtccggcggccggttcgtgctcggcctcggcgcgagcagcccgcagctggtcgagggctggcacgacctgccctacacgcatccggccgcgcggctgcgcgaggtcacgacgcgggtccgggatctgctccggggcgagcgggccgtgacttgcggcgcccggccgctgcggttgggccagccgcccgtgccggatctgccgatctggctggcggcgaccggcgagcggaccctgcgcgccaccgccgagctggccgacggctggttcccgctgtatctgcgccgggaccggatccgcgagctgcgcccggcgatcaccgcgagccgcccggtgaccgtcacggccgggccgttcgccgtcgtcgaccccgatgtggacgccgcccgcgccgccgccgcggcctgcaccgcgctgtatctgggcgcgatgggcgacatctatccccgcctggtcgccgggcagggtctggccgccgaggtcgccgcggtccgcgccacccgggtcgtcccggcgcaggcgcagccgctgctcgacgagttcacctcctacggcacggccgagaccgtggccgcggacctggcccgctgggacgagatctccgacgtgacggtggtggtgctgccgccgggcctgccgtggccgcggatggaggcgacgatccgggccgcgatgccggtcaggccggccagcccggcaggccggggagttgacgctcggcgatccgggtga

SEQ ID NO: 6606 - DNA, 114 bp, Actinoplanes utahensis
gtgcgcggccggctgggcgaagcggtgtttctacctaagcccggcagccgggcggcggtgccgaacggggccggcggcggtcaggcggtgaggtcggccgggatcagcgaatag

SEQ ID NO: 6607 - DNA, 555 bp, Actinoplanes utahensis
gtgagcggaaacgtgttccccgatgccatcctgcagacggcccgcctgacgttgcgcccgccgcacgagggtgatgtcgacgcgatcgcggccgccgcctcggatcaggaaacgcagcgctggctgccgcttccgtttccgtacgaacgcggccacgcggtcaccttcgtggccgagaccgtgccggcggcgcgggcgagcggcgcgggcctggtgcgcgcggtcgaatgcgacggcgtcctggccggcgtcatcgatctgaagaagaccgactggcggcaccgggcgacggagatcggctactgggcgacacccgcggcccgcggccagggtgtcatcaccgaggcgacggccgcgctgtcccgctgggtgttgaccggggccgccttcgagcgggtggtcctgcggatcgcgcccgccaacgcggcctccgtccgggtcgccgagaaggccggtttcaccttcgagggcgtcgcccgcaacgccggcatggtccacggggccagggtggacctggcgatctattcgctgatcccggccgacctcaccgcctga

SEQ ID NO: 6608 - DNA, 273 bp, Actinoplanes utahensis
atggctgtcgaccaccacgaagccatccatgaaattcgcaggctactcaccgacgccttcgggtccggcgataccgtcggctgccacgaccatctgatcggacccgtcctggtcaccctcgccggggccggcgctgccgacgacgcccggctgtggctcgatgccgagatccgccggcatctcggcgagaccgcgggacggctcgacaccgcagacgtcgcgggccggcttgtcacctggtgggccgaccgggagagccgcaggtggggctga

SEQ ID NO: 6609 - DNA, 216 bp, Actinoplanes utahensis
atgcgcgtgacgtacgacagcgaagcgaacgccgcctacctcgaggtcgatgagatcgccgacggcgccgccgtcgagaacgtcgtcgtggagcgccccggccggggcgacatcgttctcgacttcgatgccgacggacgcgtgctgggcctggaggtcatcggcgccacggaacttctccgcgcaccggttctggacgccgccgaccggctgtga

SEQ ID NO: 6610 - DNA, 447 bp, Actinoplanes utahensis
atgatcaggcctatcacggatcggccgcgtcagggtgataccagcggtatgccagaggcgcgggtcacgctccccaccatggattccggcatctcggacgacggcaccgtgatcaccttccggaccgtcggtaccggccccgggctggtcgtccccggcagcaaccgccgcgcccaccactacgaccggctggccgcgctgccggccggcagccgcactccgccctacctgcgcgacatcctgccaccgctggcccggctcatcccgggcgccggctacgagatcctgcccggcctcgaccacaacgccccggaccgcaacgccccggagacgatcccggcccgcctgacggccttcctccaccccatgatcgcggcgtacgcgccaccgccacccgccgcggaaccgctggaccccgcgaccgtccacccaccacgagatcggtag

SEQ ID NO: 6611 - DNA, 1005 bp, Actinoplanes utahensis
atgctcgctggccgtctgaacgtgtcgaccgggacgttcgccgtggaggaggtggacgagccgcacgccggacccgggcaggtgcggatcgcggtgcgggccgccggggtgtgcctgtccgacgtgcacctcatccagggcatgctcaagccgctgcacctgcgcggggacagcgtcacgctggggcacgagacggccggggtgatcgacgaggtgggcgcgggcgtcaccgggctgaccgtgggggagcgggtgctgctgcaggccggcgagtacgccccggacggcagcgtgctcacccgcggcgtcgactacgacggcggctgggcgcagtacgcggtcgccacggccggcaccgtcgtgccgattccggacaccctgtcgtacgagcaggcctgcttcatccccgacgcggtgtcgacaccgtgggcggcgatcaccgccaccgccgcggtccagccggcccgatcggtcggcgtgtggggggtcggcgggctcggcgcgcacgcggtgcagctgctgcgggcgatcggggcggcgccgatcgtcgcggtcgacccgctcgaagcggcccgggagcgggccgtgcagttcggcgccgacctggccctggacccgaacgatccggcgttcgcggccgcgatgggcaccgcgaccggcggggcgggcctggcgtacgcattcgacttcgccggcgtcgccccggtacgcgtgcaggccgcccggtccctcaccaagggcggcaaactgaccctggtcgggctgaccgaccagccgctgaccattccggacggcacccggttcagctacctctcgcaggagatccgggggcactacgggtccgggccggaacacgtgctggagttgttgtcgctggtcgcgctcggccggctggaattctcccggtcggtgagcggtaccgtgccgctggccgacgcggccgaggccgtccggcgcctcgaccagaaggaggacaatccgatccggttgatcctcgtgccctga

SEQ ID NO: 6612 - DNA, 1437 bp, Actinoplanes utahensis
gtgccctcgccatcctgctcgcccagctgctccgcgacgtcgaggggatcccgcccgaccaccgtccgccgtggtgggattcccgcgtcgaggagctgcgcacgcaggccatgttcagtgacctgttcttcgacgtggccctgggcctcgaacccgggcagcgcgaggagctggccgagctgttcgaggacagcgcggaccggctggccgagcgccagccccgcaccccgggccaggtcgacgactggcacctggtgttccgcggcgaccacgcctacgacgtggggccgatcgccgagctcggacgcgcgctcggcgagctgctgcgcgggacgctgccggcgccgccgcccggcaccctctggttgtacgggacgccgggcgggcggaccacgatcagcccgcgctgaccaccgtgacccgggcgccgtccacggtgggacgctcgatctcgtcgagcacggcgatggcgagatcggcgtacgacagtcggccttcgctgatcgtctcaccgcccagccggtaaccgcccaggcggggcagttccgccgacagcagcgccggcggggtcagcatgacccagccgcggtccgcctcgcgcagccgccgcaggccggcggcgtgcgcgtcggcgaacgcccggaactgctcgggcagcggatcggcaccgtccaggttgctgaccagtccgatcgcgacgacccgggggacgccggaatcgaggagcgcgccggcggccgtggcgaagaagtccggatccaggtcgagtgtcgccaactcctccgggccggacgcggggctcaccgcgttcaccgcggagtcgtgcccacggacgatcgcggcgacgcccgcggcgtccgtgacgtcaccggtcacggcgggaaggtcgggatggcgggcggggtcacggacgacggcggtcacggccaccccgcggcgccgggcctcggcggtgacggcgcggccggcgcggccacccgctccgaagactacgatgctggtcatgtcgggcacggtaggcggcgcacccccggttaccgcaacgaaaccggcggtacgctcggggtcatgacggccagcctcagcccggacatgttcgacccggcctgcccgacgaccgcgatgccgctgcagatcggtgacaagtggacggccatggtcgtgctgtgcctggagcacggcccgcgccgcttcaccgagctccgtgtcccgctgcgccgcgtcaccccgaaggtcctcgccgaaaccctgcgcgcgatggaacgcgacggcctgctcaaccgtaccgcctacgacgagaacccgccccgggtggagtacgcgctgaccccgctcggccgcagcctgctcaccctggtcgacgccgcccgcgcctggtgcaccgaccacttcgacgacctgctcgccgcccgcacggcctccgcggccggtgcctga

SEQ ID NO: 6613 - DNA, 477 bp, Actinoplanes utahensis
atgggtgtcgtggcactgcggccgctcgcggacgccgacctggacgcgctgttcacgatgatgcgcgacccggaggcggtgcggatggccgccttcacggcgaaggatccggacgaccgggccgcgttcgacgcgcacatggcgagaatccgcaccgccccgggcgtcaccctgcgcgcggtcaccctcgacggccgcctggtcggcagcatctccagcttcccgatggagggcgacaccgagatcacctactggatcgaccgtgcggtctgggggcagggcgtcgccggccgtgcgctcgcccagctcctcgacctggtccccacccgcccgctgcacgccagcgtggccggcgacaacgccgcctccctccgggtcctgcaacgcgccggcttccacatcgtcggcagcgcgaggggctacgcgaacgcgcgcggcgccgagatcgaggagaccctgctgcgactcgatcggtaa

SEQ ID NO: 6614 - DNA, 1008 bp, Actinoplanes utahensis
atgagaccccgtcggcggcgcgccgccggtcgccggggtgccgcacgttttccaggccttcgccgggcacctgccggaagcggacgtggcgctcgaccgggccgccctgttcctcacccagcacctatcctgacgggcgtggatccatcgagtcccgcccggctggcggtcgtctccggcggcggcaccggcatcggccgggccgtcgcccgacgcctcgccgcgcagggcgaccgggtggtgatcatcgggcggcgcgccgaggtgctgcaccggaccgccgccgccatcaacgccgaggtgcggcgcccggccgccaccgaagacagcggaacgctgcggcttccggccgccgcagagaacggcggcgcggtacggcgcccggccgccgcgggagacagcggcgccgtgctgccgatcagcgccgacctgaccgatcccgatcaggtcgagcgcgtcgcgggcgagatcggccggctgggcccggtcgacgtcctggtcaacaacgccggcgcgatcatcaccccgccggccggcgacggcctcggcgcgctggccgccgcctggcgccacgacctggacgtcaacctgatcaccgcggttctgctcacctccgcgctgctggagcggctggcccggcccggcggccggctcatcatgatcagctcggccgccgcccagcgcggcggttccggcccgcactccgccgggtcgtacgccgccgccaaggccgccctgcacgggtgggcgctcggcctggcccggcagctcggtccggacggcatcacggtcaacgtgctggcacccggctacatcgaggacaccggcatcttccacggccgggacacccccgacttcgtcaccgccaagatcgccgacaccctggtcggccgcccgggcaccccggccgacgtcgccgcggcgatcggctatctggcctccgccgaggccggctacctgaccggccagatcatcggcctcaacggcggcgctgtcctgggtcgctga

SEQ ID NO: 6615 - DNA, 465 bp, Actinoplanes utahensis
gtgcggcaccccggcgaccggcggcgcgccgccgacggggtctcattggggcagttcgagttgctgcgctacctgcgcgaacacccccggtcccgggtggccgacctggccggctggttcgccatcggggtcggcgcgaccagcaagggggtcgaccggttggaggcgcgcggctggatccggcgtctgcccaacccggcggaccgtcgctcgtcgttgccggagctgaccgaggccggcgccggggcgctcaccgcggcggagcggaccttcgaggccgaggccgcgcaactgctcggcctggtgctcacccggcggctctggccgcggcggccgctgccgtcggcgtactccgcaaggctcttggggagcgaaatctgggtgccccggtgggctgaccgcgagctcgcgcttgtcgctgacctgcggcgtcaggccggcgcgctcagcaacccccggttgtag

SEQ ID NO: 6616 - DNA, 645 bp, Actinoplanes utahensis
gtgagtgacccgatcaagctgctggtcgtcgacgaccacccggtcgtccgggacgggctgaccgccatgttcgaccgcgacccggagttcgccgtggtcggtgaggcggccgacggcgcggaggcggtccggatcgccgaggcggtcgggccggacgtgatcctgatggatctgcggatggccgggatggacggggtcaccgcgatcaccgagctgtcccggcgcggggtgccggcccgcgtgctggtgctgaccacctacgacaccgacgcgcacgtgctgccggcgatcgaggcgggcgcgaccggatatctgctgaaggacgcgccccgcgaggagctgctgcgggcggtgcgggcggcggcccggggtgaggtggcgctctccgcgtcggtggcggcgcggctgatgagccgggtgcggacgccggcgccgacgaccgggccgctcagcccgcgcgagctggaggtgctgcggctgatagcggacggcaacaccaaccgggaggcggcggcacggctgttcatcaccgaggcgacggtgaagacgcacctgctcaacatctacgccaagctcaacgtgaaggaccgggcggcggcggtggcggccggctacaaccgggggttgctgagcgcgccggcctga

SEQ ID NO: 6617 - DNA, 864 bp, Actinoplanes utahensis
gtggccggcgccgcgacggtggccgggacggcgcaggccaccggcgttgagtacggcaccgtgaccggctggctgacctggctcgccgtcgtggccgccaacatcgtgccgatgatcctggtgtcctggatcggggagatcagcgcgcaacaccaccgggcccgggaggccgcggtggccgagatcgccgccctgcaggaccggctcgtcgagcaggcccgggcggccggggtgctcgacgagcgggcccggatggcgcgggagatccatgacaccctcgcccaggggctcaccgggatcatcacccagctgcaggcggccgagcacgccgcgcaggatccggcggcgtggcgacggcatcacgcggcggcgaccgcgctggcccgggagagtctggccgaggcccggcggtcggtgcacgagctgcggccggagccgctggagaccgggcggctggtcgacgcggtgaccgaggtggcggcccgctggtcggcgcggcagggcatcccggcacgggtgaccgtgaccgggcaggcgatggtgctgcggcccgaggcggaggtggcgctgctgcgcaccgcgcaggaggcgctggccaacgtggccagacacgcgggcggggcgacccgggtgggtctcaccctgtcgtacatggatcgcgaagtggctctcgatgtccgcgatgacgggcccggtttcgaccgggaccaggcgccggaccatcggggcgggggtttcggactggtcgccatgcgacaacggatcgaggccctgtccggcacactgcagatcgagtccgcccccggcgccggcgtcgggatcgccgcctgcctgcccctgacgaccgcggaggtccacccgtga

SEQ ID NO: 6618 - DNA, 405 bp, Actinoplanes utahensis
atgagggagcccgggacgcgcggcggcttgcgagactgtgtcgagtgccgaccgtggggagtgagcgtggagccgcaggattcgccaccctgggagcggcggttcgagccgctggtcaccgtggtgccctacgggctgctggcggtgctggccgcgatgaccgtggcgctgggtcgggacgtccgggtcgatctcctgctcggcgcgggggccgcggtctggactctggtgctgttcaccctgcggcccggctggcggcggcgtccggtgatcatgggggtgttcctcgccgggctgatcctcttcggcctggtcatggtggcccgctacccgtggtgggggttctacaccccggcgctgtacttctacgccttccggatcatcggctggccgcaggagctgtag

SEQ ID NO: 6619 - DNA, 639 bp, Actinoplanes utahensis
atgccgaccgactggtaccggacgacggagtggcacgagtcggcccaagccgaattcgaacggcgtctcgcgagggcgcgtccgtcgagccgcggccaataccttcggatcaaagccgtcagcctggccgaggccggcatcgtcgacggagcgcgggacctctatcgccgcgtcgtgaaggtcgaccccgacggctcctcggcggcgtcagccaccgagctgctcggcgacctggaacgtgcgcaaggtaacgctgccgtggccgaacagcactaccggacactgctcgaccgttggccgaccctgaacggcacgagccgtctggcggaactttcgcttgccgagctactcaccgaacacggcgacgcgcaccacttggcggaagcggacaggctgctgatcgcgtgcgcggaccgtggcctggcgttcgacgacgccatcttccgctggaacgtcgcacgtgcacgactcgccgaccgactcggcgacgaccagtcccgggcagcggctgcgacgacggcgctggccctggtcgggaaaggaccgcagctacctcgccatcctgatgtcggcctggtccggaccgacgaagccacgctgcgttggctgaagcgactgacgaaccgtcccggcgggtag

SEQ ID NO: 6620 - DNA, 507 bp, Actinoplanes utahensis
gtgcccgcgctctctaggctcacgggcatggcatcccctgtcggagcttgttggagctcacctcggcgctcgatcgcggacgcgtcatcgtgcgtctggctgtccctgcacctgttgctctatttcatgctcgacgtcgccacgctcacggctttgagcgcgccggaagtcggtggcgggcttcacttcgcatcgaaagccctctacctcttcggtctggtcctcacttctgttctctggccgctaccgttgcagagcgctgcgctcctgctggccgtgggcgcgttggcgattctgcgatccggtgcgggtctgccgaggccctggttccggattgcggccgtctcggtgttcctgatactccctctgctgctggcccttctgctgtccccgggcgactccgcccccttcctgcaggtgctcccgatgcacatcctgatgggcctgttggtggtgcaaccgcgatggccgaacatggtcccctcccgggaccggcatcgatggtga

SEQ ID NO: 6621 - DNA, 459 bp, Actinoplanes utahensis
atgacgacacaggatgcggtcgcaccggtctactccttcagccctcgcttccatgagatcgatggccagggcgtcatgttcaacatgtggtacctgagtcatgtcgacgaggccgtcgatgtgttcttcgagggccggggcttgccgtaccagcaatggcacggtctgggtttcgacgtgcatgtcgtacacgtcgatatggacttcgccgcgggagtccgacgccacgagcgcaccgaggtcctgatcagtacgtcccggatcgggtccacaagctttacgctggactttgccttccgccgagagggtcgaaccgtttgcagcggcggcatcgtctatgccaccgtctccacccaggggcacggcaccgtgaagttgcccgatccgttggtgaaggcgctcggtgcggaaagcccgctgcgggccgcacgccggcatgccggaacgccggcctcttga

SEQ ID NO: 6622 - DNA, 168 bp, Actinoplanes utahensis
ttgccgcccctggcctgcgaccgtcgacgcctgacgacggtaaccgtgcagggccggatccatcggctgccgaacggcgcccggctggtcgtgctcctcgacgaaccggccaccgttgacgggcggatctgtgccggcgttcacgcccggtggctgcgcgcgacgtga

SEQ ID NO: 6623 - DNA, 1266 bp, Actinoplanes utahensis
gtgccgatacttggctgtaccaagcattctcccgagaggttgcggcccgtgagcgcacccacctacgcggccccggcgcccagcccggccagtccccgccgcgtaccggtccgggcggtccacgccactcccccacgggtcgccgggcagcgccgccaccggctacggatcgccgcggtcctcgccctggtcgccctgttcggcaccgaactcctcctcggctggagctcgctggccggcgcactgcaccacctgcgccggccacaccccggctggctcaccctcgcggtgctcgccgaggtcgtctcgatgaacgcgtacgcccggatgcaacgccacctgctgcgctccgccggcgtccgggcccggatcgtcgacaccgtccggctcgccttcgccgcgcactcgctcaacgagaccctgccgggcggcgccgccttctccacccggctcaactaccagcagatgcgccgcttcggcgccagcccggcggtcgcctcctgggtgatcgcgctcagcggcattttgtcctcctgcgcgctcgccgcgatcaccgccggcagcgccctcgccgccggcggcgacgccgactggcgccacctgctcggcctgctgatggccacggtgctgctcatcctcggcgcccggcggttggctcacaaacccgacatcgtgcgtacgccgctggccgccttcaaccgcctgcgccgccgccccaccaccgacggccacgaccgtgtctccgccttcctgggtcagctgcgcaccgcgcagctgcgcccctcgatgggtttcgccgcgtccctgctcgccgtgctcaactggctgctcgacgcgctcggcctgtggctctgcttccgcgccatcggcgagcccccgccgtcgatcaccgccaccctgctcgccttctgcgccgccatggcggccggcggcgtcaccatcgtccccggcggcttcggcatcatcgacagcgcgctgatcctcggcctgatcaccggcggcgtcgccacccccgccgcggtggccgccgtcgtcctctaccgcatcgtcagcttcggcttcatcatcggcctgggctggctctcctggctccgcctccgccggctggccacccccacggccgccgaccgcgcacaccccgatcggacggccgccgaccgcacgcaccccgagcgctgcgtcccaccgcggcgccgccgcccctcccggtggaccggcaaccacccgcgtcgcccctctacgccccgccccagcggcaccccctga

SEQ ID NO: 6624 - DNA, 786 bp, Actinoplanes utahensis
atgacgaccctcgccaccaccttcgccgattccgccacgatgttccgccggcagctgctgcacctgcgccgctacccctcgctgacgatcatgctgatcgggctgccggtgatcttcctactgctcttcgtgtacgtcttcggcggcaccctgggcgccggtctgggcggcggccgcgccgagtacgtcgactacctgaccccgggcatcctgctgttcaccgtggccggggcggtggccggcaccgcgatctcggtggccatggacatgagcgagggaatcgtcgaccggttccgcagcatggcgatcgcccgggcgtcggtgctgaccgggcacgtgctgggcagcctggtgcagatcttcatcgccctggtggcggtgctcggcgtggccctgctgatcggcttccgcccgaccgccaccccggtcgagtggctggccgtgctgggcgtcctgctcgccaccgcgttcgcactgatctggctggcggtggcgctcgggatggccgccgacagcgtggagacggccagcaacaccccgatgttcctgagcctgctgccgtttctgggcagcggcttcgtccccaccgcgacgatgccgccggggctgcgcgcgttcgccgagtatcagccgttcaccccggtcatcgagacgctgcgcggcctgctgctcggctccgggatcgggaacagcgctctgatcgcgctgggctggtgcgcggtgatctccgcactgtcatacgtgtgggccaaacgtaagtacaaccagcgcgctgctggcaagtga

SEQ ID NO: 6625 - DNA, 948 bp, Actinoplanes utahensis
atgacagcgacagtcaccacccggcccgccgtctcggtggccggcctgcgcaagagcttcggcggcaggctcgtgctcgacgacatcgacctgacggtccccgagggcaccgtgttcgcgctgctcggcccgaacggcgccggcaagacgacgatggtgcggatcctggccacgctgctggccgcggacgccggatcggtccgggtggccgggcacgacctggtccgcgagccggacggcgtgcgggccgcgatcggactgaccggtcagttcgcggcggtcgacaggctgctgaccgtacgggagaatctgaagttgatggccgacctgcatcgcctcggccggagcgcgggcggccgccgggtggccgggctgatcgagcggttcgacctcggcgagtcggcgggcaagccggtgcagctgctctccggcggccagcagcgccgcctggacctggcgatgacgctggtcggcagcccacgactgatctttctggacgagccgaccaccggcctggacccgcgcagccggcacgccatgtggcagatcgtccgcgagctggtcggcgagggcgtcaccgtcctgctgaccacgcagtacctcgacgaggcggaccagctcgccgaccggatcgcggtgctcgaccacggccggatcgtcgtcgagggcaccccggcggagctgaaacggcagatccccggcgggcacctgctgctgcggttcgccgacccggccgggctcgcggcggcggcgtcggtgctggccaccgtgcaccgcgacgacgacgcgctgaccctgcaggtgcccagcgacggcggcgtcggctcgctgcggaccgtgctggcccggctggacgcggccggcgccgaaccggaaagcctcaccatccacaccccggatctcgatgacgtcttcttcgccgtgaccggccaccaggagtcccgatga

SEQ ID NO: 6626 - DNA, 846 bp, Actinoplanes utahensis
atgcccctcttcgacacccccggtccgatcgccgtctcggccgacctggtcgccgccgacctgcacgtgatcgcctccgaccgggccgacaccgtggtcaccgtgacccccggttccgccggtgaggaccgggacgtccgggccgccgagcagacccgggtcgagttcgcctccggcacgctcatcgtgcgcggcccacggcaggccggcttcggcatcttcggccgggtcggcaccgtcgacgtggtgatcgaggtgcccaccggttccgacctggaggtcaagctcggcgtcggcggcgcccgctgcatcggggcgttcggcgcctgccggctgcggagcggcgccggtgacctgcgggtcgagcaggccgagagcctcagcatgaccaccggcatgggtctggccaccgccgagtcggtcaccggcgacgcgcacctcaccaccggctccggcaagctgcgggtcgactcggtgaccggcccggccgtgctgaagaacggcaacggtgacacctgggtcgggcacgccggcggcgagctgcgggtcaacgcggccaacggcgacatcggcgccgaccacgcgaccggcccggtcaccgcgaacaccgcgaacggcaacatccaggtgcgcgagctggtccgcggggtggccacgctgcgcagctcggcggggcggatcgaggtgggggtccgcacgggcaccgcggcgcggctcgacgtgcacacctcgtacggcaagatccgaaatgaattgaccgcggccgacggaccggccgagaccgacgagcgggccgagatccgcgcccgcacctcgttcggcgacatcctgatccaccgcgcctga

SEQ ID NO: 6627 - DNA, 297 bp, Actinoplanes utahensis
atggaactacgcccgtacatcgacgctctgcggcacgagctcgccgtcgccgccgcggccggtggcgaggaggctcgtgagctcgccgagcggctgaccgcgccgctggagtccgcgacccggctcgctctgctcgacgccctgtccgaggcggccgccgagatcacccgtgacctcgcgcccggctcggtcgacctgcggctgcgccaccgcgagccgaccttcgtcgtcaccgccccggcggccgacccgtggtcggagccgccggtgcccgagccgcccgccgcgcccggctag

SEQ ID NO: 6628 - DNA, 252 bp, Actinoplanes utahensis
gtgaagcgggtatcgatcgtcgttgtcgttctggtgccgcggctgaccgcggtcgggggcgccggccaggtccgcgcccagcaccggaagacggccgccgagccggccaccacgcgacggctggccgcactggaggcatcgaagaccccgctgcagcgggcggcgcgcggcatcgacctggcccggcgcctgggtcgggtgacgaatttcgccgtggtgccatcggtgatgccacccggcatcaccggatga

SEQ ID NO: 6629 - DNA, 1455 bp, Actinoplanes utahensis
gtgcgtctactcgccctcggggccgccgcggtcctgtcggcgtggtacctggccgcccccggaccgctgaccgcccaggtgatcacctgctgggtggcggtcggctcgtacgcgtcgatgatgtcgtacttcgccttccgggccggcgcgctgatggaccgggccgacccgcgccgccgcttctggcgctccctcgggctcgcggccgcgacctgggccgcgggagagtgggcgcagatcgcgaccgcggtggccgacccggactcggtcgccgcgctgaccggcaccggcatggtccgcaccatcgccctgagcgtgggctgcctcggcctgaccggggtggtgctcacctatccggtcgggcaccggtcggcccgggcccggctctgctacctctacgacctggccaccgtcgtcaccacggcgggcgcctacggcctgtgctgggcggcctccgccggcggaggttcggggttcgcctacgacatgttcaccgtcggcgccgccccggtggtggcgatgctgaccgcgttcgcgatcggccggctctacctcagcggggcggccccgttccgctggccgctcggcgtgctcggcccgttcgccgccggcgtcgagggactcgcccgcggactcggccccgaactggtcagaagcgggcaccccggggtgatcttcgcactcaccgtcaccgcgcacgcgctgctgatgatggccgcgtgggcgcagtaccggaccgtgcacgtgctgcccgaccgggtgcgggaccgcccgtacagcctgctgccctatgtcgcactggccgccggtttcgccctgctggtcggcacgctggcgttcgacggcctggaccggcgcgcctggatcgcggtcgccggcgtggtcatcggcaccggcatcgtggtggcccggcagctcaccgcgttcgtcgccaacgccgaactgctcgccgaacgcgacgccctcgccggccgcctgcacaccatggcgttcaccgacagcctcaccggactgagcaaccgcgccctgttcctcgaccggctcggcgccgcgtcccgggccggcgtcctgctgatcgacctcgacgacttcaaacccgtcaatgacgtgtacgggcacgccgccggtgacgccgtcctcgtcgaagtcgccgcccgtctgcgggcggcgaccggcccggaccaggtggcggcacgcttcggcggcgacgagttcgcggtcctggccaccgacgcgaccgccggtgacctggccgcgctggccgaacggatcgtccaggcggtcggcgagccgtgccggctgccggacggccgacacgtgcgggtgcacgccagcatcggtgtggcgaccggcgacgggcgggacgcgaccgccctgctgcacgccgcggaccaggcgatgtatgccgcgaagtgcgggggcaagggctcctatcggctggccccgacgggctga

SEQ ID NO: 6630 - DNA, 561 bp, Actinoplanes utahensis
atgtggtggcctgacctcgccgcctcgccgcctcgccgcctcgccgcctcgccgcctcgccgcctcgccgcctcgccgcctcgccggctggctggattgttgcgttcgccgatccgcccggccggtgccgagggaccagcgtcggccgggtggtgccgagggatcagcgcgccggccggccggtgtcgagggaccagcgtcggccgggtggtgccgagggatcagcgcgccggccggccggtgtcgagggaccggccggccggatcggtaggacgcgactactcggtgcgcagcgcggtggcggtgcgggtgcgggccgcccagcccgccgggagcagggcggtcacggtgggcggtcgtacaccgcaagcatggtgtcgggcaggtgcaggccgccgctgccggtcatggccgggacgaccaggataccggccgttcgtgctgctggcgcccctggtcgcggctcggatcctggggaaggtgagcctgcgcgaccgggtcgaggccgtggtgacggcatacgagacggggccggtcagccccggcccgcccacggagtag

SEQ ID NO: 6631 - DNA, 792 bp, Actinoplanes utahensis
atggaaaaacgtaatgagcagccccgatccgttcgacgggcagcagccggcttacgggcagcagcccccgcccccgcccggctacggccagcagcccggctaccagcagcccggttacggccagcagccgccgcctccgccgcccggctacgggcagcagccgggctacggtcagcagccgccgccccgcccggttacggtcagcagccgccgcccccgccgcccggctacggccagcagcccggctacggccagcagccgggctacggccagcccggctaccagcagcccgaatacgggaaggccccgtacggcgcgcccgggaccggcgtcggccagcccggcaacctgatcgaccggttcgtcgcccggctcatcgacggcgtcatcgtcgccatcgtggtcagcgtcatcagcgtcatcctcgggatcctgtcgaactcctggttcctcagcaccttcctctcggcggtcgtggatgcggtccttttcctgggctacttcgcctacatggagtccagccaggggcagacgatcggcaagcaggtgatgaagctccgggtgtacggtcccgaccgggccagcaacccgacgttggagcaggccatccgccgcaacatctacgcgggcctcgccatcctgaacatcgtcccgatcctcggtcccgtcatcagcgtgctggccgcgatcgctgcggccgttctgaccgcggtcggcatcaacagcgacccgcagcgccagcactggttcgacaagttcgccggcggcacccaggtcatcaaggtcggctga

SEQ ID NO: 6632 - DNA, 1668 bp, Actinoplanes utahensis
atgtggcttggaccaccatccggggaggcactcgtggtgcagcagcagctcagtatcagcaccggaccggcggagccgccgctgctggaccggacgatcggcgccgacctcgtggccaccaccgcccgctacgccgagcgggaggccctggtcgacgtggtgtccgggcggcgctggacctatgccgagctcaccgccacggtcgacgccgtcgcgctcggcctgcgcgcactcggggtcggcacgggtgaccgggtcggcatctgggccccgaactgcccggagtgggtgttcctgcagtatgcgacggctcgcctcggcgccatcctggtcaccgtcaacccggcgtaccggacccacgagttgagctacgtgctgcgccagtccggggttcgcaccctgatcgccgcgccgtcgttcaagacgtccgactacgccgcgatgatcgacgaggtgcgcgacgagtgcccggacctgatcgacgtggtcctgatcggtcaggagcagtggaccgcgctgaccggcaccgcgccggagccgggggttctcgacgcgatcggcggcaccctgcacccggacgacccgatcaacatccagtacacgtcggggacgaccggcttccccaagggcgccacgctgtcacaccgcaacatcctgaacaacggtttcctcgtcggcgagttgatcgactacacggcggcggaccggatctgcatcccggtgccgttctaccactgcttcggcatggtgatgggcaacctggcggcgaccagccacggcgccgccatggtcatcccggcgccgggcttcgaccccgcgctgacgctgcgggccgtcgccgaggagaaatgcacctcgctgtacggcgtgccgaccatgttcatcgccatgctgcaccacccggacttcgccgggtacgacctgtcgtcgctgcgcaccggcatcatggccggctccccctgcccggtggagacgatgaagcaggtgatcgaccggatgggcatgaccgaggtgtcgatctgctacgggatgaccgagacgtcaccggtctcctgccagacccgccccgacgacagcctcacccgccgggtgtcgacggtcggccgggtgggcccgcacctgcaggtcaaggtcgtcgacccggccggtgcgacggtgccgatcggcgagtccggcgagctgtgcacccgcggctactcggtgatgctcggttactgggggcagccggagaagacggccgaggcggtggacgcggacggctggatgcacaccggcgacctggccgagatggacgccgacggctatctgcggatcaccggccggatcaaggacatggtgatccgcggcggggagaacgtctatccgcgcgaggtcgaggagttcctgctgacccatccggacgtggtggacgtgcaggtgatcggcgtcccggacgagaagttcggcgaggaggtgatggcgtggatccggatgcgccccggcgcgacgccgctggacgcggcgaatgtccgcgctttctgcgccgggcggctggctcacttcaagattccgcggtacgtgcggctggtggacgaattcccgacgaccgtcaccggaaaggtccgcaaagtcgaaatgcgcgatatctccacccgcgagctggccctgaccagcaagtcagatgtctga

SEQ ID NO: 6633 - DNA, 1566 bp, Actinoplanes utahensis
gtgcggccggacagttccgaggacgatgacgacgaacgtcccgctgcgggcctcgacctgtggcagctcgccggcctccccggcggcctgctgcaggcaagctatctgaccagccggtttgcggcgcagtaccggctgatcgtggacgtgctgctggccgagcaggaacacacgctgaccggcgtcgccgccaccgaactgcccgatctgctgcgcaggcgcctgcgccacctcggcgtcgacacggccctgctcgatgatcccggcttccggctcaaggaacggatggcccggctcgaacgctggggtgtggtgtacacgttccaggacaaagccgtccgggacgctgaattcgtcctcgaccgagaccggtaccagctgaccgagaccgtcgcccagctgcaccgggcaatcacctcgctcggggatgacagcgcggccgaagccgccgccactctcgcccccggcatcctgaccgcgaacctgaacctgctgtacgagtacgcccgcaccgacccggccgcagccgccgcagcctggtcggtgatcgccaccacgcatcagtcgatggtgaaagccgccgccggctggcaggcccgcctcgccggggccctggccggggccccgacgccggaaaagatcaccaccgtgcaggagacgctgcgccgctacgtcgacatgtggggcgccggcatcgacacccactccgacacgatcaccacccgtgccgggaaactcgccctgctcccggctggggtgtggcggcgcatcgccgtacacaccctcggcaccaacgccgacaacccggcgatcgacgccttggtcgacactcaccagcacaccctgcaaacgctgcggcgctggttcgacggcccggactgccaggcccgcaaactacgccggcagatgcgcgacacgatcgggccgctcctgcgcgggcagcgcacccttgccgcggtcggcgggcacgtctcccggcgtgccgaactgctcgccctggcggcacgcctggaatcagccgccgacgaccacgccgcctggcgactgtggtgcgccgccaccgggcttttctccgcccggcacctaccgggcgagacgaacccgccggccggcagcgccggcgcggtgtcgttctgggaagccgacccggtcccgatcgaagcacggctgcgtaaacaaggccccaaagccgtgaccggcaccgcagcccgcatcgccgaccgcacgggcgccaaacgcgccgcccgggaacgtgctgcccgcatggcagcgcacgccgcgctcaccgaagccgcgatcctcgcccggtccgggcagcgactctcgcaatggcgcaacgtaagcgccgatgagctgcagatgctgctcgttctgctggccacgatcgccgcagcccgccccgacccgaccggcatcaggtcggcgaccaccggcgacgcgcgctggctgctgcacgccgacccgccaccagacggcgcacccgccgcgatcgtgcacacccccgacggacgcctggtccaccccgacatcgccctgcacatcaccccggccgggagccgcccgtga

SEQ ID NO: 6634 - DNA, 1164 bp, Actinoplanes utahensis
gtgaacaccgcgacctccgccgtcgaaaagcaggcccagcaggcattcctcggtctgctcgcccaacccctgatcaccccggccaccaaccggatcctgcaccggcacgtgctgcgccaccaacgccagatcaccgaccacgctcgccgcgccggctaccgcatccaacgcgtcggccgcgccgtccgtctcatccgggtaccgatcggcggacaggtcaccgcaccaccacgccccgccggcgcgcccggccggcgactgctggcactggcgtgctgcctcgccgcctgctgtgaagaagtctcgaccaccgtcaccctgcagcagctgtccgacatggtccgcgacctgaccggcgccgccgggtccaccgtcaccggctacgacccggaactgaaaccgcaacggcggctgctgcgtgacgccgccaccctgctcgccgactggggagtgctacgccgccgcaccagcgacgaaatgctgctcgactggaccgaagacggtgccgggcccggcgccggctatgacgtcgaccgggacgccctgctgctgatgaccagccccgacgtcctggccgcggccctgcacaccgccgcggccgatgctgagcagctggccgcgacccgcaccgtgcggcagctgcgagagctgctggaaacccccgccgtcgtctacgccgacctcgacgaacacgacgccgacgcgctgcgcaaagcccgcggcctgcgcaccgccgatctggcgcagatgaccggcggcacggtggaagcgcgcgccgagggcctgctcctcgtcctaccggatgatcccgaccggcagccgagcgtcgtcgactggccccgcgcccgcgccgcggactgggtcgcgctgctgatggccgacctcgccggccgccacggcgcccggacctccaccggcacggtccgactgaccggcacacaggtcgacgaggtcgtcgacgaccttgtggcatggcgcggcgactacatgtcgaaagaccagaaaaccgtgcccggcagcgtgcgcgccgacgccgaaacgatcctgaccgaactcggcctgctccaggtcggcgccgacggctcgtggacgttgtcaccggtcgcagggcgttaccgggaccccgacatcaccctgatcgacaccacggagcccacccgatga

SEQ ID NO: 6635 - DNA, 3138 bp, Actinoplanes utahensis
atgacgatgatcgacctgcccgcgccggggccggccgccaccgacgagcaactggccgcctggcgtgacgccgtgaccaccgccggactccccgccccgtcccgcagccgctggcaggtcctgcgcgcaggcgtgatcggactgtgggaattcgacgtcgccgagtactggttcgctgacggccgggcccagttcgtcggccagaaccagtccggcaagtccaccatgatggccttgaccacgctgctcatgctcgccggcagcctcgaccgcaagtacgtcgacaccttcggcgagtccgagaaggaataccggtactacgtcgaacccgtcaccgacgaccgggaccggcgtgacgcctccacctcgaccaaccggggctgggcctgggtcgaatacggccgcgtcggcccgctcggcgcccccgaattcttcaccaccatgctctacacccagaccaaacgcggcgtgaagcagatgacccgggcctgggtcgtctgccgcggcaccgcccgcgtccgcgacggcctggacctggccgtcggacaggcggtcaccgagcccagggaactcgagggcgtcgacgggctcactgtctacccgaagggcgcggactacaccgagcggctcgccaccgacctgttcggcttcgacgacaccgaacgctatgcgaccgtgatcgagatgctgaaggtgctgcgtaccccacacctggggcagaaactcgacccggcctggttcacctcccagatccgttccgcgcttccgccggtcgcgaaaagcgaggtgaccgagctggccaacggctggcaggaactcgaacagctggcccacgaccgtgaccacgccgacgaagcccgcaaggcgatcaccgtctacctcaaccgggcgtggcggccctgggccgatgccgtcctgcggctgcacgccgacacactgatcgccgctgacgctgcgttcatcaaggccggcgacgacgccaccgcggcggaaaggaagcttgagcaggcgcgcgcccgcctcaacgaggagactcagaacaccatcgacctggagaaggccctcggacggacccgcgccgacctgatgcagctgctgcgctcatcggcgtacacgaccgccgttgaccgcgccgacgacgcgaaacgcctgcgcgccgacgccaacgccgctgctgagcgcgcccgcaaggccaccgcccaactggccacgacccgcgttgacctgcagaaggcaaccggccgtcgcgacacgacccgggcagagctcggcgttgcccgagacgaggtcgagatcgcgggcgggcacgctgtcgaggccgccaccgccgccgggctcggcgaacacgcaccggcctgggcagccgccggcgacgtggaccggttcgacgccgcaatcgccaaccgccgcgggcaagtcgccgctctccgcaaactcatccgcgccgccagcaccgccgccgcgacctggaacaccctcgacgacctggcgcagaaggcgcaaaccgaactccacaatcggacggccgcagccaccgccaccgagaatgctctgcagcaagcggtgcagacgctgtcggacgacctggaacgctgggcttcggcactcgacgaatgggcgccaccgaccgagatccgcacccagtggatcaccgccgtcaccgaccagacccgcgtcgagcggccccgggaactgctcaccgccctgctgacccaccagtggctcgaaccggtcaccgtaccgctgatcacccgcgccgccgacctgcgcgccgccgcgaaaacggccacccaccaagcagccgcggcggacgccgaagctgaccggctcgccgccgccggcgaccccatcccgagcccgccggcccgctggacccgccgtgaacgccccgccttccccacagcggcgggcgccccgctgtggcgactgctcgatccggtcgacgatctcgaccccgccgtcctcgaccatgtcgaggcggccctggccgccgcgggcctgctcgacacctgggtcactcccgacggcaccttcaaccccgagcacggtgccgacgtcgtcatcaccaccggcaccctgcctgccgcgacaacctcgctggccgccgttctccaacccgccgaagacgccgccaccctcaccgaggccgtcacgaaggtcctccacggcatcggctacacccctgacggcccgctcaccacgaccgtgtgcctcgccgccgacggacgctggcaaaccaccgccgcagccggccgggcagcgcccgccgaacacggcgctgcattgatcggcaccgccgcccgcgccgcgacccgccgccgcaacatcgcagaactacgcgcacgggccaccgcgttccgcgacgaagcgcagcgcctcgccggtgaagcagacaccgtcagcacccgcgtcaccagcctgcgcgccatcgccggacaggcacccaccgacgccgacgtggtcgctgccgccgccgctcacactgccgcgaccgccgaagccgagaaggccggcaccgcccaccgcgacgcccgcagccgcgaggcgcatgcccgcaccctgtcgcaggagaagtcagcagaggtcacccgctacggcaccgacaaccggctgcccaccggagaagaacaccttgacgcacttgccgcggccctcgacaccaccgccaccgccgccggcaccctgaggctggcactgcgcgggctcaccgccgccaccgctgccgcaaccgatgccgccgaccggttcatcaccgaagaggatcgggtcagcgccgctaccaccctcgccgaggacgaagcggcagccgccgaactggccgacacgaacgcgaccctggccgaacaattcgtggacgccgacgctcaacagctgttcgcccaggccgaggaactcgaacgcagagtcgaggaatacggcccgtcgatctcagccagccgacgcgaaggcctggcccgctccaaagaggcaggcgaagccgagaacgcctggaagagcgcctgcaaggaccacaccgcagccggtgaacaccgcgacgtcgcagccaccgcctggtggacccccgtcgacgccggtctcaccaccgcccgcaacctgcccaccccggacagccgcgacctgcccgccgcgcctagctag

SEQ ID NO: 6636 - DNA, 1152 bp, Actinoplanes utahensis
atgctcggcagcgccctgattgaccttcgcaccgttctggaagcccacggcggtcgctccgtcatcaccaccgaagccgacgaacagcaccccctgccgtcggtcactctgatcgtcgatgcctccggcaccccgctcgaccccgccgaagccatcctgcacctgcagaaactggtcgacgacctgtcgcgcacccacgacgagaagctccaccagatgtacaccgaacttctctcgtccaccttcatcgaccacctcgccgaccggatgcggaaggtcatcaccctgctcaagatcgtcaacgatgtcctcgagaaacacccgaccggcgccaacaagaccaccctgcgactgcgtcgcgtccccgcggaaggccagacccccggcttcaaaatcctcaaagcactcctggacggcaccatcgaatccgacgccgcgcaacaacagatccaactgttcctcggcgcccgcctccgcgaagcccaggaagccggcctcgtcgggaccgaagactggaccgaccgcctcgctgaactcctcgactaccgcgcctggttcgacgtggtcgcccaatacaaggtcggcgacagcgacgaggacgagaaccgatggaaggacctcaccaggaaagtccacggcgtcgactccggcggcggcaaagtcgtcaccctcctgcaacctttgctggccaccctggtcgccctgtactccgaatccccgaacgcaccccgccccctctggctcgacgaagccttcgagggcgtcgacccggccaaccgcgccaccatgatgcggatgctcaccgacttcgacctcgacttcctgctcgccggcccggcacccctggtcgccgtcgcgcaagtccccgccgccgcagtctggatcatcacccgcgcacccgcacccatccccggcgtcgacctgtccctgatgctgtgggccggccacaccctcgaacagatccccgtcggggactacgccacccggctactcaccccacgccgcagcgccgaaaacctcggtcccgacctgttcgcggccatgctcaccgacccggcaccggccgagccgtcgcacaccaacggagccgaccacaccgacaccgagcagacatcggacgcggccggcatcggcgaaagcgagcccgcatga

SEQ ID NO: 6637 - DNA, 1212 bp, Actinoplanes utahensis
atgagcgcggcaaccgaccgatgggccgcccaacccggcccccggaaggtcctcaccgccgtccgtgaactgctgcaggaacgccgcaccggcaacggtgtcatcgtccgcgtcgagctcaccgcgacgcaacgagcccaagtggcccgctacctcggcgtggcgtgggacacctccggtcagcccgtgaccctcggcagactccgtgccgccctcctccgagccggcgacgacctgctcgacctgctgacccgtaccggcggcgccatcgaggacgttcgcggccgccgtgacgaagccgccgcccgcgccgccgcccgcatcgacgccgcctacaccggcctcaccaccgcaggcctacccgatcacgccgtccgcctggcccgcaaacgccgctggctcggcaccgaccccgagaccgccacccgccgctccgacgacctgcaacacctgtggcaagcgttgcccggcaccggccgtcccctcgccgaaatcgccaactccctctacggcgacccacaccgcctcgaccgcgaccacgacctcggccgcgccgccgcccggctactcgcggccgccgcggccgccgcggacgatgacgccgccttcgccgccgacaccgcgctgaccgccgaccggtggcggcaggtgtggtcccagtacggcatcggctgcgacgaagtctccgccaccgtcctggtcctcaaccttcccctgatcgggaaggcaccggccgcccggatcgcgggcgcggcagccgtacacggcgaaccggtctggctgaccagccgcagcctgcgcggagactggacacccggacccgacctgaccgtcgtgcgcgtctgcgagaaccccgccgtcgccgaggccgccgccgaccgactcggcagcgcctgcctgccgctggtctgtatctacggacggccctcatcagcagcctggacactgctgcgtggcctcgccgccgacggcgtccgactccgggtcaccgctgaccgtgacgccgcgggccgcggcttcctcaccgagatgctcgccttacccggcgccaccgaatggctgcccgacgccgacgggctgtacgaggaagcccggctggaagccctggtggccgacctcgatcccatcacccgtgccgccggtgacagagatgatcatggtgaggggcttttgccgggccccgatccgaagccgacaatgggcttcgactga

SEQ ID NO: 6638 - DNA, 660 bp, Actinoplanes utahensis
ttgtcgcatttcggggtttacgtctgcctggctccgggggcggaggcggactggcaggcggccgtcgccgcggtgatggcgcccttccggatcgacgacgagaccggtctgggggagtgggaccactggcacccgtccgggcagtttctggtccggccggagtacgcggacagcccgctcatcctgcccagcacccgatggcctgccgatccgctgcggtgcgacggcggcccgaaacggatgctcgatctggaagggatgcggacggcggcacgggatcgggcgggacagctgtgggccgcctggcgggaggcggtatcccggcatccacccgcccggtccctcgagacgtgcgcgtcgcgggaggcgtacgaggcgcaacccctcatcgcggagatccgggcccgcagcgacgacgagggcgacgtcttcggcctgctgtggaccgacggccgggacgaggtcacctaccttggagacgacgagcagcgttttctcgacaccgccgtcgagtccgcgctgatgacgtacgcgctggtcacgcttgacggccgatggctggacatggagcagacgccggcgttcgcctcgctggtctggccctgtctggaaggcctgccggaggacgccttcgtcatcgagctcgactgtcactgttga

SEQ ID NO: 6639 - DNA, 414 bp, Actinoplanes utahensis
atgagcccggactcaccggcgtcgacgtcaccgcattccaagcttcgcctttacctggtcgcgctcgcggtcgttctcgtggcagcatccgcggcggcggtgatgttcatcgtgcgggacgggtctggcctcaaggtccgctacgaggtcgaggccaccagcaagaccgccaccatgatcacgtggaccaatggaacgagctcggaaatttccaaggtgccggcctcgctcggagagacagccggcctcccctggtcaaccaccgtcaccttcaagaagtcccagcagtacgtagccgtagcggtcaccttgagcgaacccggaaacgccacctgtcgcatgttcttcgacggcgaaaaggttgcggagaccaccaacccggggggcgtgatctgtgaaggcacaaccccctag

SEQ ID NO: 6640 - DNA, 2094 bp, Actinoplanes utahensis
atgtgccgacacttcgtgcatggcggctggttgctcgccggtgccggcccgctgcgggccggcaccggcgagggccatgcatcagcggtggtaggtgcgccggctgctgtactggatgttgccggcgcgatcgtacgcccgcagttgcacggtgaaggtcttgccgtacctcgcggggttgagggtgaacgcgtagccggcgcgggtgtcggtggcgaccggtttgccgttgacgagcagctcgacccgggcgatgccgttgcggtcgctggcggcggcggtcaccgcggcgcttccggtgagtttggcgccgttggcgggtgccttgctgatcgcgatggcgggtttggtgttgtcgacgacgacggtccgggtggcggtgctggtctggcctcggcccgcagggcagccctccgggcggccacgcccgaaaatgtcacaccgcacttccagcctcacgacgaacggaaagggcatctgcgaccctcgtccgctgcggctgaccggcggcgacgtccggagaagcgtccaaaagtttcacagcatgacgcattcctgaaaacgctctcccgtacggtctgcgccgtgacatccacgattctgcttctcgccgttcccggctttctgacgctctacttcggattcttcgctgtcttcaactacacctacgcgttcggcgcgctgacccgccgccgcccgcccacggtcccgctgccgctcgacgcggcggtggcggtcgtcatcgtgtcgttcaatgagcgcgaagtgatcgccgacacggtggtcgcgtgtgagcagctgacctatcggaacaagaccatcatcgtcggcgacgactccaccgacccggaaacgatcgccctgctgcggacactggctcaagagcggggctgcacgttggtacccggcgcccgttacgccggtagcgacatcgagctgtgggaatcggatcggttcgtcctgttccaccgggcggagaacgtcggcttcaaggcgggcaacctgtcgaccatggagcagtatctccgacagcgtggcttctcccacatgtaccttctggatgcggactggcgtccccaggccgacgccgtcgagcgctgcctcgaggtgatcgccgccgacccggccacgggatacgtccaggccaagcgtctgtatcactacggccgtagcgaccacttccagcgctgtctggccctcaacgaggaatcttgctatctgtccgacctgcccggccggcagcggtggaaccacatggtgctgttcaccggttgctgcgcgatgttcgacctgcgggcgctgtatgccgtgggcggattccgcgccggtcacctgaccgaggacatcgacctgtcgaatcgtttctacctatccggctatcgcggcgtctacctggaagacgtggccaatctcggtgaggtgccgccgaattaccaggcgttccgtcggcagcaggagcgctgggcgatcggttcggcccgcaccttcaaggagtacctgctgcccgtcctacggtcagggctcgacctgcgcaccaaatggagcctgctgcgccagaacgcctactacaccgccgccttgggcgtcgagttgtccgtggtgtggagcctgctggtggtcgccgtcgcggtcctcggcaccggaccaggctggccggcggccgagcccggtgagctgctacgcgtcttgggatacgggctgggaccggtcatgctcgtgacgctgctcagcggcgtcgcccccctcgtcgtcacgaccatcaaaaagcgcgaatggatcaatcttctctacatcccggtcgctagctggatcgccctgtcggtcgtgcacacctatgcgatcgccaacatcaaggggttccgcaacacggcacagtcctggttcgtcaccccgaagacaaaccgtaagaagggcgcggtacgcatacgcgcggggcgtcgtatgcgggcgttcaacatggtgacgctggtcgccatgaccgccacctatctggccgtataccaccacacacccgacccggcgtcgctcgcgctgctcgccgtgtacgccgcgctctggctgccgtcgatggccatcgccgccatgaggagctga

SEQ ID NO: 6641 - DNA, 2622 bp, Actinoplanes utahensis
atgtccggtgccggcggacgcgggttggtcggccggcagggtgagctcgacgccgtccgggcggcgctcaccgagctcgggtccggtgccggccgggccctcgcgttcgtcggggaacccgggatcggcaagagcgctctcgcggcggcggcggtgtccctggcccgagcggccggggtcgatgtcgtcgcggcgcgcggcgccccggtgcccgtcccggggccgcgacggccggtgctggtggtggtcgacgacctgcacgaggtcgccgacgcgcacatcgaccgggtcgagcgtctggtggcggcgaccggcgccgggccggtgctctgcctgctggcctaccgcgagcggcagatgtcgcgggccctggccgcggtgctcgccggcaccgtgcccgccggactgctggaacgccgcacgatcggaccgctctccgccgagcagtgccgggagttgctcggcgaccggcccggcgtcgaggcggcacaccgggcgagccagggcaacccgggttacctcgctgttttcgcggggcagccggacgccggcaccccgatcctcggtgagctggcccgcctcgaccgcgccgccctcacgctggtgcgtgctgcggcggtgctcgagcagccgttccggccggagcttctcgccgaggtcgccgagttgccggtgcccgcgacgctgacggccctcgacacgctcatgcgactcgacctcgtccggccggccgagccggcgccgcacctcgcgctgcggcacccggcgatcggcgtggtcgtgtacggccggttggagcccagccaccgcgcggagctgcaccgccgcgccgacgccgtgctggccgaccgggcggccccgatcgcgctccgcgcccaccacgtggcgcgagcggccgacctgagccggccggacgacgtcatcaccctgatcgcggcggcgcggggaatgctctacggttccccggccggcgcggccggttacctgcagaccgtcctgccgttgctgcgcgacggcgacccgcaccgccacgaggtccaggtgctgctggcccgggcgcgcctgctgaccggcgaggcgtccgagggccgggcgctgctcgacgcgttgcgctcggcaccgccgcgccgggcgcccgacgaggcgcacgcgctggtcgactccagccgcatcgagcggcagcgcggccgctacggcgaggccgcggccctcgcgcgggccgggctggccgccttggccgaccgcgacaccgggaccgccgcggcgctgcacaccgaactcgccgaccatgcctacaacctgggtgactacgagacgtcgcagcagcacgccgagaccgcggccgccatcgcccgccgccaccacgacccggtcggcgaggcacacgccctggcccacgcggcgctcgcccagctgttcaccggccggcaggcctgtgccctgcggaccgcgacccgggcggccgacctggtcgacgcggcacccgacgccgtgctgctgaccaacctggaggccgtgttccagctcggcatgatggaggggatgctgggccggctcgcgaactcggcccggcacctcgagcgcggcgtcgacctgtgccggcggaccggtcagaactacatcgagccggcgatgctgaccgcgttgaccaacgcgcgcctgcgctccggcagcctgccacaggcgctggcgacgttggacgagcccccgcacccggtcgaatgggacgccaacgcggccaccgaggcgatcacggcgatgctgcgcgccaagatcctgttctggcggcaccggcccggcgacctggccgaggcggtggcgcaggccgatcatgcggtacgcctcgccggtgacaccccggagtcgtgggccgtcacgatccgctgcttccacgccgaattcgtgctgctgaccggcgacccggcccgtgcccgctggctgatgctcgacgcggccggcggcgccgacctgccgaagctgaccgcctggcggcgcccccgctggtgcgacaccctcgccgaggcggcggcggccgagcacgacgaagccgcggtgcggcactgggccgagctcgccgaggtctgcctgcggcagctgccgtcgaccgaccggcaggggttcgcccggcgcgcgcggatgcgggcccatgcactggccggtgaggtcgaccgcgcgctcgccgccgggcgcgacgcgatcaccgacttctcggcgggcggggagcggatcgaggtgggccgcacgttgctcaccacggccgcggtggcgctggacgccggcgacaccggcgaggtggcccagtggctggaccgcgccgcggtgctcgccgaccggtgcgggtcggcccggctggccgaggaggccgcgaccctgcgcggccggttcaccgaaggtggtgcgctcgcccacctcacctcgcgggaacgtgaggtcgcccggttggccagcaccggcatgaccagtggcggcatcgccgaagccctgttcctgagcgtgcgcacggtcgacggtcacctgggccgcgtgtaccgcaagctgcaggtgcgcaaccgggccagcctgatcggtgctctccgggccggtgtcacaccgcgaccgcggtcaacgccgcccgcgacgtga

SEQ ID NO: 6642 - DNA, 366 bp, Actinoplanes utahensis
gtgcccgccgagatccgcgcccgcctgctgctcggccgggtcctcgtcgacctgcggcagctcgacgaggcggccgcgagcgtgggcgaggcgaagaacctcgcggacgcgtacggcgcggcccggctcgccgtcctcgcggtcaacgtgcagcgtcgcatcggcgcgggccggtcccggggctgcgccgacgtgctctccgagcaggaacggcgcatctgtgccctggtcgcggccggcctcacgaaccgggacgtggcccgtgagctgtacatctcggtcaagacggtggagggacacctgacccgcatcttccgcaagctgcgggtcacgtcgcgggcggcgttgaccgcggtcgcggtgtga

SEQ ID NO: 6643 - DNA, 1005 bp, Actinoplanes utahensis
gtgcgggccgatgcctcacagccgccgctcgtcggccgggacagcgagctcgacgccctgatcaccgccgtcgccacctgtgccggcggcgggtccgtggtggtgaccgtcggcggggacccgggactgggcaagaccgcgctgctcgatgagctgggccggttggccggcgcggccgggctcccggtgctccgcggacgggcgacgccggtcgggcgggcggttcccggcgactccccggtgtcgcgggccgtcgacggcctgcgctccgccgccggcggtcgacgcgccgtcgtgctgtgcctcgacgatctgcatgcggccgacgacgacgacctggcggtgctcagccggctcctgcggcgtccgccgaccggggctctgctggtggccggtgcctatcggccccgtcaggtctccggtgcgctggagacggtcctgcgggacaccgccgccggtttccgcaccgtccacctggctccggccgctctcgaccaggcggcggccacgcggttgttcggcgacggtccggccctgcgccacctggccgccagcggcggcaatccgctctatctgcgggtggcatgcgaactggagcgccgcggcggtgaccccgccgcgttacccgaggatctgcgcaccgccctgacccgcgacctcgcgccggtgcacggcgatcagctcgcggtgctgcgcgccgccgccgtcctgggcgacccgttcgacccgctcctgctggcgccggtcgccgagctcgacgagcgggccgcgctcgccgcgctcgacggcctggcggcccgggacctcgtccgctcggacggatcgcatcaccggttgaccctccggcacaccctggtgcgggtcgccgtggtccgccggacgccaccgggatggtggatcgccgcgaacgcgcgcgcggatcgggccctgcaccgctgcggtgccggccccctcgcccgggctccgcacctggcccgggcggcccggccgggcctagctagctag

SEQ ID NO: 6644 - DNA, 2718 bp, Actinoplanes utahensis
gtggcggcggtcgtcgccgtcgacggcacgcagggctggtcgttcaccgaggacgacacctggtgtcacgtctgtccgccggacggcaccgcggtagcgcgggtgcaggggtggaagctgcacgtctcggccacccggctgtccgtgccggaggtgctgcaccgctgcgccggggtgctggtcgaacgggcctgcgccttcaagttcgcccgcaccgccgagctggtcgccaagctcaccaacgagcggtacgaccgggcccagtgcggcaagatcatcacggtctacccggaggacgacgatcagctgcgggaggtcgccgccgcgctggatgcgacgaccgcgggcatgcgggggccggccgtgctctccgaccggccgctgcggccgggcagcctcgtgcactaccggtacggcgccttccagggcgtccgggtgctgaccgacgacggcgcctaccaggtccggctgcgcaccccggacggccgcacgatcgaggacgtccgggcgccgaggttctccccgccgccgtgggccgagccgccctatccggcaccggccgccccaccggcgagcaacggtgccgcgggggctcgcacggtggtcctgggcgaccgtttcgaggtacgtgaggcgatccggcacgcggcccgcggcggcgtctaccgcgcgtgggaccggcacaccgagacgatggtgatcgtcaagcaggcccgggccgacgtcggccagcgtccggacggccgcgacgcccgcgacgtgctgcgcgccgaggccgacgcgctcgacgcgctggcgggcatcgcccccgaccggctcgccctgttcgaccagaaggaccacacgttcctggccgaatccctggtccccggcacgaccctgtccgcgtggatccacgaccggctcaccgccgccgggccgatggccggccccgcgccggccgacgcgctggacatggcgtcgcggctggccggcctgctggccgaggtgcaccggcggggcctggtcttccaggacttcaccccgatgaacatcatggtcaccccggacgggtcgctgcggctgatcgaccccgaactggtggccgtgccgggcgcctgggcgctgcggggacacacgccggccttcgccccgccggagaccgtcgacgagatcgggccgggccgggtgccgcaacagagcgccgacctctatgccctgggcgcggtcctgttcgtcctcgcgctcggagccgcgccgctgttcggcacggaccagcccgggccgggctccacacacgaccggatcaccgcactgatcaccgccgcggcggtgcacaacgccacggcccgcgccctggccccggcgatccggggactgaccgccgacgaacccgcgcaacgctggagcatcgagcggctgcgcgcgttcctcgacgaccgggcggcgacgccgacgacggtgctccgcaccgggccggccgagggtacgacgtccgaccggctgccggccgccgaactggacagcttcgcccgggacgggctgacccacatcgtgagcaccgtcgcgagcgagccggatgccggccggctgtggtccagcacggccttcggcaccacggccgacccgcactccgtgcagcacggttcggccggcgtgctcagcgtgctggtgcgggccgaccagcttctcgaccggcccgacctgcgcgccgtgatcgcccgggtggcggcctggaccgggcgtcccggcacggcgccgcggctgctgcccggcctgtacttcggccggtcgggaacggcctgggcgctgtacgacgccgcccggcacctcggcgacgccgatctggaggcccgcgcggtcgacctggctctcgccctgccggtgcgatggcccaacccggacgtgtgccacggcgtcgccggctcggccctcgcccagctgcggctgtggcggggcaccggccgcgaggaattcctcgatcgggcccggcaggccggtgaagcgttgctggccggcgccaccgaggcggacgggcgggtgtactggaccgtgcccgacaacctcgactccacgctggtcggcatcacccacctggggttcgcccacggcgtcgccggcatcggctacacgctgctcgccctcgcgcaggccaccggccgggaggacttcctgcgcaccgcggtgctggccggcgacaccctggctgtcgaggtcgaccggaaaccgtggggtgccgggtggcgctccgaccgtggcgacgagcgcggcaccggcatgcagttccactggtgcagcggctcgtccggggtgggcaccttcctgctgcgcctgtggcaggccaccggcgagatcacgtacctggacctggcccgcgaagcggccgccgcggtgcggcagacccgctggcgcacgggtacctcggcctgtcacgggctggccggcaacggcgagttcctgctggacctggcggacgcggtcggtggcgagtaccgggcctgggcgcaggaactggccacctcgatggtgctgcgccacgcccggcacggcgacctgcggctggtacccgacgagggggatcaggacgtgaccgccgacttcaacgtgggcctcgccggctcggtgggattcctgctgcgcctgcggcacggcggccggcggccgttcatggcagacccgtcgagcggacggtggcaggtcgcgccggcctcggcccgtcgtccggtggccgcacgatga

SEQ ID NO: 6645 - DNA, 1773 bp, Actinoplanes utahensis
atgagcagcccggcgacggcgcaggtcaccgcgcgcatcagcttccgcttctcggccgacgggagccgggcggtctgcatggcggccgacgaacgcggccggcaccgggtggagagctggcagctgggcaccgtcggcccccgcctgagcttcaccgcacccgtcaccggcgacccgcgctggatgatgcccctgccggtggacgccgaccgggcgctgctgacctggttcggcgccggcggggcactgaccgccgaactgctggaccgcgacggcggccgcaccacactcggcaccttcccggcaccgctgcgcgtgatcggcgcgccggcggcgaccggcttcccggcactcggctgggcggacgcaccggagagcgccggtacgacgctgcaccggctgggcgtcggcacgccgtggctgcgcccggtcgccgaggtgcccggccggctgcgcgacgccgtggcgtgcggcgaccgggtgctggtcaccaccggccacggcggccggtccacccggatgatcgtcgatccccgggacggcacgtgcgtgcccgcgccctggttggacggtctgtcccgggtgctcgcctgcgccggccgccgggtgctggcgacggtgcgccggccggagggccccaccgtggtcctggccgacctcgacaccggggagccgcggtggtcggcgccgggggactggtgccgtcccgaggtgtacccggtcgcgctcgatccgaccggcacgagcatcgccgtcgtgcagacccgcggggctcgttcgcgcctgctccgctgggacaccatgtcccgcgccgcgcaccccgtcaccatgccggacagtgatctggtgccgctcgcggcctggacgccgaacgggttgtggcttccccggtcgggcccggatcggccgtgcggcctcgcctggctaccccccggcgcggaccggctgcgggtgcccgcgccaccgtccccgccgtggtcgcccggccggctggagaccttccccggtgccggcgggccggtcgaggccgtcgtgcacgggcccgactggcgcagcgcggcacacgtcgtggtggccctgcacgggggcccggcgagccggtggtcgctcaccttcgagccgctgttccaggcgctggccacggcgggggtggccgtggtggcgcccaaccagcggggcagcaccgggtacggcaccgcccacgcccgggcgatcgtgggcgcctggggggtgcccgatctcgccgacgtcgccgccatcggcgcgttcctgggcagccgccgcgggcccggccggccgcgcccggcactgtacggcgtcagctacggcgcctacctcgcgctgctggcggccgccacccaaccggacgcctggtcggcctgcgccgccctcgcgccgttcctgtccgggccccgcctgcacgccgacggccatcccgccgtgcggggcatggtggagcggctcgacggactcaccgaggccgacgacgagatcggcccgcgcgacgtggcacggctggcgtccgggctgcgggcaccgctgctgctggtgcacggcgcccaggacgagtccaccccggtggcgcattcgcggctgctcgccgagcgactgaccgccctgggccggtcgcgtggcgtcgacctgcactacctggaaccccctgaccgcggtcacgccgtgctcggcaccgccgtccaggatccggtcaccgcagtggtgacacggttcctcgcggagagccggccgaccgtcgcccctgccccgacgagctga

SEQ ID NO: 6646 - DNA, 147 bp, Actinoplanes utahensis
atgacgatgaccgacgatctcgacgccctgcaggacctgccggcgatggaggaggaggaggcgcaggccggcacctgccggttcacctgtgcctcgaccacgtgcaagggcacctgcccggccacctgcagcgtgaccggccagtga

SEQ ID NO: 6647 - DNA, 141 bp, Actinoplanes utahensis
atgcgggtcttgacggcgaccgccgggatgctgcgcgtacgcctgaccctgttcgtcgccgcgctgacggtgcaggccgcggccggcgtgaccgtgccggcgctgctcgccgcggcgagcgacgcggtgctagctagctag

SEQ ID NO: 6648 - DNA, 1455 bp, Actinoplanes utahensis
atgctgaccctccggcggctgctggcactcgggccccggtcgccgttcgccgtgggggaggcggtgacccaggtggcgcaggccgccccgcaggccgcggcgctccccggtcatgtggccgaggcgtccgtctcagtcgccggctcggccgcggcactcgtcgcgttgtggctcgtcgactggcgggccggcctggccttcaccctcctggtgccggtcaccgtgctggccgcccggcggttcgtcaccgaggccgccgaggtcgagggccgctatctggcggcacagacccgcatggcgtcgctgttggccggcgccctcaccggtgcccgcaccatccgggccgccggcaccctggccgccgagacccgtcgcgtcgccggcccgctgcacgaactgtccgccgcgggccacgcgtcgtggcgcgtccagcgcagcgccgtctggaagatcgggttgctggtgcccggtaccgagatcgtcgtgctggccgtcgccggagtggacgtgagcgccgggctcatcaccgccggaaacctgctcgccgtcgccggctacctcgcgctcgccaccggacttctcgaccagatcgacaccgcgctgagcctggcgcaggcccgcgcgggcgccgaccggctcgacgccgtgctgcagcggccggccgtcccgggcgggccccgcagcatcccacccccggacggcgcggtgtcgctgcgcggcgtcaccgtcgtgcgcgccggcgggcgggtgctcgaccggctcgacctggagatcccggacggtgtggcggtggcgctggtcggcgccagcggctccggcaagagcgtgctgggcgccctgctcggccggctggccgacccggacgagggtgcggtccacatcggcggcgtcgacatcaccgacctggatctgccggccctgcgccggacggtgacctatgccttcgcgcgccccgcgctggccgggcgcaccctgcacgaggcgatccggctcggccggcccgagctcgaccgggtggcggtggagtcggcggcccgcgccgcgcggatccaccacgtcatccggcggctgcccgccggctacgactcggtgcccgcgcgtaccccgatgtccggtggacagctgcagcgtgtcggactcgcccgggccctggtgcgacccgccctggtgcacgtgctcgacgacgcgacgtccggtctggacagcgtcaccgagcgggaggtcagcgaggccgtgacggcccggctgcacggccgcacccgcgtcgtcgtcacccaccgcgcggacaccgcggcctgctgcgacctggtcgcctggctggacgcgggacgggtccgcgccctcgcgccgcacgccaggctgtgggccgatccccgctaccgggccgtgttcgagaccgtggcggtcccgtcggcggccaccgaccgggagcagccgtgcgccgccgaccggtga

SEQ ID NO: 6649 - DNA, 1728 bp, Actinoplanes utahensis
gtgcgccgccgaccggtgagcacccggatgatccgcttcggcctgaccgggccggccgccgccctgctcggcgatgtcctgcggggcagcggccggccgctgcggcggatcgccgtgctctcggtggccgaggccgctcccgcactggcatccggctgggtcaccgcggccgcgctggaccgtggcttcctgcagcaccggctgtccgtcggactcgcctggctcgccgtgctcgccggtctgcacctgctgcgggccgccgctgaacgtgccctgttcgatcctctggccgcggtcgtcgagccgatgcgggaccggttgacccgccgggtggtgcaccacacgctgctcgaggcgacctcgctcgcggcgccgccggacaccgccggggtgtcccggctgaccagccaggtggacgcggtacgggacctcacctcggcgctgctgcgcaccgcccggcccctggccatcacgctgctcgccgcgggagccggcctgaccgcgctcgaccccgtgctgtccgggccggtgctggcggcgctcaccgtcgccctggtggccttcgcgtggtcgatccggcgggtgggggcgctgcggcgggtcgcggtgctggccgccgaggacgtcgccgcccgggtcggcgaggtgctgaccgcggcgcgggacatcaccgcgctgggcgccgaggaggaagcggccgccctcgtcgaggcggactcgcagcgcgcgctgcgcgccatgctgagcgccggtcgcgccgccgcgtcccgggtaccggtcgtgctcgtgggtggccatctaccgctcgtcgggctgctgctggccgccccgcacctgatcggcacgcgggccatcaccgcgggcaccctcatcggggccgccacctacctggccgggtcgatcgtgccggcgctgcggatgttgaccagcgccgtcggcggttactggaacaccctcgccctgctgctgcaccggctggccgaggtggccccggatccggtcgccgatccggtgcccccggccccggtgtcaccggcggtgcgtcacgacacgaccgccgacctcaccgtggcggggctcaccttcgcgtacgccgccgacgcggagccggtcctgcgcgacctgacgctcaccgtgccgtacggcgatcacctggccatcaccggcgccagcgggatcggcaagtccaccctggccctgctgctggccggcatccggcagccgtcggccggtcaggtgcgcatcggcggtcgtccggccgccggactgcccgaggagcagcggcaccggctcgtcgccctggtgccccaggaggcgtacgtcttccccggctcggtgcgggacaacctgcgctacctggccccgtccgcggacgacgacgaggtcgttcgcgcggtggcggcggtcggcatgaccacgctgctgggccggctcggtggcctcgacgccgagctgaacgacccggccgccaccctgtccgacggcgagcggcagctgatcgcgctggcccgcacgtacctgtcgccggcgccggtggtcatcctcgacgaggccaccgcgcacctggatccggccgcggagacggtggcggaggccgcgttccgcgaccggcccggcaccctgatcgtcatcgcgcaccgcaccggctcggccgcgcgggcccgacgcgtcctgcacctggacggcgacgaccacacggtgaccgagcacctcggcgcacacacctga

SEQ ID NO: 6650 - DNA, 1458 bp, Actinoplanes utahensis
gtggcgggcccggctggcgctcgccgcgaccggcgcccgggtccgggtcgcgccggtgccccacgccggcctgctgcccggctcggtcccgcggcccgacctggccgacgccttcgcggtgcgcgtgccgcccggcaccaccgtcgacccacaggactgggcggacgcggtcttccggaatccgccgagagtcgtggcggcgctgctgcgtctgcggaaccggctggtcaccctggtcggcatcgcgccggacgacggttcggccttcgacacgctcacccgcaccgatcgggaggtgctgctcggcaccgacgccgaccacctcgccttccgcgccgcactccgggtcgaaccggacgccgacggcacgaccgtcacggtggccaccctggcggcgacccggtcccgcgccggacgcgcctatctcgccgtcgtccgccgggtgcacccgctggtggtccgcacgatgctgcggcacgcggcccgcaccgtcgccggcttcaccgcagccggcccgctgacgatcggcgacaccggccgatagcgtggccgatcatggcccacgcgctctccggtttcctgctgatcggcgtcatcgtgctggccgggtggggactgcgccggtggggccggctgccgccggacgccgaggcggtgctggcccgggtggtctggctggtgctcaacccgtgcctgctgttcaccggggtggccgcggccgacccggcggcgctgttcagcgagccgctgctggtgtcggccggggcggcggtggtgtgcttcgggctgttcgcgctgatctgtcgcggtcgttcgccggtggtgggcgcgctggccgccggttacgtgaacgccaacttcatcgggatcccgatcgccacctatgttctcggcgacgccgccctggccgtcccgatcatcatgctccagctgctggtcatcacgccggtcgcgctcaccctgctggagatcgccaccaccggccgggcatcgtggcggggcacggtgaccgcgccgctgcgcaacccgctgatcgtggccaccctgctcggcgccgcgaccggggcgaccggcctgcggctgcccgccgtgctcctggacccggtgaccacgatcggccatgccgccgtgccgatggtcctgatcgcgttcggcatgtcgctgtccggccgccggattctcgcgcccggcccggaccgccgggccacgctggtcgcggccgggctcaaaacggtggggatgccgctggccgcctgcgggctggcggccgggttgcggttgccgcacgaccaggcgtacgccgtcacggtgctggccgggctgccgaccgcgcagaacgtgtacctgtacggccagcggttcgccaccggcacggttctcgcccgggacgtcattctgctcaccaccctggcctgcgtgccggtcctgctgctggtgacattcctgttcgcccggtga

SEQ ID NO: 6651 - DNA, 624 bp, Actinoplanes utahensis
atgcgggagcaacaggagcggcgcggcaccggcaagcgggcggcgtcccggctgacagcggacgactggaccgccgcggccctggaggcgatggccgccggcggcctcggggcggtcgcggtggagccgttggccgcccggctgggcgccaccaaggggagtttctactggcatttcgccaatcgggaggcgctgatcgaggcggccgtgctgcgctgggaacgggagtacaccgagggcgtgatccggcacgtcgacgccgagcccgacccgctggcccggctccggctgctcatcggcctggtcctgggggccaccgcgccggaccggggcggcgccgtcgaactggcgatgctcgccaccgccgaccatccgcacctcgccccggtgctcgcccgggtcaccgagcggcgggtggcgtacacctcggcgttgttcaccgcgctcggctggccggtcgccgaggcgcgccggcgcggagtgctcgcggtcaccgcctatctcggctacgcccagatggcccacgtcgcgccggagtccctgccggccaccgagccggagcgactccgctacgtcgaccaggtcgtggacctgctcaccgcgcctagtagaccagtcgtctag

SEQ ID NO: 6652 - DNA, 693 bp, Actinoplanes utahensis
atgaacgttctggtagttctgacctcgcacgacgaactgggcgacaccggccgcaagaccggcttctggctggaggagctcgccgcgccgtactaccggctccagcaggccggtgccacgatcacgctggcgtcgccgaagggcgggcgcccgccgctggatcccaagagcgacgagccgggctcgcagaccgaggacacccgccggttcgcggcggacccggcggcgacggccgcgctggcctccaccgtgccgctgagcacggtcgatccggccgactacgacgcggtgttctacccgggcgggcacggcccgctgtgggacctggccgaggacagccactcccgacgcatcatcgagaccacgctgcgctccggcaggccggtcgccctggtctgccacgcgccgggcgtgctgcgccacgtcaccgacgaggcgggcgcgccgctcgtgcggggccgtcaggtgaccggcttcgccaacaccgaggaggccggcgtcggcctgaccgaggtcgtgccgttcctggtggaggacatgctcaaggccaacggcggcgtctactcccagggtccggactgggcctcccacgtggtgcgcgacggcctgctgatcaccggtcagaacccggcctcgtcggcggaggccgccgatgtgctgctcgcgctcctcgacgagcgcgccaccgcctga

SEQ ID NO: 6653 - DNA, 597 bp, Actinoplanes utahensis
gtggtgacgaccaggaatctccaccgcgacacgcgtacgcagctgctgctggctgccgagcggtcgttcgcccgcaagggctatgccgcggtcggcatcaacgaggtcctgtccagcgccggcgtgccgaagggctccttctaccactacttcgcctcgaaggacgcgttcggcgaggcggtgctcgcacgttacttcgagcagtacctggcggagatggacgagatcctgaacgccgccggtcgagacggggcttccaagatcctggcctacttcgcgtcctggcgggaatcgcagagtctcggtgactgtgcgggcaagtgcctggcggtcaagctcggcgccgaggtcgcggacatgtccgagcccatgcggctggccctgaaagccgggaccacggggatcgtcgaccggctcgaacacgcgatcgtcggcgccgtcgccgacggatccgcgccgttcaccggggatgcccgcgccaccgccgacgcgctctatcagctgtggctgggagccagcgtcatggccaaggtgaaccggagcccggccgccctggacaccgcgacgacggtgacccgccggctgctcggcatctga

SEQ ID NO: 6654 - DNA, 1224 bp, Actinoplanes utahensis
atgaggtggggcgagcaggccgtcaccaccgcttcatcgtcatgcacgccggccctcaccccgaggccatggccgactcgaccagggaagccgacggccgggtcacgactcgtcgagggaaccgagcatcgcggtgcggacggcgtcgccgtgccgatcgacccaggcgcccagggcgaggatcggaacgagcaggtcccggccggcctcggtcagtcggtactccacccggggcggtgcctgcgcgaaactgcgccgctccaccaggtccatctgctgcatccggcgcagggtctgggtgagcatcttctgactgatgccgccgatcacccgccgcagcgcgcccggccgcatcggaccgtcccgcagcgtgtagacgatgacggtcagccacgagttgccgaacaggtcgaccgccagccgcgccggacaatccgattcaaagtctccgtacgacgggaagaccgtccgttcgatgctcgtcgtcatgtcattgagcgtgccacctgcgaagcgcacctgggggtgcgcatcggcgtccctaccgtcggcaccgacacctacggtcaaggagcaagcatgcgaatcggcatcatcggcgcaggacagatggcgcgggcactcggcggcgggtgggccgcggctgggcacgagatcatgatcggcgcgcgatcgccgcagcgggccgacgaactggccacagcgatcgggtacggtgcccgcgccggcaccgtccgtgacgccgcgcggttcggggaggtcgtcctgctcgcggttccggtggccgcgctgtccgaggtgctcgcggaggcgggcgacggcgcgtggtccggccgtacgctgatcgattgcaccaatgcgttcaccccggacggtgcggcgggcgagacgctggtgctcgccgaggacgcggtggccgaacggatcgcggcggcggcacccggtacgcacgtggtgaaggccttcaatctgtgcgcggctgaggtgtggctctccgggcagcagccgatcgtcccgctgtgcggcgacgacgacgcggtgaagctggtcgggttgctggtcagtgacctggggtcgcagccggctccggccggtgggctgcaccgcgcccgatatctggaggcgacgtccgtcctggtggtcggcctctggttcgccggggtggacgcccggaaggcgtttccgccgctggaggcggccttcgcggtcccggacagcgcctga

SEQ ID NO: 6655 - DNA, 564 bp, Actinoplanes utahensis
atggcgatggtgagcgagctcgacttcaccgagctctaccaggcgcactacgtggacgtgctgcggttcgtccgacgccgggcgagcccggaggacgccgacgacatcgtcggcgaaaccttcctcaccgcgtggcgccggcgcgcggacctgccgcccgagccgcgcccgtggctgttccggaccgcccgcaacatcatgctcaacacccagcggggctcccggcggcagcaggcgatcagcatccgtatcgcccatgagccggcggaacctgtggccgacgccatggggccggtggagacccgggtcgacctcagcgccgcctggcgggagttgaccccccgtgaccaggagacgctggctctgcacatctgggaggcgctcagcgatcgggacgcggctgccgtcctcggctgtacgagagcgacgtacaccatgcgactgatgcgggcccggcgccggctggcccgcctactcggaccgggggccgtcgtctcgtccgccgccacccccgccccgcacccgacgtccacgctggcaccgaccggatgggagcactcgtga

SEQ ID NO: 6656 - DNA, 858 bp, Actinoplanes utahensis
atgggagcactcgtgaacaccgacaccatcgccctgctgaagtctcgcgacggtgctccggcccgcgccctcacccgggaggagaaggcccggcaggcgcatctgctgcaccgcatcctcacggatccggcgcccgttcgtccggcggctgcccggtcccgctcctgggcggcgttctggacgaccgccggcatcggggccgtggcgatggccgccgtcgccgtcgtcgtgaccgtcggcccaggggtgctgcggtctccggccgcaacggggctgaccacggtcgacgtggcgagctggaccagcacctcgatgcgcctgccgtccgcggcccaggaggtcgccgcgggtccacgggactggtgcatgaagaacacggtcggtgatccgaacagcacggcgacacgcaccgtggtcagtgctgagcttcgcggggtggtcggctccctcatcatgaagcagggcgacgactactcactgtgtatggcgggacgggaccgatcgggcttcgccgagctcctcgacgcacccacaccgctgctcgacgcagaggtccggccgatgaccggcggcggccacggcgacgggaagtccgccttctcctacgtggtcgggcgggccggtgatgcggtgacgagggtgaccttgaccgtgggcgcgaggacggtcgacgcccacatcgaagccggctggtggacggcgtggtggccgaaccccgaagccaccggcgaccggcccgagcccgaggtcaccgtcaccgtcaccgtcaccctccgcgacgggcgcagtcgcaccgctccgctgtcctacgatcagccctcggccggcccccagccgtccgccacggcgtcgcgctga

SEQ ID NO: 6657 - DNA, 807 bp, Actinoplanes utahensis
atgaccccccgcccggtccgcgtgctcaccggactcctgatcgccacggccgtcgccaccgtcgccgtcgagaccgtcaacttctcctccgccccggagcacggcgtcggattcgcggtccggaccggttgggccctggtccgcacgttgggctggctgatcctgatctcccaggtccgcaagggccgggccaccgccaggccgctgagcgtcatcctggccatgaccaccctgttcgcggtcggccggctgatcgtctcgccgtccgggctggtcggtttcggcgtgctcgccatgctctggctgaccgtggtcgcactgctgcaccgccaccggggcatcggcgcgcacctgacccacctgccgcgccggccggtcctgacccgggagggcctgagcctgcgcgaggccccgccgggcgacccgtgggtgctgaccgcccggctggccgcgttcagttacagcccgctgatgctggtgccggccctggtcgcggcgggcacgctggggcaccgtccggagtgggcgttcccggtcatcctgtggatcctggccgggatcgcggtcagctacgtcgccctgctgtccgccttcctcctcgcccggggcagcggccgggcccgccggaccctggtgtcggtcaccatcgcggtgctgctgttcgacctgccgctgtgccgcctcctgctgggcaccgacggactgatccgcgacggggcgccgctggtggcggcggccgccctcaccctgtacgccctgcgccgcgccgcggcgtcaccgcgcgtactcctcgacgaccactgttga

SEQ ID NO: 6658 - DNA, 789 bp, Actinoplanes utahensis
gtgagcgatcccgatgcgtattacctgccggccggtgacggcgagttcgacgccaccacggcgacgaccagtccgtgggacgacgcgatgcagcacggcggcccgccggccgggctgctggcccgcgccgtcgagctgacccggcccgatccggagatgccgatcgcccggctgaccgtcgacatgctcgggccgatcccgcgcgggcgggtgcgcaccgaggcgacgatcgtgcgcccggggcggcgggtggagatggtcgaggcgcggctctgggccggcggcagactcgcggtcaccgccacggcgtggcggatcaggacgcagaaggaccttacccggcggtacgccgtaccggtcgtaccgccgcctcttcccgccgcgcaggccgcggtcttcttccccggtgtggaccccgcgtggggttacggccgctcgatcgagtggcgtttcgtcgccggctcgttcgccgaacccggtccggtcgagttgtgggcgcgggtccggctgccgctggtggcgggggagacgccgtcgccggtgcagcgcctggccgtgctcgccgactcggcgaacggcatctccggggagctgccgctgaccggatggctgttcatcccgcccacgatgacgctgacgatcgcccgggtgccggagggcgactgggtgcatttcgcggcgcggaccacgatcggcccgtccggcaccgggatcgcccagggggtgctgtccgacccggacggattcgtcgcccaggtcggacaaccactgttgatcagcccgcgatga

SEQ ID NO: 6659 - DNA, 2049 bp, Actinoplanes utahensis
gtgcacccttggatccgacggcgtgttgccgcaagcgccgtactgctgacgatcgggctcgcgcccgccatcgcgccgacaccggccgccgcggcgaccgctgacacccacgtcgacgtcgacacccgggccggcctcgccaccgtggccggcaccgcggtcggcgtcaaccatgccgtctgggactcccagctcggcaccgacgcggtcgccgacctgctgcacgacgcgggtgtcgggatgctgcggtatcccggcggctcgtacgccgacatctaccactggaaggacaacacggcacccggcggctacgtcgcgcccggcaccgacttcgacaccttcatggcgggcgcccagcggaccggggcccaaccaatgatcatcgcgaactacggcaccgggaccgcgcaggaggcggccgactgggtccggtacgcgaacgtcaccaagggctaccacgccacctactggacgatcggcaacgagaactacggcaacgggcactacggctcggcgtgggaggcggacgaccacgccgacaagagcccgaaggagtacgccgacgccgtggtcgcctacgcccaggcgatgaaggccgtcgaccccaccgtcaaggtcggtgcggtgctgaccatgccggggaactggccggacgggatcgtcggggccggtgacagcggcacctggaaccaggaggtgctgacccgggccgggaccgccatcgacttcgtcgacgtgcactggtacccgggcgggaccaccccggccgaggcgctgggcaagccggcgcagatccaggacgcggtctacctgctgcgccggcagatcagccggtacgccggggcggacagctcccggatcgggatcagcatgaccgagaccaacgtcgacgccgggcgcaacacccagccgggggcgctgttcctggccgacgtctacagcgggctgctcgcccagggcgtcttcacggtggactggtggaacgtccacaacgggccggaccgggcgggcacgatcgccgggcagaccgacttcaacgacttcgggctgctctccagcggcacctgcacgccggacaacgcggcctgcgagccgccgctgaacacgccgttccccgcataccacgcgctgtcgctggtcggctcgctcgcgcacgccggtgaccgcttcgtcgggaccgccagcgacaacgcactggtcagcgcgcacgcggtgcaccgggccaacggcgacctggcggtcctgctgatcaacaaggacccggacgcggcgcacacggtggccctgaactaccagggcttcacgccgtccgcggcggtgccgacggtgtccacgtacgccaccggggcgacccgggtgaccagtggcgcggccgggacagcgggcacgcaggtgctcgcgccgtacaccgtcgatctggttgtcctgcatcccgaccgggtcgacccgaaggcgccgaaggcgcccggacaaccggccgcgaccgcgaccgaccgcaccgcgacgatctcctggccggccggcggcggcggcctgaagtacgaggtgtaccggcagaaccggggcgtcagtgcactgctgggcgagaccaccggcacctcgctcacggtgcacaacctggagcccgggcaccggtacacgatcaacgtgctggcacgcgacggcgccgggcggctctccccgccctcgccgccggtgaccgtcacgaccggcgcgcccaccgacgccgcgtgcacggtggcctaccgcgacaccaacgactggggcaacgggttcgtcgcttcgatcgacgtcaccaacaacggggccgggccggtcagcggctggacgctggccttcacctggccgaccgggtggcagagcgtgagcagcgggtggggtgccacctggaactcggacgggcggaccgtccgggtcaccagcgacgcgaccctgggcgccggggcgagcgggaacgtggggttcgtcggggcgtacagcgggccgaacgtgccgcccggggtgttcaccctgaacggcacggtctgcggagtgaccaccgcgggctga

SEQ ID NO: 6660 - DNA, 456 bp, Actinoplanes utahensis
gtgggcatgacgagcggtgagggccggggagcacaactgttgccggtgctcgggcagctggtgcggttcctgcggcagctggaggggccggacaatccgagttcgatcgcgctcgccgtgctgcgccgcctcgccgatcacgggccggggcgggtcaccgacctggcgcggctcacccgggcctcacagccgggcatgacccagctgatcgggcggatggagaaggccggacaggtgcgccgggtgcccgacccgcacgacgggcgcggcgtgctggtcgaggtgaccgacgccgggcgtgagctgctcagccgcacctacgcgtattacgccaccaccctggaccggctcttcgagcagctgaccccggaggagagtgacaccgtggtggcggcgctgccggccctggaacgcctggcccgggccggtgagcgggaaagcgccggcacccggtag

SEQ ID NO: 6661 - DNA, 1752 bp, Actinoplanes utahensis
gtgggcggccgccgcgggcgcccagccggccgggctggcctgccgggacacgctgcgcctggaggccggcatgccgctgtacggccacgagctgaccgtgcgcaccacgccgttcgacgcgggcctggggcgggtggtggcacgggacaagcgggatttcgtcggcggcgacgcgctgcgggccgcggagccggtgcgcgagctggtcggcctggtgacgaccggccgccgctcgccgcgcgcgggctatgcggtgatcgatgcggagaccggggcgaaggtcggcgaggtgaccagcggtgcgctgtccccgacgctcggccaccccatcgcgctcgcctatctccggaaaaatctggatcgggcccggctggcggtcgatgtacggggcacgccgatcccggcggagatcgtgaagctgccgttctaccggcgaaagaaggactgatggccgtctcggtgttcgacctgttctcgatcggcatcggcccgtccagctcgcacacggtcggcccgatgcgcgccgcccggatgttcctgggacacctcgacgaccgggtggcgaccgtgcgcgccgagctgttcggctcgctgggcgccaccgggcacgggcacggcaccccccgcgcggtgctgctcggcctgatgggcgaggacccggagacggtcgacaccacgctggagccgccggcctccctcaccatggacgaccgccgggtcgaggtcgacctggtcctgcaccggcggcggtcgctgcccgagcacccgaacgggatgacgttcaccgcgctcgacgcgagcggcgcggtgctgatcagcaagacctacttctcggtcggcggcgggttcgtcgtcgaccagggcacctcgcggctgcgcgccgacgagaccccgctgccgcacccgttcagctccggcgccgaactgctcgcgctcacccagcgcaccgggctgtccatctcccggctgatgctggccaacgagaccgcgtggcgccccgagtccgaggtgcggtccggcctgctcgccatctgggacgtgatgcgcgactgcgtcggcgccggcctggacgccgagggggtgctgcccggcgggctgaaggtgcgccgccgggccgccgccacggcccggcaactgcgggccgccggggatcccgcggtgcacgcgatggagtggctcaccgcgtacgccatggccgtcaatgagcagaacgcggccggtggccgcgtggtgaccgcgcccaccaacggcgccgcggggatcatcccggcggtgctgagctactacacggcgttcatcccgggcgccggcccggacggcatcgtccggttcctgctggcggccggcgcgatcggcctgctgttcaaggagaacgcgtcgatctccggcgccgaggtcggctgccagggcgaggtcggctcggcctgcgcgatggcggcggccggcctggccgaggtgctcggtggcaccccggagcaggtggagaacgccgccgagatcggcatggaacacaacctggggctgacctgcgacccggtcggcggcctggtgcagatcccgtgcatcgaacgcaacgggatggccgcggtcaaggcggtgaccgcggcccggatggcgctgcgcggcgacggtaggcaccatgtctccctcgacaaggtgatcaagacgatgaaggagaccggcgccgacatgaagatcaagtacaaggagaccagccgcggcggcctggccgtcaacgtcatcgagtgctga

SEQ ID NO: 6662 - DNA, 279 bp, Actinoplanes utahensis
gtgaccaccgcgacgatcggcgcctcggccgcctgcgacaagggcggaccgaaggtcgccgacaccggcgccggcccgaactggatctgcatgatgagcttcaccgacctgcacgggcagcatcaggacggcaagttcgaggtcaccgtgaagaccgacggcacctacgtggccggtggcccgtcgaagatcatcggactcgcgacggtcaccgacacgcagggacacgacgtgccgaaaccggtgttcgagttcgacggggtgctcagcactcgatga

SEQ ID NO: 6663 - DNA, 303 bp, Actinoplanes utahensis
gtgagcgggcgggacgtggcgccgatcgatggcggcgggctgccggtgcgcggtccgcaggagcgcatcgatgccctgatcgccgcggtcgtgggcgcgggatcgcgcggcgcggcccgacccaccggggagacgccgtccgttcaccgggccgctgaccgccgggctggcggtcagtgccgcccggaccctgatctgcctgaccgcggcgttcctgacgctgcgccgccgcgacatcaccggaggatgaccatgcgacccgccatcacccgcgccgccctggtgctcgccgtcccggcgtga

SEQ ID NO: 6664 - DNA, 2331 bp, Actinoplanes utahensis
atggacgaaacgccgaccgacctcgacgcactgcacgagatcgcccggcgcgtgctgtggctgtcggcgtcgatcgtcgacgccgccaacgccggccggcccaacgactccggggtcaaggtcggcggccaccaggcgtcgagcgcctcgatggtcgacatcatggtggccctgtggttcgccgagctgaccagccgggaccgggtgtcggtcaaaccgcacgcctcgccggtgctgcacgccgtcaactggctgctcggcgacctcgacgaggcgtacctgccgacgctgagggccaagggcggcctgcagtcgtatccgtcccgcctcaaggacccggacacggtcgacttctccaccgggtcggtgggcatcggggcgacggcggcgctctgggccgcgatggcgcatcggtacgtcgcctcgcagttccccggcacggcccccggtggacgcttcatcagcctgctcggcgacgccgaactggacgagggcgccatctgggaagcggtcatggacccggccgtggccaagatgggcgagttgctctgggtggtcgacctcaaccggcagtccctggaccgggtcgttccggacatccagatcaccaagttgcagggcatgttcgcggccgccgggtggcaggtcgtcatcctcaagtggggtcgcatcatctcccggctgttcgaccggcccggcggtcagtcgctgcgcgcccggctggaagcgatgcccaacgaggagtaccagcggatgctgcgggtcggccccgccgaggtggccgagcgcatcctggcgggcagctcatcgctggccgacggccacgagctcaaggcgctgctggacgagatcccgccggacgagctcgccgccgcggtccgcgacctcggcggccacgatctgggactgctcgtcgacaccttccacggcgtcgagacgcaccgccccaccgtcgtgttcgcctacaccgtcaagggccgcggcctgcccaccgaggggcaccccaacaaccactcggcgctgctcagcgccgcccagatggacgcgctggcgcaggcctgcggcatggaccgccgggcgccctggcagcgtttcggcccggacaccccggccggccggctgtgcgcggcccgcggccgggcgctgcgccgcgagcccgtcgcgccgacctcacccctgccggtgccggtccagctcgaccacggctaccgcaagccgatgagcacccaggcggctctcggccggttgctggccgacctgccgcgcgacgctcccgaggcggcggcccgggtggtcacctgctctcccgacgtggcgtcgtccaccaacctgggcggctggatcaacaagaccggcgtctggtcggtggaggaccggcacgactggttcgccgacgacgccgagcgggtcctgcgctggcgggaggacagcaacggtcagcacatcgaactgggcatcgccgaggtcaacctggtgtccctgctgggcgagctgggcaccacctggtcccgctggggtgagcggctgatcccgatcgccacgctgtatgaccccttcgtgtcgcgcgccctggagccgtggtcctacggcatctacgccgggggtcagtccatcctcgtgggcaccccgtccggcgtgacgctcgcgcccgagggcggcgcccaccagtcgatcaccaccccgtcgatcgggctggagcagcccggctgcgtcgcgtgggagccggcgttcgcgcaggacctgcagtggtgcttcctgcacgcgatgagccgggtcggcgtcgagggcggcacctcggcgtacttccggctgtccacccggcccatcgatcccgggctggcccgcgtcccggaggaccccaccctccgggagcgccgtcgccggcagagcgtcgccggcggctaccggttgccggccgatcacccgatcggcgacgaggaggtgacgctggtcggggtcggcgccatcatgcccgaggtcgtcgcggccgccgacgctctggccgcgcacggcgtcaaggccggggtcgtctgcctgaccagcccggatctggtcttccgctcgttccagcagcgcggcagccgcgctgccggcgtgggcggcggcatcctggacgagctgttccccgccgagcaccccacgcccctggtcaccgtgcaggacggccatccgcacacactggccttcctcggcgcggcgcgcggggaccggatgcgttgcctcggggtgaccgagttcggccagtcctccggcctggcggacgcctaccgcctgcacggtatcgacaccggcagcatcgtcgacgcggcgctgaccctgacccggcactga

SEQ ID NO: 6665 - DNA, 1932 bp, Actinoplanes utahensis
gtgcggggtggggtgttcaggcagcgacgggagttggggaccgtgttccggggcgaccaggtgccgaagcgcgtcagggtgtgcgacgcgggcgatggtgggttcaccatgctcgagatgatcgtgtccgccgcggtcgtgtgcgtcgtgctgatggggttgagcaccttcttcgtgcaggccatgtcgacctcgcacgggcagggtcagcaacagggcggcatccggctcgccgcggatgccatggacaccctccgggcgccgcaggtgacggccctgctgtccgagcgtgcgccgtgcgccacggcatgcccggcgccggtggccaaggcggtgccgctgctggccgacaccgagcggtgggacgccgcggcggtgccgacggcggtcaccaccgcgccgtccacggccaccggcggcatcgccttcccggtgccgccgagctcgtcgggcatcgcggtcaacggggtgacgtaccagcgctatctctacctcggcaagtgctgggagcagaccggcgggagtccctgcaccgccgacaacacccagccgatcgccatggtgcgcgcggtcgtcggggtggcctggccgtcgcccgcctgcggcggcgacacctgctcgttcgccacgtccacgctcttcggtgccggtgggtcgggcgacccggtgttcggctccggcgcggtggccgtgaccgccgtgcccgaccaggtcagcacgctcgggtcggcgatcgcggcgctcccgctgtcggccaccggcggcagccggccgtacacctggtcggtcaccggtctgccgaacggtctgaccttcgacccgaccacgacctcggtgaccgggacgcccacgagcgccggcacctcgacggtgacggtgaccgtcatcgacgcccgcggcaagaccgcccggatcaccttccggtgggcggtcgtcaccaagatcacgcttgccaagatcgctgaccagggcaccacgcagggtcgcagcgtcacgctctcaccgtccgcggccggcggcaccactccgtacacgtggtcggcgaccggtctgccgaacggcctgtccatcgacagcgccacgggggtgatcacgggtacgccggacaccctcggcgcctcgaacgtcaccgtcaccgtgaccgacgcccgcaagcagaacgccaaggtgtcgttcgtgtggacgatctactcggcgccgaagctggccattccccccaagcaggacacctacatcgacaccgccgcggtcccgctgcagatggtcgccaccgacggtgtcggcccctacacctggacggccacgagtctgcgcgccggcatgtcgatcgggtcgagcagcggcctgatcaccgggacgcccgccgccctgggtaccgcccacgtcgtggtgaccgtcaccgacagccgcggcgagagcgcctcggtgaccttcgactggtccatcgacaaggctcagcagctgaacgacagcaccaccacccagctgatcgtggccaacccctcgctgtacacctggggtgccgtcaacctgccgccggggctctcgatcaactcggcgaccggactcgtgagcggcacgccgaccacggccggcacctgggacatccagatcctgctcaccgatgccagcggcaccgtgaagaagatccccttcaagtggacgatctacgcaccgctgaccatcacgtcgccgggcgcgcagtccagtcagaagggcaaggcgatcacggcgctgcagctgacccagacgggcggcgtcggaccgttcacgtggacggcctccgggctgccggccggcctcgcgctggacgcgaacaccggtgtgatcaccggcaagccgatgaccgtcgccacctcgaccgtgtccatcaccgtgaccgacttcgccggcaaccggaagacgatcgcctttacctggcaggtgagctga

SEQ ID NO: 6666 - DNA, 678 bp, Actinoplanes utahensis
atgaggaaccggaccccgatccgggcacgccgcgccctgccgggcggggacgccggggtcacgatgatcgacctgatggtcgccatggcgctgatgtcgatcatcggggccatcgcgaccggcggcctggcgcagctgtaccggatgaccgacgccaccgaccggatggacgaggcccagacacaggcgagcctggcatacgccggcctgcaaccggagatcggcgtcgcctacgacatcagtgacccgggcgccggagccggcggcgatccctccgtcgagtacgtcacccaggattccagcggtcagcgggtctgccaccagcttcgcctctccggcggaacgctgaagctgcgccagtggcccgcgtcggccacgaccgtgtccgcggccggctggcgggtcctcgcgtccgggctggcggctcccgccacgccggacgccgacaccggcgcggcggccgcgccgcagaccctgcacttccccgacttctcgacaccgtcgctgacgaacctgccgagcgccacgccgctgcaactgcggatccggctcaccgcgacggccagcggggggaagggctcgacccagcgcgacacccagaccaccgtcgtcgcggccaacagcaccgtcggctggcacgacccggtcgcctgctcgctaggaaggaacacgccgtga

SEQ ID NO: 6667 - DNA, 1545 bp, Actinoplanes utahensis
gtgagcgctccccgacacccgcgtccgctgcccgcggccggcgaccgcgggtcgatgcccatcgccctgctggtcaccatggtggcgacgagcctcagcgtggtcctgagctccctggtgatcgcgcagatcggtaccacgcgcttcgaccagcggcgggtcagcggactgcagtccgcgcgcgcgggcctgcaggctgccgtggccacgatccaggcgtccacgtcgggtggcgtgtcgaccgtgaccctgtccacggcggccggcaacccgcagggtgatcgcaccaagctgccctgcgccccgatgaccgacgcctcgtccgcgggcccggccacctatgcggtcagcttcgactactacacgaccgacccgcagtacggcggcagcccgctggccccgtgccagaccggacaggggcccggcaaccaggccgcctacgtacggttgacgtcgaccgggttggacctcgcgggcaaggtcagcgtgacgttgacggccacgtaccccctgctgtccggtgaccagaacctggccggcgacaccgtccggctcgccgggaccaacctgtgcctggacgcgggcgacacgcccgtcgcgggcgggcaactggcgctgcgcacctgcgccgccagcacccggcccaagagccagctgttcgcctacggctccaacctgcaggtcagattggtgtcgtcgagcccgcccgacggactgtgcgtggacgcccagcagaccagcgggtcctccctggccctcgccgcgtgtggcaccaccaccgtccccgccactcagcagtggatctccgcgagtcccgggccgtccggtggcggtacctgggcctcctcggcccggaccctctgctggcgggccgcgggtcccgtggcgggcctgtcggtcaacctcgacgccgactgcagcaccgcgtccaccttcgtctcgcggggctcggccggtgcgggcgcggccgtgctggccgaccggaaccagtgggtggactacgccgagttcagccggtgcatggatgtcggcggacagaaggtcgccgacgcccggctgatcacctatccctgcggtcagagcccgagcctgacgagcgccgactggagccagcagtgggtgccggtggacgccaccagcggtcaggccgcggtgctcgccaacggggtcgccggcgtggcggacgtcctgttcacggtgaccgacaacgacgcaagcccgaccaacccggacggcaggtactgcctgtggagccccggaaccgccgggcagaaggtgcaggcgaaggcctgctccacgacaacggccggataccggtggacgatcacccggaacaccggcctgcccacgaccagctaccgggtccaggacgaccatgccctgtgcctgaccgcggtcggacaggacgtcctcgtggacccgggcgccccggcgaacacgagcattctccggacgatgccgtgcgacggctccgaccagcagaaatggaacgccccgtcgaccgcgcagaacgcgtcaccgctgctgaacgtgacgcagcggtag

SEQ ID NO: 6668 - DNA, 174 bp, Actinoplanes utahensis
atgggcgccgccgaactgggccgcgaactgggcgacgcgggcggaccgctgctggtcggcgcgatcgccacggcgaccacgctgaacgggggattcgccgtgctcgcggtgctggtgggtgcactcgccgccatcctgccggcactaccgctgcgtcacgttcagcagcggtga

SEQ ID NO: 6669 - DNA, 798 bp, Actinoplanes utahensis
atgtggccactctacgcggccgggttcaccaccgcgttcggagcgcacgcgatcgccgcgaacctgggcggggcgcaggtttcgctgctgacgctcggtggcctgctggccctctacgacggcgccgagatcgtcctcaagccggtgttcggcagtctcgccgaccggatcgggccgcggccggtgctgctcggcggcctggtcgcgttcgcgctcgcctccgcggtctacgtggcggcggacagccccggctggctgtgggccgctcggctcgggcagggcgcggccgcctcggcgttctccccggccgcgtcggccctcgtggcccggctgaatcccggcgccaagcacgggcgggcgttcgggtcgtacggcttctacaagtcgatcggctacaccctcggcccgctgctcggcggcgtgatcgtctgggccggcgggctgcggtcgctgttcgtcgtgctggccgggctcggcgcggcggtcgccgtctgggcgctgctggccgtcccgcacctggcgccgctgccgaagacccggcagaccctgctcgatctggcccgccggctgacctcggcgaccttcctgcggcccacctcggcgctggccgccgcgaccgcggccctgtcggtcggcgtcggcttcctgccggtcaccgggcgggccgccgggctcagcccgatcgccaccggcgcggccgtgtcggtgctggcgctgtgcgcggcgctggtccagccgcgggccgggcgggcgctcgacgacgggcggttgagcctgcgcaccgggctgaccgcctag

SEQ ID NO: 6670 - DNA, 336 bp, Actinoplanes utahensis
atgcgggtcctggtggtggaggatgagcgtcggctcgccgagctggtggcgcgcgggctgcgcgaggccgggcgttgcgccggccgggcccgacgcagcgtaaccgcccgcgccgcagccggccgggggatgccagcccggcacaccgccgaggtgcggcacaccggcgacgacgagctgctggccctgcaccggcattcccacgagtcggccgtggctgtgctgcaggccggtgacctgcggctcgaccccggcgcccggcgggtgttccgggacggcgcggagatcgagctgtccgcccgcgagttcgacatcctggccctgctcatcatctga

SEQ ID NO: 6671 - DNA, 321 bp, Actinoplanes utahensis
ttgcatactaaagaaagtgactatcaccggtccggtccgggagtgtccagcggcaccaccggccccgcaaccaggcccggctgcatcgccgggcggatgccggcagcggtgaacagccggtccgcggccacccgtggccggtccgccggcagtgcggccaagtggtggccgcggcgcgcagggggccgccgcgggccgggcaggccgggcaccacccggttgccggcgtcgagcagctggaaggtggtgcccgggctgaccggcggcggcccgccccgcccgaccgcggtggtgagctgctcggcctgggcgctcagatga

SEQ ID NO: 6672 - DNA, 192 bp, Actinoplanes utahensis
gtggtgcccggcctgcccggcccgcggcggccccctgcgcgccgcggccaccacttggccgcactgccggcggaccggccacgggtggccgcggaccggctgttcaccgctgccggcatccgcccggcgatgcagccgggcctggttgcggggccggtggtgccgctggacactcccggaccggaccggtga

SEQ ID NO: 6673 - DNA, 2004 bp, Actinoplanes utahensis
atgagccgctatccgacgctgctgagcccgctcgacctcggccacaccgtgttgcgcaaccgggtggtgatgggctcgatgcacaccaagctcgaggaccgcgagcaggacctgccgaaactcgccgcctacttcgccgagcgggccaagggcggggtgggcctgatggtgaccggcgggtacgcgccgacctggcggggctggctggcgccgttcggcagcaagatgaccagcggacggcacgccgacaagcaccgcgtggtcaccgacgcggtgcacgagcacgacgggaagatcctgctgcaggtcctgcacgcgggccggtactcgtaccatccgttcagcctcggcgcgtcggcgaagaagtcgccgatcaccccgttccggccgcgggccatgtcggcgcggcaggtcgacgcgacggcgaccgcgttcgcccgggccgcgcggctggcccgccgtgccgggtacgacggcgtcgagatcatgggttccgagggctacctgatcaaccagttcctggccgcccggaccaacgaccgcaccgacgcctggggcggctcggccgcgaagcggatgcgcttcccgctggagatcgtccggcggacccgcgagctggccggcgacgacttcatcgtgcagtaccggatcagcctgctggacctggtcgacgacgcccagtcctgggaggagacggtcgagctcgcccgcggcctgcaggaggccggggtgtcgctgttcaacaccgggatcggctggcacgaggcgcgggtgccgacgatcgtcacctcggtgccggccggcgccttcacctgggtgacccgcaagctgcgcgacgaggtgacgatcccggtcatcgcctccaaccggatcaaccggccggaggctgccgagcagatcctcgcggccggagacgccgacctggtgtcgatggcccggccgctgctggccgacgcggactgggtggtcaaggccgagcagggccgggaacgcgagatcatcacgtgcatagcgtgcaaccaggcctgcctggaccacaccttcaagaacacccgggcgtcctgcatgctgaacccgcgggccgggcacgagaccgaactcgtgctgctgccgacccgtaccgtcaagcgttgtgcggtcgtcggagccgggccggcggggctggcggcggcggtcgagctggccgggcgcggacacagcgtggagctgttcgaggcgggcgagtcgatcggcgggcagttccggctcgcggcgcgcattccgggcaaggaggagttcgcgcggaccctcgactactaccggcacatgatcgacgttcgcggggtgaagctgcacctcggggtgcgggccaccgtgacggacctggccggcttcgacgaggtggtgctcgccaccggcgtgacaccgaggatcccgcagattgccggcatcgaccacccgtcggtcctgacctaccagcagctggtggagggtgcgccggccggggagcgggtggcgatcatcggcgccggcggcatcggcttcgacatcggcgagttcctgctgcacgaccagaacgagccgctcgacgactggatgcggcgctggggcgtcaccgacccggcggcggagcgcggcgggctgaccaccgccgtcaagccctccgtccggcgcaaggtctacctgctgcagcgcaaggagaccgcgctcggcaagggcctgggcaagacgaccggctgggtgcaccgggcgacgctgcagcagtccggcgtgaccatgctgcgcggggtgtcctaccagaagatcgacgacgccgggctgcacctcaccgtcggcgagaaggcccaggtcctcgcggtggacacggtcgtgctgtgcgccggtcaggactcggtccgcgatctcgtcgcgccgctcaccgaccgcggcgtgacggtccacgtgatcggcggcgcggacgtcgcggccgagctcgacgccaagcgggccatcaaacaggccaccgagctcgccgcttcggtctga

SEQ ID NO: 6674 - DNA, 813 bp, Actinoplanes utahensis
atgggatacgtcagcctcaccatcgacaacggcatcgcccaggtacgtctcaaccggccggagaagttgaacgccctggtcctggacaccctgcacgagctgatcgcggttgcccgccggttgcgccgcgaccgctcggtccgcgccgtcgtgatcgccggggagggcccgtcgttcagtgccggcctcgacatcgccggcaccctgaaatccccggcccgggtcgtgcgtgccttcgtcccggtcccctggcgcggcaccaacctgttccaggaggcctgctgggcgtggcggcggatcccggtcccggtgatcgccgcggtccacgggcactgctacggcggcggcatccagatcgcgctcgccgccgacctgcgcttcgccaccccggactcgcagtggtcggtcctggagggcaagtggggcatcatccccgacatgtccggcatccgcagcctcaccgaggtggtcggcctggacgtcgccaagcggctcaccatgaccgccgagcggttcagcggcgcccgggcggccgagctgggcatcgtcaccgagctcgccgacgatccggtgaaggcggccaccgcgttcgccgaaagcctgctggccaagtcaccggacgcgatcgccgccgcgaaacgcctgctcaacggagcggtgacgagcagcgcccggcgcaccttcgcccgtgaacgctgggagcagatccggctgctgcggctgcccaacaccgcgatcctgcgccgcgccgtgctcgccaaggccaccccggagttccggccccgggcccgtaggatgcgtccgtggcactga

SEQ ID NO: 6675 - DNA, 555 bp, Actinoplanes utahensis
gtggcactgaggaacgccgttctcgcggcgctgatcgaccgcgagtcctctgggtacgacctggccaaacgcttccgggtctcggtcgccaacttctggaccgccacgccgcagcagctctaccgggaactcgaccggatggagtccgaggggctgctcgcggcgcggctggtcaagcaggacaggcggcccgacaagcggatcttctcggtcaccgaggcgggccgggccgcgctgctcgacttcacccggcaggagccgaaaccgaccacggtccgcgacgagctgctggtccaggtggaggcgctggcctgggccgacccggccagcgtccggtcctcgatcgaggcgcggatcgagcagagtcgccggcggctgaccgcgtacgagcagatggtggtggagatcctgggaagccggagccacgcggagttcctcgccaccggaaaccggatcggcccctacctgacgctccagcggggcatcagcttcgagcgggagaacatcacctggggtgagctcgccctccaggtgcttcagtccaggtcgatgtag

SEQ ID NO: 6676 - DNA, 1512 bp, Actinoplanes utahensis
atggccaccaagaagcacgcgcgccgggccgctctcaccgtcgccgccgccaccgccaccgctgtcagcctcgcctacccgatcgccgccggcgcggcgccgggtgtcccggtcagcgttctggccgacaccccggggaccgcgaagccggtgaccaaggcgccgaccgcgaccgcggtcaccccgccgagcggcaccaccgcgggcggcaccacggtcacggtcaccggttccgggttctcgtcgctggacctgacgaacccggccgcggtgaagttcggtgacctcaacgcggcctcgttcgccgtcgtgtcggacacccggctgaccgcggtcaccccggccgggacgaacggcgcggtcaaggtgaccgtcaccaacacggtgggcagcagcagcgggacggtgagcttcgggttccgggcgccgctgggtgcccggttcgaggcggtgaccggggcgaagggcggcaccgtcgtcccggtcaccgtgaccggcggcaccgtgggcgccaccgccgcggccttcaccaccgagaaggtgaccgcgaaggtcggggacgccaccgcgacggtggcctggaccgacgaggcgcacgtcaaggtgaccgtgccggccggcacgaagttcggcgcgatgaagctgacgctgacccacgacggggtggccggcaccccgtccgagtcgacgatccgctacgcgccgctgctgagcggggtgttgccggccaaggtgtccaccgcgggcggcgagacggtgacgatcaccgggaacggcttcaccgacgtggccagcgacgacccggcatcggtcaccttcggcggcaggaacgcgaccagcttcacggtcaagtcggccacccagatcaccgcggtggtgccggagggcgcgaacggggcggccccggtcgtggtgaagagcgcgggtggctcggtgagcgggaccgtcacgtaccgcacgcctctgggcctggaagttcccgccggcgcggtggcgaaggcctccggcggcacggtcacgctgacggtgaccggcgggacggtcggcgcgaccccgaaggagttcggcacgcaggcgatcagcgccacggtcggcacctcgaaggtcgtcccggtctgggtggacgccacccacgtgaaggtgccgatgccggcctcggccgcggcgacggccccggtgaccctgctgcacgacggggtgccgggcaagccggtgacggtgagttacgccccggtcgtggtgaacctgtcggcgaccaccgacacgctggccggcggcaccaaggtcaccgtgaagatcgccggcggggagctgggcggcgcgaccggcttcacgttcggcggtaaggaggcgtcctgcaccaggcagggcaccggcaccttcgtcacctacctgtgcgtgacgccgccggcgaccacggccggcccggtctgggtgtcgttcaccgccagcaccggcaccgccagccggttcaccccggccgccgtcttcaactacatcgacctggactga

SEQ ID NO: 6677 - DNA, 993 bp, Actinoplanes utahensis
gtgatcgtcgaggtccgggaaggcctcgggcacctggtcctgaatcggccgcgggcgatcaacgcgctcaccgccggcatggtggcgatcatgcgccgggctctggccgggtgggcggcgtcggacaccgtgcgggccgtgctgatcacgggagcgggtgagcgcgggctctgcgccggcggtgacatccgggcgatccacgcggacgcggtgtccgggggcagcgggtcgatccggttctgggctgacgagtacgagttgaacgcgacgatcgcggagtatccgaagccggtcgtggcgctgatggacggtctcgtgatgggtggcgggatcggtgtctcggcgcacgcgtcggtgcgggtggtgacggagcggtcccggctggcgatgcccgaggtgggcatcggcatgcacccggacgtcggcggctcctggctgctctcccgggcgcccggcgagctgggcacgcatctggcgctgaccggctccgcggtgggggcggcggacgggatcgcggccgggctcgccgacttcttcgtcccgtccgagcgcctgcccgcgctggtcgcggcgctggaacaggggcagggggtgcgggccttcacggccgagccgccgccgggtgagttcgccacggcccgggagtggatcgacgtctgctaccggggggactcggtgatcgagatcgtggaccggctggcccggcacccggccccgggcgcgcaggcggccgccaaggagatcggcacccgctcccccaccgccctgacgatcaccctgcgttcgctgcggacggcagcgcgcctgcccgatctgcgcgccgcgctggggcaggagctgcggctgtcggcggccatgctgcggctgccggacctggcggaggggatccgggcgcagatcatcgacaaggaccgcaatccgcgctggcggccgtcgtccctcgccgaggtgcggccggagaccgtcgacgaggtgttcgaagcaacccgttag

SEQ ID NO: 6678 - DNA, 579 bp, Actinoplanes utahensis
gtgtcggtaacagaacgcaagcagcgggaacgggccgtccgcgagcgcctcatcgtggcgaccgcccgggagctcgccgagcagatgggctgggaggcggtcaccacccgccggctcgccgagcgcatcgagtacagccagcccgtcctctacagccacttccgcggcaaacgggagatcatcggcgcggtcgccctgcagggcgccaccgagatggccgcccatgtccgggccgcgacggacgcgacggacgacccgcgagcccgggtcaccgccctggcccgcgcctacctcgacttcgccgcgcgccatccggcggtctacgacgcgctgttcctcctggacggcggcctggcgtatgggcgccaggacaccccggcgccgctcagggacgccttcgccgcgctgcgggaaaccctgggtgaggtcgccggggacggggtcgacaagggcctgttcaccgaggtcttctggtcgtcgctgcacggcctggccaccctgacccgcaccggccggttgttgcccgcgttcgccgaggcgagagtggaactgctggtcgaccggctcgccgtgctctga

SEQ ID NO: 6679 - DNA, 447 bp, Actinoplanes utahensis
atgctcaacgctctggaagtcatcaccaccgtggtcgtcggcctgatggtgggggtcgagttctccgtcgccttcgtcatgaacccgatcctggacgccctccccgaggacagcggccagctcggccacgcacacggcggccggatgctcggtcggctgatgccgttctggtacatcggctcggtcgtgctgatcgcgatctgggcggtggccggccggcggcacgacggtgacgggctcgtcgtcaccgccgccgggctgctgatcgtcagcgtgctcatgtcggtgctgctcctggtcccgatcaacaaccgcaaccggacctggacgccggagacccggccggccgactggaagcagcagctgaaccggtggctgcgctaccactacggccggctcgccgtcatcctcgccgccttcacggtgctggtcaccgccctggtctga

SEQ ID NO: 6680 - DNA, 1287 bp, Actinoplanes utahensis
atgaacgactgggtcgagcacgtgatctggtggcacgcgcatcccctcacgttcctgggggctgagcgggcggcgctgccaccggatgccgcgccggtgccgcggctgcggcgtttcgcgccgtggctggactatctggtggagctgggctgcaacggtctggcgttggggccggtcttcgcggcggagacgcacggctacgacacggtcgaccactaccgggtcgatccgcggttgggcaccacggacgatctgcggtggctgctcgacgagtgtcgtcggcgcgggatccgggtgctgttcgacggcgtgttcaatcacgtggggcgcggtttcggcccgttccgggacgtgctcgaccgggggcgcgattcggcgtacgccaactggtttcgtctttcctacaacgacgacggcgggttcgaccatgccgatttcgagggtcaccaccatctggtcgccctcaatcacgatgagccggccgtcgtcgactacgtcgccggggtgatgcggcactggcgggagttcggcgcggacggctggcgtctcgacgcggcctatgcggtgccgctgccgttctggcgggcgaccgccgggagcatcgacggcggctggttcgtgggtgaggtgatccacggcgactatccggctttcgtgcgtgacggcggcctcgattccgtgacgcagtacgagctgtggaaggcgatccggtccagtctgaacgacctgaacttcttcgagttggcctgggcgttggagcggcacgacgcgttcggcgccgatttccccccgctgaccttcgtcggcaatcacgacgtcacccggatcgccagcgccctgaccgagccgcgccatctcggcctggccctggccgtcctgttcaccgtcggcggcgtgcccagcgtctacgccggcgacgagcaggccttcaccggcgtcaaacgcgacatcgagttcggcgacgacgagatccgcccggccttccccgcgaccccggcggatctggccccgttcggcgagcccaccttccacctgcaccagcagctgatcagcctgcgccgccgattcccgtggctgcaccgcgccaccacgaaacctttgcacctcaccaacaaacaactggcgtacgaggtgtccgccggccccgaccgcctcatcgtgctgctgaacgccgccgaccacggccacgacttccccttggacctcggccccgcccgcgtcgtcgagtcctccggcggcaccggcaccctcgtccccggccccggctggtcgatcctgcggggctga

SEQ ID NO: 6681 - DNA, 1212 bp, Actinoplanes utahensis
atgcgtgtggtgttgagcacctggggttcgcggggcgatgtcgaaccactggccgcgctggcgttccagttgcgggcacagggggccgaggtgcaggtctgcgcgccgccggatgaggagttcacgacgctgctgaacggggtgggcgccgagcacgtgccgctggggccggcggtgggttcggtggtggccggcagccggccgccgtcggcgcaggacgcgttccggctggcggcggatctggtcgcggcccggttcgagacgctgggccgggtggcgaagggggccgaggcgctgctggcgaccgggttgatgccgtccggtgtccgctcggtcgccgaccacctgggcgtccggtatgcgatggcctgcttccacgtgtacgggctgccgtcgcggcaccgccggccgggcacccggcccggggtgcagtcggcggcgcaggagaccgatccgcgggtgctgtggaaggaggacgcggaccggatcaacgccctgtacgcggagccggagaaccggcaccgggcggcgctcgggatgccgccggtcgaggacatccggtcgtacgtcttcaccgaccggccgttgctggccgccgacccggtgctgtgcccgtgggcggacaccaccgacctggacgtggtgcagaccggcgcgtggatccggccggacgaccgtccgctgccggccgagctgaccgcgttcctggatgccggcgagccgccggtgtacgtgggtttcggcagcatcgcctcgtacctgccggccgacatcggccgggtcgccgtcgaggcgatccgcgcgcggggccgccgggtgctgatcaaccggggctgggccggcctgtccgcgctcgacgacggcgccgactgcctggtggtgggcgaggtgaaccagcaggcgctgttcccccgggtggccgcgatcgtgcaccacggcggggccgggacgacgaccgcggcgagccggtcggggacgccgcaggtggtggtgccgcagatcgccgaccagacgatgtcggcggagcggatcgccgagctcggcatcggggtggcacacgagggccgctcccccacggtcgggtcgctgtccgcggcgctggccacggcactgggtgcggatgtccgggcacgggccgccgaggtgggcggcacgatccgcaccgacggcgcggcggtcgccgcggggatgctgctgagcggcgagttctga

SEQ ID NO: 6682 - DNA, 420 bp, Actinoplanes utahensis
gtggagcgcggcgaggtctggtgggctgagatcgacgggaaacagcccgtcgtgctgctttcgggcggccccgggccggcgttcgcggcggtgcaggtcgtcgaaccggccacgccggcgcagaagatcgggttcgtcctgttgtccggcgcgcaagcggtcgacgccgacgagcggtgccggatcctcgcggctgccggaccggatacgcgggccggcggcatcgaggtcttcctcggagccgaggagggcctgccacgcagcggtgtggtccggctggccctgccccgggaggggaaggtcttctgcacctgggaggcgaccgtcagcgtcgactcgctggtggagaggatcggcacgctgtccccggccaagctgcgggaactggacaccgccctggcgctcgccggccaccggtga

SEQ ID NO: 6683 - DNA, 1530 bp, Actinoplanes utahensis
gtggactggccgccgtcgccgtcaccgcttcgtcccgccgtgccggccccggggccggcacggccacggtggccgctgtcgccgtcagcaccggcgctccggtccggccggccctctgcgacgccgcgcggcccgccccgcgcgacccgttcccgttcaacccggacgccgccggccgtgaccggctgctccccttcgtcgacctgctcggcaacggcgccaccttcaccggcggcgccgggtacttcgggccgctggacgccgccgggctggccgcgctcctcgacgggaagtggctggacccggacgaccggcagaacgccgccccgtcggcctgggacatcttccggttcgtctgcgaccacccgggcacccacgcgcagggttacgcggtcagcccggaccgggacgactaccgggtgtccctggagaccgtctgggcgccgcggatcgacgacgcgctgcgcgccgacgcgaccaggttctgcgccgacgcggacgccatcgagacctccgaccacctggagtgcttctgggactgatcggcggccggccccttcgggcgatatctgccgggacgaacaggacggcaacctctacagtgcgtcgatggtgacgaagctcgatctcgtgtgtgccgccctcgacgcgctcttcgaccttgacacggcggcccccgacgcggcgatgagccggcatgtcccgcgggtgtacgacgaggccggagtcgactggcgggcgttcgtcgagccgcgtttcgcgcaacgattcaacgggttgatgcaccgcgggcatccctcggtgggtgccgtccacggcgcctgcctgccgtcggcgcaggtgctggacgactggctctccgtcgcgcggaccggtgacttgttgatcactcaccatcccatcgacatacggaacggctcgcccgaacacgacacctgggcggagggtttcgtgccgatcgccgacgcgcaccggctggccatcgtcgagcgtcaactgtcgatgtactcctgccacgcgccgatggacacctcggtgcgggtcggtaccgccgcggcgatcgtggagggcctgggcggcaccgcggtggactatttctggccgtacgacgagggttacgcagggcatgtcgcggacatcgcgcccacgacgaccgacctgctcgtgcgccgtgcccgcgaactgttcggcctggacctcgtcgaagtggaaggccggtcacgcgacgacatcacccgcatcgccgtcgtcggtggcgtcggcgaccacgtcgatcagatggccgaggcggagaggctcggtgctcaggcctacctgaccggcgagctgcatgtgcgcatcgagggtgactacggccgccgcaagttcgccgacgtgcagaacttcgccgccacgaccggcatgaccttgatcggggtgtcccacgcggccagcgaacacctcgtcatggagacccagctggctcgctggttcacggggacgctgggcctcaccctgcacccgatccgcgaaaccgactggtggcggtag

SEQ ID NO: 6684 - DNA, 786 bp, Actinoplanes utahensis
gtggatctgggacggcggcgggaccgcgacgactatgcgcggcggatggcgtacgcgtcgcccggtggcatgatcgcccgggcgaccgcggcgcggctggccggtgactggcgggccgcgtgcgccgcggcgatggtcgacgtgcgcttcgagccggccgcggtgcgggaccggttcggtgccgcagcgaccgcggcgatcgaggacgatctcgccggactggcccctgacctgctgcgtcgccacctgccggtggacacctgggggcggtggccgtcccgggcccgggtggtgctgtcgagccgtccggagccgttccgcgagcgccgctttctcgcccgccggcgtccgcgggttccggtgctggtcgcgacgctcccgcgggacgggctggtcgcccggcgggtcaccctcgaggtggtcgacgtccacgagctgtccggggtctgggtggatctgccggcctgggcctggcacgcggacgcgatcgaggggcgccgctgggcctacggggcctcggcggcacgtctgccctggcacttcgcggacggcacggcgtacccgcagggaaccgtgaccgacgggaccgatcgcgccggcgagttcgagcgccttctcggcccgatagatcaggatcgcaggacggagtggtacgccgcggccggcatcgccgtgcccgatccgcaccgcgacgcctggatcgtgcagcggctcgccggtctgcaggatcggctgccggtcgccgcggccgaggcccgccggctgatcgaacggctagctagctag

SEQ ID NO: 6685 - DNA, 594 bp, Actinoplanes utahensis
atgatcggcccggatcagctgcatccgctcgtgcacgaggcgctgttcccgggccgggtccagcactggcagccgatcgagcaccggccacgccggacgttccgggtgctgtgcggcggccggtggcatccggtcgaggcggccggggcgagcctgcgcatcctgcaccccgaccatccggtgacaccgaacgggtgcacggccgcggtcgaccggttccgcaccgccggcgccggcaccccgaagaaggtgcgccggctgcgccagcgggtgttcgagcggatcgtgcacggggacaccgacgcggtgctggccgatctggcggccggctgtgatccgttgctgcgcgaccagcacggccggacgctgctgcactacatcgcgaacgtcgagcatgagcgggtgctgccggtgctgctggccgccggcctgtcgctcgccgaccgggactacgacggccgcaccccgctgcatgtggccgccctgtcggcggacaccggggcgatggccgcgctgatcgccgccggcgccgacgagaacgccttcgacggccgcggttcgaccgccgcccaggtccggcgggtcgggtcctga

SEQ ID NO: 6686 - DNA, 1269 bp, Actinoplanes utahensis
gtggaccgcgcggacctcgacgccgccgtggctgccctggcccggctcgacgacccggagctggacccggcgtcccggctggagctggagcgtgcggtgaccaccgcggcgcgccggatcaagcagcgggcgaaggcccggcggtccgcgcagtcccgggacgccgaccggaccctgctggccggggcgagccggttccggaccgagatcccgtccccggagcccgtcgcacccgccgcaccggccgagacgctgggcgtgctgcgccgggtgcggctctgctacgtctgcaagggcgactaccgcgaggtcgacgccgactaccaccagatgtgcccggtctgcgcggcggagaaccgggactggcggcacgcccgcaccgacctgaccggacggaccgcgatcatcaccggcggccgggtgaagatcggcttccacaccgcgctgaagctgctgcgcgacggcgccaccgtggtggccaccacccggttccccgacgacgcggcccagcggttcgccgccctgtccgacttcgaccagtggggtgaccggctgcacctgcacggcctggacctgctcgacctcgacgcgctgcaggagttcgtacgcttcgccgggcggcgtttcgaccacctcgacatcctggtcaacaacgccgcgcagaccgtgtaccggccgcccgcctactaccgttcgctcggcaccgcgcccgaactccaggctctcgaccagcggttcttcccggccgggcgggtcgacgagaccggtttccagctcgacctgcgcccggtcaactcgtgggtcctgcgcgacggcgaggtcagcccgcacgagtggctgtccgcgcacgtggtcaacgcgttcgcgccgttcctgctcacctcccggctgcgcccgctgctggccgccgggccgccgcgggaccggcacgtggtgcaggtgtccgccatggagggcagcttctcgcggaccggcaagacggtccggcatccgcacaccaacatggccaaggcgtcactgaacatgctggtccggacgtcggcgccggactacgcccgggagcggatcctgatgaacgcggtggacaccggctgggtcaccgacgagcggccgcacccgcacaagcaggagcagcgggccatcggtttccggccaccgctggacgtcatcgacggcgcggcacgggtctaccatccggtcgtggcggccggccgcggtgcgccgatcagcgggaagttcctcaaggactatcggagcgtgccctggtga

SEQ ID NO: 6687 - DNA, 1149 bp, Actinoplanes utahensis
gtgtcagcggtagatgctggcgatcgcgcggatgtccgggtgcggggtggtcgagggacggtcggcgagcaggccggcggcgcggcgccgctgtttgcggggaacgccgccgttgatgccgaggtattccagggtgggatgcccgtcggcgatcgcgtcgaccagcagccgggcgccgcggccgccgatcccggtccggcgcaggtcgaggcggcgcagccgggcggtgggcagcgcggccgcgaaggcggcggcgccctcgtcgccgaggtcgttggcggtggcgccgagggcgcgctcggacggtggccggctcaggtccagaatctgccaggcggcgcagtcgcgggccagggccgcggcgccggtcgcggtgatcccgttgccgccgagacccaggattgccggtacgccgtgagcagcctcgccgagcgcggcggcgccccggtcgcccagatggttggcggccaggtacagctcgtgcacgccggcctcgtggatcagccgggccagcacgccgacggcgtccgggccgagtccgttgccgccgaggaacagccgctgcagacgggcgccgccggcgaccagggcgtcggtcagcacggtcaggccggtcacggtgagcccggtgttgaccagatcgagcgtacgcaggatcgggttgccggcgagcgccgccgcgagccgcgcgacgccctcgtcaccgaccggattgcgtttgagccagagggcgcggaccgtgtcgtcggcggccagccgctcggcgagcaccgcggcaccgtccgggccgatccggttgcagcccaggtagagggtttcgatgccgtgcccgggccgcagcgcgccggcgaccgcctcgacgccctcggtgcccagcgcgttggtgccgagcagcaggtgccgtacgtgcggggagccggcggccgcggcggcgatccggcccacctcgaccgggccgacgccctgcttgcacaggtcgaggcgaccgtcctgccggaccgccccgcgcgggaagacagccgggccggccgggccctcggcgagccagctgaccaacgggtcgaagtcggcgggtggggcgaggccgtcgtccgggttctggatcgccgggcagcggatcggcatggtcaccagggcacgctccgatag

SEQ ID NO: 6688 - DNA, 1128 bp, Actinoplanes utahensis
gtgaccatgccgatccgctgcccggcgatccagaacccggacgacggcctcgccccacccgccgacttcgacccgttggtcagctggctcgccgagggcccggccggcccggctgtcttcccgcgcggggcggtccggcaggacggtcgcctcgacctgtgcaagcagggcgtcggcccggtcgaggtgggccggatcgccgccgcggccgccggctccccgcacgtacggcacctgctgctcggcaccaacgcgctgggcaccgagggcgtcgaggcggtcgccggcgcgctgcggcccgggcacggcatcgaaaccctctacctgggctgcaaccggatcggcccggacggtgccgcggtgctcgccgagcggctggccgccgacgacacggtccgcgccctctggctcaaacgcaatccggtcggtgacgagggcgtcgcgcggctcgcggcggcgctcgccggcaacccgatcctgcgtacgctcgatctggtcaacaccgggctcaccgtgaccggcctgaccgtgctgaccgacgccctggtcgccggcggcgcccgtctgcagcggctgttcctcggcggcaacggactcggcccggacgccgtcggcgtgctggcccggctgatccacgaggccggcgtgcacgagctgtacctggccgccaaccatctgggcgaccggggcgccgccgcgctcggcgaggctgctcacggcgtaccggcaatcctgggtctcggcggcaacgggatcaccgcgaccggcgccgcggccctggcccgcgactgcgccgcctggcagattctggacctgagccggccaccgtccgagcgcgccctcggcgccaccgccaacgacctcggcgacgagggcgccgccgccttcgcggccgcgctgcccaccgcccggctgcgccgcctcgacctgcgccggaccgggatcggcggccgcggcgcccggctgctggtcgacgcgatcgccgacgggcatcccaccctggaatacctcggcatcaacggcggcgttccccgcaaacagcggcgccgcgccgccggcctgctcgccgaccgtccctcgaccaccccgcacccggacatccgcgcgatcgccagcatctaccgctga

SEQ ID NO: 6689 - DNA, 453 bp, Actinoplanes utahensis
gtgtgggattatccgcggccaccgcgggtggagcggacggccgcgcgggtgacgatcgttcaccaggggcgggtgatcgtggacagcgaccgctgctggcgggtgctggagacctcgcacccgccggtctactacgtgccgcgcggcgagatcgccgccggggtgctggagccgggggagggccggtcgttctgcgagttcaaggggatcgcggcctactgggacctggtcggggacggcatccgggtgccgcgggccggctggtcgtacgaggatccttcgccggggtacgcggtgatcgccggcgcggtggccttctaccccagccgggtgggcgagtgccgggtggacggggaactcgtccgcgcgcaggagggcgacttctacggcggctggatcaccgcggacatcaccggcccgttcaagggtggcccgggcaccaccggctggtga

SEQ ID NO: 6690 - DNA, 207 bp, Actinoplanes utahensis
gtggcccgggcaccaccggctggtgacggcgcccgtctgacctttccgggacggataagatccgggccggtcgcgccgaacgagggcagcgtgacgacggatgacgacagcaagggcttcgtgccaccgcagccgatcgagttcgccggtgccgtgccgtggacgccgccggccgggttcgccgggccggtcccggcccgcgcctag

SEQ ID NO: 6691 - DNA, 423 bp, Actinoplanes utahensis
gtgttcgccggggccgggctcctcgccggcctgatcgcgggcgtgggtctcgcggtggggccgctgcacgatccgctcgcgtcgctgtcgtcgaaggcgtccagcgagtcgccgcgaccgacggccgcgccgtcgggccgggggccggtggtgccgctgggcgacgcgctgaccctgaacctcgccgacgggcactacctgaaactgggcatcgccctgcaactggcggccgggcagccggacagtctggacgtcaacaaggctctcgaactggcggtcgacaactacaccggccaggatctcggcgaactcagcaccgcgcagggccgggcgcggctcaagcagcagctgctggagaagacgcaggcggcctacccgggtgtcgtgtcggacctctacttcgtccagttcgtcacccagtag

SEQ ID NO: 6692 - DNA, 1575 bp, Actinoplanes utahensis
gtgacgctcaccatccggcgccagatcgccgctctcgccgtcgccggcttcctgctggtcgcggtcgccggcgccatcggatacctcggcacgtccgcgctcgacgagcagcaggcggtgacccgcaacgcggccgccgcgctgcaggcggcgcagtcggccgacatcgcacggtcgctgttccgcggcagcgtcctggccgcgctggtcaccaacgacgccaaggaacgccaggaggtcctggaccggctgggcaggaacgtgcgccaggtccggcagggcgtcgacgaggtgatccgcgacatgccgcaggtgcggccccaggccgacgcggtcctgccggtgctcaatcagctgatcgcgtccgggcagcggatcgtcacgctggccagccgggtggcgtccgacccgaagcggacggcggcgctcgcggcgcggcccgcctacgacgcggtcgacgtcaaggcggcccaggcgatcggcgcgctgcaggccgcgatcaacgagcggatgaaggcggcgtacgacgatgccgccgcggccgccaagcggtccaagaccctgaccgtggtggtgggcctggtcgccgcgttgctgctcggcggtgcggcgatgctgctcgcccgccggatcgcccagcgggtcaacagctgcctgtcggccgcccggtcgatcgccgcctacgacctgaccgtcgaggcgcgcctcggtggcagcgacgagctggcccagctcggcaccagcctcaacgagatcgtcagcgccttgcggaccgccgtgtcggagatcagcgggaacgcgagctccgtcgccgcggcctccgagcagctgaccgcgaccagccggcacctggccgagggcgccggcaccgcgtcgtccgaggccgcggtcgccaagcaggacctggagcaggtgacgtcgagcgtgcacgaatccacccgggccgcccgcggtctgggcagctcgatccaggcgatcacgaccgcggtcgccgaggcggacacggtcgcccgcgacgccgtcggcctggcctcggacgccaaccggatgatcgagcggctgcgcagttccagcgacgaggtctccgcggtgatcagcatcatcacctcgatcgccgagcagaccaacctgctggccctcaacgccaccatcgaggcggcccgggccggcgagcagggcaagggtttcgccgtggtggccggcgaggtcaaggacctgtcccgggagacggctacggccaccggcgacatctcgtcccgggtgaccgccatgcagaccgacaccgggcaggccttcgacgcgatcggccggatcggccaggtgatctcccgcatcgacgagctgcagcagtcgatctccaccgcggtcgaggcgcagaccagcgccaccgacctgatcgccggcaacgtcgaggtcgcggaacgctcggcggccgcggtgtccgcctcgatcggccgggtcaccgacaccacggtcctgacccacgaggccgccaaccagaccgaggcggccgccgtcgagctcgcccagctgtcccaccagttgcgcctggtctccgaccgcttccagctgtga

SEQ ID NO: 6693 - DNA, 849 bp, Actinoplanes utahensis
atgggacgactggcccgtcttctccttcccgccctgctggtggcgaccggcgcgaccggttgcggctccgcgaccggcgccctggggcagcccgtcgaccggctggccgaggcccgcgccgcactgccgcccggcatggccgacggcggggtgctggtcgccggcaccgacccgacgttcgagccgatgacgttcaagcagggcagcacctacaccggtctggacgtgcagctggtcgaggcgatcgcggcccggctgcggatgcgcgtcgactggcggacggtgagcttcggcgacctgctcgaccaggtgcagcagcacaagatcgacctgtccgtgtcgtcgatgttcgaccgggccgaacggcagaagaaggccgacttcgtcgactatctcaacgccggcacgtcgatcgtggtcgccaagggcaccggtgacgtcggcggcatgcccggcctgtgtgggcggcgggtcgccgtgcagccggacaccgtctacgtcgacatggcggccgcgcaggccgcccggtgcggcggccggaaactggtctcggtacgcagcgacaacccgtcggccgcggtcgcccagaaggccgccgacgctgccctcaacgacttcccgatcgccgccctcgacgtacagaagaacccgggcctggagctttccggaccgcagatcgaggccatcccgtacggcatcggcatcgccaaggatcgtccggcgctgaccaccgcggtgcagaccgcgttgtactcgctggtcgacgacggcacctacgacgccctgctgaccaagtggaaggtgaccgagggcgccctgcgcaccggtgccgtcgacggcggcgcgtga

SEQ ID NO: 6694 - DNA, 711 bp, Actinoplanes utahensis
gtgcccatcgatccgtccaaggctcccgcatcaacttcgccgttgtggataatcgcgctcttcatcgtgctcagcgaggtgatggcgggcgttgcctccatcgccaccgacggagcaacccgaataatattcgcggtgtttgcggtgggatttccgctgattgtcttcgccgtgttctcctacctgctggtgggtcacaccgcgaagctttacgctccaagtcagtacagtgttgacatcgacccggagcgcttcgctgtcggtgtgaatgccggcggcttcacgcagcctcaggtgacgctcatcgccgaagcggtggcccaagccatcgagcagtccgaaccggcttcccatggcgacgcgaacgtggcgtcacgagctgtcgaggtgttccgccagacgatcttccagtcatctgtcgcggtcgatcttgacggcatcggcgatggaggttcggacggtctcgtgattcccgtcgaccgcggcacgggagtcgatgactttcttgatcaggtctggttcgcgatgcggggaaggttcagggcgttcacgtatggcaaggactgggttctagtggacgacgagaaccggaaggagttccgtgaagctgggactgcctgggcccagaagcatggtgaaacccgcgatcggcgtccgctttcggaaatcggaatctctcctggatcgaacctcagggttgtggcgttgtag

SEQ ID NO: 6695 - DNA, 423 bp, Actinoplanes utahensis
atgatcgaacccacggtggccgtccggatagcgcgtccgagtcgcgatctggccgcggcggaacgcttctacgtcgacggtctcgggctgaccgtcatctggcgcacgaccggcgacctgcaacccggcgagcacgacctgatcatgctcggctggcccggcgcgacctggcacctggagctggtcggcggcccgaacctgaccgtcgagccgtcgcccaccgcggcggacctgctcgtcctctacctggccgggccggtcgacgaggccctgatcgcccggctggagcgggccggcggccgccgggtcgcgcagggcgggtactgggaccgctggggtgtcaccgtcgtcgacccggacggctaccgcctcaccctgtccactcgttcctggtccaacgggactacaacgccacaaccctga

SEQ ID NO: 6696 - DNA, 564 bp, Actinoplanes utahensis
atggggaaactgacctacgggatgaacgtgagcctggacggctacatcgccgcgcccggcggcgacctcggctggggcgcgccgagtgacgagctgttccagtggtggtccgaccgggtggccgcgaccgggctggcactgtacgggcgccggctgtgggagacgatgaacgcgcactggccgaccgccgaccggcggcctgatgccaccccggcgcagatcgagtacgccggccgctggcgggccatgccgaaggtggtgttctcctcgacgatcggcgcggtcgacggcaacgcgcgtctggtcaccggggacgcggtcgccgagatcacccggctccgggccggcgacggcggcccgatggacatcggcggcgccaccctggccgcggcggccgtgcgggccgggctgatcgacgaatacgtgctggtcaccgcgccggtcctggtgggcggcggcacgccgttcttcaccgccctggacagctgggtgaacctgaacctggtggagacccgcgccttccccggcggcgtgctcctgacccggtacgagacgaggcgatga

SEQ ID NO: 6697 - DNA, 282 bp, Actinoplanes utahensis
gtgggtatgtacacgcatacccaacgtgtgtacgcgcgtacatatgggcgcctcgctcggcttcccggtcgggatggcgcgggcggcgacgatccgcggatggccgccgcccgggacagggtgatcgcgtcgatcggttaccgcgcgttcctcggcgggccgccggcgatcggtttcctcggccaccatgtcggcgtgctgagggcactcatcgtggtggccgccctgccggccctcgcggtaccgatcgccggcagtgtgcggccggcgcaccgcgactga

SEQ ID NO: 6698 - DNA, 1749 bp, Actinoplanes utahensis
atgagccctgtcccccgacggcgcctactgatcggcgccctgatcaccgtgctggtcgcggcgttcgcggcggtcttcgccggccccgcgcaggctgccgaccagctgctctcccaaggccggccggccaccgcgtcgtccgccgagaacgccgacaccgcggcggccaaggcggtcgacgggaacgcgagcacccgctggtccagcgcgttcagcgaccctcagtggatccaggtcgacctcggcgcggccgccaccctcagctcggtcaccctgaactgggaggccgcgtacgccaggtccttccagatcctgatatccaccgacggcaccacctggacgaccgcctacagcaccaccaccgggacgggcggtacgcagagcctggcagtcggcgggaccgctcgttacgtgcggatgaacgggaccgtgcgggccaccgcgtacggctactcgctgtgggagttccaggtccacggaacgttcacggcgtccggatgctcggcgaacgactcggcgcgtggcgccacggcgaccgcgtcctccgcggagaacgccgacaccgcggcggccaaggcggtcgacgggaacgcgagtacccgctggtccagcgcgttcagcgacccgcagtggatccaggtggacctcggcgcggccgccacggtctgcggggtggagctgagctgggaggcggcgtacgccaggtccttccagatcctgatctccgcggacggcagcacctggacgaccgcctacagcacgacgaccggcgccggcggcaaccagtcgctgacggtcagcggcaccgggcggtacgtgcggatgaacgggaccgtccgggcgaccgtttacggctactcgctgtggtccttcgtcgtgcacaccacgacgggtggcaccggcacgccgccgggcggcaccaccatgccggactccttctggggtgacacgagcggcattccggcggctggaaacgtcctgcaggtcaagatcttgaaccgcaccaacggcagatatccggacagccaggtgtactggagttacaacggggtcgcgcactcgatcgccgagcagccctatttcgacatgccggccaacaccgccgggcggatgtatttctacctcggctcgccgaacagccagtactacgacttcatcgaattcaccgtgggaccggaccagttcaacggcaacaccacgcgggtcgacgccttcgggttgaagatcgcgatgcggctgcattcgcacgacggcaacgacgtgcaggtcggtgaggattaccagaccttcaccgaggaccgggcggtgaccttccagaagttctccgacgaggtgccggccgagttcaagcacctggcgacggcgaccgcgccgtaccggatcctggcgccgggcagcgacgcggcgttccggcagggcgggcagtaccagaactatctgtccggctacgcggcgcagaacgggatcaccgcgatcacgtcggacatcttcgggtgcgccggggtgctcgccgggcagccgcagcagtgcgcggcgctgaaccggcacacgatcgacctgccgcaggcgcagtgggagacgccgtcgaacttctaccgggcggcgccggccaactactacgcgaaattctggcacgaccacgcgctggggagactggcctacgggttcccctatgacgacgtggccggccagagttcgttcgtgtcgcacggcgacccgcagtatctgctggtcgcggtcggatggtga

SEQ ID NO: 6699 - DNA, 801 bp, Actinoplanes utahensis
gtgtccggccggccgcttgctccggcggtggtgatcgacaagactgcagctgtgcgacggcgagcggtactcaccaccctggcggcggcggccggactcccggtccgcccccagccgcaacccgtcggcctgcagttgcgctacaaacacctgggcgacgcggcacaggcgatcatcgtgagcggcgagagctggacgtcgacgtatgccacgttgcgcagcttccagcgcgacagcgacggccggtggcaggtggcgtacccggcgatgccggcccgcaccggctacggcgggtgggcctgggcggccaagcgggtccaggaccgggggctcaccccggccgggacgttcaccctcaccgagggcttcggggtgcaggcgaacccgggcagccggctgccgtaccgcaaagtcgacggcgacgactactgggccggcgacaaactcgacccggcgacctacaacatcttccagccgtccgcacccaccacccgcacctggcggatcaccgaatcggaacgcctcgccgactacccgacgcagtacgcctacgccgcggtgatcgacttcaaccgcccggccggcgtgcactgggacgcctcccatgggcagaacgtcaccgccaccccgtcccacgtcggcgccggctccgccgtcttcctgcactgcagcggcgccggcaacaccgccggctgcgtctcggtcggcaaggacgacatggtcaccctgctgaagtggctcgacccggcccgccacccccgcatcgtgatggccccggcggccgacctgcacagcgcctga

SEQ ID NO: 6700 - DNA, 1422 bp, Actinoplanes utahensis
gtgggcccgggcgtagccgaccgcccggtcaccaggcacgccgtccaggaccgccaggcgggaccatcgaggcccgcaccgacagcccacggctcaccacggcacatccctgacgagccgggcgaaccaggtgtcgccgtacgccggacgggtgcgccggtcgaagcggtagccgagccgatcgtagaaccgccgggcaccggcgttggcctcccacacctcggcgtgggccgtccgcaggccgcgacgccgccagctgtcggcacacacccggtgcagcgcctgcccgacaccgcgcccctgatggtccggccgcacctggatctgccacaactcgccgatccgcgtcacgtcggcggccgggtcgtgcggcgggccgatcagcgccatgccgaccacctcgccgtcgtgctccgcgaccagcagctcccggcccgggtcgccgaggatcgccggcacataggcgccgcgcaccaccaccgcccgtgccgccagctgcgcagcgctctgcacgtcccgcaggaccccgttgcgcgcggcgacatgcaccccggccaccgcatcgagatcccccacccgcgccggccggaccaccgtctgcgtcccgatgcgctccccgccgactcccatgatccaagcttatcgaggcaagacatcgacacagtcaaactattggtggtacgcgttaaggtgccccgtgtgatcaccgacggggtgcatgtccacgtgtccaacgcggcggcgatgtggcgggtgctggtgcccggcgcgcgtgagctcggcgatcatctgcgggccgaccgggccccggcgacccggttgctggtcacccgcccgctaccggccgcggccgtcgccgcactgttggcgaccgtgccggacgggcgtccggtgacggtcgaggacacgttcggcgcggaaccggctgaggccgccggggccacggtgcgccgcatgccggtgatgaaccggccggccggcccgccggatccgcgcaacgcgcccgatgtgcgggtgaccccggtgaccgccgccgacgaactcgccgtggccgagcggatcatggtggagagtttcccgatgtccgagttcctgccgctggtgcgcggcgcggcgctgcccgagcgcctgctcaccgcgcccggctggcaggtctggctggcgtatctcggcgatcgcccggccgccgccgcgtacaccttcgacgacggcgtcgcggccggcgtctactggctggccacgctgcccgggttccggtcgcgcgggctggcccgggccctgctcgccaccgcgatcgcggcctacccgacgcgcgtcttcacgctggtggcgacagcggccgggatacctctctacgagtccctcggcttccggacggtgggtacgaccatctggtaccggagcccgggcgccgcgcgctga

SEQ ID NO: 6701 - DNA, 255 bp, Actinoplanes utahensis
gtggaagcgtcaggtgacggtaccggccgcctggcgcggacctgggtgcttacccggaaggaattcaagtcccgcaccgcggagacatcgaccgagcttccgtggtcggcgttcacctggctctggcaggacgacgacgcctacctgctgcgtaccggcgacggcaagacctgggacattccgcgagagccgctgaccgcggaacaggatgccgtgctggccggtttcctggacgggctccgtcgggcctcttga

SEQ ID NO: 6702 - DNA, 390 bp, Actinoplanes utahensis
atgccagttgagttgaatcacaccatcgtccacgcccgggacagccgggagtcggccgagttcctggcacgcatcctgggacttgaggtcggagccgagtggggcccgttcattccggtaaccaccggcaacggggtcacactcgacttcgccgccatcccggcggggccgatcgccacgcagcactatgcgtttctggtttccgatgaggagttcgacgcggccttcatgcgaatccgggaggccggcgtcacatactacgcggatccgcacctgaagcagcctggagagatcaaccaccaccacggtggacgcggcctgtacttcaaagatccggcagggcacggcatggagatcatcactcagccctacggcacaaccgtgaactga

SEQ ID NO: 6703 - DNA, 462 bp, Actinoplanes utahensis
gtggagatggccgttcgtgaaggtggcggtgccggacccgagttcgccggccccgacgcgccctgcctgcagctgctgaccctgagcgcccaggtgctcgacggtcccgccctgacggtcggcacctaccaggacgacgatgtgttcgggctgctcctgacctcccccgaggacggcgcctcctctaggaacggcatcttccgcgcgcggagcctgcccgagctgccggtcggcccggtcgacgaggtcaccgtccacctggacgccgatgtcctggccgaggtggtcctgcggatcggcgagcggaacctgctcctcatcgcgggtgaggcgtacgagaacggcgacggtgacctctcctggcaccgcctcgacgagtccgtcctcgccttcgtcgatccggaggccgcgcaggcgctgccgtggatcccccggcgttcgacacctgccggatcggcctag

SEQ ID NO: 6704 - DNA, 321 bp, Actinoplanes utahensis
gtgtcgatcaccgcgttcgccctgctgcgacccaacggcccggcgaacccgccggccgccccgccctccccggcggtctcccccacaccgtcggccctgcccacctcggcgtcgccgccggcccccacggcgtcctcggcgggccgggtcccgtcatcgtcggcccgccccgcgtcccccaccgccctcgccgtcaccggcccgggtgtcaccgcgccggccggcaccacgcccaccccgtcggccgcctccgccactgctcaaccgaccccgaccgggtccgggtccctctccaccgtcgcctccaccccgaaacgctga

SEQ ID NO: 6705 - DNA, 285 bp, Actinoplanes utahensis
gtggcgatcacggtcgcgctcggggtggtggccgggctcgcggtggcggacgcggacgtggccggggaggcgatcacggtaggggaggtcgccggggcgggtttcctgtcgccggcgaaggcggctgctgcggacactccgccgatcgcggcgacggccacggctccggcggtgaccacgagggcccgggtggatctgcgcatctcaagctccagcactgtcggtcggtgcactgtcgcctgggaggacgcctcagcgcaaaaaaggttggcgatcatgatgtga

SEQ ID NO: 6706 - DNA, 1032 bp, Actinoplanes utahensis
atgagcgctgtggagagcttgcgcttcgcccgtgccgaggacggtgtgaccgtcggataccaggtgttcgggcgggggccggcgctggtctggatgccgtcgctgagcaacatcgtggcgcagtggcggattccggtgatgcgggccgcctatcgggggctggccgagcgggtgaccctggtgctctacgacgggcgggggaccggcagctcggaccgccggatcgacctcaccgacctgggggtcgacgcgcacctgcgggacctgcgggcggtcctcgaccacgccgggatcgcccgggcgtcgctgctcggctactaccactcggtgaccaccgcgctggcgttcgcggcccgcgaacccggccgggtcgagcgcctggtgctgttcggcgggtcgccgcggctgcgcgaggcgatgctgccggcccagacccgggcgctgctgtcgttgatcgagcaggactgggacctgttcgccgacgcggcggcggctgcctggctgggctgggatgcggcgccgtcgaaccggtggacggcggaggcgttccgcggggcgacgaccgcgccggtggccaaggcgtggttcgaggcggccggcgagatcgacgtcagcgacgaggtggcccgggtccgggcgccggcgctggtgctgcaccggcagggcgagcagcagatcccggtcgaggtgttccgccggctcgcggccgacctgccggacgcgcggctggtcgagctgcccgggtcgacgccgacgctgttcatggaggatccgggggcggatctgcggctggtcaccgatttcgtggtcggcgggcgggccggcgccttccgggcctcgccggggctgaccgcgcgcgagggggaggtgctggccctgctggcggccggcgagtccaacagcgcgatcgccgggcagctcggaatcgcggtgcacactgtggaacgccacctgggcagcatctatcgcaagatcggggcgcgcggccgggccgacgcggtgcgcctggcggtctcccgccatccgcgctga

SEQ ID NO: 6707 - DNA, 405 bp, Actinoplanes utahensis
gtggctcccagcagcacctcctggcgtttcgcccgggccaccgcgcccgccgtccgggtcctcgccggccgccggctgatcccgctctgggcggtggtgcaccaccgcgggcgggtcagcgggcgcgcgctgaccgtgccgatcgcgctcaccgtggcacccgacgtgttcgtgatcaacctgccctggggtgccaccaccaactgggtccgcaacgtcctggccgcgggcgggtgcgtgatccgttggaagggggccgaccatccggtgcgtgatccgcaggtgatcggcgaggtgcaggcgcggccgtactacgggcgggtggcgtgggcgatcgcccggcgcctgttcccggcggacgagtggctggtggtctcccggcataccgcaaatcccgcccgatag

SEQ ID NO: 6708 - DNA, 408 bp, Actinoplanes utahensis
atgccatggatcagacgccgccgctacgactactacgacccgtactacgaccggcgttaccgcaacccgcagggctcctgcctgcgcgatgcctgcctgctggagaccggctgctgcatcgccgaaggcctcgacggcaactgcctgatgctgaccctgccgctgctgccccggctgctgacggccaccaccaccggcgggggtggcctgctcggcgggatccgcttctaccagcgggagatcagcgcccaccggccggcggtctgccggttcaccccgagctgctccgagtatgccgcgcaggccatcgagcgtcgcggtgcactgcgcggcgccctgctcgccgcccggcgcctgctgcgctgccggcccggcggcgcccgcggcagcgacccggtgccggcatag

SEQ ID NO: 6709 - DNA, 204 bp, Actinoplanes utahensis
atgaccaccggcaccgtgaagtggttcaacgccgacaagggcttcggcttcatcagcccggacgacggcggcgccgacgtcttcgcccactattccgccatctcggccggcggctaccgcagcctcgacgagaaccagaaggtggagttcgagatcacccagggtcagaagggcccgcaggcgcagaacatccgcccgctctga

SEQ ID NO: 6710 - DNA, 321 bp, Actinoplanes utahensis
atgcgcgtgcgcccgaccgaagaactgaaggacaacaccatgaccacgaactattcaggccccgcgaagctgaccctggtcgacggcgcgtgcatctccggcatggtctccctcagcaccaaccagcgcggcggaatcaccggctggggcggcacgttccgacccgaccagatcacgaccgaactgcgcaacgcgggcgacgggttgcagctggaactgccctacgaccgggtggggacggtcgccgtcaccggcatgcgcaagctgctcgccacgcagctgctgatgtcgttgaccggtcagggccccgcaccgttctga

SEQ ID NO: 6711 - DNA, 726 bp, Actinoplanes utahensis
gtgctttcggtgcaggtcagtggccgcgatgacggcccggtgctgctcctgctggccgggcaggccaactcgcacctctggtggaccgggctgcgcgagggcttcgaggaccgccaccgggtggtcaccttcgactggcggggcaccggcgacagccgcggcccggtcggcgactggaccacccggtcgttcgccgacgatgcggcgtccgtgctgcggtcgttgcccggcccggccgacgtctacggcacgtcgatgggcgggcgggtcgcgcagcacctcgcggccgggtatccgggcctggtgcgccggctggtgctggcctgcacctcgcccggcgggccgcaggcgcacgagcgcacccctgaggtccggcgccggctgctggaggcccgcgccggcaccctgcgcgagctgttctacaccgacggctgggacgggcacagccatctgttcggcgaccccacgatgagcgccgaggagagccgcgcccacctgcgggccagcaaccggcacgacgcctgggacgcgctgccccgcgtccgggcgcccaccctgatcctgcacggcaccgacgaccggatggtgccgtcggcgaacgcgccgctgctggccgcccgcatcccgggcgccgtgctgcacctgcacgagggtggccggcacggcttcttcgacgaattcgccggcgagatcacgccgatcatcgatgactttctgggcgactga

SEQ ID NO: 6712 - DNA, 1239 bp, Actinoplanes utahensis
gtgaacggggacagcggcggcacatggacatcgccggacggctcgtacatggagcgactgctctgtcaccgccggctgcccctgatcgccggcgtgaacgggagccgcccggcggtgcacgtgtgggagcacggatcgggcgggctccggcagctcggcgtcgtcgacgccggcggtgaaccctatccggccgaagcctggaaacgacaggcactcgtccccgagccggcctggcatccgtccgcggcgcggctggtcgtgaccggcccggccggcccgcacctctggacgccggagggcaccgctccgctgcccgcgtcccggcccggccacgcctaccgcttcgtcgccttcagcccggacgggcgcacgctgtgggcgtcgccgtccgcactgttcgatccggagtcggccggggaacggtcggacgccatcgacctggccaccggcgagctgcggccggggccgaggtgggacaccgccgtcgtcgagcatcccggcggcggactgctggccaccatggtgagcgaccagggcgcgacccacattctgttcgcccggcccggcgcggacccgcccgcgggcctgacgctgttgcgtgatgcgatcatcctcgatgtcgacggctacgagacgccggtgttctccgacgacgggcggtttctggcggtccggggcaacgcctacgttcagtctctcgacgtcttcacgttcccggccatgcgcagggtcctcagcaccaccctcggcgagccgtatccgggttatccgtatccgcccgagtggctggccgagcagcagcgctggtccgcgcacaacatcgccttcgcccccgggaccggcaccctgctggtcggcacggcgcggggcggcatcctcggcatcgatctcgacaccgagcaggtcgccgaagaggagcacagctccgcgccgatcagcgcgctggcgatcacctcgaccggccgcctggtggtcgcggaccgcgccgggcaggtcaccgtgacacagcaccggggccgccggaccggagacagccggccggcgagggcggtcgccgcccggttccgcgcggcgaccgtcgagctgcccgagggcgccgacctggcggaacacctgatccgccacgacggcgagcgggtatgggtgcccggcgacctcggtgacgtgaccgcggccgcggagaccgacccgacctggctccgcctccaggccgccatcaacacggctcagcgccgctga

SEQ ID NO: 6713 - DNA, 729 bp, Actinoplanes utahensis
ttgcttctgtacgacatgatcggcgccgactatccgaccacccggagcaccgacccgcggatcgccgcgcggatccggacggctctcggtgatgcccggaccgtgctcaacgtgggcgccggcaccggctcctacgaaccgcccgacctcgcggtcaccgcggtggaaccggccgcggtgatgcgctccctgcggccgccgggctcggccccgtgcgtggccgccaccgccgaccggctgcccttcgccgaccggtcgttcgacgccgcgatggcggtcagcaccgtgcaccactggcccgacccggtggccggcctgcgggaactccagcgggtggcgcgccgcgtggtcgtcctgacgtacgacgccgcctgctcgcaacacttctggctgaaccgtgactacctgccggaattcgacggtctgctgaccgcctggccgtccctggccgagctgaccggcgccctcggcgcccgcgccgagccggtcccgatcccgtgggactgcaccgacggcctgttcgaggcctactggcggcgtcccgaggcctatctcgacgaccgggtccgccgcgcggtctcggtctggacccgggtgggcccgcgggcggagcggcgcgccgtcaccgcgctgcgcgccgacctggcctccggtgggtgggcggcccgcaaccgcgacctgctcgccctcgactccgccgacctcggcctccgccttctggtggcctga

SEQ ID NO: 6714 - DNA, 1965 bp, Actinoplanes utahensis
gtgctctcggtgctgctgttcgtcccgttcctgatcctcaccgtgctggccttcgcggcgatcatccgccggctgctcggtgtccgggtcggcctgggtcgcacgctgctggccgcggtgctggccaccggggtgacctcgccgctgctggcggccctggcgccgcccgacccccggcacgtcacgaccggtcaaggcgtcctgctgatgctggccgcggccagcgtcgcggtgctgatcgcgatggccgccctggtgatcgccgaggtgctgctgccgaccggcaccctgcccggtccggtggagctgtggcgcggcacccgccggcggatcgtgcgcacccggcgctatgcggcgatcgtccggatcgcgctgcgccacggtctgggccggttcctgcgcggccgccggcagaccgggcccacctcggccgccgcccgccgccggctggcccggtcgttgcgcgccgcgctggacgagggcggggtcaccttcgtcaaggtgggccaactgctgtccacccggcgtgacctgctgcccgccgagttcgtcgaggagctgaccgcgctgcaggaccgggccgctccggtgccgtgggagcggatcgaggcggtcctcagcgcggagctgggacgttcggccggcgaggtgttcgcgaccatcgaccgggagccgctcgcggccgcctcggtcgcgcaggtgcacgcggccaccctgccggacggcaccccggtcgtggtgaaggtgcagcgtcccggcatcgccacgatcgtcgaccgggatctggacatcctgcggcggctcgcggccacgctggaggcccgcacgagctggggccgctcgctcggggtgcgcgggctggcgctgggcttcgccgaggcgctgcgcgaggagctggacttcaccgtcgaacgcgacaatctgcagacgatggccgcggcgctggccaccgcgccggagcgcggcgtgcgggtgcccaccccgtacgccgcaataagctcggaaaaggtcctggtgatgcgccggctgccgggtacgccgctcgggtcggccgcacccgtgctcgaccggctgggcgccgaccggcgcgagacggtcgccgcggcgctgctcgacagcctgctcgaccaggtgctggtgcacggcgtcttccacgccgacctgcaccccggcaacctgctcgtcgaccacgacggcgccctcggcatgctggatctcggctcggtcggccggctcgacgcgatcacccgcgccgcggtcggccggctgctcggcgcggtcggccgcggtgacgcggtggcggccagcgacgcgctgctcgacctggccgaccacaccgaggaggtcgacgagcgggatctgcagcgggcgctgggcgtgctgctggtccgctacgcggcgccgggcagcagtgccggggtggccgcggtgtccgccctggtgcgcacgctgaccgcgtacggcctgggcatcccggcggcggtggccgcggtcttccgcgcgttcgccaccctggagggcacgctgggcctgctccggcccggtttcgacctgatcgcgcaggcgcgcgcctcggccgggcgccggctggcggcgaccttcgccccggcaaacctgtcccgcaccgtcgaggaggagctgatcgcgctgctgccgatgctgcgcggcgtcccgcgccgcctcgaccggatcggcgacgcgatcgagaacggccggctgcggctcaacatccgcctgttctccgacgaccgggaccgccaggtggtcaccggcctggtccaccagacgttgctcacggtcatcggcgccgcggccggggtgatggccaccctgctgctcggcaccaccggcgggccgcgggtcaccaccggcatcggcctgttcccggtgctcgggtacctgttgctgatcgtcgcggtggtcctcgtcctgcgcgtgctggtcgtcgtcctgcgccgcgactga

SEQ ID NO: 6715 - DNA, 699 bp, Actinoplanes utahensis
gtggcccggcttctgctgatccggcacggtcaggcgtcgttcggcgccgacgactacgacgccctctccgaccgggggcacgagcaggccgccgcgctgggccgggtgctcgccgcccgcggggtgcggcccacgctgctgctgcgcggcaccatgcgccggcatcgggaaaccctggacgggctgggtttggacgcgccggtggtgaccgacgcgaactggaacgagttcgacttccagcacgtcgtcgaggtgcatcgcccgcacttccgggaccgggccgcgatgatggccgagctgaaccggtcggagcagccgggccgcgccttccaggcgatcttcgacgaggccaccgcccgctggtgttccggtgctttcgacgccgagtacgccgagtccttcgccgcgttccgcacccgggtcgccgccgcgctcaccgcggtcgccgccctgctgcgcgagcaccgggacgtcgtcgcggtcagctcgggcggcccgatcgcgatcgccgccgccctgctcaccgccggcccggacgcgccggccaacaccctggcgacgatctgggcggcgctgaaccgggtgtcggtgaacaccggcgtcaccaagatcatcgccgggcgggccgggctgtcgctgtccaccttcaacgagcacacccacaccgagaccgagccgcggctgctgagctaccgctga

SEQ ID NO: 6716 - DNA, 756 bp, Actinoplanes utahensis
gtgccctaccgtgtcggcatgtcacgaggagtcgtcctgatcacgggtgccagtgccggcctcggcgaggagatggccaggcagttcgcggcgctcggctacgacctggcgctgtgcgcgcgccgggtggaccggctggcggcgctgcgcgacgagctgcccggccgccgggtggtcgtcaagcagctggacgtcaccgacgacgccgcggtgtcccgggtgttcggcgagttcgccgccgagttcggccggatcgaccgggtggtggtcaacgccgggctgggcaagggcgcgccgctgggcaccggccggttcgccgcgaaccgggcgaccgcgatggtcaacttcgtgggggcgctcgcccaggcggacgccgcgctggagatcttccgccggcagcggggcggccatctggtgctgatctcgtcgatgtcggcgctgcgcgggatgcgcagatcgatgacgacgtacgcggcgaccaaggccggcgtggcggcgatcgccgagggtgtccggtcggagcggattcccggcgtcgacgtgtcggtgatctatccggggtacatccggtcggagatgaacgagcacgtccagcagaagaccaggttcatggtcgacaccccggtcggggtgcgggcgatggtcgcggcgatcgagaaacgccggttgaaggcgttcgtcccggcctggccgtgggtgccgatcggcgccgcgatgcggcttcttccgctttccgtcgtacgaaggatggtgtga

SEQ ID NO: 6717 - DNA, 207 bp, Actinoplanes utahensis
gtgacatgccgacacggtagggcacgccgtcgcacccgtcgaaaccgcgtcctgatacatccgatcaacgtcggctcccaggacgtcgccgcggccaagggcgacaccttcacctcgatcgcccacctcgacctgggcggcaaccgccactacgggatggtgatgaccggcggcgaaacctccggcccggtccaggccgccgaatga

SEQ ID NO: 6718 - DNA, 465 bp, Actinoplanes utahensis
atggtctggcgaaaattctggcgtacggtcggctcgatccccgggttcaccccgatcgcgaaacgcaccgtgaccctcgaccgctgggtcagccggatcacccgcggccggatcgtggccctcggcatggcccccggcctgctgctcaccaccaccggccggcgcagtggtcagccccgcagctgcccgctgcagtacgtcacggacggcgaggggtacgtggtggtcggctccaactggggcggcccgaacgccccggcatgggtccacaacctgcgcgcgacgccccgcgccaccatcaccatcggcggccgcgacgtgccggtcgacgcgctggaggccgacggcgacgagcgggaacgcctgtggcagttgttcgtggaccagtggccgggctacgcccgataccgcgaccgggccgcccaccgcaccctgcgcatcttccgcctcgtcccggtcaggtaa

SEQ ID NO: 6719 - DNA, 636 bp, Actinoplanes utahensis
gtgggtcagcccggtcacccgggtcggctacgaagcgctgcacaaccggatgggagtgtcgatgccacagaccggaaggctcaccctcgcccagcgcccggccggcgacaacgacctgatgtcggccggggagatccgcacccccgccggcgacccggcgtgatgaccgtcgagatctcctaccgccccgcggacgcgccggtcccccggctggcggcgctgttcgccaccgcctggtgggcggccgggcgcaccgacgacgaggtggcccggatcgtggccggctcggacgtggtcgtcgccgccgtggaccgtgactccggccgcctcgccggattcgcccgggtgctgaccgacggtgtcgccctggcgatggtgctggacgtgatcgtcgccccggagcatcgcggcaccggcgtgggcgcgctcgtgatggacgcggtgctgcggcatcccgcggtggcggcggcgcgcagcgtcgagctggtctgccagccggagttgctgccgttctaccgccggtggggcttcaccgaccgggtcgggcggtcgcggctgatgcgccggaccgccgatccggccctgaccgatgacgatcagacgccgccgaccgctgagcgccggcccgtgccgtga

SEQ ID NO: 6720 - DNA, 1191 bp, Actinoplanes utahensis
atgggggtgaacccgcacgagcagtcgccgtacacgccgatgccgccgcagcagtactggccgcagccggccccgccgccgcggcgacggccggtgggtgcgctggtggccggtgcgctcgcggcgctgatggtcaccggtggggccgggttcgccgcgggttggggtctgcggagcgagccggtcgcgcagcagagcacccgaggatcccacctgccccgagatcccggcgacggcgcctcgtcctcagccggggccaccgacgcccaggtcgccgcggtcgcggccaaggtcgacccggccctggtcgacatcgacaccgtcctcggcgcgcagaacggcgcggccgccggcaccggcatcgtgatcggcgcggacggcatcgtgctcaccaacaaccacgtgatcgccggcgccaccgccatcacggtcaccgacatcggcgaccaccgggcttaccgggccgccgtcgtcggctacgaccgcgcccgggacatcgccgtgctccacctcgacggagcgtccggcctggccaccgccacgctcgctgagtcgaccccggtccgccagggcgacccggtcgtcgcgatcggcaacgcgggtggcgccggcggcacccccggcgcggtcggcggcgtggtcgccgcactgcaccggtcgatcaccgcgcaggacgcgtcgagcggcgcgtccgagcagctcaccgacctgatcgaggtgaacgccgcgatccggcccggtgattccggcggcccgctgctgaccaccgacggcacggtgatcggggtcgacaccgccgcctcgaccggtttccgctatccggcctcgggcggtgccggctacgcgatcccgatcgacgccgcgatgagcatcgtccggcagatccaggccggtcaggcctccgacggcagtcacctgggcgccaccggctatctggggatcggcgcggccgacggtgccggcggcgccgcggtgcgcagcgtggtgcggggttcgccggccgcctcggcgggcctcgcccgcggcgacacgatcaccgccgtcgacggcgcccgggtcggctcggcggccgcgctgatcgagcggctggaccggcaccaccccggcgaccgggtgaagctgtcctggacggacaccgccggccggacccgctccggcaccgtggccctggcgagcggcccggtcgggtga

SEQ ID NO: 6721 - DNA, 429 bp, Actinoplanes utahensis
atgggtcgtacacgcaaatcgcttctgatcgtcggaccgctcgcggccggcgtcgtcgtcgccgcaaccgccgtccgccgccgcggtgccgcgccgcccacccgccggcggcacgtcctcacggtctacaaacccctgtccgagttggagagcacgcagctgcccggctcgctgcgcgagatcgccgaccgggtcgagatctcgctggcggccgcacccggcggccgcggcaccgagatcgcggtccgcatcccggacggctccccggtcaccgacggcgacgtccgccgcgccctgcgcgaaacccgctccctgatcgaggccggtgacgtgctgctgccgtccggcccggccaccaccacgccgacgctgctgaaccggccgctgcaggcggccacccgcaacggccgcgaaggaggcctgctgtga

SEQ ID NO: 6722 - DNA, 1170 bp, Actinoplanes utahensis
gtgaaggcgctgcagtgggagggtgtgaacaagctcgccgtcggcaccgtgcccgacccggagctgcgcaacccgggcgacatcatcgtgaaggtcgccaagaccgtcacctgcggctccgacctgcacctgctcggcgggtacatcccgttcatgcagaagggcgacgtgctcgggcacgaattcctcggcgaggtcgtcgagatcggcccggacgtgcgcaaccaccgggtcggcgaccgggtcgtggtgtcgtcgttcatcgcctgcggcaactgctggtactgcgaccagaagctctactcgctgtgcgacaacggcaacaccaacccggcgatcaccgaaaccctgtgggggcacgcgcccagcggctgcttcggctactcgcacgcgatgggcggcaacgccggcagccacgccgaatacatccgggtgccgttcgccgacgtcggcgcgttcaccgtcccggaagcggtcagcgacgagcgcgcgctgttcgcctccgacacggccgccaccggctggatgggcgccgacctggccggggtcgccccgggcgacgtggtcgcggtgtggggcgccggggcggtcgggcagatggcggcccgcgccgccgtgctgctcggcgccgaccgggtggtcgtcatcgaccggctcgagaaccggctgcggcaggtccggcagcacatcggcgcggagaccctgaactacgagcagaccgacatcgccggcgaactgcgcgagctcagcggcggccgcggcccggacgtgtgcatcgaggcggtcggcatggaggcgcacgcgcccggcccgcacttcgcctacgaccagctcaaacagcagctgcggctgcagaccgaccggccgatcgcggtccgcgaggcgatccacgcctgccgcaagggcggctcggtgttcgtcctcggcgtctacgccggtttcgtcgacaagtttccgctgggtgcgttgatgaacaagggattgacggtacgcggcgcccagatgcacgggcagcgctacatcccgatgctgctggaccggatggccacgggtgagctcaccaccgaacacctggccacccatgtgatgccgctggaccgggcgcccgagggctaccagatcttcaaggacaagaaggacgactgcgtacgcgcggtgttcgtgccctga

SEQ ID NO: 6723 - DNA, 741 bp, Actinoplanes utahensis
atgcactcgctccacttcaccgcccagaccaccgccgacggcgtcctcgaacgcgacttcctcgtcggtgacatccccggcgtcctctggtcaccggccggcgacgccggtcccggcccgctgatcctcatgggtcacggcggtggcctgcacaagaagacccccgcccaggcggcccgggcccgcgacctggtcaccgcccacggtttccgggtcgccgcgatcgacgcccccggccacggcgaccgcccccgcggccccgaggacgaccgggcccgcgccgccttcgcctccggcgacccgtcgctgttccggtcggccagcgtccgctacggcatccacctggccgcccaggcggttcccgagtggcagcagaccctggacgcgctgcaacagctgccggagatcggcccggacgcgccgatcggttacggcggcggcatcaccctgggcaccgcgatcggcctccagctgaccgcggcagatccccggatcagggccgccgtcttcggcagcggcttcttcgtgtacgacgcggcccggcaagccgcgcgccggatcaccgtcccggtccagttcctgatgccgtgggacgacgaacacgtcacccgggccgaggccctggagctgttcgacgcgttcgccagcccggagaagaccctgcacgccaacccgggcgaccaccggcggatccggtggtacggcctcgaccacgacttcctgccccgccacctgaagtga

SEQ ID NO: 6724 - DNA, 633 bp, Actinoplanes utahensis
gtgacatcaccacgtccgcgcaggtcacccccgcctcaggaacgccggcgagacccggaacgcacccgccggaagattctggaggcggccgccgtcgagttcgccgaccacggctacgccggcgcccgcacccgggccatcgccgcccgcgccggcgtcaaccagcaactggtgtcgtactacttcggcggcaaggaaggcctctaccgggccatgtccgaccagtggcggcagcgccgcgacgacctcgccccggacggcaccccgatgcccgaacagctccgccggtacgccatggagatcgtgcacaacccggacggtgtccggatgttcgcctggagcggcctgcagtacaccggccccgacgacgacccggaccgggactcccgcacccagatgctcggcggcagcgtcacccacctgcgccggctccaggaggcgggccggctgccggccgagatcgacccggtctgcctgcagatcatgctgatggccgccagcatggccaccacgacgctgccgcacgtgatcgaggggttgtgcggggcggacccgcgctcccccgagttcgtcgaacactacgccgaccaggtcgccctggtggcccgcctgctcggcctcgacgaggactga

SEQ ID NO: 6725 - DNA, 1104 bp, Actinoplanes utahensis
atgattgacaaagacatgcgggcgcttgataccgtgtcgggcatgacgaaaatcctgatcagcggcgccggtctcggtggtctcgcgctcgcccaggccctgcaccgcggcggcttcgaggtcgccgtccacgagcgtgaccccggtccgcagacccgcggtcagggctaccgcctgcacatcgacgcggatggcaacgccgccctgcgcgactgtctgccgcccgccgtcctcgatctggttcgggacaccagcggtgtcaccggcgacctggtcgccaccctgacccccgacctgcggcgggtgttcgcccaggagttccccggcatcccggacacggagatcaccaacgtcgatcgggagacgttccgccgcggcctgctcaccggtgtgaccgacctcgtccacttcggccacaccgtggccgactaccgggtcaccgaggccggccgggtccgggtgacgttcgccgagggcggcaccgacgagggcgatctgctggtgggtgcggacggggccggctcggcggtgcgcgcccggctgctccccggcgccgcgccgcgcgatctcgggctgcgctgccgatacggccggatgccgatcgacgccaccaccggcccgctgatcccggccgatttccgccgcgggttctgctgggtgaccgggagcgggggctggggcgccggcttcgcgccggtggtctaccgggacggccgccccggctacctgatgatcgcgctggtcggcccggccggcaccggtcaacccgacgactggcatccgaaaattcagcagcttctttcgtacgccgatggctcctccttcttccccatcaccatccgagcgagcgtccgcaccgacccgtgggcgcccggtccggtgaccctgctcggtgatgccgtgcacaccatgccgccggccgggggagtgggcgccaacaccgccctgcaggacgccgcgaccctggccgccgagctgctgtccggcaggccactacccgacgcggtcgccgcctacgagcgggtgatgattccccggggatacgacaccgtggagcggtccgtccagatgatcacccagatgtccggagccacccactcctga

SEQ ID NO: 6726 - DNA, 396 bp, Actinoplanes utahensis
atgccccacgtgacgatccatgcactcgaacacgagctggccagccatgaaccggccctcatcgcgaaactgaccaccgccgtcgtatccgtttacggcgaacgggtccgcagctcagtggacgtcaagctggtcggcatcccggccggacggtgggctcgcggcggagcggcggtcgcgacggctgcaccctcggtcacgttcggcatgcgcgaggaagtgttcgcccgaccggacgcggccaccgtcgccgcacacctggtcgccgcgctcgccgaggccatcaccgccgttttcggcgacggttgccggggcgacgttctcgtcgaaccggtcggccggcccacgtcccggtccgggctcggcggcagggtgatcgacgtcgtcagcgattga

SEQ ID NO: 6727 - DNA, 660 bp, Actinoplanes utahensis
gtggatcttccgaacgacgccgcggccatcatcttcgactgcgacggcctgctcgtcgacagcgagacctgctggacacgcgccgagacgaccctgttcgccgagcacggccacggcttcgggccggagcagaagaacctgctgatcggcaagacgctgccggccgccggcgaggtgatggccgaccacttcggtctgcccggcagcggcccggccctggcggcacgactctccgccctggtcgcgcaggaattggcgacgggcgcggagccgctaccgggggcccggaacctggtcgagtcgctgctgggccgggtcccgatcgcggtcgccagcaacagcccgcgcgccttcgtcgacgccgcgctgatcacttccggcctggccgacctgttcaagtacgtgtatgcggtcggcgacgtcgaacacggcaaaccggcacccgacctctacctggcggcctgcgcgggcctcggcgccgacccggcccgctgcgtggccttcgaggactcggcgaccggcgtcgcctccgccagcgccgccggcctcttcgtgatcggcgtgccatcggtcccgggcaccaccctcaaagcccaccggtcgtacgcgtcgttgaccgatcctggactgctggcctgggctgaccgcctcgcatcgtga

SEQ ID NO: 6728 - DNA, 765 bp, Actinoplanes utahensis
atgatcgtcgaatacctccgctaccgggtcgatgctgaccgggccgccgggttcgagcaggcgtaccagcgggcggccgtgcagctggcggccgccccgcagtgcgtcgactacgagttgagccgctgcgtcgacgagccggcggcatacctgctgcggatcacctggacatcggccgaagatcatctgaagggattccggggcggcgagctcttccccggttttctggccgagatccggccctacgtcgacgacatcgaagaaatgcggcactacgaggtgaccggggtgcacggcaccgggggctcggtgccgacgatgtacgagtgggccggcggcgcggcggccttcgaacggctcaccgcagccttctacacccgggtcctcgccgacgacacgatcggcccgctgttcgcccacatggacccgtcccacccgagatatgtggcgatgtggctgtccgaagtgttcggcggcccctccgcgtacaccgactcgcgcggcggatacgcccacatgctgggcaaacacctcgggcgggcgatcaccgagcagcaacgccgccgctgggtggcgctgctcgtggacgccgccgacgaggtcgggctgcccgacgacccggagttccgggccgcgttcatgggctacatcgagtggggcacccgactggccctggccaactcgcagcccggcgccgcaccaccacgacaggcgccggtgccgcactggggctggggggtggcgccgccgtaccgggtaccgtga

SEQ ID NO: 6729 - DNA, 2709 bp, Actinoplanes utahensis
atgcaggtacagcgccgcaggcaggtgagacagaggtccggccggtggttcgcggtgaccgccgggacgaccgcgacggtcgtgctggccggggccggggtggcctacgggtcgaccctcccgttcggtcacgaccaggtcggacaggtcaccgcgaaggggcaggtggtctccgccgatcagtacatcgacccgatcggcaagcgcctggtcatcgacaagggcaagatcatgtccgcggtggtgagcccggacggcacgcacgtggccgcgtcgatcaccgacggcgggatggcgctggccgtcgtcgacctcacgacgtggcgggtgcagcagctgatcggcaacaacgcggccgccgacctgaagatcagcggtaacgacgtcgggcaggagggtcccacctactcccccgacggcagacagctgtggcttgcccaggcgaccggataccgcagattcaccgtgcacgacgacggcacgctcgccgacccggcgttcgtcccgatccccaccgacgcgacgaagaaggccctggccgggcaggccgtgttcagcgcggacggcgctaccgtgtacgccgcggtcaacgggcagaaccgggtggtcgcgatcgacgcggcgaccggtgcgatcacccggagctgggcaaccggcaacgcgccgcgggacctggcgctggtcgggtccaagctgtacgtcagcaacgagggcgggcgcaccgcggtcaccggcgacaccacgctgaactcttacgacacgcaggtgccggccaatccggtgaccggcgcgacgacgaccggcacggtcagcgtgatcaacgtggcggatccggacgcggcggtcggcagcatcaccgtggggctgcacccgaccgcggtgtacgcgcacggcagcacgctgttcgtcaccaacaccgccaccaacgacgtctcggtgatcgacaccgcccgggacgcggtggtgcagacgatcgccacgcagccctggccggaggcgtcggtcgggtacgagccggatgcggtgaccctgaccggcgacgggcacctgctggtcaccctgggacgggcgaacgccgtcgcggtctaccggttccgcggggcacaggagccggtcagctacgtggggctgctgccgaccgactacttcccggccgagatcgcgacggtcggcgggcaggtgctggtggccaacacccggggcatcgacgcgcggcggcccaccaccgcggccgggcacggcagccacgacaccacgtccagcctgcagcggttcgcgctgcccgcggatcgggtgatcaaggcgtacaccgccaaggtcttccggcagaacggctggaccccgggctcggtggtcgaggccccgaaacggggacgcgtgcgggcgacgccggtgccggcgcggctcggcgacccgtcgacgatcaaacacgtgttcctgatcgtcaaggagaaccggacgtacgaccagatgttcggcgacgagccacgggcggacggtgaccctgcggtggccgagttcggcgagaccgtgacgccgaaccagcacgcgctcgaacggcagttcgggctgtacgacaacacctacgacatcggcaccaactcggccgaagggcacaactggctgatgcaggccgacgacccggagtacaccgagtcctcggccggcgagtacacgcgcagctacgacaccgaggacgatgcactgggtcaccagcggaccgggttcatctggaccggcgcgcaggcggccggcaggacggtgcgcgacttcggcgaattccaccagttcctcaccaagccggccgatgcgacctggcagaacctgtactgcgacgcgaagaccatgagcgccgcgggggcggacacggcgtaccacctcgtgtcgtcctcgccgatcccgtcgctgaacagcgtgtcggtgcccggcttcccgaagttcgacaccgcggtgccggacatctaccggtacgagatctggaagcgggacttcgagcacaacggcccggcgaacctgaacatgttctggctgtccagcgaccacaccggtggcccgccgagcgccgccgcgcaggtcgccgacaacgatctcgcggtcgggaagatggtcgacaccatctcgcactcgaagtactggaaggactcggcgatcttcgtggtcgaggacgactcgcaggccgggctggaccacgtcgacgggcatcgggcgccgatccaggtcatcagcccgtacgcgcggcacggtgtggtggacagccggtactactcgcagatcacgatgatccgcacgatcgagcagatcctcggggtccacccgatgaaccagaaggacagcgcggccacgccgatggtcaccgcgttcaccgggcggccggacttcacgccgttcaccgcgctgccgaaccgcacctcgctgaccctgggcctgtcgacgccgccgccgtgcggtgcggacaccccggtggcggcagcccccgcggcggccgtcccggcggcggtcaccccgctggtcgcgcagtgggaggcgtggaagtcccggcagcggctgaccggtccggacgcggtgcctgacttcgccaacccggcgcagatgaaccacttcacctggtatcagacgcacaactggaccaagccgtacccgggggaggcgacgatcgtcgcgcccgatcgggtgccgggggcgtacctgccgtcgacagataccgactaa

SEQ ID NO: 6730 - DNA, 1362 bp, Actinoplanes utahensis
atgaccgccggcatcgcaccggacccgcaacggaccggcgagcgaccggtgccggtgccggtgcggcgggggtatcggttcgagctggtgaagctcggggcgcagtggcgcatccggctactggtcctggcctgctggatcgcgcccgggttgttcgtggcgggggtcggtcagcagacgacgttgccggtggacacgctgttcgggcggtggatgctcgcgaccgggtgggcgagtccgctggtcatgctcgggttcgccggcacgtgggggctgccgctgctggcggcgccggccgcgggcgacgtgttcgcggtggaggaccggctggggacctggcggcatctgctggtcacggtgcggtcaccgcggcggatcttcgtggccaagacgctggccggcctgacggtgatcgtgctgctggtggcggggctggccgtgtccagcacggtgggcgggctgctcgcggtgggtgaccacccgctgatcggactcgatgggcaggtgctgacggcggggtccgccggcgtaccggcaatcctgtcctggatttctgcccttgccccgaccctggcgctggccgcgatcgggctgctcggttcggtggcactcggccgcaacccgatggggctgctgctgcccgcgatggtggggctgggcatgcaggtggcgcagatgctgccgctgccggtggcggtgcgcctggcgttgcccattcacgcgttcctcagctggcacggcctgttcaccagcccgcgcgagctcggtccgcttctgatcagcgtcgcggtcagtctgctgtgggcggccgcggccaccgctctggcctaccggatcttcgtgcgccgggacttcacccctgcggcgtacgacggctcgggccgccgcgcgctggtcgatggcgccctgccgctggccggtctggcggtggcgacggtcgggctgttgctcgtcacggtgcccggctcgaccgggaccgggatcacccaggcgcgggtggagtcctcggtggcgaccactttcgcccgtctctatcggctgcaggccgggcagttgcaccggccggacgtgaccgaggcgcagttgcaggcggccgcggcgtgcacgaagggcggcggtctggtcgacgcggaggggccgggcaacgactggcgctgcgtcgtctcctggcatctgcccgaggtgaccgctgtgggtcaggccgtctaccagctggatgtcgccacggacgggcggtatgtcgcggacggcgacggcccgaaagaggtgaacggctatttcgtcgtgcgcaccgacaacggcgacgcaccgaatccgctctggcagttcgacggcatcgtcgagctgcttccgaagggatag

SEQ ID NO: 6731 - DNA, 948 bp, Actinoplanes utahensis
atgccggcactgcatgcgatccgggcccggggtgtcaccaagcgcttcggggaggttgtcgcactcgacggcgttgacctggatcttgggcgtggacagattcacgggctggtggggccgaacggggcggggaagacgacgctgctcgggctgctgctggggctggctgtgccggacggcgggacgctggagattctcggggtgccggttcggcgggcgctggcggggccggatggggtggcggggttcgtggatgggcccgggctctatccgtcgctgaccgcgcggcagaatctggaggcgctggccgcgctgcggggtcaggtttccgggggccgcaccggtcgtgtccgggccggggcggtggcacgggaagcggacctcgatgaggtgctcggccaggtgggactggccgaggtggccgatgatcgggcggggacgttctcgctcgggatgcggcagcggctgggactggcggcggcgctggtgaccaggccacggctgctggtgctggacgagccgtccaacgggctcgacccggccggcaaacggcaggtgcacggggtgctccaacggatggccgcggacgggaccggggtgatcctgtccagccatcggatggacgaagtggaggcgttctgctccgaggtcaccattctgaacctggggcgggtggtgttctcggggccgctggccaagctggccgccgagcatcgcgagctggagtatcgcctggtcacctcggatccggccggggcccggcgggtggccggggacacgccgggggtcgcggtcaccggggacctggtgatccgggcgctccttccggcactggacgacctggtggtgcggctggtgcgggccggcatcgcggtgcgcgagctgaccccggccgtgtcgccgctggaagccgccttcctgtcactcaccgaagcagccgcggcatga

SEQ ID NO: 6732 - DNA, 1503 bp, Actinoplanes utahensis
atgaccgacgtcgtagtggccggggcgggcccggtgggcctgctgctcgcctgtgagctgcgactggccggggtcactgtggtggtgctggagcgaaacaccgagatcgacctgacggtcaaggccggctacatcaccgtgcccggcatccaggccctcgaccggcgcggcctgtcgcccgcgatcgagcgggcccgcgacgagacgctggcccgcatgggcttcgccggccggggcccagtccagcagaagatgccccgattcatcggccacttcggtggcatgatgctcgacggccagcttctcgaccccgacgatccggacatcgccgccggcggccggttcagcgcgctcggcatggtcagccagcagcagctggaggtcatcctcgaggagcgcgcccgggcgctcggcgccgaggtgcgccgtggcgtcaccctgaccgacttcgagcaacacgccgacggcgtcgtcgtcaccaccgaccagggcctcatcgaggccggttggctcgcggggtgcgacggcggccgcagcacggtccgcaaactggccggtttcgcattcccgggcaccgatccggagatcaccgcctaccaggcgatcgccgacatgatcggcaccgagggcctgcgtccgggttggcacatcaccgacaccggggtctacacgttcggcccgttccccggccgcatcctggtcgccgagttcgacggcgccccggccgaccgcaccagcccggtcaccgtcgacgaactgcagggagcgatccgccgggtcaccggcgtggacgtgaccgtcacggggatcagctcggtcacccggttcaccgacaacgcccgccaggccggtacgtatcggtcgggccgggtgctgctcgccggagacgccgcccacgtccactcaccattcggtggtcagggcatcaacctggggctcggcgacgcgatgaacctgggctggaaactggccgccaccatccggggttgggcccccgacgggctgctggacacgtacaccgcggagcgccacccgatcggcgcccagatcctcgactggacccgtgcccagatcgcgatcatgcgccccgaccagcactcccgcgccattcgcggtgtccttcagggtctcacctccaccgtcgacgccaccacctggctggccaaacgcatctccggcgtctggcagggctacgacctgcccggcgaccatccgctgaccggccgcagcgcccccgacctcacgttcgacgacggcacccgactccccgaccacctccactccggtcgcgccctgctggtcgacctcgccgacgaccccgacctccccgccctggccaccggctacgccgaccgcctcaccgtccactcggccaaagccgccacctccgacctcaccgccgcactcatccgccccgacggctacgtcgcctgggcctcttccggttcccccacgaccgacctccgccaccacctgaccacctggctaggcaatcccgcctga

SEQ ID NO: 6733 - DNA, 621 bp, Actinoplanes utahensis
atgggactgcgggagcgcaagaagcgccagacccgcgagctgatctccggcgtggcgacggagatgttcgtccagcggggcttcgacctggtgaccgtcgccgaggtggccgccgcggccggcgtctcggagaagacggtgttcaactacttcccgcgcaaggaggacctgttcctcgaccggttgcccgagctgctcgcgctgaccaccgaggcggtccgcaaccgtccggaggggacgagtgtgctcgccgccttccggggtgtcgtgttcgacctgctggccgccggtcacccgttgagcgcctacccgggtcgggggcacgccgggttctaccgggtggtggtcggttcaccggcgctgcaggcacgggtccgtgagttccagcaggagttggaggatctgttggtcgagctcgcccgggagagcagcgggaggggcgggggcgagggggaactgcggctccggctggccgcggcggtcaccgtcgccgcctaccggacggtctacttccgggccgccgctcgcgtgctggccggcgaagatcccgtggcggtcggtgaaaccctcttcgcggagtacgcggagaccttcgccgccgcggagaaagcactgagctga

SEQ ID NO: 6734 - DNA, 1452 bp, Actinoplanes utahensis
gtgcggcgccccgaggagacgtgtgtggagcaggccggccgggaggaaacccggctgcggatcgcccgttacctggacagcccggcaccgtccgcgccaccactgaccgcatcggcgtcaaccgggactgcatcggcgtcaggcgatgcaccatccccgccggccggtgctccgcccacgtcgtccgcggccgggcccacgtcggcggctgacacatcgacgtcgtccgccaccgcagcgacgtcagcagccaccggggccaggctgcctgccaccacagcgacgtcagcagccaccgggtccacgctgcctgccaccacagcgacgtcgaccgccaccgggtccacgctgcctgccaccacagcgacgtcgaccgccaccgggtccacgctgcctgccaccacagcgacgtcgaccgccaccaggtccacgctgcctgccaccgcgtcgacggctaccgcctcattcgatcggcgcctgccgaacatcgccgactactggccggatgcccccggccgccggaaagccggctggcagggtctgctcccgggtgcgggtcgccggcagggcccactcccgggcgggggcggcgaccacagcgccggcagccgccatcctgaccggcggccggctaccggccgcggtagcgacattccggattcgtctccctcgtcccggcgccggcgccgtcggccggtcatcctcgccggggtcctcgcgctgctggtcatcatcggatcggtattgctcgcccgcccactcaccaactcggacatccatcagcgcgcggcgcccgtcgtgccgcccctgccgagtcaggtggtcattccgctcgaacccaggcccaccccgtcgtccgtcgcgccgagccatgcgcccagcatcccggtgatcccggtccggaccacggccgccgcccggttcgaactggtcaccggagtcaccgacctttcggtccgcaccgcccggctggacggcgacttcaaggtcagcggaccggcggacagcgccttcgacgacggcgtgctgcggctcagcggcaacggcgacggctccggcccggtcgaggtccagttgagcgaccagcgggtgtggcgcctgcggatcggcgccggcaccaaatcggtcaccctgaacctaggcgcgggcacgatcagccgcatcgacctgaacggcggcgccgaacgcatcgacatcaccctcggccgcctggccgcaaccctgccgatccggatggcgggcggggtgagcacctggcagatccgcaccgccggcgagataccggtcaaggtgacagtcgggcagggcgccggcgacatcgccttctacggcaaccatcagggcggcatcggcgccggcgccaccctgcgctccggtgacttcaccgccggccccgccctcgacatcaccgccaccgccggcctgggcaccctcgacatcgcccgagcctga

SEQ ID NO: 6735 - DNA, 819 bp, Actinoplanes utahensis
gtgagcgaccggcgcagcgcattggatcggatcgacaccacggtggcgcacccggcccggcgctacaactacctgctcggcggcaaggacaacttcgccgccgaccgggcctcggccgaggcgatcgagaaagcgatgccggccatccggctggccgccctggagaaccgggcgttcctgcagcgggccgtcaagttcctggccgagcgcggcatccggcagttcctcgacatcggcaccggcatcccgaccgcggacaacacgcacgaggtcgcccagcggatcgacccggccgcccggatcgtctacgtcgacaacgacccgatcgtgctcacccacgcccgggcgctgctcaccagcacccccgagggcgtcaccgcctacatcgacgccgacctgcgcgacccgcgcaccatcctcgacgacccggaggtgcgcgccaccctcgactgggaccggccgatcgcggtcatgatggtcgcggtgctgcacttcatccgcgacgacgaggacccgcagggcgtggtcgacaccatcctggacgcgctgccgcccggcagctatgtggtcgcctcccactccacgtgggagtatctgccggccgacgcgatcgccgcgctggaggccgccaacgccgacggccggttccgcgcccgcaccggcgagcagctcggcaaactcttccagcggctcgacctgctggagcccggcgtgcagtcggtgtccgagtggtggccgcaggaggcgtcgcagccccggccgtcgatcgaggacgtcgccttcaacgcgatcgtgggacaggtccgcgcccgggggtga

SEQ ID NO: 6736 - DNA, 1479 bp, Actinoplanes utahensis
gtgggtgacgaggcggccgagtactacgaccggatgctggtggacgcggagtggggcgaggcgttctgcctgaccatggtccgcggcctggccgaggccgacctgatcaccgcgttcggcggcgacccggcggccgtgctgccgcaggccgagctcgcccagatcctggacacgttcccgcacggcgcggaaccggccaccctggtcgtcaccagcctcggcgggtggcggttcggcatcgaggtcaacggcggccagggcaaccggccggaggtgctgcgccgggcggccgaggccggcgacggcacggcgctcagcgtcttccgggacgtccgcggccgctccgagttcacgctggtccgcgacgggcgcacgatggtggtgctggaccaggtgcggccgcagcggcggtccggggaggagccggggctgctcgacgaacacgtcggccggctgcccttcggccaccaggacgacatcattcccgaggcggccggtctggccctggcggagcggctcaccggcgtacggctgcctcccgatcttctggaccgggatctgcccggcgtggtgttgactccggtgcccgacgatctcgtcccggagggcgggcgcggcctggccgcgctcgaccatccgttcctgcggcggatgctcgccgaaccgaccgcggcgaacgtgccggcgatggccgcgttccgggcgcgactgatcgccgaggacgccgggctgatcggcgaacccgcggtgcgggagacgctgaaagctctggaagccggacgtgaaccggcgccggaactccgggcccggctgcgggacctgcacgaacgcgacgatccgcaggtgatgaacgcggtgcgggacatcgccgcggcggctttccccgccgatggggaccggttcgggaccgcgtacgcgatccgggacagcgatcgcagcctgcaggcgacggtgctgcggcggtgcgcccagcgggcactgcgggacgcgccgccccggccggtgatgccggccccgagcccggcggtgtcctcggcgtacgcggcggtggccaaacagttcgccacctgggacccggataagcagcggcgggtgacccggtggctggcgcggcgggcgttcgaggtggccgggctggacaccctggactgggcgcggcccgcgctggaggcgctcgatcgcggggcgccgctgccgttcccggaccggcgggcggtgttccggctgatctccgcggcggcgctggtgaccgcggcgaccggcctgccgctggaccggctggaagaccggctcaccgaggagcagcgggccgacctgcgagaacgcatcgaccgtgcaccgatggcggtgatcacgatcttcaacaccgccgacccggacccggcgcgggcgctggccgacacgttcgccacggcgctggacaccttccacggacgcaccggcgaactgctggtggagatgcacgcccggttcgcctga

SEQ ID NO: 6737 - DNA, 747 bp, Actinoplanes utahensis
gtgggaccgcgcaccgcgccggacgcattccgctatggtcgacggttccattccggcacgattgccgccgcgcaccccggccgcccgcaccggatcggcccgtattccggtccaccaatcggtggcttttctgttctccttttggtgaataggcaggatccgcgccgctgtgacagcctttttcctgtgacggtgcgccgggtgacgctcgcggagatcctctccttctaccgtcccgcggtcggcggtgacacgtgggagcaggccatccccgatctgctggccgaccccgacgacgcccggatcgtcgacctgctccggtccgaactcgtcgcgcacggcgatttcgccgaaccgatcgtcgtcgaccagcaggaccgcgacattctcaacgggatgcaccggatcgccgccgcggtgctgaatcggcagtcggcgctggacgtcgccgacacctacgcggatctgccggagaaacggcgggttctcgtggttctcggcgccgaggcgctcagcgccgcggtcgtggaccggctgaccaaggtgctgtggtcgttcccgttcgccggtggctggaccaactgtgacgtgatgttccccggtgacggtcgggtctccggctggtggcactgcccggacgggagggaccgggcgctcggcgacgagctggtgatccgcgccgccgaggccgggatccggctgaccgtggagtcgatcaccgaggtgaccggggccgatccggggtga

SEQ ID NO: 6738 - DNA, 1212 bp, Actinoplanes utahensis
atgacgcctcgaccctccgccgacccggcgatcggcgaccggatccgggaccgccgcctgcggcgtggctggagcatccggttcgccgcgagccgtgccggtgtctcacacgccacctggagccggatcgagcgcggccggcaggccgccgacaaccggttcatgctcgccgatctggccgccgccctggactgttcccccgccgagctggccgggacggcggtgccggccggggatcgggaggcggtcgccgcgcacgccgccgtgcacgccgtccgccaggccctggtcgacctggacctgaccgcgacgcctgcctcacttccggcactcccgtcgctcccggaactgacccggacggccgcgctgctggacacgctgcggcaggcctgcgactacgccggcgccggacggctgctgcccgggctgctccgcggcctgcacgccgcgaccggctccgagcagcggccggccgccctgcggctgctctgcgaggtcaccttcatcgcctcgtcggtgctgcgcaatctcggccatccggccgaggcatggctgggcgcggaacgctgccgggacgcggccgaggcggcgcgggatccgatcctgcgggggtacgccggttattcgcgagccgccgcggccggcgcgtgcggctcctacgaccgcgcgtacacgctcgccgcgcaggcggtggacgagctgcgcccgcacgcggcccgggccggctggccggagatgaccggctcgctgcagctgatctgcgcggacagcagccgcggccggaaacgctccgacgacagccgggcctggctcaccgaggccgccgcgctggccgcccgcaccggggagaccaccacgctcggcctgtacttcggcccgaccaacgtgaacgtgtggcgggtcggcatcgaatccgacggcgacgagccgggccgggcggtggcgatcgcccgggagaccgatccggcggtgctgccggtcgggttccggcaggtgttcttctatgccgacacggcgcgcgccctgacccggctgcgtcaccgggaccgggaggcgatccggttcctgctcaccgcggaacgggtggcgccgcagcacgtgcacacgtcgtcgctggtccaggagaccgcgcgggcactgctggaccggtcgcgccgggcggccggcggcaccgagctgcgtgccctgtgcgaacgcctgcggatcggctga

SEQ ID NO: 6739 - DNA, 2490 bp, Actinoplanes utahensis
atgacgctgaccgatcgccttcccggcaccgccgaacccgacgccgtcttcgaagcctttcaatcctgggtgacggagcagggcctcaccctgtatccgcatcaggaggaggcgctgatcgagatcgcgaccggctccaacgtcatcctgaacacgccgaccggctcgggtaagagcctggtcgcggccggcgcgcacttcgccgccctggccgacgggcgcaccaccttctacaccgccccgatcaaggcgctggtcagcgagaagttcttcgccctgtgcacgatcttcggcgcgcacaacgtcggcatgctgaccggcgacgcgagcgtgaacgcggacgccccgatcatctgctgcaccgccgaggtgctggccaacctggcgttgcgcgagggtgcccaggccgatgtgggccaggtggtgatggacgagttccacttctacgccgagccggaccggggctgggcgtggcaggtgccgctgatcgagctgccgcaggcccagttcctgctgatgtccgcgacgctgggcgacaccacccggttcgtcgacgacctgacccgtcggacgggacgggagaccgcgaccgtcagcaacgccgagcgtccggtgccgctgctcttcgagtacgcgatgtccccgctgcacgagacgatcgaggagctgctcaccacgaagcaggcgccggtctacatcgtgcacttcacccaggcggccgcgctggagcgggcgcagtcgctgatgagcatcaacatgtgcacccgcgacgagaaggacgcgatcgccaaggcgatcggcaatttccgcttcgcggccggtttcgggcgtacgctgtcgcggctgatccggcacggcatcggcgtgcaccacgccggcatgctgccgaagtaccggcgtctggtggagaccctggcccaggccggtctgctgaaggtgatctgcgggacggacacgctcggcgtcgggatcaacgtgccgatccgcaccgtgctgttcaccggcctgtcgaagtacgacggggtgaagacccggctgctcaaggcccgggagttccaccagatcgccgggcgcgccgggcgggccggctacgacaccatcggcacggtgatcgtgcaggcgccggagcatgtgatcgacaacgagcgcgccctggcgaaggccggtgacgacccgaagaagcggcgcaaggtggtccgcaagaagccgccggagggtcagatcggctggggccggcccaccttcgaccggctggtcgaggcggatccggagccgctcacctcgtcgttccaggtgtcgcacgcgatgctgctcaacgtggtggcccgcggcggcgacccgtaccaggcgatgcggcacctgctcaccgacaaccacgaggagccggccgcccagcgccggcacatccgccgggccatcgcgatcgcccgcgcgctgatcgccggcggcgtcctggaacgtaccgacgagggcgtctacaagctggtcgacgacctgcagctggacttcgcgctgaaccaggcgctgtccccgttcgcgctggcctgcctggagctgctggacagggaggccccggagtatccgttagacgtggtctcggtgatcgaggcgaccctggaggacccgcgccaggtggtctccgcgcaacggcagaaggcgcgcggcgaggcggtcaacgcgatgaaggccgagggcatcgagtacgaggagcggatggcgctgctcgaggacgtgacctggccgcagccgttgctggagctgctggagggcgcgtacgagacgtaccggcgcggccacccgtgggtcggcgactacgagatcaagccgaagtccgtggtccgcgacatgtacgagcgggccatgacgttcaccgagtacatctccttctacgggctgtcccgctcggaggggctggtgctgcgctacctggccgacgcgtaccgggcgctgcgccagaccgtaccggaggacgcccgcaccgaggagttgggcgacctgatcgagtggctcggcgagctggtccgccaggtcgactccagcctgctcgacgagtgggagcggctgcgcaacccgggcgcggtgatcgaggaggtgcggatcgacgacaagccgcccgcggtcacccgcaacgtgcgcgcgttcaaggtgctggtccgcaacgccctgttccgccgggtcgagctggccgccctgggccgctacgccgagctcggcgagctggacggcgagacctccggctggaccacggaccggtggcgggacgcgatcgagagctacttcgacgagtacgacgagctgggcatcggctcgtcggcgcgcggcccgcagttcctgcagatcgagacgagcccggcgatgtggagcgtccggcaggtcttcgaggacccggccggcgaccgggactggggcatcgacgccacgatcgacctcgccgagtccgacgagatcggcggcgcggcgatccggatcgtcgcggtcggcccgcactga

SEQ ID NO: 6740 - DNA, 552 bp, Actinoplanes utahensis
gtgccggcgccgatctccgacggtgaccgtgaacgaaccgccgaactcctccagcacgcgtgcggcgacggacgcctcaccctggaggagttcagcgtccgggtcggcgcggtgtgggctgccgaaaccgacgccgagctcgcccggaccatcgacgggctgcccgcccagccggtggtcggatccgccgccaccgtcgacaaggtggtgaccatcttcagtcagacccggcggcgcggccggtggcggctgcgggaccggatcctgcgcaccaccaccctgttcggctccaccgagctcgacctgcggtccgtgctgaccggacaggacgtcatcgagatcagcggcacctgctggttcggtcagatgaccgtgatcgtgcccgagggcatggaggtcgacctgaccgggacacacgcgttcagccagcacgagctgcggctggcgccggtccggcggctccccggcacccccgaggtgcgggtcgcggtcaacgcctggttctcccaggtcaacgtggagtcccggccgcccgagctgcctactcgttga

SEQ ID NO: 6741 - DNA, 315 bp, Actinoplanes utahensis
atggcggtgctggccgacgccgatcacccgctcaccccgggcgaggtccgcgacgtgctcgatccggccggcgacgtctcgtacagcaccgtcgtgaccaccttgacccggctgttcgagaaggggtccgcggtccggcagcgggacggccgtgccttccgctacggcgcgccgcacggtccggccggcctggtcgccgaccggatgtcccggctgctggcgatcgagccggaccgcgcctcggtgctgcgccgtttcgtcggcaacctggacgccgacgacgagcgcctgctccgcgacctcctcaacgagtag

SEQ ID NO: 6742 - DNA, 387 bp, Actinoplanes utahensis
atggaggacgacgcgatggacggctgcacggtcacggtgtgccgggactgctgctgtggcagcgccggcaaacatcccacggtggaccacgacgcccagctcgaccggctcgcggcggcgctcggtccggctcaccgcgtacgccgcagtctctgtcttgatgtctgtgcccaatcgaacgtgctggtggtgcagcccacgccggcggcgcggcgcgacggcgcccggccggtctggttcggcctggtgctcgacgacgtggtgctcgacgacatctgcggctgggtgcgggccggcgggccgggccgcgccgacctctccccgatgctggaactgtccgtgatcaacgcaccccgcgccgcacccggcctgcccgccggccgatag

SEQ ID NO: 6743 - DNA, 144 bp, Actinoplanes utahensis
gtggcgcacctgctccgaccgcagccggtggcagccccgcgcgccgccgtcctgctgccggtcctggtcgcgctcagctcggtgctctggaccggggaggccaccctcgacctggtcgaactcctgcacagcgcgctccgctga

SEQ ID NO: 6744 - DNA, 1278 bp, Actinoplanes utahensis
atggaacggcgcagagtgctcgggttggcaggcgccggcgcggccggagtggccgtcgccggagccggtgcggtggccctgacccaccgcgactccgccgcgactccggcatccggcgccggctccgcggcggacgccgccggggcgattccgttctacggggcacggcaggccgggatcgtcaccccggcccaggaccggctgcacttctgcgccttcgacgtgatcaccaacgacaaggccgccctgatcgacatgctgcaggactggacggccgcggccgcccggatgacccagggccgggacgccggcacgttcggcgcggtcggcggctcgctggaggccccgccggacgacaccggcgaggcgctcggcctgcccgccgccggtctcaccctgaccatcggtttcggccccacgctgttccgcgacgcgcagggccgggaccggttcgggatcgccgcgaaacgcccggccgccctggccgacctgccgaaattcccccgcgacgcgctcgaggaggcgatctccggcggcgacatcggcgtgcaggcctgcgcccacgacccgcaggtcgccgtgcacgcgatccgcaacctggcccggatcggcatgggcaaggtcagcgtccgctggtcccagctgggcttcggccgcacctcctccacctccaccacccaggccaccccgcgcaacctgttcggtttcaaggacggcacccgcaacctcaaggcggaggagccggcccagctcgacgagcacctctgggtccagcccggcgacggcccggactggatgaccggcggctcctacctggtcacccgcaagatccggatgctggtcgagacctgggaccgctcgtcgctgaccgagcagcagacgatcatcggccgggacaagggcgagggcgccccgctctccggccggcaggagcacgacgagccggacttcaaagcccaggacggcgagggccagccggtcatcccggtcgactcgcacctgcgcctggcccacccggatcagaacgccggcgcccgcatcctgcgccgcggctacaacttcgtcgacggctccgacggcctgggccggctgaacgccggtctgttcttcatggcctaccagcgggacccgcgcaaacagttcgtccccatccagaaccagctggccaaacaggatgccctcaacgagtacatccgtcacacctcgagcgccctgttcgcctgcccgcccggcatgccggacgccggcgactactggggccgcaccctgttcacctga

SEQ ID NO: 6745 - DNA, 1137 bp, Actinoplanes utahensis
atgaacaccgcacgactgctgaccgcaggcgccgcagccgcgctactcctgacgggatgcgccgacaagggcgccgacaaagcgggttcgggcgccgccggcaccggcaagatcacggtggcggcctcggacaccgagtgcaaggtcgaccgcggcaccgccggcgccggcacggtcaccttcggcgtcaccaacaagggctccaagatcaacgagttctacgtgtacgcggccggcgaccggatcatgggcgagatcgagaacatcgcgcccggcctgtcccgcgagctgatcgtcgagctccccgccgggtcgtacgagaccgcctgcaagcccggcatggtcggcaagggcatccgcaacgccttccaggtgtccggttcggccgccccgctgaccgaggacgccaagctggcccaggccaccgccgactaccagcgctacgtcaagtcgcagaccggcgccctgatcgaacagaccaccgcgttcgtcgccgcggtcaaggccggcgacgtggcgaaggcgaaggcgctgtacccggtcgcccgcacctactgggagcggatcgagccggtcgccgagagcttcggcgacctcgacccgaagatcgacgcccgcgacggcgacgtggaggccggccaggagtggaccggcttccacaagatcgagaaggacctctgggcgaccaaggacatcaccaaggacggcccggtcgccgatcagctgctcaaggacgtccagaccatcgtcaccaaggcggaatcggtcaccttctctccggtggagctcgccaacggtgccaagggcctgctcgacgaggtcgccaccggcaagatcaccggcgaggaggaccgctactcgcacaccgacctgtgggacttcgccgccaacatcgagggctcgcagggcgccatccaggccctccgcccggccctgcaggaccgcgacccggccctggtcaagaccctcgacgacaatttcgccaaggtccaggccgcgctcgacaagcaccgcgccggcgacggctggaagctgcacaaccagctcacccaggccgacctcaaggaactcagcgacgacatcaacgccctcgccgaaccgatcagcagggtggcggcgctggtcgccaagaagtaa

SEQ ID NO: 6746 - DNA, 846 bp, Actinoplanes utahensis
atgaccgccatctacctcatcggactgcgtgagggcctggagatcacgctcgtggtctcgattctcgtggccttcctggtcaagagcgaccggcgtccgctgctgcgcccggtctgggccggcgtcgcgctggccgcggtgatctccatcggtttcgcggtcctgctgcaggtcggcatcgccgagctcagctccaccaaccaggagctgttcgaggggatcgcgtcgttcgtcgccgtgctcttcgtcacctggatgatcttctggatgcgccggatggcccgccacatcggcgcggacctgcgcgaccggatggagggcgcgatccaggtcggcccgctcgcggtggccggcgtcgcgttcctcgcggtgatccgggagggtttggagacgtcgatcctgttctacgcggccgcgcagggcgccaccgacgccaagccgctgatcggcatcacgctgggcatgctcaccgcgatcgtgctcggctggctgctctacttcggcgccgtcaaggtcaacctcgggacgttcttcaagtggaccggcgcgctgctggtgctggtcgccgccggcatcttcaagtacggcttccacggcctgcaggaggccaacgtcctgggcggtctggacaagaccgcgttcgatctgaccgacagcttcccgcccaccgcgtggtacgcggagctgctccgcggcatgatcaactttacgcccgcgcccaccgtgatcgagacggtcgcctggctggcgtacgggatcccggtcctcattctcttcctctggccggcgcgcccccagcgcccggccgccgcctcccccaccacccccgccaccaccgcctcctag

SEQ ID NO: 6747 - DNA, 543 bp, Actinoplanes utahensis
gtggtgaacttcatcgatccgaccgaccgggcggtctggcggcccctgtgggatctgcaggcggccctggacgccgacatcgcccggctctacgccgcggccgacctcggcgggctcaagagcacctgggtgaaagagctgatcaagctgcatgccggcgggccgatgacgatcaccgagctggccgcggcggtggggcggacccactcggcgatgagccagaaggtgtccgcgatgcgcgccgccggatgggtgcggaccacggccggggctgacgggcgcaccaagaaggtggcactgaccgccaaggccgcagcggtcgccgaccggctcgccgccgaatggcgggccaccgaggaggccgtcgccgagatcgaagccgagattccgtacgggatgctccgcgtcgtgcgtgacatcgaagcggccctaagccgcaagagcttccgcgaccggatcgccgagcggctcgccggggacccggcgtggggcctcgccggggatccggcctgcggcctcgccggggatccggcgtggggctga

SEQ ID NO: 6748 - DNA, 1260 bp, Actinoplanes utahensis
gtggggcctcgccggggatccggcctgcggcctcgccggggatccggcgtggggctgagtgcggcgctgatcgacctccggccgctgcggagctcgccggccttccgccggttgtgggcgggcgggctgctgtccgggctgggcacgcagatgaccctggtcgccgtgatgtaccaggtgtggcggcagacccacagcacggtgtggaccggcgcggtcgcgctcgcgcaggcgctgccgatcgtggtgttcgggctgttcgccggcgcgctcgccgaccgggccgatcggcgccggctcagcctcggcaccaccgccggactcaccctgtgctccgcgctgctcaccgtgcagggcttcctcgggctgctgccggtcaccgggctgctcgccctggtcgtcgtgcaggcctgcttcgtcgcggccggcggccccgcccagcggaccttcctgccccacctgctcacggccgaggaactcccggccgggctcgccctcaagcacatctcgttccaggcggcgatgctcgccgggccggccctcggcggcctcatgctcggctggctcggtgtcggtggctgctacctggtcgacaccctgaccttcctcgccgcgctgtacggcatcgccgggctgccgtccctgcccggcggcgccgaacccggccgctccgggctccgcgccgtcggcgaaggactgcggttcatggcgcacaaccgggctgtccgcggcgccctgctcaccgacctcgcggccaccgtgctcgccatgccgatcagcctgttcccgctgatcaacgcggaacgcttcggcggcggcgaacgcaccttcggactgttcctcacctcggtcgcggtcggcggggtgatcgcgtcgctgctgtccggcacctacacccggctcggccgccccggcctgaccatgctcggcggcgccatcctgtgggggctggcgctcgcggcgttcggtctggtcaccgacccgtggctgagcctgggctgcctggccctggccgggctcgccgacaccgtctccgtcgtgtcccgggccaccgtcatccaacagcacaccccggccgcactgctcggccgggccgccgccgccgagcagatcgtcggccaggccggcccggacgtcggcaacatgcgggccggcctggtcgccggagcattctccggaccggtcgcactggtcagcggcggactgctgtgcgtcctcgcggtcggggtgatcgcccgcacctcgtcaccgcgggcgtga

SEQ ID NO: 6749 - DNA, 468 bp, Actinoplanes utahensis
atgaggaagtggattttcgccctgcccgcgttggcactggtcgccggtggttgcggttcggctcaggccacccagcccgacaaggtcaccggcctgcacgacaagtgggtgtcctgcgaacaggcgcgcaaggatgaggccggcgcaccgtccggcgcccggctcaacgacgcgttcaagccggtcgccgcggtggtctgccagatccggccggtgccgcgggccgatggcagcagcgcgccggtggagcagcgggtgaccgacatctcggagctggtcacggctctgcgcctgccggatgacacggcgtcccggtcgccggtctgcaccaagatcttcatcgcgccgccgtggatcgccctgctcgacgaccagaaccggtggatccacccgtcgatcccggtcgaccagtgtcacaagccgcgcaccgaggtgctgaccgcggtcgggaagtcacgcccgcggtga

SEQ ID NO: 6750 - DNA, 642 bp, Actinoplanes utahensis
atgaacgtcgacgacttctaccgtgacgtcgcccggatcgccttggcggtcgccgacaagcacgggttcgttctcggcggcggcgtcgcctggctggtcaacggactggtcgcgcggccgaccgaggacatcgacctgttcaccgacacggcgggcggggtgaccgcggcggccggcgaggtgacctcggcgctgaccggggcgggctaccgggtggtccgcgaggagggcgacgaactgtttcccggcatggacgccgacatccaggagttcctggtcgccggcgagcatcgggcgctgcgcctgaccctgtgccgcctggaccgccgccgcaccccggtggtgatggacctgggtccggtcatgcacctggacgatctcgtcgccaccaaggtcgccgcgctggtgaaccgccgcgaggtccgcgactacatcgacgtcgcggccgcgctcgaacggtatccgctggatcggatcctggagttggcgtacgccgccgatccggccctggatccggaggacatcgccgacgcgggccgttacctggaccgcctggatgatgcccgcttcaccctgtacggcctggatcccgcccagatcagcgatcttcgtgaccggctgtccgcgtggccccgcgattag

SEQ ID NO: 6751 - DNA, 342 bp, Actinoplanes utahensis
atgtccgcgagcgccgcacccgttgtccacctggctcggccgcaccggccggtggtggtggccggcaccctggcggaattgcgcgggccgacgtgcgggttcgtcgagttgccgttgcgcctgtggtggcatccgcagcgggcgttcgatctgtcgcagcgcacgatgctcttgtggatgtatgaaaatgtgctgcgggaatcgatccgggtcgacgagttgcgcgcgtttctggatggcgcgaccctggtccgggtctggtccgagctgaaccttccgcgcggcgtccgcgccgcctgggaggcccggcatcccaggctgcggctccgcgcggccgcctga

SEQ ID NO: 6752 - DNA, 858 bp, Actinoplanes utahensis
atgatgggcatgcggatgccatatgagtcgaccgggcgcacccggcagaagtcccgcacccggcaggcgctggtcgaggccacccgtgagctgctggccgacgggctgacgccgcgggtggaggacgccgccgcacacagcggcatctcccgcacgacggcataccgctacttcgccaaccagcactcgctcctgctggcggcacagccccagatccagcccgacacgctgctcgatgccaccgccccgaccgagcctcgcgcccggatgacggcgttcatggacgcgttcacggcctacaacctccagtgggagccccagctccgctccgccctgcggctctccctggccgctccacgggacaccgccgtgccgacccctgaccgtccagagctccggttcgcagctgcccgcgcccacaccggccgccacgacgacaccgtttggcacgcaccgcccccagctgcgacacggcaggggcacccggacagcgaccccacctcgacgcagccggacagcagtgcaccagccggtaccgacagcagtggatcagccggcacggagcagcccctcctccgccgcggcagggcaatcggctggatcgaggacgcacttcgcccccttgccgacagccaccccgccatcgaccggcggtccctcgccgtcgccatccgatccgccaccggcatcgagtcactgatctggttgatcgacatcgccgcccagacccgtgaccaggccgccgcgaccgttcaaggcaccgccctggccctcttggacgccgccatgaaccaagccccacctcagcaagccagccgagcagacaacggcctccaccggcagcccacaccggggtag

SEQ ID NO: 6753 - DNA, 342 bp, Actinoplanes utahensis
atgagcagtcacgatccgatccagaccgatcccgacctctacaaggtggtcttcgagaacgagcgcgtgcgcgtcctggaatatcgggatgcaccaggagacaagacccatactcatcggcatccggacagcgtgatggtgaccctcagcagcttccggcgccgggtcagttccggcgatcaggctgtcgatgtggagctgcccgcgggcgccgtccgctgggtcggggcgcaggagcatcaaggccacaacgtcggggacaccccgacgcacggcatcttcatcgagctcaaggagaagcccgcggttcaggttcccgggctgctcggcccacagacctga

SEQ ID NO: 6754 - DNA, 645 bp, Actinoplanes utahensis
atgtcgatggattactacctgttggccggggacgttctgctggtcgaggagttcacctacggaccggaccacgtcaccgttgccctgagcggcgcgatgtggtcggcgggtagcgacggctggtctgacgcgggcagcttcggccgcctgctgcgcaccaatgagcagttgctcgccacggccacgccgatcacccgcgatcgggcggagcggattcatctcgaactcagtggtggggccctgccgaccgaggcggctctgcgcggagtgttcggagaagtcgtacgcttcgcgaacgccgcgccgttgcgcttgagcatggacgacacccccgacggctttcaggagaagcggatctatcgagtgctgttcgccaaagaaccgcgagccgcacaactggccgaactgtccgccgcctggcgcggcaccaccggcgggggcatgccctccggcaacgggcgggccggtgaccacctgttcacctggaatctgcgccgggtcggccagggcatagcctgggggctcgacgtgaccgtgctgctgggcgccgaaaccgccgacatcaccggcaccgtcctgcggaagttgaccgccgacgtacgccgtcagggacttgtcccgctgacaacggaaagattcgcctga

SEQ ID NO: 6755 - DNA, 669 bp, Actinoplanes utahensis
atgggacccgactacctggcactcctgcgtaacgaactgaccaccttccagtcgcgcctgaccggtgacctggacgccccggtcgagcactgcggcgactggaccctccgtgacctggccggccacctggctcagggcaacctctgggcagccaccgcggtcaccgaacggcacggccgtttccaaggcccgcccgccccggacgacatcgccccgtgggtcgaggaatccagccgcatcctcctcgccactctgtccgccgacccggacaccgaagcctcgacattctggccaccgcgaaccgtcgccttctggcgccgccgccgctggctggaaaccctgatccaccgctgggacgccgaaaacgccctccacctccccagcgaactcgaccccgcatggtgcgccgacggcattgccgaagtcggcgacaccttcctcccgcggcagatcgcactcggtcgcattcccgctcccaccgcggccgtctgtttcgccgccaccgatctcgccgagtcatggaccctgggcgagggcgacccgatcaccaccctctccggtccggccgcggacatcctgctcgcgctgtggaaccggctcccttggtccagcctcaccggcgaccacgaagccgcccgcaaggcactccccggccccgtgactccgtaa

SEQ ID NO: 6756 - DNA, 408 bp, Actinoplanes utahensis
atgggcgggaccctaccgaggactgacactgggagggtgccccttggacgcttgcaccatgtgattgtggactgtcccgagccgcgggagcttgccgagttctggagcgcggtgctgggggaaccggtcacctacgacgacggtgacttcgtggtggtgtcggctgatacgaccacgtccgggttggcctttcagcgggcgccggaccatcgggcgccgacctggccggatgcggcggtgccgcagcaacttcacctggacgtcatggtggaggacgtggcgctggcaggcgcggcggtggtcgcgctcggcgccgtggcgttgcctggtgatcacgtgttcgctgacccggcggggcatccgttctgcctcatcccgcggcccggctgggcgccgccaatgcaatag

SEQ ID NO: 6757 - DNA, 576 bp, Actinoplanes utahensis
atgacgcaagacggagagttggatgttctggtccggcagcggatccgaggcctccggatcgcccgcggctggaccctcgacgagctggcctcccgcgcctacctcactccgtcaaccttgagccgcatcgaaaccggccaccgccgcatcgccctcgaccagctggcccccatcgcccgggccctcggcaccaccctcgaccagctggtcgagtcaggccgcgacgaggacgtggtgatccgcccccaccacgacgactcccgcggcatgaccacctggctgctgaaccgcgaaggcgcccccaccggcatgaccgtcgccaaactccggatcgaccgccccgtcccccaggacttgagagtccaccccggccgcgactggttcgtcgtcctcgccggcaccatcacgctccgcctggccgaccgcacgatcaccgtccgagccggcgaagccgccgagttctccaccatggtcccgcacgccttcggctccgccggcggccccgccgaagtcctctgcatcctcgaccaggagggcgaacgctcccacctccgccctcaccatccccactcctga

SEQ ID NO: 6758 - DNA, 939 bp, Actinoplanes utahensis
atggcgaacgaacacggtcacggcgggcagcacggtaacggtgagctcaggggtgacgcgcagctccggcatggcgggcatgggcatggcggcgacggatccggcgggcatgggcatggcgggcatgggcatggcggccatgcggacggcggtgacgggtccgggcttgctcagatgcttgatcttgatgcggaggtgttgggggactactaccgggagctgatggactgggctgcttcgctggtgccgggggagccggcaatcgtcgacctcggggcggggaccgggacgggaaccattgcgctggctcggcatctggtgggggctcgggtgaccgcggtggatgtcgatgaggagatgcttgccctgctgcggcagcgggtggatgcggcggggctccgggacagggttcggacggttcgggcggatctggacggcgactggccggcgctcggggcggcggatctggtgtgggcttccgcgtcgatgcatcatctggctgatccgcagcggaccttggagcaggtcaaggatgtgctgcggccgggcggcgtattcatgatcacggagctggacgggttcccgcggtttctgagcgatccggcgggtgtggcactggaggaacggtgccatgccgagctggcgcggatgcggttggagggcggcctgcacatgggtgaggactggggtgcccggcttacggcggcggggttcgcggtcgaggcggaacgccgcttcgacatcgacctgacaccgccgttgccgccgcaggccgggcgctacgcgcaggtgacgctggagcgcacggcgagccggcttgctgatcggctcagcggcgacgacctcgcggcgctgcgcgactacgccgcgagcgcgccggcccggtccgacctgaccgtccgcgccacccgcgacgtctggatcggccgccgcccctga

SEQ ID NO: 6759 - DNA, 747 bp, Actinoplanes utahensis
atgacgatcgacgtgccgtcctgggccgcctcggccgcccgggaactcccgtatcccctggtcttctgcacggtcagcggggcccacctgtacggtttcgcctccgtcgactcggacctcgacctgcgcgccgcccacgtgctgcccgccgccgaggtcgtcggcctgcaccacggcccggaaaccctgcagcgcggcggcgtccgcgacggcgtcgaactcgacgtggtctcccacgacctgctgaagttcgccaagctgctgaacagccgcaacggttacgtgctggagcagctgctgtccccgctggtcgtggtcaccagcccgctgcacgaggcgctgaccgcgctggcacccggcctgatcacccggcatcacagctaccactacctgggcttctcacacagccaggagaagctgtacgcgaaaaccggcgaactgaaaccggcgctgtacaccctacgggtgctgctgaccggcatccatctgatgaggaccgggcgcctggagacggatctgggcgtgctgggggccgagatcgcctacgtcccggacctgatcgccgccaagcgcgaggccgaacacggcccgttcccgcccggagtggccacccgcctggccgccgacatcccccgcctgcgcgccgacctggaagcggcgaaggacgcctcggcgctcccggaccgccccgccgaagccaccgtcaccgccctccacaacctgatcgtgacgacccgcctgagctga

SEQ ID NO: 6760 - DNA, 675 bp, Actinoplanes utahensis
atgacggaccttgtcgagaagcacacgatcctcggggtcgtggtcgggtcccgcgcctacgggctggacgggccgggcagcgaccacgaccgccggggcgtctacgcggcgcccacccgggacttctggcgcctcgacaaaccgcccacccatctcgacgggccggtcgaggagcagttctcctgggaggtcgagcggttctgcacgctcgccctgcaggccaaccccaccgtgctggaggtcctctggtcgccgctggtcgaaacggtcaccgcggacggcgaagagcttcttgccgcgcgtacggcgttcctctcccgccgcgtcgccgacacctacggcaactatgcccgcgatcagctggaccgggtcgccgcccgtcgggcccggaccggggagaccaaccacaagcaggcgatgcacatgatccggctgctgatcgccggcgcgcatgtgctgcgcaccggcgaggtgctggtcgacgtgcgcccgctgcgggaccggctgctcgccgtcaggcacggcgagctgtcctgggaggcggtcaccggctgggccgccgacctgctggccgacctggaccgcgcccggtccgagacccggctgccgtccgacccggaccgcgaccgggtcgagcacctgttgaccggaatccgccaacggaggttgtcatga

SEQ ID NO: 6761 - DNA, 996 bp, Actinoplanes utahensis
gtgacctactcccctgccgagaaccgctacgcgtccatgacgtaccgccgcgccggccgcagcggcctcagactccccgccatctcgctgggcctgtggcacaacttcggtgacggccgccccgccgaccgccagcgcgacatcgtccgccgtgccttcgacctcggggtcacccacttcgacctggccaacaactacggtccgccgccgggcagcgcggagaccaacttcggccgcatcctggccgccgacttccgccaccaccgcgacgagatgatcatctcgtcgaaggccggctacgccatgtgggacggcccgtacggtgacttcggctcgcgcaagtacctgatcagctcgctcgaccagtcgttgcggcggctcggcgtcgactacgtcgacgtcttctaccaccaccggcccgacccggagacgccgctggaggagaccatgtccgcgctggaccggatcgtcagatccggcaaggcgttgtacgtcggtctcagcaactacaaggccgagcagaccgcccgggccgcggcgatcctgcgcgatctcggcacgcccctgctgatccaccagccgtcgtactcgatcctgaaccgctggatcgaacacgacaacctgctcgacaccctcgaggaggtgggcgccggctgcatcgcgttcagcccgctgcagcagggcctgctcaccgaccggtacctcaacggcatcccggacgactcccggatccgcaccagcgtgttcctcgacgaggacgccctggacgccaagactctcggccggctgcacgcgctcgacgacatcgcccagcggcgcggccagtcgctcgcccagctggccctggcctgggcgctgcgcgacccgcggatgaccagcctgatcatcggcgcgtccagcgtgcggcagctggaggacaacatcgccgcgctgaccaacccggtgctctccgaggccgagctgggcgagatcgacgccaccgtcctcgacctgtaa

SEQ ID NO: 6762 - DNA, 2811 bp, Actinoplanes utahensis
atgacctcgtcattcacgcaccgccacatcggcccgcaggccgacgagcaggcggcgatgctcaaagccgtcgggtacgcgtcgctcgacgagctgatggatgccgcgatccccgagtcgatccggttccgtggcgacctggacctgccctccggtgcctccgaggaggagacgatcgccgagctgcggtcgatcgcggcccgcaacaccgtggccaccccgatgatcggcctcggctactacggcacccacacgcccgcggtgatcaagcggaacgtcctggagaacccggcgtggtacaccgcgtacaccccgtatcagccggagatcagccagggccgcctcgaggcgctgctcaacttccagaccatggtcaccgacctgaccgggctgaccaccgcgaacgcctcgatgctcgacgaggccacggcggtcgcggaggcgatgacgctcgcgcgccgctcctgccgcagcaagagcccggtgtacgtcgtggacgccgacaccctcccgcagacgctcgccgtgctgcgcacccgggccgaaccgctcgggatcgaggtgcggctcatcgacctggacgccggcgccgacctgcccgacgagttcttcggcctgcacctgcagtacccgggtgcgtccggcgcggtccgtgaccacgccgccctggtcgaggcggcgcacgccaagggcgccctggtcaccgtcgccgccgacctgctcgcgctgaccctgctgcgtgcccccggtgagatcggggcggacatcgcggccggcaccacgcagcgtttcggggtgccgctgggcttcggcggcccgcacgccggctatctggcggtgcgcgccggcctggagcgcagcctgcccggccgcctggtcggggtgtccaaggacgccgacggggcgccggcgtaccggctcgcgctgcagacccgggagcagcacatccgccgggagaaggcgaccagcaacatctgcaccgcgcaggtgctgctcgcggtgatggccagcatgtacgcggtgtaccacggcccggccgggctgcgcgcgatcgcccagcggacgcacgggcacgcgctgaccctggccggcagcctgagcgcggccggcgtcgaggtcgcccaccgggcgttcttcgacacggtcaccgcggtggtgccgggccgggccgcggcgatcgtcgcggccgccgccgagcagggcgtggacctgcgcctggtggacgccgaccgggtgtcggtcgcgaccgacgagacgaccacggcggcgcacgtcgccaccgtgctggccgcgttcggagtgccggtggccgaggccgccgagtgcggtgcgaaggccctggcccgcaccggcgactacctgcaccacccggtgttcaacacccaccactcggagaccggcatgctgcgctacctgcgcaagctgtccgaccgggactacgcgctggaccgcggcatgatcccgctgggctcctgcacgatgaagctgaacgccaccaccgagatggaggcggtcacctggccggagttcgccaacatccacccgttcgcgccggcgtcgcagaccgagggctacgaggacctcgtcgcccagctggaacgctggctcgccgagatcaccgggtacgacgcggtcagcgtccagccgaacgccggctcgcagggtgagctggccggtctgctggcgatccgcggctaccaccgctcgcgcggctcgctggggcgcgacgtctgcctgatcccgtcgtcggcgcacggcaccaacgcggccagcgccgtgatggccggcatgcgggtggtcgtggtggcctgcgacgagaacggcaacgtcgacctgaccgacctggccgccaagatcgagaagcaccgggacgcgctggccgcgatcatggtgacctacccgtcgacccacggcgtctacgagaccggcatcgccgagctctgcgagcgggtgcacgaggccggcggccaggtgtacgtcgacggtgccaacctgaacgcgctggtcggcttcgccaagccgggcaggttcggcgccgacgtgtcgcacctgaacctgcacaagacgttctgcatcccgcacggcggtggtggccccggcgtcggcccggtcgcggtccgcgcgcatctggccgagttcctgcccgggaaccccctggagcagggcgaccaccacgcggtctcggccgccgcgcacggctcggccggcatcctgccgatctcctgggcgtacgtgcggatgatgggcccggacggcctggcccaggccaccgccaccgcggtcctggcggccaactacgtggcgagccggctgcgcgagcacttcccggtgctgtacgccggggagaacggtctggtcgcccacgagtgcatcctcgacctgcggccgatcaccaaggccaccggggtcagcgtcgacgacgtggcgaagcggctgatcgactacggcttccacgcgccgaccatgtcgttcccggttgccggcaccctgatggtggagccgaccgagagcgaggacctggccgaactggaccggttctgcgccgcgctgatcgcgatcaaggcggagatcgaccaggtggccgcggggacctggccgcgggacgacaatccgctggcgaacgcgccgcacaccgcctccgcggtgaccgcggacgagtggtcgcacccgtacccgcgttcggtggccggtttcccggagggcgtcgaccggacggcgaaatactggccgccggtacgccgcatcgacggggcgtacggggaccggaacctggtctgctcatgcccctcgccggaggcgttcgagagctga

SEQ ID NO: 6763 - DNA, 201 bp, Actinoplanes utahensis
atgtgccagcacctgaatcaatgtccgcccgccgacgctatcgaccgggaggcggcccgtaccgtggcgaccttctgcgaacagggctggagcctgctctgcaacggcgtcatcgtcttcgaggacaccggcgagctgctgccggacggcacgacgatcgagccgcaccgcggtccggcccgccacgccctcgcggcgtaa

SEQ ID NO: 6764 - DNA, 963 bp, Actinoplanes utahensis
gtgtcggctgatgccggatccgtaatgatcaacgccactcccggcggccccagtccgatccccgtggtaccggacgtgtacgccgtcgtctgggtacacgccagcgtggccccgcccggttcaaccggagactgggaactcggttcctggcacgaaagctggaccaccgacgagcacgcccgggccgtccaggacgtgcgtgacgcgatcggccgcggtgacgtctaccaggtcaacgtggtggggcacgcggccgcggcgtacaccggaaatccgcaggcggccctgcgccgcgtcgccgccctgcccggcgcccgctacggcgggatcctcgccgacgaccgggccggctgggcgatcgccaccgcctccccggagaccctggtcgaggtgcgcgacgggcgcgtcgtcacccggccgatcaagggcacccggccggccaccgcggccggccgccgggaactgctcgcctcggccaaggagcgcgccgagcacatcatgatcgtcgacctggaacgcaacgacctcgcccggctccccggcaccggtccggtccgcgtcgacgaactgttcgcggtccgccgatggtgcggactctggcaggccgaatcggtcgtctccgcgcccctgacgggtgacgtcggactcgccgacctgctccgcgcggtctgccccggcggcagtgtcaccggcgcccccaagatcgccgcgttggcccggatcgccgccctggagccggtcggccgcggggtcagcatgggcgccctcggctggatcgggcacgaccacctcgacctggggctgagcatccgcaccgtggcggtcgacggccggcgggtgcacgcctgggccggtggcgggatcaccgcggacagcgatccggaagccgaggtcgccgaggccgccgcgaaagccgcaccgctgcgtgccgccctcgccgggacggtcaccgccaccgcatag

SEQ ID NO: 6765 - DNA, 570 bp, Actinoplanes utahensis
ttgacgcacgcgtttccccggacacggtccacagtgactgcagagaaggcaacacccatgctcgatgccctcgacccgcccgccgcggtggagttcacccgtttcgcgcgggacacccggcagcgcctgcacggcagcgccttccagctctgccgcgactggcacctggcgcaggacctgacccaggccacgctgaccaagctgtttctgagctgggagcgggccgcggacagcgacaacctttcggcgtacgcgcagaagatcctctttcgcacgtacgtcgatcatcgccggcgccgcgcctcgaccgaggcggccatcggcgagctgagtgagccggcctactcgatcgacccggacctgcggatcaccgtgctcgccgcgctcggccggctgcccgcccgggaccgcgccatcgtgctgctgcgctacttcgccgaccacagtgtcgagcaggtggccgccgagctggacgtgccgatcaccgtcgtgaagagccagacccggcgctcgctgatcaagctcaagcacatgctcgtcggtgaccgtcaggctctgcttgccgcgtga

SEQ ID NO: 6766 - DNA, 624 bp, Actinoplanes utahensis
atggcagccgtcggacacgacctgcgcggacgtctgatgcccgcgctcaactatccggccggggcgctgctgatcgtcgccggagtgcccggggccggcaaaaccaccctgctccagcggctcctcccgcacccgggtgtccggctgctcgactccggccaggcccgcgaggagttgcggccctacctcggcgcggtgccgtaccggtactggcgacccgtcgtgcacgcggcccactacgtgcggctgtaccgggcgctgcgacagcccggggccatcgtggtgcacgaatccggcacccgccgctgggctaccaggctgatcaccgccgcggcccgccgggccggccggcgcacccacctgctgttgctcgacgtcgacccggcgcaggcgcgggccgggcaggtggcccgcaaccggaaggtgcggcggtcgtcgttcgccgggcactgccggaactggcagcggctgctgcgatcggtggccgacccggccgatcggatccaccgggacaccgccaccatcaccatcatcgaccggccgctggcggccgggctgaccgcgatccggttcgacgggctgcacatcgttcccgcggcgcgggctctgcgtcgcgcggcctag

SEQ ID NO: 6767 - DNA, 240 bp, Actinoplanes utahensis
ttgcaccctgcccgggtgccgcacctcgtcctgccgccgcagcagcggcgcaacttccgggcgtacgccggttacaccaccgccccgacaggcccgcacgacaccggcacgctggtcgaggtgctgctccgggccggcctgctgctcgcggtcaccggctaccatcggcgcgtcgccgccggccgggccgcggacaaagccgggccacggacaaagccgggccacggcccgcctggctag

SEQ ID NO: 6768 - DNA, 489 bp, Actinoplanes utahensis
atgacgatccggccgattcggctctatggtgacccggtcctgcgcacccctgccgacccggtcaccgacttcgacgccagcctgcgcgagatcgtgcgggacctcgaggacaccgtccgggaaccgggacgggccggggtcgccgggccgcagatcggggtcgggctgcgggtgttctcctacaacgtcgccgggcaggtcggacacctgatcaacccggtgctcagcgacttcgacggggagcaggaggacgacgaggcgtgcctgtcgctgcccggcctcggatactccacgaaacgggccatgtcggtcaccgcacgcggcttcgaccagcacggggagccgctggtgatccacgggaccgggttcctcgcgcgggcactgcagcacgagaccgatcacctcgacggccgcctctacatcgacacgctgaccggcgacacccgccgccaggcgctgcgcgagctgcgccgggtcgtcccgcggtga

SEQ ID NO: 6769 - DNA, 651 bp, Actinoplanes utahensis
gtgaccgttcctgatccgaccgacacgcggcggtacgcggcgcagtcgctcgccgcgggcgatgcgacgggctggttcgagcggctctaccgcgacgcccgtgccggccgggcggtcgtgccctgggacgtcgcggcggcgagcgtgagcctgcgcgagttcccgctgccacccggtgacggccgagccgccctggtggtcggctgcggtccggggcgcgacgcggaacacctggccgcgctcggctacgcggtgaccgctttcgacatctcggcgacggcgatcgacctggcccggcagcggcatccggggtcgtcggtcgactaccgggtggccgacctgctcgacccgccggcctcctggcggcgggctttcgcgctggtgctggagagcaacaacgtgcaggcactgcccgcgcagatccgggcgcgggcgatcggtgcggtgggcgggttcgtggccgacggcgggacgctgctggtcctggccgcggcggccaccgacgacccggccgcggggccgccctggccgctgagccgggcggagatcggcgccttcgctgcgccgggcctgcgcgaggtctcggtcgaggagctggccacgccggggtcgcggttgccggcccgctggcgggccgtcttcacgcggtga

SEQ ID NO: 6770 - DNA, 555 bp, Actinoplanes utahensis
gtgggctcacggcgtacgcgccaatcgaaacgatcgggaggtcggcgaaggctggacgtgtccgcctaccctgtcgccgtgatcttgcgagggcgatggtcggtggccggcgcggcggtcgtggtcgtcatggccggtgtcgtggtctacgaagtccggaagccccggggggacgacctgccggacacggtgcgcgacggcctcgcggtggcggcccgggacgcgatcgagggcgccgccaccggtgaccggctggcctgcgcggtccgggtcatcggcgcggatccgccgacggcgacggccgcggcgcaggtgcgtacggcgtacgtgtggtcgttgtgcgagacggtcggcgcccgggtccagtccggatcgtcgatgccggccgcggtgcatctgaccgttccgccgacggtggagacgcccggtgacggtgtcgcctacggcccggacctcgagcggatcttccccgcccggctccgcgatgcggtcctcgacgtcgacggcgccgccctggagccccaggttcggcagcggatccgcgagcgctcctga

SEQ ID NO: 6771 - DNA, 432 bp, Actinoplanes utahensis
atgggtacctgggacgtcgggccattcgacaatgacaccgccgcggattggtgcggtgatctggacgaggccgccccggggcagcgagaagcgctgatccgcgatgcgttgaatagggtcgccgagcacggcgacgagtatctcgacagcgacgaggcagtggaggcgatcgccgccgcggccatcgtcgcatctcaactgccgggcgggacggcgattacgaccccctacgcacccgacttcctgctggagggcggccggatcgaggtacccgacgatatccccgccatcgcagtacgagctttggatcggatcgtcggggacgactcggagtggcgtgagctgtgggcggaggctgaggagtcgtatccgcaggcgctcgcctcggtgcaagccatccgcgacactctcgaacgggcgattcgccgctga

SEQ ID NO: 6772 - DNA, 564 bp, Actinoplanes utahensis
gtggcagccaacccggcaacatcccaagaagacctgatccggctcgtcggcgatccgcacccgcacgtccgctgggaggtggcagacaatcccgggtgcgacgaacacgtgcagcgcgcgatctgtgcgtcacccgacgaggatcttcgcttcaagctcgtctaccgcaaagacctcgcgcccgacgtagtagcggcgctcgttgccgacagctccgtcaatgtccgcagtgaacttgccttcgaaacggctgattcggtcgccttggccgccttgggcgccgactccgtcgccaaagtccgagccggcgcggcaatgaacacccgcacgacggccgagcaacgccgcgtcctcgccagggatcgctcagcgctggtccggtccgcactcgttcgcgccgtcaccctggaggagaaagacctccagcggctcgcccgagatcgatcggtagaggtccgctggcggatggccgccgcgctcattaccccacgacacatccgcgacatcctcagacaggaccctgacgcctcagtccgctcgcaggcggaggatccttcgtactaa

SEQ ID NO: 6773 - DNA, 618 bp, Actinoplanes utahensis
atggtgaccagcaaaatcggcaggatcgccataggcatggtcagcaccccgctgctgctgttcgtggcgattccgctcgtgttggccctgctggatgcggtgaccagcgcgggcaatcagacaggtgaaatggatcgcacgatccagtggatgttcgtgatcgaggtggcgcccttcctgaccgaaccgattcgcgagttcatcgacgcacgcgccgcggagctttcagtcagcgctgacgtactgtggtcagcctggcagttcaccgcgctggcgatcctggtagccggctttaccggggtgctctgggcccggattgcccggctgggattgtgtctgagcatcggtgggatgctctgggtgaccaccacaggcctgcaccggcaggcgacgctgagcttcacactggcgtggctgatgctcgaggtagtgctgagcatccggccggtcgaacgccttcgccggtcgcgcgcgatcgaactccttcgccggttctggcggaatctgacgcgtccgcagctggcgtcgtacgaacagcagcatctcgaaatcgaggtgctgccggaacattccctggatgctcgttcaggcacccccaacggccagcctcagcggtga

SEQ ID NO: 6774 - DNA, 519 bp, Actinoplanes utahensis
gtggaatctgatctgtcaagttgtccagcaatagccgaccaactggttgcgcggcgtccgaccgagggtccgtaccgcgatcggcacagtcccccgaccgaccgccgccgactacgcattgtcgcggagtcgagctctatccgagcagtctggcgtcagctggcgcgcggatcccggcagtgtccggctccgagcggaacgagctgggccgaagaccacgtcgccctcaccgcgatcatggggatcggacgggagaaggactgttccctggctgggcgctcgggcagccggttcctcatccaggagtggggctatccagagatcggcgtgtacttcgctgaccgtccttcggccggccacgacatgatcgcgttcgactaccgggactgcggcccccggggcgaaccgcgcgttgtccacgtggatcaggaggttgactaccggatcaccgtactggcgccggatttcgtcagcttcctccaagcgctgcggccggagagcgactacggctatgactga

SEQ ID NO: 6775 - DNA, 252 bp, Actinoplanes utahensis
atgacggtgcaggtgacaccggcagacgtcaccgaccgcgatgccgcccgcgagatgcttcctaagctgcgcaagaacaacccggaggtgaccctgatgtgggccgacaacgcctacacaggtctggccgaccgggcccgcaacgacctcaacctcaccttcaaggtcgtgaataggccgccgaaccgggtcggcttcaaggtgctgccccgccttctgtggaatctgatctgtcaagttgtccagcaatag

SEQ ID NO: 6776 - DNA, 1026 bp, Actinoplanes utahensis
atgcgttggcgagcagctgcagcgtggatgatggcgattattgtgtgcgtggcatcggcgggttgttcacaccgctccgggccgccgcagatgagctcggcggctcgtgcctacttggcgcgggcccttgatctgctccagcgcaattcgattgacgccggcgcggtcgactggccggtgcttcgggctaaggcctacgaggtggctgccacggcacagacgagcaccgacacctacgaggcgatccaccgggcggtctacctgctgcacgacgcgcacacccgtttcttcacccggaccgaggccaaccttgcgttcgaccaggccactatgtcggacggcccacccaccggacggattctgcccggcggctatgccctgttgacggttcccgcgatgagcggcaacgaccaagccgtggccgcctacatgaagggcggcgttcaagccgtccatgagctggatcaggaccacccctgcggctgggtcgtcgacctgcgcggaaacgggggcgggaacatgtggccgatgctcaccgcgctggcgccgctactcatcgggcccactctcggctacttcgtcgacgcatcaggtaagcgcagttcgtggatcctgcgggacggccaactgttcgtcgacggcagcccacagctaccgcaacccgacaactattcgttggcccgaccgcagccaccggtggcgatcctcaccgacccactcaccgccagcgctgcagaggccacactcatcgccttccgcggacaggcgaacagccgaacgttcggccaaccgaccgccggatttccctcagccaacgaggccttcgcactaagcgacggcgccgttcttctgatcacggttgccaacgacgccgaccgaactggccacgtctatcccaacctcgtcgcgatcccaccagatcaacccgtgtcgcattcaaagccgggccccagcaccccgcgcggagctgatccggtcatcgacgccgcgacccaatggcttgccggcacaccggcctgccggtaa

SEQ ID NO: 6777 - DNA, 453 bp, Actinoplanes utahensis
gtggattgcctcgcctgcgcgaccgacgcccggttcgacgacccgccgccccgcgagcggatcgcggccgacccgcactggcgggtggtccacgccttcaccagcacgctgcccggctggctggtgctgatcccccgccgccacgtcaccgcgatcgccgacctgaccgacgacgaggcggcggctctcggcacgtggcaggtccgggtgtcccgcgccctgcacgccgcgacccgctgcgcgaagacctacgtggtgcagttcgcggagcaggacggcttcggccacgtccacttccccatcgtgccccggatgccggacctcccggacgaccgccgcggccccgccgtcttccggtatcttgccaaggctccgacccagggcctcaccgaggcggagcgcgacgagctggcgctgacgctgcgcgcccacctggacccggccggttcctga

SEQ ID NO: 6778 - DNA, 1308 bp, Actinoplanes utahensis
gtgacaaccgaaaccggggcccgcacgagccggccggggcgcaggcgcgggctcgtcgaaacggcgtggctggctctgctcctggtcatcctctcgctgctcttcctcgcccggtacaacgatcctcgcaagatcgtcagcggtgacagcttctggtacatgcggcaggcgctgatgtacaccgggctgaccaagcaggaggcgcacaccgaggccgcccggcagatctgccgggagatcaaccggtcgctggtcgccaacgggcaccgccccgagtgcgtcgagtacacgctggccggcatctccccgcggtacatcgcgatcttcgacagccgcccgggctatccgctgttcgccagcccgttcgtggctgttctcggcgcctggaccggcatgatggcggccaccatggtgctggccctgctcgccgccaccctggcgtacctggccgtctggatggccagcggcctgcggctggccggcgtgctgagtgccgtcgccatgttcctgctgcccaccggcttcctgatgacccggatgctgaccgagggcggcgtcatggccggctatctcgcctcgatcatcggcggcatgctggtgctgcgcgggcggcggtccggtttcgcgatcatcgcggcctcgctggtctggctgttcgccttccgctcggccagcggcatggcgatggccctggccctactcgccgccggcgccctggccgcgctgcgccgggagcaccgccggaccagcctgatcctggtcgcgaccggcgccgtcgcggtgctcggctggcagctgctcagctcgctgctgcacctgccgagcctgaacgacaccattcaggactacgccaccggccacttcaccgcgaagccggacgtgccccacccgatcagctggctgatcgaccgtgacctggacttctggcccacccagctgaaggccgagctgaccgtgccgaccaccctggccgcgttcggcttcgcggtcgccgtcctgatcatcaagatgcgcccgtacgccccgctctggatcttcaccggtctgaccggtgtgatgatggtcgcggcgcacccgctgaaaagccagtatgaccgcctgatgctgcccctctggctcccggtcgccctggctttcggctacgccgccgcgctcgccctgcgcccggccaccgcccgcctcagcggcgccggatcggcggacgatcccaccgggacgcggcccgcgccggtcatcccgcaggcccgccgtcccgagccgagccccggcgaggcccgcccctacaacatggccggtgacacctggtga

SEQ ID NO: 6779 - DNA, 375 bp, Actinoplanes utahensis
ttgcccgcttccttcaaccacaccatcatcgccagccgggaccgctccgcgtcggcgcggttcttccgcgacctgctggagatcccggaggccccgtcctggggcccgttcgccaaccttcagctcaccgacggcgtgctgctgcagttcgccgagccgccggtcgagatccagatgcagcactacgcgttcctgctcgacgacgagctgttcgaccgggcgtactcccggctcgtcgagcaggagatcgtgcactgggccgacccgcagatgcggcgccccggtgagatcaacaacgagcacggcgggcgcggcgtctacttcaaggacccgtccggtcacgccatcgagctgatcacccggccctacctgtag

SEQ ID NO: 6780 - DNA, 222 bp, Actinoplanes utahensis
atgacgcaccggggccgggccagcgagatgctggccagtctggagggcaaactccccggcacggcgacggtgatcgcggccgcgcacgcgcacgccgtgctggccgtcgcggacgagttgcacgcgctgcgcgtgacgttgcaggagttgtccggtagcatcgtccaccgtgaacaccggaccggctctgcgccacgcacggatcggcgacccggtggctag

SEQ ID NO: 6781 - DNA, 123 bp, Actinoplanes utahensis
atggggcggctcagcagccggcgggcgttcgggcacaacggctcgaacgcctgcctcggctgggccgacccggaccgcgggctggtcatggcgtatgggatcggcccggcctgcggggagtga

SEQ ID NO: 6782 - DNA, 750 bp, Actinoplanes utahensis
atgaacacctacgacctgcgggatcgcaccgccgtcatcaccggagccgccagcggcatgggcgccgccaccgcggagctcctcgccgtctcgggcgcccgcgtcctcctgctctcccgccgccgtgaccggctcgaagacctggccgccaagatcatcgccggcggtggccgggctcaggcgctgccggtcgacgtcaccgacctggacgcggtcacggccgccgcggcgacggccggcgaggtggatctgatcgtcaacgccgccggcgtgatgctgcccaatccgatcgccgacggccgcgccgacgagtgggcccggatgatcgacacgaatctgaccggcgcgctgcacgtgctccgcgccttcctgccggggctgcgggccgccgcggccgccggccgccccgccgacctggtcaacgtgtcgtcgatcggcgcgcacgtgaccttcccgggctatgcggtgtacgcggcgaccaaggccgcgctcacccatctctccgcgtcgctgcgcaccgagctgggcgccgagatggtccgggtgaccaacctggagcccggcctgaccggcaccgagctgggcgaccacatcgacaacccggagctcgccggccagctgggcggcatgttcgagctgctgccggcgctgcgcgccgacgacatcgccgatctgatcgcgtacgtggtgtcccgcccccgccacgtcaacctgcgccaggtgatcgccctgcccaccccacaggcctag

SEQ ID NO: 6783 - DNA, 834 bp, Actinoplanes utahensis
atgaacggggaggcggaaatcggggcgttcctgcgggcacgccgggcggcgatcaagccgcaggacgtggggctgcccgcgctcggccgacgccgggtgcccgggctgcggcgcgaggagctggcccagctggccggggtcagcccggactactacatccggctggagcagggccgcgggcggaacgtgtccgatgcggtgctcgacgcggtcgcccgcgtcctcgggctcgacgagaccgagcggcggcatctgcaccgcctggcccggccggccatcgcccccgtgcgccggcagcgggtccggcccggcgtgcgactgctgctcgacatgatggagacggtgccggcgttcatcctcgggcggcggatggacgtgctcgcgtggaatgcgctcggcgacgcggtcaacgggttcagctcctggccggccgaccggcgcaacgtcgccaggcaggccttcctcgacccggcggcgcgcaccttctatccgcagtggaccgaggtcgcggccgagacggtggcgttcctgcagctcgacgcgggacggcatccgggcgacccgctgctggccgcgatggtcgacgagctctccggcgccagccccgagttcgcccgtctgtgggccgaccgccgggtcaaggagaaggcgtccgggaccaaggtcctgcggcatcccacggtcggtgagatggccctgggatatgagacgctcaccctgcccggcgagaccgatcagatgctggtcacctacaccgccccgatcggcagcccggcccacgacgcgctgcgcctgctgaccagctggaacgcacccacccgggcggtcgcatga

SEQ ID NO: 6784 - DNA, 615 bp, Actinoplanes utahensis
atgcgattcgagccgggtcaggtcatcattcggcggtatcggcgcgggccgtggcgcacgtgggcgcagccgatgcgggtgatccgggacgatgacgcggggctgctgctctgggcgcccgagggcggcgacttcgcccggctggtcgatgtggacgggcggaccacccgcgacgtgagccccgacctgatgcaggatccgcggctggcccggcacacctggcgtggcaacgacgtgctgatcctgatgccgcccggcgccggatactcggtctggtggttcttcgtcgccggcgggttcaccgggtggtacatcaacctggagaaaccggcggtccggcaggaggacggcgtcgagaccaccgacctggtcctcgacatcgtcgccgacccggcccggaactgggagtggaaggacaccgacgagttcgccgagctgaccggccatccgctctacttcgacagcgccgaggcggccgtgatcgaagccgaagcagcccggctgatcacgctcctcgaggcgggcgacttcccgttcgacggcaccttcaccggtttccgccccgacccggcctgggatccgccccgcctgaccgacgcggcgatgcaccggtga

SEQ ID NO: 6785 - DNA, 978 bp, Actinoplanes utahensis
gtggactttctccacgaaagcggccgcgacgtatcaaagggcgggcatacctgccgcgaggcggtgtcggacccctcgcttaggatgcgcgccatgcggggtgaggcgggggcggcggttctgccgttacgggtggcgaccgcgggggaatcgctggacaacgcggtggcgttgttgcggcggcgggccctgccgctgctggtcatggcggccgtgctggcggcgggcgagcaggtgctgctgcaccggctgcggacggggctgtatctgcggccgccgttctactggccggacatgggctacgacccctattacggctatcgcgggcagccgggcgccttcggcgtctggtggcaggtggtggcgaccgggctggcgaccgaggtgctgatcatcacgttgttgggggcgtatgcgggggccgccgcggggccggccctggtcggccgctcggtgaccaaccggggggtgttacggcgtacgccaccctggtccgccctgctgatcgcggtcgtgctggccgcggcggcctggcccctggcgtacctgggcctggtggggttgatcgtgctttacggccttttcgggctggccgtgccgatgctggcgttcgacggggtcaacccggtgcgcgcggtggtgcggtccgggcagttgtcggtgcggaccggggcgcgggtggcgcgggtccggattctgggctacctgacctggctgggcatccgggcggcgctcggcttcgggtggatcgcggtggccggcatgctggccgtcaacgtggccgacgccggctggctggactgggtcgtcccgatcgcctgggggatcgcgaacacggtggcctacgccgcgctggcctgcctcgacgcggtgctgctggtggacgcccggatccggaccgaggggctggacatcgcgctgcaccgcgcccgggcgcgcggcgaggatgacgccgccgtggtggcgggcgcgcgatga

SEQ ID NO: 6786 - DNA, 621 bp, Actinoplanes utahensis
atgaggggctacgacgagttcgtcggccggatcttcgacgtggtgccgggccgggtcctgctgctcatcctgatcatcgtggcgggtctgaccgccgccctgtggtactggtatccgtcctgggtgccgcgccggatgccccggatgccccggctgccgcgcttccggctgccgcggttcccccgctggcgactgccccggttccggcggcggcggagggtcaggaagaaaccggaccccgtgcggccgtcgccggtgcccgacgacgacccggtggccgatgagccacagccgatcggcggcctgtccctggccgaccggttcgccctgcaggggcggtatgccgaggcgatccgggagcggctgcgtgacaccgtccgcgacctcgcccgggccggcgtgatcaccccggagccgggcgccaccgcggccgagctggccgcggccgccgcggtgcgccagccggtggtgagcgcgccgctgggcggcgccaccgagatcttctccgagatctggtacgggcggcgggaggcctcgccgggtcacgacgcccggatgcgtacgctcaccgacgaggtccgtgccgccctcaccaccgtgccgggagggccgcgaccgtga

SEQ ID NO: 6787 - DNA, 903 bp, Actinoplanes utahensis
gtgaccgtcaagagacgccgcctgcgcgtcgtgatcccgctggcggtgctgttcgcgctggtcgccggcaccctgatcgtccacgcgatcgagcagcccgatcaggacgacagcgacttcctgtcgccggtcagcagcgccgggatcggcgccgaccggctcgccggcctgctgcgcgggcgcggggtcggcatcgtccgggagaccacctcggacgaggcgatcgccgcgctcgccggcggggacgccaccctgttcgtcaccaccccggcgatcgccgacctggcccggatcagcctgcccgacggccgggccgggatccggatcgtcgtcgtcgcccccgagcaggcgcagctgaccgcgacgccgtggccggtgcgggtgcgggattcccggtggaccaccgaggtcgccagtcccgactgtgccgatccgctggccaccggcgccgggcgggccggcgtgcacggcctgcgctacacctccgcggcggcgaccagctgctacgacggctcgctgctcgacgtgccggccgggcaggccgcggtcaccgtgatcggggcggccgacccgttccgcaacgaccggatcggcgagcacggcaacgaggcgctcgcggtagggctgctggcacgcacctcccgggtggtctggctggaccagcaccggcgggacaccccgccggcaccggccacgacgccgaccgacgaggacaccgaggacccgtacgccgcgccgccgacccgggagcgggagaccgcccggcccgaccgggcgccgcggcggaccccggcgggtcccggcggtggcggcgacgatgaccaggcgcggggcggcggcgagccggacccgctgttccaggcgttcccgccggccgtcttcgcgaccgtcctagctagctag

SEQ ID NO: 6788 - DNA, 2544 bp, Actinoplanes utahensis
atgcccggctctaccagcgggcccgggcccgcgacgagtcgctgggcctgctgcggtccgcggcccgccggcggatcacggcgcacctgggcctgccgcccggggcgctgctcgccgacctggccgagcattccggatacgacgaggacgacatccgcgagatcctcgccgacttccaccccgacaacgacgacgagctggtctcggccgccgccgccgtgcagaacctggtacgcgagatcaccggatttgaaggagaccagccgtgacccccgatgcccaagaagcccgcctcgccctgggccggctgcgcgccgaggtcggcaaggccgtcgtcggccaggacgcggtgatcggcggcgtcgtggtggcgctgctctgcggcggccacgtgctcctcgagggcgttcccggggtggccaagacgctgctggtgcgcaccctggccgccgccctcgacctggacaccaagcgggtgcagttcacccccgacctgatgcccggcgacgtcaccggctcgctggtgtacgactcgcggaccgccgcgttcaacttccgggccggcccggtcttcaccaacctgctgctcgccgacgagatcaaccggacgccgccgaagacgcaggcggccctgctggaggcgatggaggaacgccaggtcagtgtggacggcacggcccggctgctgccccagccgttcctggtcgccgccacccagaacccgatcgagtacgagggcacctacccgctgcccgaggcccagctggaccgcttcctgctcaagctcgtggtgccgttgccggaacgcgacgccgagctgaacgtgctgcgcgcccaccaccacggcttcgacccgcgcgacctcaaggccgccggggtgagcgcggtggccggcgccgccgacctggccgccggccgggccgcggtgcagcgggtgcaggtcgccgacccggtgctcgcctacgtcgtcgacctgtgccgggccacccgggtggccccggcgctggagctgggcgcgtccccgcgcggtgcgaccgcgctgctggccgcgtccaaggcgcacgcctggctgaacggccgcgactacgtggtgcccgacgatgtgaagggctacacgttgccgaccctgcgacaccggatccggctgcgcgccgacgccgagctggacggggtgaccgtcgagtcggtgctggccgccgtcctggcctcggtgccggcgccgcgctgatgatcaccaggcgtttcgccgggctgctcgcggccggactgccgctgccggcgctgctgccgtcgccgtggctgggactggccgtggtgctgatcctggccggcgggctggccctggccgacctggccgtcgccggcccgctgaacgggctgcggctgcgccgcgacggcgaccgcacggtctggctcggccacccggccaccacccggctgaccgtcaccaacacctcggaccgcaccgtccgggtcggcctgcgggacagctgggtgccgtcggccggcgccgggccgctgcggcacagcctggagctggcgccgggcggggagggcacggtcaccacgacactgacgccgacccggcacggcgaccggcccgcggtgcgggtcaccacccggtcgtacggaccgctcggtctcgcctaccggcagcggcgccgggcgttcaacgaccggcagaccccggcgtggacgctgcgggtgctgccccgcttcccgtcccgccggatcctgccggagaaactcgcccggatccgggtcctggacggcgccgtggtcacccgcggccgcggccacggcaccgagttcgacgtgctgcgcgagtacgtgatcggcgacgacgtccggtcgatcgactggcgggccagcgcccggcatcacgacgtggtggtccgcacctggcgcccggaacgcgaccggcgcgtctactgcgtgctggacaccggccgcacgtcggcggtccggatcggcgacgcgccccggctggacaacgcgatcgacgcggccctgctgctgtcggtgctggccgcccgcgccgacgaccgggtcgacctgctcgccctggacaccgagatccgggtccgggtcgagggcggcgggcaccgcacccagctgccccggctgatcgacggcatggcctcgctggaaccggccctggccgagaccgacttcacgctgctgggccgcgagctgctgcgccgggaccgcaagcgcgccctcgtggtgatcttcacggcgctggacaccgccccgatgatcgagggcctgctgccggtgctgccgcggctggccgcccggcacaaggtggtggtggccggggtgcgcgatccgcaggtggcccggctggccgcgctgccggccacgccgaccgccgcggacgtgcacacggccgcggccgccgagcgggtgctcgccgaacgggaccgggtgcgcgacgtgctgggccggtccggggcgaccgtggtcgacgccgacgcggccgacttcgcgagccgggtggccgacgtctacctgctgctcaaggccagcggccggctctga

SEQ ID NO: 6789 - DNA, 1164 bp, Actinoplanes utahensis
atgaccgcctgcaccaggatgtcgatgcccaacgcgatggcccgggaaccgagccgggccgggcgcaggtcgagggcgaccgcctcggcggtgaccaggtcggtggctgctgctgtcacccgcacagcgtccactacgcttccgcacaacgaaccggcgggggcggcagaactcatgatggatctcgacgcgtatctggccgagcgcggcggcgagtggcggcggctggagctgctcgccggccgggccaaggacctcaacccgggcgagctggacgagctggtggtgctctaccagcgggcggccacccacctgtcggcgctgcgcagccgcaacgccgatccggtgctgctggccgacctgtcccggctggtgctggccgggcgggccgcggtgacccgtacctccggcggcttctccctgcgaccgctggccgacttcttcgcctaccgcctgcccggcgcgctcttccggacccgggcctggtggggcacggtgggcgtggtgctggtcacggtgaccgcggcgatggtgtggtatctggccgaccacccggacgcgctggccgccttcgtctccggcgaccagatcgaggacatcgccggccgcagcttcgtcagctactacagcgagtaccgggcgcagaacttcgcgctgcaggtatggacgaacaacgcgctgctgaccgcccagtgcctggccgccggggtgctcatcctgccggtgctctacctgctctggggcaacctgctcaacaccggggtgctcggcgcggtgatggtcagccgcaacgccggtgacaccttcctgatctatctggccccgcacggcctgctggagatcacctgcctgttcgtcggcgccggggtcgggctgcggatcggctgggcgtggatcgcgccggggccgtcccggacccgccgccagtcgctgatcgactggttccgggagggcatggtgatcgcggtcggcctggtggtggcgctcgcggtggccggctgcctggaggcgttcgtcaccccgtccgggctgccggccgtggtccgggtcggcatcggcgccgtggtctggctcggcttcctctggtacgccctgctctggggccggcgggcggacgcccgggcgccggccggcccggaccacgcggacctgccgaccgcctga

SEQ ID NO: 6790 - DNA, 456 bp, Actinoplanes utahensis
gtgaccggggtgcggctggagccgatgaccgaggaggagtaccggtcgtggcgggccgacgcggaggcgcactacacccggagcgtcatcgcgtccggccggtcaccgcacgatgcggcccgtttcgccgccgacacctatcagcggttgctgcccggcggcttcgccaccgcggacaaccatctctggtacgcccatgacggtgaccgccgggtcggcttcctctggatcaaggtggagcacggcgccgcgttcgtccacaacgtggctgtcgagccggacctgcgccggcagggtcacggccgggcgatcatgcaggctgtcgagcgctggtgccgggagcgcggactgacccggatcggcctgcacgtcttcgcccacaacaccggcgcccgcgccctgtacgaggcgctgggcttcgtcgagaccggccgcaacctcgccaaggatctctag

SEQ ID NO: 6791 - DNA, 840 bp, Actinoplanes utahensis
atgaaccacgacctgcccggcgggcgctaccgcgtcggcgacctcgacctcacccgtttcggctacggcgcgatgcagctcgccgggcccggcgtcttcggcccgccgaaagaccgcgacgccgcgatcgccgtcctgcgcaccgccgtcgacctgggcatcaaccacctggacacggccgacttctacggcccgcacgtgaccaacgagatcatccgcgaggccctcgccccctacccggacgatctgcacatcgtcaccaaggtcggcgcccgccgcgacgagaccggcggctggccgcacgcccgcagcccgcgcgagctgcgcgaccaggtccacgacaacctgcgccgcctcggcctggacaccctcgacgtggtcaacctgcgggtcggcggcttcgaccggcccgagccgggctcgatcgcggagatgttcggcaccctcgccgacctgcgccgcgagggcctgatccggcacctggggctgagcacggtcagcgccgagcaggtcgccgaggcgcaggccatcgccccggtcgtctgcgtgcagaacttctacaacctggcgaaccgggaggacgatccgctgatcgacgcgctggccgcgcagggcatcgcctacgtgccctatttcccgctcggcggcttcagcccgctgcagaccgccgagttgcggcgggccgccgacgacctcggcgcgacgccgatggcggtcgcgctcgcctggctgctgcggcgctccccgaacatcatgctgattcccggtacgtcgtcggtcgcccacctgcgggaaaacctcgccggagcggccctcgacctgccggccggcctgttctag

SEQ ID NO: 6792 - DNA, 639 bp, Actinoplanes utahensis
gtggacttccggcaggcagcggcggacgggcggcagacggccgaggcgctcggggcgctgcaggcctggctgctcgccgaggacgcctatcggcgtggcggggtgcccgacgaggtgctccagttccttcaggaccatgtcggccacctgctcgggccgcaggcgatggccacggcccagatcttcctgcgcggacacgctgactgggccacgcccgcgcgggaccgggcgctgctgctggacctgctcgcggagatcgagggcgcgcgccggcccggcttcgagttcgggtggtacgccttcgggccggacggtgcggacgacgggccgacgacgctgctggtgatggcggagtacggcgtccacgatccggtgtgggagcggccgcggggcagcggctcaccggtgtcgctggccgatcacggcgtctcggagtcgctggtgcggcggctgcgggcgtggaacgagacgttcgagcggtacgggacccgcgacgaggatcgggcggacgacgcgtgggccgccgagggtctggcgctggcgcacgagttgcagcgggagctgccggacgtggaggtccgctactaccacggtgacgacgaccgtccgctgcgcgacgtggtcaccggggcgtcctga

SEQ ID NO: 6793 - DNA, 843 bp, Actinoplanes utahensis
atgaccttgccggccgacagccatgtgcacagcgagtggtcctgggacacccgggtcgggtcgatggagggcacctgcgagcgggccgtcgcgatcggcctgcccgcgctcgcgttcaccgagcacgtcgaccacaccagctggccggtcccggtcgacggcccgtacgcgagcccggagctgaccgccgccgccgacgccgacggcatcctgcacccgcccgccttcgacgccgagggctacctggccgccgtcgaacgctgccgcgaccgcttccccggcctgcggatcctcaccgggctggagatcggcgagccgcactggtacgccgagcagtgcgccaggatcctctcggccggcaccttcgaccgggtcctcggctcgctgcactgcctgcccgacggcgccggcttcgccgagccgtgggcgctgttcccgcaccgcgacccggccgccctggtccgcgagtacctcgccgagatcccccggatggtcgccggcgacgacccgttcaccgtgctggcgcacatcgactatccgctgcgctcctggcccgccgagaagtccgggccgttcgacccggcgttgttcgaggacgatttccggtacgcgttgcgcgccaccgccgagtccggccgcgccctggagatcaacacccggatcccgatggacgccaccatcctgcgctggtggcacgaggagggcggccgggcggtcagcttcggcagcgacgcgcaccgccccgagctggtcgccaacggtttccgcgaggccaccgcgatggccgacgccttcggcttccgccccggccgcaccccgtgggacctgtggccccgggcctga

SEQ ID NO: 6794 - DNA, 996 bp, Actinoplanes utahensis
atgaacaccgcaccgagcccctggccgcgcgtcctggccaccgtcgccctgctcacggtgatcatcagcgcgctgctgaccgcgttcgcctggcccgccacccgggccgcggtgcacgacatcccgatcgccgtcgccggtcccccggccgccgcggcccgggtcaccgcggccgtcgccgacaaccgcccgggcgccttcacggtttccaccgtcgccggcacggccgccgcggagaccgccatccggcaccgcgacgtgtacggcgcgatcgacctcaccggcggcaccccgcaggtgctcaccgcctcggccgccagcccggccgtcgcccaggccctacagggtgtcgccgcggccctcagcggatcggccgctcccccggtccgcgacatcgtgccgctgcccgccgacgacgcccgcggcgccggcctggccgccgccgccctgcccatggtcctcggcggcatgctcgccgcagtactgctcagcctgcgcgtcgacggcgccacccggcggatcgccggcgcgctcacctatgccgcgctcggcggcctcgcgatgaccgccatcctgcagtactggctgggctcgctgaccggtgactacctgaccaacgccgcggtgatggcgctcgccctgggcgcaccggcactgaccatcctgggcttcgagtcgctgctgggcacggccggcttcggcgccggcgcggtcctgctgatgctgctgggcaacccgctgagcggggcgaccagcgcgcccgagatgctgcccgggtggtccggcgccgccgggcagttcctgccgccgggggcctcgcagtccctgctgcgctcggccgccttcttcgacgggcacgccgcggcccggccactgaccgtgctgctctgctggctggccgcgggcctggccctgaccgtcgccggcagccgccggcgcagcaccgcggcggcggtcacccgggtcgcaccggtaccggcggcgccacaccgatag

SEQ ID NO: 6795 - DNA, 1737 bp, Actinoplanes utahensis
atgaaccactggtcgacccatcagctcaccgagttcttcgccgcggtctgcgcgccgcaggaggaacactccgcgatcatggtcgccgtcgaacgggctgccgaggtgctggagaccgagatcggggcggtgctgcgcgacggccgggtcgaggtggcctggggcgcgagccgcgagcagctgcagtccctgctggacggtgacccgcggccggcgatgctgaccgtgcccgggatcggtgagctgcacgtgagcaccgtccggttcggggcgaagccgggcgggacgctgctgctggcccgggccggcgacccgctggacccggaggagcggcagctgctgcaggcgatggcgcagacgctgggcctggcgctgaccaacatcggcctgctcaccacggaacggtcgctgcgcgaggaccgggagcgggaggcgtccgagcggctcaccctgatcgagtcgctgcgcgaggcccggcacgacccgctgaccggtctgccgacccggatgctgttcctcgagatgctcgccgagcggctggccggcagcgtgccggccagtgtgctcttcatcgacctggaccggttcaaggcggtcaacgacagcctcgggcaccgggccggcgacgaactgctcggcctggtcgccggccgggtgcgcggctgcctgcggccgaccgacacggccgcccggatcggcggcgacgagttcgcggtgctgctcgccgactgcccggcggaccaggccgtcccggtggcgcagcggctgatcgacgcgatcaagaagccgttcacggtggccgggcaggacgtgttcatcggcgccagcatcgggatcgcggccggccccggcccggcgcccggtgagctgctgggcaacgcagacgtggcgatgtaccgggccaagaccgagggcccgggcaaggtggtgctgttcgagccgcagatgcacgccgaggccctggcccggctgaccctcaacggcgatctgcagcgggcgctgacgctgggcgagttccggctgcagtatcagccgctgatcgacctggacagcggcgagccggtcggggtggaggcgctggtgcgctggcagaacccggagcgggggtacgtgtcgccggccgacttcgtgccgatggccgaggagaccgggttgatcagcgacctgggccggtgggtgctgcacaccgccggtcggcaggcggcggcctggcgccgcacccgcccgcacctggggatcaacgtgaacgtctcgggccgccagctgaccgatccgcagttcgccgcggacgtggagcggatgctcagcgacacccggctgccggccgaggcggtcaccctggagctgaccgagtcggtgctgatgagcgacccgaagacggccatcgcctgcctgcgcgacctgcaggacctcggggtggacgtgtcgatcgacgacttcgggaccggctattcgtcactgtcctacctgcagcggctgccggtcgacgaactgaagatcgaccgggcgttcatcagcaagcagatcccgacgaccgcggacatggcggtgatccggacgatcgtcgagctggcccggacgctgcggctgcgcacggtgatcgaggggatcgagacggaggcacagcgcaccgcgatgcggatgctcgggtgcgacctggggcaggggtaccacctgtgccggccggtgcatccggaggacctgctgggcagcatcacgccggcggaggcggcctga

SEQ ID NO: 6796 - DNA, 1329 bp, Actinoplanes utahensis
atgcccgatcaccccggaccagaacaccgcgagcgcgtacgcgtcggccgcatcgaacgagacgttgcgaatgagggagctcatcggccgactctaggcgcgcacctcaactcgggcgaccggcggccgatgtctgcgggcatgacggatggcatcggtggggagcggtggttcggcagtgggcacagcacgctgagcgatccggccgcggccggggcggaggcggccgccggcgcgctgggcgggcgggtgccggccgtcgtgttcgtgttctgctcggtcggctaccaggtgcccgagctgttcgacgcgctgcgggcgcaggccgggccggccacggtgatcgtcggctgcacgacgtcggggcagttggccgaggggcgggtgagtcgggccggggtggccatgacggcgtggggcggggcggggttctccgtccgtacccaggtgtcggagagcgtgagtggccgcctccgggagtcgggagcgcgggccgcgtcggcactggccgggatcgatgcggagcatcgggcgttgctgatgatcggggacgggttgaccggcacccagcacgaaatcgtgcgcggcgccttctcggtggccggcgcggcgatcccgctggtcggcgggtgcgccggggacgacctgacgtatgtgcggacctaccagttccacggcggtcgcgacggggtggcgatcctgtccgacgcggtggtcggggtggcggtcggctcggatcggccgctcggggtgggcatcgcacacggctggcgcaaggacggcgacgcgctggtggtgaccagcagccgtgacggacgggtgctggagctcgacggcgaaccggccctggacgtcttcctgcgccggctgggcgtggacgagtccgcgctcgacgacccggccgggttccgggagctggcgttccaccacccgctggggctgtcccggcgcagcggcgaggacatccgggtgatccacgacggaaaccggaccgaccggtcgctgctctgcctggccgacgtgccgcagggcgcgctggtctggctgatggagagcgacagcgacgcgctgctcgacggggccggcgaggcggccgggcaggcgctcgacgcgctgggcggggtcccggcgctgggcatgctggtgttcgactgcgcggcccgctggatcaagctgggtgaggcgggggtggagcgggagaacgccgagatcggcaaacggctcgacggcgtgccgtacggcggcttctacaccaacggggagatcgcccgggtccgtggcgccctcggcatgcaccacttcaccctggtcaccctggccctggcctga

SEQ ID NO: 6797 - DNA, 468 bp, Actinoplanes utahensis
atgaagaacgttctccctgccgccctgctcaccgcggccacgtccctcgccgccatcccgcacccggccctcgccgccgcaccctctccgatcgccgcgccgtcttccgcggccgcgcggtcttctgccgccgcgccggcagtgtccgccaccgcccaggtctacgacgaggacagccgcctgctcgccgaagcccgcttcgacgccccggccgacgccttcacggtgaccaagcgcatcaccggcaccgaacgcgcctacctggaataccgctacaccacgccggccggggccgtgcagaccggcacccaatggggctcccgcgcagccggcgaaaccctccgattccggcacgacttcgccaagggccgtcaggtcaccttccgcgtctgcctggagggcgaccaccccttcaacccctgcagcggcgccgacaacggcgagaactggaccctggccatcgcctga

SEQ ID NO: 6798 - DNA, 1041 bp, Actinoplanes utahensis
gtgcttgtactgaccggcgccgatgtggaagctctgtgtgacctggacgcgctgacggcggcgatggccaccgccctgcgcgagctgagctgcgggcgggcgcacctgccgccgcgggcgagcctgctggtggacggggccgggctcctcgacatgccgagctggattccggcgctgggggcgctcaccaccaaggtggtcagtgtgttcccgggcaatgcgggcggggatgtacccgtacggcaggcgatgatcgtcgttttcgatccggagaacggcgtgccggttgcgatgatcgatgccgggtggctgaccgcggcccggacggcggcctgctcggcgctgtcggtgcggctgctggccaggccggacgccgcggtgctggcgatcgccgggaccggggtgcaggcgcgggcgcacgcggtggcggtgagccgggtgcggccgttccgggaggtgcgcgtcgccggttcgtcgccggaccgggccgccgcgctggcggaggagctgtccgcggtgctgcccatgcgggtgcgggccgtcgccgaccatcggacggcgctgcgcggggccgacgtggtgtgcggggcgagtttcgcggtgcggccgccgatccgccgggagtggctggcgcccggcacccatgtgacctcggtcggctaccggctggacggccgagaggtggacgatgcgacggtggccggggcggcgctgttcgtggagtcacgggacgccgcgctgcgcgccgtgccacccaccccggatctggcgcagccgctggccgccgggctgatcaccgccggacacgtgcgggccgagctgggcgaggtgatcgccggaaccgcgcccggacggctcgacgacgccgagttgacgctgtacaagtcggtcggtgtggcggtgcaggacggcgccgcggccgcgctgctcctggccgcggcccgcgatcacggccgcggtcaggagatcaccgggttctcgccgatcgccggcaccagtacggcgaagtcgaaggcgtccgcggccggcagctcgatgtag

SEQ ID NO: 6799 - DNA, 1281 bp, Actinoplanes utahensis
atgcttctgtccactctggacccggacgccggccttgacgaccttgagccgctccgcgagctcgtcggcggggcgcgggtggtcgggatcggcgagtcggcgcacaacgtccgggagtatcagcaggtcaggcatcgtttggtgcggttcctggtggagcggatgggcttcaccgacgtggcgctggagtccggcttcagcgagggcctcgcggtcggccgctggatcgccggcgcgcacagcactgcccatgacgaccatgacgcagcgagcgatgtgcacccggacgtcgccgtggaagatcgcgccggtgcagccgacgacgtgacggaccgggggctgacctacgggttcgggggcaccgcggagacgcggcgactgatccgctggcttcgcgagcaccaccgcaccgggcgaaatgttcggttcgccggtctggacctgccggctcagctcggatccctgctcccggcgatcgacggggtggcccgctatctcgccgaagccgaccccgccgccgcccagctggttgatcggatccggacgtacggcaaggcctgggccagcccgcacaccctggtggcgttccgcgcctaccaggccgtcccgccagcggaccgggacgcgctgacgatcctgctgtccgaactcgccacccggatggaggcgatgcgcccgctgtacgcgcgacgtggcgccggggacggattcgccaccgcccggcacgagctgcgcctggcgggcctgctcgaccagatgctgcgcgcgcaggtcgcggcggtcggcgggtcgggcgtccacgccgcggtgaacgtgcgggacgcggcgatggcagccaccgcccgccacctgctggccggcggcggccgattggtgatctccgcggccaacacccacctgcagcggattccgatcagcctgggcggcaccttcgaggtgccggtcgccggtggtcacctggccggcgacctgggcgacgactacctgtcgatcgcggtcacctgcggcgggggccgaactccgacccggcggcccgccccgggtaccgagagcggtgtcgaggtgctcaccgtcgacctcgccgagccggtcccgggcagcctcgaggcgctgctcccccacgacggcgtccggatcaccgatctgcgcccgctgcgcggcacaccggaggcaccgcgccggttccgcaatctcgacggctacatcgagctgccggccgcggacgccttcgacttcgccgtactggtgccggcgatcggcgagaacccggtgatctcctga

SEQ ID NO: 6800 - DNA, 1149 bp, Actinoplanes utahensis
atggctgagccgcccccgcacatcaccgacgcgctcaccgcccgaccaaccccggtctgcgcctacctctacgacaccaccacgctgcgccgccaggccgcccgcctgcgcgccgccctgccaccgcgcaccaccctgctctacgccgtcaaagccaacggccacccggacgtcgtccgtgccctgctgtccgcctgcgacggcctggaggtcgcctccggcggcgaactcaccctggcccgccacgccggcgcccgccgcatcgtcttcggcggccccgccaagaccgacgcggaactcaccgccgccatcgacgccggcgccctgatcaacgtcgagagccccttcgaagcccggcgcctggccgccctgggcttccgcggcgacatctgcctgcgcatcaaccgcaccaccgtcgcggtcaccggcagccacaccatgaccggcagccccaccccgttcggcatcgacgaaaatcagctcgccaccgtcctgcgtgaactccccccacagctcaccgtcatcggattccacctgcacgccgtctccaacaacctcgacggcgcagcgcacgcggccttcctcacgcaggccatcgcctggtcgatgacgacggcttcccggtacggggtggacctgcgcgtcgtcaacgccggcggcggcctgggaatcgactacacctccgacacctcgatcgacctcgccccgctgtccacggtcaccgtccccgacagcctcgaactgatcctcgaaccgggccgcttcctggccgccgacgccggcttctacgcggccgaggtcgtcgacctgaaaaccacccacggccgcaccttcgcggtgctccgcggcggcacccaccacttccgcctgcccgccgcctggggctacagccacccgttcaccatcctgccgatcgagtcctggacccgcccctacccccgccccgaggtcaccgacaccgagatcgacgccgtcggcgaactctgcaccccccgcgacgtcctcacccgcggccagcacgtcgcccacctccgcgtcggcgacctgctcatcttcagccgggccggcgcctacggctgggacatctcccaccacgacttcctccgccacccgcacccggaattcctcatcatcgacgcggagaaatga

SEQ ID NO: 6801 - DNA, 1548 bp, Actinoplanes utahensis
atgacctccagcctgaccaccggccgcctcgccgcggccgccgcgcacacccaggccgccctcgccgtacacgcacccgacctggtcaccggcttcctcgacaacctgccccgggccgccgacaccgtcggccggcgactgcgcggcgccctcgcccgcgaaggcctcaccgacgacgacgcacccggcgccacccggcacgcgttccaccggatcgaattcgcccgctccggcgtggccgacccggtggacctgctcaccggcatcgacgcaccccgcttcgccgccgagatccgcaacgcggtgatcaacctggcggtcgcactggcccggcccggcccggcccccggcggcgacgccgacgaggccgccatcgccgccgaacgactcgccgtcaccggacacaacctgcacccctgcggccgcacccggctcggctgggacacctgcgacgtcctcgcccacgacctcgaatccggatccaccgacatccgattcatcgccgtccgcgatgacgcccacctcggcgacgacctcagcacgcactaccccgccatcccgcgcccaccgtccggtttccggctgcagcccgtccacgcctggcagcacgacctcgtccgccaccgataccgcgacctgttcgacgccggcgtcctgcgcccggccgacggccacctcgacgccgtccccaccgccgccctgcgcaccctgctgctcccacccgccgccgacggccgccgccactacctcaaggtctccctcgacatccagatcacctccacccgccgcagcatctccgtcgccagcacccgcaacggccccgccgtctccgccctcctgcaccgcctcaccaccggcgaacccaccctgctgctgatggccgaaacccacggcgccgccgtccccgccggcaccggacgcgacctgtccgccatcgtccgcgacggcctcaccggccgcctgcaccccggcgaggaggccatccccggcagcgccctgccccaccggctccccggcctgctcacccggcacggtggcggtcccgccgcctggctgcgcgactacacccggctcctgctccccccactgctccgcctcgccgcccacggcgtcggcatcgaagcccacctgcagaactgcctgcccaccttcctgcacggccggccccaccggctcgccctgcgcgacttcgccggcctgcgcctgcacctgccccgcctcgccgccgccggccacgacgtcgacctctggcccgactccgtcgtcggcaccaccgaccccgccgtcatgcgcgccaaactcggctacaccgcgttccaggcccacctcggcgaactcgtcctgcacctcgacctcgacgaacccgacgcctggcggatcatccgcgacgtcgtcgacgaaacctacgacgctctggacaccccggacgcccgcgccgaccacgccgccctcaccgcaccgaccgtcccgcacaaggccctcgtccggatgcggctcgccgacaacggcgacatctacctcccggtggagaaccccctgcatggctga

SEQ ID NO: 6802 - DNA, 1773 bp, Actinoplanes utahensis
gtggctcgcgggtgggtgccgggcgagcggcgacacactggtgacgcgcccatcggagaaaatccgatacattctcatatcttcaacgagcgggaggtcatcgtggacacggatgtcatcgtggtcggcgccgggctggccgggctggtcgcggcgcgtgaggtgaccgccgccggcaagcgggtcctgctgctcgaccaggagaacgcggcgaatctgggcgggcaggcgtggtggtcgttcggcgggctgttcttcgtcgacagcccggagcagcggcgcgcccggatcagcgacagtctggagctggcctggagcgactggcggggcagtgccggcttcgaccggctcggcgacgaggactcgtgggcggtgaggtgggcacgggcgtacgtcgagttcgccgccggcgagaagcggtcctggctggccgggctgggcctgaggtggctgccgttcgccggctgggctgagcgcggtgacctgcgcgccggcgggcacggcaactcggtgccgcgcttccatgtcacctggggcaccggcaccggggtggtcgagccgttcgtcgccgccgcgcaccggtccgccgaggccggcctgctcgggttccggcaccgccaccgggtcgacgagctgatcgtcgaggggggcgcggtcgtcggcgtacgcgggaagatccttgctccggacgagggcgcccggggggtggcgtcgaaccgcgaagagctgcaggatttcgaggtacgggcgcaggccgtgatcgtgacgaccggggggatcggcgccaaccacgatctggtccgcgagtactggccggcccggctgggcaccgccccccgggagatgatcaccggggtgccggcgtacgtcgacggccggatgctcgcgatcgccgaggcggccggggtgcgcctggtcaatcgtgaccggatgtggcattacaccgagggcatccgcaactgggcgccgatctggcccgggcacggcatccgggtgctgtccgctccgtcgccgatgtggttcgacgcgctcgggcgccggctcccgcagccgtactacccgagctacgacactctggggacgttgcgctacctgcggacgacgccggaactggccgagcacgaccactcgtggttcatcctcacccagaagatgatcgagaaggagtgggcgctgtccgggtgcgagcagaacccggacgtgaccgcgaaggatcgtcgggcgttcgtgcgcgagcggctgtttggcaagggcgccccggcgccggtcgaggcgttcaaggagcacggcgccgacttcgtggtggccggcacgctcgacgagctgatcgccgggatgaacaggctgaccgaccggccgctgctggacgccgcgcacgtgcgtgggcagatcgaggcccgggaccggcagctggccaacaaggtcaccaaggacgcgcagatccagggtatccacaactcgcgccgctacctcggcgacaagctcggccggacctcggcgccgcaccgggtgctcgacccggcggcgggcccgctgatcggcgtcaagctgcacatcctgacccgcaagacgctcggcggcatccagaccgatctggactcgcgcgccctggccccggacggctcggcgctgcccgggctgtacgcggccggcgaggtcgccggtttcggcggcggcggtgtgcacggctacaacgccctggaggggacgttcctcggcggctgcatcttcagcggccgcgccgccggccggcacgcggcccgatccctctga

SEQ ID NO: 6803 - DNA, 687 bp, Actinoplanes utahensis
atgagcgcgatccggggtgctcgcgatgagctgctcgactgcctggcccgggaggtcggcgcggtcgccgtcgcgcacccggtgcgggtcgccgtggacgggccgcccgcggccggcaagacgacgctcgccgacgaactggccggcgtgctgcgcgccgcgggccgcgtcgtcgtgcgcgccacgatcgacgacttcctggtgccccgggcacggcgctatgcgcggggcgagttctcgatggaggggtgctaccgcgacgcccacgaccacgatgcgctcaagcgggtcctgctcgacccgctgggcccgggcggcgaccggcgtttgcgcaccgcggtccacgaccacggtgcggatgcggtgtgctgcccgccgccgtcgccggccccggccgacgcggtgctgatcttcgacggtgtcttcctgctgcggccggagctggtcgaccggtgggacctgcgggtgctcgtgacggtgtcactcgacaccacggtggagcgggccctggtccgggagcgggagaaggcgtcccgggcggcgatcgagcggcggtggcgggaacggtacatccccgcgcagcggatctacttccgcacggcgcatccggtgcagcgtgccgacgtcatcgtccacaacgacgatccgcggtgcccggcctggcaggtgcggcgggctccggggtag

SEQ ID NO: 6804 - DNA, 1014 bp, Actinoplanes utahensis
gtgagcctccagcgagttctcctcgtcgccggatcggtgctgctgctcctgcagatcgtcaagttctccggggtgctctcggcgatccggtggatcctcgccaacgggcgggagttcatcgtcgagctgcgcaaacggcaggacaccttctccgaggcggcctactgggaggtgctcgaccggtgcaacggccgggcggtgccgccgttcggagtgctggagtaccggctcctgcggttcgcgagccgacgcggcagagcggccggcgtcgcgatcaggttcggccggacgatcctctacgacttcacggcgatcggtgtgtacgtcgcggccttcctcctgatcaccggtgcgcccgctctccggaaccgggtgcacggcccggtgaccacgctggcctggatctcggcggggctgggcgcgctgcagctgatcgccatctacgccgaagcctgcgtgtcgtatgcgcggatcggctcctacggcctgggcttccacggggccagcagatatgtcgaacgcgagcgtgccggcacctacttcgccgaggtgaagacgctcgtcggggccgtgctctactcgttgctcatcggcagcatgatcttctacttctcggccggccacggcgctcggtacgacgcgttccgcatcgcgcagaccacgccggccggggtcgccggcgacgtgctcacctgcgtctacttcgctgtgatgaccttcttcaccgcggacaccccggacgcccggaacggcgtggcacacctcgcgacggtcatcctggtgctccaggcggtctgcgccctggtgctcgcgctcaccacggcgacgatgtacatcgcgccggactcccggcccgaaccgccgccggtcgacccgcccgcgccggagccgtcccgtctgccggtgcaacgcccggcccgttccgggccggcggccttcgtgaccggtgtcgtcatcggcgtcgtcctggcgggtgccggcctgcgggcacggcggccgggccgccgacgatga

SEQ ID NO: 6805 - DNA, 975 bp, Actinoplanes utahensis
atgatcgatgaaggggcggggatccggcggccgcggctggcgcaggcgccgccgcgggtgcggctggccgtgcgggagatgctgggcgggccggtcgtcgcggaacaggcggcggatgccgggttcaccccctcgatcgcttcggtggtcaccggcggtgacgggaggcggctgttcgtcaaggcggcgccggtcggtgacgggctcggtgaggcggtgacggccggggtggtcctggccggggtgaccggaccggtgggtccgcggctggtcggctgcgcgtcggccggacggtggcgggtggcggcctacgaggtggtcgacgggaccgctgtgacctgctggcgggccgctgatctgccgcatctgctgcgggtggtggatcggctgcggaagatcgcgcagccgtgcccggtggtcggtgtcactccgtacgccgaagccttcgttcctcttctcggtacctggcgagcgctgaacggggagggtgacggcggggtcgcggtcgatcatctgcgcgggcggccgctgccggtcgagctgccgatcccgctgctcgccgggctggagggggactggctcgacgcgctcgctgccggcacggccctgcatcacggggacctgcggcgcgacaacgtcatccgggagccgggcggccggcttcggatcgtggactggacccatctgtggacggcgccgggatggctggatctggtgcggctggggccggacctggcgatctgcgggcatgatccggagcggatgctgcggcgttcctgctggcgggacgctccggcggacgcggtggacgtggcgctggccgggctggccgggcgggcctggcgagagggctggctgcccccggtcccgggcctgccggggctgcggcgcatgcaacggcgtcagggcctgcacctgctgcgctggctggcggcgcgaaggcggcgcaccttgcctccgccccttgcgcaatga

SEQ ID NO: 6806 - DNA, 114 bp, Actinoplanes utahensis
gtgatcgccgccgcctacccggagctggccggggaggcgcgccggcaggtcgccgagcacgccgcggcggtccccgcccgcccccgccggtcccgcgccggccaccggcggtga

SEQ ID NO: 6807 - DNA, 669 bp, Actinoplanes utahensis
gtggcgcgacggcgactggctgctgccgttcgcgccgaactgatgagcgtcccgagcttcgccgaggtgaaccggatcaggtccgccgcgaccatgcgggacctgatccggcgcgacgacctgcccgacgacccgcagtggtggctcgcggtgatctcggtcgggcaggccgcgctgctgggcgccgaatccggacagcccggcgcccgcgcctgggcgccggtgctggtggagtccctggatgccgccgagcgccgcccggcgctcggcgtcgccgagaccgtccaccgccggctcgcggcctgcctcgcggcgatccactacttcgggacgcggaccggtgacccggtgcgcgacccgaagctggtgctcgaccacctcgaagcggcgctcggcggcaccccggaggcctacctggcccgctaccgcgagacgctcgccaccgccctggccgagcaccgtcggatcggcgccggccggggcggtgaccggcgggcggtgagcagcgcgcgggcctggctgacgggcacccgggccgccctcgtccagatgtgccgggaactcgcaccgctgctgtccgggacggacgcggccccggacgtcacggtcggctggcaggcggccgtgaccgcgatcgagcagatccgtcgggaggcgcaacgggactga

SEQ ID NO: 6808 - DNA, 2145 bp, Actinoplanes utahensis
atggcgatcgacgtcgcgaacagcgccatcctgatcggcgccgaacagagcgccgcggccgaacagcacgcggccgacgcggaggccgccgcggtgcacgcggccgaggaggcgctgcgggcgcaggaacaggtcaagcccgcctacgccgcggcacagaaagccgccgaggacgccagccgggcgatcaaggcgagcaaggccgcgatcaccgccgcgaacaacgccgccaccgaggcgcgcgccaccgtggcggccgccaacgacgccgcacacgccgcccagcaggcgaccgcctacgccaacgccgccgagggcatggcggttcaggccggacacgacgccgccgtgggccggcaggcggcgggcgccgcccgcaactacgccaaccaggcgaagaccgccgccgacaacgccgactcgatcgccaagcagatcaaggcggcgtcggactcggccaccaccttcgccaccgcgatgaagaacaccgccgcccggatggtgcagatcgcggccgacacccacaccgcggtgcaccagctcgccgatctcaccgaggcggagaagaaggcccgccagacctcctggatgcagacctggcgcgactacgtcgacaagaagctcgccgccaaggacctccccgactggctgaagaagttctaccgcggcgaaagcgaggaggtgctcggcatcgccggcggcctctggctctccgggctctgcgcgttcggcgcccccggcaacaccccgggcaacacgccggactccgaagaagcctgcgacatgctcaaggacggcgtcaagcagctcatcgaccaccccggctccctcatccacctggacgaatggcgcaacggggactacgccaaggcgctcggcatgagcgtggtcgacctggccaccctcgacctgccgaagatcgggaagatcaccgcggcgatcgacgtgctgcgcgacggcatcgccgcgggcctggccaaactgctctccggcgagctgctcaacggcctcaagaacatcggcgccgacctgatcgacgcggcgctcaagaaactcggcgcgctcaagctcacgaagctgatcgagctcaacgtcgacctgcccaagaagatcaccttcagcgcggacgaactgagtgccctcaagctcgccatcgacgtcaaggggttcccggccgtcgcggacgcactcaagggcctgatcgacggcaagggcatcctcgacggcctcgacgatctgatcaagaaatgcctgggcgacagcttcacgccgcagacccgggtgctgctcgcggacggccgcgcggtgccgatcgccgccgtccgggtcggcgacctggtcctggccaccgacccggagaccggggtgaccgccgccgaaccggtgaccgacctgcaccgcaacctggacaccgcgttcgccgacgtccgcatcggcggccggcacggcgaccaggccgtgcacaccaccgcacaccacccgttctggaacgcgggaacccggcagtggaccgacgccggggccctgcagcccggcgacaccctgctcgggcgcggcgggccggcgaccgtcaccgccgtccagcagcacaccggccgccggatcatgcacaacctcacggtcgcgacgctgcacaccttctacgtgctggccggcgccacgccggtcctcgtccacaactgcctgcccaacctcagggacgagggcatgcagaagatcgaattggacgcggcggccaaacgcggggtcagcccggttacgatcgggccgggcagcgggctgcaggcactcaaggacgcgatcagcaaggcgtcgcccggcaccgagggatacttcaaatgggggatcacgatggacggtgagctcaaggtgatccccgccttcgccgggaccaccggcagcggctggccccgggtggagatcgcacacaccgtcctggccgggctgaaaggcaaactccgggcagccgggaccggccacatcgacgacctgttcggcgtcgagatcaacgattcgagcggtcacttccagccgaccgacggactcatcgacctcggcgtcgagaaattccacgaggcgggcatcgacgtgttccccagctcgtggcgcgacggcgactggctgctgccgttcgcgccgaactga

SEQ ID NO: 6809 - DNA, 1800 bp, Actinoplanes utahensis
atgacgcgcgcacgtatcgccgcggtcgtcgcaagcctgctcgcagtggtgatgctgccgcaggccgcgaacgccgccgtaccgatcacaccggaggccgtgccgcccgcggcggccccgacgctgcaggactggatcgcccgcgaggcggccgccgacgccgaccgggaacgccggctcgcggccgacggcccgatcgacgacaccgaactcgaccggatgctgatccaggacctcgccgactacgacgcggacccggacgtccgggccgccgccgcgcaggtgctgcaggccggcgacccggcccagttcgcgccgttcctggaccgcgcgttgccggtctaccgggcggccgccgccgaacgtcgcacgcgcgacgccgccgagaaccgggagatcgtgcaggactgggccgccaccggcggcccggtcgagcggcagaaggcggccgcggcgctggccaccgggaacgacgacaggatcgcggacttcatcgcggtcgggcacgccgccgcggtcgcggccgaccagcaggaccggatcaccgcggccgagcaggccaaaacgatcaaggcgcgggtcgagcagatcgtcgccgccggcggctacgaggtcaggtgggccggccagggtgccctcgacaccgaggacccggcgacgatcgccgcgttctacaccaccggctacgccgcggccgcggcccgcgacaccgccgcgcagcagcagatcgaggccgcgctggccgcgcgcaccaaggctgtcgacgacctgaccgcgctcgcccggcgggccacccaggcggccaccgcccgcacgacgatcatcaccgagagcgtcaccgccacccaggcgctgaccgtggccgcgaactcgatgggcctggccgacaaatacgccaagcaggccgacgccgtctacgccgcggacctgccgatccgcacagccggcggcgccacccacaccgccgacctcactcggctgcgcaccgacgcctgcaccgagtcggccaccaccgcccgcaacgccggccaggtcaccgcgcacaccggcgtcgccaagaccgccgccgacaccctggtcaccaccggcctgacgcacggcgtcgactgggccgcggtcatgcaggcgcagaacgacgccgccgacgccgccggccaggccgccgcgaccgcctgccatgccgccgaggccaccgaggccgcggccaggacgctcgacgccgaccaccacgccaccgtcgatgcgaacaacgcggtgaagtaccggcaggaggccgaacgggaagcggccgcggcggcgaagctcgccgcccaggccgagaaactcgccgccgccgcccaggccgccgaagccgacgcgcaccagcagcggctgcgcgccgaacaggacgcccgcgacgcccggtcccgcgccgccgaggcccgcgagcactacacccgggccaagacccagcgcgacatcgcccggcagcagagtgcgatcgcgatcgcccaacaggccgccgcctacgacgccgcgcgccgggcggtcgagcagcagaacgtcgcggccggcaagggcgccaccgccaaggccgcggccgacgaggtcaccaagtcgatcgaccggttcgacactctggtcaacgactccaaggcggcctccctgcgcgcccagaaggcgatcagcgaccgcgacaccaaacagctcagctacgaggcgtaccagcaggacgcgatcgccaagaagggcaccgccgagggcgactacgccgcgcaacaggccgcgatcatcggcgcccagctgcccggcgctagctag

SEQ ID NO: 6810 - DNA, 2328 bp, Actinoplanes utahensis
atgtctgtgagaaccgtccaggccggcctgctcgcggccggcctggtgtgcgggctgctgggtgtgccgggagccgcccacgccgccccgtcaccgtcgccgtcggcctccgccggcgtgcgggccgccaaggcctccgccgccacggtggacgatccgacgaacctggccaccgacgaggacaaggtcaaggcggccggcgcgatcggcgtcaacccgggtgtcgacctgctcgtcctcaacgaccaggcgttcgtcttcgcgctgtggcgccgcgacgaggccggcacgaacgtcaaggccgccgcgctgcgggcgtacgagtccgacgacccgcacgccgcgtacgacttcatcgtcaccggcatcttcgtggccgccaacgacgacgcccaggccaagatcgccgaggccgccgcgcaggcccgccggcgctcggtcgcggtgaccgtcgggctcgacccgtccgacaccgcgctgatcgagcgcaacgaccgcgacttcatcttcggggtctggcagcgggtcgaggccggcagccacgtccgggatgccgcccaggccgcgatcgccgacggcaccacccaggccgactgggacacctttctgaacaccggcgcggccgcggcggccgacctggacatccgcgaggcgatcgccaaggcggacgcggagcaggccgccaagctgcgggccgcgcagctcctggccgccaagaagtcgctgctgcagctcctgctgctgcaggtgaccgacgagctggtcagcgcgccgaaccggcagttcgtgctgttcgtccacaacaacgccaagggctccgaggtctccctggcctcccaggtcgccctgaacgcgcccgacgaccagctcgacaaggcgctgaccgacttcatcttcaccggcggcgccgccgccaacaagcgcgacgaggacgccgccgcggtcatcgagcgcgacggctaccacgcccgggtcatcccgatccgcgacgccgccgagcacgacggcttctcgccgaacctgctcgccgcggcccaggcggcactggccgccaacaccctggtcgccctgcagaccttcctgctcaagggccaggacgaggcgcgcgccaaggaccgccggctggacttcggcagcggcttcgaggccgccgacgcccggccgaactggcagaacacggtcgacaacaccggcaacgggcacggcggcacgatcaacgtcggcggcatcgtcaactcggtgaccacttcggagctgggcgtgcgcgccgagaaggcgcacaccgggtcgcaggcgctgatgtactccggcatggacaacaacgccaccaagtcgttcgcctacaaccaggtgttcgggctcaagggcgtctcggtgcggccgaccaccaagctgtcgtactggatctacccgcagagctcggcgcagatgactcaggtgtccggcgccaacagctcctgcgtggcggtcgacctgatcttctcggacggcaccaacctgcgtgactcgggcgccaaggaccagcacggcaactcggtccacccggccgcgcagtgcggcaagctgaccctcgacacctggaacgaggtggacgtggacctcggcgcggtcgcggccggacgcacgatcctgcgggtcaccgtcggctacgaccaggcggcgaacaccggcggctaccgtggcttcatcgacgacctgtcgttctccgacctggagagcgcgccgaagttccgcacctcggcggagcccggtgacaccaagctgacctggaccaacagtgccgacaccggcgccaagccggccggcggatcgctcaacgtcggcccgatcgtcgccagcgtcaccggtccggagctcaaggaggggccggccaccggccgcaccggctcgaacgtcgtgctctactcgggcaaggacaccagcgccaccagctcgcacgcgtacatgaagggttacagcctcggcgagacctacgtgaccccgagcacccagctgtcctactggatctacccgcagagcacccggtcgttcggcggggtgaccggcagcaacagctcctgcgtgtcgctcgacctgctgctcgaggacaagatcgcggcgaccacggtctccctgcgcgacaccggcgtcaaggacacccgcggcaacgtcgtgcacccgttcaagcagtgcggcaaactgccgctggacacgtggacccaggtgatcgtgccgctcggcgcgatcgcgaacggcaagcggatcacccagatcgacctcggctacgaccagccggccggcaccggcggctaccgcggctacatcgacgacatccgcatcacccagtaa

SEQ ID NO: 6811 - DNA, 420 bp, Actinoplanes utahensis
atgaccgcgatctacaccgcctcggcgaccgcgaccggcgacggccgtaacggccacgtccgctccagcgacggcgtcctcgacttcgacctggccatcccgaaggagatgggcggcccgggcggcgccctgaccaaccccgagcagctgttcgccgccggctacgcggcctgcttccacagcgccctcaagcgggtcgccagcatgcagaaggtcacgctgaccgacaccgcgatcaccgtcgacgtcggcatcggccagctccccagcggcggcttcgggctgaacgtcaccatcgaggccgagctgcccggcctgtccgaggagcaggccacggcgctgctggaggccgcccaccaggtctgcccctactccaacgccacccgcggcaacgtcgaggtcgcgctgaacctggcctga

SEQ ID NO: 6812 - DNA, 477 bp, Actinoplanes utahensis
gtggtgacggtcgccaccaatcagttgtgcacaactaaattgcccactacctttctgggcatgcgggagagcacggcactggacgagatgatctgcttccagctctatgcggccagccgatcgatcaccgcgctctaccgtccgctgctcgacccgcacggcctgacctacccgcaatacctggtgctgcgcgtcctctggcacgacggccccactaccgtgcgtgatctcggtcgcaccctgcggctcgacagcggcaccctctccccgctgctgaaacgcctggcggcgcagggccatctgacccgggtccgcggggccgacgacgaacgcaccgtcctgatcagcctgaccgactccggcctgcggctgcgggacgcgatcggcgatctgacccaggccctgctctgctcggtcaacctgaccgtcgacgagctcacccagttgcacagcctgctcatccgcgcccgcggctga

SEQ ID NO: 6813 - DNA, 504 bp, Actinoplanes utahensis
atgccgggcatccgattcgtgaagcttccccccgccgccctcagcgccctcatcgacggcgacctggccgccgcgagccacgccgccggtaccccgctgagccgctacctgatcgacgaaagctggctgtggcgcatccggctggaggacgtgcgacgcgacccggaggccgccgactggatcgcccgggccgcggtcaccgacccggacggcgtcgtggtcgggcacggcggcttccacgggccgcccgacgccgacgggatcgtcgaggtcgcctactccgtcgacccggcacaccgccggcagggccacgccaaggcgatgctgcgcagcctgctcgaccgcgccgacgccgacccgcgggtcaccgccgtgcgggccagcatccgcccggacaatctcggctcccgcgccaccatcaagggcttcggcttccgcaagatcggcgagcagtgggacccggaggacggcctggaggacgtctacctgcgccccacccgctga

SEQ ID NO: 6814 - DNA, 1104 bp, Actinoplanes utahensis
gtgccgaccaccgccgccgcgaaccggtgcgcgggcgcccccagcgcctcggcgcacaacacggtcagatccagcccgcccgaccggggctgcgcccggtcgacctcctgcagcccgaggacgtccgcgtcgagctcgccgacagcgtcgcggacccgatcggcgtgtaccgtgccgtcggacagtgatctgccgtgcaacaggttgaacgtggccaggcgcaccggcccgaccttagtcgatggaggctggcatgttcatcaaggccctgtgctgcacgatgctgatcttcgtggccggcgcgatgctcggcatctggctgcagcgggcgcgcggccgcaagtgatcgtcctgcttttggtggcggccgcggcggccgggtgggtcgacgcggtcgtcgggggtggcggcctgctcctgctgcccgcgctgctgctcgccgcacccgggctgccgctgccgaccgcgctgggcaccaacaagctcgccgcgatctgcggcaccggcacggccgcggtcacgtacgcgcgccggaccaagatcgactggggggtcgccgggccctccgcggcggtggcgctgatctgcgccggctgcggggcactgctggccggggcgatcccggcaacggcgtaccggccgatcgtgatgatggtgttgatcttcgtggcgatcttcgtgaccgtgcggccggccatggggctggccgagcacggggagaaacgcacgccggtgcgccgggcgctggccgtggcgaccgcgggcgggctggtcgccgcctacgacggactgatcggtccgggtaccggcacgttcctggtgctggccttcaccacgatcgtcggcgcggacttcgtgcgcggctcggcgatggccaaactcgtcaacaccggcaccaacctcggggcgctgatcgttttcggcgtcaccgggcacgtcgactggctgctcggcgccggcatggcggtctgcaacatcggcggtgcgttcctcggtgcccggatggcgctgcgccgcggctccggcttcgtccggatcgtgctgctgatcgtggtgctcgccctgatcgtcaagctcggcgtcgaccagatgagaatgggctga

SEQ ID NO: 6815 - DNA, 474 bp, Actinoplanes utahensis
atgagcgacgagtcgcagaacctgatcgcggaactcaaggaccaggaacgccgcctggtcttcgaccacttcgacgaggccgacgcgtgggcgttgggctgcctgctggtcaacctcgccaccgagcgcagcctgcccgtcgcgatcgacatccgccgcggcgaacagcaactgttccacgccgggctgcccggctccaccgccgacaacgacgtctggatccagcgcaaggtccgggtggtctaccggttcgccgcctcctcctacctggtcggccgcgaactcgcggccaacggcagagagctcgacgccgcgatgggcgtcgatccgatgcggtacgcggcccatggcggggctttcccggtacgcgttgccggggccggcgtgatcggcgtcgtcaccgtgtccgggctgccgcaagccgacgaccacgcgttggtcctcgaggcgctggagaccttcctcgaccgatga

SEQ ID NO: 6816 - DNA, 963 bp, Actinoplanes utahensis
atgcggatactgattctcggcggcagcggattcgtcggccgggtcctggcggccaccgcggtggccgacggccatgcggtgacggtattcaatcgcgggcaccgcgacccgatccccggcaccaccctgatcaccggcgaccgcctcgccgacgacggactggccggtctggccaccgggacgtgggacgcggtcgtggacacgtggtcggctcaggcgtccgcggtgcgggccgccgcccggctgctcgccgggcgtgccgggcactggacgtatgtgtccagccgatccgtgtaccggtggctggcaccgcagccgctgaccgaacagaccgcactcgcggacgtcgacgatcccggatacgccggggacaaactgcgcggcgagatcgccaccgaggcgttcggcgggccggtgctgctggcccgcgccgggctgatcctcggcccgcacgaggacgtcggccggctgccgtggtggctgcggcggatgcaccgtggcggcccgaccctcgcgcccggcccccgctcgctgccgctgcagtacatcgacgtccgcgacctggcgctgttcctgctcgccaccatcggcgccgaggggccggtcaacgtggtcagcgaagccggccacgccaccatgggcagcctcctggacgcggcgaacgcggtcaccggcgggcacgccgagctgcggtggaccgacccggagccgatcctggccgccggggtgcaaccgtggaccgacctgccgatctggatgccgccgggggaggcccacgacttcatgcacaagggggacgtcagccgggccctggcggcggggatgcggtgccgaccggtgatggagacggtcagcgacacctgggcgtggctgtcggggctgccgggggcggcgccgttacggaccgatcggcccgcggtcggactcgatccggacgtcgaggcgaaactgctgtcggactga

SEQ ID NO: 6817 - DNA, 741 bp, Actinoplanes utahensis
atggacatcccccgtcatcacgtcatccgcgagggtgaccttcgcattctcaacccgttctcgcccgcgaagctggccgtcctcggccgagcgatcaagctgcgggccggcgaccgcctcgtcgacctgtgctgcggcaagggcgaactgctccgcagctggcacctggcgcacggcatccgcggcatcggggtggacctcagcaccgccttcatcgcggaggcgcgcgagcacgcggccggccttccggtggagttcgtccacggcgacgccgccggcttcgtcgcgccggaaccggctgacgtggccgcctgcatcggcgccacctggatcggccacggcgtcgccggcaccatcgagatcctggagcgcagcctgcgtcccggtggcatgctgctgatcggcgagccgtactggcgacgggaaccgcccgaccagcagaccgtcgaggcgtgccacgcgcaggcccgcgacgacttccggtcgctgccggaactggtcgcccacctcggtgccgacctcggctgggacctcgtcgagatggtgctggccgatcaggactgctgggaccggtacgcggccgcgcattggctgaacatccggacctggctggacgccaacccgcacgatgagctggccccgcggatgcgcgccgaactcgacaccgacccgctgcgccacgtgcgccatcggcgcgagtatctcggctggggcgttttcgccctgcgaaaacgcggatga

SEQ ID NO: 6818 - DNA, 1158 bp, Actinoplanes utahensis
atgccgatacagtgtatcggcatgagacctcgtatcgctgtggtgggggccggtcccggggggctgagcttcgcgcgggtcatgcatcaccatggccactgcgtcaccgtcctggagcgtgattccggaccggatgcccggccacccggcggcaccctggacctgcacgagggcatgggccaggtggcgctggagaaggccggcctgttgccggagttcgagaagctgtcccggcccgagggccaggccatgcggatcctcgccgcggacggcacggtcctgcgggactggcggccccgcccggacgagcgggccaacccggagatcgaccggggccagctgcgcgacctgctgatcgggcccctcgacgtgcggtggggacacgcggtgtccggggtcgttccgggggcggtgcacttcgccgacgggcggcgggaatccttcgacctggtggtcggcgcggacggcgcctggtcccgggtgcgcccggccgtctcgccggtgacgccccactacaccggtgtcaccgtggtcgagaccgccctggacgacgtcgacacccgccaccccgaactcgccgggctgatcggtgacggttccgtcggggcgtacggcgtgaaccgcagcatcgtcgcccagcgcaacagtggcggccacgtcaaggtgtccgcccgcttccgggcaccgctggactggcacgccggcctggatttgaccgacgccgcggcggtgcgcgcgacactgctcgcccggttcgacggctgggcggccccggtcctcgatctggtccgccgggggaccgcgttcgttcaccgtccgatccacgttctaccggtgggccatacctgggcccatggtcccggggtgaccctgctgggcgacgccgcgcacctgatgcccccgctgggcgccggtgccaacctggccatgctggagggcgccgagctcgccgaggcggtcgccgccggtccggaggatctcgacggggtggtccgaactttcgaggaacggatgtgggcgcgggccgggatgtgggcgcggatcacgacggccggcctcgaacgcctcgtcagcgcggacccggcggaagccgtcgcgcagttcgaccgggtcaaccaggattccggtgcccgaaccggtcgctgccctgctgcttga

SEQ ID NO: 6819 - DNA, 303 bp, Actinoplanes utahensis
gtgcccgaaccggtcgctgccctgctgcttgagtacctgggacagcgcacaaacctgcgcactgcgaccaaccgcgactcgcgctggccgttccccggccgctgggccggtcaaccgctccagtcccgcgtcctgtcaccgctgattcacgcgctcggcgtcccgaccaccagcggccgcgccgccgcaatccgtcagcacgtgctcaccagccccaacggccgggtcgctccgcgggtgcgctcggccggccactgccggtccgggtggaggccgatgccgcggcgtacggcatcgtggtga

SEQ ID NO: 6820 - DNA, 405 bp, Actinoplanes utahensis
gtgactcacggaccggcccgattcggcgggcgctccaccgtcgtcctggcgatcgtgttggactgcggcgacctggagaaatccaccgccttctggtccggcgtcctcggctacacccccggcccggacggcgacggcccctatcgccgcctgctcccgcccgacggcaacggcgtcgaactgctcctgcagcgcgtccccgagcgcaaagccaccaagaatcgtctgcacctcgacctacgcgtccccgacctgcaggccgagagggaacgcgtcaccgccctcggcgcccgcctgctcaccgagcagccgatcgccgaggagggctgggtctggcacattctggccgacccggacggcaacgagttctgcattctccagccgcccgccgaccgcctcatctga

SEQ ID NO: 6821 - DNA, 306 bp, Actinoplanes utahensis
atgcttgagctgccggcgggctgggattgggagattcacaggtacgacggatggcggttgacattgatcggggatgtcgatctgacgtaccactggaaccgggaagtcatcttctgcgacgtcacccatctggcatgtccgttccagttctgcgacccgatctttcgcgagccgacgccgcgggaactcgcctcggtccgcgaggatgagccggcggtggtcgtggcgttcgacgtcgaggacatgccgtgcctgatcgcggccgagtcggtcgcgatcaggcacggcacggtgatgcgccgctag

SEQ ID NO: 6822 - DNA, 315 bp, Actinoplanes utahensis
atggcctggaccgttctcgtcgtctccggtctgctcgaaaccgtctgggcgatcgccctggaccgcagcgccggcttcagcagactcctccccaccggcgttttcggcgtggccgtcatcctcagcatgctggggctcggctacgcgctgcgcaccatcccggtcggcaccggatacgccgtatgggtcgggatcggcgcggtgggaaccgcggtcgtcggcatggtcgcgctcggcgagaacacctcgccggcccggatcatctgcctgttcctggtggtggccggcgttgtcggcctgaaatacgcccactag

SEQ ID NO: 6823 - DNA, 801 bp, Actinoplanes utahensis
atgcgggtgtgcggggcgtgtcatcatggcccgcctatggagacgtctactacctggcgagcgccgctgttgtggcggtttctgctcgcgctgtcccgcgtggtgatcgcgccggtgtgccggttgcgggtgtcgggttcggtgccggcggagttgcggtcggggccggtgatcctcgcggcgaatcatgtgagtccgttcgacccgctggtgttggtggcggcgtgtcaccgggtggggttggcgccgcggatcatgatcaccggtgggttgttcgacgcgccggtggtgggtgcggcgatgcgggcgtgtgggcacatccgggtggatcggggtacggcgcgggtggcggaggcgttgccggcggcggcgcaggcgctgaaggacggtgcgaccgtgctgctgtatccggaggggcggatcgggctggatccgtggatgtggccggagcggggtaagaccggggtggcgcggatggcggcggcgacggatgcgccggtggtgccggtggcgcagtggggtgcgcatcgggtgttgccgtatgaggcgccgacgcggatcgggcgggcgttgttgcgggctctgttcacgcggccggtggtgcgggtcgggttcggcgctcaggtggatgtgtcgggcctgtcgggttcggcgggtgcgcaggcgatgcgcgcgacgcggttgatcatggaggggatcgacgcggctctggcgccgctgcgggctgatgagatgcagttgccgcggtacgtcgatgcctctcgcccggtcgacctgtcgcgggtgcggcgcccgctctga

SEQ ID NO: 6824 - DNA, 369 bp, Actinoplanes utahensis
atggtgaaggggcggatcgtcgccgagagtctgcgtccgggtgccgcgttggtcgtgcccgggctggagctggcgcgggtggcgcgggtggcggtggcggctcccgggccggggcagccggcggtgtggacgctgctggatgtggtggcgccggaggagcggtcggcggagttggcggcggcgttgagtgcggcactggctcccgacggtgggtggtatgcggatttccggtccggtggcgagcatgtggtggtgttcgccggccgggtgttccggtatgcggtgggtgatggggtggggcgggccgaggcggtggcttacgggcggtcgctcggggtgccgcgggcgcagctggactggggtccctga

SEQ ID NO: 6825 - DNA, 537 bp, Actinoplanes utahensis
gtggtaggcggggtgttaagtcaccggttggcggtgcgggcggatctgccggtgctggagtcgctggtcgaggcggcgatcggggagttgcagaggggttttctcgacgaggggcagatcgcgtccagtcgggcgatcatggggttggacacggcgttgatcgacgatgggacgtatttcgtggtcgaggccgatgggcgggtggccgggtgtggtggctggagccggcgcgccacgctgtacgggggtgatcatcgcgcggggcgggatgcggcgttgctggatcccgtgacggatccggcgagggtccgcgccatgtacacgcatccggatttcgtccgtcgcggcatcgctcggttgatcctgtcgttgagtgaggcggctgcggcggcggagggtttccgtgcgtgtgagttgatagcgacgctgtccggggagccgttgtaccgggccgcgggtttcgttccggtcgagcgtctcagcgatgcttcgggtggggtggccgtccctttggtgcggatgcgcaaggctctttga

SEQ ID NO: 6826 - DNA, 507 bp, Actinoplanes utahensis
atgagcgaacaccaccccggccagcgacccgacgaccggcccaccggccaccgacccgacgaccggcccaccgagcccggccccaccggacaccagcccggcgacagccgcggggccaccggcgagcgacccagcgacctctggcgccgccaggtgagcacccagaccgcccagatcaccgccggccaactcacccccgacaaggcgtacgcggccgagctgtggccccccgacttcatcgccgccgtcgacctcgccctcaccgcctacgaggacgacgtccgcgagttctcccccaccagcagcgaccacgacatctggaccgccgtcgaacgcgtcgtgctcgccctcaacgaggtcgacgactacatcgaaaccgacgaacgcgaacaactcgccgcctacgtccacgacgtcctcgtcggcgccggcgtcgacgtcaccgccgtggccggccgccgaggcctgcaccccgccgaactcaccgaccaatggcgcgactggtaa

SEQ ID NO: 6827 - DNA, 357 bp, Actinoplanes utahensis
atggacatcacgatcgaccccgactcccccaccccgccctacgaacaggtccgcctacgcatcgccgcactcgccgccgacggccacctcgccgccggcacccgcctgccccccgtccggcacctcgccaccgacctcggcctggccgccaacaccgtcgcccgcgcctacaaggaactcgaacaggccggcctcgtcgaaacccgcggccgagccggcacggtcatcaccgcccgcgccaccggcacatcgctgcgggcccagaaagcagcagcggcgtacgccgaaaccacacgcgccctgggcatccccgccgacaaagccctcgccctggtcgaagccgccctgcacgcctga

SEQ ID NO: 6828 - DNA, 1377 bp, Actinoplanes utahensis
atggccctcaccggcaccccgacacccgcacccgccggtaaacgggaacgcaccggctggtacctctacgactgggccaactccgcgttctccaccacggtcatcaccgtcttcctcggcccgttcctcaccaaggtcaccgaacgggccgccggctgctccatcgacgccgacgagtgccacgcctccgtgcacccgttcgggctcaccgtcgccgccggctcctacttcccctacctggtgtcgctgtcggtgctgctcaccgtcttcgtcctaccggtgatgggcgccgtcgccgaccgctccccgcgcaagaaacccctgctcgccaccgccgcgttcaccggcgccgccgccaccgtcgcgatggccctggtcaccggcgaccgctacctgctcggcggcatcctgttcctgatcgccaacatcgccttcggcgcctccgtcgtcgtctacaactcgttcctgccccacctcggcggccccgacgaacgcgaccggatctccagccgcggctggggcatcggctacctcggcggcggcgtcctgctgctgctcaacctcgtcgccgtcaccctgttcagccaggacggcaacccccaacgcaccctcgacctggcccgctggtccatcgtctcggccggcgtctggtgggccgccttcaccctgctgcccctgctctggctccgcgaacaccccggcgccgacagcacccccacccgcggcaacgtcgtcaccgacggcttccggcagctcggccacaccctcaagtcgatgcgcgcctacccgctcaccctcgccttcctcggcgcctacctgatctacaacgacggcatccagaccgtcatctccctcgccagccaattcggcaccgaggaactcaaactcgaacaatccacgctgatcatcaccatcctgatcgtccaattcctcgccttcggcggcgccctgctgctcggcgccctcgccaaccgcatcggcgcccgcaacaccatcctggtcgccctcgccctgtggctcgtcgtcgtcgtggccgccttctggctccccgccggcgcccccgtccccttcatgctcctgggcgccggcatcggcctggtcatgggcggcagccaagccctcagccgcagcctgttctcccaactcatccccaccggccgggaaggcgagtactacggcttctacgaaatcagcgacaagggcaccagctggctcggcccgctgttcttcggcatcatcttccagctcaccagcagctaccgcctcggcatcgtctcgctcgtcgtcttcttcgtcaccggcggcatcctgctcgccctcgtcccgatccggcgggccgtcatcgccgccggcaacacaccccccacactcatctga

SEQ ID NO: 6829 - DNA, 483 bp, Actinoplanes utahensis
atgagcgaccactggggcggtttcgaccaccacgacgacggcggcgatcaccacctgccggacttcgacgactcccacgacctgcccgccggccacgacctgacggacatgtccgacctgcacgatcagcacgatcatgacgacccgggacacgacgacgcccaccacgacgacgcccagcacgacatcgccgaaatcccggacacccaccacgacccggtggcgctgaccgacgacttcccgccccacctcgaagtcggcgaactccccgaacccgtcgacggcttcccctggaccgacgccgccaccctcggacacgccgccgcctacacccccaccaccgacccggtcgacccgcacgacctcgccgcctacgccggcctcgacgtccccgaaggcagcgacccgtggaccgccctgaccgcctccgacgaccccgcgatcagcgccctggcccgctggtggacacccgatgaacagtga

SEQ ID NO: 6830 - DNA, 1803 bp, Actinoplanes utahensis
atgcgtgacctgaccgccaccctggacgccgccgtccgcgacagcctcgcctacctgcgcggcgtcgacatggacgccgccgccgacctcgccgagctgcgccgcacccagctcacccgacccggcgtggtcgtcgtcggcgaaaccaaacgcggcaagagctccctggtcaacgccctgctcggggtccccggcctgtccccggtcgacgccgccgtcaccaccgccgcctacctcgacttcgtgcccggcccggcgtactcggcccgcgcctggctgcccgagggcggcgacagcgtcccggtcgacgacctcggcgcctgggcccgcggcgcccaccgcgcccgccgcatcgaggtcacccaccccgccccgctgctgcagtacctgagcctgctcgacaccccgggcgccggcggcctcgacccggtgcacgccgtcgtcgccctcgacgcggtccgccgcggcaccgccctgctgttcgtcgccgacgcctccgcccccctgtccagccccgaactcgccttcctggcccaggccgccgaacgcgtcgacgccgtcgtcttcgccctcaccaagatcgacgcgttcgggcagtggcggcgcatcgccgaggacaaccgggccctgctgcaggcccacgccccgcgcttcgccgccgcaccctggtacccggtctccgcccgcctcgccgaactcgccctgaccgccgccggcgaccaccagagcaccctggccgaagcgtcacagatccccgccctgcagcacgccctgatcgaactcgccggccgcggccaccagctgcaactggccaacgtgctgcgcgccgcccgcggcgaactcggccgcctgcagacccaggccgaaacccgggtccaagccgccaccgccgacccggcccgccaggccgaactgcgcgccgaccgggccgccctggccgcccgcaaacgcaccgagtcccgccagtggtcgctgctgctcaacgccgaggtgcagcgcgcccgggtcgaagcggtcggcgggctgcgcagccgggtcgccgacatccagcaggacctgtccgcccggatcgacaagatgcgcggcgagcagctcacccacctgcccgacgacgtcgacacccacctgcgggcggtcgccgccgacctgtcgcaacgcctggagaacaccttcgcccaggtcgccgagaccgtgctcaccagcgccttcgaaccggacgaacgcgacgccgtgctgggtaaactgaacgcgacactgcgccacgaactgaccgcggcgccaccgcgcgacggcgccggcgacaacatgctgatcgccctgtccgccggcggcatcgcgttcatggccgggcgcggcgccgccctgggcatctcggtgctcggcgccgccggcggcctgctcgtcccggtcgccggaatcggactgggcctggccgccggcgggtacgtgctgtaccgccggcgcgtgcactccgaccggcagcacgcccgcggctggctgcgcgacgtgctcggcgaggcccgcgccgccctcgccgacgagatcaccgtccggttcaccgacctgcagtacgccctgtcggtcgccctggacgacgccacccagcggcggctgcgcgacctcgacgcgcagatcgccgacatcgacgcggccgccgcggaggacaccgccgggcgcgccaaacggcgcgcggtggcccagcaagagcttgacacggtacgcgtacgggtgcgccaggcggacgaggcgctgctgcgggcccgggcgctgaccccggcaccgatcgacgagagggacagatga

SEQ ID NO: 6831 - DNA, 1494 bp, Actinoplanes utahensis
gtgaccggcccgctcagcacccgactggctaccctctgtcacgatattgtcacggaattcggttccgctgctggtggccaggtacgacagatcggcaaccgtctccacgagccgttacgcgtcgcgatcgccgggcgcctgaaagccggaaagtcgacactagtgaacgccctgatcggccggcgggtcgccccgaccgccgccggcgagtgcacccgggtcgtcacccggttccggtacggcccggccgaccgggtgaacatcgtcacccgcgacggcatccaccacagcctgcccctcgacgacgacggcatggtccccgcccgcctcggcgtgcccgccacccggatcgcctacctcgacgtcaccctcaccaacgaccgactgaaaacgatcaccgtcgtggacaccccgggcctgtcctcgaccgacaccgcctccagcgaccgcgcccgccacgtcgtcggcgacgcacccttcgacgacgacatcgacgccgactcggccggcgaggtcgccgccgccgaagccgtcatctacgtcttcacccaggcggtgcgcgccgacgacgtacgcgccctggacgccttccacgacgcgtccgcccgtctggcggccagcccgatcaacgccctcggcgtcctggccaaggtcgacaccctggccggcggcgccggcgacccgtggccggtcgccgcgcccctggccgagcagcaggccgccctgctgcgccgcacggtcagcggcgtcgtcccgctgatcggcctgctcgccgagaccaccggcgccggccggctcaccgacgccgaccgcgacgccctggcccgcctggccgccctgcccaccggcgagctcaccctgctgctcacctccaccgacctgctgcgcaccctgcccgccccgatcccggccgaccaccgcgaacggctcctcgggcgcctggacctgtacggcatcggcttcgcctgcgcgcagctcgccgccgaaccccggctgggcaccggcgacctggtgcgccgcctcgaagccgcctccggcatcccccggctgcgcaccaccctgcaacagtcgttcggctggcgcgccgacgcgatcaaggccggctgggcgctgacccggctggaccgcctcgccgggcacaccggcgacccccgcctgcgcgccggcgtccgcgacgccctggaaaccgtgctgcgcgaccccgcctaccaccggctgcgactgctcgacgccgcccagcgcgccgcgaccggcgccgtacgcctgcccgccgaccgggagaccgaactgatccgcctcgccacctccaccgacccccggtacatcctcgacctgccgcaggcacccgagcaggaactggccaccgccgccatcgccgcggccggccgctggcgcgcctacgccgtcgacggcgccggccccgcccaggcccgcgtcgcgcacatcgcgcaccgcggcttccagctgctggcccaggaggtccgccatgcgtga

SEQ ID NO: 6832 - DNA, 183 bp, Actinoplanes utahensis
gtggcggacgaggctcacctggccgcatcctccactctgcgtcacggccccggcctcgtcgtgctcgccggcccgcccggctgcggccgcagcaccctgctgcagcgcctcgccgcgaccctcggcggcccggtgcacgccggcggcggcctggccatgctcgccggcgtcccggctagctag

SEQ ID NO: 6833 - DNA, 303 bp, Actinoplanes utahensis
gtgctggccggccgcgcccgccgcggcctgcgccagcacggcatccaccgcgacacccgcagccgccgctccgagggcggcctcacccaacgcgaacaggacgtgctgcgcctggtcgcggccggcgagccgacccggcgcatcgccgggcaactcggcatctccaccgagaccgtcgacacccacatccgggccagcatgcgcaaactcggcgcccggacccgcaccgaagccgccgccctggccttcgccgccgccgggccccgcgcagacaccagcgacaacagcgaggatggccggtga

SEQ ID NO: 6834 - DNA, 528 bp, Actinoplanes utahensis
gtgaacaatccacccgacacaccacgccacgtagttgccggcaccgccgacgccgagaccatcctgcggcgcctggtccgcgacggctggaccgcccggcccggcttcgccctgcccgacgccaactgggatgtcaccgccgcccacctcgtcctgcacggccgggtctccgacgacgacacccacaccgccggcctggccgtcctggccgccgcccgcggcgccgccgtcatcgtcatctgcgacaccgactccccggccggccgcgccctgatcgacgacctgtcccgcatcggcgccgtcaaccaggaccccgacggcgccgacccggtcgcccacctcatccccgaacaacgcgccctgctcgaccgcctcgccgccggcgacaccatcgccgccgcggccgccgccgagtttctgtccctgcgcaccgccaaccgacgcatcgccgaagcccgcgccctgttcggcgtccgcaccacccgcgaagccgtcctggcctacctgcgccagcgtcaacccgactga

SEQ ID NO: 6835 - DNA, 618 bp, Actinoplanes utahensis
atgaggcgctacacgctggccggattcgtggccggccacccgtggacgaccggcggtcaaccctggaccgccgacctgccgggcacggtggccaccgtcagcgactgcctcaccgcattcctgcctctgggccgggacatcgagccgtggcagcagcccctgttcgagccgtggcaccgtaccctgcgtcaggcagcccgcgcggccgagcgggcacccgggtcgcacgtgctgagcatgagcgtgccggccgacgggtccgacccactcaccaccatgatcgaagagtggatcggtgaccttccgcacccgatccggatcaacctcgcgcaccccgcggccgccccacccggaacgatccgcggacacgaggtcctcggcttctccggcggccgcttccacagctggctctgctaccgcctggacattccggcagccgccgaactcggcgtgcaggcggccggcaacgccctgctgagcaccctcgacgacgcccggcgagtcgccgacatggccaacgacaaccgcggcacccctgacggcaccccgcacgacatcacctggtttcccgcgctcatcaccgaacaccacgacgcggccccggcaccgcaacgctga

SEQ ID NO: 6836 - DNA, 333 bp, Actinoplanes utahensis
atgaccggcgatggggcgtggaacgcgctcatgccgatgcgtccgatcatgcccgtggtgacggcctatcctgggccggtgctggaaaccgtggcccgtgccctgttcgagtgtctgatgttcgttgaactcagcgacgacgacgccgttgaccccgacagcgcggtggccttgatggaatcggtctctcacgtgctgctcgagctgccgctcgccgagcgactcgtcctggtccagctggcgcagcgccaggccgagcaggagtcactaccggctcgccgagattttctggcgtcgctcggtggcggcctcggacttatcgacgaaggctga

SEQ ID NO: 6837 - DNA, 2205 bp, Actinoplanes utahensis
ttgctcgagcagggcgtgaagagtggtctcgtaaccggcagggatgccgttcatcggtccgccaccgatgacctcgacgcgggcgccgaggtcatcgggagtcagcacggtgatcgcgggacgagtgacagatccgtcggtggtgccggctgccgactcatccggctcggcggtgcccgacgagcccggattcgtcagatcgagccggagtacgccctgctcctcgccgagcaggccgatccagggcttgatctccatggtgttcgcatccgtccagcgcagcgtccgggcggcgcgccggaaacctgccgaggtgctgaacgccagagcggacgcggacgcggcgaccacctgcccatcgacacgtcgccgggcctcgatgatcacccggccatagccgtcatcatgcagcacgaataccggacgagcggtatgccgccggtccgggctggtctttgccggcccggtccaccggaaacgcagaccggccgccagcgcgtggtcatacgcgcgagccagagcgtcgcagttcccgccacggtcgtgcgccagtcgagtggcggcggcatgcaccacgtccaagaccagacgcgcacggtcggtggccggcagtgccgcaacggtgggcggtatcgcggccgccgccgtctcgaacccctcgcgaacctccggatacaccgtcaccacgacatccgcacggctccggtcgagccggcagaagagccgcagctccgaatgacgtgcaggaatggccgcctgcgccaccgcttcgctgtacaactcacagacactacgtgcgctgcgcacgaacgcgtcctcgtcggggtgctccagccagggccgatcagggaacccggcaggcggccagaacccgaccatacgcaggtacgacatgctatcgatcatgccgcacggcagggagagccaccggcggtcgcctgcgccatgggacggactcgacgaaggctggcgccgcaactcgcgaacgggaccggcgcatggtctccgcgggtttgcaccgttgactacgatccgggacatggcgttccgggtgaagcgggtgcacgacgatgccgatccggccgacggctgtcgcgccgaactcgacgcccacccgcaggccgtggccgacccgcgccggacgccccgcgagcacggcacgatcaccctgctgcacagcgtccgcgagaccaccgacaaccatgcccgcgtgctcgccgaccatctgtccgccggcgccgacctgccggcaccggcatgacgctcggccgcgggaagctcgccgccaccgccgccgcgatcgccgccatcggcgtcggcatcggcatcggcatccacgggctcgggggccgcaccatcaccagcagcagccccagccccagcagccccagcgccagcccgagccccagcgccacctccagccccatcaccacagccaccaccagcagcaccagccccggcaccacgaccgccgacaccccggccggggcgccaccgccgggcaacgcgagtttcgactaccagatcggcggtgcctacaccccacctaccggggtcaccgtggtcagccgcgacagccaggcgtccccggcgcccgggctctacaacatctgctacgtcaatgccttccaggcccagccgggcacccagccgtggtggcaggcccaccaccccgagctgctgctgcgcaccgccgacggcgacccggtcatcgacaaggactggaacgaggccctgctcgacttctccaccgacgccaagcgcagcgcgctgaccgcgatcgccggcgcctggatcgaccggtgtgccgccgcgggtttccaggccgtcgagccggacaacctggactcgtacacccgctccgcagggcttttgaccaagaatcaggccatggtgtacgccacggcgctggccggccgcgcccacgaggagaaactggcgatcgggcagaagaacaccgccgagctgagcagtgccgacgcgcaccgcatcggcttcgatttcgccgtcaccgagcagtgcgccgacttcgacgaatgtgacgcgtacaccgcctcgtacggcgatcgggtcttcgtcatcgaatattccacggccggtttcaccaaagcctgccacgcctacggcgcccgcctgtccatcgtgctgcgcgacctggaagtgagcacccccgattccccgtcgtaccgttaccgggcatgctga

SEQ ID NO: 6838 - DNA, 390 bp, Actinoplanes utahensis
ttgagttcagtggtcaatcacatcaccgtcgactgcgtcggcgacccgtacgacctggcgcggttctggagcgcggtcaccggcaacccgttgtccgacgacgatcagccgggcgatccggaggccatggtgatcccgccggccggtaccggtccgttgatgctgttcgtccgggtgcccgagaccaagacggtgaagaaccggctgcacctggatgtcaaaccgaccgaccggacccgcgacgaggaggtcacccgcctgctcgggctcggtgcccgtccggtgaccgatcaccgccgcggcgacggctccggctgggtcacgctcgccgaccccgagggcaacgagttctgcgtcgagcgttccgacgccgagcgccgcgggggctga

SEQ ID NO: 6839 - DNA, 867 bp, Actinoplanes utahensis
atgtcgtctccttcgcttcccggtggctccgggaatctgggtggctcgccggtcacccggttcgggtacggcgccatgcagctggccggtccgtgggtgatggggccgccggccgaccgcgacggagcgctggccgtgctgcgggaggccgtcgagctcgggatcacccacatcgacaccagcggggcgtacgggccgcggatcaccaacgagctgatccgtgcggcgctgcacccgtacccggcgtcgttgttcatcgcgaccaaggtgggcgcccaccgtgacgcgcagggcggctggccgacggcccggcgcccgcaggatctgcgtcagcaggtctccgacgatctgcggactctcggggtggacacgctcgacctggtgaacatgcggatgggtgacgcccgggggccgcggcccggctcgctggccgaggcgttcgggacgctcgtcgagctgcagaagcaggggctgatccgccatctgggggtcagcaacgtcaccgccgagcaggtcggcgaggcgcagtcgatcgcgccgatcgtgagcgtgcagaacatgtacaacctggcgcaccggcacgatgacgccctcgtcgaccggctcgcggcggacgggatcgcctatgtgccgttcttcccgctgggcggtttcaccccgttgcagtccgcggcgttgacgtcggtggcggaccggcgcgggagcacgccgatggcggtcgcgctggcctggctgctgcagcggtcgccgaacatcctgctgatcccgggcacctcgaaggtggcgcacctgcgggagaacgtcgccggggccggtctggtcctgtccggcgaggatgtcgccgagctggacggcatcggccgctag

SEQ ID NO: 6840 - DNA, 444 bp, Actinoplanes utahensis
atgcttcgggggatcgagggtgaggagcatccggtggcaacgacgacagccgcgcaggcacgggccgacgccagagggcggtacaacgcgtttctggcggtgtgtcccagccacaagatgctggagcggatctccgggaagtgggtcatcctcatcctgtcggcgctgggcagcgggcccggctgtgacggcgacccccgcccgatgcgctactcggagctgtcccgggtgctggccggggtcagccagaagatgctgacccagaccctgcgctccctggaaggcgacgggctgatcagccggaccgtggtgccgagcgtgccggtcacggtctcctacgagctgaccgagctgggcctgtccctgcaccacctgatgcgcggcctgaagaggtgggccgaggatcacgtggaggcggtgtcggccagccgcaccccggagtga

SEQ ID NO: 6841 - DNA, 1653 bp, Actinoplanes utahensis
atggaccacgaatatgttgttacgcggcgtggggagcgctcggggctggccgtgacgatcgcggtgcatgccaccgcgcacggccggtccgccggcggctgccggatcaagcactatccggattggcgcgcggggctcgccgacgcgttgcggttgtcggcggcgatgaccgccaagtgtgcgtacgccggtctcccgctcgggggtggcaagacggtggtgacgctgccgcccggacaccggctggacgcggccgggcggcgggatctgctgcacgacgtcggtgacctgatcgaggatctgggcgggcggtacgcgaccggtccggatgtcggcaccggccccgacgacatgacggtcatccacgaccggacgcggcacgtgttctgccgtccgcggtcgcaggggggcagcggggattcctcgccgcacaccgcggccggtgtcgtggccgccctgcgggccgtgggcacccaccggttcggcacgccggagctggccgggcgccggatcgcgatcctcgggctgggccacgtcggcgcgcacctgctgcgcatgctggccgccgagggcgcggtgctgaccgtggccgacgtcgacgacagccggcgggcgctcgccgaccggcacggcgcgacctggaccggcccggacgactgcctgcgcgccgagaccgacatcctggtgccggccgcgctgggcggggtgctgaccgcggcgaccgtgccgcggctgcggtgcgccgcggtggccgggccggccaacaaccagctcgacgacccgcggaccgcggatctgctgcgcgagcggggcatcctgtgggcgccggacgaggtggtcagcgccggtggccccgccggcagcgccctgctcagcctcggccgggccttcccgctgctggccgacgcggcgtcgttcgccgtctccgccctgctggtcaggtcactgccggcgctgcaccggccggcccgccaggcccgggagtcgctgctgcggcaggcccggtccggggcgtcgtacgtgttccgcgaccggctgctgctcggcctcgcgctgcgccccgcgatcggcaacatcgccttcgtggccgccgaaaccgtcctggccctgttcgcccacgatcgcctcggcctgggcaccgccggtttcggcctgctgctgaccgccgaggccgccggcgggctgctcggcgccggcctcgcctcgccgcttcgccggaccctgggcaccggcaccgcgctgacctgcaccgccgccatcgaaggcctcgccgtcctgggcctggccgccgccccgaacccgtatgccgccgggctggccctggccgtctgtggcgccggcatgggcgcgaccatggtcctcgcgccgtcgctgcgccagtcgatcgtccccggtcatctgctgggccgggtcaccgccacctcccggatgctggccatgtgcgcggcaccgctgggcgccttcctcggcggctggctcgccgccgcgttcgacgtgcgcaccccgctgtacgtgggcggcggcctgctgctgagcatgaccctggtgacggcgacgatgaccggcaaccggcgggtggcggcggcactgcgcgccgccaccacggtcgagtctcactccggggtgcggctggccgacaccgcctccacgtga

SEQ ID NO: 6842 - DNA, 546 bp, Actinoplanes utahensis
gtggtccatggcaaaaaactaatgaggtgtacgtcgtgggcgatctgtttccgaacgatgttcgcgcgctgggcgataattccggccgtggacgaacttgattcggcgatcgtggcccatttgcagaccgacgcccggcagaccaaccgcgacctggcccgcgccgtcgggatcgccccgtcgacctgcctggagcgggtccggtcactgcgcgagcgcggggtgatcagcggcttccacgccgaagtggacctcggcgccctcaaccgcgcggtgcaggccctgctgcacgtgcaggtccgcccgctgaaccgtggtgtcatcgagagcttcaaggcgtacgcgatgggcctgcccgaagtgctgtcggtgtacgtgctggccggcggcgacgacttcctggtacacgtcgccgtgcccagcgtcgacgggctgcacgcgttcctgatggacaagctcagcggccgccgggagatcatcggtttccgcagctcgatcatctacgagcacacccggaaaccggtgatcgacccgctcgacctgtga

SEQ ID NO: 6843 - DNA, 498 bp, Actinoplanes utahensis
gtgctcggcctgatcgcggccggctgcgcgctcggctacgccccgttcgcccggctgttccggcagatcatcgagatcctgctgttcggcgcccggcacgacccgatccgggccgccacccgcgccggcggccgcctcggcgacgacccggtcccggccctgcggtcgctgcgcgaatccctggccctgccgtacgcggcgctgctcgacgccgccggcgaggtggtggccgccagcggcaccaccagcgcgaccgtggtgcgccaccggctggccggcctcgggcacctcgacgtcggcctgcggaccggtcagtcccacctgctgcccggcgccgtgcaggtgctgaccgtgctcgcccccgccctggcccagctgctgcacgcccgccggctcggcgccgacctgcgcgcctcccgcgccgccatggtccaggccatcgaggaggagcgccgccggctgcgccgcgacctgcacgacgggctcggccccggctga

SEQ ID NO: 6844 - DNA, 852 bp, Actinoplanes utahensis
atgctgatcgaccgggccgggctcgccgagtttctgcggcgacgccgggagtccctgcaacctgaggacgtcggcctgccccgcgggacccgccgccgcacggcggggctgcgccgcgaagaggtcgccacgctctgccacctgtccgccgactattacagccgcctggaacgcggccgcggaccgcacccctcgccgcagatggtcgcgtcgatcgcgcagggcctgcacctgtccctcgacgaacgcgaccacctgttccgcctggccgggcaccacccaccggtgcgcggcgacgccggcgaccacatcagccccggcctgctgcgcatcttcgaccggctcaccgacaccccggccgagatcatcaccgagctcggcgaaaccctgcgccagaacgcgctgggcgtcgccctcaacggcgacctcacccggttcaccggcccggcccgcagcatcggctggcgctggttcaccgacccggccagccgggcccggtatcacccggacgaccaccggctgcactcccgggtcttcgcctccggcctgcggcaggtggcaaccctgcgcggccccggctcccgcgccgcgcaactgcagcagcagttgctcgacgggtgcgcggaattccgggaggtctggaacgagcacgagatcggcattcggtaccagcacgtcaaacgcttcgtgcatcccgaggtcggcgggctggaactgacctgccaggcgctgctcgaccccgagcagggccactcgctgctggtctacaccgccgtcccgggcagtgacagccaccagaagctggccctgctctccgtcatcggcacccaggacctgacggtcgacacctga

SEQ ID NO: 6845 - DNA, 945 bp, Actinoplanes utahensis
atgccgcgcacccagcccgacctcacccttcccgacctgtccgaccggcgggccgtggtcaccggcggcagcgacggcatcggcctgcgcgtggccacccggctcgccgccgccggcgccgaggtcgtcctcccggtccgcaaccgggacaagggcgaggccgcgatcgcggcgatccgccggcagcagcccgccgcacgggtctctctgcgcgagctcgacctgtcgtcgctggcctcggtggcggcgctgggcgccacgctgcggaccgaggaccggccgatccacctgctgatcaacaatgcgggggtgatgaccccgccgagccggcagagcaccatcgacggcttcgagctgcagttcgccaccaaccacctgggccacttcgccctggtcgcgcacctgttgccgctcctgcgggcgggcgcggcgcgggtggtcaaccagatcagcgtcgcggccgactcccacgccatcgactgggacgatctgaacggggaacgctcgtacgacggcatgcgggcgtacagccaatcgaagatcgctctcgggttgttcgggctggagctgagccgccgcagccggcggctgggctggggcatcacctgcaccctggcacaccccggggtcgcaccgaccagtctgctggccgcccgcccggaggtcggccgcgaccggcagaccatcggccggcgactgatcggcgccctgtcggcgcgcggcatcctgctcggcaccgccgactcggcgagcctgcccgcgctgctcgccgcgaccgggcgcgacggcgccttctacggcccgggcgggcccgggcgcctgggtggggcgccggccgagcagaagctgtactcgcggctgcgcggggaggccgacgccgagcggatctggcgcgtctccgaggagatgacgcgggtgtcgttcgccgccgggttgcaccggtga

SEQ ID NO: 6846 - DNA, 705 bp, Actinoplanes utahensis
gtgacgatccgctgggtgaccggtttcctggactcccccgccgggctggccgcggccggtgagcggttctggctcgccgtgaccggttcggtgatgtcgccgcggcgcggcggtggcacgttcgcgacgttgctgccgccggccggtgacccgtggctgcgggtgcaggtcgtcggggacggcccggcccgtacgcatctggacctgcacgtcgacgacttcgccggcttcgaggtgcccggggcgcgggtcgtcgaccggcaggacgacgtgatggtgctgcggtccccggccgggatcgtgttctgtgtggtcccgtggtccggggagaagatcgtcgcgctggaccggtccgcggtcgtcgaccaggtgtgtctcgacattcccgatcagctgtacgaggtggaggccgcgttctggacggccctgaccggctgggcgcggaccccgtccggggcgccggagttcgagcatctgaccccgccgccgacgctcccgatgaagctgctgctgcagcgggtgggcgcggggccggccggaatgcacctggactgggcgtgcacggatgtgccgggcgaggtggcgcggcacgagtcgctgggtgccacggtggtgcgccgggtgcccggggactggacgacgctgcgggacccggccggccgggagtactgcttgaccgcccgcccgccccgccgtccgggctga

SEQ ID NO: 6847 - DNA, 993 bp, Actinoplanes utahensis
gtgggaggtcgccgccgggttcgccgagggtttcgggcgcccggatgtggcgcgggcgttgcggacggggaggaactgacactgatgcggcgggtgcgttatcaccggcacggcggtcccgaggtgctggtggtggaggacggtccggagccggttgcgggcgagggtgagctgctcatccgggcggcggcgatcggggtgacccggcccggggtggcgcgggtgcgcggcggggacggtccgctgccggcgatgccgggtggggaggtcgccggtgaggtgatcggtatcggtccgggcgtgtcgggttgggcggtcggggaccgggtggcggcgttgccgttcggtggttcgtatgccgaggtggtggcggtgccggcggcgtttgcggagcggattcccggttcgttcgtcgacgcggtggcgttggtgcgctccgggcatgtggcgctcggggtgctgaccgtcgcggcgctgcgcgggggtgagtcggtgctggtcacggcggcggccagcggggtcggtcatctgctggtgcaggccgctcggcggcgcggggcggggcgggtggtcgcggcggcggggcccggaaaagccgatttcctgtacgggctcggggcggatgccgtggtcacgtacgaccggttgccgttgccggacccggtggatgtggtgctcgacggggccggtggtgacctgctgggcgcggcgctcgggtcggtgcgggccggcggcaggctgatcttcttcgccagtggtggtggcacggtgcccgctttcgatctgctggcgggggccaagacgatgaccgggttcacgatggccaacttcgcccgcggcaatcctgaggtgtatgccgggcacggtcgtgagctgtgggatctcgggctgacggtgtgtgtgcacgcggcgttgccgctggcgcaggcggcgcgggcgcacgagatcgtcgaggcgcgggcgaactgcgggaaggtggtgctgctgccgtga

SEQ ID NO: 6848 - DNA, 741 bp, Actinoplanes utahensis
atgcggcttgcggtgatctccgatgtgcacggcaatctgccggcgttggacgcggtgctcgcggcgatcgccgcggacggcgtcgatctgaccgtcaacctgggtgatctgctgtcgggctatgtgcagccggccgagaccgcggaccggttgatcgccgcggatctggtgacggtggccggcaaccacgagcggcaggtgctgactctgcccgaggatcgccagggcatggcggaccggatcaccaccgggttgctgaccggtgcgcatcgggcgtggctggcggcgctgccggcggtggtgtcgcccgcaccgggggtgctggcgtttcacggcacgcccaccgacgacctgcagtatctgctgcacacggtcaccgcggacggggttcgggacgcgaccggggacgaggtgcgtgagcggctcggtgcggcggccgccgggccggcgctgctgctgtgcgggcacacccatctggccggatcgctgcggctgccgggcgggccgctgatcgtgaaccccggcagtgtcggctggccggcgtacaccgatgaccggccgttcgagcaccagatggcggccggcagcccgcatgcccggtatgcggtggtcgacgatgcgtcgggccggtgggaggcgcagttgcgggcggtggagtatccgtgggaggtcgccgccgggttcgccgagggtttcgggcgcccggatgtggcgcgggcgttgcggacggggaggaactga

SEQ ID NO: 6849 - DNA, 597 bp, Actinoplanes utahensis
atggctgcggccacgttgagcggggcgttgcgggatccgtgcgtaccgcggctgcggttgttgccgccggaggtggctgatcttctggtgtcgatgcaggcaccaccgcggctgggcgcgcatctgcgggcggtgcacgatgtggcgtgggagttgaccggctggctcgccgcggcgtatccggggctggtcttcgatcgggcggcggtgctgttcggggcggccacgcacgacatcggcaaggtgtggcatccgcgggagttgtcgggtccggggtcgcggcatgagtcggccgggcagcggctgctcctggcggcgggggtggcgccgcggctggcccggttcgcggccagtcacggggtgtgggatgcgccggggctgggcgtggaggatctgctggtcgccgtcgccgacaaggtgtggaaggcgaagcgggtgccggatctggagcagctggtggtggagcggctggtggcggtgtccgggcgtgagccgtggtcggtgtttctgaccttggatgatcagctggatgtgctggcggcgggggcggacgcccggttggcgtatcaaaatgggtttcccgtcgccgtagggtga

SEQ ID NO: 6850 - DNA, 600 bp, Actinoplanes utahensis
atgcgctcacccgtcctttgtggatgctatgaatgtgcggtgcggaaacgggtcacggacgcctgcgcgcgagcgctggcctgttgcggtttcacccggcggcggcacgggatcctgttgcaggccgattccggctggctggacctgggcctgaccgatcatcagacgtcggtggtggcggagccggtggtcggggtgcggcatgcggtggtggagcggatcctggtggcgacggccggctgggatgagccggtggcgtgtgtgacgttgccgctggggcggggctggcggttcccggcgggggcggatctgagcgagatcgccgcggagctggcggaggaggtggtggtgcgcgggcagccgttcatcgaccgctggtcggatccggtggcgttgcgccgtgacatcggcacggtggtggcgcagcagacgcggcatctggtggtgccggcggtggcgctggccggcgggcagcgcgagcgtgcggtgggtctggtccgggccgaggtgcgacagttgagcgggcgcgacgacgggtacgcggtcgcctaccgcgagttcgcccgccggttcacccggctcgccgaggggggtgcctga

SEQ ID NO: 6851 - DNA, 525 bp, Actinoplanes utahensis
atgatctaccggcggggcagctcagcgagtggactcgcaacgttcaatgtcgctactcacagtgcccatcccgccgggcctcagcccggcatgtcgggccggagacaccgctcctggcacagtcccggtcgctgtggtggtggctgccatgatgctgcggtgggtgaggtgcgggtgccgtttcactgcgggacggcgacggtgtcggaggctgtccgggatgggcggctgctgtgggacgtccatcaccggtgtccggacggggatcaggtctcgtgcggccgggacgggttgcctgacgagctgcggcaggcggtgctggcgcagggtggacggttccgggtcgggtttccggaggcggatcggctggcggtgctgcgggtgttgcggcggcgcggggtggcgatcgggtcgttggacggcgtacggcagaggggggtgaccgggaccgaggcggagatggagctgttgcggcaacagctcgccgcggtgggtgtggtggtggtcgtcgagcggtgtgggtga

SEQ ID NO: 6852 - DNA, 624 bp, Actinoplanes utahensis
atgcgagcgcttgatatcttccccatcatcatgatcaattcgcagaccgctgccaccgcggctctcatcgcgctcgccgcctacctgatcatcatcaccgcgctgcacgtcctgccgaccggataccggctggccgaccacgccgtcagcgactacggcgtgggccggtacgcccgcctgttccacaccggcctgatcgtcaactcgctgggcgtcctcgcgctcgcggccgccctggccctcgcaccgaacctggacccgcccacgactcccctggtctacctggtgctgctgccggtagccaggatcggcatcgccgtcttcccgaccgacctcgaaggccgcgggctcacaccgaccggcatcgcccactacctgtcggccatcgccgcgttcaccctcacctacctcgccatcgacggcctcacccccacgctgcgcgccgccacctcacaccccgacgtgccacattggctcgccatcgcgacgcccgtactgctcgccgccgtcgccgtcaccatgttccggccactacgccggctcttcggggtcaccgagcggctgttccttctggtcacgaacgcctggtacgtcgccgctgccctcatcgtcctggcccgctga

SEQ ID NO: 6853 - DNA, 585 bp, Actinoplanes utahensis
atgagcgactacgacgaacgctaccgcagcggcaacacaccctgggagatcgggaaaccacaacccgccctcaccgcactgctcgaacacggcgtccgcggacccaaagtcctcgacctcggctgcggcaccggcgacctcgcctgcaccctcgcccgccgcggataccacgtcaccggcatcgacatctcgcccaccgccatcgaacgcgcccgccagaaagccgccggactcaccgccaccttccacgtgcaggacgccaccaaactcgacctgcccaacaaaccgttcgacaccatcttcgactccggcctgctgcacaacctgcaccgcaacggcggacccgtcgaccagtacctcgcccaactccccgaactcgccgaacccggcaccctgctctacatcctcgccatctccgccaccgccggacagggatggaccatcacccgcgaatacctccaggaaaacctccccgaacccacctggaccgacaccagaatcaaagacgtcaccgtcaccgcccaggtcgacgacaccaccatcaccatgcccgcctacctactgcgcaccgcccgctcctactga

SEQ ID NO: 6854 - DNA, 516 bp, Actinoplanes utahensis
gtgaggttggagtcggcgcgcctggtgttgcggccgttcgagtccggggatgcgccgggggtgcatgcggtgtggaacgagcgggagtttctgcggttcgcgccggtcggtttccggttcgcgggtgcggatctgtcccgggtggcggactggtgtgcccggggtgaggtgttcgccggggtggagcggtccagtgggcggttggcgtgtcatgtggggttgttcggggcggactggtcggcgatgacggtggagattcattactggacggcggtgtgggcgcgcggtaatggtttcgcggtggaggcggcgcggttggtggcggggtgggcgttgtcggtgttggggttcgcgcgggtgacgttgcagacggatgtgcggaatgtgggttcgcggcgggtggcgcggggggcgggtttccggttcgagggggtgttgcggaatgcgtcgtggacgcggtcggggcgggctgatctggcggtgttcagtgtgattccgggggatgtgggtcagtag

SEQ ID NO: 6855 - DNA, 720 bp, Actinoplanes utahensis
atgaagctggtcgaggatgaggtgcgaatcggtgagattcgtgcggtggtggtggggccgtccggtggtgggtcgtttcccggggtgttgttgtacaccgacatttttcagctgacggagtcgacgttgcggtcggcgcgcaggctggcgtcggagggttttgtggtgtgtgttccggagatctatccgcggggtgagctggccggggtggcgttggcgttcgacgatgcgggcaaggcgcgggggttggcgggtgcggcggcgacgccgacggcgcagttcgatgccgatcgggtggcggtgctggattatctgcaggcccgggcggatgtgtcggcgctgttggtgacgggcttctgtatcggtgggcatctggcgttccgggcggcgttggatccgcgggtgtcggcgacggtgtgtttttatccgaccggtttgcaggatggtgggttgggtgcggatgtggcggattcgctggcgcgggccggggagatccgggggcggttgatggtggtgttcgggtcgcgggatccgcatgttccttcgcaggcgcggctgcggatcgtgggtgcgttgtatgcggcggggctcgatgatgcggagttgcatgtttatcagggtggggagcatgcgttcatgcgggatgtgggtgcccggcatgatccggtgctgacggatctggcgttggcggaggcggtttctttttaccgtgggcgttga

SEQ ID NO: 6856 - DNA, 969 bp, Actinoplanes utahensis
atgcagcacgaaccatctgtcgatccgccctctcccctttctgacctggtcgaggagttcctcgccgcgcgggccacgcggaagccgtcggcgcacactctcgctgcgtatcggcgcgatctgtccctggtgttgcggcaggtgtcccccgcgccggccgatccggcggacctctcccctcgcctgttgcgggcggcgttcgcgcgtttcgcggcggaccgcgcccccgcttccgtggcgcgtgcctggtcgtcgtggaatgcgtttttcacgtttctggtgaccgagggtgtggtggcgggcaatccgatgtcggcggtggacaagccgcggatggtggcgcactcccccaagccgttgcggggtgaggacacgccggagcaattgttgcgggtggcgagtgtcgcggatgagcgtcagcgtgatccgtggccggagcgggatgtgctggttctggcgttggctctgtgtgccgggttgcggctttcggagttgctggggttgaccgtcggtgcggtgtcgggtcgtgatggtgagcggcggatcgaggtggccggtaagggtgggcggccgcggtcggtgccgatcgatgcggggctggatgccgcggtggcgcggtatgtggcgagccggcgggtgcggttcggtcgggtggcgagtgtggatcggttgctggtggatcggcatggggcgccgttgcagcggggtggtctgcagtatctggtgcggtcgtgtttccggcgggcgggtatcggtgaccgggtgccgcggggtgcgcagttgcatgcattgcggcatacctttgcgacgcgtcttgccgaggatggggcgaatgcgtcggagatcatgcggctgttggggcatgcgtcgttggcgacgtcgcagaactatatcgaggtgacggcggagcagcagcgggcggcgatccagtcgaatcgtacgaaccgggtgttgcgcgagttggcgtga

SEQ ID NO: 6857 - DNA, 480 bp, Actinoplanes utahensis
atgccgatccccgcattcgtcctcgccctgcgcgccaagctcgggcacgacccactgcccttgaacggtgtgatcgccgtggtgctcgacgagaacaaccggatcctgctcgtccggcgctccgacaccggcgaatgggccctcaccaccggatgcctcgaacccggcgaacaacccgccgacggcgcgctccgcgaggtcttcgaggaaaccggtgtccgcgcacgggtggaacgcctgctttccgtggaggcgctggatctgtcggtcgcacccaacggcgatcagatctactggctcgccatcggtttgctgtgccggtccgtcgagggtgacgcccgggtcaacgacgatgaatccgtcgaggtgggctggttcgatccggattcggtgccgccgttgccggcgcaccaggcgcgatgtctggcgctcgcgttgtctgacgacgccggtccctggtttgccgctcccctggattga

SEQ ID NO: 6858 - DNA, 435 bp, Actinoplanes utahensis
gtggtggatgcggggcgcgcggggcgggccgacgtgcgggatgcgctggcgggtgcgggtttcgtggtggagggtttcctcgaccacgcggagctgcccgcgcagggtgaggtgtggcggccgttcatcatgtcgtcggcgcggccggtgaaatgggtacgtcatgagtctgacgatcatgatgcccgggtggatcggctgtggcatctggtgagtcgccgcaacggcacgatcgatgcggacggtgcggtgctgctgtcgttggctcagggttcgttcggtccgttgccgtggattcgggtgcgggtcggtgagtcgttgccgcgggtcgcggggttccgggagttcgtggcgttgtcaccgacgacgtgggcgagtagcgcggtcagcgaggaggagtatgcgacgtggattctcgctgatccgctcccctga

SEQ ID NO: 6859 - DNA, 753 bp, Actinoplanes utahensis
atggcggcggcgggtgtggaggcccgtgggttgaccacggaggagttggacgggatccgggacgcgttggcggccgggcgcaagcctcgggtgcagttcaccgaggcggcggggcagatcgccgggcagatcgggcaggtggtggggctggcggatccggcggtctccgatgagtgggtggtggtccggttcggtcgtgatgagctgcccttctcccccggtgatctgcggatcgcgccgaaaggggcgccggtgaggaaggtggtgccggtggtggagccggagcctgagccggtgttgtcggggccggagtttctgatcgacaagccgatcgggagaccggtggagaagccgcgggcggctccggtgcagcggcgtggggatgacgatggtgtggtgggaaaggatgtgcaggacgtgacggctccggctccgcgtaaggtggcggctcgttcggtgaaggcgaagccttcgccgtcgttgacggtgacgctggcctacggcgagggtgagtggacggtcggggcgacgcaaggtgccaaggcgctggcgaagccctatgtgatccgtccggccgaggcgttgaagatggtgcagctgatcgacgttccgggggtgcaggaggcggtggagcagatcctgtcggcggagcgggcggaggcggagcagcaggcgcagcggttgcgggcggagttggcggagatcgaggcgcggttggcggagctgggtgaggcgggtcagcagccgtcgtga

SEQ ID NO: 6860 - DNA, 837 bp, Actinoplanes utahensis
ttgaacatctttcaggcgattctgatgggcgcggtggaaggcgtcaccgaattcctcccggtctccagcaccggacacctgaccatcctggaaaaactgctcggctaccgcctcgacgacccggacatcaccgccttcaccgtgatcatccagtccggcgccgtcctggccaccatcatcttcctgatgaaggacatcctgcggatcgtcccggccttcttcaaaggcctcaccaacgccgacgcccgcaaacaccccgactaccgattcgccctggccgtcatcctcggctcgatccccatcgtgatcgccggactcaccttcaaagacgccatcgaaaccaccctgcgcagcctctggttcgtcgccatcgccctgatcgtctggtcagccgtcatggccttcgccgactacgccgccacccaggtccgccacgaagacgacgtcacctggaaagacgccctcatcatcggcaccgtccagtgcctggccgtcatccccggcatctcccgctccggctccaccatgtccgccggcctgctgcgcgacctcgaccgggtcaccgtcaccaaactctcgttcttcctgtccgtgcccgccctcaccggcgcctcactgctgcagggctacgaggaatacgacaacatctcccacggcgtcggctggaccaacaccatcgtcgccaccgccgtgagcttcatcgtcgcctacttcgccgtgacctggctgctcaaattcgtcgccaagcactcctaccgcatcttcatcttctaccgcctcgccctcggcgccctgctcctgctgctgctgggcaccggcaccatcagcgcccagtaa

SEQ ID NO: 6861 - DNA, 933 bp, Actinoplanes utahensis
atggaccccatgtcgctgctgccccacgtcaccgcgtcagccacccgcttcaccgacgcctggctggaaaaccggcgactgtccgaccacacccgcgacgcctaccgccgcgacgtcaccacctggctcacctggtgcaccgaacaccacctcgaccccctgcaggccaccttcctcgacgtcaacgcctacgcccgcggcctggaagcccgccccatggccgccgccaccgtcgcccgcaaactctccgggctctccagctggtacgccttcctcgtcaaactccgcgtcgtcaccggcaaccccgtcgccgacgccgaccgcccctacgtcgaccgcgaccactccgccaccatcggcctgacccccgacgaagtcgacaacctgctggccgccgccgaccgccaggacggacccgccgccgtgcgccaccgcgccgtgctcaccctgctcgccgacctcggcctgcgcgtcggcgaactcgtcagcctcgacctcaccgacctcggctgggagcgcggccaccgcaccgtccgcttcaccggcaaaggcggccgcccccgccgccgcgtcctgacccccagcgccgccgccgccctcgacacctacctccgcgtccgcggcacccagcccggccccctgttcgccaccaccaccggcgcccgcctcgaccggcacgccgtcttccgcctcgtccggcgcctggccgccgaagccggcatcgccggcgccgacaaactctccccacactcgctacgccacgccttcgccaccaccgcccgcgccgaaggcgtacccctcgaagacgtccaggacgccatgggccacgccgacccacgcaccacccgccgctacgaccgcgaccgccacaacctcgaccgcgaccccgcctacaccatcgccgccgcccgcgaccgccgccgcaccgcctag

SEQ ID NO: 6862 - DNA, 1599 bp, Actinoplanes utahensis
atgcccgcccacctcaaagccaccgggctggcccgcacccacgacggcgacctgctgttctccggcgtcgacctgatcctgcaggacggcgaccgctacggcctcgtcggccccaacggcgccggcaaaaccaccctgctgcgcgtgctcgccggcgacctgccacccacccacggcaccgtcacccgcacccccggaacccgcatcgcccacgtcacccagcagatccccgaccccgaccacaccgtcggcgcctacctcaccgccggcctcggcgaactcgccaccgtcaccaccaccatgcgcaccctggagaaccggctcgccgccggcgccgacgtcctcgacgcctacgcccgggcccaggaacgctggaccgccctgcaaggctggaccgccgaaacccgcctcaccgaaatccgccagcgcctcgacatcgaccacctcgacgacaccctgcccctggccaccgtctccggcggcgaacaggcccgcctcatgctcgcccgcgccctgctctcccacccccacctgctgctcctcgacgaacccaccaaccacctcgacaccgacggcgccacctggctgcgcgactggctccagcaattccccggcggcgtgctcaccgtcagccacgaccgcgccttcctcgacgccaccgtcacccgcatcatcgaactcgacggcatcgacgaacacccccaggactatcccggcggcggctacaccgcctaccgccaggaaaaacaacgtcgctgggaacgcctgctgctcgactacgaagcccaggagaaggaccgcctgcgctgggaaaccgacatcgaacgcaccaagaaccacgcccgcggcgtcgagaacaccgtccgctccggcgccgaagccccccacctgcgccgcgtcgcccgccgcgtcgcccgcaaagccaaagtcagagaacgccggctccgccgccagatggcctccgtacgatggatcgccgaaccccgccgccgcccacccctgaccctcgccttccccgacgacgacggcgaccccgccgacaccgtcctggcaatccgcgacctcaccctcggcttcggcgagcgcaccctgctcgaccacatcgacctcgacgtcacccgtggcgaccggatcctgatcaccggccgcaacggcaccggcaaaaccaccctgctgcgcgccatcgccgccggccaccccgacgtcgccgtcctcccgcagaccaccgaccacctgcgcaccgacaccaccgtcctggaccacttccgcgcccacgtcccggtctacgccgacgacgccgaacgcctgctcaccggccaccagttcgaccccgaccagtggaccgcccggctgcgcgacctgtccgccggcgaactacgccgcctgctgctcgccatcctcgtcaacagtcccgcccgcatcctgctcctcgacgaacccaccaacttcctcgacttcgacgccctcgacgtcatcgaggaagccctgcgccgctaccgcggcaccctgctcaccgtcacccacgaccactacttcgccgacgccgtcggacacacccgccactggcatgtcgccgaccgcaccgtgatcgagaactga

SEQ ID NO: 6863 - DNA, 1182 bp, Actinoplanes utahensis
atgcgtgtttccgctgttgccagctcccccgtgcgtgatctgttggcgctcgtcgaccggccggaggtgatctcgttcgccggtgggctgccggcgccggagatgttcgatgtgccggggtggcgggcggcgttcgacgcggcgttgagcgggccggccgcgcgccggcatctgcagtatgcgccgaccgagggtgatccgcggttgcgggagttggtcgcggcccggatggccgggcgcgggttggcgaccggggccggtgacctgttggtgacgaccgggtcgcagcaggggttgacgctggtggcggcggcgttgctggagccggggtcgacggtggtggtgcaggagccgacgtatctggcggcgttgcagtgtttcgcgatggccggggcgcgggtcgtgtcggtgccctccgatgagcagggggtggatccggcggctctggcggaggttctcgtgcgggagcggccggcgctggtgtatctggtgccgacgttcgcgaatccgaccggggcgacgatgagtgcggcgcggcgggcgcaggtggccgcggtggcggccgggcacgaggtgtggatcgtggaggacgacccgtacggcgagttgcggtatcgcgggacgccgctggcgccgctcacgacgtacggtgatcggggtatttatctgggtagtttgtcgaagatcggtgcgccggggctgcggctgggttgggtgcgcaccccggcggcgctgcggtcggcgctggtgatcgcgaagcaggcggccgatctgcacacgtccacgatcgatcaggccgcggcggcggcctatctggcggccaccgaccttgacgatcatgtgcgccggctgtgcgacgggtatcggttgcggcgcgacaccatgctcgccggactgcaggggatcaccccgggtggtacgtcgtggaccgatccggacggcggcatgttcgtctgggtgcggctgccggagggcaccgacacgaccgcgctgctgcccgtcgcgttgcggcacgacgtggcgttcgtacccggcgcgccgttctacgccggccggccggacccggccacgctgcggctgtcgttcaccaccggcacgccggagcagatcaccgagggtctgggtcggctggggcgtgcgatcgacgccgcatttgacatgctggcggggtccgacacgtga

SEQ ID NO: 6864 - DNA, 603 bp, Actinoplanes utahensis
atggcgaagctggtctcgacactgttcatttcggccgatggggtggccgagattgatcccgcatggcatttcccgtacttcgacgacaacatgggccgcgcggtcagcgaggactacgagaccgcggacgtgctgctgctgggccgatcgacgtacgacagtttcgccggggcgtggccgctgcgcgaggccggcggcgaggacgacgcgccgttcgccaagcagctcggcgacacccgcaaggtggtggtgtcccggcagtcgctggagttcacctggcgcaactcggagctgctcggcggggagctggccgcgggtgtggcggcgctcaaggccgacccgcaggtcaagggcatcctggtgcccgggtcgatctcggtggtgcagcagctgctggccgccgggctggtcgacgagctgcgcctgctggtgcatccggtcgccgcgcggcgggggcggcggctgttcgacgagggggacacggcgtaccacctgaaggtggtgagcaccgaggcgttcccgaccggggtgctacgggtgatctatgcgccgggtgaggcgccgttcgtggccggctacgaggagaccaagggcaaggtctga

SEQ ID NO: 6865 - DNA, 870 bp, Actinoplanes utahensis
atgaccgcgaccgcgcagcacaccggcaacacccgctccgtcagccgggagcaggagcagatgatccgcgacaacatggcgcttgtcggtcacatggtccgcgagatgctgttcaaggttccgccgcacgtgcaccgcgacgacctggcctcggccggctacgccgcgctggtcaccgccgcgcaggcctacgacccggcacgcggcatcccgttcggccgtttcgccgccgtccgggtccgcggcgcactgctcgacgagctgcgcagcatggactgggcgagccggtcggtgcgcgcccgggcccgccgcgccgatgtggcccgcgaggagctgacccgccagctgggccgcaccccgaccgccgaggaactggccgaactgctcggtgtcgcggtcggcgagctcagcagcgtcgacgacgacgtgcagcgtgccgcggtgctgtcgttgcaggggttcacctcgggcaccgccgaggacatggtgaccgagtcggcgatgaacccggaggagatgctgctgcaccgggagcgcctgggctacctgcacgacgcggtgacggtgctcccggagcggctgcggttcgtggtcgaggcctcgttcctgcaggagcgtccgctgtccgaggtcgccgccgagctcggggtgaccgagtcgcgggtgtcgcagctgcgcaccgaggctctcgccctgctgcgcgacggtctgaccacgcacatggagcaggtgtccggcccggtcgccaaggacgggtgtgtcgcccggcgccgcgccgcgtacgccgcgcagatcgccgcccgctcgaccatggcgacgcggctgagtgccaccgacgcgcagggcatgcgcctggccgtggcggcatga

SEQ ID NO: 6866 - DNA, 612 bp, Actinoplanes utahensis
atgatcaaactgttgctggccgacgaccaggctctggtccgcggcgcgatggcggccctgctcgacctggaaccggacatcaaggtggtcgccgaggtgggccggggtgacgaggtcgtcgacgcggcccgcgcccacgaggtcgacgtcgccctgctcgacgtgcagatgcccggcctggacgggatcagcgccgcgcgcagcctcaacgaggcgctgccgcagtgccgggtgctgatggtgaccaccttcggccgggccggctatctgcgtcaggcgatggcggccggcgcgcacgggttcgtcgtcaaggacaccccggcccggcagctggccgacgcggtccgccgggtgcaccagggcctgcgggtggtggatccggcgctggccgcacagagcctggcccacggcgattcgccgctgaccgaacgggagtcgcaggtgttgcaggccgcccgggacggcggcacggtcgccgacatcgcccgggagctgcgcctgtccgacggcacggtgcgcaaccacctgtcctcggcgatcggcaagaccggcgcccgcacccgcgccgaggcggtccgcctcgccgtcgacaacggctggctgctgggctga

SEQ ID NO: 6867 - DNA, 1158 bp, Actinoplanes utahensis
atggcaccggcaccgaccgcgacaccggcaccgtccggggcagcggccacgacgcgaacacccagcccaggcttccgggccggctgggtgttcgccgggatctggctgttctatctcggtgagaacctgaacatcctgctccaccagccggacggcatgtggcgcgacaccggcctggtgtcgctgttgctgttcgcggcgaccttcctggtcgcctcgaccaccatgcgccggcaccgccgcgacggcccggaaacggcctcggccctgcagatctggatcgcgctgctggtcatgctggtgttcacggtgttgcaggtgccggcggtcggtgagacgacgctgacctgcggggtgtacatcgcggcgaccgcggtgatgggcctgcccctgcggcacggcctgacggtcgtggtggtcatcgccgcggccatcgagttgaccgtgcggttcgtgcccgggtggcagaccaccagcgcccacggctacgccctggcggtgatcctggccggcgccgcgacctggggcatgcggctggccttcgaacggcagggccggctgatccaggcccagcacgagctggccgagctggccgtctccgacgagcgggcccggatcgccatcgacctgcacgacattctcgggcattcgctgaccgtggtcgcggtcaaggcggagctcgcccagcggctgctcgacgtcgacctggaccgggcccgcgccgagctggccgatctggagtcactggcccgcgacgcgctggccgacgtgcgggcgaccgcactgggcatgcgcggcatctcgctgcccggcgagatcgccgccgccaaggccgcgctgaccgcggcgaacgtccaggcggatctgcccggtgccgccgacgacgtgccgacccgtaaccgggagctgttcgcctggaccatccgggaggcggtcaccaacatcgtccggcacagccgggcccggcacgccgaggtgcgcctgagccccaacagtgtcgagatagtcgacgacggtcagggcgccgtcggcaatgacaatccaggtcaggggcttgccgggctgcgccggcgggccgaggaactgggcgcgcacctcaccgccggccagcggggggaccggccggggttccgtgttcgagtggaggtcccctcatga

SEQ ID NO: 6868 - DNA, 795 bp, Actinoplanes utahensis
atgaccgccgtgaccgtggaccgtagccggacggaccgcaaacttcccaaattcggcggcttcaacctgggcatgatcgccctggagttgcggcgcctgatccgcaacaagcgcaccgtcatcttcagtgtcgtgatgccgccggcgttcttcctgctcttcggcaccagcgccgactacaagcacgagcgcatcggcgacggcaacgtcaccgcgtacgtgctgatcagcatggccgtctacggtgcgatgctggcgaccacctcgggcggggcgatggtgtccatcgagcgggccgccgggtggagccgtcagctgcgcctgaccccgctcaagccggcggcgtacgtcgcgatcaagctgaccctggcgatgctgatcggcctggtgtcggtagtggtcgtcaacgtcaccgggctgttcttcggcgcggacctgccggtcgcccagtggctggcctgcgccgcgctggcctgggtgtgtgccctggtgttcgccgcgttcggcctgttcatgggctacctgctgcccagcgagaacgtgatgcagatcctcggcccggtgctggcactcctgtcgttcgccggtggcctgttcgtgccgctcgaccagttcggctcgacgttcgccgcgatcgccaagtggaccccggtgtacggcgtcggtgagctggcccgctacccggacacccacgacggtcagctgtggcaggccgtgctgaacgtggtcgcctggacgttggtcttcgccgccggcgcgatgtggcggttccgtcgcgacaccgcccgcgtctga

SEQ ID NO: 6869 - DNA, 969 bp, Actinoplanes utahensis
atggtgcgccaacacaatgttcccatgacgctcaccgcttcaaccgatctcgcggcctccggtacggggcagctggccgtgaatctggacggcgtggtcaaacgtttcggcacggtcaccgccgtgaacggaatcgacctgcgcatccgccccggagaggtggtggccttgctcggcccgaacggtgccggcaagacgaccacggtggacatgctgctcgggctctcgcagcccagcgcgggcaccgtccaggtgtacgggcgggccccgcacgaggcggtcgcgctcgggctggtgtccgcggtcatgcagaccggtggtctgctcaaggactacacggtcgaggagaccgtgcggctgaccgcggtgctgttcggcaagccgcgctcgtcggtgcaggtggccctgaaacgggccgggatcgccgacatcgccgaccggctggtcggcaagtgctccggcggccagcagcagcggctgcggttcgcgatggccctgctgcccgatccggagctgctgatcctcgacgagccgaccaccggcatggacgtcggtggccgccgcgagttctgggacgcgatccgccaggacgccgagggtggccgcacggtcatcttcgcgacccactacctggaggaggccgacgcgtacgccgaccgggtggttctggtgcgccgcggccggatcgtcgccgacggcaccgccgccgaggtcaaggcgctggccgcgggccggacggtgcgcgccaccctgcccgacgcggaacgcgccgacctgtcgcaggtgcccggggtcgagacgaccgagatccgcggcgacacgatctacctgcacgggcgcgacaccgacgcgatcgcccggtatctgctgacccagaccgaggcccgggacctggagatcacctcccggaacctggaagacgcgttcctgaccctgaccgccgacgatgacgaggagaagccggcatga

SEQ ID NO: 6870 - DNA, 636 bp, Actinoplanes utahensis
atgggaacattgtgttggcgcaccatcgtgctgtcccccgctatgcgtcacggctcgcccatgacatccgtcagtatgtgctttgtccggcggcgtccatcgacgacactttccgggatggaaccgacgcacagcgcccttatcgttcctgtacccgaagccgagccggcggtggccgacctgagggcccgactcgaccgggccgcgtcctggggagtgcccgcacacatcaccgtcctctacccgttcctgccaccggcccagctgaccccgcaggtgctggccgcgatccggctgatcgccgccggcgtgccgcgcttctatctgaccctggacaggatcggctggttcgacgaccgggtgctgtggctgtcacccagcccggccgaacccttccgcgaactgaccaaccggctcgccgtccgattcccccagacccagccctacgagggtgaattcgccgacgtcatcccacacctgaccgtcgggcacgacacaccgggcctgcccgaagcagccgcccaggtgcagccgctactgccgatccgggccagggtcacctcgctacggctgatcgccggccgccgggagcccggcgactcctggcacaccctgaccgactttcccctcggctga

SEQ ID NO: 6871 - DNA, 882 bp, Actinoplanes utahensis
atggtcacccagccggtcccgtcgaggcgacgatggtttcggcggacgtccaggtcgtcgagcagcgggccgagctcgtcggcgtcggccggacgccatcgccgcggggtcagatccataccctcaccctacgccgtcaactcaaggttgacgccagcaattcgtcaacctaaggttgacggcatgacgcagattgatccgccggtacgcctcgatgatctgatcgccgccatcagccgaaaccgccccgacgacccgctggaccgcctgtccgatgccgtgctgctcggcgaccacctcggcgagctggccgaccacctgatcgggcacttcgtcgaccaggcccggcgctccggcgcgtcctggaccgacatcggccgcagcatgggggtgtccaagcaggccgcgcagaaacgcttcgtcccccgggagaagctggacccctcgcagggcttcaaccggttctccgaggcagcccgcgccgcgatcgtcgcctcgttgaacctggccaaggcgcacggcaacccggagatcagcccggcgcacctggctctcggcctgctcgaccagccgcagggcaccgcggtgaccgcgatcatggcgcagggcctgggcatcgacgagatccggcagcggctgaccgcggtcctgccggccccggccggtgaggtcccggagctggtgccctacgacgcccgggcgcgcaaggcgctggagttgaccttccgggaggcgttgcggctgtcgcacgaggacatcggcaccggccatgttctgctggccctgctggaggaggagcaggaggacggcacgctgcgcaatctgggcctgtccaaggccgccgtcgagcaggtcgtggcgagcgagccggccgacgcttag

SEQ ID NO: 6872 - DNA, 354 bp, Actinoplanes utahensis
atgagccagacccgcacgatccgtgtcaccgtccgcggatccttcgacaatctgaccgacaagcagaagaccgagctgaccgccaacggtggtgacgacctgctgaccgcgcagtacaccgagcagggtcacctgacgtacgacatcgcggcccgcccgttcttcaccttccgcttcgccgagcaggtcaccgaggagaaggagatcccgcaggccgcgatcaacgccgagatgaaggcggtggcgtggctggaggagcacggttacggctacaagaagatcacctcgcagacggtcgacatgtccgaagtgccgctgggcaagcgcggccgccgcgaggccgcgaagtcctga

SEQ ID NO: 6873 - DNA, 618 bp, Actinoplanes utahensis
atgatcattccggtgtgggacatggacggcacactgatcgactccaccgaggccgtcccgcgcgccttcgtgcaggcggtggccgtgctgggcggcccaccggtcacgcccgccgacgtggtcggctcctattggcgcggcacgaacgaggtcatcctcacccacctggtcggccgccccctgtccccggctgaacaggagatctatttccgccagctggacgacgtcagcgtgcccgtctaccccggcatcctcgacaccctctgcgctctgcatgccgccggcctgccgctggtcgtcttcaccggcgcctccacccgcgccgccacgctgctgctgcacgccgccggcatcacctgcgacctgctgatcggcggcgaccagatcagggccccgaaaccggccccggacggcatgctgctggccgccgaccgcctcggggtcacccccgaccggctgatcatggtgggggactcgcccctggacctgggctccgccaccgccgcgggcagccgcagcgccgccgcggcctggggccacatgcacgacccggcagcccccgccgaccacaccctggccgcccccggcgacctgctgccgataatcggctgtcgctga

SEQ ID NO: 6874 - DNA, 819 bp, Actinoplanes utahensis
gtgacacgacgactgttgatcaccggcggcagtggctccctgggccgccgggtcttcgcccgtgccgcggccgccggatgggagccgatcggcacctatgtggccgcaccggccccgaccgcgtctgtccacctcgacatccgcgacccggccggcatccgtcgggtcctcgccgacctgcgccccgacgcgatcgtgcacaccgcctcgggccgcgaccgcaacgactggccgtccaccgccgacggcgccgcccacctggccgtcgccgccgcgggcatccgcctggtacacgtctccagcgacgccgtcttctccggccgcgagatccactacgacgagtcagccctccccgatcccgtctaccgctacggcgccgcgaaggccgccgccgagaccgccgtccgcgccatcaccccctccgcggccgtcgtccgcacctccctgatcctgggcgacggcaacggcgcccacgagatcctcacccgcgccctgatcgccggccgggcccggggcgccctgttcaccgacgagatccgcacccccgtccacgtcgacgacctggccgacgccctgctcgaactggccgccggcgactacgccggaatcctgaacgtcgccggcgccgacccgatctcccgttacgacctgggcgtcctggtcgcccgccgggaaggcctcgatccggccgcgatccccgccaccacgctcaccgcacggggcctgcaccgccccggcgacgtccgcctcgttgtcgaccgtgccgaacagctgctgcacacccgcctgcgcggcgcccacgaattcctcactgcatga

SEQ ID NO: 6875 - DNA, 903 bp, Actinoplanes utahensis
ttggcggcaaggctggactgcatgcagctgaccggtgtcctcgtcccgatgatcactcctttcgacgcgtccggagcggtggcgttacccgccctggaacggctcgcgcacgaggtcctggaggcgggcgcggccggcctggtggggctcggcaccaccggggagccgtcgtcactcacccccggcgagcagcaggcggtgctcgccgtgctgtcccgggtcgccaccgcccaccacgtcccgctgctggccggcgggcccgtgtccgcaccgccccgcggcgctgtgtccgcatcggtcggtagcgccgtgtccgcgccggccgacgcggggttgagcgtcgtcccgccgttcgtgcgccccggcccggacggtgtcgtggcccatttcaccgcgctcagcgaaaccagcccggtcccgttggtcatctatcacgtgccggcccgcaccggtcaggtgctggacgccggcaccctgcgacggatcggctcactcgaccgcgtgatcgggatcaagtacgccaccggcagcctcgacccggacgcggtcgcgttgctggccgacccgccgcccggcttcgccatcctggccggcgacgacgccctgctgtccccgatgctggccctcggcgccgccggtggcatcaccgcgtccgcgcacctggccaccgaccggttcgccgccctggccgcggcctggcagaccggcgacttggacaccgcccgcaaactgggccacctgctcgccccgctgtccgcggccctgttcgccgagcccaacccctcggtcatcaaagccgtcctgcacgcgcagggccggatccccaccccgtccgtacgcctgccgctgctccccgccacccccgaatcccgcgcccgcgccgtctcgctgcttccggactga

SEQ ID NO: 6876 - DNA, 903 bp, Actinoplanes utahensis
atgctcgacgtacgcaagctgctgcttttttgtgatcttgaacgtctgggaacgatcgccgcggtcgccgcggcgcgggcctatacgccgtcggcggtgtcgcagcagctggccgcgctggaacgggaggccggggtgccgctgctggaacgcaccgggcggcgggtgacgttcaccgcggccgggcggatcctggcccggcacgccaccgccgtcctggcgacgctggaggaggcggacgcggcgctcgccgcggtgcggaccgggccggccgggccgatccggatcggcgccttccccagcgcgatgcgggcgctgctgccgcaggtgctggtcgcgctgggccgcgaccatccggccctcgaactgacggtgaccgaattggacccggtcgcggtgccggccgcgctcctcgaccgcagcctcgacgtcgggctgctcaacgactacgacatcgcgcccgccgggaccgacccggcgctggagtccgtgcccctgctgcaggagaccgtctacctggccgtaccggcgcccgccggcgccggcacgctggccgcggccgcggatctgccgtggatcctggccaccccgggcaccctgtgtcacgaggtcacgctgctgatctgccggaccgccgggttccgcccgcaggcccgccaccatgccgacgacttcgccacggtcctcgccctggtcgccgccgggcagggggtgtcgatcgtccccgaactcgcggttccggccgcgccggccggagtccggctgaccgccctggacacccggcggcgcacccggatcgcctaccgccgcggtgccgcgacccacccggccgtcgccgcggtgatcaccgccctggacaccgccacccgcaccgcgccgacgctcagcggcgcgccccgatga

SEQ ID NO: 6877 - DNA, 945 bp, Actinoplanes utahensis
atgggtcgcatgactgtcgccgatgtctaccgggagttcgcggccaccgaggcgcgcggggtgtcgccgatctacgaacgcctggcccggcaggtggccgccgacccggagctgctcgaccggctggccatgctgcccgcaccgaagcgtcagccgaacctgctgttcgcggtggtccggctgctcggcgggccggtgggtgacccggccggcttccacgacttcgcgctcgcgcagtgggacgcgatcctggctcagctgatggtccggggcacccagaccaacgagatcgggcgtaccgccgcgcttcttccggttcttgcggcgttgccgcaaccgctcgcgttgatcgatgtcggtgcgtccgcgggcctgtgtctgtatccggaccggtattcctaccgctacggatcgcacgtggtcggcgacagcggcccgctgctcgactgcgcggccaccgggttcaccccgccggaccggctgccgcgggtggtgtggcgcgccggcctcgacctcaaccccctcgacgtgaccgatcccgacgatgtcgcctggctcgacgcgctgatctggccggagcacacccaccggcgcgatcggctgcgccaggcggtcgccatcgcccgggccgacccgccacacctggtccgcggcgatgcggtgaccgacctgccggctctggccgcccaggctccggcgggtgcgacgctggtcgtctaccacacctcgatgctgtaccagttgcccgaccggcaggcgttcctcgacgtggtgcgggccctgccggcccgctgggtcgccgtcgacggcgacatcggcgccgacctgcccgagccgcccaccgccgatctgtacaacgtgctcgccctcgacggcgagcccctggcctgggtgcgcgggcacgggcagagcgtcacctggttcggcgcacattcactcacgtaa

SEQ ID NO: 6878 - DNA, 1506 bp, Actinoplanes utahensis
gtgcgacgactgctcgtggccacccttgccacagcgttgacgctggccgcaacgggcgcggccgcccaggcacaccccagggtcgccgcgcccgcacccggcgcgcccggcatcggggacccgtactacccggactacggcaacggcgggtacgacgtctcccactacgacatccggctgcgctacaccccggccaccgacaagctgaccgggaccaccacgatcctggccaccgccacccaggatctgagccggctcaacctcgacttcgtcctggacgtgtcgaccgtcctggtcaacaaccggccggccaccttcgcccgcgagggcgaccacgaactggtcgtcacccccgcccggaccgtcgccaaggggggcgcgctgaccatcgtcgtcacgtactccggcgtgccgtccaccaaggtcgccggcggattcaccgcgtggacccgcaccccggacggcgccctggccgtcggcgaaccggaaatcgcctggtggtggtacccgagcaacgaccacccggcggacaaggccaccttcgacgtgtcggtctcggtgcccgacggcgtcgaagcgatcagcaacggcgtccagccgcgcccgccggtccgggaaaccctcggatacacccggtggagctggcgttcgctgaagccgcaggccacctatctgaccttcctgaccatcggccagtacgacgtcaccaccgacaccaccgcggacgggtcggtcgtctacaacgcctactcccagctgctgagcccggacttccgggacgccgcccaggccagcgtcgaacgcaccgcggagatcaccgactgggagtcgacggtcttcggcccgttcccgttcgaggcccgcggcggcatcgtcgtcccgccgaacacgatcaatttcgcgctggagaaccagacccggcccaactactccgccggcttcttccggcgcggctcgaacacctacgtgatcgcgcacgagaacgcgcaccagtggttcggtgactccgtctcggtgcggacctggcagaacatctggctcaacgaaggtttcgccagttacgccgaatggctctggtcggagaagaacaacgagggaaccgcccaggagatcttcgattacctgtacgccacgtctcccgacgacgcgccggtgtggaccaccgcgccggccgatcccggcaccgccgagctgttcggcgacgccgtctacgaccgcggggcgatgaccctgcaccagctgcgcctggccgtcggcgacgacgcgttcttccagatcctgcgcacctggaccgccacccacaggtacggcaacggcacgaccccggaattcaccgccctggccgagaagatctccggaaaggacctggacgcactgttccaggcctggctctacaccccggccaagccggtggtggccaccgcggcacgctcgctgagcgcgccggtcgccccgaagtcgtgggcggcgatcaagcagacccacgcgctgctgcacgagcactga

SEQ ID NO: 6879 - DNA, 858 bp, Actinoplanes utahensis
gtgcgaggccggcggcaccgccaacgcgacgatcatcgaacgcctctagggtggtcgggtgcagagcttcccgcaggccaccgccgtgcagccggccgacgacggataccacgccgacctcgatccgcagtggggtgtcggcgacaaactccacggcggctacctgatggcggtgatcgcccgcgcggtcgccgccgccgcggacaccgcggcgcacccgcatccggtggcgatgaccaccgcgttcctgcggccgccgcggccggcgccgcgacggtcggtgtcgagctgctgcgctccggccgcggctcggcgcagtaccgggcccggctcagccaggacggcgagccgtgcgccgagtcgctgctcacccagggccggctcgacgatgcggcgccgtggtggtcgggcctgccggtcccggacctgccggccgaggacgactgtttcctgctgccgtcgcgcccgccgggcgccgcgttcccggtgcacctgctcgacgtcgtcgatcatcgcctcgacccgtcgtgtctgggtttcgccgtgggccagccgtcgtcgaccgggcaggtcagcggctggctgcggctgagcgacggcaccgactgggacccgtggagcctgctcgtcgcgctcgatccgtccccgccgatctcgctcaccctcggcatccagggttgggctccgacggtcagcctcaccgcgtacctgcggcggctgcccgcccccggcccgctgcgcatgaccatgcgggccgccgaggtcaccagcggccggatggacgagaccgcgctgctctgggacagcaagggcgccctggtcgcccaggccacccagctcgccgccgtccgcccgtag

SEQ ID NO: 6880 - DNA, 1170 bp, Actinoplanes utahensis
atgcgagacgccgtcatcgtcgacgcggtgcgcaccccgctcggcaaaggcaagcccaccggtgcgtacgccgggatccaccccgtctcgctgcacgcccacgtgctgcgcgcgctgatcgcccgcgtccccgacctcgatccggccacgatcgacgacgtgatcggcggcgccgtcggccaggtgggggagcagtccgggaacaccacccggctcgccgcgctggccgccggactccccgaatcggtgcccggcgtgaccgtcgaccggcagtgcggcagcagccagcaggcgctcagcttcgccgcccagggcgtgatctccggagcgtacgacctggtcatcgcgtccggatcggaatcgatgtcgcgggtgccgatcggcagccagaccctgggccacgacgtcggcgggccgctgatcaccgaacgctacgacggcggcctgatcccgcagggcgtcgcggccgagctgatcgcccgcaaatggggcctgtcgcgcgcccagctcgacgagttcgccctgctcagccaccacaacgcggcgcgcgcctggtcggccggccgattcgcggcgcaggtcgccccgctggccggcctggacaccgacgagacggtacgcccgggggcgaaccgggaagcgatgagcgcgctggcgccgtcgttcgccgacccgcggtgggagcgccggttcggggtgatcgactggaaggtgaccgccggcaactccagcccggtcaacgacggcgccgccgccctgctgatcaccaccggtgagtacgccgcccggcacggctggcgcccgcgcgcccggatccacaccgcggtggccgtcggcgacgacccgatccacatgctgaccggcatcatcccggccaccgcggcggtgctgcggcgtgccgggctgaccctggccgacatcgacgccttcgaggtcaacgaggcgttctcctcggtggtgctggcctggctcgccgagaccggcgccgacccggccaaggtcaacgtcgacggcggcgcgctcgcgatcggtcacccgctgggcgccagcggcgcccggctggccaccaccctgctcggtgtgctggagcgcaccggtggccggtacgggctgcagaccatgtgcgaggccggcggcaccgccaacgcgacgatcatcgaacgcctctag

SEQ ID NO: 6881 - DNA, 597 bp, Actinoplanes utahensis
gtgccccgccccgccacccccggctcccgcgacgcgatcctgcacgccgccagccggctgttctactcgcacggcgtccgcgcggtcggcatggcccaggtgatcgacgccgccggctgcggcaagaacctgctgtaccggcacttccccagcaagaccgacctcgccgcggcctacctgaagctggtccgcgccgaccgtgaccggtccgccgacatcgccctgaacggcgccgccgacccgggcagccgactggtcgcgctggtcggcgaggtcgccgccctggtccgcggcccgcactaccgcggctgcgcgtttcgcaactacctcaccgagttccccggcgacgacgacgaaccggcccggatcgcccgcgcctacctgcgtgacacccgtgcccgcatcgacgacctggtcgccgcccggggcctggcaccggtcaccgccgaccggatctggctgatcgtcggcggcctgtacgccggccccgccgaccaggccgaggtcgccgtcgactgggtccgcgaactcgtcgcccaggtcggatatccgaccggcagcactggttcgccccgccacgggataaataacggctga

SEQ ID NO: 6882 - DNA, 993 bp, Actinoplanes utahensis
gtggaggttgccgcctggttgtggacggtcaccctggtcggactcggcgccctcgtgctcgccgacctcgccctggtcagccgccgcccgcacgagccgagcctgcgcgaatgcgccctgtgggtcaccggttacgtcaccgccgcactgctgttcgccggtttcctgtggctgcgcttcgacggcgccgccgccgggcagtacctggccggctggctcaccgagtacagcctgtcggtcgacaacctgttcgtcttcgtcatcatcatgtcgcggttccggatcgaacgacgccaccagcagaaggtcctgctgatcgggatcatcctgtcgctgctgctccgcggcgtcttcatcgccctcggcgccgccgcgatcagccgcttcaccggggtgttctacattttcggcggcttcctgatctacaccgcggtccggctgttcggctacgacaccgacgagccggaatacgccgagaacatcgtcatccgctgggcccgccacgtcctgccgatgaccggcagctacgacaacgcccgcctgaccacccgcgatgcccgcggccgccgccgcctcaccccgctgatcgtcgtgttcatcgcgatcggcaccaccgacgtgatcttcgctctggactcgctgccggccatcttcggcctcaccgaccagccctacctgatcttcaccgcgaccgttttcgccatgatgggcctgcgtcagctctacttcctgctcggcggcctcctggaccgcctggcctacctgtccatcggcctcagcgtcgtcctcggattcatcggcgtcaaactcgtgctgcaggccctggccgacaacaatctgcccttcgtcaacggcggcgacccggtcgactgggccccgcacatcagcatcggcgtctccctgtcggtcatcgccggcactttgtcgatcaccgccctggcctcgatcctcaaagcccgcctcgacgcgtcgaagatcagctcacgacgatga

SEQ ID NO: 6883 - DNA, 327 bp, Actinoplanes utahensis
atgaatattcgtaagccgttcctcggcgccgcactgaccaccgcagtcctggccgggacgcttggcgtgagccgggccgcacaggcccgggccgccgactggagcaccgtggccgcaccgtatttcgccctggtcttcgacgagtatggtggccccaccaccatcgggcacacccagaacgagtacgtctacgcggtctgccagcaggacggcatctggggctggcaaaccaacgcctacgtgccgtcgctgtccgcatacggctggatccgcaacggcgacctcttcggctataccaatccggctgagggtctcagcgtgtgctga

SEQ ID NO: 6884 - DNA, 471 bp, Actinoplanes utahensis
gtgggtgagggcgagaagaccagggtgatcgcctggaatcgcgagctgcgcagcgtccacggcagattgcgcgaggcgctggcagtgacccggcacgcgttggccgcgggcgaagcggtcgagccggccaccagagatctgctgctgttctgtcacgggttctgcacggcgctggccgcccaccacgagggcgaggatcatcacctgttccccgcgatcgtcgagcagcatccccacctgcgggaaacgctgcgtcgcctgcagcaggaccactcgatgatcgctcacctggtgggtgggctgcagtccgccgtcgcccgggctgcgccacccgcagagctgcaccgtcacctggacggtgtggcggcgatcatggaatcgcacttcaggtacgaggagcgccagctgctgagcatcctggagggcctggctctcgacgtggaaccgcactcagcgctggggcccctgtaa

SEQ ID NO: 6885 - DNA, 681 bp, Actinoplanes utahensis
gtgaaccgcctggcggtggtgaccggggcggcccgcggtttcggcgcggccctgtccgagcggctcgccgccggcggctgggatgtggtggcctgcgtccgggatgccggtgcggctgcgggccgtggccgggtgcgggtcgtgcggcacgacgtgcgggacccggtcggggaggagctactcgccgcggtcggggagcgggccgtcgacgtgctggtcaacaacgcggggatcggtgcgccgggccggccgctcgcggagaccgacccggcgacgattctggccgcggtcgacgtgaacgtggccggtccgctgcgtctggctcaggcgctggcgccgcggctgctgcaggcccgtgatccgctgatcgtcaacgtgtcgtcgcggttgggttcgctgaccgcgcaggcggccggggtgttcgccgcgcaccggaccagctacgcctaccggatctcgaaggcggcccagaacatgctgacggtcgccctcgcccaggaattcgccgggcggatccgctgctgggcggtccatccgggcgcgctgaccacggcgatgggtggccgggacgccgccaccgatccggtcgacgccgcggaacgcctcgcggcactgctggaccggcacgatcagacctcgccccgctacttctcgctggacggcccggagctcacctggtag

SEQ ID NO: 6886 - DNA, 1983 bp, Actinoplanes utahensis
gtgccggttgagttcctcactgatgagcaggcctccgcctatggccggtttccggccaggctgacgccgacggagctggagggcctgttcttcctggacgacttcgaccgggacctggtggcccggcgccgcggtgacgagaaccggatcgggttcgggttgcaggtggcgaccgtgcgggcgctgggcttgtttttggccgatcccctcgaagtgccgaccgaggcggtcgactacgtcgcgcgccaggtcggcgtggcggatccgtccagggtcaaggggtacctgcggcgggagaagacgcgtttcgagcatcagtgggagatcgcccgggagtacgggtacaccgacttcgccgcggcggagccggagctgattcgctgggtcgatgaccaggcgtggacgagtggggacgggccgaaggcgctgttcgacgtggcggtgggctggctgcgcgagcgcaaggtgctactgccggcggtgagcacgctggcccggctggtggcgcaggttcgtgggaaggccactgatcggctgcacgagcggctgtcggggctggtgtcggcggagcaggcgcggctgctggagggtctgctcgacgttccggagggttctcggttctcgcagctggagcggttacggacgccggtgacgaggacgtcgggtatcggcatggtgcgggcgttgcagcgggccggtgaggtcgccgggctcggcttgggtgggctggatgtcgcgatggtgccgtggcggcgggtgtgggagctggcccgctacgggttggaggcgaaggcgccgacgctgcgccggcacccgtacccgcgcaagctggccaccttgctggcgacggtgcgggcgttggaggcgcgctcggtcgatgacgcgttggagttgttcgacgtgctgatgaccacggagttgatgagccgggccgagcggcagtcgaaaaaggagaagctgcgccgctatccgaaggtgtcgcggcatgccgggaagctcgcggccgcggtggcggtgctgctggaggcggccgagtggggtgagcaggtgcgcctgcagcaggtgtgggacgcgatcgagagcaaggtgtcgcgcgctgagctgcgggcggcggtcgccgggatcgctgaggtgttgccgccggcggacgcggatccggatggggagtggcgggcgcatttgctggagcggatggccaccatccgcgggttcgtgcccatgttgtgtcaggtcatcgagttcggcgccaccgcggacgccgcgccggtgctgtacgcggtcaacggcctgccggagctgctggatgcacggcagggccgcaaggtcgccgccgggttcctcgacgcccgccggatccaggtggacgtcgtgccgtccggctggtggcagcgcctggtgttcccgaaggaccggccgccgggcacggtggacaaggccgcgtacgtgttctgcgtgctcgagcagttccatcagcggctcaagcgccgtgacatcttcgccgcggtctccgaacgctggggtgacccgcgggcccggctactcgacggcgacgcctggcagcaggccaaggcgcccgcgttgaacgcgctgcaactgcccgaggaaccccacgacctgctgcaggctcacgcggtgacgctggacgaggcgtggcggacggtcgcggccgggctgtccgcggacaccgcggcccggctcgacgacgagggccggctgcacgcgcagaaggtcaccgcgatcccggacccggcgagcctggtcgacctgcgccatcgggtgcaggcgatgctgccgcgcatcgacctgggcgagctgatcttggaggtgatggcctggtacccgggcttcgcggccgcgttcaccgcgctgtccgggtcggccacccgcctggacgacctgcacgtgacgatcgccgcgaccttgacggcgcacgcgctcaacgtcgggttcgcccggtcatctccgacggcatcccggcgctga

SEQ ID NO: 6887 - DNA, 1005 bp, Actinoplanes utahensis
gtgttgatcgacgcccaggacggcatcggcatggcccgggcgtggggcggcggcttggtcgccgcagctgacgggatgcggttcgtggttccggtgcgcagcgtgcacgcccggccgaacccgaaatacttcggtcagcggcgcggcgcgacctggctcaacatggtcaacgaccaggccgtcggcaccgccggccgggtgttgtccggtacgccgcgcgactcgatgcacctgatcgacctgctgtaccggcgcgacggcggccgccgccccgaggtcatcatcaccgacaccggctcgtactccgacgtcgtcttcggcctgctgcagctactcggcttcgactaccggccgcagctggccgacctgcccgacgccaagctgtggcgcatcgaccgcagcgccgactacggccccttggacgcgaccgcccgcgggatcatcgacctggaccggatccgccggcactggcccgacatgctgcgcatcgccggatccattcacacctggcaggtgtcggcctacgacgtgctgcgggtgctgtcggccggcgggaacctgacccagctcggcgaggccctggcggcctatgggcggatttttaagaccctgcacgtgctgaccttcgtcgacgacgaaccgtaccggcgccagatcaagggcatgcgcaacctcaacgagggacgccatgacctggcccggcacgtcttccacggccgccgcggggaactgcaccgtgcctaccacgacggcatggaggaccagctcggcgcgctcggcctggtccttaactgcatcacgctgtggaacaccctctacctggacctcgccctggccgggctgcgtgcgcagggctatccggtcctggacgccgacgtcggccggctctcgccgttcgtgcgccaccacatccgcgtccacggccactacaccttcaccctgcccgacttgggtgggcgcacctaccgcaggctgcgcgacccggacgccggcgacgacgagtag

SEQ ID NO: 6888 - DNA, 1245 bp, Actinoplanes utahensis
atggctgagccggcgcaccgccacgaaccgcacggcgtcgcacccgagcaccacggccacggccacgaccatggccatgagcacccgcacggtgaaagccacggacatgatcacgatcacggaggccacgagcacggccagggactctggcatcgcctccagcacatgatcacaccgcactcgcacgacagcgccgacaaggtcgactcggccatggaagcctcccgcgacggcatgcgcgccctgtggatctcgctcgccgtgctcggcgcgaccgcgatcatgcaggcgctgatcgtggtgttctccggatcggtcgccctgctcggtgacaccctgcacaacgtcgccgacgcactcaccgccgtcccgctgggcatcgccttcatgctcggacgccgggccgccacccgcgcctacacctacggcttcggccgcgccgaagacctcgccggcatcgtcatcgtgctggtcatcgccgcctcgtcgatcaccgccgcctggctcgccgttgaccggctgctgcacccgcaacccatgacgcacctgccctgggttctcgccgctgccgtgattggctttgccggtaacgagatcgtcgcccgctaccgcatcaccgtcggccgccggatcggctccgccgccctggtcgccgacggcctgcacgcgcgcaccgacggcttcacctccctcgcggtcgtcctcgccgcgctcggcacctgggcgggctggagctgggccgacccggccgtgggcctggccatcaccatcgcgatcgccttcgtcctcaaagacgccgcccgcgaggtctaccaccggctcatggaccgcgtcgaccctgaactggtcgaccaggccgagcggaccttgcgcgccatccccggcgttcacgacgtctccggtctgcggctgcgctggatcgggcaccgcatgcacgccgaagccgccgtcgtcgtcgacgccaacctcaccctgctcgccgcacacgaaatcgccgccgacgccgaacaccaactcacccacggcgtgccccggctgaccggcgtcaccgtccacgtcgaccccgacagccaccccggcggccagcaccacaccgacatctcccacgaccgccgcgaccgcatcaccgccagcgtcgccaccaccgttgtgccagccaagccggtcaacagggcactagccctgctgagctcctctccgatctactcgtcgtcgccggcgtccgggtcgcgcagcctgcggtag

SEQ ID NO: 6889 - DNA, 375 bp, Actinoplanes utahensis
atgcacgcacgcgacaacatggcaagtgccagtgacctgcaacaacgcgctgtgagtgacaacgtcatcggtgcagcaacgctggcgctggggatgcttgcggacgcgacgcggctgcggctgatggtcgcgctgctggccggcgagcaggacgtgaccgcgttgacggcagcggtgggcgcggcgcgtccggcggtgtcccagcacttgagcaagctgcgactggccggcctggtggccgctcggcgcgacgggcgccgggtgatctacgtgatcgccgacgagcatgtggcccggctggtgaccgaggcggtctacaccgccgagcaccgggtgtcggccagcccggaccatcatctgcccccgcaacgctga

SEQ ID NO: 6890 - DNA, 369 bp, Actinoplanes utahensis
atgctcagttggggcacgatgatctacggcgcggcgctgtccgcgctgctcgccgccgttctggtcgccgccgccgtgcggccgcgtcgcccggccgtgatcgccaccgccgcgatcggcgccctgctcgggccgctggcgtggaacgcgatcctgcgcgccgcccacggcgcccagttcttcaccgacgcgcccgtcgcggtcctgcccgcctcgtggcaggacaccggcagcggcgtgttcaccatcgcggtcaccgcgctcgcgctcggcctcgggcccctcgccgcgggaaccggccgccggctcgccgccaccgccgcactcgccggcctggcagccttcctcatcgacgtctacctgtactga

SEQ ID NO: 6891 - DNA, 963 bp, Actinoplanes utahensis
atggacacgacacgcaggcgactcctgcaggccggctggacagtcccggccgcggcattgaccgtcgcggccgcggcgcaaccggcgcgggccgccggcgatgaccatgccggggactgccatggccgcctcgcgccggtggtgaccgccgcggcggactgggcgccggtcgcgcaggcgctggggcgagagggcaagctgctcgacgacggccgggtctaccgggtcgggttcgcccgtcgggacctgaccgtggtcagcggcgccgtgacgatcaagccggcgttgtcgctggggtcctacgcggctttcacccgctaccgcgacggacaggtcctgctgatgggcgacctggtggtcaccgagcaggaaatgcccgccgtcaccgacgcgctgcaggctgccgggctggcgcagaccggcatccacaaacacctgctcgcgcacgagccgcagctgtggtggacccacatccacgccgtcggcgacccggtgagcgccgcccgcggtgtccgcgcggccctcgaccacactggcactccaccgcccgcaccggcgaacaccacccctggcgagctggacaccgccgccctcgaccaggccctgggccggaccggcgcctgggacggcggggtctacaaatacacgatcgcccgcgcggaaacgatcaccgaccacggccggaccctcaccccgggcatgggcgtcaccaccgggctcggcttccagcccgccggcgacggccaggcggcggtcaacggtgacatcgccatgcgcgccgacgaggtccagccggtgatcaccgccctgcgcggcggcggcgtagcggtggtggagttgcacaaccacgccctgcacgacgagccgcgcatgttctacctgcatttttggggccacgcggacgcgcaggccctcgcccggacgctgcgcgccgcggtcaacgccaccgccaccacgccgtaa

SEQ ID NO: 6892 - DNA, 1899 bp, Actinoplanes utahensis
gtgggccacccgtgccggcgtacacatcgaccgggccgcatgcgcctggctgatccgccgccacatcgacccagacgccgagttcgtgttcgtcaccgacatgacggcggtcccggccgatgcgaccccgttcgacatgcgcggcgtggatctgggccaccacggcgacgactgcagcttcgaaacgatcgtgcgccgctacgaactcaccgacccgatcctgtggaaactcgccgagatcgtgcacgaagccgacctcgacgacgaacgctacgacgcccccgaagcccccggcctcgacgtgatcctgcgcggcttgtcgatgatctgcgacgacgagcagatcctcgccctgaccgggccggtcttcgacggcctgtacgagtaccaccgccgcgccctgctgctgaaccgcccacctgcctgagcatcagccgtcacccgcatgcccgcccgagctccagaaaggcgctgatgaacagcaccgacccgtcgtcccacccctccgctgcgccaaccggcccggcaccggggcagcagccggcccgtgacgtggtcccgttcggcgaggccgtcaaggcgtggctcgtgatctcactgcagaccttcggcggcccggccgggcagatcgccgtcatgcaacgccacctggtcgacgaacgccgctggatcgggcagaaacggttcctgcacgcgctgaactactgcatgctgctgcccgggcccgaggcccagcaactggccatctacgtcggctggctgctcaacggcctacgcggcggcctgttcgccggcaccctgttcgtgctgcccggcgtggccgccctgctcgcgctgtcggcggtgtacgtcggcttcggcgacaccaccgtggtcaccgccctgttcgccggcctcgccccggccgtcgtcgcgatcgtcgcccaggcggtgtggcgcgtcggcagccgcgccctgaccaccaagatcctcgtcggcttcgcggtggccgcgttcgtcgccctcgccgtgttcggggtgccgttcccgaccgtggtcgccgcggccggtgtgaccggctgggcactgcaccgctggcggcccgccctcgtcgccggcggtggcggccatggcggcgcccaggacggcccccagccgttgatctccgacgacgcgctgcacgacgaccggccctcggcccggcgggcgctgaccatcctgacggtggggctgctcgcatggttcctgccgatcgccacggtcgccgccctcaccggggtcaacagcgtctacacgcagcaaggactgttcttctccggtaccgccgtggtcaccttcggcggcgcctacgccgtgctcgccttcgtcgcccagcgcgccgtcgagcactacggctggctggccgccggcgacatggtccgcggcctggccctggccgagaccaccccgggcccgctgatcatggtcgtgcagttcgtcgcgttcctcggcgcctaccaccatcccggcaccgtcaacccgtggaccgccggcatcgtcgcttccctgctcaccacctgggtgacgttcgtgccgtgcttcctgttcatcctgttcggcgccccctacgtcgaacggttgcgcggcaaccacgccctgtcggccgcgctgaccgggatctccgccgccgtggtcggcgtgatcgccaacctcggcctctacttcgccgtgcacaccctcttcaccgacatgcacgaggtcaccagcgggccgttgcacctgcaactacccgacgtcgccacgatccgcccggtgccggtagggatcgccgtggtctccgccgggctgatcttccggctgaaatggtcggtcctgcgggtcctgggcatcagcgccggcctcggcctcgccgccggactggccggcctgcccggcatctga

SEQ ID NO: 6893 - DNA, 1137 bp, Actinoplanes utahensis
ttgttctcacaacgcgttctcacgcaagcgcgtcggtccgcgattctgagaaatgtttgtgcgagcattccgggcatggccgaacccgagaaccgcgaatccgactcgcgtgacgccgccgcgatcgagcggcacccgtgcccacgctgtctggcgcagcccggctcgccgtgccggtcgcgctccggcgtggtcgcaacctcgtaccacaccggccggttcaccagggtcggccggctgagcaaggccctgcgcgtgctcaccccggccggccgcggcccgggccagccgtggcggcccggcaccccgccgctgacgctgatacccgccgacctcccgagcgccgacatccggatcgggtacgcccggtgcagcaccatgacccaggagctccagtcacagctggacgcgctcgccgcgcacggcatcccccgcgacaagatcttttccgagaagatctccacccggatgcgcatccggccacagttcgaggcggccctcgccctcgcccgcgagatcaaggcccacgccccgcactgccgggtcatcctcaccgtcaacgagatgaagcgcctcggccgcgacgccgccgaactcaccgccctcgccgaccacctcgtcgcgcacggcctggtcctggagatgctcgccggaccgctgccgggcatctacgacccgaccgggcccggccggatcctgttcgcgttcttcgccgccctggccgagaccgaacgcgacaacatccgcgaaggcaccctcgaaggcctcgatgccgccgcccggcagggcaaacacggcggccggcccccggtcatcaccgacgacatgctgcacaccgtgctacggcgccgcgccaacggcgagaccgtcgaaaggatccagcccgacctgatcatcccaaccggcaagcgcaaaggccgcaacccgagcgtggccagcatctaccgggccatcgccgcgtacgagaaggcccagggctacccggacgccatcgagcaggcacacgctgagcacgcaaagcgagccagcgaccgcctcccggcgatcgtgcgcccccggcccgctcgggttctcgacccgatcgaccccgaactggccgcccggatccaaggccgccccctcgaccggatcgagtag

SEQ ID NO: 6894 - DNA, 891 bp, Actinoplanes utahensis
gtgcccgccggaaaagcccggaaccgggtgcccggagagcaacactgccggcctcgatggagtcgggcggcgtggcacgaattttcggatccggcgccgcccacggtcagaggtgtaccggctgctgcggagtgcgtagcatcgacaactgtggactggctcactcctgaccggtatctgtccgccctggaatccgagaccacccgcctgatcaccgcgatccgcgggcgtgcggccggggagccgatcccgacctgccccgactggacgctgcgtgacctggtcacccacgtcggcaccggccatcggacggccaccggcgtgatcagatcaccatcgccgaccccgccggcgtacgcggtgatcccggcccccgacgacccggacgactggcccgggtggctgagttcgggtgccgcggacctgatcgccgcggtccgcgacgtcggcttcgacacgacggtctgggcgtgggtgccgaagtatccgatcgccggtttctgggcgcgccgcatgctgcacgacctgatcatccaccggttcgacgtggcgcccggcggtgacctggaccaggatctggccgtcgacggggtcagcgacatcctgctgtgctgcgccacgctcagcgcccgcccgcagccgaggatggccggcctgcgcggcgctggcgaaacgttgcgcttcagcgatggccggcacacctggcatgccaccctcaccccgaccggcgccgcctggaccgacactccggacgtcaccgtccccgccgccgtgaccctgcgcgcgccggccaaggagctgctgctgaccctgaaccggcgccgcgaaccgggcccgtccaccggcgaccgcgccctgctgcgccgctggctggccaacagccgcttctga

SEQ ID NO: 6895 - DNA, 2316 bp, Actinoplanes utahensis
atgacatccacgtcgagccgcatcaccacggacgacgcacaggctcactggtacgaggagcgtgcggcgcaagccacctcaccctggatgttctcgcccgccgatgaccaggccacccggcgagagccgctctggtccggctcctgccacgacgcccggttcaccacggtgcagggccacgactcggtctgggtcctggccacggccggcgacggggcccgcacggccctgcgcgtggcgtactgtcccggcgggctgctgcgaacggtggacgtggagccggccggcagcggtgtacgcctgcgggtcgaatcggcgatcgggacgttccgcaccgagatcgcgctgccggattctgacgtggccctgctgcacgcgacgaccacgctgacgcccgccgccacgctgagcgtgccgtactggccccgggatctgatcccgctgggtgacggcgacgccctcaccgactcggccgggcgcgtgtacgcgtatcaggagggcgtgcgcaccggatgcgtgcacttcagcgtcacccggcccgaaggcgccggcagcatctactacttccagaacctcacggcgctcaacgactacgccgaacagaccaccacctcgctggccggggtggtgggcggcgcgtggccggaactcggcctgtccttgccggtctcggtggacaaccccctgcgtgcggggcaggagacggtgctgtccgacgcgtacgtgctgttctggccgtcgatccccgatgacgacacggggatggccgagcagttcctcgactcgctggcgcgcatcctgctgctgctgccgcaccgcgagccggcctacatgccgtggccggacatcgccgagaaagcgctgcgggacctgtcccaagcggccggctgcagcacccgcatcgacgggcaccggttcctcaacgcctacgtcggcgacgtcgatacaccgccggagagcatggtgcagctggccgtcctgctgccgctgctggagtacgcagagtggcgcggcgacgagatcgcgctgaccggcgaactgctggacgggctgccgggcttcttcgacgacgaggccggggtgatggggcgctggctgatggcccggaaggaccggctggacggctccgagccgcagaagaagccggggaccatggactcctggtacctgtaccactcgttgctcaacctcgcccggctggcacgccacggtgaccgtacggcccggcggctgttcctcgactcgatggacttcgccgtcgaggtggcgcaccatttcgagtaccgctggccggtgctctacgacatgtacaccctcgacgtggaggtggcccgctcgggcgaggacgaggccggggagagcgacgtcgccggcctgtacgtgcacgtcatgctggaggccttcgagctgacccaggaccggcgcttcgtcaccgaggcgacggtcgccgccgaccggctggcagggctcgggatgcggatgttctaccaggccaacgtgaccatgttcggctgcgccgcgctgctgcgcctggccgagctcaccggcgagcagcggttccgccgcctgagctacgtggccctggccagcgccttcaacaacacctggacctgggagtgcgactacggccacgccgctcactacccgacgttcctggccatgctgccgctgcgcgccgctccgtacatcgccgtcatggaagcgatcgaggccttcagtgcggtccagtactacctgcgctcgttctccgagccgatgccgtcctggatgacggtcctgctgccgcagttctgccgcggactgctggagcgtgcggccttctactacccgcagaacctgccggacgacgtgatcagcgacgagcaggagtcaggatcgctcgacgcgcggctctggatccccctggaggacctgcgcgacggctgggaacggccgggccaggtcgggcaggaggtgtacggcgccggtgtgcccttcgccctcgtcccccggcagtaccgccggatccccgaggccggcctgctggtcttcaccgactacccgatcgccgcgttcaccgtcggcaccggccgggcgacgctgcgggtgaccggggacgcccggttcacctgccggctgctgctgatccccgacgatcccgaccgtacgccgcaggtctcggtgagcgacgccgccgacggcgggctcgtgcccgctgaccgcaccagcgagggatacctggaccaccggctgcgcggcgaccaggccgtgatcatccgttggcaaccgactgagaacgaggagcacgtccatgaccgccaccgcgcagaagcatga

SEQ ID NO: 6896 - DNA, 777 bp, Actinoplanes utahensis
atgaccgccaccgcgcagaagcatgaacccgccactgccctgctacccgagtcggtagccggcaagaacatcctgatcaccggcggaagcaccggtatcggccgggccaccgccgagctgctggcgtccgccggggcccgggtggcgatcgtcggacgccaccagccggaactcgacgacgcgacacacgacatccacgcggccggcggtgacgtgctggcactgcgggccgacctcaccgccgaccgcgacgtccagcgggtcttcgccgagctcgaccggcatttcggcgacgttcacatcgtgatcaacaacgccgcgctgggtgccgggtcgatcgccgagggcacgtacgagcagtgggagtacgtggtacgcaccaacctgctggcctacctggccgtcacccatgaggccgtcacccggatgagagagcagggcagcggccacatcgtctgcatcgggtcgatgagcgcggacgtacgcgagaagggcagctcggtctacgtggccaccaaatccgggatccagggcttcaccgaggcgctgcgcaaggaggtcaacgagttcgggatcaaggtgagcctgatcgaaccgggcgcggtcggcaccgacatgcaggcgcagttctcgccgcaacagcagcgtgagcagatcgaagcgatgacgatgctggacgcccgggacatcgccgcctgcgtgctctacacgctcacccagccgcgccgctgcgacgtcgtcgacatcaagatccgtccgcaccggcaggagatctga

SEQ ID NO: 6897 - DNA, 705 bp, Actinoplanes utahensis
atgttctccgctgtgctgggctggttcgccgcggcgttgtcgatcgccctgatgtggccgcaggtgtggcgctcgtgtgtgctgcgccgcaccgccgggttgtcgcccaccgccacctggctgggattcgcgctgccggtgggatgggtcgagtacgggctgctgatcgacgacccggtgcagatctacaccaacacggtgggcgcgggcgccggaatcgcggtgctggtcgctctgctcgcggcacgcgccgagctgcgtcagcgccgtttcggtgcgcgtgccgccgtgggtgcggcggtgctgctgtcggccacggcgctcaccgccgggctcgcgagcctgcccggcggtgagcaccgcacgctcgcgtcggtcctgggcatggtcctgaccgtggcggtcgtgctggccaacgtgccgcaaccgctggccctgctgcgcgaccgccggcaagacctgtccggagtgtccgggctgcggtgggtgctggccagcgcggcgaacctcagctgggcggcgtacgcctacagcctcggccagggcgccgtgctggtgtgctcgctgaccgggctggcctgttctctggtggtgtgcacggtgctcgtcagcgcccgccggcagcgagcggtgccgccggtcgccgcgtccgccgtggcgagcgtgccgcgcgccgcggaccaactggcggtggccgcggcatga

SEQ ID NO: 6898 - DNA, 1233 bp, Actinoplanes utahensis
atggccttctatacgacgggcctcgtcatcacgccccggccgggcatgaccgccatgatccggattggcgcatccgcggccccggcgatccgtagagtgcgaagagtcggcccccggctgagctggcgtgccactcgcctgcgcgaccggctcgcgaaccggatcgaggaggcgccgcgcatgcgggcagcggtcaagacagcggacgggacattcaccgtcgaacaagtcgactcgccggagcttcccggcccggactgggcccggatccgggtgcgtgtggccggtgtctgtggaacggatctgcggcactggaaggtccccgatcccgcggtgacgggccgtgtcatgggacatgaggtggccggcgaggtcgccgaggtgggaccgggcgtgtcagacctgaacccgggcgaccgcgtggtggtcgaaaccgtgatgggtgacggtgtctgcccatggtgccgggtccgccgctacaacatctgcccccatctgtacgacgtgcgtacgcgcaccgtctcgcgcgcctacgccgagttcctcgtcgcgccgcgggcgaagctgtaccggctcccggagcggatcagtttcgaggaggcggcgctcgtcgacacgctttcggtgtgcctgcatgcgcagcatctgagcgggctctcgatcggcgaccgggtcgccgtgctcggcgccggcccgatcgggctgggccaactgatgctcgccaaggccaccggcgcccgggtgatcatcagtgacgtggtggcgtcgtcgcggcgcatggcccgcgagctgggggcggacgccgtcgtcgacgccgcgaacgaggacgtcgtcgcccgggtgatggagttcacgggcggtcggggcgctgacgtcgtgttcgagtgcgtgggcggcccggcgatgccggtgacgctcccgcaagccacccgggcggcgcgccgcggcgcagcggtcgtggtggtgggcggcttcgacgagggtgacgtggagatcgcactgccgtggcaggacatccagaagtcggaaatccggatcctgcccagcgccagtttcgccgtgcacgagctcgacccggaacagggcatggtggtcgacctgctggccagcggcatgctcgacgcccagcgattgatcacccaccggttcccgctggaacgcatcaacgaggcgttcgagaccgcggccgacaagagcggcaccggggcggtcttcgtggcgatcagcgtgtga

SEQ ID NO: 6899 - DNA, 648 bp, Actinoplanes utahensis
atgaccactgcccctaccggcatcccggccggcatcgagcatccgcacaaccggatccgcgtcggctacgcccgggtgtcgactcgggcccaggatcatcaagcgcagctggatgccctcaccggcgcgcactgtcgcgaggtggtggtggaaacggcaagcacccgaggcgatcgaccgaaactacgcgccaccctcgcccggctgcagccgggcgacaccctggtgatctacaagccggaccgagtagcccggtcgatgaaggagctgctgatcttcgtcgaggaccaactgcacgcccgcggcatcgtgctggagatcctgacaggggtctgcgccggcgtccaccgccccgacggagccaccatcgccgaccggctgctgttcgccgaactggaacgcgaactgatccgcgaacgaaccctcgacgggctacgcgccgccgcagccgccgggcgccgcggtggccgaccggtcgccgtcaccgccgaccaactcgacatcgcccgcgcccggctgtcccgcggcgaatccgtgaccgcgatcgccgcgcacctgggcgtcggccggtcaacgctgtaccgagcactggacctagcagccgacgcccctaacggacagacgcgaactgaaacagacacccattaa

SEQ ID NO: 6900 - DNA, 1437 bp, Actinoplanes utahensis
atgggtgacgccggcaacgcctgggttaccgtgacgcggaccgatcgtgccggcgtggtctgcaccgtccatggggatgtcgatcaagacacccgtgctgtggtgacgcgtgaactgttggcggctgtcaccgcctcatcacctccggacgtggtcgtcatcgacctgagcgccgtggcgtttcttgccgccgcagggttgcacgtgctcggcgaggttgccgcagtctgctctgagcggcgcgttccggtccggctcgtcagcgccccgggcgcctgcactaccagagtcttgcagctgtgtccgcccggtggcgacgtgccggtgttcggcagcgtggccgatgctctcgccctcggtcaggcggctcatgcaccacaaccatcggcgtcggcggtgcccgaaccacttcaccgcttcgtcggcgctcccgcgctgccggcggtcgcgggaccggcgtggcgcagtcgccccgagcaggcgatcatcgacgccgagatgcgggccagccggcgcgcgatcctggcgctgtttcgccgccggttgcgcaccgacgtggccacgctggtcgcgccggatttcctggtgctcgccgacgagccactcgtgttctcggcgatcactaccgcggcgttcggtgtcgccgatgcctgtgatgtgcagacctacgacccggtgacccggtcgttgcaggtggttgcgcagcggggtctgccgcgggccttcgtggagcatgtcgccacgctcgacgtgacggccggttccgcggccggggtcgcggcgcgcaccggtgaaccggtgctcgtcgacggcgtcgcggccagccgggtattcgacggccagccgacacgcgaggtattgctggccgccgggtcacgtgctgtgcacagctatcccttgcacgacgaccaccgccggctacgagcggtcctgtcgctgcactatcacagtgcgggacgccatcccggtcaggagttgctcgcctggtacgccgagcaggcactctcccgcgttgccctgcctttcacactcgcagccgatgccgggcagctcatgacagagtcgatgagcgccggcatcgccgtggccgcctctgatgcgagcaccacgacgatcaccgtgtccggatcgctcgacgccagcaccgcccctgagctgaccgacctcatccatcagacgctgaaccgcctcacgacgccccatgcagtccacatggacctgcgtcagctgcagcatctcgcggcggcgggcgggcgcgccctcatccaggccgccgagcgatgccacgcccatggggtcgactgctacctgatcatgggcgccgatgatcccgcccgcaccgtgctgacccggctgcaagcacccagcagcctgcgcatcgtcgaggacgtgcacctgcttcgtggccagcaggggcaaggaccggccgcgccgtaa

SEQ ID NO: 6901 - DNA, 2013 bp, Actinoplanes utahensis
gtgcagaacagctcagctaacgacctcgatggcctggtgggggacgcgcagaccgtccggcacaccttcgagtccatgccgttgatcatgattgagtgggcgggtagcgaccaccgcatcgccgccatcaacgcggcgttccgccggatcgtgggccgcgagcacgagcggctggtcggcctgccgacgcgtgaggccacgccggaactcgccggtcagcaggtcttcgagatgttcgacgaggtctacacgaccggccgcgagcaggtagcgcgggaatggcgtttgcaggtcagtgccggaccgggcggcgagctgcgggaaatcttcctcgacttttacctggtcccggtgtacgacgacagcggtgcggtggtcggcatgcgagcgttctccaccgacgtaaccgaccgcgtacgggaacggcaggcggcccaggagcgcacggcggcggccgaacatcgctatacccaagcccgcgacgtcatcaacgccctgcaacgacagctgctgccccccgggttgcccgtgctgccgtcggcgcggatcgcgggcagctacctgctcgccgacgccgaaaccgccgcgggcggtgactggttcgacgcggtgccgttagccggcggccgggtggcgctggtcgtcggcgacgtggtcgggcacggcgtcgccgcgtccgccgcgatggggcagctgcgtgcggtgctgcaggaccggcttgacgacagcggtgacattctgaccgcgatgggcgcggctgaccggatggcccgtcggatgccggccgcccgcgccgctacggtgtgcatcgtggtactcgaccccgtcgacggcgcactgagctggtgttcggccgggcatccgccgccgctggtggtcaacgccgacgccgcccggttcctgccttcgtccgggaccgccccgctgggcaccggcgggcgctacaccgtgtccagcgaccagttgcgcgccggtgagatggtgctgctctacagcgacggcatcatcgaacgacccggccgcgaacccgccgccgccaccgtcgagctgtcccaggtcgccgtcgacaccgtcgccgggcgcggcatggacaccgacgacctgtccgccgtcgagcgggcctgcacacagattctggaactactggtccgccgaaccgggcacaccgacgacatcaccctgctcgccgcgcaacgccgcacgccgtcaccgccgctgcacctgagcggtccgacagcaacagtgaccccgcgggctgcccgggccgccgtcgaggactggctgaggctgcatgaagccggggaagaagaccttgtcgcgctgacgcacgcggtcggcgagctggtcaccaatgccgacgagcacgcccggcccgacaccgccgacgccacggtgacggtcaccgccgaactgcgcgacgacggcgaggcacgactgtgcgtcgccgacaacggccgctggcggcaccgcgaccgccccggcgacgagcaattccgtgccggccatggcttcggattggccatgaccgccagcttcgccgatgacctcgacatcgaccgcggtgagcacggcactaccgtcagcgtgcggcggcgactgtaccgcccggcccggctgctcaccgccgaacagatcaaccacgagcgtccccccgcggacgaagcgccgaaagtgatgatcattcttgatcagccgcacgctgccggcagccgcatcgccatccacggccccctcgacaccgacaccgtcgacaacctgcgtacagaactggaccgatacaccctcgggggcacccacgagctgaccgtcgacctcaccggcgtcacccacctcgccagcgcggccgtcgccgagctgtaccggccacagcagtacgacccagcacgcccctacccgctacgcctctacgcgcccgccggcagcaccgcccaccacgtgctgagcctgatcaacctgccccacaccaccaccgaccccgacggcaacgacaacgatccgcaaccgccccgatag

SEQ ID NO: 6902 - DNA, 843 bp, Actinoplanes utahensis
gtgggacgccggctccaccgcggtggcgtcggactccacccacttcggggcgttcgaccagaacatcttcaccgagtggcattcgcgctacggcggccgcggcgtgctcatctactggcacgtcgagcgcaagagcatggccattcactcgcagctgatcaactgcaccgcctccgaggtcgccgcgatggtcgagggcgcgatgcggcacggcaccaccatggaggtcgagggcaactacgtcgactcccacagccaatccgaggtcgggttcggcattacccggctgcccggtttcgacctgctgccccggatcaagcggatcaacaaggtccggctctaccggcctgccgcgggcgaggcggacgcgtacccgcggctcgggccggcaccgcctccaccgaggcgatcctgcgccggttcacccgggccaatgcgatccaccccacctaccaggccatgatcgaggtcggccgtgcccagcggaccatcttcgtcgcccgctacctgcgcgaccgggacctgcaacgcgagatcaacgaagggctcaacgtcgtcgagtcgtggaaccgggccaacagtgtgatcttcttcggcaagggcggcgacatcgctaccaaccgccgcggcgagcaggaactgtccgtactgtgcctgcgcgttctccaggccgctctggtctacgtcaacaccctcatggtccaggatgtcctggccgacgccgactgggccggcacgctcaccgacgccgaccggcgcggcctgaccccgctgttctggacccatgtggccctgtacggcgaggtcaaactcgatatgagcagccgtctgccgctgggctga

SEQ ID NO: 6903 - DNA, 1617 bp, Actinoplanes utahensis
gtgctaggtgctggccccttccgcgaaatcggtcgtccacgcgttaccgcgatctcgccccatgaatcgcttatcgcggtaggcgggtcgctggatcggccacaatggcacggtcgggacgtctctgatcgttcacgaccgcatccgggttggcacccgacggcggtctaccgctccgacaacctgacctgcgtgttccatatgaccacgcgatggccagccaacgcgctcgccttccatcccaccctgccgttgttggcgatcggcaccggcgcgtacgacggcggatggtcctacaacggcgaactgctgctgctggacctgaccaccggtgcgaccgtgtcgctgctggccgatccgcgggaggtccggcagctcacttggcaggatccagaaactctcgcactggtgctcgctgttccgtgcgacgaggatgaggagcggttcggtaccacatctctggcctgcaccatccgccgcgacgactggagccgggccaccgcaggcatgcttcgtatgccctacggcgaagagccgtacatggacgaatgtcgaacgggcccggctgccgctgccgctgccattgaacggttgtgctcagcacgaggacttgcctggacgccccgccgcgccgtctgggcggtgcaggcactcccagacggccgtattctcgccgccctcgaaggtattgctctggagtgctggacaccgacgtccgagagccccgcctggcaggtgcccatcgacggtaccggttgccaggtcaccacgctgccggacggacgaacagcggtggcgttgacacaaaccccacccgccttccacggcggccgatggacgagtgagccgagcgtggtggtggaggtcgacctcaatgagggcacggtccgaaatacccgccaggccgcctcgcccgcaatcgtggtatcccgggctgacggccggtgggcgttacgcaacaccgaacacgacaccgcaacgatgaccggcgaggtcacattcatcgatcctggtgatgcccagccgaccacggttcatctgggtcgttacgacctgttcaatcactacttcgacatccggtatgcccccgacctgctcttcctgcaaggtgtgggcagcaaaccctggcgtgacaagtgggtggtcgccgtcgatgtgccacgcgggcggatacggcggctcttcccgctcgagtgggatgcgtcgcgcggtgggcacctattcggtggctgtggcgcctacctcagcgaccgagccggccccgcgctcctccacaccggtgccgttcacgatggtgcgggactgttgaccgggaacgctttcgtggcccgtcgcgcgtatccgaccggcgagctgcaatgggtgttcaccgccgaccatcaggccaccgcactcgacgcagacggcgacttcgtctacgtgacgttcaactcgggagagctggtcatcctgcgcgccgtggacggcgcggtgcaggtgcggcagcagctccaggtgaacgggtaccgggtcattccgctctcactggcacgggtgggagcgaaccggcttgtggttggcacgctggacggtcgtgtactcgactgttcgatcgccgcgctgcctcgatcggggtaa

SEQ ID NO: 6904 - DNA, 339 bp, Actinoplanes utahensis
atgaccaccctcatcacccgcgagcagcttcgcgccgagatcgacgcgggcacggtcaccgtcgtcgacgccctcggcggcgactactacgctcagcagcacctacccggcgccatcgcgctggtggaggccgacgtcgcggaccgcgccggcgagctgctgcccgaccgcgacgcgccgatcgtgacctactgctcgaacccggcctgcccgaacagccagcgggtggccgacaagctcaccgccctcggctacaccaacgtgcgcaagtaccgcgaaggcatccaggactgggtgaccgccggcctgcccgtcgagtccggccagctcgccggctga

SEQ ID NO: 6905 - DNA, 642 bp, Actinoplanes utahensis
atgcctcaggacattagcggaccgcagtccgtttacgccagcgcggccgaggaactcctgctgttgcgcagctcaccgccgaccgagcgggccgacgccgcccgcaaccgggccgccgtgctggacgcggcagcggccctgttcagccgacacggcatcgaagcggtatccatggacgcgatcgccgcggccgccggcgtgggcaagggcacgctgtttcgccgcttcggcgacaaggcgggactggccgtcgccctgctcgatgagcaggagcgcagcctgcaggaggcgatcctgttcggcccggccccgctcgggccgggcacgccgggcgacgatccgggcgtccgcgagcggttgcgggctttcgtggccgcctacctcgactaccttctggcccatctgccactggtacggatgtcggagaccgcttcgcccggcgcgcgctaccggatcggcgcataccggttctggcaccggcacgtctcgctgcttctgcaggatcgcgatgacccgcaggccgacgcgcacaccctgctcgccgcactcgccgccgatcacgtgcacgccgtggccgacgaaatcggtgccacccgggtacgccaaagcgtgcagtgcctcgccgacgtcctcaccgcctga

SEQ ID NO: 6906 - DNA, 204 bp, Actinoplanes utahensis
atgccgtacatcaatgtgaaaatcactcgtgagggtgtgacgcgagagcagaagcgccgcatcatcggtgagatgacgcaggtcctcgtcgacgtgctcggcaaggacccccggacgaccttcgtcgtcatcgacgaggtggagctcgacgactggggcatcgggggcctgcccgttcccgaattccgcagaaacggccgctga

SEQ ID NO: 6907 - DNA, 408 bp, Actinoplanes utahensis
atgacggtcgctcccgcgggtggcgccgtcggattcccggacgtcgaggggctgctgaggacctacttcgacgggttgtaccgcggcgacgtcgaccgtctcgcggccgtcttccaccccgccgcgctctacatcactcaaaccccggacggcacgctgcaccgcgacctgccgacctacctcgacgtggtggcacaccggacggctcccgcagcacgcggcgaagcccgcaacgaccgcatcgttgcgatcacgcaggtcgccccgagtctcatcgtcgccgtcgtcgaatgctccctgggcgacgtcgactacaccgacgtgctgaccctgctcgacgccgacggacgctggcagatcgtgaccaaggcgttccacgcgactccccgacgccacggaaaggactga

SEQ ID NO: 6908 - DNA, 738 bp, Actinoplanes utahensis
atgagcagttcctcgacagtgatcatcacgggcggcagcagtggtctcggcctcgccgcggcgcgccgcttcctcgccgacggttaccaggtggtcctcggcggacgtgacgatgcgcggctcaagcaggcggagtacgacctgtcggcgggcgaccgggtggcgacggtcgctggtgacatcggtgcggccgacaccggacagcgcctcgtccgcaccgctgtcgaccggttcggtggggtcgacgtactcgtcaacagtgccggcacgttcgccgcgaagccgttcctcgacgtgaccggcgaggaactcgacggcttcctcgccgggaatctgcgcgggacctacctcaccacccaggcagtcgttcgtcgcatggtcgcgcagggccgcggcggctgcgtggtgaacatcggcacggtactcaacgaccacgcggtcagcggcttcccggcgtccgcggcgctcgtttccaagggtgggatccgcgcgttgaccgtggcactcgcggccgagctcgcaccgaacgcgatccgggtcaacgaagtggcccccggtgtcgtgcggactccgctgcacgccgccgtcgacgtcgacgcgttcgccggccttgccgtgctcgaccgcgtcggcgaagccgacgagatcgccgaggcggtgcactacctcgcgacggcacagttcgtcaccggtcacaccctcgcggtggacggcggcttcgtcacggtgcggtcatga

SEQ ID NO: 6909 - DNA, 126 bp, Actinoplanes utahensis
gtgatgatcactgtcgaggaactgctcatggctcatcctgtcgtcgaaggggaccggtcggatccggccggcccgtcaagcagtgacgctacggagaaaccaaccgatcagtccaagacgcggtga

SEQ ID NO: 6910 - DNA, 948 bp, Actinoplanes utahensis
atgaacgtggacgtgcgggacctggagttgctggcggcgctggcgagcggggggaccctgcttcaggcagccgaggagctctatgtgagtcagcccgcgctcagccagcggctcgccaagatcgaagcgcgcgtcgacgcgcagctcttcgaacgccgcgggcgccgcctggtgcccaccgaggccggcagacgcctcacggtcagcgccgtgcacgtgctccgggaactcagcgcggccgaaaacgacgtacgccgcatcgcgcaattcggacgcagtcgcgtgcgggtcgcaacccagtgcagtacgaccttcggctggctcaccccggtgatccgccgccaccgtgaagatcaccctgacagccaggtgcgggtggagtccgtgccggatgacgacgtcgtcggcgcactgctcgaccagcgcctcgacgtcgcggtcctgaccaaactcgaccggcgggcggaggagctccagctgaccccgctcttcgacgacgagatggtcgcggtggtcgcgccgcaccatgcgtgggcacggcgcgaccatgtggcgccgcgcgacttcgcccacgtcgatctgatcttgtatgactcctacgacccggcccgggccctggccacgccgctcccgctgccacccggcgcccacccgcgcagcctcacgacggtacccatggtgacggacctcgtcgtcgagcttgtcgcagcccaggagggcgtctcggtgctcccctcctgggtgatcgcgccgtactccgaacgcggtgacgtcgctgtggtgcgcatcggcgcgcggccgactacacgcacgtggtacgccgctgtgcgcgccggcgacgagcgcgcgtcagtacgcggattcatcagcgccctgaaacagcacttcgccgcccagggccccggcgaggtgctgctgaacgcggcgggcggctcgggtcacctctag

SEQ ID NO: 6911 - DNA, 828 bp, Actinoplanes utahensis
gtgggagccctccgacgagccgggccgtccaccacggcacatgtaccggctgagcgcggagggggccgccctggcgcagcagcgtctggccgcggcgaaacccgccgccgaaccggttcgccgtctcggcggcgccattcaggcgcggacagcatgagcgcggtccgccggatggcgcatgccgtcctggccgccgcggtgcgcggccgccgggatcgtggcggcgactggggtgaggctgtactcgccgaattccccctggtcaccggagactgggcggccgtacggtgggccgccggcgggctgcgcgcggcccgctacgaacgtcgcgcccgggtgcgggaactcccgcggatggtccggatccggcggcgggccgtgctgatcgcactgatcggcatcgtcggcgggttgctggtcaaccggttcgtggtgaccgtggggtacgagccgagcggcagcatgcagcccgcctacgacatcggcgaccggtatgtgctcgaccgggtggcgttccggctcaccggtgtccaacggggggacatcgtcgagttcaccatgcccggcaccgaccgcctggtcatcaaacgcgtcatcggcctgcccggtgacgagatcacctgccgcgacgggcaggtgtggcgcaacggcaggccgctcgacgagtcgtacctgccggcggacccgggctggtccggcaccgactgcacgccggtcaccgtgccggccgaccaggtgtatgtgctcggcgatcaccggacggtgtccttcgactcccgccagtacggcccgatcagcgagagcgccctggcgggacgggtcctctag

SEQ ID NO: 6912 - DNA, 240 bp, Actinoplanes utahensis
atgcgcgaaactctacataactcgaccaacgaagatcaagtgaagtggcagccgagctcgacgaaggcacacggcatgacccggttcaacggcccggtcggcgccctgaccggcaacaagccgatgttcgacaaggtcaccttcacctggctcgccgagtggctggtaccgatcccgccgaccgccgaggccagggtgacggttctcgccggcctggtcggccgccagagcgtgcagtag

SEQ ID NO: 6913 - DNA, 711 bp, Actinoplanes utahensis
atgaccgggacattgcggacagtggcgctggatgccgccgaccatcgggggcttgccgacttctatgtggcgctcggcgggtggagcgagcagtacgccgacgacgactggatccagctgcgcaccgccgagggttggcgggtggcggtgcaggccgcgcccgatcatgtgccgccgcggtggccggatccgcggtttccgcagcaggcccacctggatctgcgggtgcccgacctggcggccggcgccgcgcgggccgtggagctgggtgccacgctgctgcgggagaaccagacgtggcacaccctggccgatccggccgggcatccgttcgacctgtgcctgcaggcgggtgcgccggcgacgacgctgatgggcgtgatgctggactgcccggacgcgtcgcggctggccgcgttctacgccgagctgctcggcaaacccgtcacatacgagggtgagggcatggcgatgatcggcgaggacggcgcgcagccgatcatgtttcagcaggtggccgactatcgggcgccgcgctggccggacccggcgcatccgcagcaggtgcacatcgacgtgaccgtcgacgacatcgaccgggccgaagcggccacgctgaagctcggcgcgaccgccctggcggcctccggggagaactggcgggtgtacgcggacccggccggcaagccgttctgtctctgctgggactga

SEQ ID NO: 6914 - DNA, 1173 bp, Actinoplanes utahensis
atgaacgaacgacttctgcgggacctggtgccggcggtgatcggtgtcctcgtgcgccgtggcgcggatttcgcgtcggccgaggacgccgtgcaggaggcgctgatccgggctctgcagacgtggcccgcggatccgccgcgggatccgcaagggtggctggtcgcggcggcctggcgcaagttcgtcgacgcggtccgggccgacgcgtcgcggcgcgggcgggaggaggcggtggacgcacagccgccggccgggccggcgccgggcgtggacgacacgctgcgcctgtattttctctgcgcgcatccgagcctgtcgcagagcgcggcggtcgcgttgacgttgcgggcggtcggcgggctgaccacccggcagatcgccgccgcgtatctggtgcccgaggcgaccatggcgcagcggatcagccgcgccaagaagaagatcaccggggtggccctcgaccggcccggtgatccgggcaccgtgctgcgcgtgctgtacctggtgttcaacgagggttacagcggcgatgtggatctggcggccgaggcgatccggctgacgcggcagctggccgggctgaccgccgacccggaggtggcggggctgctcgcgctgatgctgctgcatcatgcccgacgggcgtcgcggacgggcgagggcgggcggctgatcccgttggcggatcaggatcggtcgctgtgggataccgccatgatcggtgaaggggtgctgatcctgcagaacgctctggcgcaggatcggctgggggagtatcaggcgcaggccgcgatcgcggcgttgcacgcggatgcgccgcgggcggccgataccgactgggtgcagatcgtcgagtggtacgacgagttggtgcggatcaccgacagtccggtggtgcggctgaaccgggcggtggcggtcggtgcggcggacgggccgcgggccgggctggtggccctgcaggcggtgggggagcaggtgccgcggtacgcggcggtcaaggcgtatctgtgcgagcgcgccggggacgtgcaggcggcggcgcggctgtatgcacgggcggcgcgggaggccggcagtgtgccggaacgcgatcatctgacccgggaggcggcccgggtgcggcagcgggcgggcgggtcaccgcgtacccccgcaagcggatggtga

SEQ ID NO: 6915 - DNA, 408 bp, Actinoplanes utahensis
atgaaatacctgctgctcaagcactaccggggcggtccgaagccggcggccgactgcgcgccgatggacgagtggacgccgcaggaggtcgacgcgcacatccagttcatgcgcgacttcgccgcccgcctggaaaccaccggcgagttcgtcgacgcgcaggccctggcgcccaccggggcatgggtgcgctacgacggcgagggccggccgccggtcaccgacgggccgttcgccgagaccaaagacctgatcgcgggctggatggtgatcgacgtcgactcgtgggagcgggccgtggccctggccggcgaactgtccgcggcccccggccagggcggcgcgccgatccacgagtggctggaggtccggccgttcctggccgagccgcccacggtgaccgaatga

SEQ ID NO: 6916 - DNA, 210 bp, Actinoplanes utahensis
atgagcgaacctgaaaccgttgcgggtggcagcaccgaccagcacgtctccgggctgccggagaccggggacttcctcaccgacgcgccgccgacgtccggcacaccggccgacggcagcagcaacgccggcatcaaccggaccggcgccaaccggcccgcggccgcgaccgccgacgccgaggagatggacgacctcaccgaccgctga

SEQ ID NO: 6917 - DNA, 693 bp, Actinoplanes utahensis
gtgacgacgacgctggatgtgcacgggatcaccatcgcctaccgtcgcgccggcgacccgggcaacccgccgatgctgctgctgcacggcctgggtgacagctccgccgactggcatccggtcctgcccgacctcgtcgagacccactgtgtgtacgcggtggatctgcgcggccacggcgacagcgcccacccgggcacgtattcgttcgagctgatgcgcgacgacgtcctggggttcctcgacgccgccggcatcgagaaatgtgtgctggtcgggcattcgatgggggcggtcgtcgcggtgctgctggcgttgcgtgccccgcagcgggtcacccacctggtcctggaggacgcctcggtgccccggcccggtatgctgcgccgcccgccgctgcccccgccggtcgagccggtcccctacgatgtccccgtcgtcaacgcgatccgcgcgcagctggaccagcccgacccggcctggttcgaggcgctcgccaccctgcccgtgccgaccctgctgatcagcggcgcggagagcccgttcccgcacgagctgctcgccgattccgccgaccggatcccggacgcggtcctggccaccgtcaccgccggccatcacgtgcatctggagcagccgaccgcgttcaccaccgagatcgcccggttcctcaccggccgcgtcccccggtga

SEQ ID NO: 6918 - DNA, 99 bp, Actinoplanes utahensis
atgcggcggtacgcgcccggctggttctcccgggtgttcgaggcccggtccgtgcggggcgtgggcggccggtcggtcaccgggggacgcggccggtga

SEQ ID NO: 6919 - DNA, 531 bp, Actinoplanes utahensis
gtggtctacggcgtgaccggctccggcaagtcgaccctggccgcccggatcgccgcccgcaccggcctgccctatcacccggtcgacgacctggcctgggaacccggctgggtcgaggtccccgtccccctgcagcggcagcggatcgccaccatctgcgccggcgactcctgggtcctggacagcgcgtacatgtcgtggctgcaggtgccgatggcccgcgccgacctgatcgtcggcctggacctcccgcagtggcggtgcctggcccggctgctgcgccgcaccctcgtccggctgctgctgcgcacccgggtctgcaacggcaacgtcgaatcgctgcgcgaactgttcacccgcgattcgatcatccgccagcagttctcgtcgtacccccgcaagcgcatgcggatgcgggcctggcacctcgacccggccatgcccccggtcgtcctgctccgctcgccgcgcgccgtccgggcgtggctggccgcactgcccccgggcccgggaccggcctcctccggctga

SEQ ID NO: 6920 - DNA, 759 bp, Actinoplanes utahensis
gtgcccgttgtcgatgccgtggcccgatgtgcggcaccggccgccggcggcatggtgtccggcatgaccctcgtgttccccgggccgcggctgggcggcctgtccctgatcgccgggccgccgctgctgctggccggcaccgcgctgcggctcggcgtgccgttcttcttcccccaccagatcgccgcctaccagcagagaccaggattgtggggtacgtcgtacgcgttggcgctggccggcatcatcgccctgtggccgggcatcgccatgctcgccgcccagatcgcggacagccggcccggctggggccggtggggcggcaccctggtgatcaccgggctgttcgcgcgggtcttccagcacggcgccgacacgttcgcgttctccctgaccggcagtgccgggccggtcgtcgccgagcaggcggtcggcgcctactaccggtatccggagtgggtggtctccagcctcagcgtcgcgatcatgacggggtggatcgtgctggccgtcggcggccggctgtcgcgggtcttgcgggcgtggcaggcggtcgcgctggcgttgatgtcggggctgatgatcggggtgctcaagggcagcaccgtggcgtcggtggtggaggtcgccgggctggcggtggcgctggtgccgcacggcgtcacctgcctgcgcggggccgggctgccggggtggcggacgctgggtctggtggtgctgaccgccggcgcctcgatcatcctcggacagctcgggtga

SEQ ID NO: 6921 - DNA, 111 bp, Actinoplanes utahensis
gtgaccgcagcgcgcgcaccgatggtggatgtggccgccgccgtcgccgtcctcgccgcgtgcggggtcgcggcgcaggaggtcgggccgcccgccgggtggcctagctag

SEQ ID NO: 6922 - DNA, 1323 bp, Actinoplanes utahensis
gtggccgaccgtggtcgccgtcccctggctgaccggctggctggtccggcaccgccggcacctcgccgagcagctcgccgagcaacgctccgcccgcgcggtcaccgaggaacggctgcgcatcgcccgcgacgtgcacgacacggtcgcccacagcctcagcatgatcaccatgaaggcgagtgtggcccggcacgtcgccgcgacccgccccgaggagtccgcggccgccctggaggtgatcgagacggcgggccgggaggcgctgctgcagatgcgccgcaccctcggactgctgcgagacgagccggccgacctgcacgctctcggcgaccgcgacggggtgacgatgagcgtggccggggaggcgtcgctgccccccggagtgcgcgcggtggtgtaccggatcgtgcaggagtcgctgaccaacgtgacccggcacgcgcccggcgcggcctgcacggtcgacgtcgacgcggggccgcgggcggtcaccgtccgggtcgccgacgacggcggattcgggctgcgcgggatgcgcgagcgggtcaccgcgtacggcggcacgctggccgccgggccgcagcccgacggcgggttcgcggtgaccgcacacatcccgtacgacgacgagacaccgtgaccgagccgatccgggtcctgatcgccgacgaccagaccctgctgcgcgacagcttccgggtgctgctcgacagcacacccggattcaccgtgaccggcgaggccgccaccgggcgcgacgccgcccggctagcgctcgcccaccggccggacgtggtactgatggacgtgcgcatgccggacctgaccggcatcgaggccaccgagctgatctgccggcagaccgacgacgtgcgggtgctgatcctgaccacgttcgacctcgacgagtacgtgtacggcgcgttgcgcgccggcgccagcggcttcctgctcaaggacaccaccgcggccggcctgatcgccgcgatccgggtcgtcgccgccggggaggcgctgctcgccccgacggtgacccgccggctgatcgccgcgttcaccgcggcgccgccgcgcccggcacccgccgtcgcggcgcacctgaccgcccgcgagcaacaggtactgctgctgatcgcccgcggccggtccaacacggagatcgccgggcagctgcggctgagcgtgccgaccgtcaagacgcacgtcggccggctgctcaccaagctcgccgcccgcgaccgggcgcaactggtcgtcgccgcctacgaatccggcctggtcaccgcggcgatcgcggattcccgggtgtcgccgaagtag

SEQ ID NO: 6923 - DNA, 366 bp, Actinoplanes utahensis
atggccgccaagatcagcgttgtcggtgacaccctgcatgtcgaggtcctcggtctgcacaaggtgtgggcgctgcgcagccggctggagattccgctggccaatgtcgccggcgccaccatcgacccgggtatcacccgcgggtggaaggggatccgcaccggcggcacccaccttcccggggtgctgaccgccggctcgttccaccacgccggcgagcggatcttctgggatgtcagcgacccgaaccgggctgtggtcatcgcgttgcgcgacgagacgtacgcgcggctggtcgtcgaggtcgacgacccgcgggccacggtcgatctggtggagaatgcgatcagccgcccggcgcggtga

SEQ ID NO: 6924 - DNA, 462 bp, Actinoplanes utahensis
atgggaaggccgcgagcgttcgacgagaccgaggtcgtgcgggccgcggccgggctgttcgcccggcgcgcgttcgacggcgtctcggtcgacgacctggtcgcccacctgggcgtccaccgcaacagtctctaccaggtgttcggcagtaaacgcgggctctacctgcgggcgctgcgctggagcctgcagcacgaggtcgggccgctgctgcggcacgcggggccggggtcgctgaccgatcttgccgccgacccggtgctcgatctgctgctgctggccgccgcggaacgtgccccgcaggatccggaggtcgccgcggaggtcgccgcggcgctcgccgacctggacaccgccctgggcggtcaggcggccaccctgctcgggctgcggctgtgcgcccggatcaaccccctcgggaaggaggcggcagatggccgccaagatcagcgttgtcggtga

SEQ ID NO: 6925 - DNA, 993 bp, Actinoplanes utahensis
atgatcgggacgcgcaatcccgtaggaggacgacaccaccatgcccaaggcccagaccacccggcccctcgccatcccggcgatctccacccgcctgctgctcaccgccgccggcatcaccctcctgctgctcgccctcgcctacctggtcgccttcgaccagggcgccctctcccgcagcggcatgtacatgcacgaactcatgcacgacggccggcacctgctgggcgtcccgtgccactgaggcccaccttcgggcggctcctcatcgccggcctcctggccggcctcatcgcgggcatactcgccggcaccttcgcctacttcgccggcgagccccgcgtcgacgccgccatcgccatcgagcagcagaacgccctggcccacggcgaagccggcggcggcgaggaactcgtcagccgcgacacccagaaacacgtcggcctgttcctcgccaccggcctctacggcatcgccatgggcggcttcctcgccaccgcctacaccctgctccgccgacgcctgcacaccaccagcgacacccgcgccgcgatcggcctcgccgccgccgccctcaccggcatcgtcctggtcccctggctcaaatacccacccaacccaccggccgtcggcgaccccgccaccatcaaccaacgcaccaccagctacctcgccgtcctcgcactcggcctggtcgccatctgggccggcatcatcgccgcccgcacccaacccaccgaatggcgccgcgccaccgccgcactcctcggcttcctgaccgtcgtcaccatcgcctacaccctgctgcccacggtcaacgaagtccccgccaccttccccgccgtcctgctgtggaaattccggctcgcctccctcggcacccagaccatcctctggaccgtcctcggcatcgccttcgccgcccaactccaccgcatcgccaccagcaccaccccggcccaaccggccacaccacaaaccaccaccgcctga

SEQ ID NO: 6926 - DNA, 525 bp, Actinoplanes utahensis
gtgaccagttttcccgcgaccgcgcgccgggttcgtgacgagagcctcgacccccgacgacggcgagtgcgtctgcggaactgcctctaccatttcgcgccgtatggtttccacgccacttggcatcatctggcgaccacgcaccgcattccggggcgtatcgaggccgatccgtcgtcgctggtccgggccctcgacgaggtggaggcggcccgcgctctggtgctgccgagggtggtcgccttcgctgcccggcgacgcctgcagaagcgggagggcagacgtgtcccggcggcgctgcatccgtgggactcatggggttgccacgacatcgcctactgtcccgatccgcggaagcatccggccgagccgctgccggttgtggtggaccgggtgctcgatgcgtgcgccgccggtgccgaccgggccggagggtgcctggtctgcggtcgggaggactgggacctgtggagagtttgccgcaactgcggtgtcgcgtccggaggccccggcacccattactga

SEQ ID NO: 6927 - DNA, 465 bp, Actinoplanes utahensis
atgccccgattcaccggactcgacgacctcctcagccgcgaagaactgggcaccaccgcctggcacctgatcgaccagccccgcatcaccggcttcgccgacatcaccggcgaccaccagtggatccacaccgaccccgcccgcgcccgccgcgagggcccgttcggcaccaccatcgcccacggcgcgctcaccctctccctgtgcatgaccttcctgaccgagatcgtccaggtcgacaacgtcaccttcgtcgtcaacggcggcttcgaccgcgtccgcttccacaccccggtccgcgccggcgcccgcctgcgaggcagcatccgcctcctccagtcccgacgcctgcccaacggcgcccgcctggtcctgcgcaccaccgccgaaatcgacggcgaacctcgccccgcctgcgtagccgaccagatcctcgccctctacgaagcacctccggcccggtaa

SEQ ID NO: 6928 - DNA, 87 bp, Actinoplanes utahensis
ttgaagctgttcaccaagaatgttctcgagacggcgctgaacgaggtgatgacggagcacctcggtcatgggccgccctactggtga

SEQ ID NO: 6929 - DNA, 861 bp, Actinoplanes utahensis
ttgctcgcggcgccgatgtgcaacgctccgtcgatgatcgccagaacgccgtacgacgacgaccgctcccatttctcgcgccgtgcccttgcccgtctggtcctctccgaccaggccagcggtctgtccaatgctgcggcgagtctggcggtcacccgctacgacgagttctccggcgccggcggccgcgtcagcgaggcggcggcggtggccagtcatgcggatcggctcgtcatcactgcggtgatctacgaacgggaacgcggcagttcctgggaggacatcggccggtatctagacctcagcggtcccgcagcggagcagcggttcgcatcggccgtcgagcactggcattccgcgttcgacgccccttaccgcctcgacgagacgggccggaaacgcatcccgcagttgcccaccgctgcctacgatcccgctcgctcgatccgcaatctggacctctgggcggacgtgcgtcttggattcgacgacaagcacgccgtcagtggtggcctacagccgcgcgacgacaccgaggaggaggcggggctgccgaagccgaagggcaccgagatagacgggcgaatccagctaccgcaccttggtgccttcctcgacctgctctccgagtacgccctgcaccgccccaccggcaaagctcgcgaggtggtggccagggcaatggacaacagcaaggacgaaggcaggggcagctggcactcatacaccatggacgggatcttcgagacgctcgacgtccgcctggcaccccacggtgacatggtctctgtcattgtcgccggcgcgcactcgccggcgttgcggttgcagatcagcacgctcttggacgccttcgcctga

SEQ ID NO: 6930 - DNA, 876 bp, Actinoplanes utahensis
atgtccccattcacccttcccgatctgaccgggcggatcgcgatcgtcaccggagccaactccggcgtcggcctggccaccacccgggcgctggccggcgccggcgcccgggtcgtgctcgccgtgcgtgacatgggcaagggcgaggccgccgcccgcaccatcagcggcagcgtcgaggtgcgccgcctcgacctggccgacctgtcgtccgtacggtcgttcgccgacagctggtccgggccgatcgacctgctgatcaacaacgccgggatcaccgcgccggagctacgccgtaccgtcgatgggttcgaattgcagttcggcaccaaccatctcgggccgttcgccctgaccaacctgctgttgccacaggtcaccgggcgggtggtgagcctggcgtcgcaggccgagcggatgggccgtctggacctggacgatccgaacgacgagcgccgcgcctacaggcagtcgccggcctacaaccggtcgaagctggcgaacatgctgttcatcgcggaactgcagcggcgcctggacgcggccggctcgccggtgcgggccatggccgcgcaccccgggctggtgcgtaccgacatctacaccgaggccggcccggtcagccggttcatcgtccgcaccttgggccagagtgccgagcagggtgcgctgccggtcctctacgccgcagccgccgacctgcccggcaacagcttcaccgggccgagccgcttcgcccacatgatcggcgagccccaattgatcaaccgctccgcccgcgctcgcgacgagcaactggcggcgcgcctgtggtcggtatccgagaagctgaccggcgtacggttcccggccgcgctggtcgagcgggcggtgtaa

SEQ ID NO: 6931 - DNA, 573 bp, Actinoplanes utahensis
atggcgagatgggtacccggcacggtcgagcgcctgcgcacggcggcgctgacgctcttcgacgagcagggcttcgagaagacgacggtcgcgcagatcaccgaacgggccgggatgaaccggcgcacgttcttccaccacttcgccgacaagcgcgaggtggtcttcgccggccaggaacactccgaggaactcatcgccgccgagatccgcggccaggaccacgggacggacccgcttcgcgccgcggtcgccgggctgcaggccgtctccgaccaggtctacgagcagttccgcgagggcgcggtcgtgctcggccgggtcatcgccgccagccccgaactgcaggaacgtgaactggtcaaacgcgccatcctggcggaccggatcgccgccgcgctgcgcgaccgcggcacggccgacgccgccgcgaccgtcgccgcctggaccgcggtggcgatctttttcgtggcccgcaatcagtggaaccagccggataaccagcacacgctggcccacctcatcgccatgagccgggaggacttcctgggcgccacccggcccacaccctag

SEQ ID NO: 6932 - DNA, 1506 bp, Actinoplanes utahensis
atgaggacagcgctgccggcgcccgcgagtaccgtgcaggccagggccgcgagggtgaacgcccgggcgctgcgcgcggccgtcggccgtcggggcggtgtgcgcccacgggtccacagcgttaccagcgccgacgcgacggccgacgggatagcgatcgtggtccaggcggctgtggccagtgccgtggcgaccgcacggtcggggatcaccagcgcgttcccggccgtggtcaccgccgggagcagatacgcagggacgacggcggtggccagcgccaccagcacaggaggccggtctggcgcacgctgcggcccggggtggccagtcgcaagcgggctgctggttgattcggtggggggcatcggcgggggtcccttcggaggcgctgccggcgggtctctcccgctgccgccgacggtacgggcgttgccagcatgggcactagacgcgaagatccgaacgcgttgttgcacacggggaacaatcgcagggacacttcacaccgtgacactggagcccacggcgaagccggcagtcgccggcgggacccttcgacccacctcgccgcaccacaccgctgccggtcaggccccgcacacaccgggcggtctcgacctcgacgacgtcgcggttttcgtccaagtcgtggactgcggcgggttcaccgccgcggctcgggtactgcgcataccgaagtcgtcggtcagccgccaggtcaagcggcttgagcaacgcctcggcacgcagctgctgcaccgcagcacccgagcggtcagcctgaccgacgccggccgggccttccaccgtcgcgtcgcagccgccctcgccgaggtcggcgacgccgtcaccgcggccgtcgacgcccgcgaagtgccccgcggtgtcatccggttcaccgcgccgccggacctcggcgcggaggtgctgcccgcgttgctgaccagcttcaccgcccaacacccgctggtacgcgtcgacatcgacctgctcgcgcacacccccgaccttgtcgaagccggctacgacctggccctgcgggtgggtcggccatcccagcacgggttgaccaccgacaagttgcaggacatgagcttccggctctacgcctcgcccggctacctggccggccccaccggcatccccgccacggtggagcagctcgccgagcacagctgcatcctgttccgcgcccacaacggacaggcccgatggcagctgcaccgtcatccgcacggcgacgacggggtcgacgtcaccgtgagcggaaggctgaccgtcaacgacatgtccttcgtccggcgagccgctgtcgccggcgccggcatcgccctgctaccccgactcgtcggcgagtacgccgtcgccagcggcgagctcatccccgtcttgcccgcctatgagacagccggcttccccctgtacctggcctacccctccgcccggcacgtaccgctcgccgtcagagcgctccgagaccatctcctcgccgcattccccacctga

SEQ ID NO: 6933 - DNA, 954 bp, Actinoplanes utahensis
atgatcctcgttctcggagccaccggactcgtcggcggcgccgtcctgcaccgcctggccgcactccaggcgcccgtacgcgccctggtccgacgccccacacccgccgtgatgtcgctgtccgcggccggcaccatcgacgtggtcgtcggcgacgtcgccgacgaggactgcctgcgccgcgccgtccacggcgtacggcaggtcttcctggtcatggccaacgggccgcagcagcagcaccacgaactcgccgtcgtccgcgccgccctggatgcccgggtcgagcacctggtcaaggtctccgcgccctacgtcggacccgaagtgcccgtcgccatcgcccgcatgcaccacaccatcgagcaagccatcgtcgccgcgggcgcacgccacgacatgcgacacacgttcctgcgcccgtacgcgttcatgcagaacctgctccacaacgctccgcccatccggatggccggcttcttcaccggcaccaccgcggacaccccgatgaacatggtcgacgtccgcgacatcgccgacgtcgccaccaccgccctcaccaccacccgcacccacggccgcgcgctggtcctcaccggacccagagccgtcagctaccccgacgtcgcgcggcacctgagcgcactcgggcgtcccacccgctacctcaccatgcgaccacccgagtacgccgcgaagctgcaccgcgccggcctgccaacctggaccatcgaacacctcctcgaaatccaggccatgaccctgacccaccccgaaacccccaccagcaccgtacgggacgtcaccggccacacaccgagaacgatcgaagccttcctcgccgagaacctcaccgagttcacccacccccgcggcctccgcgaacgactcatcgccgtccccctccggctggccacccgccgccacaccaccgcggcagcccccatcgcctga

SEQ ID NO: 6934 - DNA, 1263 bp, Actinoplanes utahensis
gtgagcgggccgggtgtcccggccgcggccggcccgggtgcggccgcgacacccgccccgacgggtgtcgaggagacgctgcggcggttgatgccccaagtcctcggttcgctggtgcggcggtacgggcagttcgacgggtgtgaggacgcggtgcaggaggccggcctggcggcggcgctgcagtggccggtggacggggtgccggcccatccgcgaggctggctgatgacggtggcggcgcgccggctggtcgacgaggtgcgtagcggctcggcgcggcgggaccgggaatcggccgtggcggcgcgggccgaggtgcagccggaggaggtgccggatcgggacgacacgctgcttttgctgttcctgtgctgtcatccggcgctgaccgcggcctcgcagacggcgctgacgttgcgggcggtcggcgggctgacgacagccgagatcgcgcgggcgttcctggtgccggaggcgacgatggcggcgcgggtcagccgggcgaaacagcggatccgggcggcgggcagcacgtttccgctgccgtcggcgccggagcggttgccggtggtgctgcacgtgctctacctgatcttcaacgaggggtacacggcgtcgtcggggcggtcgctggaccgggccgatctggccggggaggcgatccggctggcccggctggtgcacgcccacctgcccgacgacgcggaggtgagcgggctgctggcactgatggtgctgacgcacgcccggcggaccgcacggacgaccgctgccggtgatctgattccgttgcaggagcaggatcggtcactctgggaccgggatctgatccgggaagggttgtcgctggcgaaggcggcgctgggcgggccgacgctcgggcagtatcagttgcaggcggcaatcgcggcgacgcacgcggacgcggctgccgcgggggagacggactggcggcagatccacgcgctgtacctgatcctggagcggatcgcgccgaacccgatggtgaccctgaaccgggcgatcgcgctggccgagatcgatggtccgcgggcggggctggcactgctggccggcctggacgccgacgagcggctggccgggcatcaccggttgtggtcggtgcgggcgcatctgctggaggcggcgggggagcggggcgcggcgtacgacttctaccggcgtgcggcgaaagcgacggcgagcctggccgaacggcgccacctggaggcgcgggccgctcgttgccgaccgagctga

SEQ ID NO: 6935 - DNA, 372 bp, Actinoplanes utahensis
atgaagttcctgatcagcctctacatcaacccggccgtgctggaggccctgaccgacgaggagaagggcgccatcggtgacgggcacgggcggttcatggaaacgctcaaggagtccggggagctgatcaccacccaggcgctggtggatccgtcgcaggcggtggtggtgtcggtgcgcgacgggcagaccgtggtgaccgacgggccgttcgccgaggcgaaggagttcctgggcgggttctacctggtcgactgtgcggaccgggcgcgggcggtggagctggcggcgcggatcccggatgcggcgatcgacgggctggcggtcgaggtgcgtcaggtgatgttcgcggacgggctgctcgaggcgtga

SEQ ID NO: 6936 - DNA, 432 bp, Actinoplanes utahensis
atggagccccgtcggcgatggccgtggctgctgtcgaacgccggaatcatgagcgtcaccgtgttcgtcgctgggctcgggatcaccgcgctggtgatcatgctgttgatcgcaggtggcgctgcggacgccggccaggcgaaactgcagattgaagcgctcaagtacgggctgggcttctctgccacggccggcgcggtcgccgcgctgctgctgggctctcatcgccaggtgctcgccgaacaccactgtcacggatgctgtggtgcccgtgtcgagccgcaccgcacctacaccgtcatcgcgcgccggtgtcggcgtcgtagcgacagagggctcaacagcagcgcaggcggggcggcgtcactgccgaggtcatccttctcaagccggtccgttcgggtggtcttcgcctgggccggcagcgcgtag

SEQ ID NO: 6937 - DNA, 537 bp, Actinoplanes utahensis
atgaacaccatcaccaccacggaactgttcagccgactcggccagccggcccgtatccagcagatcgcccgatacgacgtcttcgactccaccctgcaggcccaactcgatgctctgtccgctcgcaccgccgatctgctgggtactccggtgtccatggtttcggtcgtgctcgacagctcgcaattcatcatcggccagcacggcgtgcccggctggatggccgaagtccagggcacccccgccgaatgggcactgtgcagccacaccgtcctggccggcgagccgtactgcatcgccgacggcaccgtcgaccccgtccacgccgacaacccactgttcgccatggccccgatccgcagctacgccggcgtacccctcaccgacgacagcggccatgtcctcggcgcccactgcgtcatcgacgtcgtcccccgcaccttcaccgacgctgacatcgccaccttgaccaccggcgccaccgaagccatgcgcctgctgaccgaacatcgcacccggccccacccggccggctga

SEQ ID NO: 6938 - DNA, 303 bp, Actinoplanes utahensis
atgtcgatcacatccggcgacacggcgcccggctcttacgggctgcaacggccgaccatggccgacgcccgcgaggcgatgctgcgcgtgcacggccacaccggccgctccacctgggaacggctgctgcaggccgccggcatgtcaggcgaagagagcggcgacgatgccctgcaccggctgctcaccgcgatggccggcctcgatcccgtcagccggctctgcgcccaggccctgaacatccgcctgtcgtcgcacacccacctgtccgccgcgcacaccatgaccaggagcaccgcatga

SEQ ID NO: 6939 - DNA, 1635 bp, Actinoplanes utahensis
atgagtaccactgctgccgccgttccggtggcgcccacggcccggggacggcgatcgttcgccgacctgagcgtgaacgtcaagattctgatggctgtcgcgcttgccgcgctggtcgcgttgctcatcggggtgctggggctgtccgcactgggaaaggccagcgggtccgcgcagctgatctatcgcagtaacgtcgcgtcggtcaaagcaatcggtacggtggacaagacgctggtgcaggcgcggctggacaccgccttccaactgatcgcccagaagcccgccgacacccagaagtacgccgacgcgttctccgcggaccagcaggccttcaccacggcgctggccgcttacaaggcgagcagacctgccggcgatccggcgctgatagccgatctggagtcgcagtggcaggcctacgtgcagatcgcgcagaccaagctcctgcccgccgggcaacgcgacgacatcgtcggctgggagacgatccgcaccacccaggtcctgccgctgatggcccagatgaacaaggacatcgccgcgctgaccggggccgaggacgccgacgcggcccgcaacgccgggacggcacagtccgcctacgactccagccgtatcgtgtcgatcctgctcctggtggcggggctggccctggccctggggctgggtgtgttcgtggcccgttccatcgtcaggtcgttgaacaaagtcaaggccgtctgcgaggccctggccggcaacgacctgacccgcacgaccgggatgacctcccgcgacgagaccgggcagatgggccgcgcgttggacaccgcggtcggagccctacggcaggcggtcaccaccatcgaagggtcagccgtgaccctggccggcgcgtcggaggaactgaccgcggtcagcacccagctccagaccggtgcggcagacgctgcacaccgggccaccacggcgacgaccgccagcgagaacgtcaacgcaggcgtgcagtccatcgccgccggcgccgaagagatgagcgcctccatcaccgagatcgcgtcgaacgccagcgccgcggcgcaggtctcgcagaacggcatggccgtcgccgaacgcaccaccaatcaggtcgccgcactcggtgccgccagtgcagagatcggtgatgtggtccggctgatcaccagcatcgccgaacagaccaacctgctggccctcaacgcgaccatcgaggccgcccgggccggagaactcggcaagggcttcgcagtggtcgccggggaggtcaaggaactcgcccagcagaccgcgaaggccaccgaggagatcacgcaccggatcagcaacatccagaactccagcaccaccgccgccaccgcgatcggggagatcaccgacgtgatccggcagatcggcgactacaccaccaccatcgcctccgccgtggaggaacagaccgctaccaccggtgagatgagccgatccgtggccgaggccgcgaccagtagcgcgaatgtcgcccgcaccatgtccggggtggccgaggtcgccaacgccaccgccgaaagcgccaaggccacccaacaggcctccggcgacctgacccgcctggccagcgacctgaccactctggtcagcgccttccgccactga

SEQ ID NO: 6940 - DNA, 306 bp, Actinoplanes utahensis
gtgccgaccgagccggtcgaccacgtcgccgggcaggtcggcgcggcggatgcgtcggtggtgaaggggtatctgcggcgccggctgacccggttcgagcatcagtgggagatcgtccgggagtacgggtacaccgacttcgccgacgccgagccggatcttgttcggtggatcgatgatcgggcgtggactaccggggacagcccgggttgctttcggccgggcaggcccgacagttgcaggatctgctcgacgttccggacggttcccggctcccgcagttggagcggttgcggacaccggtga

SEQ ID NO: 6941 - DNA, 1053 bp, Actinoplanes utahensis
gtgacggttttcggctgccggacctgcgacgccactctgacggttccggtgtcgagggtggcgctgccggcccacgcggagcagagttacggcaacgcgcagggatcgctcgcgccggcgctggagcccggcacgttcgcggtgaatcccctgccctccggatcgccgtggcggcggtgggacgactgtgagcccggtgaggccgaggcactcggctggtacgcgccgaggttcagcatctccgccggtccggccggtcaggtgctgctcaccccgggggacgtccgcggcgccgtcatcgacctggcgctggtcgacgacgccgcctgttgcggcctcggcggtggcgaaccgaacctggtctgtgagacctgcggcacgccggtgggccgccgggtcgacgactgcggcctgccgcaggcggtctggctggacccgctgaccacccgcaccaccgaggacggccccggcccgcacccggtgcgcgagtgggcgggcctgctcggccaggagtccggtatcccgccgtgcgacccggacggcggctggcacccgatgtgggaggccgccgccggctcagcgctggcgcacctcctggccgcctcgggcggtgacccggtgatgatcgacgatcaccgggtcgccggaattctccggcccactctcgaccgtctcgtcggcccgcccggcaccgggcgggagggcaccctggtcctggcgggacccggccttccggaccccgccggcgacttcgctctcatcccggagcatccgcagaccggcgaaccctggccggtggccccaccggtgaagccggtcccgctggcctgggaggtctggcggcacctcgcggtgcaccgcgacccgaagccggtcgggcggtcggtgctcatcccgccggaggccctgccggcgcgcctcccgcaccggttcgagcccgacggccgggtcttcctccgcgttctggcccgcaggcccgaggtcaggcagccgcggttgcgagccgtctacgcccgggggcgcccctacgactactccttctgcgggttctga

SEQ ID NO: 6942 - DNA, 309 bp, Actinoplanes utahensis
gtgaccgttttcgcactcgcccagatcgccatccacgaccggcagcgctacgaccgttacgccgccgccttcatgcccgtcctgacccggtaccacggccgcctcctcgccgccgacgagtcacctcgggtggtcgagggagaatggccctacgagaaggccatcctgatgtccttcgacacccgcgaacacttcgaacagtggtccacctcgccggagtaccgggagatctcccgagaccgcgaagccgccacccatggcgtggtcctgctcctcgacggcattcccgccgtcggaccggtagcctag

SEQ ID NO: 6943 - DNA, 603 bp, Actinoplanes utahensis
gtgctctccatcgaggagggcccgatccgaccggacccggagaccgagaccccggacagcaccacgacggtcatccaggaccgcccggccagcctgcacgtcaccggccactacgacggcgcccgccatggcgacacgtacgtcttcgtccaatggcagcggaccgacggcacctgggtgaccgtgcagagctggggcccgcgcgacagcggcaccgtgcgatccatcgcccagcacctcaccggcggtgcccgcatcccggccgtgccgaccccgttcagtctcccgttcgccccgcccggcctgatcctgcagtacctcggcgcggaccagatgtgcctggccacaccggacaaggccgcccgcgagcgcaacccgaccggcctctgcgtcaccatgcagcagggcgccttcgacccggacggcgccaccgacacgtggaaggtgaacggccgccgcgtcgcctacctgcccgacgccgcctccctgatcatcgagtggggcggtgacacacagatcgaggtcggctgggatccgcaggacatcccgctgacccacgaccaggtggtcgaactgtccgaagggttgtaccccacccgttga

SEQ ID NO: 6944 - DNA, 513 bp, Actinoplanes utahensis
gtggacagtggtttcgaggaatacgtccgggcccggggcgacgcgttacggcgcttcgcctacgtgctctgcggcgatcggcaccacggcgaggacctcgtgcaggaggtgctggtcaaggcgtaccgccgctggtcgagaatcgagactgatcagccggacaggtatctgcggaccgccctggtccgcacccacatctcgtggctgcgccgattgtcgaacaccgaacgcccggcggagatcgccgacgatcgcgcggcgaccggggccggcgccgagttcgccgaccggcaggcgctgcgcgacgacatgtgggcgcggctggccgagctgacccgcacccagcgtgccgtgctggtgctgcgctattacgaggacctcgacgaccagcagatcgccgagatcgtccgctgcgcgccgggcaccgtgcgggtgcacgcctcgcgcggcctcgccaagttgcgcaccgacctggaccccgcccacccgacgacggccggagcaaaaccgtga

SEQ ID NO: 6945 - DNA, 999 bp, Actinoplanes utahensis
atgcccgaattccggcgcggcgtcgaactggcccgcgacttctaccgggaggcggtccgcccactgctcgacgaccgcccgcacctcgcggcccggatcggcccgggcagtgacgtcctcggcttcgacacggcacgctccaccgaccacgactggggtccgcgcctgcagttgtttctcgacgatcccggcgacctcgaccaacgcctgcgcgaggggctgccgaaacggttccggggctggccgacgcacttcgtgccgcccggcgcccgggtccggtcgatggccgacaccgacggcccggtcgaccactacatcgacattctgccgctggaaacctggctgcggcaccggctcggtgccgacccgcagtggctgagcctcccgtggcagcggctcgccgaggtggccggcggcgcggtgttccacgaccccggcggggagttggcggcggtccgggcgacctggaagtggtatccggacgacctgttgcgccatgtgctgggctgtcagtgggcccgcatcgggcaggaagaggcgttcgtcggtcgtaccgcggaaatcggcgatgacccgggatcccgcatggtgaccgcacgcctggcccgggatgtcgcccggctcctgctgctgcagcagcgacggtggccgccctatcagaaatggctgtcggcggcgtgccccgatccgcggctcgccgcggcattggcggcggacgatgcgaaaacgcggtccgacgcgctcgccgacgcctatgaggaggcggcccggcggcagaacgccctcggcctgtgcccgcccctggacacccgccggcggccgtatttcgaccgcggctatccggtgatcgacgccggccggttcgccgaggctctgctggacgggcggccggcgatcggctcgatcgaccagatctgcgacagtaccggcgtgctggaacggcccgacatctgccgggcggtatgcagcgcggcccactcaccgcgtcaggaagggtga

SEQ ID NO: 6946 - DNA, 984 bp, Actinoplanes utahensis
gtgacggcattgacgcacagcaccgcgaacgaggtcaccggcggggtgtggcggattccgcaccagggcgggaccgcggtacggaaactggtgatgcgccgccgggcgggggccgcggcacatctggccgccagcgacgatcccggccatttcaactattggcggcgggagcccaccgcgtacgccgaggggctggcccggaccgcgttcaccgccggtggactgtcggttcccgaggtttaccggatcaccgaactggccgacgggtcggtggagatgctgctcgccgacgtgccgggccggccgatgcaggcatggcggccggacgatctcggggaactcgcctatcgcctcggcgtcgcgcagtgccggcggctggcggagatacccgcgtacgactggctggcccgggattttctgcgggactacacgctcgctcaacccgttccggaggaattggactgggatcacccggtggtgcgtgcggcgtgggatccggaattgcgggcgcggctgcgggagatgtgcgcggcccggcaggacctgctggcggccgccgaccggttgccgcgcaccctgtgccaccacgacgtgtggccgatgaacgtggtcctcgccgcctccgggccggtgctgctggactgggcgttcgtcgggccgggcgcgatcggcgaggacgcggcgaacctggccctcgacaccttcttcgacggcctgatcgacctgagcctgctcgacggggtcctggaagccgtcaccgacggctacgtgcgcggcatgaccgaggtggacccgctcgtcgtccagcgcgccatcatgatcaccggcgcggcgaagtacttctggctggccccgcgcatgatcgacatgctgatgcgcgaccagtcggccgcctacgaccggcgggactggccggaacgcttcgccggccgcgcgccgatcctggaggtggtcgcccgctgggccggcgaggcgctgcgctga

SEQ ID NO: 6947 - DNA, 693 bp, Actinoplanes utahensis
atgtcctatgacgacttcgccgaggcatacgcgtccgagacggagggcagcctcgagaacgcgtactacgcccgtcccgcgatcctcgacctggccgcagacgtgaccgggcggcgcatcctcgacgtcggctgcggcgccggcccgctcctcgaggcactgcgcgaccgcggcgccgacgtgaccgggatcgagcccagcgccggcatgctccacctggcccggcggcggctcggcgccggcgtcgccctgcaccggctcggcctgggcggcgatccgctgccgttccccgacgccacgttcgacgacgtcgtcgcctgcctggtgctgcactacctggaggactggacgggcccgctcgccgacctgcggcgcatcctcaaacccggcggccggctcatcgtggcggtcaaccatcccttcctctacaagctgatcaagcccgagggtgactacttcgccgtcgaggagtggtccgacgagttcatgttcagcggccgcaccaccgtgctcaccttctggcaccggccgctgcacgccatgttcaccgcgttcctcgcggccggtttccgggtcgcggtcgtcagtgaacccgcaccggctcccggcgcccgcgaagccttccccgacctgatcacctcgccgtcgggccgcttcatgggtttcctcttcctcgtcctcgatgcggcctaa

SEQ ID NO: 6948 - DNA, 723 bp, Actinoplanes utahensis
gtgttcctggcctaccgttcgagcaaaggtcacgcgctgatcgaccggcagctgtatctgcccgtggcgtggactgacgaccgtgaccgctgccaggccgccggtatcccggacgaggttgagttcgccaccagagtgcagatcgcccggaccatgctcggccggacgttcgccgcagggatccgggcgggctgggtgagcatggacgaggcctacggccagtcgaattcgcttcgggtctggctcgaaagccacgaccagccgtacgtggtagcgacccgccgcaacgacgacatgatcaccaccagcatggacaccgcccgcgccgacgagctgatcgccaccctgcccggccgggcctggtcccgcatctctgccggccttggtgctcacggcccccgcgaatacgactgggcccgggcgccagtgcggatttgctggcggcccggccgcgggcactggctcctcgcccgccgccatcgcaccacccggcgaactggcctactacgtctgttacggaccgcggaagaccggccgatggacctggcccgcagcgccggcggccgctgggctatcggcccgatctgcagtcgtcgccgcacccggccgatccatggacgtccctgcagcaggaagcggcccatcatgccactcggcggccccgccgggtcacaccggacggaccggaacgcccccggcgagcgagttgagcggggtccgtga

SEQ ID NO: 6949 - DNA, 720 bp, Actinoplanes utahensis
atggcgcacgaaggaacggcggcatggtggggtcgccattcggtaaacccggctgccgttctgccggcgagtcgtcatcatgggcgcgtgctgaccctcgaagctcctctcgtcacgaagcgcctgcgcctacgtcccttccgctcccaagacgccgatgccctctacgacctccgctcgtgccctgaagtcctgcgctacctctactggccaccggcttcagtggaaggcgtacgcgaggtcgtcgcggcacggctcgccatgactaaattagccgccgacggggactgtctagtgctggccgtggaggtggcggccaccggcagcttcatcggggaggtggacctcagcctggtcagcaccgagcatcgtcacggcgagatcggcgtgatcctgcatccgagcgctcagggtcacgggtacgcgaccgaggcggtaggcgccctgctgaacttggccttcgacgtgttgaagctgcaccgggtgactgctcagaccagcgccggcaatcaggcggcggcgggggcgatgctacggctcggcatgcgtcaagaaggacacctgcgtcagtgcgtacgcttcgccggcgagtggtacgacgagctgatcttcgcgatccttgccgaggagtgggccaaccgaacgggctcagcgccatcgcacacggaaggcgggcacggctttattggacaccatggcttccacaacggtcacccataa

SEQ ID NO: 6950 - DNA, 1722 bp, Actinoplanes utahensis
gtgaaatccgtactcggggccagaattcgcctcacccgccggtgcctggcagcagcagttgccgtttccgtcctactcgtcccggcccgggctgcccaggccacggagaccgccgcgactctcagcccgttcgccgccgacgtcacgctcacccgcgtgacgccggacacgaccagtctcatcagagccgtcgagaacgccggggtaaccaagggctcgatcagcgatgtgctggcgaccggccggaccggaaccccggggctgtgccacaccccgaacggtttgaacggcgccctcatccccgacggcttctgctgggacaaaaccgacgacgaatcgacctatggcgaaggcggcggcggctggatgccgcagggcttcaccaccgccgacggcgcctatgtgggccgctcactcacgatcacctcgtggtaccacggcacctacgttcgcgaccgcgagccgccggccattgaggactacgcccgtatctcgatcgccgagtcgactccgacccgggtccgctacgggcacgtggcgctggtcgaacccgcggccggtggcacgttcaagccgctcaccttccgcacccatgccgacggcatcgcgtggtacggcgaccggttgttcgtcgccaacggcgccgaacttcagatctacgatctgacccacctgtggcggatgaccgacactgccggcgacggcacgggcctcaccgcaggaaggtcgtcggcccgcggccacctgtgggcactgccgctggtggctcgctacagcaccgtcggcaccgcccaggtcgacaccgaatcttcggccttcgacaaggacaacccacgcgcctgcggtcccgcagtcgccaactacctgtgcctgagcagcctgagcctcgaccgcgccggcgtgacgccggccctcgtctcggcggagaaccggacgaagcccggcggccgggtcgtccgctggccgctgaccgctctcggcgcgggcacgcccagcacggtggcttcggagccggaggggtacatctcgccggtcggtggaatccaggggaccgccacggatggcacgagctactacatgagcggcacctgcccgctctcctatccgagcgccgacacgctctacgcctgcatcttcgtggccgcaccgggagagacgccacgtgtgttgacccaggcgccgcggctgaccgagggtctgtcctgggatccgcgcgctaagcggctgtggggcaccaacgaggcggtgccctcagccggccacgcgctccgcgtcgtgttctcactcaaccccggcgcgggtgcggccgtcgacggctggggctggctgaccaattaccacatggccggctcggcctgcgcgacgccggagggcaacgacacgggcctcggcaccaagattgctgtctggacctgtacgggttcggacctccagcggtggcggtacgacaacggcctcatcgtgcacaaggtcagcggtctgtgcctgacgcccgcgggcaacggcgcagatgcccagggcacggtactcaccttgtggacctgtgatggggccagcgacgtccagcgcttctccgccggcccggacggcagcctcgtgaacccgtggggaaagggcctcactccgagcggcaacgacgtcgagaagggaaggtacctgactctctggaccaaggggacaccgacacctgacgttcaagactgggtcatcaagggattctga

SEQ ID NO: 6951 - DNA, 825 bp, Actinoplanes utahensis
atgcgggccgcaccgggacggggatcggcgtggctgccgtcgatgtgcgcggccgtgccgggcggctactacgatgtgctgatcgccgggttggccgccacggcgctggtcaccgctttctgggcgtacgccgtggtggcgcacgtccggcacacccgcaccgtgccgtggccgctgctgctgaccccgctgctgttcgccgccgtgtggctgctcgcctccggtgaccttcttcgccgtcaaggaccccgcgatggccaaggccgccgggctggcctggttccccggcatccgcccccggcccggcgacgaaggcgagtccttcgagccgatcgacggcgactggtacgcgtatgtgatccggcacgggctgtgacaggatcgcgaccacggtgccccgccgtggggcctgcagctgagcgagtgggaaggccgcaccgaggcatgaggcgattcttcttccccggcgagcgtgccggcctgacgaagcggccgtcccggctgaccggtttccgggcgctcctggccggcggcaccctgctgacggtgctgaccctgatcctgcagcccgccaccgaagtccgcggctgctcgaactacggcggcaacggcaacggcaccgccttcgccgacgagggctgggacctgacgtaccacgtgctgctgctcgtctggttgctcacggtcatcacggagcagctgctcccgatcacctggaacggccgcatggcgggaccggtcatcgcccgcggtgtcctcgccgtcaccctcaccctgatcgcctgctgcggcatcggcctcaagctactcatcctctgccattag

SEQ ID NO: 6952 - DNA, 540 bp, Actinoplanes utahensis
gtgcgggattggtcctactacggcgccgcgcaccggtatgccgtccacgaagatgagggcgccgatcggctgtgcgatcgaacgatgggcgcgcttcgtctggccggcgacgaagccgagctgcggcgccgagccggtgccggcgacaggtgcgccgctgtcaccctcttcgagatcctggtcgatgccgaccggctcgacgacttgcgggcgatgcaggaagcgggcgacgatcgcgccggtgtcacgctcatggaggcattgacccgccagggccgggaggacgaactccgccgcgagatcgctgccggccatgacgtcatgtggcttgtgcaccacctcaacgaccgcggtcgcatggacgacgcgcttgctgctctccaggagtgggcggaccagcatccggaccaggcccgtctggcccatgcgcgccgcctgaccgtgctgctcgagcacggtcgagtggaagaagtccggcgcgccgcggaatcaggtgaccacacagccgcccgctacctgggcaggttcttcagcaaatag

SEQ ID NO: 6953 - DNA, 336 bp, Actinoplanes utahensis
atgcgcgcacgcgacaacgttgcagatgccagtgagctgcagaaacacctaacgggcgacaccctcaccgtggcaacgacgatgctcggactgctcgccgaccccacccggctgcgcctgctcgccgccctcgtccccaccgatcaggacgtctccgcgctcaccaccacaaccggcgccgcccggcccgcggtctcccagcatctcgcgaaactccgtctcgccggcctggtccgggtccgcagggagggccggcggcaggtgtacgccctggccggcccgcacatcgccacgctgatcaccgaggtcctgcacgcggccgcccggcaccgctga

SEQ ID NO: 6954 - DNA, 999 bp, Actinoplanes utahensis
atgaccacatggcacgggatcaggcaccgcctcaccccgcattcgcacgccgccgcggaccgggtcgatgacgcgctggagtcgtcgcgggtcggcatgcgagccctgtggatctccctgggcgtgctcggcctgaccgctttcgcccaggcggtcatcgtgtggcgctccgggtcggcggcgctgctcggcgacaccctgcacaacgccgccgacgcgctcaccgccgtgccgctggggatcgccttctggctcggccggcgggccgccacccgggcgtacacctacggtttcggtcgcgccgaggacctggccgggatcgtgatcgtgctggtcgtcgccacttccgcggcgttttccgggattgtcgcggtacgccgtctggccgacccgcactctctcacccacctgccgtgggtggtcgcggccgggctggccgggttcgccggcaacgagctggtcgcgcggtaccggatcgcggtgggccggcggatcggctcggcggctctggtcgccgacggcctgcacgcccgcgccgacgggttcgcctcgctcgccgtggtgctcgccgccgggggtgcctggcgcggctgggcctgggccgatccggcggccgggctgctgatcacggtggcgatcgggctggtcctgcgggacgcggcgcgggaggtgtaccggcggctgatggatcgggtcgacccgcacctggtcgacgccgccgagcgggagctgcgccggatcccgggtgtgcggggcgtgtccgggatccggatgcgctggatcggacaccgcctgtacgccgaggcgtcggtgctggtcgacgcccatgtgagcctgatggcggcgcacgagatcgccgcggacgccgagcatcggctcacccaccaggtgccccggctgaccgaggcgagcgtgcacgtggacccggacacgcctcccggtgccgcgcatcacctgcggctctcccacgccgcgccaccggctacattcggatcgtga

SEQ ID NO: 6955 - DNA, 582 bp, Actinoplanes utahensis
gtgatcgacatcgcggtggccggccccgagcatcgtacgagaatcgtctccgccctggtcgcagcgttccgtggggatccggtgatccgctggcagttcccggacgacgacagctatccggagctggccgcggtcttcttcgggcacctgttcgacaagcgggtgcaccgcggcgcggtgtgggtggccgagggcggcaacgcggtcgcgatctgggagccgccggccgacgccagccccgcggtcgaggatgtgctgccccgcaagctgccggccgacgtgctggcccgggtgcgcgcctacgacgacgcggtgcacgcggcactgcccgccgagccgtactggtatctcggcgtgctgggtacccacccggaccacagcggccgccggctgggtcacgcggtgatggccgaggggctgcgggcggccgccgcggatgggcggccggcggttctggagaccgccaccgagggcaacgtgcggatgtacgaacgggccggctggcgggtgatcgccgagctcaccgacccgctgccggtgtgggtgctccagaacgacacctacgggtcatcccggatgtga

SEQ ID NO: 6956 - DNA, 1146 bp, Actinoplanes utahensis
atgcgaatcctgcttcccgcagtcgcgctgttgctggtcgcggcctgcggcaccaccacgaccccgacgtcggcgccggccggggtgaacccgcacgccgggcacctggccggctccgcgccgccgtcgcaaccgctgcgcgccggtgaacggttcgtcgatctggccctcccgcaggcgtacaccccgaaggctccgaacggcggcaccgacgaataccggtgcttcctggtcgacccgggcctgaccgggaacgcctacctgaccggcagccgcttcctgccgcagaacgcggccatcgtgcaccacgcgatcttctaccgtctcgacccgcagcaggccaccgaggccgcccggatcgacgcgcagaccccgggtgagggctggacgtgcttcggtgactccggcgtcgagggccagaccgcgtgggtcgcgcactgggcgccgggcgccggtgagacgcagatgccggccggcttcggtttcgccatgccgccgggcggcaaactggtcatgcaggtgcactacaacctgctggagccgggcgcggccgggcagagcgaccagtccggcatccggctgcgggtcgccgccggcgccaccccgctcaagccgctgtccaccgatctgttcccggccccgatcgagctgccgtgcgcggccggcgagtccggaccgctctgcgatcgcgccgccgcgatcgccgacgtcggttcccgcttcggtgccgacgccggcgagcaggagggccacctcgtcgaacgatgcgacgccggcaaggtcaccccgggcaccacccagcactgcgaccggccgatcgaggagcccgccacggtgtacctggccgccggccacatgcacctgctcggccgctccatcacaatcgagctgaacccgggccggcccggcgcccggaccatcctggacgtcccgcagtacaacttcgacaatcaggccctggtcaccctgccgaagccgatcccggtcaagcgcggcgacgtcgtacgggtcacctgctcccacgacgccaaactgcgccggctcctcccccaactgcacaccgtcgccccgcggtacgtcgtatggggcgaaggcaccagcgacgagatgtgcctcggcatcctcgtcaccggccccgcgtcctga

SEQ ID NO: 6957 - DNA, 234 bp, Actinoplanes utahensis
atgactatagtcccacgcatgaagaccacacggccccgattgatgggcaccactgaaatctgcgtccggctgggcgacctgagtcgccagcgggtcaaccagctctccgccaagacgaacttcccgaagccgatcgccgacctggcccagggccgcgtctggctcgccgacgagatcgaggagtggatcgcccgccaccgcaccaccccgatgcccccgcaccacgacgcctga

SEQ ID NO: 6958 - DNA, 1206 bp, Actinoplanes utahensis
atggtgccggtctccgggatgggcggggcgatgctgccgggtgacgttctgcggctcggcgtggtcggcctgcggacccggaagctgcgggccgcgctctccgcgctgggcatcgcgatcggtatcgcgaccatgctggtggtgaccgggatcccggcgtccagccgacaggcggtggccgaccggctcgctgcgctcggcaccaacctgctccgggtccagccggagagcgccggcgaccggccggtgccgctgccgccggagtcggtggcgatggccgcgcggatcgggccggtgaccgcggtcagcgccgtcgctaacgtgcacgccgtggtgcgccgctcggacctggtcgacccgtacgacggatccggactgaccgtgctggccgcccgcaccgacctgctcaccgcggtgaacgcgaggatccgatccggacggttcctcaccacggcgacgtcccggttcccgaccgtggtgctgggcgccgaggcggcggcccggctcggactgggcgagatccgcccggacggtccggccccgcaggtcagcgtcggcaaccgccgattcgccgtgaccggcatcctggcgccggtgccgctggccccggacctggaccagtcggtgctggtcggctgggcggtggccggccggttgctgggcttcgacgggcatccgacggtgctctacgtccgctgccgggaggcggccatcgagcaggtccgggcggtgctgccggcgaccgtcagcccgcagctgcccggactggtccgggtgtcccggccctccgacgcgctgtccgcgaagcgggccgcggacagcgccttcggtgcgctgctgctcggcctggccggagtgtcgctgctggtcggcggggtgggggtggccaacaccatggtcatctcggtgctcgaacgccgccgcgagattgggctgcgccgtgcgctcggcgcgccccgcgggcacatccggctccagttcctgaccgagtcggtgctgctcgccgggctgggcgggggtgccgggacggcgatcggcgtggccgcgaccatcggatacgcgacctggcagcgctggccgccggtgatcccgccggggagcgtcgccgccgggctcggtggcgcgttgctggccggggtggtggcgggcgtctacccggcgatgcgcgcggcccgcctcaccccgacgtccgccctggccgcctga

SEQ ID NO: 6959 - DNA, 807 bp, Actinoplanes utahensis
gtgacggcaccggtgctgtcgctgcgcgagatcagccggatctatcccggtggggtgaccgccctcgaccgggtgtcgctcgacctcgcccccggcgagctcgcggcgatcgtcgggccgtccggctccggcaagtccaccctcctgcacatcatgggcaccctggacctgccgaccagcggaaccgtggcgattgagggccgggacgtcaccacgctcggcgaccgtcggctcgccggtctgcgcgggcgccggatcggattcgtcttccagcagttccatctgatcgacgggatcagcgcggcggagaacgtggcgaccggcctgctgcacgccggggtgccggcccggcgacgccggagccttgccgaggaggcgctcgaccgggtggggctcggccaccgccgcgggcatcggccggggcagctctccggtggcgagaagcagcgggtggcgatcgcccgggcggtggtgaacgccccggcgctggtgctcgccgacgagccgaccggtgcgctggactcggcgaacggcgaggccgttctggaactgctcggccggctgaacgcggaaggggcgacgatcgcggtgatcacccacgaccgggagatcgcggcgcggctgccgcggcgcatcaccatccgggacggacggctcgaggacaccgggtccggggaggcgggcttcggcgccgcgcggaccgatggtgcagtcctccggggcgcgcggatcgatggtgccggtctccgggaggcgcggatcgatggtgccggtctccgggatgggcggggcgatgctgccgggtga

SEQ ID NO: 6960 - DNA, 885 bp, Actinoplanes utahensis
atggacctcaccgacgagcgcaccgtgccggggacgctcggcttcggcccggcccgcgtcgtcaagggccccggcaccggcgtgatcacccacctgccggagaccggccgcaagaccatccggggccgggaactgtaccgggtcgacgaccagccggtgatcgtcatctacggcgacacgcctctgttccggccgctgaacaagcccgggctgagcgggcgggacgtgctcgaggtccggcagaacctgaccgcactcggctacccggcgcggtcgctgcacccggaggtggccgacgccggactgctcgccgcgatcaaacggtggcgcggggaggacgacctaccgggttccggcatcgccccgggcggcgtcgtggtgctgcccgggccgagccgggtcagcgaggtgcgggcgcaggccggggacccggccgaggggccggtgctggcggtcaccgcgaccggcgccgtggtctccgtgccgatgagcccggcggacgtggccaccgtgcgcaccgggaccgcggtcaccgtgatcgcgccgtccggcaccgcggcgccggccaaggtcaccgcgatcggccgggcggtcaccggcggggagggtggggaagccgccaaggtcgacgtcacggtcaccccggacaccccgatttccgcgtacgacgcggccgccgtccaggtgcgcatcaccaccctggtgcgcaagggtgtgctggccgtcccggtcggcgccctggtcgcgctggccgagggcggctacgccctgcaacgccccgacgggtccctgatcgcggcggccaccggcgtcttctccggcggcctggtgcaggtcagtggccccggaatcaccgacggcctgacggtggtgagcaccccgtga

SEQ ID NO: 6961 - DNA, 552 bp, Actinoplanes utahensis
atgccgaagatcctctatctgaccgctctgctggcgctcggcgcgtgcagtgcgcccgctcccgatcccaccgccgccgatggtggtggtcgggtcgccaccctgcagagcgccccgcccgccgccgccacctcggcgcccgccgcctcccggccgcagctgcgactcgacaccagcgaggaggaggcgaaccggttctggaccgcctacgacgactgcctggtcgcccacggggtcaaggccgatccggtcgatcagcccggcccggccggcccggggcgccggctcgaccagagcggcgagcccaggtccgcgtacaccgcctgcgccgggagacttccgcggcagccgcccgaactggacgaggacgccaacccgaaatacgcggcgcaatggaacgaccacgtgaaatgtctgcgcgcgcacggtctgaaggtgcacgtgaccaagccgggcgagtggacctacgactcgtccgacggcggaatcccggccaacgagagccagatcgagcacgactgcctgctggaggcgttcggccatggctcctag

SEQ ID NO: 6962 - DNA, 687 bp, Actinoplanes utahensis
gtgtgcgcatacgtgctggtcgccgaggacgacccgaagcaggccgaactcgtgcggcgttacctggagcacgagggtcacgccgtcgtcgtggtcggtgacggccgggcggcgctggaggagatccggcagaacccgcccgacctggtggtgctcgacgtgatgatgccccgcgtcgacggcctggacgtgtgccggattttgcgccgcgactcggagctgccggtgctgatgctgaccgcgcgcaccaccgaggacgacctgttgctcgggctggacctgggcgccgacgactacatgaccaagccgtacagtccgcgcgagctggccgcccgggtgcgcacgctgctgcgccgcaaccggccggcggcccgggtcgcggatccggtgctgcgggtgggcaatctgcaggtcgatccggtacgccacgaggtgcgcgccgacggacgcccggtgacctgcaccccgggcgagttccacctgctgcggacgctggccgccgagccgggccgggtgttcacccgcgagacgctgctgcggcacctgcacggcttcgactcgtacgtcaccgcccgcaccgtcgacgtgcacgtgatgaacctgcgccgcaagatcgagccggatccgcgccgacccgcgcggctgctcaccgtctacggtgtcggctacaagctcgccgatggctag

SEQ ID NO: 6963 - DNA, 1857 bp, Actinoplanes utahensis
atggctagggcccgctccgccggccggggcagcctgctgggccggctgctggtgctgtccgcggtggtgtcgctgctgtcgatcggggcgaccgcctggctcgcggtccgcaccaccacccgcgcgatccagcgggagcagggccaggcgctcaccgacgacgcgaagatctacgacacgctgctcggctacgcggccacccatcgcgactggtccgcggtcgccccggtggtcgcgcagctggccgggagcacgggtcaccgggtcgtgctgaccgggcaggcccgggagccgatcgcggactcggcgtccggcccgctcccccagcagccgctgaccaccgtcgaccccaccgacgccggcaaccggatcgatccgcgggcggtcggcccgttccggctcaccaccgccgagcgggccggactgcgccagatcgccgcccgggtgcagagctgcctgcgggagccgagcaccccggcgccggcccgcgacggccagcagcgggtcctgccgcacaatgtggagatcgtcgacgagcccagcggccgcccgcggctcgaaacgcccggcagcgacctgagcgccgacacggtgacctgcatggaaggccgcaccgcgctggccgcgccgaccgccaccgaggccacagcgctgcagcagctcgatcggctggtcaactcctgcctggcccgccagcacctgccggccgtcacgatcggcctggagaacacctggacctgggccgacgcggagtcggcccgctccggtcggcgccgcaaccagccggtggccgactgcctcacggccggtcggcgcgagcagctggccggctgggtggcgccggccgcgctgctcttcgtcaccgcccccggggagcagagcgcgcggcgcgcgtccacgctggacctgtcgcgccccaaccagatccggatcggcgcggtgaccgggctcgtgctgctcgccgcgatcggggtgaccgcgctggtcggggtgcgcctggtccgcccgctgcgggcgctgaccgcggccgccggtcggatgcgcgacggcgacgcgaccgcccgggtccgggtcaccgggcgcgacgagatcgcccgcctggcgaccgccttcaacgacatggccgatcggcgacggcatgtcgagcagctgcggcacgcgatggtcggcgacatcgcgcacgagatgcgcaccccggtcacgaacatccgcggctggctggaagcggccgccgacggcgtcgtcccgctcgaccgcgagctgatggcctccctgctggaggaggcgatgctgctccagcacgtgatcgacgacctgcaggacctctccgcggcggacgccggcgagctgcgcctgcacccgcagctcgtggaggtggccgagctgctgcccgcgatcaccgacgccttcaccgccgccgcggaccgggccggcgtcaccctgcacacgacggcggcgtcggcgctggtcaccgtggatccgatccggatacgccaggccgtcggcaacctgatcaccaacgcgatccggcacaccccctccgggggcaggatcgacatcatctccggtacgagcgcgggccggctgcgcatcgacgtcaccgacaccggccccggcatcccgcccgagcagcaggccctcgtgttcgagcggttctggcgcgcggacaagtcccgcagccggcagaccggtggcagcggcctgggcctgtcgatcgtccgcaaactcgccgaggcgcacgcgggcacggtgacggtgaccagtccgcccggccagggtgccacgttccgcatcgacctgccggtcgccgggccccccggttcgcagcgcgccgggcgtggttcgatgggacggtga

SEQ ID NO: 6964 - DNA, 1035 bp, Actinoplanes utahensis
gtgagcgggcctgggcagcggatcgcgtcgacgacctcgccgggcggcgcccggatcgggtatgcgaccgtcggcagcggaccgccgctggtgttcgtcaccgggtggctcagtcacctggagctgagctgggcgctgccggccgagcgtggcttcttccaggccctcgccgacgggcggcggctgatccgctacgacaagcccggctgcggcctgtccaccgcggccggcgacgggccgcacaccatggagcgggaggtggacgccctgcgggcggtggtcgacgcgaccgggctggagcgtttcgacctggtcgggatctccaccggggcggcggtcgccgcggcctgggcggcccgggagccgcggagcgtgtcgcggctggtgctctacggcggctggccgtacggtccggacgtggcgagcccggagatccgcacgcatgtgctcgggctgatccgggagcactgggggctggccagcgacctgctcggcggcgtcttcgccccggacgccgaccccggtacgagggccgcgttcgtgcgctaccagcgcgaggccgccacggcggaggtggcgggcgcgatgctgctcatggcgtaccggatagacgtccttgacctgctgccgtcgatctccgccccgaccttggtggtgcaccgcgaacgggaccgggccgccccgatcgagcagggccggcggctcgccgacggcattcccggagcccgcctggaggtggtgccgggacggtcgcacctgccgtacatcggggactaccggccgatcacccgcgccatccgccagttcctcggcctgcccgccgcccaccgtggcgccgcgccgggcctgaccgagcggcagcgcgaggtggccgcgctgatcgcgcagggccgcaccaaccgggagatcggcgagcggctcggcatcaccgaacgctccgcggaggcgcatgtggagcggatccgcacccggatggatttccggtcccgggcgcagatcgccgcctggtacgtggcgacggccggcccggcatga

SEQ ID NO: 6965 - DNA, 780 bp, Actinoplanes utahensis
gtgggcgatcgctatcctggcgatgccgagctagttccggccgaggcgaggaagcgaccggtgggagatcacgtgaccaaggcgaaccttgccgacatcgtggtcgacgaccatctgcagcggatcgcggctggtgatctacggccgggtgacaagctgcccaccgagatcgagatgtgtgatgcctacggcatgagccgcagcgccatccgcgaggcagtccataagttggccggtaaagggttcgtctccgtacggcaggggagcggcagcacgatcgccccgcgtgagcagtggaatgagctcgatcccgactacctccgctgcggtgtcgacaccgacatgtttcacgagctggtcgtgacccacctcatcgaggcgcgagagtctctggagccggtcatcgccggactggccgcgcagcgcgccaccgaggaggaacgccggacattacgtgctctgctggcggagcaacagcggttcggggatcgcgaacccgaggcgcaggccgaggcggacatccgattccatagcgcgctcgcgtacgcgacacacaatccgctactgattgccatgcacacgtcactggtcaccctggggcggcgttcccgcacgctggccactcaggtgcccggcggggtcgatcgggccatcatgtggcacacccacctgctggaggctgtcgaatcccgagactcgatggccgccaccgatgcgatgcgcatgcacctgcgccaggtacgtggcgagttgcaggcagcggcacaactggagcggtga

SEQ ID NO: 6966 - DNA, 216 bp, Actinoplanes utahensis
atgactcggccggccgccatcccggcatccggatcgatggcgtactcgtacttcaccgtgcatcagctccacggaccgctgcccctgcggaacggcggcgacaccccggcattgttctgctggtcgttcctggtgatagcggccggcgccggatcctggtccattgacgcatggctgtaccaccgctgggccgacatggcaccgcttcgcaactga

SEQ ID NO: 6967 - DNA, 819 bp, Actinoplanes utahensis
atggtcaactcgatacagcgctatcccgagatgcaggatcaggtcgctgtggtgaccggagcggcttccggcatcggtgccgccgttgcccgtgacttcgcggctcagggctgccatgtggccctgctggacgccgaccggcccgcgctgtttcgcctcgtcgatgcgctcgccgacgaagtggagggagcgcttcgcccgatcgaggtggacgtgtcggatcccgacgcggtgcgaagcgcggtcggcgatctcaccgccggttggggcgccatctcgtacctcgtcaactgtacggcgggcttggtggcggccggagcccatgcggccaacgaacaatgggaccgagctttggcggtgaatgttcgcagcgccgcgatgttgctcggcgaatgcgtgccacacatgatgcctgggtcggcggcggtgcatacggcgagcatcgcggcccgcgaggctcaaccgcttcgatggattcacgacgccgccaagggcgccatcttcgcgatgacccgctgtcaggcgttcgacctggctcctcgcgggattcgagtgaacctggtgagcccgggatggatgggagcaccggagggggtccggcccgtccccggcgatggcgacgcgggggaatctgcgtggggcgtccaccgaattctgcctcgggccggtcagccctgcgacgttgcccgagcggtgcttttcctgtgcagcgaggatgcgtcgttcatttccggcaccgagatgatggtcgacggcggttactcagtgttgtcggccgcaagcctgagggaaacgtcacgtgtcgccggcgcggtctga

SEQ ID NO: 6968 - DNA, 774 bp, Actinoplanes utahensis
atgccccggtacgaggtgaccacgctcgccgtcggtcacagtgagatacccggtccagagctgttctggatgcgcgactgggaccgctggcatcccttgacctttcaggtggtgttgatccgtggtgaggggatcgtcgcgctggtcaacaccggcccggcgcttgatctcgagccgatgaaccgaggttgggcggcatttctcggtgagcgggccgcgatgcggcgtgccgagggcgaattcctgccagatcagcttgcccgggtcggagtgacggctgaggaggtcacccacgtcatcctcacgcccctgcaactgtattcggtgagcaacgtgctcgccttcaacaacgcggccatctgcatcagtgagcgtggctggtcacatttccacaggacccacgaccacccgcacgacgaccgcgccacctcgctgcccgacgacatcctggtgccgctggtgacaaccgcatggccccgggtacgcctgctggccgacgaggatcacatcgcgcccggcctgcgtacctggtgggccggcgcacaccaccgagcgtcgatggtggtggaggtggacaccgccaacggcgtggtcgccatctccgacgcgttcttccacctggagaacgtcgagcagaaccatcccatcggcattaccgagaacatctacgaagcgttgaccgcgtacgagcgggtccggcggaccgccgacatcatcttgccgctgtacgacccgaagaacttcacccggtttcccgccgggcgtgtcgcgtga

SEQ ID NO: 6969 - DNA, 759 bp, Actinoplanes utahensis
gtggtggtccggcgtaagcgcagccagatggttgtcgacgagtgcattcaccggatcgccacgggtgaatggaaggaaggtgccgtgctgccgaccgaggccgaattgtgcaaactcttcgggttcggccgcagcgcggtgcgggaggcactgcaagcgcttgccgccaagggcttcgtcacgctgcggcagggcagcagatccaccgttgctccgcggagcgactggaatcagttggacgccgagtatctggccatgagacatgacggtgacctactccggtatctggcggaggcgcgggaggtcgtcgagccggccatcgcggcgctggccgcggaccgcgcgtcacccgccgaactccggagactcggggagctggccggagaatcggcgcagctcaatggagctgatccgagtcggcatgcggaggccgacatggccttccacgaggcgctggcgcacgcgaccggcaaccctatcctggtgtccattcacgcctcgatcaccggtctcggccggcgatccggaatgaggacggcagtgatgccgggcgcggtggatcgtgcgttcgcctggcaccgccacgttgtggacaccgtcgccggcggcgattcgccagccgcggctgacgcgacgtgcacgtacgtgcgccagattggcgcggaacccggcccgacggggcgcgtcgatcgcattggcttcgccgctgatgtccctcggcagatctcgggaggagcggcatgccccggtacgaggtga

SEQ ID NO: 6970 - DNA, 2241 bp, Actinoplanes utahensis
atgggtaaagcgccttcggacgcgcaattcatcacatcacttagccgtcgcctgggtgccgttctggccgtgaccactgcggcgctgacggtgaacccgtacgccgcgggcgccgccccgggcgacgtctcggccaccaagtcgggcacagtggcggagaccggatcgagcagcgacgtggctgccggtcagcgaatcaactgggtcatcggcctgcacaacggaacgaatgccgcagtccccgcgcaagtgaccgatccggtggaggcggggcaggcgttcgttccgggatccctgcgcgcgccgaccggctataccaccgccttcagtgcggacggcagcgcgtacgcgtcggagcagccggccacggtgaagagtgtccgggtggccggtgcggtcctaccggccggcacgaacggcagcgaggcgccggtcaagcccgccggcaagggcttcgtcggaaactccggcggcggcgacggcacgtacgcggccttcttcgggtcgaacgtctacaccgtgcaccatcaccgtgcgcccggggccaagctgatggaatgccatgacaaggccaccggcgcggtctgcccgggatacgagaccagcaccaccttcttctcgtcagaggccggcaaggcgatcaacaccggcgcagacgattactacactgcgctatcaccgggtaccgtcgtcgaccagtccagcgggcggctctacttcccggcgcagcgcggcgccgcggacggcaaccacaacaccgtcggagtcgcctgcgtcgacctggtgagcaaccgttcctgcggcttcaccgtgctggccggtgacgcgatgccccgcgtccgcgggggaatcgacctgagcggcgcggctctggtgcgaggccgtctctacctgcgcaacgagaccggcaagctgttctgtttcgactcggtgaagggcaccgggtgcgcgggcttcccggtgaccgtcgacgcggcagccgcggcgaacaccgacacgaccgaaggcgcccgtgcgcaaaccgacgcctttgacgaccgctacgtcttcacgtcgttccatatcgccggtcgtatcgacctggtctgcttcgacaccacgacgaacgcggtctgtcccggcttcccgaagtccgagccggcggccggcgacgcgtcgaagttcttcgtgccgatgctcgaccacggcggcgcggtgaccggcgcctgctggacgctgagcgccaatcatcggctggtcggctggcgttgctacagcatccagggcgagcaggtggcgacgcctacgggcttccccgcagccggcaccagcgtcctcggctatgacggtctcggatcgcctgaacggctgggtgcccggatctacctgccgatggtgcactccgacgacacgtccacctacatgtgctacgacttcgccacaggtggtccctgcgccggcgttgcggcgctgaacaccgggctcgccacccggacctactcgctgcgcgaggacccggcggctcccggttgcctctggtcggtcggtgactccgggcgcttcgaggtgttcgacgccgcgggccacaccggctgcaatgtcgcgatcgcctcggtgcccgccatcgttcccgcctcctattactgtgacaacaagaccggccacgtgaagggttgggccacccttgcccttacgggcatcgaacccagccggtacgcaagcgccgtggtcacccttcgtgacgccaccaaccagccggtggccggcttcgaccggatcgcgctgaagggtcaggaactggacctctcgtccatcccggccaccggtgcgaccgcgcgactgaccgccgacgtcgtgctgaccgccccgacgggcgacgccgtggaggccggcaaggccgcggtgacgctggccttccgtggggacgacccgcaggtctgtctgagcaccaaggtggacaccgcatgcgcctcggatggtgtcaccgcggtgatcaatgaggcgaacctcctcgtcgggacgcgccgctccacggcgcgcgcctcgctccggtacgcccgggtcggcgcttgcaagccggatgggcccgacgcgagcacccctgtcgctgcgcccgcgacgccaagcggcggaggttccggcctgccgctgaccggttcgcccgtcatgctggtcggcatcgtaggtgctgtcctgatcctcgggggtggcgtgacgatgatgctgatgcgtcgtaggcgcaacgttcgcttcgacgcctga

SEQ ID NO: 6971 - DNA, 660 bp, Actinoplanes utahensis
gtgcggggcatcagtagggtggtggtggagattcgccggacgaagggtcgagaggtggggcgaccgaaagatcctcagcggcggcaggacgtggccgatgctgcgcgccgcgccgtcgttcgcgatgggctcacccaggtgcgcctacggtcgatcgccgatgaggccggcctcaccgcgggtgcggtgttgtactactacggcaacgtcgacgctctgctcatcgaggtgtatcaccagggcgtcgaacgctggtgtgtggagcgggaagcgctggtccgcagacacgacgacgcacggctgcgtctacgcgagtgcatcgagaccggcgttgccgacggcccggacgatgagctcggccggctgctgatggagttcacgccgcgggtgctgcacgacccgaccgcagcccggctcgacggggaattcgcgcagcgtcaggccgacatctacgcagaagtgctgaaccgcggcgtagaccaggggcatttccggctcagcgatgccgcggagctactcgccgccacgttcgtcgccatcgaggacggccgtcagctcgacgtgctcagcggtcgcatcagccggcaggagtcggtgcggaccctcgtgtcgtatgcccgggcagtgacctcctgccatatccccgacaccgtcggctga

SEQ ID NO: 6972 - DNA, 447 bp, Actinoplanes utahensis
atgaacagagcaacgaggcgcgtgctggccatcgctaccggcgccgcggctgtggtcggtgccgtcccaccgggcagcgccgccgcggccgacatccaggtcagttacatcgccaccatccgcgtcgacagcggccatggcgcggagtacttccaggcccgcttgaccgacccggccgacgtccgcgccgctacggacaatatgcagggcgtcaccaaccagcacatcaacgggcgggtcgtatacaccggtgcggacgtcaacaagggttacacctggcacctggacccggccgacgtcagcttcgtcgaccagtcgatggaactctgcgacggcgcgcccagctacgtcgccggcgacccgaacagctacacgcggtactgcccctggcacagcaaggttcaggacctccgcgtcacctacacgccgtaccgcccgcgaggctga

SEQ ID NO: 6973 - DNA, 666 bp, Actinoplanes utahensis
ttgcgcactacgaaaatcgctgtgtccgtcgccaccgttcttgccggtctcgccggcacggtgagcccggccgccgccgaacccgcagaaccggcacttgccgtcagtgacctcactgtcctcggtggcggcacccgcgacgcccgcggcaacactgtcggccgggacgtgtgcgggccgcgcggcaccgtcctgccccgacacgcactcggggacggttcgagcgcgtactacgcccacggcgacgccctgggcgcgggcctggacccggaccgggcagtcacgaccgacctgtggtgcacgttctccctgacggtcaccgccgcccagggccgggcgtacaacctgacgaacctatggatggccggccagagtcgtctggcagccggcacctccggcaccgcgactaccagcgtcagctcaccgagcggccacaccaacctcaccaccacgatcagcggccccaccacgctgggcgagaactggcagctgaacggcctgccgagcgacagggcgctgatcggcggttgcggcacggcggagaccctcgtcgtcacccagcggatgcacctcccgcgggagtcgaacggctacctgagcaacgtggcggaccccggctggaactccacccggctgatgctgtccagcgtgccctgtaacgactga

SEQ ID NO: 6974 - DNA, 501 bp, Actinoplanes utahensis
atgcctgtcgtggaagccgtgatcgttgtccccgtgaccccggacgtcgcgtttgctgtatcccagaccgccgcaccgttgcgttaccgctgggatccgttcgtccgcgaacagcacttcatcgatggcgcgactgatcctggcaagggcgtgcgcaccttcacgcgttcacggcacggcatcgtcatgatcagcgagtacgtgtccttcgccccgccgagccatgtcggcatgaaaatggtgcgcggtccgtggttcttcgacgtgttcgcgggcggctggcgattcgcgcccgccccggatctgcccgatcacaccgtggcgacgtggcggtaccatttccgctgccgcccggcgatattgcgccccgtcgccgaacggatcggtacgtggctgctgggccatgacatccggcgccgcatcgaaggatatgcgcgcggttgtgaggaccctgaggtgctggccgcggtccgacaaagtctcgacgatcacgccgtttaa

SEQ ID NO: 6975 - DNA, 675 bp, Actinoplanes utahensis
atgcggcgccatagcggtgcgcggacccgaccgaccggtgttgccgcacgccgctccccgcctcgcccatgcgagacaatgggcggcatgccgtaccacgtccaccgcgagccggtgccgccggagaaggggcggaccggggcttggacgcgtttcggcatcagcgccgcgtggggtgtcgtgatgctggcgttcttcgcgacgtccgtgctggcctccatgatcggcgtcggtcttctgctggagaccccaccgctgaccggactcgccgggttccacaccgacgaactggttgaggcggccggtgtcacttccggcatagcggcggtgatggcctgtcgtcgagcgcggatgtggtggctccgggcacgactacgcaggctgcgccgccacggtgtctgcgctacggcgaaggtgaccaaccgtgagctggtccagacggtcaacccgcggggccccgatgtctgccagtacacgatttcagtgcactggcatgaggccaccgcagaacacgggggacagcggcgttaccggtttttcggctccgcccgtgacgatttcctgaagcggaccgcgtccggcgccgccgtgaccgtctaccacccgccgggccggccgcgtcgattcctcatcgacatcccctatgccccgaccgtcgccgacttcttcctatga

SEQ ID NO: 6976 - DNA, 117 bp, Actinoplanes utahensis
gtggcgcaggtcgcggccaccactgccgacggcgccaaggccacccagcaggcagccaccgacctcaccgtgctcgccggggaactcacggccaccgtcaacagcttccgccactga

SEQ ID NO: 6977 - DNA, 1644 bp, Actinoplanes utahensis
atgccgaacggtctgactgtgaagccaccacgagcagttgatgtcttgagcggagacacacagccgggtcgccaggcgggttcctggcggtcggcctgtcctgcccgactcggggtcaccgtttgcggtgtcgtgttggtctcttactgctggctactgatggcccagccgatgtccggccgcgcaatgatgatcatgagcaacctgatgatgatcggcgcggccgtgaccgccaccaccgttgcagcgctcgggttccgtcgcctgaccacatcctcgcggcggggtgccgccttgctgatcggctcgatggtcagtttcgccatcggccagaccatgtacttcagctatgaactgcacccagaacacggccagccgttcccggcaccggcggacgtcgcgtatgtatgctcctcgttgctcctcgttgccgccatagcgatccttgcgccacggcaacgccggcgtctccagactgcactcgatgccgccatgatcggttgcgctctgttgtacgtgagctgggcactggtgctcgggcccatcgtgcgcgggggcgctggatcggcgatggagtggaccctgctgctcctgtacccgatcgttgatctgatcaccggcagcatcgccttgctcgtcgtcgcacaggccggcacccaatatcgcggcccacggctgaccatcggattgggcgcgctcgccttggctgtcggagacagcggcttcgcgtacctggctcacctcggcctctacgtatccggcgaatcggtcaccgacgccggttgggtcatcggctatctggccatggggtggggtgtctggtacctcgccgcgatgcaggaacggcctgcgggccaagcccgcgcgcgttccgtagccagcgacgccggagccgcgaccgtgccgacgcgggcgacggtggttggtgtgaccacgccttacctgcctttcgcagcagcgctggtcaccacggtgttcctggtcgcccgggacggctccgtgcccaaggaactactactcctcggtctgggttttgcgctgctggtgatggttcggcaggtggtggcgttgtgggacaacattctgctggcgggaaagctccgcagtaccgtcgaacggctacagctgcgcgagcaggaactcgagatgctcgcgtttcacgactcgctgacggggctcgccaaccggacactgttccatgatcgagcgcggcacgcgctgatccggcaagaccggctcaagacctccctgtcggtgctttacatcgatctcgacggtttcaaggccgtcaacgatcggctgggccacgcggcgggcgacgctctgctggtgaccgttgccgagcgtctgcgctcctgcgtccgggcctctgacacactggcgcgccttggcggcgacgagttcgcggtgctcgccgatccgatgcaggctgtcgaggatgttgccgtcatcgcggaacgcatcgtgcggtgcctggccgcaccggtatcactgagcaacggtacagccatggttaccgccagcgttggcatcgccacccgcgaaccgttcagcggagacctcgacgcactgcttcggcgtgccgacgaggcgatgtaccaggcaaaggggggcggcaagaatcaagtcgtacaggcaagatga

SEQ ID NO: 6978 - DNA, 1449 bp, Actinoplanes utahensis
atggggcgagcccagggaccagcttgggcttggttcgccggaatcggcctgctcgtggttatggcgtatccgttgctgcccggtgatggacttccgagatgttatttcgacgggattggcgtcggcggcaccgtagcggtgatccttggcatcctccgcaaccggcctcgagcggcgggaagctggtggctgcttgccgcgggccagctgggcaccgttgcgggcgacatcatgtacgactaccggcaagccgtgttgcacaacgcctcgtggcctggaccgcctgaagcgctgtacctgaccagcgaccttgccgtggcagccgggcttttcggcctgctgcgtaggcgccgccgcagcagtgatcacgccgcgttcgtcgactcggcgatcatcgcaagcgccttcgccctactcagctggatattcctcatcaagcccgcagccagggacgcctcgctgggtagatgggcgcaggcgatgatggtcgcctttcccacggtggatctgctgttgctggcgatggtggcgtgcctgctcaccgtgaacggtgctcgcaacaccgcattctttctgatcatcagtcggatagcagtcaccctcgttggcgactacacatggctcatcgccgaccggacctcctacgatcccggtgaggtcgccagccggctggtcgatatcggatttctgatcgcatacgtcacgctaggggcggcagcgctgcatccgaacatggtcgaggtcgggcagcccaccaccgctccgcgacgcccgacatcggcgatacggctggtgttcttggctgctgccgtcctgatagctcccgttctactggcatggcaggcgcgaacagcaagcggatatgtccccgacgcgaatgccatcgcttcgggcagcgctggtcttttcctcctcgtcgtcatccgcatggcgctcctgttgcagcaggtgcgcgcccagaaccacctggtggagcgacaagcccaacgactgcgggagctggctgaacgtgacgtgctgaccggcctgcccaaccgccgggcgtgggacgaggccctgcccgctgccctgaaccgggccgcccgcgatggcagcccggtcaccgtggcgattttggacgtcgatcatttcaaggcgttcaacgatacttacggccatccagcgggggaccggctgctgcgcgaggccgcagcttcctggagagcgaacctgcgtgaggccgatcttatcgcccgatacggcggtgaagaattcgttgcgttacttcccggcacgccgctcggcgaggccacgataacggtggataggctccgtccgactacgccgatggggtgcactttctccgctggtgtggccacctgggacggtcatgagagcgctgccgagctcgtcagccgtgcagaccgcgcgctttaccgggcaaagcacgccggtcgtgatcgcgtttaa

SEQ ID NO: 6979 - DNA, 1617 bp, Actinoplanes utahensis
atgctcggtgtcttgcgacgcctccgactgcgtagccggctgtttctggccttcgggctgttctgcctgctggtggcagtgatgacctcggtgggggtcgtggagtcgcggcggcagacacacgtagccgacgaggtggggcgactgcaggtgctgacccgtgacgtcatgcagctgaagttcttgaacgccgacgccagcgcctggcagctgggtttcggctgggattcctcgctgatcggcggaaaagccgccgccgaccctgagtcgagcaaccgtaaaggcacgctggaggcgtacgagctggtgaagcggcaaatcgccaagatcgagggtgctgatctagctgccggcgagcgggattctttgaacgcggtcaagaaacattttgccgacttcctcagtttcgataatcagatcgtcgccatcatgcgcaccggcggccggagcgcgccgcagcggacggcggacctgatgaacgggcccgcctacgaaacgtttcaggcggtgggcgagaacatcgacaagctggccgactcagtcatcgcccgcagcgacgctgcgcagcgtgagacacaggcggcggcccagcgcctgcggacggccttgttgatcgggtgcgggctggcgctggtgctgaccgtgctgctcggcctgctgctcacggcaagcattgtccagccggccgccagagtggccagagccttgcgtgttctcgccggacgcgacgtcacgccacgcttgccaaccgacggccgcgacgagctgaccgacatggcgcaggcattcaacgaggccggcgacgcgatgcggcaaatcctctcgggagtcggcgagcgggcgtcctcgctggccgccgcgtcccggggactcgccgacgtcgcccagcgcatggacacgcaggcgttcgacaccagttcccaggccacggtcgtggccggtgctgccgacgaagtgtccggcaacgtgcagaccatggccggcgcggctcaggagatggtgtcggccatttcagaaatctcccggagcaccacctctgccgcgggcgtcgctgcggaagcggtcacgtccgcgcagcaaaccgcagagtcggttgcccaactggtcaccgccagtgcggagatcggcgcgatcgtcgcgacgatcacttcggtcgccgaacagacgaatctgctcgccctcaacgcgaccatcgagtccgcacgagccggcgacgccggtaagggattcgctgtggtggccagcgaggtgaaggatctcgcgcaggaaaccgcacgggcttccgatgacatcatcgcaaaaatcaatgccattcaacgaaccacggaacatgccacagcggcgatcggccgcatcactgacgtcgtgatgcagattgcggagctgcaggagaatatcgccgcggccgtcgaagaacagtcggccaccaccgacgagatcaaccgtagcgtgtcggaggtggcactgggctcccagcacatcgcggacaacgtggccagcgtcgccgacatagccgcggcgaccacccgcgacgccacgtccacgcgagaagcggctcgtgagctcggtgacttggccactgacttggacactctcgtcgcctcgttccggtattag

SEQ ID NO: 6980 - DNA, 816 bp, Actinoplanes utahensis
gtgaacgttgttcagcgctatcccgagatgcgcgaccaggtcgccgtggtcaccggagcggcatccggcatcggcgccgccatcgctcaggacttcgccgcgcagggatgccgggtcgccctgctcgacatcaatgagacgcaactgcaccggaccgcggccgacatcgccgccggagcgccgggcacagtccgtccgattacggtggacatcgccgactccacggccgtgaaggagtcactcgccgagctggttgcgggatggggcgggatttcttacctcgccagctgcgcggtgagcttcgtggccgccggggtcgacgccactcaggagcagtgggaccgcgtcctgcaggtgaatgtccgggggacagcgatggtcctcgctgcatgtgtgccatacatgctgcccggctccgccgcggtgaacacggccagcatctccgcacatgttgcgcagccggaccggtggacatacaacgcgaccaaaggtgccatcgtatcgatgacccggtgccaggctctggatctcgcgccgcgggggatccgggtgaacgtggtgagcccgggctggatctggacgccggaggtcttgcgggcggcccaggacgaccgggaggcctgggagccggtatggggtccttaccacatcctgcgccgcctgggagaaccacatgaggtggctcgggcggtgctcttcctctgtagtgacgacgcctcgttcatcaccggaacagagctgatggtggacgggggctactcggccctgtcagccgaagggctcggccagacctcgcagttcgccggcaccgcttga

SEQ ID NO: 6981 - DNA, 816 bp, Actinoplanes utahensis
ttggtattatgttccgcgtactggcgccaagtcggtacgcggagctaccggcaggagtccgacgtggccaaggtcaatcttgccgacatcgtggtggacgaccacctgcgtcgcattgcggtcggagagttgcggccgggggatcgcctgcctaccgagccagagatgtgcgacgcctacgggatgagccgcagcgcggtccgggaagccatgcacaagctcgcgggcaagggattcgtcacggtgcgccagggcagcggcacgacgatcggaccgcgcgaacaatggaatgagctcgatcccgacttcgtgcgctgcggcagcgacaccgacatgctgcgcgaactggtcgaggtgcacctcattgaggctcgacaggcgctggagccggtgacggcgagcctggcggctatccgcgcctccgaagaccagcgccgggagttgcgcgcgctgctagttgagcaggagtggctcggcgaccgggatgccgatgctcaggccgaggcggacatccggttccacagcgcgctggcgcgcgccacacacaacccgttgatcatcgctatgcacgcctcactggtcacgctgggccgtcgttctcgcactcttgcggctcagacgcctggcggtgtcgaccgggcgatcgcctggcacacgcatcttgtcgaggcggttgaggcgcgcgacgcgctggcggctaccgatgccatgcggatgcacctgcgccaggtgcgcggtgacctgcaagccggcggcccggtggacgcgcagggagcggcttccggcttccacccgcaagtctcatcctgttcctga

SEQ ID NO: 6982 - DNA, 1272 bp, Actinoplanes utahensis
gtgggccggggcgcatcatcgcgcgtcggtggtcgtggaggtggacaccgagagtggtgtggtggcgatctccgacgcgtacttccatctggagaacgtggaacaggaccatccgatcggaatcaccgagaacatctacgaggcgctcgccgtccacgagcgtgtgcggcgtacggctgccatcgtgcttccgttgtacgaccccaagaactttgcacgcttcccggatggacgggtggcatgaaagcgctgatcttccagggcccgatgcgcatggtcgtggaggacgtaccggagccggtggctgccgcaggcgagttgttgctgcgagtggacgcagtcggcatctgcggctcggacgtgcacggttacgcgggcgagacaggccggcgcaccgccggcatggtgatgggacacgagatctcggcgaccgtgctcgagctcggagacggcgtgacagggtggtcctcgggcgattgcgttgcggtgaacccggtgatcggctgtcgtcagtgcatccgatgccatgccggcaatacgaacctctgcccctatcgtcgtgtcatcggcgtcgactctcactaccggggcggttacgccgagcagatcgtcgtgccggccgccaacgccgttcccctggaagcgggtctctggcagggcgctctgatcgagccgctcgccgtcgggctgcaggcagtgcgtcaggcaggggtgtgcagagacactgaggtggctgttctcggcgccggaatgatcggcctcgccgcgacgtgggccgcctggcgtgacggcgcccgcgacgtcttcacgggagacctcgacgctaccaaagtacgccgtgccgagcggctcggcgcggtcgggttgtccctcagcgccaccaccctgcgagaagcgttggaggctcgcggggtcaccgaaatcgcccgagtggtcgatgccatcggcatctcagcgacgatcgactccgcgctggacatggtgaccccagggggcacggtgtgcatcgtggggatgggctccccgcaggtgcagttgccggcgtatgccctcaccaccgcggagcgccggatcgtgggatcgttctgctacagcgaggcacatttccgcgaagccgctgaggcgttgctcgatggcaccgtgccggtcgacctgttcatcgatcgggagatcggtctggacgaggcgccggaagcgttccggcaactggcatccggtgagcgggccaccgtcaagacggtgattcggccgaccggccgtcaagcctgctga

SEQ ID NO: 6983 - DNA, 747 bp, Actinoplanes utahensis
gtggtccggcgaaaacgtagcgaagtccttgtcgatgactacctgcgcaggattgccgcacgggaactggtggagggagacacccttccgacagagtcggagttgtgccggttgtacggggtggggcgcagtgccgtccgtgaggcgctgcaggcgctggcggccaagggcttcgtgaaggtacggcagggaagtggctgcacggtcgcgccgcgcgtcgagtggaaccagctggaccctgcgtaccttcgcgtcagccacaacggcgacctgctgagtcacctcgtggaagcgcgcgagatcctcgagccggcgatcgcggcgatcgccgcgtaccgggcctcaccggtgcacgtgcagcggttgcgggaactggccgaggaactcgaacaagtgggcggcgcagaccccggcaggcacgccgcggtggacatggctttccacgaggcgcttgccagagccaccggcaacccggttctcgtgtcgatccacgcctcgatcgccggcctcggacggcgatcgagagtcgccacggcggcggtgcccggggccgtggaacgcgccgtgttctggcatcggcacgtcgtggacgccgtggccggcggtgacccggacgccgtccgcgacgcgatgaggatgcatatgcgacaggttcgcaccgagatccaccgagtcggcgctgccatgccggaccaggtgcccagctcggggaaggtgaagggagcgcaatgtccacctacgaggtga

SEQ ID NO: 6984 - DNA, 1041 bp, Actinoplanes utahensis
ttgtccattcgcacgataccccgattcttactgacagcgctggccgtaacgacgatggtgtcggcaaccgcctgtcagaagtcgccttccgccaagagcggatcgacgacgtcaagcggaccggtcaaagtcgtctacataccgaagaacctcggcaacccgtacttcgacgcgattgtcgccggcttcaaggagacgtcccagacgctcggttaccagttcgaggaagccggtcccgccagccccgatccgacagcgcaaatcccgttcatcgacgcggcgatccagaagaaggtcagcgcgatcgccatctcgcccaacgacgacgaagcgctactgcccagcttggagaaggcgaaggcggccggtgtcaaggtcatcaccatcaactccgacatgaaggccacggacgggcgcgatgccgcgatcatgcccaccgacttctcgccgatgggcaagttcctgctcgacctcgccgcccagcagatgaactacacgggcaagttcgccatcctgtccgcaacctccaccgcaccggaccagaacgcctggatcgagggtctcaagaaggagctgaagaacgatccgcagtacgccaagatgcagctggtcgacaccgtctacggcgacgaccaggtcgacaagagcactacgcaggcacgggcgctgctgaccaaacaccctgacctggcggcgatcatctcgccgactgccgtgggcctgccagcggcggccaaagtgatcagcgagtcgccgcagaagggcacgctcgtgctgaccggtctgggcctgccgagttcgatgaaggcgtacatccaggacgggacggtcaagaagttcggtctatgggatcccaagcgggaaggcgtcatcgccggctacctgctcgccggcatggcgaggggcacgataaccgcccagccgggcgccacgttcagcgccggcagcctggggacgatgagcatcacgccggcgggtcaggtcatctcgggtccgctggtgaccttcgacggttccaacatcagccagttcaacttctga

SEQ ID NO: 6985 - DNA, 1077 bp, Actinoplanes utahensis
atgaccagcgaaacgatctccccgtcggtaacggccgatgccggcgagccgctgacggcatctacggagacgtggcggcagcgcctgctgcacgctccggagtcgactgccgccgcattgctggtcgccgcattgctggtcggagtcctcatgtcagccgatttctgggatcccgcggcactactgaccaacacgagctcttacgtcgagatgggcctcgtcgcgctgccgatgacgctcatcgtgatcaacggtgacatcgacctgtcggtcgcttcgatggtgacgctcagcgccgcgacactggcaaagacatatcaagccggagtgccgacctggctggcatgtgtgctggcggtcctcgccggcgcgctgctcggtgccgtgaacggggtgatcatcacctacttcggactgcccagtctggtggtgacactcggcacgttggcgctgtaccagggcatggccgaggtcgttctcaccgacaagtccatcggcgactttcccgaagcgttcgtgggttttgaccagtacggcgttttcggcaccatgccggacttaccgatgccggtgctcgtgctgctggtcgcggccgccgccttctggttcctgctgcatcgcacggtatacgggcgactctgctacctgatcggtagcaatgccgaggcagcaaggtactcgggaatccgcacggcgatggtccgcacggtggcattcacgctgtcgggaaccgtctgcggcctggccgccattttgctcacctcgcgcctggggtccgcccagtcgaatttcgccaccggcatggaattgctggtcatcaccgttgtggttctgggaggcacggacatcttcggtggccggggttcgatgctcgccacattgctggcgttcttcgcgatcgtcgtcgttcgtcaggccatgaccgtcgcctcggtcaacggcgagatgcagaacgccgtcatcggccttctgctcatcggatcgatcctcgtaccgacgatgacggcctccctcgctgcgcgcctgcgccaccacacacgacggcgaccgtcgtcggtgggccgtcgccgatcgtag

SEQ ID NO: 6986 - DNA, 1005 bp, Actinoplanes utahensis
atgaaattctccatgccacgtgggcgcggcctctatctcttccgtgatctcggtatcggcgttttcgtcctggcgttgacggctgtgttcggtggtctgcagggacgctttctgtctccgacgaatgtcaaccagattctgctggacatcggcatcatcacgattgtggcggtcggccagatgctcgtcatcgtcacccgcaacatcgatctctccgtggggtccatcgtcggactgagcgcaatggcgatggcgatgctggtccgcgaccatcccggcgtctccgtgccgatggcggttctggtagccgtcctcgtcggcgccgccgctggtctgtgcaacgggctggtggtaagcgtcggcagagtgccggcgatcatcgccaccctgggtaccctcgccgccttccgcggcgtgatctttctgatctccggtggccgtcaggtcaacgactgggatctgcctcgcggcgtggtgagcctggcttcaggagcgcacaccgccgtgccgtggctgctggtatcggcggcggccacactggtgttcggtatcttcctcacccggtacacgctgaccggacgcaggttctacgccgtcggttcgtctcccgaggccgccgtcgcgcggggccttccggtcaaacggctgaccgtcggcgttttcgtgatctccggcgcactcgccgggctcggcggcgccatgtacgtcgcccgattcgccagcatcaatcccgccgacgcgggcctgcacatggagttcgcagtgatcagcgcggtggtcatcggcggtacgaacatcttcggcggcagcggcagcatcctgggcagcctgctcggttgcctgctgatcggcatcctcggcaacggtctcaccgtcgtgggggtgtcgccgttctggcagagcgccgcgcagggggccatcatcctcgccgccgtcatcttcgacgcgcgcatccgcatgaactacgagaagcggcggcgcctgtcaggaagggcactggcatga

SEQ ID NO: 6987 - DNA, 1506 bp, Actinoplanes utahensis
gtggaagcagccttggcctgccggggcctgtcgaagtcgtacggtggcgcccgggcgctgaccgatgtcacgttcgtcgtcgagcccggtgagatccacgtccttctaggcgagaacggcgctggcaagagcactcttgtcaagatcgcggcgggcgtcgtggcgtcggacaccggcacggtcgacgtcgggggagtgtcacttcctcccggtaacgtgcaggctgcccaggcagccggcgtcaacatcatccaccaggagccacggttgttcggcgacctcgacgtggtgggcaacatctacttggaccgtccgccgcgccgttggggaaccatcgactgggccgccgcgatccgggagactcagaagctgctggaccgggtcggctgccgggtgtccccccgggccaaggtccgtgatctatccgttgccgaccaacagatggtcgacatcgcggcggcactgcgccgagatcccaaagtgctgatcgtcgatgagcccaccgcatcgctgactcctgcggaggtggcccggctcttcagcaatctgcggggactgcgcgaccggggtgtagcgatcgtgttcatcggtcatcgcctcgaagagatcatggagatcgctgaccggatcaccgtgctgcgcgacggcgagttggtcaccgtggtccgggctgccgagacggatgccgacgccctggtgcgggcgatggccgggcgggccgtcgaggaggcagcggcgcccgccgcaaggcccaccggcgacgtactgctgcgggtgcgagatcttgcgagcgccggggcattccgggaggtcagcttcgacgtgcgcgcgggggaggtcgtgggactggccggactggtcggcgcgggccgtacagagatcgctgaggccatcttcggagttcggtcgcgcgaaggcggcacagtggaggtgggcacttcgcggtcacggccgcgcaacgccgctcaggcggttcgcgccggactggtctacgtgccggaggaccgtgcacgccatggtctcgccgtgcgctgcagcatccgggagaacgccacggtggggctcttgtcgtcgctggctcgtcacggcgtccggcgtgggcgccgggagcgggaaaccgcggcgggggcgatccggcagtacgcagttcgcgcggcgtcaaccgagcaacccgtgagttcgctctccggcggcaaccagcagaagatcgcggtggcgaagtggttgctcaccgggccgcaggtggtgatcgtcgatgagccgacccggggcgtcgacgtcggcgcgaaggccgccatccaccgtattgtgctcgacctcgccgaccggggaatcgccatcgtggtgatctcgagcgagaccaaggaactgcgtctgctggccgaccgcatcctggtggtccgggagggccgactagccggcgaactgggccgcgccgacgcgaccgatgaacgcatcgtcgcactggccactcgcaacgtggacgtggcgggtgcgagcacatga

SEQ ID NO: 6988 - DNA, 936 bp, Actinoplanes utahensis
atggctgacggaccacacattgtgatcacggactgtgacctgggagatacggacatcgaggaagagctcctgatctcaggtctcgacgcgcgggtgacggtcgctcggtgcaagagcgaggatgatgtcatcgacgcggccggcgacgctgacgctctgctcgtgcaatgggcgcccatcaccgcccgcgtcctcgaagcgcttccccacctcagggcgatcagccggtacggcatcggactggacatgatcgacctcgacgccgcccggactcgcggcatcgaggtggccaacgtgccgcactactgcaccgaggaggtcgcctcccacgcggcggccttactactcgcgctctggcggcgccttcccgcgctggaccgcagcgtccgggccgggcgatgggagccggtgccggtcatggccggcgtcaagccgctctcgtccgccactctcggcctgctcggcgccgggcgcatcgcgcaactgaccgcgcgtcccttcaccgccttgggtacacgagtcgtggcctacgacccgtacgccacagcaacgccgggtgtcatcgagctggtcggcctggacgaactcgccgacgctgacctgatcagcttgcacgctccgctcaacgcggagacccggcacctggtcgacgcggcattcctgagccggttgaagtcgcacgcggttctggtcaataccgcccgcggtgctctcgttgataccgcggcgctgatcgacgctcttcgcggcgaacgcatcgccggcgcgggcctcgacgtctacgagaccgagccgctgccggctcaccacgagttgacctcactggaacgagttctcatcaccccgcacgcggcctggtgctcgaccgacgcgctgccgacgttgcaacgacaagccgccgagaaccttctgcggcttctcgccccctccgcctga

SEQ ID NO: 6989 - DNA, 849 bp, Actinoplanes utahensis
atgcgcatcgcgctgctggacaccgcctccgggcctcggctcgccgccgaatgcgacggcgcctacctgccgatggccggcaacgacctgcgagcaatgttgaccgcggatgccgatctgaccgatccggtactcggttcaccaccggtgaccggcagtcttcgcgccccgttacgacccggcaagatcgtcgcaatcggcctcaactatctcgaccacatccgcgagaccggcctcgacaagcccgttgagccgctcatcttcaccaagttcgtgtccagcgtggtgggccccacggatgacatcgtcgtggacccggcgctgaccgagcgcgtcgactgggaggtcgagctggccgcggtgatcggccgccgcgcgcgcaacgtcgacgttacccaggcactctcccacgtcgccggatacctggtcgccaacgacatctccgctcgggacctgcagttccgcgatggtcagtgggtgcgcggcaaaagcctcgacaccttctgcccgctcggcccggtcttcgtgaccgcggacgagattcccgatccgcagaggctctcgctacggacgatcgtcaacggcgagattgtccaggactccagcaccgaggagatgatcttctccgtggccgagttggtcgccttctgctcgcgaagcttcaccctcgatcccggcgatgtcatcctcaccggcacgccgtggggctgcggggagttcatgaacccgaagcggtcgctgcgcgagggcgacgtggtcgaggtgtcggtcgacggaatcggccggctgcgcaacacggtccgtcacgcctcctggtcactcagccgaaggaccgagccgtgcgaatag

SEQ ID NO: 6990 - DNA, 1581 bp, Actinoplanes utahensis
atgtgctgccgcggaaaccacgggcgctcactatctggccgctgccgacaattcctgcctggcccacatcggcggcggcctcagccggcgccgcagcggtctccagacgatccactatgccgagatcctggcggccgggcagtgagcggcctcggcataccgggaacggcccgaggcgtcccctttcccaccgccgcggcgcgggcactcgccgacgaacagctgcgggccaacctgcgccgagcgaccagcaccatccgccgtcgccgcgacgaggcagtcggtgagatcgccggctgggaacagctgcgcgacgccgcagcggccatcaaagccgagaccatggcccggctgccagaactgctggaacgattcgaggcggccgcgacagcagccggcgcccaggtgcactgggcacgtgacgcggtagaggccggcgccatcgttgccaggctggtggccgccgcaggagccagcgaggtcgtcaaggtcaaatcgatggcgactcaagaaatcgcgctgaatcacacgctcgcccgctcgggcgtcgacgtggtcgagaccgacctggcggagctcatcgtccagctcgccgacgacgttccttcacacattctcgtacccgcgatccattacaaccgcaagcagatccgcgacctgttccgcgatcggatgccggacgcgcccgctgatctcagcgacgatccgcatgcgttggcggcggccgcacgcgcacacctgcgcgcgcgttttctctccgcccaggtggcggtctcgggcgccaacttcgccatcgccgagtccggcaccctggtcgtggtggaaagtgagggcaacggccggatgtgcctcaccctgccgcgcaccttgatcagcgtggtagggattgagaaaatcattccgcgcttcaccgacctgtcgatattcctgcgccttctacctcgctcgtcgaccggtgaacgcatgaacccctacacctcgacgtggaccggcgtgactccggacgacggtccgcaacagcttcacatcgtcctgctcgacaacggccgctcagcaaccctggccgacccggtcggacgccaggcgctgcactgtatccggtgctcggcgtgcctgaacgtctgccccgtctacgaacgcacgggcggtcacgcgtacggcagcgtctacccggggccgatcggtgcggtcctcacgccacagctgaccggagtcgccgcgaacccgtcgctgccgttcgcctcgacgctgtgcggcgcgtgctacgacgtctgcccggtgaaaatagatattccccgcgtgctggtacacctgaggcaacaagcggtgctcgcctcaccggcggcacccgaaggcgccgtgatgcgggcattgacctggaccatgagcgatcgccgccggtacgaacgagccttacgggccgctcgcgccggcgccgctccgctggtgcggatactcggccgacgcacggtacgccggctaccggcaccactgtcgccctggacgcgctatcgcgacgccccgctgcccgcagccgaatccttccgggattggtggagacgcaatgacccacgcacgtga

SEQ ID NO: 6991 - DNA, 612 bp, Actinoplanes utahensis
atgacccacgcacgtgacgaaatcctgtcccgcctccggcgagccttgtcagactcgccggcggtgccgcaagctctcccgctgccgactccgacacaaccgccggacgctctcgctctgctttgcgaacggttgctcgactaccgggcgcaggtggtcaccaccacgtggcacctgctgcctgacatgctgaccgaactcgtcacgggcgtagcggacgacatcgccgtgcccgcggatctgccttcacgctggaccgcggcctggcaggcacgtgccgtcgtggaccggggccacctgagcaacgcggtgctggaccaggtgggtgctgtggtcaccggttgcgcgctcgcggtggccgagaccggcacgatcatccttgacgccggcccccgccaagggcgccgggtgctgaccctgcttccggatcggcacatctgcgtagtcgatgcccggcaagtagtcgcggacgtgcctgacacctttgcccggctggaccacagccgtccactcacctggatttccgggccctccgctaccagcgacatcgaactacgccgcgtggaaggcgttcacggtccccgtctgctgcaggtcgtactggtcagctga

SEQ ID NO: 6992 - DNA, 684 bp, Actinoplanes utahensis
gtgattctcggctatgccgttctggcctatgtgacgttcctgttcagcatcgggtgggcggtcgtcttcctgaccggcccggtggacggcccggccacccactcccccgccaccgccctgaccgtcgacgccctgctgctgctcgcgttcgccgtccagcacacgatcatggcccgcccccggttcaaacgtcacctgccggccgccgtcgagcggagcaccttcgtgctcgccgccagcctggtcctggtagccctgttcgcctggtgggagccggttcccgcggtcgtctggcggggcagcccgctgctctgggtgctgtacgcggcgggctgggcgctcgccgtcgcggcgacctacatgatcgaccacttcgacatgttcgggttgaagcaggccgtccggcgggacgcgtatcaggcgccggccttccgggagcgctggctctacaagcgggtccgccaccccatgatgctcggcatgatcatcgctttctgggcgacgccgacgatgaccgtcgggcacctgttcttcgcggtggcctcgaccggctacatcgcgatcggtatccgtttcgaggagcgtgacctgcggcggcagctgggcgacacctatgcggagtatgccgcccgggtgccgatgctgattccgggcacgcggcgcgcgcactcgaaagttgcttag

SEQ ID NO: 6993 - DNA, 1932 bp, Actinoplanes utahensis
atggatccgttcaccagggtgccgctcggccgcaccgatctcaccgtgacccgcctcggcatgggcctggccccgatcgccgggctgttccggccggtcggggacgccggggcgatcgccgcgatcgacgccgccggggatgccggggtgcgcttcttcgacaccgcgccgctgtacggcgcggggttgtccgaggtccgggcgggccgcgcgctgcgcggccgccgggggttcgtgctgtccagcaaggtgggccgccgcctggtcccggccggcgagacgcggaacgagctgtggtccgagccgtccggcgcggcacaggtctgggatttcagcgatgccggcgtacgtacgctgtggcgcgccagcccggaccgactcgccgtggatcgcctggacatcctgcatctgcacgacccggacgaccatttcgggcaggccgtgcacgaggccctgcccgccctggtggagctgcgccgccagagggtgatcagtgcggtttcggcggggatgaaccagtcggcgatgctgaccgacctcgtccgcaccgggcagctggaccgtgtgctgctggccggccggtacccgctgctggaccagtccggcctcgccgacctgctgcccgagtgccacgcgcggggtgtcgcggtgatctgcggcggcgtctacaactccggcatcctgaccgatcccgatggcagtcccacctaccactaccggccggctccggcggcgctggccgcccgggctcgggcgatcgccgcggtctgcgaccggcacggcgtgccgctgcgggccgccgccctgcagttcccgctcgcccacccggccgtcgtgtcggtgctggtcgggatgcggtcggccgccgaggtcgccgacgccgccgcgatggctctgcccggtccggatctgcgcgcatgcgcccgtacgtcgacatcgctcccgatcttccgggtcggaccggctcatgtccggtgcgaaccggccggtgtgcgaggtggtggcgtcctgcggggaggtcactctggtgctcaccggcattcccggcggccgctccggcgctgcgtccggccgcaccgcgatccgcgtctatcgatgggagatctcgtgaggtatctgcgcgccggagcgccgggggcggaacgtccgattctgtacgccggggggcggctgcgcgacctgtccgaggtgaccgcggacatcgacggggcgttcctggccgccggcgggttcaccggggaccccgacgagctgccgccggccgatctcgaccatcaccggatcgccccgccgatcgcccggcccggcgtcgtcctctgcatcgggccgaactacgcggcgcatgccggcgagtccggggcggcgccgccggccgagccgatcgtcttctccaaggcgccgaacacggtgatcggcgccgaggacgacatcctgatcccgcccgggtcgaagcgcctcgacggggaggtggagctgggcgtcgtgatcggccgccaggcgcggtatctgtcggacccggcggccgggctgcagtgcgtggccggctacgtgctctccaacgacgtgtccgaacgtgattaccagctggagcggtccggcgggcagtggtccaagggcaggtcgtgcgagacgttcaacccgctcggcccgtggctggtcagcccggacgagctgcggttcccgctgcggctgcgcagctgggtgaaccgggagccgcggcaggactccagcaccgccgacatgatcttcgacgtcggccacctgatctggcacctgtcccagttcaccgtcctggaaccgggcgacctgatcaacaccgggactccgcagggggtggcgctcggcggccgcttcccctacctgaacgccggcgacgtggtggagatggagatcgacggactgggtcggcagcgcaacgtggtgaaagggtga

SEQ ID NO: 6994 - DNA, 2724 bp, Actinoplanes utahensis
gtgcagcaggaatccatcgagaaacgaaccgtccgctggcgccgactggtgaccaccgtcgtcgccgtactgttgttctgggtcggcgcgggggcggccgcagccgaggcgtacgtcgaatccgtgccggtgcccggcgtgagcccggagccacaggcgtccgtcctgtactaccgcgacggtcggaccatcctggcccgggtcggtgccaccgaccacaacgacgtggcgctgtcggccgtctcgcccgagctgcgccgggctgtgctgatcgccgaggaccgcgacttctaccaccacgtcggcgtctccctgcgcggcgtgatgcgggccatggtggccgacgcgggcggcgcgcaccagggcgcctcgacgatcacccagcagtacgcccgcaacgccttcctcacccagaacgtcacggtgaaccgcaaggcccgggaattcgcgctggccctcaacctggaacgcgagcactccaaggacgagatcctggagcggtacctgaacacgatctacttcggtcggggcgcgtacgggatcgccgccgccgcgcacgcctacttcgggatcaccccggatcggctcgacttcgcccagagcgcggtgctcgccgcggtcatcaaggatccctggggatacgacccggaccacgacgccaaggcggcccggcggcgctggaactggatcttggcgagcgcccaggccaacggctgggtggacccggcggtgacgtacccgcagctgcagccggccggctcgccgatcggcggcccgctcggtctggtcgtcgaccaggtggaacgcgagttgtccacccaccagatcacctcccagcagctgcacacccagggcctgcaggtggtcaccacgctggacgcggcggcgcagcaggccgcggtgggcaccgtcgcggcacaactgcacggccagccgtccggcctgcaggcggccctggtcgcggtcgatccggcgaccggtggggtacgggcgtactacggcggcgagcacggcagcggctacttcgactacgcggcggctctgcacccggccgcgtccacgttcaagccgatcgtgctggcggccgcgctgggtcggggcatcgcctatcagtcccactgggacggcagctcgccgcggttgttcccggaccggggcgtgcccctgcgcaaccacaacgatctgcagtgcgccgactgcacgctgcagcacgcgatggtcgactcgctgaacacgccgttctacgcggtgaccgcggagatcggcccggaccgggtccgggacatggcggtgaagctcggcattccggacacttaccacggggccaagtcgatggtggatgtcaagggtgacccggcccccggccacacccgcggcgacatcgccatgggtcgttacccggtcacgccgggcgacctggccaccgtgtacgcgacgctggccggcaacggcgaccggcaccagcgccacttcgtgcgttcggtgaccggggcgaccggcttcgactacaccgagccgaccggcggtaccgccgcggtcgacccgaagatcgccgccgacgtctccacggtgttgcggtcggtggtgcaggagcacggtttcaccccgggtcgtccggccgccggcaagaccggcacccagcagtacctcgagacgcgcgacaaccaggacgcctggatggccggctacacgccggaactggccaccgcggtgtggctcggcagggcgaaaccggggccgctgcgcgacgcgaagaacaagcggatcgagggtgacacgatcccggcccagctctggcgcgagttcacccggtcggcgctgcagggcgcgccggtcacgccgctgccggcaccggcgcacgtcgggcgcgccgacacgggcgacttcggcaagaccggccacggcggacacagccccgactcggtcaccgatctgcacgccgccgcggccggttacgagccggtcgtgcacaccgagcaccccggcaaacggctcgcgctgaccttcgacgacggcccgtccgactacaccccggcggtcctcgacctgctcgcccggtaccacgtcaaggcgacgttctgcatggtcggcgagaacgccggctggtatccgcagcaggtgcgccgcatcgtggccgacggccaccggctgtgcaaccactcgatgcaccacgacgacctgggcatcgtctcggaggccaagagtcgggcggacatcgccgagacggacgcggccatcgccgaggccgtcccgggcgcgacggtgacctactaccgcgccccgtacggcgacttcggcccctcggcgaaggccggcggcaaggccgggcacaccccgctgggctgggtcgtcgacccggacgactggacgctgcccggcgtcgacacgatcgtgtcgcggatccgggcgcagctgacaccgcgggcggtggtgctcgtccacgacggcggcggcgaccgcaagcagaccgtggaggcgctgcgcaaactgatcccgggcctgctcgccgaggggtggaccttcgacttcccggagacgacgatcacctcctcgccactgcccggcccgcacgccggcgccaccaccccggcgccgtccccgtcgtcggcgtcaccgtccgcatcggcttccccgtcaccgtccgcctcgacctcgccggtgcccgtccccacgccggcactcccggcgaagaccgacgcgccgcggccggacaccacgccgtga

SEQ ID NO: 6995 - DNA, 540 bp, Actinoplanes utahensis
gtgggatcatgccggcgtggtgattcagccggtcgaggctctcaagggtcggagttgagcatgtctcacgccgcggacgacacgatcgggagcgatccgttggcggtcatgacgttgtcctacctggatgatcccgagatcgcgttgcgtgcagacgacctcgaagccgaacatcgaacgaacacgtggcactacagtgtgccgaaccgctttgacctcaccgccgttgccgccgccctggaacatgtcgttcggcacctggcgaagcgacacggccccggcccgggcatcttctactgctggtacgacgaacaggctgggcagcttcgctgttcgttgacatccaagcccgcggacagtctcccgttcggtggtcgttaccgattgacgcccgaggtcaccgatgtacttcttcttgcggcctccgatgctcagccgggaaggatcccctggacggagctgaccgaggttcagaactcggccgatctgagccggcagaatccggatcccttccccgtgtgggccgccgctctgtcctga

SEQ ID NO: 6996 - DNA, 156 bp, Actinoplanes utahensis
gtggaggtgccgttcacccgggacgcgctgcgccggatgctcggcggggtcggggtgccgcacctggctgtccggctgggcctgcaggatccggagcacaccgccccgccgcacaccccgcggctggccaccgagcaggtcgtcgagatcgtctag

SEQ ID NO: 6997 - DNA, 651 bp, Actinoplanes utahensis
atgattcgcgtcttcctgctcgacgaccatgaggtcgtccggcgcggcctgatcgacctgctgcaggccgccggtgacatcgaggtggtcggtgagtccggttcggcccacgaggcggcggcccgcatcccggcgctgcggcccgacgtggcggtgctcgacgcccgcctgcccgacggcagcggcatcgacgtgtgccgggacgtgcgcgccgtcgactcgacgatcaaaggcctgatcctcacgtcgtacgaggatgacgaggcgctgttcgccgcgatcatggccggggcgtccggctacgtgctcaaacagatccgcggcaccgacctggtcgacgcggtccgccgggtggcgcagggccagtcgctgctcgacccggcggtcacccagcgggtactggagcggatccggcacggcgtggagcagccccgcgagctggccggcctcaccgaccaggaacgcaggatcctggagctgatcgccgagggcctgaccaaccgggacatcgccggccggatgttcctggcggagaagacggtgaagaactacgtgtccagcctgctggccaagctggggctggaacgccgcacccaggccgcggtgctggccacccgcctgctgggcgaccacccgcacggcggttcctag

SEQ ID NO: 6998 - DNA, 1716 bp, Actinoplanes utahensis
atgggtgatccgattgccggggacggaccgccgtcgctgggtttgagcccgctgtcgcgggtccgcctcgacgagctgctgcacgagatgctcgaccgggtcggcgaggtgatgtccagccgggagcggctgcgcgccctgctcgacgcggtcgtcggcatcggcagcgacctcgacctgcgcagcaccctgcaacgcatcgtcgaggcggcatgcgcgctggccggcgcccggtacggcgcactcggcgtgatcggcgccgaccgcacccagctcgccgacttcatcacgcacggcatcgacccggcggcgcacgcccggatcggcgacctgccgcacggccgcggcgtgctcggcctgctgatcaccgatccgaaaccggtgcggctgccggacatcacccggcaccccgactcgttcggcttcccgccgaaccacccgccgatgcacagcttcctcggcgtgccggtccgcacccgggaccagatcttcggcaacctgtacctcgccgagaagcagggcgccgccgagttcagcgaggacgacgaggagatcgtcgtcgccctggccgccgccgcgggcgtcgcgatcgacaacgcccgcctgttcgccgtcgcccagcgccgggcccgctggctcaccgcgaccgcggagatcaccagcgtgctgctcggcgacgtgcagcgcaccgatgcgctgcggctgatcgcccgccgggcccgcgagctgtccggctccgatctggtgatggtcctgctgcacgacgaggtgaccgggcggtacacggtcgaggtcgccgacggcgccgacccgggctgcgccactctcaccggcaggtcgctgctggtcgaggacacggccctggccgacctgggtcgggagacgtatcggcacgtgccgcgcctgccgacggtcgccgactggccggtcccggtgcccgacggtccggcgctggccgccccgctcagcggcaccgacatgctgcacggcgtgctgctcgtcgcccagcccagcgcccagccgctcggcgacgaggacgcggtgctgctggccagcttcgccggacaggcctcgctggccctgcagcgggcccgcgcccaggaggaacgcggtctgctgctggtcctggaggaccgtgagcggatcgcccgggacctgcacgacgtggtgatccagcggttgttcgccaccggcatgcagttgcaggccgcgatcgtccacgccacccgcccggaggtggcggaccggatcaacaccgcggtcaacgatctggacgcgacgatccgcgacatccgctcgtccatcttcgagctgcgcgccccggtgggtccgtcgctgcgggcggagctccgcgaggcggtgaccgcggcggccggcaccctcgggttcaccccggtgctcgacaccaccgggccgatcgacagtgtggtgcccgacgacgtcgttcccgagctgctcgccgtgctgcgcgaggcactgtcgaatgtcgcccggcacgcgcaggcgcgcagtgcccgggtcagcgtgcacgccggcaacacggaggtcacgctgcgggtggaggacgacgggatcggcttcgatccggcgcgggcccgcggtggcctggtcaacatggccgaccgtgccgacgacctgggcggcacgttcagcacggggccccgggcggacggcaccgggaccacggtgacctggcgggtcccgctcggcacttga

SEQ ID NO: 6999 - DNA, 987 bp, Actinoplanes utahensis
atggccacctacgacgacaccgacctgcaccgtgccgccgccgcgggcatccgcgcaccgtcgctgcacaacagccagccgtggcggttccggctggccggcggcgccatcgagatcctcgccgacccgtcccgccagctgcgggtcgccgattccgcgggctgggccgcccggctcgcgtgcggcgccgccacctacaacgcccggctggccctggccgtcgccggccgccccgccgacgtgctgctgaccgccgacagcgaccgccccgacctggtcgcccggctcacccccggccgggagcgcccgcccacatacgccgagcaggacctgcacgccgccatcacccgccggcacagccaccgcaacccgttctggcccgacccggtcccggccaccgcccggatccggctggtcgaggcggcccgcagcgaacacgcctggctcgacctgctggtcggcatggccgccctggccggcttcgcgcagatcgcgcacagcgccgaccgcgtcctgcgccgcgacaccgcgtaccaggccgaaatgatcgcctggaccgacgccggcagtgcccccgacggcatccccgcacacgccggcgccccgatcaccgaaccgcaggacctgctcccccagcgcatcctcagcgaccggcaccgcgcccccggccgcgactacgaacccgaaccgctgatcggcatcctcggcgtcgcgggcgaccgccgcctcgaccaggtcgtcgccggtcaggccctgcagaaggtgctgctcaccgccaccgccgccggcctggccacctcgctgatctcgcagccgatcgaggtgcccgccgcccgcgaccagctccgccgttccctgggccgcaccgggtacccccagctggccctgcgcgtcggttacggcaccaccaccggcccgctcaccgggcgccgcgacgtccccgaggtgctgaccggcgcgccggtcacgcaggcacagtcccggtag

SEQ ID NO: 7000 - DNA, 1179 bp, Actinoplanes utahensis
atgggcgcaatcgttacccgagcagctccgatcgggtcggggcacagttgcgggagtgacgcggcgacagccgccgccgagtcggtgctgcaggcactcggcggccgggtgccggccgccggtgacctcgtcatcgtctttccgaccttcgacctggagcccgcgatcgtccttgccgcggctgaggcggcggcgggcgatgccacggtggtcggctgctcgtcgttcgcatcgttcaccgaggccgagcacgtgtcggccggttgcaccgcggtctacgtcccggcccacggtgcgtcgttcggcgtggccgccggcgaaccgcttgccgatgacatcgccggggtcacccgccaggtggtggaatcggctcgcgcgaaagccggcgtacggcacccgcattcggtcctgatgatcctttccgacggtctcgccggcgaccagcgtgaggtgctgcgcggggcatacgcggtcgccggcgccacggtgcccatcgtcggcggcgcggcggcagaaccgttgcggatggccaggacgtaccagctcggcgagggccgcgtgctgcacaacggggtggtcgccgtgtggatcaactcgcccgttccgctcggtgtggcggtccagcacggctggcggcccactggcgagcccatgatcgtcacgcgcgcggagggcaacgtgatccgcgagatcgacggccggccggcccgcgaggcgtacctcgcgatgcgtggctgcggtaccggtgaggacaccggcatgtccttcgcgggtctcgtgatggaccggcccctgggattgccgaacgcctccgggcggttcgacgtgcgccacatcctggactgcaccccggacggtggtctcgtcatgttcggctacgtcagtgactatgcggtcgtacaggtcatggagagcagtttcgaggagctcatcgacgcggcccggcaggcgaccgccgaggcggtcggccagcttgccgggtcaccgaggggcgcgctcgtgttcagctgcaccgcgcgcaccgccctgttcagtgagcgggtcggtgccgaagccggtgcggtgcgagcagcgttggccggggcgcaggccggtggtctgttcacctacggggagttcgcgagggtctccggctcctccggtttccacaacgcaacggtctcggtgctggcgttctga

SEQ ID NO: 7001 - DNA, 1479 bp, Actinoplanes utahensis
atgaccgacaccatcccggcggacgttgtaccggcagactccgcggagctggcccgactgcaggaggaggtccggcagctgcgcacacagatcgccgcctcgcacgccacctccgcacgtgcgttatcgcgagccacccgcctggcacaggtggtgagcgtgctcggccagctggccgatgtcgacgacatcttcgctcgcgccgccggcgaggtggccgagctgttcaacgccgatgtcgcgctcttctggctggtcacggaccatggcgtggagctgtccggctgctggggaatcccggcacatgatctgcccgccaacgccgctgagctgccgcccgacctggcggccacgcgacgcggcgagacggtgacggccggtccggccggccaggtgccgttgcctgcctggctcaaccgtgacggcgtccagcacgccgcctgggcgcgccttgccagtggcgcggagaacctgggctacatgctgctgatacgtcattccgaatcgccgttcgacgcagccgactccctcgagttgcgcgcagtggccagccgggtggcgctcgccgtcgacaacacgcgcctgcagcggcgtacccgcatgcagctggagcggctgcgccgcctgcatgatctcacctcgaatctggtcggcatgctcgatcttgatgaagtcctgcacgcggtcgcccggatgacgatcgccgaggttccggtggacgacgtgacgatcgccctgcacggggatcacccggagccgatctcggcgtccgccgggaaggtcctcccgagtgccgcggaccaggccgatggtccggacaccaccgcactgcgcctccacgccggcggccgtgaggtcggaactctgacggtgcacggagcgccgccggccggcggtgaggccgacgcgctgctacgccacctggcagatctggccgcgctggtgatctcgaaggcgttgctgttccagcgggtcagagaacaggcggaacacgacacgctgacccggctggcgaaccgtgccctgttcatggaacgcctggagcaggcggtggtcgatgccgaacgcaccggcggcacggtcggagtgatcttcgcggatctcgacaagttcaaagcggtcaacgatacgtacggccatgacgtcggtgacgcgttgctcgtcgccatggccgcacggctgtccgcggccgccggtcctgcccacctggtcgcgcggctgggcggcgacgagttcgtggtcctctgcgcgccgctgaccgatccggcggaggcgcgcgccgtcgccgatcggctggggcgcgtgctggaggcgcccttcgagctgggcggcacccgcctgccggccggtgccagtttcgggctggcgaccaccggcgaggccggctacgacccggaggcgctgctccgcgctgcggatgaggccatgtacaccgccaaggccgctgcccgtaccgcggcgaaccgggcagaaccctga

SEQ ID NO: 7002 - DNA, 741 bp, Actinoplanes utahensis
atggtgtggctggaggatgcggagctgtcgccgggggcggcggggccgttcgatcggtggctgacgccgcggcgggagttgttctggcgggtcggtgaccgggcgatcgatgggccggtcgccaagctcggcgggcagccgttctggctggatgagccgttctggccggtgtccgggacgtccggtgcggcgatgacgttcgtggggcagttcccgctgccggggccggatacccggatggcctacctgttcctcagcgacgaggacggcaccttcctggcggagggttgggagaacgcgctgctggtccagccgggcgggcgggtgccggggttcgtgcggggggaggcgcgccggagcgggccgtcgttgtggcggcggggggcgtcgtgggaggaccgcgtaccggctgaattgtctcttgatcttcgtgatccggatccggccgacgcggcggcgttcgagcgggcggcggcgttccagcgggcggcccggggtgggctgccggagcctgacgacgacgcgtacgtggagtggcgcagctacgtggggggcgagccgatcctctggcagccgtggacgtccgaggtgctggacgacagctggcggttcttcttccagctggacgggtcggacggctggggtggcaatccgttcacgctgaacttcggcggcgggaccggatacgcgttcctcagtgaggacctgcgggaggggcgcttctactgggactgtgtctga

SEQ ID NO: 7003 - DNA, 1353 bp, Actinoplanes utahensis
atgagcactgacgccgacgccgcgctgttcggcaaccggttcgtgacgcaggaggtgccgagccggacgtttccggacgagggtatgacggccaccgacgccttccggctggtcgccgaggagatggcgctggagggcgacccggcccggaacctggccaccttcgtcacgacctggatggagccggaggcgcagcgcctgatcgccgccaacctgcaccgcaacttcatcgaccacgccgagtatccgctcaccgcggagatcgagcagcgctgcatccggatgatcgccgacctcttccacgctccgggcgagacgaccggcgcgcgcacccagggctcctccgaagcgatcatgctggccggtctgtcgctcaagtggaactggcgcaagcggcgtggtgacaccggttccccgaacctggtcttcggcggcgacgtccacgtggtgtgggagaagttctgccggtatttcgacgtggagccgcggatcgtgccgctgcggcccggcaggtacacgatcgggccggaggatgtcgaaccccacctcgacgagaacacgatcggagtcgcggccgtgctggggacgacgttcaccgggcacaaggacgacatcgccggcctcaaccatctgctgctacggatcagaggcgagcgcggcctggacgtgccgctgcacgtcgacgccgccagcggcggtttcgtgtggccgttcctctacccggactcgccgtgggacttccgcctcgaacaggtgcgctcgatcaacgtatccgggcacaagttcggtctggtctatccgggcatcggctggctgatcttccgggaacgggcggatctggccgaggacctcgtcttcgaggagaactatctcggcaagaccgacaagacgttcaccctcaacttctccacgggatccgcgatggtcctcgcccagtactacaacctggtccgctacggccgtgccggataccgatacatcatggcgaacatgcgggccaacgcccgtacgctcggcgagaagctggcggcgatgaaccgcttcgagctgatcggtgcggaccaggagcagcttccgctggtggcgttccgcctggccgccgacaacggatacgacgagttcgacctggcgtggcagttgtccgccgaacgcggctggatggtgcccgcctacaccctgccgccgaacgcccaacacgtgacgatcatgcgggcgctggtcaaggagaccatgacccgtcaacatgtcgacctgctcgccgaggacatcgacgacgcctgcgccacgttggacaacaagggcggcgcccacgagtccgaacgccgcagaatcatcaccggtccgggccactga

SEQ ID NO: 7004 - DNA, 597 bp, Actinoplanes utahensis
atgaccgccgccggcgtagtggacaccgccgcgctgtcgatgttgtgggacgaccggtggcccggctgttcgaagctgccttacgagcttcgcgatgtcagagaccggtggatacggtttcacactctgcccggatccaagcgctatcccggatcggatgccgagtacgagatggtcctcgcccggcacaacaacatccttgacgagttggtgaccggcccgacggtcctggtggccactgccggttattccgacaccgcacagccacagcaaccatgccggtcaccggagaccctggccgtgcacccacgcgccgtgtattggacgagcgtctgcatcgacgacgagccggggttcgagagctggatgcacctgtacgtcagccggctgtcctggtcggtagggtgcctggatccgttgttgcgtcgggtcgctgacgatgtgatcgccaacgtgctggtcgcggatcccggcttgcgatggctgtatcacccctatgacggcggcatggacgtcatgctgtccaccacggccgagcgtgacgctctccgggaccggcatcaggactggttgtcttcgcacccgggcggcttgtga

SEQ ID NO: 7005 - DNA, 531 bp, Actinoplanes utahensis
atgatccggattcgattcgccggaatcgccgtggcggccgccgcggtgtgcggtgcggcggcctggacggtcaccgggtcaccctcctccttcgcgggctcgccggcatctttcgtcagcccgtcggcctccttcgccggctcgccggacccggtcggtgacgtgcccggggccgccgcccagtccgcttctccgcagcgccgggaggagaacacctcccgctccggatcgggcgcccggccccggccgcacggggcacccgcgccgttcgtgcagcagttcgcggcccagcccgggcgggcccgggtccgcccgcagaagtcgccgaagacgccggtcaaggtggcgccgacggtcgacggctgtgaccggaactatgggacgcaggcgcagtgcatcccgctggtctacccgaccggggtcaccgatcactgtgcctggctcgcggcccacggtttcacccacatcaaggtggtgggcaaggaccggcagaagctcgacgcggacggcaacggcaccgcctgcggctga

SEQ ID NO: 7006 - DNA, 2094 bp, Actinoplanes utahensis
gtgacccacccgcaccgtccactgatgagccggcgcaaccggctccgcatcgcccagctgatagttctggccctggcgctcttcgtcggcctgcctcagctgccggccggcgccagcgccaacctggtcggcaaccccggcctggaagctctggacagcaccggcttcccggtctgctgggagaagtccggctggggctccagcggctacagcttcgccgtctcgcacaccgcgcacagcggcgccaacgccatgcagatcagcatcagctcggccggctccggcgaccgcaaggcgatgatgctcgaagacacctcgtgcgcgcccaacgtcacgccgggccaccagtacgatctgtccgcctggtaccagaccagcaccgcgaacaccgtgatgacgatgttccggcacgacgtcgcacagggctgggtgtactggaccgacctggccaccctgccggtgaccaccgcctggacccagaagaccgtgcgcaccccgcaggtgccggccaacaccgaccagatcgtctgggggatcaccatctacggcgtcggcaccctgctgaccgacgactaccagatgaacgacgccacccagcccgccccggaacagtcctgcagcgccggcgccgcctgcacccagggcacctgggcggtgatgccgttcaactcgccggtccgcagcatccactcggtggtgctgcgcaacggggacgtgctgctggtcgccggctccggcaacaacccggacgacttcgcggccaagaccttcaagaccgccgtctaccacccgtcgaacggcaccttcaccacggtggccaccccggccgacctgttctgctccgggcacgtgcaactgcccgacggccgggtgctggtgatgggcggcaacaaggactatccggccgccgacggcagccacggctacgaaggattgaagacctcgtacgtcttcgacccggccaccaacgcctacacccgggtcaacgacatgacctccggatcgtggtacccgtcggccaccgagatgggcaacggcgacatcatctcgctcggcggcctcggcgaggactcctccggcacggtcgccacccagtacttcgccaccgcccaacagcgctggctcggactcaacgaggcacaccagagctggaacttctggggcctgtacccgtcgatgatcctgatgcaggacggccggctcttctacaccggcagccacgtcttcggcaacggcctgcccggcaccggctcgtcgatctacaactacaccgccaacaccatcaccccggtcgacggcctgcgccagaaggaccagcgcgaccagtcgatgagcgtgctgctgccgcccgcccaggaccagaaggtgctgaccatgggcggcggcaacatcgagaccaacccggacgcgcaccggctcaccgacctgatcgacctcaagcaggccaacccggtctacacggccggcccggcactgcccgggggcaccctcaccggcggcgtcccggagaccggcacccagggcaagatgtacgtctccgcggtgctgctgcccgacggcaaggtcttcgagaccggcggcggcctgcacaaccgcgccgacccggtgtacgaggcgtcgatgtacaacccggccaccaacaccttcacccccggcatggccaccgacccggtgccgcgcacctaccactcgtcggcgttcctgctgcccgacggccgggtcatggcggtcggcgacaaccccggcaacggcaccttcgacatgcggatctcggtgtactccccgccctacctggccaacggcgcgcgcccgcacatcaccgcgatgcccgacacccagtgggcgtacggcacctcgcacacgatcaccgtcgacgcgccgatcctcaaggccgaactgatccgcccggccgcggtgacccactccagcgacccgaaccagcggttcgtcgacctgccgatgacggtcaccggcaacaccatcggcctgaacctgaccagcaacccgaacctggcgccgcccggctggtacatgctgttcgcggtcggcaccaacggagtcccctcagtcgcgaagtgggtgcatgtcggatga

SEQ ID NO: 7007 - DNA, 906 bp, Actinoplanes utahensis
atgacccccggctcccgggcccgcgccatcgtcacccccggttccccgatccgggccatcgtcacccccggttccccgatccgggccaccgtcacacccggcgacaagaccgtcccgctcgaccggtatcgcaagcccgggcggacccgggccgtgctgcccggcgagatcggcgtgcccggcgcccgcaccgcactgcggcagagcatcatcgtgccgacgtacaacgagcgggacaacgtgcacgcgctgctcgaccggctcgccgcggcactgccgcacaccgagacggagatcgtcttcgtcgacgacagcaccgacgacaccgtggccctcctgcgcgacctggcccgcacctacccgatgccgatcaccgtgcaccaccgcgacgacggtgcgggcggcctcggcggcgcggtggtcgagggcatgcggatcgcccgcggcgaatggatcgtggtgatggacgccgatctgcagcatccgccggaaatcgtgcccgacctgatcgcggccgggatgcgcgacggggccgacctggtggtcggctcccggtacaccgccggcggcagcaccgggggactggccgacggataccgcaaactggtgtcccgcgggtcgacgctgctggtgaagaccctcttccggaacagcctgctggcggtcagcgacccgatgagcgggctgttcgcgatccgggccagctcgctcgacgcggggcggctgcggccgctcggatacaagatcctgctcgaactcatcgtgcgcaaccggccgggacgcgtcgtggaggtgccctacaccttccaggcccggttcgccggcgaatccaagtcgaccgtgtccgagggcctgcggttcctcaaacacgtcggtcggctgcgactgggcggccggccccgatga

SEQ ID NO: 7008 - DNA, 1569 bp, Actinoplanes utahensis
gtgagtcttctcctggacgcggctgacgaccgtacccaagcaatcgccaccgcaaccgaacaacccgcccggcggcgacgccgcggccgcaaccccgagacctacctgatggtgacggtgaccgcgctgatcctcacggtctacgcgctcaacatcaccggcttccccggcgccagcgacgacgagggcacctacctcgcgcaggcctgggcggtggcgcacggccggggcctggcgcactacacctactggtacgaccatccgccgctggcgtggatccagctcgccgcgctgtcctggctgcccggcgtgttcggggtgcacagcccggccgtggccgccgggcggatcgccatgctccccgtgatcgcggccagcctgatgctggtctacacgatctgccggcggatggggatggccgtctggtcggccaccgccgcactgctcatcttcggactgtccccgctggccgtcaccatggaccgggagatctacctggacagtttcgcggtcgcctggatgctcggcgcgctcgccctcgtcctctccccgcgccggcacctgtggcacgtcaccgcggccggcgcggccaccgcgatcgccgtgctcagcaaggagaccatgctggtcaccctgcccgcggtgctggtcgcgctctggcagaacgcggcgcgcagttcgacccggccgtgggcgatcggcggttacgccagcgggctggtgctggtcggcgcgttctatccgctgtacgccctgctgcgcggcgaactgttccccggacccgggcacgtctcgctgatcggtgcctggcagttccagctggccaaccgctcgggctcgggcagcatcttcaccaccggatccggcgccaaccagctgctgcactcgtggttgttctacgaccccatcattctgatcgccggcctggtcgcgaccgttgcgatcgtggcggtacgtcgtctgcggccgcccgccgtggccggactgatcctgaccctcgtggcgctgcggcccggcggctacctgccggccatgtacgtggtgcagatcctgccgttcttcgcgatcgccatcgccggcgccctcgaccagctcgcggtgctggcgccgcggcgctggatccggccggccgccctggccgtactcgcgctgctcgccgcggtcctggtggtgccgcgctggtggaccgggaacgagcgggcgctgaccgccgaggacaacgcggggtacgcggcggccgccgactacctgcgcaccgcggtgctggaccgggcgcacaccaccgtggtcgtcgacgacgtgctgtggctcgactgcgtgcgcgccggatatcagcagcagaaggtgatctggttctacaagctcgacctggacccggcggtgaaggccaccctgccgcacggatggcacgacgtggactacatcgtctccaccccggcactgcggcaggacccgagcgcgctgccgaccgtgaacaccctgctgacccactcgacagtggtcgccgggttcggcccggacggcggccggatcgaggtccgccggatcaaccgacaggagaactcatga

SEQ ID NO: 7009 - DNA, 1272 bp, Actinoplanes utahensis
ttggctgccgccgtcatgatttcaatttccgtcgtgctctccgtattcgccgcggtgacgctgtggtggaccatgcacgcctggcgtacgccggagacgctggccgccacccggttcgaggagccggacggcgatcaccgggtcaccttctcgctgctcgtcccggcccgccacgaacaggccgtgctggaacacacggtggagcggctgctgcgctccacccaccagggctacgagatcatcctgatcatcgggcacgacgacccggagacggccgcggtggcccaccgggtcgcggcgagcgcgccggaccggatcctggtggtcaccgaccacaacgaggtgaagaacaagccgcgggcgctgaacaccgcgctgccgtacgtacgcggtgacgtggtcggcgtcttcgacgccgaggaccaggtccaccccgacctgctggaacacgtcgaccacgcgttccgggccaccggcgccgacgtggtgcagggcggcgtgcagctgatcaacttccactccagctggtacagcctgcacaactgcctggagtacttcttctggttccgcagccggctgcacctgcacgccgacaaggggttcatcccgctcggcggcaacaccgtgttcgtccgcaccgacgtgctgcgcaccgccaacggctgggacggcacctgcctggccgaggactgcgacctcggggtacggctgtccagccggggcgccaaggtggtcgtcgcctacgaggcgtcgctggtcacccgggaggagacgcccgactcgatcggcagcctgctcaagcagcgcacccggtggaaccagggcttcctgcaggtgctgcgcaagggggagtggcgccggctaccgtcgttccggcagcggctgctcgcccgctacaccctcaccggcccgttcctgcaggcgttctccggcctggccatcccggtcggggtgggcgcggcgctctgggcggacctgccggtcggcatcgccctggccaccttcgtgccggtggtgccgatgctggccaacatcgtgttccagaccgtcgggctgcgcgacttcggcctgcagtacaacctcaggatcggcttccggcactatgcctggctgaccctcggcgccttcccgtacgcgttggtcctgagcgtggcggcgctgcgcgcggtgtggcgtgagtacaccggccggcgcaactgggagctgaccgcgcacgtcggcgcccacctgcacggcaatgccacgcccgccgaggccggtgccgcggcgtga

SEQ ID NO: 7010 - DNA, 1014 bp, Actinoplanes utahensis
atgcctaccgaagacgacctgaggactgccatgaacgagatggcccgctccaccgatccactcccgcccaccggtgtgctgcacctcgcgcaccgccggcggacgcgccggcgactggccgtcgtcacggcggccgccgcggcggtgctggccgtgccggtcgcgatcaccgtgctcggcccggaccatcgggcggaccgcccggccgccgggaccgccctgcccggcgacgcccggcaggcgctgcgcgactcggtgaccgccctggccgccggcgattacaccttcacccgcagcggcgccagcgacgtcgccgacatccggcagggcgtcgtgcacctgcccgacagcgtgctgatcgagcactccgacaccttcgcgatggcgcgcgtgggcccgcacttctacctgaaatacctgctcgacgcgaacccggagctgcgcgcccagcttctcgggtattaccgcaaacatctcagcggcgcccagctgcgctcggtggagcagagctacgcccgactcgacggcgagcactgggtcgccgccgacgagaagaaactgatcgcggctgccgccatcgaggagcagagcggcctggactccatggcccggctgcccgacgcccggcggcccgacgccaccggagccgggacgctgattgccgcggtgaccagcgcccagcgatccggcaccgtgatcaccgggacgctggacgccaccggcaaggatccggagctgcagaagctgttcaacgacccgacctacctgtacggcgtcggcgccaaagcgatgccctaccgggccgtgctggacgatcagggccggctcaccgagttcaccgtgtcgatgcccgaccagcggatggcctcgcagccggccgagccgatcaccccacagccgcccctggtcatccggatctcgcggtacggccagaccggcgtgcagccggccccggcgaccagcggtgaggtcaccgcccaggactacgagctgctctccaccgacacggactga

SEQ ID NO: 7011 - DNA, 603 bp, Actinoplanes utahensis
atgccaacgcgatcggccggcgggtctgtcaacctttcgcccggccatgccgtcttagtgatcatgagagtcagacaacgccgccataccgacgagacgttcagcgccttcgtggcggcgcgctccggtcggctcatcgcgcacgccgaactgctgtgcggccaccatgagcaggcgcgcgacatcgtgcagtcggccctggtccgcgcctaccgccggtggcagcacatcgagcaggacgatccctacgggtatctgcaccgggcggtgaccaacgcggtcatcgactggtggcgcaccgcgcaccagcgtcacgagcagccggtcgacgtgctgcccgacctgccgccggtgatggagaacacggtcgaggaccgccactcgctcctggccgccctggacgctctcgccccccgggaacgcgccgtcgtggtgttgcgctacctggacgactacacggagcgggagacagcggaggcgctcggcgtcaccctcggcacggtgaagtcgacctgtttccgcgcgctgcgcaagctccgggtcagcttcgccgacccggcgtccggcgagagcctcaccgagcacaccgaccaccggccctga

SEQ ID NO: 7012 - DNA, 189 bp, Actinoplanes utahensis
ttggcatgtttccgggattcgccgggcgcggccggtcggcatgctcatggacatcacacgcatcacgggatgcgggatcgtcctccgggggagaaaaagatcgtgaacgttcgtacgccgctcgtcgtcgccgccgtcgtcaccgccgccgccctcaccggctgctccagcaccgcgaccactagctag

SEQ ID NO: 7013 - DNA, 204 bp, Actinoplanes utahensis
gtgctggcgccgaccgacacgctgaccgagatcacctgctaccagggttacgcgctggcgctgacccacccgaaggaggccgacaacgcccgggcggtcttccactacaccggtggcgcgtggcacggcatcggcggcggcacctccgactactgcgagggcatcgtcccggccgccgtccagccgcacctcaagcactgctga

SEQ ID NO: 7014 - DNA, 600 bp, Actinoplanes utahensis
atgtggattccctcggatgccgagatccggcagttgcacgagcgcgtggcccccactccggaggcgttcgacctggtgtggacgcactgcgaaatcgtctgccggatcgccgagcagctgatggcgcgccgcgagctcggggtggatccggatctggtccgggccggctgcctgctgcacgacatcggggtctaccggctgtacgggcgggacggggtgctcgactacccgaactacatccggcacgggctgctcgggcatcaactcctcgaggcgcagggctggccggactacctgtgccgattctgttcctgccacaccggcgtcggggtgacccgggcggacgtgctcgaccaggggttgccgctgccgccgggcgactatgtggccgagacgccggaggagaccctggtcatgtacgccgacaagttccacagcaagaagaacccgccggtgttcgtgtcggcggcggcctacacggtcagcgtcgcccgcttcgggccgggcaaggcgcagcggttcggcgagatggtcaccgcgtacggcgaaccggatctgctgcccctggcgaccggatacgggcaccggctcaccgcgtga

SEQ ID NO: 7015 - DNA, 738 bp, Actinoplanes utahensis
atgtccgcgaatcattccaggcggccatgggtgtccccggaccggatccggcgcgaatgtggggtgggactaccgatgcgccggccccggccgggccggagggtggtgagcggcgcgcaggacccggcggccacgaggtggggagagaccgtggagacgttgcaggcacatctgttcgggcgcgacatcgacgggctggccgccctgctggtgcgggccggcgtccgggtcaccccgctgcgggacgagccgcaggcgaccgtggtggtcagcggggccaccgtcgccgaggccctcgacgcctgcccggagacgtaccgcaagcagcggttcggcctgctcgtcgtggcggagtcgctcgacgccgccggggtgcggcacgggttccgggccggggtgcgcgcgatgctgccgcgggccggggtgactccggaccggctggccgcggccctgcattccgccggccagggtgaccggcggataccctacccggcgatggtcaagctgctcgccggcgcggcgccggcaccacgggagctgtcggccgagccgctgaccccgcagcaggcccgggtgctacggatgatcgccgaggggcagagcaacgccgccatcgcccgggacctggcctgctcggagcacaccgtgaagaacgccgtgtacgacctgatggcccggctgcatgtgaacaaccgggcgcacgcggtggcccgcggcatccggaccgggctgatctga

SEQ ID NO: 7016 - DNA, 585 bp, Actinoplanes utahensis
gtgaatgtcagtgtcatcgcgctggatcctgtgctcgaagccggcacgcgcagcgcgctgagcgatcgtcccggcgtggcggtggtgggcgtgggggtgcccgccgcggtcaccatcgtgatcgtcgacgaggtcgacgagcaggtgctggacctggtccggctgacccgggcggcgccgcaccggcccgaggtggtggtggtcgccacggaggtggcgcagccgcaggccctgcacgccatcgcctccggggcccgcggcctgctgcgccggcgggaggcgagcgcggcgcggctgacccgggccgtgctggccgcggcgagcggcgactgcaccgtaccgcccgatctgctcgacgatctgctggacacgggcgcgcgcggcccggcggtcgccgggctgaccgaccgggaacgggcggtgctgcggctggtcgccgacggccgggagaccggcgacatcgcccggacactgtcctactcgccgcgcacggtgaccagcatcgtgcacgacatcacccagcggtaccggctgcgcaaccgggcgcacgccgtcgcgtacgccatgcgggtcggtctgctgtga

SEQ ID NO: 7017 - DNA, 1299 bp, Actinoplanes utahensis
atggcgatcgcacccgtcacccggcaggtcaagagggcatccgacttctcggtcttcgaagatctcgagtccgacgtccggatctactgtcgcaagttccccgcggtcttccaccgggcgaagggcgcggagctctacgccgaggacggccggatgttcatcgacttcttcggcggcgccggcacgatgaactacggccacaacaacgagtacatcaagagccgggtgaccggatacctggccggcgacgggctgatgcacggcctggacatgcacaccgtcgccaaacgggagttcctgtcggccttcgccgagctcgtgctgcgcccccgcgacctcgactacaaggtgcagttctgcggcccgaccggcaccgacgcggtggaggcggcgctcaagctggcccgcaaggccaccgggcgcaccggtctgatcgcgttcaccggcgcctaccacgggatgtcgcgcggctcgctcggcgtcaccggcgggttgcgggcccgccgggccggcggcgtcaccgcgcaggacgtcaccttcatcccgtacgaggacggaccgcacggcgccttcgacggggtcgcgctgctcgaacgcctgctcgacgatccgtcgtcgggggtggcccggccggccgcggtcatcgtcgaaccgatgcagatggagggtgggatgtatccggcctccccggactggttgcgccggctgcgcgcggtcaccgagaagtacggtgtgctgctcatcctcgacgagatccaggcgggttgcgggcgtaccggcacgttcttctgtttcgagcgggccgggatcgtgcccgacgtcgtcaccgtctccaaggccatcggcggttacggcctcccgctgtcgatgaccctgttccggcgggagctcgacgcctgggagccgggcgagcacaccgggaccttccgcggcaaccagctcgccttcgtcgccgccaccgccgcctgcgaactgtggcagcagacccagttccgcaccgacgtggtggccgcggcccggcggctggagcggttcggcgcggagatcgcgcggacgcatccgggcgtcgcggtccgcgggctcggcacggcgctcggcatcgacctcggccgcgacggcggcggcggcggtccggagcgggccgcgctcgtccagcggtacgcgttcgaccacggcgtgctggtcgaactgtgcggccgccacgacgaggtcgtcaagatcctgccaccgctgaacatcgacatcccccggctcgaccgcggcctggacgtgctgcgcgacgccctcggcacggtgtga

SEQ ID NO: 7018 - DNA, 900 bp, Actinoplanes utahensis
atgcgcacgcgacggcacctcatctcgatcgacgacctcagcgacgaggacctgcgctggatcgtgcgccgcggcgcggagtacagcgcgggcaccgcgggcggcggccgcccgctcgacggcgacatcgtcggtgtgctgttccgcaacacgtccacccggacccggaccgcgttctcggcggcggcgctgcgactcggcgggcggctcatcacgtacgggccgcaggatctgcaggagaacaccggcgagaccgcgggcgacaccggcgcggtgctgtcccggatgctcgacgtgctggtggtgcgcaccgccggcggggacgccgagctgcgggcgtacgcggcgtcgcggcggatggccgtgatcaacgcgatgagtgccagcgagcacccgacccaggcgctgaccgatctgaccacgctcacccgccacttcggtggcgtcgacggactgcgcgtgctctacgtcggcgagggcaacaacaccgcgtcggcgctgtgcctggcgctgtcccggttccccggcaccgagctgcacctgcggacgccgccgggcttcggcgtcgaccggtcgttcctggaccgcgccggctcccgggtcgtccagcgccacgacatgaccgacctgccgaaggtcgacgtcgtctacaccacccgatggcagaccaccggcaccaccaaaccggtgccgaactggcgcgagctgttcgcgccgttccaggccgacgatgcggtgatggcggccaccggcgccggcgtcttcctgcacgacctgcccgcgcaccgtggcgaggaggtcaccgccgagttgctcgacgggccgcagagcatcgccttcgagcaggccgagaacaagtaccacagtgcccgggcggtgctggaatggtgctcccggtga

SEQ ID NO: 7019 - DNA, 1227 bp, Actinoplanes utahensis
atggtgctcccggtgagccgcgccggcgcgcgggccgcgatgtacaccgccggcggcatctcctcgttcggcacccagatgaccatgctggcgctgccctggctggtgctggagacgaccggttcggcggcccggaccggcgtggtctacgccgtgcaggtgcttccgctggcgctgctcggcttcgccggtggcggcgtgctgcagcggctgggcgcacggcgcaccatgctgctgggcgacgcgttgcgggcgccgctggtggccgccgtcccgatcctgcacgcggccggcgcgctgagcttcgggctgctgctcaccctggtcgcggtggtcggcgtgtgcggcgtcccgtacgcggccgcccagcgggtgctggcgatggacctgatcggtgcctcgccgggcgcgctgacccgggcctacggcgtgctggacggcgtctacaacgcggcggcgctgggcggtcccgcggtggcgggcacgctgatcgccgtggccggcgccgccgacgtgctgtggatcgacgccgcctcgttcgcggtctccttcctgctcctgctgaccctggtgccgggcggcgccggccgggccgcggcggccggccgggatcgcggcacctgggcggggctgcgctatctgcgcagcgaccgggtcctcggccaggcggtgctctcgacggtgctgttcggcctggtgctgcgggtgctggcgttgagcctgccgctgctggcgtacacccggttcggtcacgacgcccgggccgggggcctgctggtcgccggctccggtgcgggcgcgctgatcggctcgctggtcacctacctggtgtccacccgggtggagccggtgcgcctggcccgcgccgccatggtgatgatcgccctgccgctgtggttcctgctctggcccgccccgcccgccgcgctggtggtggcggtcgccgtgtcgtcggcggcggtgaccgtctcgaacgccccctacgccgcgatcgtgagcacccgggcaccggccggcgtgctgccggccgtggtccagacggtgatcacgatcagtaccctcgccgggccgctgggcctgctgctggccggggtgctgaccgaccgcgccggcatcggcgtggtcctgctcgccgtcgccggcaccgccacgatcgccgccgtcaacgtgctggtcgcgctctcccgcctgcggcccgctccggaaaggacgctgggacatgtctga

SEQ ID NO: 7020 - DNA, 2304 bp, Actinoplanes utahensis
atgtctgaccaagtgcatctggccggtggctggcggctgtggagccagttcgcgctgcgcgggcccggtttcccggccgacggcgtactgcggctggctcccgccggtctcgccgccgcggccgacaaggccgcccaggcgccgccggccggcccggagtgggcggacttcaccggactctacgatgcggccgcggtcgccaccgcgctggagctgcagcgggtcgcggcgctgccggccttccaggccgccgtcgcctggcagaaccgggccgtgctcggcaccgggatccgccccttcctggcctggcagccgagtgcggccgggcggaccagcatgccgcgccagcgggaggagctcgtcgcccactactggcagcggttctgcgtcaagaacgacaccatcggcttcttcggcccggtcgggtggggccggatcgaccgcacggtgccgggcgtcgtggtcgaccccggcgaccggttcctggcggcgtccgaggtgtacttctccagctgggcgatcgacgcggtggccaagaccgtcgaacagattccgggcctgcgcgagcacgtcgccccgcgccgcgtctcctacgcccggatcggcgcggacaccgtcacggtcgccggcagccccgcccagccgatcgacgccgaggcccggcggatcctcgccctgtgtgacggcgcccggctgccggccgagatcgccgcggcgaccggccggcccgccggtgaggtgctggacgtgctggacgtgctggcccgccgccgctggatcgtgtggcgcctggagatccccgccgacacccacccggaccgctggctgcgggccaccctggcgcgcatcgccgacccccggatccggcaggacgccctgtcccggctggcggtcgtggagcgcggccgggaccgggtgcgggcggcgggccgcgacccggccgcgctgctggacgccttcgaccgcatggagacggcgttcgccgagctgaccgcgacggccgcccagcgggagaagggtgcgcggacggcaccgtgccgggcactgacgtatgccgacacccggcgcgccgcgaccgtccgggtgggcgcggccgtgctggccgagctcaccccgctgagcttctgcctgaccgcggcccgttggctggtccaccggttcgccgaggtcgccgagggccggatccgggaacggttcgagacactgcgcgccgagctgggcaccgtggatctcgcctcgctgtggatgcggtgcatccccaacccgtacgccggagcccccgacgacgccgaggagatccgccgggagctccagcgacgctgggccgcgatcatcgacgcgccgcccggcgcccgccgggtgcggctgcgcgccgccgacatcgccgaccgggtcgccgccgccttcgacgagcccggccgcggctgggccctcgcccgctacgcgagtcccgacgtgttcgtgctggccgacagcgccgaggcggtggcccggggggacttcgagctggtgctgggcgagatgcacgtgggcaccaacaccctgacccagtcgctgttcgtcatgcagcacccggacgcggcggagctgatcgccgagaccgacaccgacttccccggcccgcggctgatgccgatgctgcccaaggagtccaaggcactgcgctggtcgacccgcagccgaccggccctgatccggccggcggactacctggtcggcgtggtcgaccacaccgccgacccgcatcggccgcgcaccctcgccggggccgacgtcctggtcgaggagcgcgacggcacgctggaagcggtcctgcccggcggcgagcggttccccctgctcgacgtgttcggcaacgcgctgaccaaccaggtcatgaaccggttcgccgtgcagcccgacgagggacacaccccccgggtcacggtcgaccggatggtgctctcccgggagacctggcggctgcccgcggacaccctgcgattcgcggccgagaagtccgaggccgcccgcttcgtggccgcccgggcgtggcgggagcaccagggcctgccccggttcgccttcgtcgtgtcaccggccgagccacggccgttctacgtggacttcgacagcccggtctacgtgagcatcctggccaaggcgatccgccggctcagcagggccgacccggtggccgtgctgaccgtcagcgagatgctgcccacccccgagcaggcctggctcaccgacgaccagggcgcccgctactgcagcgaactgcggttcgtggcggtcgaccagagcaccggaggcccgcgatga

SEQ ID NO: 7021 - DNA, 1455 bp, Actinoplanes utahensis
atgatgcccaccttcgtatccgagctgccggacggcgacactccggcgctcatcacccccggcggcagcctcagccgccgcgacctgcaccaccgctcccgggccctggcctgggcgctcgccgcccggcaggccggcccggagaagatctgcgtcgtcgccctggcggacggcgtcgaccggatcgtcgcggtcaccgcgaccgtgcgcaccggggcggcgttcctgatcgtcgacaccgacctgcccgaccagcggctcgccgccctggcccgcggcgcggacctgacgatcaccagcgcggccctggcgccccggctcgccgccctcggcctgcccgggccggccgtcctggtcgacgacacccatcccgagctgcccctgcccacccgggtggcgccgcgctcgctggcctatgtcagccacacctccggctcgaccggcacccccaacgcggtcctgatcgaacaccgctggatgcatccctacctgcgcggcatcgtgcgcgactacgacctcggcccggacacggtggccgtgcagctcgccccgcccggcttcgacgccgccctgcgcgacacctatgccccgctggtcgccggcggccgcctggtggtcctgccgcgcgccacgctgctgcggccggcgcagttcttcgcggccctggccgaacacggggtcaacagcatgctcagcgtcacgccctcgttcctcaccttcctgctcggacagccgggcgccgagcaggccctgcgcggtctgcggctggtcgcgacgaccggcgagccgatccgtccgttcctgctcgccggcggacgccggctgatcgccggacggctgatcaaccagtacgggccgaccgagtgcacgatgaccaccacccgcttcgaggtgccccgggaaccggacacgagccgggacgtgatcggcacgcccgtcgacggcaccgcggtgcggctggcggccggtggtgagctgtgcatcgccggtcccggcgtcgcgcgcggctacgccggccggcccggcctgaccgccgaccggttcgtgcccgacccggacgggccgcccggcgcccgcatgtaccgcaccggggacctggcccggcgcgggccggacggcaacctggagtacctcggccgccgcgaccggcagatcaagatccgcggttaccggatcgaccccggcgaggtcgagggcgcgctgctcacccacccggccgtgaccggcgccgcgatcaccgcggcggccgacgacagggcccgcacctacctggtcgcccacctgaccggcgacctggccggggtcgccgacgccgcgctgcgcgcgcacctcgcccggaccctgccgccgcacatgatcccccggcgcttcgcccggctgcaccgcttcccgaccacccgcaccggcaaggtggaccgcctcaccctggccgcctcggaaaggaccgctcgatga

SEQ ID NO: 7022 - DNA, 231 bp, Actinoplanes utahensis
atgagcaccaaccagaccaccgatctcaccgaactgatcaccgagatctaccgggagacgctcgcggacgccacgctcggacccgactgcgacttcttcgaggcgggcggggactcgctggccgccttccagatcaccgcccggctccaggagcacctgggcaccgacgtaccggtggcgctggtgttctcctatccgacgccggccgacctggccgagtgggtgcgctga

SEQ ID NO: 7023 - DNA, 2295 bp, Actinoplanes utahensis
atggccggttcggagagcacgccgctgctgctcggcggccggttccggctgtgggaacagttcgcgctgcgcggcccgggtttcccggccgagggggtgttgcggctcgtcgccccggaactgtcggcggccgccctttcggaggtgccttccccggaggccgcttttccggaggccgcttctccggaggccgcttctccggaggccgcttttctggagacctatgacgcggccgcggtgaagaccgcgctcaccctgcaggagatcgcggcccggcccgactacaaggccgcggtggcgtggcagaaccgggcgctgctcgaccgggcggtccggccgttcctgcgcgcgcgccccgcgtcggcccgcaccagcaaggaccgtcagcgtgaggagctggtggcccactactggcagcggttctgcgtcaagaacgacaccatcggcttcttcggcccggtcggctggggcaggtacgaccccggagtgtccggcctggtggtcgagccgggcgagggcctggtcgagcggacgaacatctacttcgcgagctgggcgatcgacgctctggcccgcagcctgggcgccgatccggtgctggcccgctgggtggccccgcggcgggtcccgttcgtgaccaccgcggccgccctgcccggctgcccggcccaggatctgtcgccggagctgctgcgggtgctgcgctactgcgacgggatccggacgcccgcggcgatcggggaactgaccggcacggatcccactgaggcgctgtccgaactggtccggcggcggctggtgcactggcggctggatctgcccgccgacgcgtacccggagcggcatctgcgcgcctggctcgagggggtcggcgacgatgacgcccggcggcgcgggctcgaccggctcgaccggctcgaacgcggtcgggagcgggtccgcgcggccaccggcccgggcgagctggcggccgcgatcgaggcgctggagaacgacttcgccgcgctgaccgacgccgcctcggcccgggagaagagcgccggcacggcacccgggcgcggcctgatctacgcggactgccggcgatccgcgtcggtccgcgtcggcggcgacgtggtcgccgccctcgccccgctggagctgctcctgtccagcaccacctggctcacctcggagttggcccggcggttccgctcccggatccggcaggtgttcgacgagtcgcgcccggccgacctggccgccttctggttcgcctgcatgccggtggtgcaccgcgacgccccggccgacgcggccgagctgcagcaggagttctggcgccgctggcaggacatcctcggcccgtgctcggacgcccgccgggtacggctgcgcctcgccgacatcgaggagcgggtccaccacagtttcccctcgaccggcggtggctggccgtccgcccgctacctcagcccggacgtcatgatcgccgcggcgagcgccgaggcggccggccgcggcgagttcgcactggtcctcggcgaactgcacgtcgccatcaacaccctcggcgccgccctgtacctccatcagcacccgaatccggacgagatgctggagctgaccacccgggaccacccggcgccccggctgctgccgatgatcgccaaggagaaccgttcccggctgtccatccggatccgctacagcctggcccggcccgaggaccactacgtcgcgttggccgacttcaccgcggacccacgccgcccccgtacggtcaactgcgcggacgtcgccgtccaggccgacggcgacaccctgttcgcggtcctcccggacggcacgcggtacgacgtcgtcgacgcgttctcccacgtcctgaccaccctcgtgatggaccggtggcggatcctgcccgaagcggaccacaccccgcgggtgaccgtcgacaaggtggtgctggcccgggagacgtggcggttccccgccgccgagcagggcttcgccgacgcgaagacggaggcgctccggttcgccgcggcacgccgatgggccgcggagcggcagctcccccggttcgtcttcgtgacctcgccggccgagccacggccgctgttcgtcgacttcgacagcccggtcttcgtgaatctgctcgccaaggccgtccgccggctggtgcgcaaggacccggcggcccggctgacggtgagcgagatgctgcccaccccggagcagacctggctcaccgacgaccagggcaaccggtacacctcggagctgcgcttcgtcgcctacgacacggcacgctga

SEQ ID NO: 7024 - DNA, 810 bp, Actinoplanes utahensis
gtgacgacgacaccgggcacgatacgagtcgcgatccagatcccaccgtcgcgggcggactatgcggccatccggcgggccgtggccgaagccgacgcgctcggcgtcgacgcgatcttcaactgggaccacttcttcccgctcggcaaggacccctccggcaagcatttcgagtgctggaccacgctcgcggcctgggccgagtccaccggccacgccgcgatcggcgcgttggtcagttgcgtcgcctaccgcaaccccgacctgctcgccgacatggcccgcaccgtcgaccacatcagcgacggtcgggcgatcctcggcatcggcgcgggcttccgcgagtgggaggccgaggagtacggcttcgcgttcggatcaccggctcagcgggtgcgcgagctacgcgaggccctgcaccgcatcgaacgccggctgcagctgctcaacccgcgcccgatccggcggatgccgatcctggttgccgccgacgggccccaggcgctgcggctggtggcccggtacgccgacatctggcagaccttcgccgaggacgacgtcttcagcgagaagtcgcgccgactcgacgggttctgcgatgaactgcggcgtgacccggccaccatcgaacgggcggtgttcgtcgacggcgacccgtggaccgtcgcagcgccgctgcgtgcgcgcggcgccggcatgttcaccctgatgacccgcggcccggacttcgatctcgacgagctacgccgctggctcgcctggcgcgacgaggagaacgcccgcctcccggtggccgcccggaatccgtga

SEQ ID NO: 7025 - DNA, 750 bp, Actinoplanes utahensis
gtggtgaccaccttctccggcaccgggcagttcgccggcgcgaccttcgtcaggaccagcttccagggcgccaccctgcgattctccgatgtcagcggtgtgacgatgcgcagcgtcgaggtggacggcctcgacatcgacagccacgacctgttctccggccgtctcctggtcaacggcgtcgatgtggtgccgctcgtggatgccgagctcaaccggcagttcccgggccgcgagctgcagcgggcccagacccccgcggggctgcgcgagggctgggccgcggtacgtgccgcctggcagacgacggtggcggacactcccccggacctcgtggacgcccacgtcgcggacgagtggtcactggcccagaccctgcggcacctcgtcctggcgaccgacgcctggctgcgcggcgcgatcctgcggacgccccgcccgtttcacgagatcggccagatcttcaccggggccgaccggatgggcttcgacatgtcgatcttccgcaccgatccgccggcctacgcggagatcctcacggtccgtgccgagcgtcagcggatggtcaccgactttttggccacggccacgacggacctgctcgccgagcagcgcgacaacccttggggcggcggcgaccggcgtcccagcgtcggtgactgcatccgggtgatcctggaggaggagtgggcgcacctgcgctacatcaaacgggatctcgcccgcctgcgccagcggccggcaacctga

SEQ ID NO: 7026 - DNA, 708 bp, Actinoplanes utahensis
atgaccgatcccgtcaccccaccgcgcacgttcggcagcttccacgccctggcggcccgcctcctgcgcgacgggtatccggaccccctgaccgacgccgacattcagcagcacgccgacgccgccgttgcccggatccgcgccaatcccggcaacggtagagctcaacccccgatcgacgtcatccgtcagggaactcgccgcctcggcacccactacgacctcagcgaggcagacctccgcggtgcgaacctccgcggggtcaagctcatcgaggtgatcctcttcgaggcgaacctcttcggggcgaagctctcctgggcggacctcaccagggcgaacctgcgcggagcgaaccttcatcaggcgtacctcatcggggcggacctcaccggggcgaatctcgccaacgcggacctcaacgagtcgcacctcatcgggacatacctcatcggtgcaaacctcaccagggcgaatctgggcggggcggatcttcgtggggcggacctgcgcggagcggatcttcgtggggcatgggccaccccggccaggctcgacgaggcggtgtgggatcggtccacggtctggccggccgggtggtcgacatggatcgccgaccgatccgagccgttgcccggcggcgggtaccggatcacgtccgatcagcccggtgccgacgaccgggctgcatctccggtcagccggtga

SEQ ID NO: 7027 - DNA, 513 bp, Actinoplanes utahensis
atgcggtcgccgtgcccgcgctggcctggccgttgtcggtggcgggctggctggccaccccggcgatcgtcggtgccgccatcggcatcaccatcgagcgggccattaccgcccgccgcagccgctcgatcaccgatgtcctcggcaccccgttggacgacccggatgcctgactggatcccggagatccctccgctgaagaacctcgtgtatgcccacagtggctacaacgtcccggacggcttcgccgccgccttcgtcgtcctgcacgatcacgactggccggccgccgaggaccactgggaacgcgccgtgcaggcagtcttcaacaccgacgcggtcgccaagaccgccaccggcgacaccgccgtacgccaggccgtgaccgcaaccgctgatttcttcaccaccaggcgatattttccctggtgttgttggtgccgcaaaggcaccccggtgcccaccgaggagcttgcccgcgcctctgccaccggtaaggaggccaccgaatga

SEQ ID NO: 7028 - DNA, 6327 bp, Actinoplanes utahensis
gtggaactgccggccgaccgtccccggccgccggtgcgcgaccccgcgggtgccttcctgccgttcgtgatccccgcgccggtcgcccggaagctgtccgagctggcccggcggcgtggcgcgaccacgttccaggcggccctcgccggatacctgatcctgctgtcgcgatacaccgggctcgacgacatcgcggtcggcaccaccgtcgccggccgcgaccacccgcaggtccaggaccttcccggcctgttcgtcaacaccgtcgtgctgcgcgccgacctgagcggcagcccgtcctactccgacgtcctcgaccgggtgcgcgacgtcacgctggacgcccacgcccaccaggatctgccgttcgaacggctcgtcgaggaactggcgccggggcgcgatccgtcgcggaccccgctgttcagcacgatgttcctgatggacgacacgccggccaccgttcgcgaggcgggcggactgcggttcgagcggatcccggtcggggagagcagcgccaagttcgacctgaccgtcgcgatcgccgagcggcccgacggatcgctggccggcggcatcacctacgccaccgccctgttcgaccgggccaccgtcgagcggctcgccgggcatctcgggcagctgctcgccggggccgtggccgacccgcgatccccagccgaccggctggatctgctcaccgcgggggagctgcggcagctcacccgcggtgggaacggcagcgtgcagacctatccgggtggcacactgcccgccctgctcgaggcgcaggccgccggcacacccacggcgacagcgttgcgatacgaggggcgggaatggacgtacgccgaagtcaacgcccgtgccaaccggatcgcccaccacctgcgcggcctcggcgccgggccggagtcggtggtggcggtcgagctgccgcgcggcgccgacctggtgttcgccctgctcggcgtgctcaaggcgggcgccgcctatctgccgctggacccggagcacccggccgaccggcgggccttcatggcccaggacgccggcgcccgcatcgtggtcaccgagcggctgctcgccgatgccgagggcggggacgacagcgatccggtcagcggggtcacccccgcccacgccgcctatgtcatctacacctcgggctcgaccggccggcccaagggcgtgctgatcgagcaccgggccatcgtcaaccggctgcagtggatgcagcagacctaccggctggacgccggcgaccgggtgctgcagaagacaccggccgggttcgacgtctcggtgtgggagttcttctggccgctgctgaccggcgcgacgctggtggtggcccgccccggcggccaccgcgacccggcctatctcgccgccctgatcgccgccgagcggatcaccacgctgcacttcgtcccgtcgatgctgcgcgccttcctggccgagccgtgcggcacgctgccctcggtgcggcggatcatctgcagcggcgaggcgctgccggcggacctggccgacgcggtgcacgagcggatcggcggcgaactgcacaatctgtacgggccgaccgagaccgccgtggacgtcaccgccctgcgctgtctgcccggcgagccggtcaccatcggccggccgatcgccaacaccagcgcgtacatcgtcgacgaccgcgggcggccgcaaccggtgggcgtgcccggcgaactgctgatcggcggcgtgcaggtggcccgcggctacatcgggcggcccggcctgaccgcggaccggttcgtgcccgacccgttcggtgccgaccccggcggccgcctctaccgcaccggtgatctggcccgccaccggcccgacggcaccatcgaatacctcggccgcctcgaccaccaggtgaagatcgccgggcagcgcatcgagctgggcgaggtcgagaccgtgttgcgggagtgcccgggggtcaccgacgcggcggccgccgtcgccgacggacagctcgtcggctacgtcgtcaccgacacgagcgtcgacgacatccgggcccacctgcgccgtcggctgcccgaggcgatgatcccggcacgctgggccgtgctggccgccctgccgctgaccggcagcggcaagctcgaccgccgggccctgcccgacccggacgccccggtgccgaccggcgcgtacgacgccccgcacggcgaggtggagaacctgctcgccggcgagttcggcgccgccctcggcatcgcgaaggtcggccgccacgacagcttcttccagctcggcggcgactccatgcgggcgatccgggtggtgggcgcggcccgtgccgccgggatcgccctgcgggtgcaggacatgttcacccaccagagcgtcgccgcgctcgccgagctgaccgggtcccgcgccgagtcctccccggagcggccggtcgagccgttcacccagatcagcgacgccgatcggcgtctgctgccgccgggactcagcgacgcctacccgatcacccagaaccaggccggcatgctgtacgagatgctgtccggggcggaccgggcggtgtaccgcaacgtctcctgctaccggatccgcgacggcaagccgttcgcggccggggcgctggagcaggcactgcggctgctgctcgtccggcacgagatcctgcgtacctcgttcgacctgggcacctactcggagatcatgcagctggtgcacgaacgggccgagctgccggtcgaggtccgcgatctgcgcggccggcccgctgcggaccaacaggacgcggtacgttcgttcctggccgccgagcgggaagtaccgttcgacatcggccgggccccgctggtgcgctacaccgtgcacctgctcagcgaccaggagtggctgctcacccacgccgagtgccacgcgatactggacggctggagtcacaccgcgaccgtcgcgatgctgatcgacctctaccgcggcgtgcgcgacggcaccccgcccgagctgcccgcgccgcccggcgtccggttcgccgacttcgtccacctggagcgcgccgccctcgattccaccgaggaccgggagttctgggccgccacggtcgcctcccgcgaccggttcgagctgccgccggagtgggccaccgagcccgccggcgccccggccaccatcgtcgacgtgccctgggccgacctggccccggggctcaagcggctggccgccgcggcgaacgcctcgctcaagagcgtgctgcacgccgcccacctcaaggcgttgagcgtcgccaccggccaggaacgcttcttcgacggactgctctgcaacggccggccggagcggctgcgcggcgacgaggtgttcggcatgtacctcaacaccgtgccgttcgccgccgacacccgcgcccgcacgtggcgcgagctggtcgccggagtgttcgccgaggaggcccggctgtggccgcaccggcgctacccgcagcccacgatgcaacgggactggggatcggcctcgcggctgatcgaggtcgcgttcggctacctcgacttccacgtgctggccggcgaggccgagtccggggtgcggatgatcgacgacttcagcccgggcagcctcgcgctggaagtgtggaccttccccggcgtgctgcggctcggtgccgacccggcccggatcgggcggccccacctggagctgctgcggcgcacgtaccggcacgtcctggaggccatggcggccgaccccggcggcgacgcccgagccgtgggcctggcggccgccgaccgccacgacgccgtcgaccggttccagaacccggtcgccttccccgcgctgccgctgctgcacgacctggtcccgaccggcgcggcggtcgcgctgcggcagggcgaccgaaccctgtcctacgacgaggtccacgccctcgccggcgggctcgccgcccgcctgcaccggctgggcgtcggcccggacacggtggtcggcctgctgctgccccgcggcacggatctcgtcgtcgccatgctcgccgtgctccgggccggcggcgccttcctgccgctggatcccgcctacccggccgagcggatccggtacatgctcgacgacgcggcacccgcggtcgtgctcaccgacccggcgtacgccgccctcgcccccggcgccgagatcgtcgaccacgaggcctaccgcaccctgcccgccgccccgccgccggcgctcaacggggagaacctcgcctacgtcatctacacctcgggctccaccgggcggcccaagggcgtcggcgtgccgcaccgggcgctgctcaacctgcgccacgcccagaaccggcacctcgacgtccgccccggcgaccgggtgctgcagttcgcctcacccagcttcgacgcctcggtgtgggaactggcgatggcgctcaccaacggcgccgcgctggtgctgccgccgcccggcaccgacccgggtgacctgcgcgcccaggccggcgtcgtcacccacatgacggtgccgccgtccctgctggaccgtctccggcccgacgacttcccgcacctgcgggtgctggtcacggcgggtgaggcggtcaccgccgaacaggtggcgcggtgggccccgcacacccgggtggtcaacgggtacgggccgaccgagaccgcggtctgcgcggccgccgccgagctcggcacctcggcgccggccggcccgccgccgatcgggcagccgttcgccaacgcccgcgtctacgtcctcgaccacgatcagcggccgctgcccgccggcgtgcgcggcgaactggtcgtcggcggggccggcgtgagccgcggctacctgggccgtccggcgctgaccgccgaacggttcgtccccgacccgtacgcgaccgtgcccggccagcggatgtaccgcaccggcgacgtggcctcccggtcagccgagggcaccctgagcttccacggccgccgcgatcaccaggtcaaggtccgcggcttccggatcgagctgggcgaggtcgaacacgccctggccgcctgccccggggtcaccggcgcggtctgcaccgtgcaccggcccggcacgcccgacgccaccctcgtcgcctacacccgtggcggtgtcccggcggccgacctccgtgcgcacctggccgaccggctgccgcagcacctgatcccgacccacttccgcgcggtcgacgacttcccgctgaccccggcgggcaaggtcgaccgggccgcgctgcccgccccggacggatcccggccggcgaccggcgccgcgtacaccgcaccccgcaccgaccgggagcggcacctcgcgcaggcgtggagcgaggcgctcggcgtcgcccggatcggtgccgacgacgacttcttcgacctcggcggacactcactggccatgatgcgggtgatcgcggcgctgcgctcccggcacggctacgagctgaccttccgatccttcctggaacagcgcacggtcgcccggctggcggccaccctgaccgaacagagctccggcagggcactgatgtggctgcgcgacgggaccgggcgggtgccgctgatctgcgtacaccccggcggtggcagtgcgcactggtaccagcggctgctcccgcacctgcaccccgagcagccggtggccgcgttcgaatggcccggaccgcacccgcagggcaccccgagcaccgaacagatggcggcccgctacctggccgaactgcgcgacgcgcggctggagggtccctaccggatcctcagctggtgcggcggcagcggcatcgcgatggagatggcccaccggttgatcgacgcgggggagcaggtcacggtgatgctgctcgaccccggcctggacatgcacagccgggacgacggctggagcgagctggccctgatgcgccgcctggaggcgttgctggccgagggagcggacacgccacagcgccggaccgagatcctgagcctgctcgaccacctggtcgacgacgtcgacccggcgaccggcatcgtcctgcccgagggcggcgccggccactggccggccgcggtgcgcatctggcgggaggtgatggagatggacatgagctaccggcaccgcgtcttcccggggcgcctggaactgattgccagcgacgagctggtccgcggtgagcacgaggtcgcctcggggcagagctacggcgactatctggcccgctggcgggaactggtcaccggtggggtccgggtgcatcgcgtcccgggcgaccacttcagcgtcctgcgggagccgcacgtccgccgcttcgccgagctgatcaccggcctgctggacgacgcctga

SEQ ID NO: 7029 - DNA, 1452 bp, Actinoplanes utahensis
gtgcgcagcacctcgtggcgggcgacgagagtgtcgagcgcgcggcgcagggcgggctcgtcgagcgggccggtgaggcgcaacaccgtgctggccaggtattcggtggtgcccggctggagctggtcgagcagccagagccgctgctgggcgtacgaaagcggaatcggcgccgaacgatccgccggtcgcgggccggcggccggccgcggcgcggtgacgccgctgagccggcggcgcatcagctccgcgcgcagcgacgccggatccatggtctcggtcatagcgcaccctccggggtttgcgggccacactcgtcggatcatcagggtgccgcccgggcggccgccgggtcagagaacaaccggtgccggcccggtgccggcaagactgcgcgtccttctctgcgccgctgccgtaccgtccgacaaggctcggtgcatgaagacgccggcattcgccagcgggatcaccggcacgatcggtgcgaccccgctcgtcgagctcacgcggctcggggagagcagtccgctccgggtgttcgcgaaattggaaggtcacaaccccggcggcagcatcaaggaccggtccgcgctcgagatgatccggcacggtgtcgccgtcggccggatcgtcccgggtcgctcggtggtggtggagtccagttccggcaacctcggcatcggactcgcccaggtctgcgcctactacggggtgcggttcgtgtgcgtgaccgacccgcgggccaaccagcagaacatcgcgatcatgcgggcgctcggggccgaggtggaggtcgtgacccggcccgacccggcgaccggggaattcctgccggcacggatcgcccgcgtccgggagctggcggcggccctgccgggcggctactgcccggaccagtactccagcccgctgaacccgcaggcccaccatgccaccatgcgggagatcgtcgaggcgctgccggcgccacccgacgtgctgttctgctccaccggatcgttcgggacgctgcgcggctgcgccgaatacgcgcgggagcagcggcttgcggtacggatcgtggcggtggacgcggtgggcagcacgatcttcggcacgccccgtgggccccgggtcatcccggggcacggcgcggccgtacgtcccgccctgttccgtgacgggctcgccgacgaggtggtgcacgtcgacgacgccgcctgcgtggtggggtgccggcggctcgtcgcgctggaggccatcctcgccggcggctcctccggcgcggtcgtggcggcgctggaccgggttcgcgaccggatcgcgccgggttcgagctgtgtcctgatctttccggaccgcggcgagcgctacctggacaccatctacgacgacgactgggtcgccgagcggttcggcgacatcgcccacctgtggaagcagaacgccatggaggccagcccgtgttga

SEQ ID NO: 7030 - DNA, 963 bp, Actinoplanes utahensis
gtgttgatcctgggaagagcagacgtccagcgcatcctggaggatgccgacgaggaggtgctccgggcggtccgggcggcctacctgcgccacgaggagggccggacggcggtgccgcactcggtcttcctgcgcttcccggacgacgaccggaaccggatcatcgcgctgccggcctacctgggcggcgacgacccggtggccggcgtcaagtggatcgcctcgttcccggcgaacatcggagccgggctgccacgggcgaccgccgtcatgatcctcaactcgatgcggaccggcgcgccggaggccgtgctggccgccgagaccatctcggcgcgacggaccgcggcctccgcggccctggccgccggcaccctggccccggacacgccgggagtgacgctgatcggctgcggggtgatcaacgccgcggtgctgcggttcctgcgtacgacgctgccggagttgagcacggtgaccgtcttcgacctcgacgacgggcgggcacggtcgttcgcggaccggatcaccggcctcaaggtggaggtggcgccgagcatcgaggcggcgctgggcgcgcaccggctggtctcgttggcgaccacggcggcccggccccatctggacaccgaccactgccggcccggggcggtcctgctgcacctgtcgctgcgggacctgccggtgcccgccgtgctcgcgagctcgaacatcgtggacgacgccgaccacgtgtgccgggcctcgacgtcgctgcacctggccgagcaggagaccgggcaccgcgacttcatcagcggctcactggggtcgttgctggccgggacgccgtaccggcgtcccgccgatcggctgaccgtgttctcgccgttcgggctgggcatcctggacctcgccgtggcccggctggtgctccggcgggccaccgagcggggcgcgggcgtcgagttcgccgggttctga

SEQ ID NO: 7031 - DNA, 1092 bp, Actinoplanes utahensis
gtgcgcatctcccgacgtcagctctggacggcctgcctcgccgccgggctggccatcccggcggccaccgccgtcgccacgagcgcggcggcagccggcagcaccgccggcctcaccgcgaccgtccagatcggccaggtcaccggcagcgccctcaccgtgcacgtcacggtgcgcaacacgtcacggtcggcgatcgacgtgctgtcccgggacctcccgcaggcccgcgagatcaaagccgtcctggccgtcacccgcgacggtgtaccggtgccctatcgcggcaggctggccaagctcgcggcgccgaccgcggccgactacacccacatcccggccggtggcacctacgcggcgacggtgaacctggcggacgactatgacctgtcacggccgggaaccttcaccgtcgcactggcatcggcccaggtgcggaccctgaacgcggcgaccgcggcccgtccgggcacactgcgggtcgacgccggtccggcctccgtccgcaccagcgccggcatccggcacgccggcaaggccgccagcgtcgcgccgaccaccaccgagcgggtgagcctggcggccgccgcggtcaccctcacctatcgcggctgcaccaccagtgagaagaccgccctgaagctggccgtcagcaacgccgcgacgttctcgcagaagtccaccacctggctcgcggcgaacccgtccggcgggggcgcctacgccacctggttcggcgcctacagctcgtcccggttcaaccgggtgacctcggcgtacaacaagatcaccggcgagctgaccggcaagaccgtgacgctcgactgcaccagcaccgaggactactacgcgtacgtctacccggacgagccctacatcatctacctgtgcaacgcgttctggacggcgccggccacgggcaccgactcgaaggccggaaccctggtccacgagtcgagccacttcaccgtcaacggcggcaccgacgaccacgtgtacggccagacggcggccaggcagctcgccgcgtcgaacccgggcaacgccgtcgacaacgccgacaactacgagtacttcgccgagagtcgctga

SEQ ID NO: 7032 - DNA, 1170 bp, Actinoplanes utahensis
atgcgccccgctacccgcagtgccgcgatcctcgccggcatcacgctcgccctctccctcacgaccccggccttcgccgcccccgcgaccgcaacggtgctctacgcggacagtgccaccgcgatcggcggctcgtacgtcgtcgtgctcaagcgcggcgaggccgaccagacccgcgcggaccagatcaccaagcggtacggcggcaccgtctcccacgtcttcggccacgccgtcgaggggtgggccgccaagctgagcgccgcaggccgcccggctcgccgccgacccctcggtcgcctccgtcgaggccgatcagcgggtgcggatcgccgacacccagagcggcgcaccctggggcctggaccgcatcgaccagcgggcgcggccgctgagcggcacctattcgtacggcccgagcgccggcgtcaccgtctacgtcgtcgacaccggcatcaccgtcagtcatcaggacttcggcggccgggcctcgtacggctacgacgcggtcgacggcgacaacgtcgcgcaggacggcaacgggcacggcacgtcgtcgccggtgtcgcggccgggaccacgtacggcgtggccaagagcgcgaatctcgtcgacgtccgggtcctggacaacaacggctccggcagcacctccggggtgatcgccggcgtcgactgggtgaccgcccacgccacccccggccgctcggtcgccaacctcagcctcggcggcggcaccagcagcaccctggacgcggcggtgcgccgttcgatcggcgccgggattccgtacgccatcgcggccggcaactcgggagtcgacgccggcgggagctccccggcccgggtgaccgaggcgctgaccgtcggcgccaccgacagctccgacgccagggcctcctggtcgaactacggctcggtgctcgacctgttcgcccccggcgtctcgatcacctcggactggcggaccggcaacaccgcgacgtacaccggaagcggaacgtccttctccgccccgcacgtgaccggtgcggtggcgctctacctggccgcgtacccgggcgcctcggtcgccacggtgaacgcggcgatcgtgaacgcggccaccaccggcgtggtcaccggcgccggcagcggctcgccgaaccgcctgctctacaccggctcctga

SEQ ID NO: 7033 - DNA, 549 bp, Actinoplanes utahensis
atgacacatcggcaacgactctcgatgatcgcggtcatggtggtggccgcgttgggactcagcttcacgggtgcgagcgcggccggcgccgccccggacaccccggtggccgcgccaccggtgaccgccctcgccaccccgatcaccggcacggccaccgacggcggctccttcgccggcagcttcaccccggcccggttcgtcgcccgcaacggcaggctgctggccaccggcgtgctttccggtacggtcagggacccgtccggtgcacccgtcggcacggtcagccgcaccgtcagcctgcccgtgaccgtggcggcggcgacctgtcaggtgctcgacctcgtactggggccgctgcacctgaacctgctcggtctggtcgtcgacctgaaccaggtacacctgctgatcaccgcggtgcaggcgcccggcgacctgctcggcaacctgctgtgcgccatcacccatctgctcgacggcgccccggcggtgggcccgctggccgcactgctcaatgccgtcctggccttgctgggccggctctga

SEQ ID NO: 7034 - DNA, 822 bp, Actinoplanes utahensis
gtggcggcaacgcgcccgcgatggccatcgtctgttcatcgtggtggcccgacgtcccggccaccacgccgcaccggggcacccctctgcccgctcgcggacgcaccgtccgccacctggggcctccccgctgaccagcctccccgcagggatccggaaaccggccggcatccggccgtaccgaagctcttcgaccccggctgggaggccatcgtgatccgcattctgctcgtcgaacccttgaccctgctccgcggcgccctgaccgcaacgctgtcccaggaggacgacctggacgtggtcgccgatctggacgcgctcggcccggcgctcgacatggccggcgccgtgtcgccggacgtggccgtgatcaacattgcgctgatggccggcgacggtctggcgacgatcgcccggttcaccgccggtcaaccgcggtgcgccaccctggcgctggccggcccggacgagtcggtgctgctcaaccgggcgctcggcggccgcatcgacggcgtggtcaacacccaggccgcgccgtgcgaactggtccgcggcatccgccgcctggtccggggtgagcgtgtgatcgacgcgagcctggccgtggccatggtgacggcgccgcgcagtccactgtcgtcgcgcgagctcaccgtgctcagcgtggccgcatccgggatgccgtcgaccgagatggccgccgagttgcacctgagcccgggcaccgtgcgcaactacctctcggcgatcctgcgcaagaccggcgcccgcaaccgctgggaggcggtccggttggccgagaacgccggctggctgacgtaa

SEQ ID NO: 7035 - DNA, 858 bp, Actinoplanes utahensis
atgcgacacccagccgcgcacggagaggatcacgcgcccgggggtacccggcgcgtcgtccggctgctcctgctgctcggcgtcgccgtcgcggcgtatctcgtgctgaccctcttcgatcatgcggcgcgtgccgataccggggtgggggaccggccgtcgggctccctcggcgcgccggccgcggtcgacccgctcacgaccgtggccggtggcgtcaccagagccgtcgcccacgcaccggtgcccggggccgaggttcaccggcccacgatcgcggcgccgcgtcgcacggtcgcggcgccgcgcatccgcgccgcagccccggtcgtcgccgccgttcacgcctcggccggtgcgacggtccgtcgggtgcgagccgccacgaagccggtgcatcacctcgtgtccgagaccggccgggccgtgctccccgacacgatggtcccggcccggacggccgcggttcgacaggcgctgccccagctggacgagcctgtttcaccggccggcccggcggggccggccgcgtcgcccgggccgggcatgccgcggtccagctccttctcggtgcgccggacgccgatcctgaccacgcccggcgccggcgccccggcgcctcgccgcgcgtccccgtacgctccagcgccgagcgccccggtaccggcttcgcccggtcagccgggcgagcactcggcctccaccgggcagatccgtgacgccggtggcggcaacgcgcccgcgatggccatcgtctgttcatcgtggtggcccgacgtcccggccaccacgccgcaccggggcacccctctgcccgctcgcggacgcaccgtccgccacctggggcctccccgctga

SEQ ID NO: 7036 - DNA, 210 bp, Actinoplanes utahensis
atgaacgacgagcagacggacgagcgcacctaccgggtggtcgtcaacgacgaggagcagtactccatctggttggccgaccgggacctgccgccgggctggtccgccgagggcacgaccggtgaccgggccacgtgcctcgcccacatcgaccgcgtctggaccgacatgcggccgctgagcctgcgtcgcctgatggccggtgcctga

SEQ ID NO: 7037 - DNA, 2964 bp, Actinoplanes utahensis
gtgaaacgatcgtcgcgtgacgcagtcgtcggccgccgtactccggacctggccggacgcgacgaggaactgcacaccgtgcagcagacgctgtccagggcccgcgccgggcacggcggcagcatgttcgtcgtcggcgcgggcggcatcggcaagtcccgcctcgcggcggccgccgccgacatggccttcgccgccgacatgtgcctgctccgtgggcgcggcagcatggtcgggctgaccgttccgttccggtcactcaccgaggcgctgctgtccctggtgcacagcggcgacccggtcgacgtcaccgagctcggcccctaccgcagcgccctgggccggctcatccccgactgggccgacggcccggccgcctcgggcggtgtcccgctgatggtgctcgccgaggcggtcctgcggctcaccgcgctcgccggccgggaccggggctgcctgatcgtcctcgacgacctgcaggacgccgacgccgaaaccctcgccgtcgtcgaatacctcaccgacaacctcgaccaccaggccaccgtgctgctctgcaccgtgcgcagcgaaccctgcccggccctcgacctggcgctcgccgccgaacagcgcggcagcgccgtcatcgagacactgggcccgctcgacgccgggggcgtgcgcggcctggccgcgtcccggctgggctgttccccgggcgacctgccgcagccgttgatcgaccggctcaccgagaacagcaccggaaccccgctgttcgtcgaggaactgctggacgccgccgtcgacagtgggcagctggttcgcgagggcgacacctggcggctgaccgagacgatccggcccgccgtgccggacacgctggtgcgcaccatcgcccgccgggtcgagcaactcgacccggcggcgcgcggcctgctctccatcggcgcggtgctcggcaagcgtttcccgctcggcctggtccgcgccgtctccggcctcgacgaccggacgctgctcaaccatctgcacggcgaggtcgccagccagctgctggtccccgacgagcagacccccgggtggtacgccttccggcatccgctgcacggcgaagcgctgctgcggaccctcacccccggccaccgcgtcgacctggcccggcgcgccgccgccgcggtcgagcaggcctaccccggcctgccgggcgagtggtgcctggtctccgcctcgctgcgcctgcgcgcccaggaaccgggcgccgccgcccgctgctacctcgaagccggccgccgggcggcggcccagggcgccgcctcctcggcggtgcggctgctcgaccgggcccgtgaactgctcgacgaccatccggaccggaccgtgcaggccgaggtcatcgaggcactggtcccggcgctggccgaggcgggggagatggagcgcgcgctcgggatggccgaccgtttcgacgagctgcccgacagccgcgaccgacgccgccgcgccgacctgcacacccggctcgcctgggcggccaacgtcgccggccgcgtcgacgacggcctgcgccaggtgtcgctcgcccgcgccgcgctcggcccgggcgcgccggacgaggacaccgtcccgatcgacgtggtcgaggcccacgtcctcgtcgaccggcccggcgcggagaacctcgcccgcgccgaggcgatgacccggcacgcggccgcggtggccgaggcccggccgctgccggtggtcgcctgccaggcgtggcagctgctcggcgcgctgacccgggcccgcgacccggccgaggcgaccgcgtgcctggaacgctcccgggccctggcggtccgccacgacctgccgatctgggagatccacgcactggtccggctgggccacgacgaggcgctccgcgacggcagcaccgcaaccctggagaagacccggcaggccgcgctggcctgcggcgccgtcaccgccgggtaccatgccgagaccaacctcgccctgcacaccgtgctgcgcggcgacttcccggccgcgagcagcctgatcgaccggtcgctgggcgacacgatgcgcctcaagatgttcgagaccacccagctgctgctgctcgcccgcgccatcctcggcgcccaccagggtcggcgccgggagatgaacgacgcgatcgccgagttccggcgctggggcggtgacccggaggtgcacgcgccgcgcgtgtacgggctggcccgcgtcttctgcgcgctgctcgaagaggaccgggagcgcgcggtcggggagctcgcccgcagccgggccggcggcgagggcaacgtcagcggccacttcggtggtgcgcacggcatcggcccgctgctcgcggcgctctccgggcccggccggccacagccccgcggcgtcgtcccatcggccgccggtgcgctccgctggaacaggcagttcgccctgctcgccggtgcggtgaccgagggccgggcccgccgggcgcgggaggcggcggccggggtcgacgaggccctcatcgcggccgagccctacgagatggcccggcacctgtgcctgcggctggccggggaggccgcgctcgacgggggctggggcgacccggtgccgtggttgcggaccgccgaggagtacttccaccggctcgacgtggtcccggtcgccagcgcctgccggtcgctgctgcgccgcgccggggcagcggtcaaccagcgtcgcagcggaaccgacgaggtgccccgggaactgcgcgagctcggcgtcaccgtccgggagtacgaggtgctccggctgctcgtcgaacgcctcggcaaccgggcgctcgccggccggctgcacctgtcgccgcgcaccgtcgagaaacatgtcgcgagcctgatcaccaagaccggccgggccaaccgggtggagctggcggactgggccgcacagatcgtcggcggcgctgccggttcttctctgccgccgccgtga

SEQ ID NO: 7038 - DNA, 231 bp, Actinoplanes utahensis
atgcgagacgaccggcaggccaccgagaccaccgagaccgacgcacgatccactctgctcgacctggtggcccgagtgcctttcggggtgcaggccgcggtcctggccggcgttctggtggccggcgtgggcgtggccgacaccggccggaccgaggcgcgggccgccgaggtggtcaccgcgttcgggatcgccagcaccacctgctgccccccgccggacccccgctga

SEQ ID NO: 7039 - DNA, 369 bp, Actinoplanes utahensis
gtggctatccgggggatccgcgcgggcgacgacccggccgcggtcgcccagcggttcacccggcggccggtgctgcgcgatctcagcctctgccacggcgaactgggcgtcaccgaggcgctcgtcgtactggcggcggccgagtccgaccggttcgtccagcgcgtgttgcgctggcgggccggcctggtgctcgacgcgctggaacggcacggacccggctgcggcgcgcccgacggcgtcgccacacccgggttgctcaacggactggccgggatcggctacgggctgctccgcctggggttctccgcacaggtgccctcggtgttgctgctcgagccgggccggaccggcaagtggacaggatga

SEQ ID NO: 7040 - DNA, 2067 bp, Actinoplanes utahensis
atgtcgctgaccggtgactctggcagggtcgtggacatgaccgagccggtgaccgacgacgtgatggctgccctcgccgcgtgcctgcgtggcctggtcacccccgcccgtgacctgctggccgggcaggtgcgcgaggtgcccgccgccgaagcgggcgcgctggccgacgggttcgccgccgagctcggcacccgcctggctaggcaggccggcagcacggtcgcggccgagttcgaccgggccggcgccggtggcccgcagcggctcgccgccctgctggcccgcctggccgacggtcccgacgacctgctggcccgccacccgcggctggccgggcgtctgcacggcaccgtcggcacggccgtgcggaccagggtggagctgctgcaccggtacgccgccgaccgggccgacctggtccgggtgctgctcggtggggtggacccggggccgctgaccgaggtccgcgcggggctgggcgacccgcatcagggcggccggacggtcgcgcggctgaccttcgccgacgggcggcacgtcatctacaagccgcgcggggtggacgcgtacgtgctgctgaccgaactgaccgcctggctcgacggtgcgctgcccggtctcggcctgcgcaccgcggcgacggtgacccgggccggctacggctacgccgaattcatcgagcacctgccgctggacagcctggcggccgcggagcggttctatcgccgggccggcgccctgctggccctgctgcacgcggtgcgggccgtcgatctgcaccacgagaacctgatcgcctgcggcgagcatccggtgctgatcgacgccgaggcgctgttccacccggactccgcgcccgcggcggtgggtgccgacccggcgcggcggatgctggccgcgtcggtctaccgcaccgggctgctgccgatgatcacggtcggtccggccggcgtcgtcgactgttccgggctgtccggtcgcctgggcacgcactccaccgacggcccggactgggagctggccgacggccggctgcgaccccgcccggccgaggccgccgggcacaacctgccccggctccacggacgggagctggacccgggccactacgacacggcgctgcgcgccgggctgcgcgccggctacgacgccatcagcgccgggcgggagagcttccggcggcttctcgacaaggccgccgatctgccggtccgcgtggtgttccggccgaccgccgtgtacgcggcgctgctggaccgggccaccgatccggagctgctggccgacgagcccggaccgctggtgccgcacgagctggccgacctgcgccgcggcgacatcccggtcttcaccgccgtgcccgggcgccgcgacgtatggtcctcgaccggcgcgccgctgcccggcctgctgcccggcaccgggctcgacgccgccgccaccgtgctcgccggcatgaacaccgccgaccgccgggaccaggaatggatcgtctcggcgacgctggccacccggcagccggtcgacgggcatcgcgccgccggcttcctggccggcccggccgccggctccgaggccggccccgaccggctgctcaccgccgcgtgcgggctcgccgaccagatcctcgcccggggcatcgccgacggcgaccgggtgaactggctgggcctggagatcgtcgacggcgcccgctggatggtcctgccgatgggcgccggtctggccaccggctacctcggcgtggccctctttctggcccagctcgccggcctcaccggggtcagccgctaccgggacaccgcccggcgcgcggccggcgccgccggtccgctgctgcgggccctcgccggacgacccgatctggccgtccacgtcggcgccggtggctacgacggcttcggcggcatctgttacggcctgacccggctcgccgcgctgctcgacgagccggcactggccgacgacgttccctacggggtcgcggccgccaccgcggcggtcgccgcgccctgcccgcccggactggccggcgggatcgccgggtgcctggccgctagctag

SEQ ID NO: 7041 - DNA, 6186 bp, Actinoplanes utahensis
ttgcgcgggccgctggacgaggcggcgctggccggcgcgctgaccggcgtcgcggcccgccacgacgtgctgcgttcccgctacgagacggtcggggaccgggtcgtgcaggtgcccgggccggtcgccgacgtcgagctgtcggtcaccgacctcagcggcctgaccgccgccgagcgggaccgccggctgcacgagatccgggtcgccgagctgcgcgacccgatcgacctgcgccggcaggccccgtggcgggcgggactggtccggctcggcgaccgggacacggtcctgctgatcaccgtgcaccacatcgcgttcgacggcctgtcctggatccggttcgccgaggaactctccgtgctgtacgccgccggccggtgcggcgaggagccggttctgccttcggtcccccggcagtaccacgaggtggccccgggcggggacggccacgagcttgccggcctcgactactggcgggagcggctggccgggctgccaccgctggagctgcccaccgaccgggcccggccggccatctgggagcccggcggcgacagcgtcgaggtgaccgtgcccgccggtgtggcgcaggggttgcgccggatcggcagcacctgccgggccacgccgttcatggtgcacctggcggcgtaccagctgctgctggcccggctcagcggccgcggcgacatcgcggtcggcgtctcggtcaacacccgcaccggcgccgagcaggcgaacgtgatcggcatgttcgccaacaccgtggtgatgcgcacgacgatcgacccggccgacgatttccccgggctcgtggagcgggtccgccgggagaccctcggcgcgttcggtcaccagcacgtgccgttcgaccgggtggtggccgccgtcgcgccggcccgcgaccccgcccgcaacccgctgttccaggcggcgttccagctggccgggcgccgccggcagtcgttcgcgctggccgggctggccgtcgagacctgcccgccgatctgggtgggatcgccgttcgacctgtcgctgcacctggccgagaaccccgacgggtcgctgaccggccagctcgtctacgcgaccagcctgttcagccggacccgcgccgagcagatcgcggcggcctacctgcggctgctggccgggatcgccgagcgggacacccggccggtcggcgtcctgccgatcgtgcccgacgacgagctgcaccggttcgccgtgtggaacagcaccgcgctggagcggccgaccgagtccctgccggagctgttcctgcgccgggccgcggcgacccccgacgcggtggccgtgcgcggcgacgccggcgagctcacctacgccgagctggcgggccgggcccgcgcgctcgccggcgacctgcgccggcgcggagtgaccgccgaggtcccggtcggtgtcgccctggagcgcaccggcgacctcgccaccgccgtcctcgccgtgctgctggccggcggcgtctacgtgccgctgtcaccggagtatccggccgaccggctggcatacatgatcgccgattcgggcgccgcgctgatcctcacctcccgggccgtcgaggagcgcctgccggccggcctcccggtgctccggatggacggcgcacgcccggccgcgcccgagccggaactgcccgcgatcgccggcgaccaggcggcctacctggtctacacctccgggtcgaccgggcgacccaagggcgtcgtggtcacccacgccggtatccgcaaccgggtcctctggtcggtcgagcggtaccggatgaccgacgccgaccggctgctgcacaagaccacgatcggcttcgacgccgccgtgtgggagatcctggccccgctggtgtcgggcggctcggtggtgatggccccaccggagggccaccgggaccccgccgtcatgatcgacgcggtgatccgcggcggcgcgacgatgctgcaggtcgtgccgtcggtgctgcgtctgctggtcgccgacgcgcgcctggccgaatgcacttcgctgcgggtgatctgctccgccggggaggcgttgccggccgagctctgccggcggctgaccgggatcctgccggtcgaggtggtcaacacgtacgggccgaccgagtgctcgatcgacgccaccgcctggacctggtcgcccgccgaccgcacgccgacggtcccgatcggatcgccgctacccaacacccgggggtacgtggtggaccgcgacggcggactcgtcggcatcggggtccccggcgagctgcgtctgggcggcaccggcctggcccgcggctaccgcggccggcccgggctgaccgccgagcggttcagcccggacccgtacgcgggcatcccgggcgcgcgctggtaccacaccggtgacctggtgcgttggcgggcggacggcgccctggagttcctcggccgcaccgacgaccaggtgaaggtcaacggggtacgggtggagccggatgaggtgcgcgccgcgatcgaggagcaccccgaggtcgaggcggccacggtgatcgcccggcggacggaagcgggcgagacgctgctcaccgcgtacgtggtgccggctgtaccggccgacctgcgcgaccgcctcggggaccggctgccggccgcgatggtgccggccgggttcgtcgcgctcggcgcgctgccgctgaccgccaacggcaaggtcgaccgggcggcactgccggatccggccgcgacggacccggccaccccggccgggcgcgcgccgcggaccccgctcgagcacgagctgacccggatgacggccgaggtgctgggcgtcgagacggtcggggtcaccgacaacttcttcgcgctcggcgggcactcgatggtggcgatccggctggtgctgcgggtgcggcgggcgctgggcgtcgccctgtcggtgggtgacttcctggcccgcccgaccgtcgaggccctggccgcgtggctcgacgagaccgctgccccggacgccggggacaccgccgacgacccgcgggcgatccggccggtgccgcgcgaccggccgctgccgctctcccccggccagcagcggctctggttcctcgaccggctcaccccggactccgcggagtatctgatcccgctggcgctgcgggtgcggggcccgctcgacgccccgcggctgcgccgggcgctgcacgacgtcaccgcccgccacgaggtgctgcggacccgctacgccgagcgcgacggcgagccggtgcaggtgatcgacgagcccggcccgatcgccttcgaggaggtcgacctgtccggccgcccggacgccgagagcaccggcctcgatctgatcgaacgcgccgccgcccgccccttcgacctgacccgcgagcagccgctgcgggtcaccctgatccgggtcggtcacgaggaccacctgctgctcgtcctgctgcaccacatcgccttcgacgcctggtcgatgggcatcttcctgcgcgacctggaggccgcctgcaccgggcagctgccgccggccccgccgatccagtacgcggacctcgccgcgtggcagcacgaccacgccggcgacaccgccgggcagctggaacactggcgggaacggctcaccgggctcaccccggtggagctgatcaccgaccggccgcggggcgcgcagcgtgacccgagcggggcgatcctgcgcgtcgacgtacccgacgacctggcccgcaagctggtcgagctggccggcgcccgcgacgccaccccgttcatgctgctgctcgcggcgttccaggcgctgctcgcgcgctacaccgcaagcaccgacatcgcggtgggctcgccggtggccgggcgcacccggccggagaccgaggatctggtcggcttcctcaccaacaccctggtgctgcgggccgacctgagcggcgatccccggttcaccgcgctgctggcgcaggtccgggcgacggccctggacgcgtacgcccaccaggacgtgccgttcgagcagctggtcgacaccctgcagccggaccgggacctgtcgcgcaacccgctcttccagatcatgttcgacgtgcagcacctcgaccgtttcccggcgaccctgggcggcgcggcgatcgaggcgctgcgggcgggtgccgcggtggccaagttcgacctcacgctgaccgtccagcagcgggccggcgaccggctgcgctgcgtcttcgagtacgccaccgagctgttcgacgccgccaccgtcgaccggctggccggccactacctgcggctgctggccggtgtcgtggccgatccggacgtccggctcagcgaggtggacctgctcggcgagcaggatcggcggctgctgcggcagggtgcgccggccccgcgggaaccccgctgcgtgccccagctcttcgaggagcaggtcgcacgcaccccgtacgcgatcgcggccgtgcacggcgccgagaccctgacctacgcgcagctcaacgagcgggccaacgccttcgcccggtatctgcggggccgcggggtgaccccggagaccgcggtggcggtctgcctggagcgcggcctcgaggcggtgatcgcgctgctcggggtgctcaagtcgggtggtgtgtacgcgccgctggacccgggccacccggccgaccgcctggcgaccacgatcgccgacgcggacgcccggatcgtcgtcaccaccgcggagctcgccgcccggttcaccgcggacacctacgaggtggtgacacacttcgccgaccgcagcgagacgaacccgcggccggtcgcgggccccggcaacctggcgtacctgatctacacctcggggtcgaccggccgccccaaggccgtgatgatcgaccatcaggcgtacgcccaccactgccgggtgatcgccgaggcgtacgacatcacgccgcgcgaccgggtggtcctgctctccgcgctcaccttcgacgtggccatggaccagatcgcggcgacgctgctggccggtgcgacgatcgtggtcagcgacccggtcttctggccgccggccgagctgcccggcaagatcgcccggtacggcatcaccatcatggagatcaccccggcgtactaccgcgaggtgctggagtacgacgtcggcgagctgcgcgggctcaagctcatgaacgtgggcagtgacgtcgtcacggtcgccgacgcccggcgctggcacgagaccgggctgcccggccggttcctgtgcaactacgggccgaccgaggcgaccgtgacctgcctgctgcacccggtccggggggcgctccccggcgagcatccgtcggcggccctgccgatcggccggccggtggacggcacccgcgcctacgtgctcgaccgggatctgcggccgttgccggtcggggtgccgggcgagctgtgcctgggcggcatccggctggcccgcggctatcgcggccggcccgggctgaccgcggcccagttcgtgcccgacccgctgtccggcgagccgggggcccggctgtaccgcaccggcgacctggtccgcctgcgcgccgacggcacggtggagttcctcggccggatcgaccagcaggtcaagatccgcgggctgcggatggagctcggggagatcgaggcggccctggcccggcatcccggggtgcaggccgcggccgtgacggtcgtcgagctggtccccggcgacaagagcctggccgcgtacgtggtcggccggccgggcgccgagccgtccgccgacgagctgcgcgcgcacctgcaggcgctgctgccggagaacatggtcccggcgtggtggacgatgctgccggccctgccgctgaccgccagcaagaaggtggaccgcaaggcgctgcccgtcccggagccgctcggcgccgggccgaaacgcccaccccgcaaccccgccgagcggatcgtcgcggacatctggggcgaggtgctgcgctgcgagacggtcggcatcgacgacgacttcttcgccgtcggcgggcattcgctgctggccacccgggtgctggcccgcctgcagcaggccttcgccgtccggctcccgctgcgctgcctgttcgaggcgcggacggtcgccgccctggccgcggcggtcgaggcggcggtcgaggcggacatcgccgggctctccgacgcggaggtggccgacctgatggcccgcggttag

SEQ ID NO: 7042 - DNA, 1008 bp, Actinoplanes utahensis
atgtcgtccaccggtccaggctgcgccccaccggcgcccgccgccaccgggccgtccccggccgagggtgatcgggcgattcccgggacagcgcgacatcgcgccgcctaccttcggcccatgcgggacagccaacgaaagcgccggtggcggacggctctctgcgccaccctgatcggcctggtcccggctcaggtggcactgccggccgagccggcgcaggccttcgctcccgacctgtccttcgtgcccagcccgatcccgctcggcgtgcagacccaccggagcatcaccgagcacgcggtgacccaggccctcggctcctatttcggggtggccgagccgaccccgcggatgcgggccgcgatcgaggagatcgtcgccgcggacaaggcggtcgacgacgaccaggtctcctcggacaagcacttcgacggggagaacttcgacgggggtcagaggttcgtgctggccaaccgggcagcgctgctggccgccctgaccgcgggcgacggcgcggcagcccgcggccgtctcggtacggcgctgcacccgatccaggacttctacgcccactccaactgggtggagctgggcaaccggggtcccgacccggacctcggcgtccccggccgggtgatcgggccggtcgccggcattctggagaacacctgcacgctgggcggcatcctgatcaccaccaagctgaccagcgggtactacggcggtgaggaccgcgtcccgctcgtgctggcgagcaagtgccggcacggcgggccgctcgactccgggcccggcagtggcggcatcagcaaggacttcccggtctcgatcctgtcgccgcacccggggctgcaccaggtcgccgcgcaggtcgccgagcaggcgacccgcaagttcctcgacgagatccgggccgccgtcccggcctggcagtcgcagctcctgctcggcgccgacctgacgttcggcccggccggcgcgagcaggagcacgcgtcccgcctaa

SEQ ID NO: 7043 - DNA, 498 bp, Actinoplanes utahensis
gtggcggcgggcgccggtggggcgcagcctggaccggtggacgacatccgggagtacgcgcgctcgctgatcgcgacgaacctgtatctgaccctgggcaccgcggatgcggacggcctgccgtggacctcgccggtctatttcgcgccgggggacgcgctgcacgagttctactgggtgtcggcgaccgacgcccggcattcgctgaacctggccgtccggccgcaggccagcctggtcgtcttcgactcgacggtggagccgtaccgaggccgggcgctgtacgccgagggcaccaccgctccggcgacgaacctgaaccactatccccgcagcggggcacgggtgtccgccgaggacgtctcgggtgcctccccgtaccggatgtacctgctcaccgctaccgcgatgtgggtgttgtgcgcccgcgagccggggctgccgtgcgctctgcacggccgggccgaggatcaccgtactccggttccgctcggctga

SEQ ID NO: 7044 - DNA, 1047 bp, Actinoplanes utahensis
atgaatgcctcatcgacggaaccgctgccaccgtggtggaagaaggtccatgacaccgcccaactgctggcctctcagctcaatgcggccgtgggacaggcctcccgggatggcgtctacaccccgccgccgggctcaccgccgccgcggcggcgccgacaggccgcctcgctgcgtcacctggccgaggtgatccgtacccatcgtcttgcccccggaatgtcggtcgacaaggacgacatcgcggcggtcctcgccggcgacccgcgccggatcaccgatccggtcctggtgatcgcggtcgcccgagccgcgcatcagatcgccgatctgcccttcaccgacgacgacgccgaccggctcagggtcgccagcgcccacgtcgcggcgctcaccgacgtggcacggcaggcggacgagaaggcgccgcgcaccgtgccggcgcgcctcaagcccgtagagcccccggtcatcgacgcgtacttcaccactcgccgaccccggaggcggtggccattggtggccaccgcctccggctcggtgctgctcgccggcatcggcacctttcttgtcctcggcgatcgcaagagcgagaaaccctcgccgccgtccgcaacggaaacccggccggcaccggtggccgccgacgccgagtgccggctgggcgccaccgacgacgacatcatcgcgaacaccccggcgctcttcgacgacgaccgggccacccggctcagtcccaccctcgacttcgaccagatgaacggctcggcccgctacgcccggcacgacggccggacctactactggggacgggccgggtccgacgaccaggatccgcacgccggcggtgcccgcatccggtggagcacccccgacggccgctggcgcagctgcgccagcgcgctggccacgacagagcggggttacgtccacacgccggcagtcgccaccaccatcggggggcagccgatcacggttcagatctgcctctggcgcgacgagccgcgccgggagaactgcacccagcagatctccaacggccgctga

SEQ ID NO: 7045 - DNA, 2121 bp, Actinoplanes utahensis
atgatccctcgtgtcctggccgcggccgtggtggtgacggcactcgtcacggtggccgcctgctctgccgagccggccggtcgagcaccggcgccggacgccggcccggtcatggaggacgtctcggcgtctccgatcggcgtgcccaaggtgtccggtgacggcagcatcgccgataccctgccggccgcggaccggccgacgaagaacccggaccaggccggtggtctcgccggccgggcggtcccgaccaaccagtggtggagttccgcgctgaccggaccgcgtacccagccgatctggacgcatccgctggcggtgcgagccgctgacgtgggcgtgcagatcagcggcgcgccggtcacggcctccgccaacgccgtcacgacgccgtttcttccggcgctgaccgtcggcgccgcgaccggggcggtgcaggtcgccggctacggcgcgttccacgtcgtgctgcgcgtgggcctggccggtggggggtcggtcgacgccaccctggtgcagggcagcccggtggtctggctccgcttccagggcgcgacgcccagcctgaccggcgccttccgggacgtggggagcacggcctcacgtgtccggctcgacatcgccggcggccggtgggacgtcatcggcgacggcctgggcctcagcggcgccacggtcaccgggtccggtgagaacctggccgtcgcccgggtgccggacggcagcgaccgggcgagctgggaacgggccagcaccgccgatccggtggtgcaaaccacggcggcgatggactacgacgccgcggcggggacggtcacccagaccctcacggcccggcgagccggcggcggcgccggggtgtgggcgctgttgccgcaccagcagagcgggctgctggccggaccggccgccgtggccggttcctacccggacgctcgcgggacgatgtcgctggtctccgccgacacggtgcgggtgcgggtgccgatgccggggctgctgaccgccgtgccgcaggtgccgctgaatgcggcggcgagccgcgcggtccgcgacgacctcgggcgggacctggcggacccggggggcgcgggcggcagctacttcgggctcaaggaactcggccggctcgccaccatcgccgaggtggcggcagcggtgggtgcgaaggcggagcggacggcggcgctcgcccggctgcggccgctactgatcgactggctgacctgctccgggccgtccgacgggcgctacttcggctacgacgggacgtggggcgggctgatcgccgtgccggccgagttcggcgcccaggactacaacgaccatcatttccagtacggctacctggtccgcgccgcatccgtgctggcgtcggccgatccgctgttcgcccgcgactacggcgacgtgatcgacctgatcgtccgtgactacgccgggtcgctcgcgatcgggccggcgtccgggctgcccccgttccgcgccttcaacgcctatctgggcagctcggccgcctcgggcttcgcgccgttcgccgacggcaacaaccaggagtcgtcgagcgaggcggtggccgcgtgggaggcggtggcccgctgggggctggtccggggcgacaaggcgatgaccgggtacggcgtcacccactacgccatggaggcggcgacggcccggatgtattggctcggcgccgggctgacccggccgccgggatacgcgcacaccaccgccgggatcgtctgggatgccaaaatcgactacgccacctggttcgacccgaaaccggagtcggttctcggcattcagctgctcccgctgaccgccggctcgttctaccgcggcccgtccgaggcccgccagcgtgagctgggtgcccgcccgagcgtctggggcgacctcttcgccgccgacctggcgctgtccgacccggcggccgcgcgccgccggctcgacgcgggagtcagccgtgaggacagcaccagccgggcgatggtccgctactgggtcgaggcgctggcggtgctcggcccaccacagcccggtgttcccgcgccgctggggtcgctggcgttcggctcgaccggcaactcccgggtggtccggccgccggccggatag

SEQ ID NO: 7046 - DNA, 774 bp, Actinoplanes utahensis
atgagcaccaccatcgagaagaccggtatcgacccccatcccgtaccgagtgaggccgaaccgcccggaccggcgccggccccgccgagaaagcggtggcgggctgtgctgcgattcgtgcgcaccctggccgtggtcctgatcctgctggcgtcggccgtcgcgggcggcacgcgcatcgtgcggcaacgatacgccgagcggaacatgctggacgccggcacggcggtgctggccgcccagccgatcaccgtgggttcgcccgacgcctcggtcgtcaaccgggtgctgatcgccgatcgcgacagcgtgaccgccggcgcgcccgtcgtcacgatcacccacaccgccgccggcggcgggccacgggtgcagcaactgaaggcgccggctgccggcatcgtcaccgagatcaacatcgcaccggggcagatcgcccgagccggcgaaccgatcgtcaccctgtacgacccgtcccagctcaccttccgcgtcgatgtgccgctcgagacgctgcgcgagctccggctggggatgaccgcctacgtctccgggcccggtctgcccggccggatcgccaccatgctcgaagaggtcgagcccaaggtcggcagtggcggggcgaccgcgccctccgacctgctcaccgtcgtgttgcggcccgacccggccgccctgccgaccgtgcgcacgctcgtgccgggactccggttccacgccgtggtggacaccaccacggccgtcggtgccaccccggcggtgaacagcgcatga

SEQ ID NO: 7047 - DNA, 1644 bp, Actinoplanes utahensis
atgacggcaccccccgtaccgtcggccgggccgggcacgcgcctggcctggcggaagctgcagcgctcgacgcgcgtcgcgatcatcgccgcgctcgccgcgaccgtcttctaccagctgttcctgctcaacccggcgtaccgcggacccacctggctctgggtcgcgatgctggcggccgagggtctgaccgccctgcacctggtcggcacatggtggaccatcctggcccacgacgaccagccggagccggtggatgtcgtcgtctggcgcaaccggctgcgggccggcgccgacgtgccggccatcgacgtgttcgtgaccgcctacggggaggatcccgcactggtgcgggccaccgtcctcgccgcccgcgacatggacctgccccaccgcaccttcctgctcgacgacggcgacagcgacgcattgcagcggatcgcggggcaggccggcatcggatatctgcggcgaccgggtggggcccacgccaaggccggcaacgtcaacgccgggctggcccgtaccgacggcgagttcgtcgtcatcttcgacgccgaccacgtgcccgagcgcaacttcctgctcagcatcctgccgcacttccaggacccggatgtcgcgttcgtgcagtccccacagtcgtacacgaacaacgtcaacctggtcgccaccggatccggcgaggcccagcgcatcttctacgagctggtctgccccggcaagaaccacttcaacgccgcgttctgcgtcgggacgaatgtcatgttccggcgggcggcgctggacggcatcggcggcatctggacgggcagcaactccgaggacatctggacctcgatcgagctgcacaagcgcgggtggaagtcgatctacgtgccccaggtgctggcccgaggcctcgccccgcaggacgtcccgtcctacctcaagcagcagatgcggtgggccagtggcggcttcgaggtactgctccgcggccggctgctcaaacgcggcagcggcctcaccatcgaccagcgcctgcagtacctcttctgcggcacgcactacctgctgtccctggcgatgctgaccttcatgttctttccgtcgctctacctgctcttcgcgctgagcccgatccgcgccgacggcttcgcctgggccacccactatctgccgttccaggccgccgtgctcctggtcacctggttgcagtcgggcgggttcaagctgtccgcgatcgtggccagcatcggcgcggttcccgtgcacctgcgagcgctggtcggcgtgctgctcggccggccggcgaaatggaaggccaccaacgccggcggcgacgacgcgcggtcgctgtgggccgtcatgccgctggtcgccctgctgctgctgaacgccaccgccatcgtcgtcggtgtcctggtgatggccgatccggcgccgacctggctctccgtcggctgggcgagcatgatcgtgctcattctcggtcggatgatcatcgagtcggtcaccggcggccgcatccgccgccggttcacgacgcccgccatgcccggggtgggtacccacccgcccgtgacccgggagctgcccgcatcgccacggaccggcctggagtccgactccgagccccagcccgtcccggccaccgcctga

SEQ ID NO: 7048 - DNA, 141 bp, Actinoplanes utahensis
gtgcacgaggtcgtcgtcgcggcggccacggtccgtacgcggcacgatgatcgggtgcgcgcacttccgccgatgggtgcgccgacctttgcccgatgcgaggcgggtaccctgccgaccggatattttattcaccgatag

SEQ ID NO: 7049 - DNA, 666 bp, Actinoplanes utahensis
atgttcgaggacactcccgtgactcccccaggcgatccttcgccggacaccggccggcgtgtcggcgcgacgccggcgccgcgacgggtggtgtcgggagacgtccgccaccggattcacctgtcccggcggtaccgcctcatcgccaccggcttggccgccggcgcggccggcatcgtgtccggcgtgtcgctcgtgggcctgttgcggccgaccacagatccggccgaggtgcacgccggtgcggcatccgtcgccgtcacgaatccaggctggtacccaccgaggccgcagatcccggtctccgtggagcccagccccacccgtgcttcgctccccccgtcacggcgaccaccggcgagcccggcgccgaccgctgttcccgccacggtcaccatcctcccggccgaccacgagagggatctgcgctcggtcgagtccgaccgggagaccgaaatcaggttcgtcaaccggcgcgacgagcccatcgtgatcaattggttggactaccggggaaaaagggagaattacggaattctcgccgccgggggcgtccgggaacaggtaacctacgtcaaccacccgtgggtgatcaccgacctgcggggccgggccctggcgatcctgctgcccgacacccgacccgctcaggcgacgatcacctga

SEQ ID NO: 7050 - DNA, 546 bp, Actinoplanes utahensis
atggtcccgctcagcgagctgctgcgccgcaaccgccacttcgccgcccacgccgacctgaccagactcaccctgcccacagccctgcccgaccggctgctcctgatcctcacctgcctggacccgcgcgtcgaaccggccggcttcctgggcctgggccccggcgaagccgcggtcctgcgcaacgccgggggccgcgtcgacgagcgggtgacgcaggacatcgcgctgctggccctgcgcttcggcgtccggatggacgtggcgatcatccaacacacccagtgcggaaccggcctgctggccgatcccgcgttccggcgcgacgtcgccgaccgcaccggggccggcgacgccgagctgaccgcgaaggcggtgaccgacccggtcgccaccgtgcgacaggacgtcgccaggctgctcgctcatcctctggcggcggacggcctcgtcgtcagcgtctccggtcacgcgttccggctggagacggggctcgtcgaaacggtcgtcgacgccgttgcgccggccgggcgccacgcagcgtaa

SEQ ID NO: 7051 - DNA, 1113 bp, Actinoplanes utahensis
gtgaaacatgcggccctcgccgctgtcgtgatcctggccggcgccgccgtgggcgtcgccggccggggtccggcccgggcggcagcatcgacctgtgacgtgacctggacggcgaactcgtggagcaccgggttcaccgccgacgtgaaggtcaccaacctcggcgcggcggtcacctcgtggacgctgggctgggatttcgccggcggccagaaggtcacctcggcctggaacgcgaccgtcacccagtccgggacgacggtgaccgcggccagcgtcggctggaacgggcccctgcccaccggggcgaccacgtcgttcggcttccagggcacctactccgggaccaacaccgcgccgtcgaccttccgcttcaacggggtgacctgcggggcggaaccgacgccgccggtcacaccgtcggcgtccacgtcgaccgttcccggcacctgcggcacccgttgtgacggcttcgagaacaagctggcgaactggacggtgaccacccaggactgttccggggcgggcaccgccgcgatcgacacgacggtggcgcactccggcaccgcctcgttgcggatcaacggcgccgccggatactgcaaccacgtgttcgcccgcaacaccagtctgctcgccgggaccggcaacgtctggtatgtccgttactgggtgcggcacaccaccgcgctgccggccgcgcacgtcaccgcggtggcgatggccgacgccaatgacggcggccgggatctgcggttcggcgggcagaacggggcgctgcagttcaaccgggcctccgacgacgcgacgctgcccgagcagagcccggccggggtggcgctgtcccgggcgctgccgaccggcacctggaactgcgtcgagttcaaggtcgacggctcgaccggcacgatcgagacctggctcaacggcacctcggtgcccggcctgctggaggacggcgtggcgacccacgacgtcgacggtcagtggctcgaccggacgtggcggccggccctgaccgacctgcggctgggctgggaagcctatggcgagggcgctgacaccctctggtacgacgacgtcgcggtgtcttcggctcgcaacggctgctga

SEQ ID NO: 7052 - DNA, 1602 bp, Actinoplanes utahensis
atgaagacccgaatgtggctggccggcgcgacagcgctggcggccgcggcggcgatggctgcggtcgtcaccgcgcaaccggccgtcgccgccggcggcggtaccgggaccggctacctgcacaccagcggcaacaagatcgtggacagcacgggcgccaccgtccggctgaccgggatcaactggttcggcatggagaccgacaacaagaccttccacgggctgtggtccagcaacccgtggaagagccagatcgacacgatggcctcgctgggctacaacacgctgcgggtgccgttctccgacgactcgctcaaggccggggcgaccgcgaccgggatcaacgacaacaccaacccggacctggtggggctgtcaccgctgcagatcctggacagggtcgtggcgtacgccgggaccaaggggatgcggatcatcctggaccggcaccggccgacctcggccgggcagaccgcgctctggtacaccgccgccgtgccggagaccacctggatcgccgattggaagagcctggcccagcggtacgcgggcaaccccaccgtgatcggcgccgacctgcacaacgagccgcacgcggagggcaccaacccggccgcgaccggcgcctgctggggctgcggggacacggcccgcgactggcggctggcggccgagcgggccggcaacgcgatcctcggcgtccagccgaactggctgatcttcgtggagggggtcagctgcccgagtggcggactctccaacgtgtgggacaacgaccccggcaacgacgaggactgcggctggtggggcggcaacctgtccaaggcgggggatttcccggtccggctcagtgtggcgaaccggctggtctactccccgcacgaatacgcgacgtcggtctaccaccaggcgtggttcgacgacccgtcgtacccggcgaacatgccggccatctgggaccactactggggctacctgtacaagcagaacctcgccccgatcatgatgggtgagttcggcaccacgctggccagcaccatcgacaggatctggctgcaagagctgctgaagtacaccggcaccggggtgaacgggatgtcgttcacctactggtcgtggaacccgaactcgggcgacaccggcggcatcgccaacgacgactggaccacgatcaaccaggccaagcaggcgatcctgcagccgtacctgatcgcgccgatcggtggcggcaacgggggcaccggctcgccgtccccgtccgcctcgtcgtcctcgtcgacgccggtgcccggctggtcgtgcaaggtcacgtacacccaggacaacgcctggcagggcggcttccaggggcaggtcaaggtgcagaacaccggcaccggcacggtcagcccgtggcaggtcacctggacctggccgtccggggtgaccctggtcaacggctggaacgcgaccgtcgtccagagcgggaccacggtcaccgcggccgcgccgagctacgcgtcgtcgctcgcggcgggcgcctcggtctcggttggtttcaccgccaacggtacggccagtgctccggccaccgtgaaactcaacggcgtggcctgctcgtga

SEQ ID NO: 7053 - DNA, 558 bp, Actinoplanes utahensis
atggatctgtacgggaccgaacccgagggtgtcgaatccgagggcatgggcgccgcgccgtcggtggcgaaactgcttctggagctccgcggccggaccaccgtcgacgtcaagccggtcggtcgcagcatccagatccgcccgcagggcgcgcggaacgtggcggtgcacatccacccgggcggggtcgacatcgcggtggcccgcaaccaggccgacgaggtcgcggcgacgatcttcggagcgacggtgaaggatccggacgacccggtgccgttcgtgtcggtcgagggtcatctgatcgacaccaactacgacgccatcctggccgcctcggtgcaggccgtcgagctgcgcaaggccggcggcccggcgaaggcgccgcgcgccgcggcgagtggcggctccggcacgccccgcgccgcctcgacccgctcggcggcaccgaaggcgaccaaatcgacccggcccgcgccgcgccccgaccggccgatctgcccgcgctgtaagcagtacgagctgctggccagcggcgagtgcccgtccggttactgctga

SEQ ID NO: 7054 - DNA, 789 bp, Actinoplanes utahensis
atggggtcgaccctaggtgcggcgcggggccgggtcttgtatgaatcggccatgggctacatcgagtgggcgccgccgccgtcgctgcgtggggtggtggcctgcctgtggcgcagcacgctgccggagcggccgagccgggtgccgatgccgatcctgccggacgggtgcgtggacctgatctggcagagcgggcacggggcgttcctggccggcccggacacccggccggtgccgaacgagggacgtgccgggcgggagatcgtcggggtgcggctgcggcccggggccggggggacggtgctcgggatgccgctggaaccgttgcagaacctgcggcccgggctcggcgaggtcgttcccgggctggtggtgccggcggaggtgcgggcgggggaggcgctgcgccggctgatcgtggcgaccgggcggctggcccgggagaacccggtggatccggcgatgctggcggcggcccggatgctgcgcgatccgcggatccgggtggatgaggtggcagttgaggtcgggctcagcgatcggcagctgcggcggcggttcacggcggcggtcgggtacggaccgaagacgctgcagcggatctaccggttccggcggtatctggcgatggtgggggaggggagcgccggggagctggcggtgcgcgccgggtacaccgatcaggcgcatctgagccgggagacggtggagttcgccgggctgccgcccgcggccctggcccgccggatgcggcgggaccaggggtcggtgggcgccggcttccgctga

SEQ ID NO: 7055 - DNA, 864 bp, Actinoplanes utahensis
atgagcgctgatttcgccgccgccgaccgtttccttcaggccgagggtcgccttctcgaccgccgcctgttcgccaccctgttccggggcgcgtccccggacggcgtggtcgacgccctgcgcggctaccgcaacgccgacggcggtttcgggcacggcctggagccggacaagcgctgtccggccagcctcccgatcgacgtcgaggtcgccttccaggccctggccgccgccggggtcgccgacccgggcctgctcggcccggcgtgcgacttcctgaccaccgtgacgaaggacggcgccgtcccgctggcgttcccggtcatcgaggaccatccgcgggccgcccactggaccgactggacctacgagccgggcgtcaatcccaccgccggcctcgccggtctgctgcaccagctcggcttcgcccacccgtggctcgacaccgccaccagctactgctggaccgtgatcgagtcgggccgccttccggaggagacgcacgcactctccgagctgctcgtcttcctcacccacgtgcccgaccggccccgcgccgagcgcagcgccgagagcgtgctggccgcgatcaccggttcggagctctttcagaccgaaccccggatcggcgcgtacgggttgaccccactgcacgtggctcccaccgccggctcgccgtggcgggccctgttcgaggacgcgcagctcgacgcccacctggaggctctggccgcggcccagcaggacgacggcggctggccggtcacctgggagccgccgagcgcggcggccctcctggactggcgcggccacgtgaccctgcaggcggtgcgcacgctgacctcgtacgggaaaccggggtag

SEQ ID NO: 7056 - DNA, 1173 bp, Actinoplanes utahensis
atgcacgcgccgatgggggccgttcgccggctgatggatctgcgacaccgggggcgagccgaggatctgcccggggtcctcacggccgccgcgccgctgctcgacgcccgggcggcgatcgtgctgctggtcgactacgcgcagcgtgagctgcatccgctgcgcgggacgacgccggtggcgccacaggcggtggagggcaccccggcggggcgggcgttcaccaccggtgatcagcagtggtcaccggagccggacggtggcggcgtgctgtggctgccgctgctgcacggggcggagcggctgggtgtgctggcgttgcggttcacgacgtaccccgtcatcgatcttcgcgacgatctggaggtgatcgcggcgctggtggcggagctgatcgcgagccggcggttctacggtgacgcggtggagcagacccggcggcggctgccgatgcagctggccgccgaggtgatctggaaccagttgccgccgctgacctatgcgatcgacgggaccacggtcaccgcggtcctcgaaccctgctacgacgtgggcggagacgcgttcgactacgcggccaacggcgagaccctgcacgtggcgctcttcgacacggtcgggcacgggatcagcgcgagcgcgctgaccacgctcaccctcaacacgtaccgtaatgcccgtcggtccggcctgtcgctggtggacacgtgccggtcgatcgacaagtggatccgcgcgcagtatccgggggcgttcgtcaccgcgctgctcgccgagctcgacctggcgtccggggtgtaccggcggatcagcgccggtcatccggccgagctgttcttccgcggtgatcggagccggtcaccgctaccgtcgccgaacacactgccgctcggcctggggcacatgctcacccggccgccgcgggtggtggagcagcggctggagccgggtgacacgctggtcttctacaccgacgggatcaccgaggcgcgcgacgcgtccggcgtgctgttcggggtggaccggctgaccgcgttcttcgaggacgcactgcgacaccgccggccggcgccggagacgatgcgccggctgatccacaccatcgtgtcgtacgaggaggaggagctccgcgacgacgcgaccgcggcgatgctgcgctggcggactacgtga

SEQ ID NO: 7057 - DNA, 789 bp, Actinoplanes utahensis
atggtgcccggtgatcttcagacggatcggccgcactcggcgcggatctacgacttcctgctggggggcaaggacaacttcgaggcggaccggcgggccgcggcgcagatgctggagcacacgccggcgctgccgatctcgatggcggccaaccggcggtggatggcccgggtcgggcgctacctggccgggcgcggcatccggcagttcctcgacgtcggcaccgggctgccgacccggcccaacctgcacgaggtggtgcagaccgaggctccggaagcgtcgatcgtctacgtcgacaacgacccgctggtgctggcgcacgcccgtgccctgctcaccccgatcggcaccggcagcgtctcctacctggacgccgacctgcgccggccggacacgatcctggggtcggcggccgtccgggacggattcgacctgaaccggccggtggccgtcacgctaatcgccgtcctgcagcatgtgaccgatgacgatcaggtccgcgacatcctggcccagctgaccgcaccgctgccggcgggcagcgcggtggccctgtcggtggtcaccgtcgacaacgacgcggccggtgagggcaccgtccggacgtacaaccagaacggtgtgccggtcgtcgcccgcccgcgtgccgcggtcgagcgcctgttcgccggcttcgacctggtcgagccgggtgtcgtcccggtgcaccactggcatccggccgacgaggaccgcgcggtcagcgacgccgacgtctacatgctcggtggtgtggctttcacgtag

SEQ ID NO: 7058 - DNA, 1353 bp, Actinoplanes utahensis
atggcgcatcgccgttcgcgaaccgaccccgtgctgggcgccgtcacgatcgccgtacgtccggagaccgatccggcactgtgggtcctgctggaccgctacccgatcggctcaacggggcaaccgcaggcactcgtcggcgacctgatgacccagacgaggctgaacatgccgggcacgtttgtgcacgagtgggcgcatgtcctccaggcggccgcgtacccgatgctgtatctacgagcctcacgcgaatggcggatggtccggacgacatggaattatctcgccgcgcatcccgggcgctatccgctgcccatagggatccagtgggacgccgacatacgccgtgcacgacaggtggagactgctccggcgcggatcgagatacgcggacgcagtgttcaggtcgtgccggcgagtttcgacaaattcgagcggggcgtgctcgtcgacaacgacctcctggaggaggatgcgagcattttccaataccgtgtggagcgcggcggctggggaagcggaaccgactaccagcggtgggtgaacgaacgctgcagttactcggcggtcttctccttcctgcgtcgatacctgccgatcgatacggcgtacgcgctcattcccatcgccgcacgcgtcgcttaccgcaccaccgacccgctcaccgctttggccatcatggtggggtcctctctgcacgaaggcgacaaacacatcgacgaggagaacgaggatttctgggaattcctcatggccatgtccgtcgaccgccttctgtcgccggctgccgacgaggcggtcggctggactcgtcacgcggatgtcgacgcggcgctgatcaccagtcagcagatgcgccgggcggttgacgccggcagcttcctgccgatcaaccacctcgcgcgccgcaatgtctccgacgccagtgtcgagaaagtgctgcgccgcccctgggagcacatcgcgccgaacgggggtgccgacgagtgcgccacctcgttgttgccgccggcgactgtcttcgaactcgccgatccggcacggttggcaatcagtctccaccgctccttcgcccagctgcacccggtggcgggtgcggagttcacgttcgctgatgtgtacccgacgatgctccagcagaaattgatgttcgacgtgcaggtggggggtcgcagtgcgcttcgcgtctgtccgcaccagacctgccgtgtccacggcaccgatctgtgtgaagggtacttcccggtgccgcgtgaaccggaggactgcggcttcccagatctgttccgcatgctgaccggcatgaccgtctcgtcagacggcgccaccttggaacccgtccaggaaggatga

SEQ ID NO: 7059 - DNA, 354 bp, Actinoplanes utahensis
atggaacttctcatcgagggtgacccgcagacactccacattctgcgacgggagatcgacgaccggatcggcgccgcggcagagctcgagccccggtacgaccggacggtgggcaccctcaacgaaccgattctgattgctctcatcgtggcactcggcggcaaggagatcatcctcgccgtccgcgacatcatcaaccgacgctacgaacacctggagcggatcgaggcgaccaggtacgccgccgatctgacattgactcttcgcgaccagaggggcgaccgcgtagtcagcgtcgacgagctgatcggggaggcgcgcgatgggcagccgtctgccgacatacgaccgtag

SEQ ID NO: 7060 - DNA, 510 bp, Actinoplanes utahensis
atgggcagccgtctgccgacatacgaccgtaggcaggtgtacgtggaggtcgatcccgatactgcccacgatccgagtaggctcgcctggcacttccggagcgcgtcgctcgcgacggccgactgggccggatgtacggtattcatcttccccgacctcgagcgggaggacctgccgatattcctggacgagcgggtccggacgttctaccgcaaactctgtgacgacgtcccgtttctcctctatttcctcgatccggaaccgggcacgggaactctgctcagcgtgctgtgcgcccatgcccgcgacgaccagatcgctcagcgccacggcatggtcgagatcgatccggacgaacgactgcgcgaccggtgcgcccggctggtcgccgacgccgcggtctacgccgatcggctgggtgacgattggccggcgttcgtcgacgaactgcctctcccggacgacttccgcacccgggcgctgaggatgtgccaaggtcgcattccctga

SEQ ID NO: 7061 - DNA, 489 bp, Actinoplanes utahensis
atgggtttcttcgggacggtgatgctcatccgggcggatgtggacctcgagacgttgcccgccgtcgtcgcgctcggcggcacgctggacgccgcctggaccggggagcacggctggcggttcgcccgggtgtacgacgggaagtcgttcctgccggccggggtccgtgccgtcgccgagcagaccggcgcgccgttcctggccgcctacgtcgtggacagcgacttcgcgatcgtccagtgtgccgccccgagcctgccggagatccagttcgtgctcaacccggcgtgcgccgcggactacgactacccggtcgacccggcggtccaggaggccgcggtgcgctacctcctggacttcgccggcgggcggggtgacgcggcccggatccgggccgtggtcgaggacgatctgacgttcgccgaggaagcggtgccgcggctggcggccgcgctgggggccggatccgtcgaggatcccgaccggtag

SEQ ID NO: 7062 - DNA, 753 bp, Actinoplanes utahensis
atgggggcccttccgatcaccgcttgtttgattttccagcggctggggcacctcgcggcgatgcccgataccgtcaaagcccgccgcggggaagcgcggctgccgtccgccgcggtggtcgtggtggcgatcgccctctacgcgctgctgccggagcagctgatcatcgggccgcgcctggtgatcccggccctcgaagtgatgctgctgatcgcgttgctggtggtcaatccgtaccggatgacccgggacagtccgtgggagcgggtcgccgcgctgaccctggtcgcgctgatcgcggtggccaacgcggtcgccctggtgctgctgctgcgccagctggtcaccaccgacgactcgcagtcggtggagttgctgatcgccgccgggcaggtgtggctgaccaatgtgatcgtctacgggctcgcgttctgggagctggaccgcggcggaccggtcgcgcggacccacgtcgcgcgtgaccggctgccccgggccgacttccggttcccgcaggacgaggaccatgacacgatcgacgaggtgcaggcgggttccagcaaggtcagcgactgggtgccggccatcgtcgattacctgtacgtgtcgttgagcaactcgtcggcgttcagcccgaccgacaccatgccgctgtccacccgggcgaagatcctgatgggcatcgagtcgacgtccgctctggtcatctcggtgctggtgatcgccaagggggtcggcggcctcggccactga

SEQ ID NO: 7063 - DNA, 276 bp, Actinoplanes utahensis
gtgaccacggaacgaaacttcgccgacgccgaaaccttgactccggtgatgcgggaggtcttcggcacccgccgccggatcaccgccgtcgaccgcctaccgaacggcaccaagacgggcgtctaccgcgtcaccatggacgacttgacgagcgcgatcgcctatatctggaacgccgaagaggactactgggacgggctgctcacggacggccacgacgacccctcgaaccctttcgcccacgcacctcggttacgtggcgaggtgacctgctga

SEQ ID NO: 7064 - DNA, 384 bp, Actinoplanes utahensis
atgcagcgtttcgagcggcctgcgggcctgcctccggtcaatgggtacagccatgtcgtcgcgttctcgggcaccatggtcgccgtgtcaggtcaggtcccgcttgacgggaacggccagttggtcggcctcgacgatcccgcgcaacagatgcgtcaggtgttccacaatctcggtgtcgctctcgccgcggcaggctcaggcttcgagcggatcgtcaagttgaccgtcttcctcaccgacatggccgacctggatgtcttccgggaggttcgcgacgagtacctggacggggcggccctgccggcaagttcgttggtgcaggtcgcggcattgatcaatcccgcatttcgggtggagatcgacgcactcgcgctcgcctga

SEQ ID NO: 7065 - DNA, 1302 bp, Actinoplanes utahensis
gtgaggcgtttcaacggccggctgcgctcggcgacgatcatcggcctgcagggcatccgcgcccgtaagctgcgcaccctgctgtccatggtgagtctcttcctcggcgtgctggccgtggtggtggtgcaggccggcgccggcatcgccgaacgcctgcagctggccgacctggagctgcagtccggcatcgacggcaccaaggtcatctacggggtgccgccggccgcgggcgctgccgaagcggtcgcctcgacggtcaaggggcgcaccgacgcggtcgccatgttcaacgtcaccgcgatcatcggcgagcccggcgtccggccggtcaacgagggcggcggctccttcgaccaggactacagcggtggcggcgcggtgaccatctgcgacacgccgacacactgctacgacccgaacgcgggcgcccccaaggggcaggcgatcgagttgcggatcagcgcgctgaccggcgacgtgcgcaccttccggccctatcggcaccgctccgggcgctggctcgacttcaccagccagccgatgctcgcccccggcctggtcctcaacgaggaggccgccaaaggcctcgaccgctaccacgtgcccgccgagatgcgagtcagcggtgccacggccaacatgacaccccggatcctcggcgtgatcaaggacggagattcacaaccccatgcctatgtacgtcttgacgagctgaccagctggctgccgctggccagactgtccgacccgaacggcggcaacgtcgacagccaggtgctgctggccgcggccaccccggtcgaaccggtcctgctcaccaaactcaaagccctcagtggcaacgacgtgaccgctgagacgatcaactcccgcaaggagatgaaggaacagctcaacctgctccggatgatcttcctggcgatggcgtccctggtcctgatcatcggcgcggccggtgtcctcaacgtcggcctggccaccgtcggcgaacgcgtcgaggaattcgccctgcgccgcgccgtcggcacaccgcgggccgtgctggccggcatcgtcctcgccgaaaccctgctcaccggcctgctcaccgcagcactcgcgatcggcttcagcatcgcggcgctcaaggtgggcacgatcgtcctcgggccgtccgagccgttcctgcaatccgtggtgttcccctggtcggccggcgtctcggggatcatcgccggcctggcggccggcatcctcggcggcttcatcccggcgatccgggcggccggcatcccgatcgccacggtgatgcgcgcctag

SEQ ID NO: 7066 - DNA, 690 bp, Actinoplanes utahensis
atgaccgcgctgatcgaactgaccgggatcaccaaggtcctcaagggccagaaggagccgcggaccatcctggacggcgtcgacctgaccgtccatcccggcgagagcgtggccatcgtcggccgctccggctccggcaagagcaccctgctcagcgtgctgggcctgttcgaccggccggactccggcacctacctgctcgacggccaggacatcagccgcctcaaagaacggcacgccgcccggctgcgcagctcccactacggcttcgtgtttcagcgcttcttcctgctcaagcacctgaccgcggcgcagaacgtggcgatggcgctggtcaacgggcagggctggcagccccgccgggaacgccgagcccgggtgatgcaggccctcgagcaggtcggcatcgcgcacctggcgaagaaccggccggccaagatgtccggcggcgaacagcagcgggtggcgatcgcccgggccctggtccgcgaaccccgggtgctgctggccgacgagccgaccggggcgctcgacctggagaccggcaccatcgtgatcgacgcgctgcaggaggcgaccggccggggctgcgcgctgatcctggtcacccacgaccgggaccacgcggcacggatgggacggaccctggacctgcgcaacggcgtactcaatgatcgggttttgacgtga

SEQ ID NO: 7067 - DNA, 429 bp, Actinoplanes utahensis
gtgccggagccggtcgtcgccgccaccaccccggccgcgcagaacccgtccgccccggccgcgcccgaccggggcaccgccggcggcgccaccggcgggtccgaggcgaccgggatgcgcctggtctgcgtgccaccggccggcgtcaagctgatcaacggcgccgacgtgaccatcgaggtggtcaccgaccgggcgagcaaggtgctcgtgctgccggtcgaggcggtcgccggcgcgcagggccggggcaaggtcgacctggtcgtcggcgacgggcagacgcgcaagacgatcgacgtcacgctgggcatctcggacggcaaggtgatcgagatcaagaaggggctgaccggcgacgagacggtcgccgtgcccgggccgaacctgcccacggtggcaccgaccggcggcgggaccaacggatga

SEQ ID NO: 7068 - DNA, 1224 bp, Actinoplanes utahensis
gtgctgcgggtagccgtcgtgccacacgctggccacccagagcgggttcttggccggcgtccggggcggggtccggccggggaaccgcaactccccgtcgaccggcgcgaccaggccgaagaccgggttgatcgtcaccttgccggccaggctgagccggttcgccagatcctgccggacgggtttgaccgtggtcaggaccgtgccacggtcggcgagcccgggggtttcggcggtatcgtgcgaggcggagcagcctccggccgccaggaccaccaccaggcccaggagggcatgcctgcgaagaaccaccgaatcccccgtcgtcaatgcattcaacagcgcggcgaagggtaccggaccggcgcaaccccggcagccggctgccatcatggtcggatgatgctcctggtccccggggatccggtgcggccgcggcgacccgacgggcacttcgcggccgaggccgccgccgcgccggcgttcgccgtggtcgaccacgacgcactggccgcgggcggcgacgcggacgcggcggtgagccgggtgccggccgcggcggacgctgtctatcgcgggtggatgctgagcgccccgcactatgcggcgatggcggcggcgctgtgccggcgcggggtgacactgcgcacgagccccggcgactaccagcgggcccacgagctgcccggctggtacgcggtggtcgccgggcacaccccggagacggtgtggaccgacgctgacatcgccccggcctgcgcggcgctgggtggcggcgcggcggtgctgcgcgactacacgaagtcgatgaagcattactggcacgaggcggcgtacgtcccggacgtgaccgacgtcgaggccgcgcgccgggtcgccgcccgcttccgcgagctgcgcgacgacgcgttcaccggcggcctggtgctgcgccgcttcgagccgttccgcggcgccgaggtgcgcacctggtggctgcgcggttcctgccgcctggtcaccgcacacccggacaccccggacgagctgccgccggacgacctcgacccgggtttcctggcgccggcgatgcgcacgctggctctgccgttcgtcaccgccgacctggcccgccacgccgacggtcgctggcgtctcgtcgaaatcggcgacggccaggtcagcgaccgccccgccaccacgccgccggcccgtctgatcgacctcctcgcgaccgcgtcatga

SEQ ID NO: 7069 - DNA, 915 bp, Actinoplanes utahensis
atgagcgaataccgtgccgaggacatcgtggttctggagttcccggaggcggtccagcggcggcccgggatgtacttcggagtcggtcggggcgatccacgactgccgtccgaggtggtgcgcaccgtcgccggcgccgcgttccaccccgcaccgcccggcgtcgagcatcgaccggacgtcgtcgtggagatcctcggcgatctggtgttctccgtgaccgtccgatcggtcaccgcgctgcccgacggcaccgcccgcggctgtcaaggatgcctgctcaccgcgccactgatgtggtgggcggcggccgccgcggtcagcgtctcggccgtggtcgagacctgggcggacggtcgtgcgctccgcgaggaactccgccacggccggccggccggaccgccgcagccccggccggcgccggagggacgggggctgcgggtcacgtaccacctggacccggagctgctcgcgcccggcgcggcgatcgccaccgaaccggcttccctggacccttacggcccgtactgcgccgcgcaccgcggccccggtcaggtgaccctccacgaccggcgtgccccgggaactccggcggtccgatggcccggcgaccggtcagcgataggtctggcggctgaccaggacggcgacgatggtgaccagcagcagggcgaacgggaggcggccgcgggcgcgcagcgggatgttcacgccggcgaacatggcggtcaggacgagcatggtggtcgcgccgagccggatcgcgaagctgccgtagtcctcggtgatccggggatcgccggtgatccagcccgcccgcgcggcgacggcgtagcccgcgaggtagaggaacggccagcccaggccggcgagggcgccgacgatggtattgccggccaggtaaagaaggcgtga

SEQ ID NO: 7070 - DNA, 306 bp, Actinoplanes utahensis
gtgatctcacgccttctttacctggccggcaataccatcgtcggcgccctcgccggcctgggctggccgttcctctacctcgcgggctacgccgtcgccgcgcgggcgggctggatcaccggcgatccccggatcaccgaggactacggcagcttcgcgatccggctcggcgcgaccaccatgctcgtcctgaccgccatgttcgccggcgtgaacatcccgctgcgcgcccgcggccgcctcccgttcgccctgctgctggtcaccatcgtcgccgtcctggtcagccgccagacctatcgctga

SEQ ID NO: 7071 - DNA, 885 bp, Actinoplanes utahensis
gtggagctgcggctgctgcgctacttcgtcgcgaccgccgaagccggcacggtcagcgccgccgccgtccggctgcacctgacccagcccgccctgtcccggcagctgcggctgctggaacgcgccctcggggtggcgctcttcgaccgcaccggccgccggctcgacctgtccaccaccggccgcgccctgctcccgctggcgcgcgacgtgctcacccgggtcgacgcgctgcgggtcgcggccgcggtcgccgcctccggccgcctggaacgcctcaccatcggcgcacccaccgtcacgctcaccgacgtcgtctcgccgttcatcgccacgctggcccccgaggaccccaacgccgacgtcctcgacgctgacggactgtcaccggtcgagacgttgcggctcggcgccgacctcgccatcggcacggtccgggccgctgatcccttccggtcgctgccgctcgcggtcctgccggtctgggcgtacgtcaccacggatcacccgtggtcgggccggccggccgtcacgctcaccgagttgctcaccgcgacgctgatcgtgcaaccgcccgccttcaccgcccggcaatcgctggagtcggccgtggccgcggcgggcgcgacgtacaccagcagcatcgaaaccgcgaacggcacggtcgcccaggcactggccgccgcggggcgtggggttgccgtcgcctccgacgacccgcgcttcggcctggtcccgctcccggtcgacgtcggcggccggcgcctgagcatccgcctcgccgccgtctgggactcccggcacgccgccgcacccaccctggagtccttcgccgcccgcctcggcgccttcatccgcgcccgctactcggccccggccgactga

SEQ ID NO: 7072 - DNA, 1341 bp, Actinoplanes utahensis
gtgaacagactgtgccgcgtgagcctcgaacagaagcgccggctggtcaccgcactgcccggcccccggtcccaggaactgatggaacgcaagctggccgcggtcgccggcggtgtcggcaccacgatgccggtgttcgcggcgcgggccggcggcggcatcgtggtcgacgtcgacggcaaccacctgatcgacctcggctccggcatcgcggtcaccaccgtgggcgccggcgcgccgcgggtggtcgccgccgtcaccgagcaggtggcggcgttcacgcacacctgtttcatggttacgccgtacgacggttacgtggccgtcgccgaggccctgaaccgcgtcacccccggtgaccacgagaagcgcagcgtgctgttcaactccggcgcggaagccgtggagaacgccgtgaagatcgcccgggcgcacaccggcagggacgcggtggtcgtcttcgatcacgcataccacggccggacgaacctgaccatggcgatgaccgcgaagagcatgccctacaagcacgggttcgggccgttcgcgcccgaggtgtaccgggcgcccgggtcgtatccgtaccgggacgccggcgtcgacggccgggccgccgcggcgcgggccatcgaccagatcgagaagcagatcggcgcggacaacctggccgcgctggtgatcgagccgatccagggcgagggcgggttcatcgagccggccgccggattcctgccggcgctcgccgcctggtgccgggccaacggcgtggtgttcgtggccgacgaggtgcagaccgggttcgcccgcaccggcgacatgttcgcctgcgaccgcgagggcgtggtacccgacctgatcgtcaccgcgaagggcatcgccggcgggctgccgctgtccgcggtgaccgggcgcgccgagatcatggacgcgccgcacgccggcgggctgggcggcacctacggcggcaacccgatcgcctgcgccgcggccctcgccgcgatcgagaccatcgagcaggacgggctgctcgcccgggcccgcgagatcgagacccgggtgaccgggcggctgcatgacatccgggacaaggacgaccggctcggtgacatccgcggacgcggcgcgatgatcgcggtcgagctggtccgggccgggggccgcgaagccgacccgcggctggcccgggacgtcgcccggtacgcccatcagcgcggcgtgatcgtcctgacctgcggaacgtacggcaatgttctccgattcctgccgccgttgtcgatcaccaatgagctgctcgatgacgcgttcgacgtgctggccgccgcattccaggagattcgatga

SEQ ID NO: 7073 - DNA, 1380 bp, Actinoplanes utahensis
atgagcattgtcgtggtggaccccgcctcgttgcgggcggttgccgaggtcccggaccagggcgtcgaggacgcccgggcggcggtcgacgcggcatacgcggcgttccccgcgtgggcgcggaccgccccgcggcaccggtcggagatcctgcgccgggcgtacgagctgatgctgcgcgaccgggagcggctggccgcgctgatcgccgaggagaacggtaagtcactgagcgacgcggccggcgaggtgacgtacgcggcggagttcttccgctggttcgccgaggaggccgtccggcccggcggcgaatacggcgaagccccggccggtggtgcccgcaccctggtcacgcaccggcccgtcggggtcgccgcgctggtcacgccgtggaacttcccggccgcgatgatcacccgcaaggtggggccggcgttggccgccggatgcaccgcggtgatcaagccggccgcggagacgccgctgaccgcgctggccctggccgggctgctcaccgaggcgggcgtgccggacggggtcgtcaccgtggtcaccacctcggacgcgtccggggtggtcggggcgtggctcaacgaccagcgggtccgcaagatcagcttcaccgggtcgaccgccgtcggccgggtgctgctgcggcacgccgccgaccgggtggtcaactcctcgatggagctgggcgggaacgcgccgttcatcgtcaccgaggacgccgacctcgacgcggcggtggccggggcgatgatcgcgaaattccgcaacggcgggcaggcgtgcacggcggcgaaccggttctatgtgcacgcggcggtcgccggtgagttcgtggcccggttcggtgcggccgtcgagaagctcaccgtgggcgcggcggcggacggcgccgacatcgggccgctgatcagcgcgcaggcgctgcggcgggtgacccggacggtggcggccgcggtggagagcggggcgcggatcgcgcaccgggcggcgacaccgtcgctgcccggccacttctatccgccgacgatcctggtcgacgtggcgcccgacgccgagatcctgcacgacgagatcttcgggccggtcgcgccgatcgtcacctggaccgacgaggcacgcatggtggcgcaggtcaacgccgcagagtacggcctcgcggcgtacgtgttctccggcgacctggcccgggccatccggatcggggaatcgatcgaggccggaatggtcggcatcaaccggggcctcgtctccgacccgtcggcgccgttcggcggggtgaagcagagcgggctgggccgggagggcgcccgcgaaggtctgcgggaattccaggagacgcactacctgagcgtcgcctggccggcctga

SEQ ID NO: 7074 - DNA, 909 bp, Actinoplanes utahensis
gtggagagcggagatctgatcgcgggccggtatcggctggagcgacggctggggcagggtgggtcggcggtggtgtggcgggccgtcgacgagttgctcggacggggagtcgcgctgaaggtgctggcgccggcgttggccgctgatcccgatctgcggcggcaggtggcggctgaggctcgggccgccgctcggctgcggcacgtgaatgtggtggggatccatgactgcggcgaactcgaggatgccggtgggcggctgccgtacgtcgtgatggaactcgtcgacgggcagtccctggacgacatgctccgacgcgggcggctcacctggcggcaggcggtcctgatcggcgcccaggtggccgcggcgctggcggccgcgcacgccgacggcatcgtgcaccgggatgtgaaaccggcgaacgtgatggtcaccggggccggggtcaagctggtcgacttcggtatctcggccgcggtgggtgcgctcgacgggcaggacgggcggctgatgggcaccccggcctacttggcgccggagcgcgtcaagggtgggccggtgcgtccggcgaccgatgtctacgcgctcgggctgctgctctacctggccctcgccggacagatgccgtgggaggcgtcgacggtcacccagatggtcaaggcgaacgtgtacgccgtcccggcaccgctgccggccgtgcccggcctgcctccggtcgtcgcccggctggtgacccgatgcctggcgaaacgtcccgccgaccggccgtcttccgccgaggccgcgcacgtactcggggagatcgccggactgccgtcgccggccctgctgcggggcgcggtcgccccgacggccgagctgccggtgcggccgggacgcggcaggcggggtgtgctggtcgcctag

SEQ ID NO: 7075 - DNA, 399 bp, Actinoplanes utahensis
gtgaccggcgggcgggacgcgaaactggttctcgacacgtcggcgatcgcggcgtgggtgcgcgggtcggtggcggtcggtgagacgctggccgaggtgaacgacgaggatggcgcggtcgtcattccgctgtcctgcctggtggaggcgggataccacacggcggtgctggggcgggagcggttggagctgctgctggcacatccggcgacgtccctgatcaccgacgacgccgaggactgggatgcgttggtggcgctgcgggcgctgaccgggcgggccgactgcgcttcggcggcgatgctcgccctggacctgggcgtcgacgtgatgaccagcgacccgagctggtacaagggcgtggccgacgggcggatcgtgctgcacgtcgaggattga

SEQ ID NO: 7076 - DNA, 618 bp, Actinoplanes utahensis
atgggccaaccgaccttgcgtaccgaccggctgctgctggtcccactcgccgaccggcatttcgagctggaggtcgggctcgacgccgacgccgaggtgctgcgatacatctgggggcgggcccggacccgggacgaggtggtcacctcgcacgccgaacggatggcgctcgccaccagggtgaacggcctcggccactggatggccttcggcacggacggcggccgccgcggctcgacggcccccgacggcgaggccgacggcgagttcatcggcctgatgatgctcccgccggcgcacggcgacgaccagccggacgatcccacggtcgccgagctgggctatcggctggcccggcggtactggcggctgggattggccagtgaggcctcccgcgccctgctgcggcacgccttcgacacggtgggtcagagccgggtgatcgcccagaccatggcggtcaacaccggatcgcgcggggtgatggagacggtcggcatgcgttacgtccgcaccttccacacctcctgggacgatcccttgccgggcaccgaggccggcgaggtggagtacgagatgacccgggcgatgtgggaatcgcaccgcggcacgctctga

SEQ ID NO: 7077 - DNA, 1053 bp, Actinoplanes utahensis
atgagaagcgctctgatctccggcgccagcgtcgccggtcccgccctggcctggtttctccgtcgcgacggctggcaggtgacagtcgtcgaacgcgcgccggctctgcgagacagcggctattcggtggatttccgcggcgacgccctcggcgtgctggcggagctcggcgtcctcgacgaggtccggacccacgagaccgggacgctcggcacgacgctgctggatcccaccgggcagccggtcggtgagctgccccccgaggccttcggcggtgatctcgaggtgcccaaggtggccctgacccggatcctgcaccggatcgccgacgtcgcatacctcttcgacgacaccgtcaccgccctcacgcagcacgacgaccgggtcgcggtgaccttcgagagggcgccggcgcgcgacttcgacctggtcttcggcgccgacgggctccgatcggcggtgcgccgcctcgccttccccggcgtcgacccggtcgagcatctcggcatgtccggcggggcgttcagcaccgacgactatctccagctcgaccgtcgaggcctgttgcaggccgggccgggccgcgcgatctacctgttcccggccatcgacccggggcggatgtgggtcagtctgtccttcgcgacgggcaatccggagttcgaccgcttcgatcggccggtccatgagggtgccctgcgcggggtgttcgccacccatccgtgggcggaggtgcctcggctgctggatgcgatgtccgcggccgacgacttctacttcgcctcgaccgcccaggtccacctcgactcctggtcgaccggccgggtcgcgctgctcggcgacgcgggctactgcgccgcgccgaccagcggcatgggcacctcccaggcgttgatcgccgcctccacgctggcccgctgcctggctgaggccggcgacgaccacgcgaccgccttccagcggtacgagaccgagttgcgcccctatgtcaccgcgaaccagaaggcgggccgtgcggcgatccccggcttcggcggcgcggacgtcgagtga

SEQ ID NO: 7078 - DNA, 492 bp, Actinoplanes utahensis
gtgggaaatcgggaggccctcatcgagggcgcgaagcgctgcctgaccgagcgcggctgggctcggacgaccgtgcgcgacatcgcgttcaccgccggcgtcaaccacgccgcgatcggctatcacttcggctcccgcgagtcgctgctggtccacgccctggtggaggccgtcgaggagctgtcggagacggtcgccacccaggctcaggacagctccgcggaggctcgctggcaggcgctgatcgacaccttcggcacccatcgcgcgttgtggatcgcccagctggaggcggcggtgcaggccgagcactcccccgagctgcgggagcggctcgccgccgcgcaacgccagggccgggaggggctcggcggttccgttcccctcgccctgctcagcggtctgatgctgcagtggctggtcgaccccgacgaggcgcccgacggcgcccaggtggtcagcgagctgcgcgctcaggcagccgaggtgtga

SEQ ID NO: 7079 - DNA, 828 bp, Actinoplanes utahensis
atgcccgacgtccgccgcctgattgcgacggccctgcctgactaccgggtcgagtcggtcagcgtgctcggccagggtctggacaacgtggcctatgagatcaacggcgacttgatcgtacgtctcagcaagaccccggacgcttcacgaaccgtccgggaggcccgcctgctcaccgaggtccgccggttcgcgccgctgcccgtccccgagccggtgctcaccctcgccgagcagggctgtctcgcctatcgcaagctgcccggggttcccctgctcgacctgccggcggccgggcagcccgagaggatcatcgccgcgctaagagatttcctggcggccctgcacgccatcgcgccggagcggctggccggcctggcggatgccgacgagcaggcgccgtccgagtggctggaggaggccgccgagacctacgcgttcatctcgcaccggataccggcgtcctaccgtccccgggtcgacgccttcctgtccgccgagccgccgccggccggcgacacgctcgtgttctcgcacaacgacctgggcatcgaacacgtcctgatcgacccggcgacgtcgcaggtcaccggcatcatcgattggagcgacgccgccctggtcgatccggcccacgacccgggccggctctaccgtgacctgggcccggccgcgctgcccgccgatcagtcgccggccgtccatgaccgggcgatcttctacgcccgatgcggcgtgctggaggacttcgcctacggcgtggaaaccggccggacccgatacaccgagaagtccctgaacgcgctggcatggctgttcccaccatag

SEQ ID NO: 7080 - DNA, 966 bp, Actinoplanes utahensis
atggacgctctagccggccggctcgcggccgaaaccgacatccgtactctgcagatggggcagtactccgggtatctcgacgatccgtcggaacccgcggtcacccggcacgggctgcaacccgacggccgcttccaccccggcgacgtcctggtggacctgcccgccggcgagccgatcggcgacgtcggttatcagaactgtgtcccggcggcgatggccctgctcgcgcaggcctggtacgcggccggcaaggagcagtacaacccgacccttgaggacacgctgcgcatctacgagaaggtctcccccttccggcgtgatccggccggcgcggcggtggcgagcaatgccgcgggcagggcagcgaacgaagcagaccgatcggcgcagcgaccgacccccgcccagccgatctcgaagcaccgggaagcccacaacgacttcggcacgagtctgctcctggcgctgaaggtgtgggtccacaaagaccagccactggccggcctgctcccggaggcccgctcgttcctggagatcgagccccgcaatctggaccagctgcgcgaggcggtgctccggttcggcggcgtcctgctcggcctggcactgcctcagtcgatcaaggatgcgcagggcacgctgcgcgaatcctggtatgtgcccggctacggcccggtctacgacgccactgcgggcagcctgtcgagtcactgcgtggcgatcaccggtttctcgcagcgtgagttcttctgcctcagcgccggtcgggtccggcgactgtcgccggagttcgtgctgacctacgccgacgaggcgtacacggtcaccccgcccgccgcgctggacgccaacccgggcctgcgcgaccggatcagcagggatgtcgacgacatccgcaggagcgaccgtccggccggaatgccggccttcaaccaccgctggcgaggcggcaacatcatgtag

SEQ ID NO: 7081 - DNA, 2925 bp, Actinoplanes utahensis
atggctggcttgaagggcttcgtgggtcgtgcggccgagctggcggacctggccggagcgctcggcgacgcggtccgcggcgacccccgaaccgtgttgatcgccggcgaggccggtgtcggcaagacccggctgttggaggagttcgaggaacgctgcgccgggcgtgagctgctgctcgcccgcggcgcctgcgtgtcggtcggcgccggcgagctgccctacagcccgtggctcgcggcgatgcgcgcggtcgaggccgaggcgctcgccgaggtgccgggcgcggaacaggcggcgctgtccgcgctgatcccggcgctgcccgacccgggcagcccgcgcgagggcgggcaactggcccgggcccacctgttctcgctgttcctggaattcctggggcggctggcggcgaaacggccactggtggtgctgctcgaagacctgcactgggcggacacgtcgtcgctggacctgctgctcttcctcagccgcaacctgcggcgggccgccgtcctgctggtcgggacgttccgcaccgatgagctggaggaggactcgcgccaccgggtcgtgttcggcgagctgatccggggccggtcgacgacgtaccgggaaatgtcccgattcggcgagagtgaactcgcggatctgctgcgcgtgtccgcgccgatctcggacgcggtgatcagcaaggtgtaccagcggtccggcggcaacgcgtttctggcccaggagatcctcgccgccgagcagcgcaaccccggcggaccggtccccgaccacctgcgggacctgctgatgatgcgggtcgaagggctctccgaggagggccagaggatcgtcggggtgttggccgcggccggccgtccggtctccggggcgttgctggaggcggccagcgggctgcccggtccggcattgcggtccgggttgcgcgatgcggtggcccggcaggttcttgtccgtacgcccgaagaaagttaccaattgcgtcattcgctcactgcggagacctactaccaggacctgctccccggcgagcgggccggtctgcacctggcggtggcgggtgcgctggccgcgtcggccgggccggagacgtccgcgatcgtgcaggccgaactggcccaccactggtttcagggccgcaaggacgacgacgcgctgttctggacgctgcgggcggctcgatcggcggccctggtgcacgcgtacgcggaagcccggcggcagtacgggcgggtgctcgacctgtggcggcgggtgcccgaagcggccgagttgtgcgagaccacctatccgcggctgctcgacgaggcggccgaagtgctcgactacgccggggacccgcagcgggcggtgcaactgaccggggaggcgatccaggtcgtcggggccggcggggaccggcaggaactggcccggctgtacgagcatctcgcgcgcctgcggtggcgggccaacgacacaccgggggcggtggcctccgcccggacgtgcatgtcgctggcggacgccggactgaaggcgcgcgcgggcgcaacgtacgcccgcgtgttgatgctcagtggtcactaccggcaggccttggatgaggcgtcggcagccctcgccgtggcagccgacccggtcgagcgagggtatctgctggtcacgctcggcaccgtgcgattcctgctcggggagcgggaccagggggtcgcccagttgcgggagggactcgcgctcgccgagagcaccgacagcaaggagaacatcctgcgggcgtacaccaatctgacctactgcctgcagatgctgaaccggctcgaggaggggctcgcgctggcccggcgcggatgtgagctggccgccgggttcgggttgcggatgacgaccggggtggtgctggtcgggaacgccgccgacatcctgctcgacctggggcgctgggaggagatcgaacggctcatcggggaggtgctgcccgatgaagcggccgacgatctgccgctgtacatccagtatgtacgggcggaagtgttcgtggcgcgtgacgaacgccgggccgcgcgggacattctggacctggtgatgagccggtcggcgggcaagaccgatcaggacttcgtcggacatgcgtacgccgcgctggccgccctggagatcgcggacgggaactggcgggccgcccggcgggccgtcgacgaggggctggccaaactcggcggcggcgaaggggcgttccccgtcctccggctcgccgtcagcggcctgcaggcggccggcgaggcggcggaccaggcgcggcgggccgatccggacggggtgcaccggtgggtgacctggggggacatgctcgccgggcgagccggtgaggccctggaagagctgcggcgggcgggtggcgggcaggcactgccggtggcggaggcactgcacgcggtggcgcaggccgaagcgttacgggtgcgcggcgaagcgcaggaggcggcgtggaccgcggtggcggccacctggcaggcgctcggacacccgtatccggaagctcaggcgcggttgcgactggcggcctgcctgctgcgccgaggggcgaccagcgccctgcaccgggagatcacggcgggcgcccggctggccgccggactcggggcccggcggctcagccgtgaactcgccgaactggcgacgctcagcggggtggtgatccgttccgagccggtgccggaagcggcgcccaggaacgattggggcctgacccgccgcgaagggcaggtgctggacctgatcgcgctgggctacaccaatgcgcggatcgcgcggagtctggacatcgcggagaagacggtgagcgtgcacgtgtccaacgtcctggcgaagctcggggcggcgaaccggtgggaggccgccctgatccgtcgtggggaaccccgcccggaatga

SEQ ID NO: 7082 - DNA, 1431 bp, Actinoplanes utahensis
atgaccgttatcgcccaacggccggccgcgacggccacccggcacgcggccaaggcgaacgctccgcacccgctcgcggaaaccgttgctcgcggggccgtggcgaatgttccgtgcgcggcaacagaagtggtggcgggtggcgcggcgggagatgtcgcgcgggcggctgcggccgggggaagcgcgcggcttctggcggggggacaggctcgggaatcggtcggggagatcgcgcggcggccgaccgaggagattttggagcacctgtcgacggtggctcgcggggggaacgggcatgcggcggcggctgcggcgctggagctggccgcggaggtggcctggtcggggcggcggcgactgctgacgctggcggcggcggacgcgcagcttgccggggagcgtcagcgggcgggggagctgctgcggcgggcggcggagaccggggagtcgctgcccgcgccgctggtcggcatggcgctggtcgcggcgcgcaaggcgatggcgcaggggcggcaccgggcggcggaacgcgggcttgcgggggttgcagcgggaatgtggcagtcgggggcgattcgccggttgccgaccgttcttgccctgcgcagctgggcgctggcgcgggcgggggacctgggcgcggcggagagtgaggcggatcgggcggtcacgctggccgcgctgaccggggatcagggtgcgaccgtgcaggccgggcatacgcgaacgctgatcaccgtgctgcggggcgggccggctccggcgagtgggggggatccgctcggagccggtctcgccctgctcggcgcgctcgccgggcgggatccggcggaggcggtcgaagtggccgcggaacacctgccggacctgctggaatgccggctgatccgggatcgggcactgagtcgcgacgacctgagcacattgcacgggctgacccggtcgacggccgggccgatcgccgcgaacgcgtggcgggtgctgggattgaccagccgggattcggctgatgactgcttcgcgcaggcgaccaggctgcaccgggcgatggacctgccgttcgacaacgcgcgggtacacctgtcgtacggggaacggctgcgccgcgacggggaccgccgggcggcgcgcaaccagctgcggatcgcgcgggacaccttcgccgacctgcgcgcgacgccgtgggtggcgcgggccgagcgggagctgaaaggcaccgatgagagccgggtgccggccgggctgacccccgccgagttcgaggtggcccggatcgtcgcgaccggggtgtccacccgggagaccgccgcgcggctgttcctgagtccgaaaacagtggaatttcacctgtccaaggtgttccgcaaactcggcgtgtcgagccgggcgcagctcgcgcacgtcttcccggagctgtcgtgtccgtaa

SEQ ID NO: 7083 - DNA, 225 bp, Actinoplanes utahensis
gtggcgcgagccgatgcgctgttcgtcagtgggctgccgaccgggtcgcatccggggagggacgaggtcgacgccaccgtccgcgccatggtccgctgttaccgcgggtcacgggggtgcgcgggcgaggtggcggcctgctacggggagattccggaatatgcggtacgccggatggcctgggcgcgctgggtcatcgccagcgtgttcgggggtgcgcgatga

SEQ ID NO: 7084 - DNA, 411 bp, Actinoplanes utahensis
gtgcctgacaccgatgccgatcacgccgagctcaccaccctcgtgcagatcttcttcgacgctttcgtctccggccccgaatcccccgcccgcctcgacacgctgcgcaccgtgcttctccccgaagccgtgatcgcccggaccacgcctgagctggccgtctacaccgtcgactcgttcatcgagccccgtcgcacgctgctgaccagcggccgcctgaccgatttccacgagtggcccgggtccggccacaccgaggtcatcggcgacctggcccagcaccgctgcgcctacgccaagtccggcatcctggacggcaccccgttcaccgccgagggcacgaagaccttccagttcgtccggacacccgccggctggcgcatcctcgccgtcgcctggcaggaccactga

SEQ ID NO: 7085 - DNA, 804 bp, Actinoplanes utahensis
atgaccccgaggagggatcctccggccgcgccgtgccgcgatgctcgatccagcagagatcagccggatccagtagggatcgccgcacagtcgaggagcatcatgcctgcaacgacggcacgaacggcggcactgtccgccatcgccgccaccaccctgtgggtctcccccacagcagcgcaagcccaccctgtactgccgaaacccccagccgtgaccaccgtgtcgacggctgacagcgtgtcgacggcgaacagcatgtcggccgtgatcggcctgggccagatccggctcagcggcccgaacgtcgccggcgaccccgtctggttcggcatcgaagccttcaccgaccggaccggctcagcacacggccggttccggttccggcacgaacgtccggacggaacggttgtcggtgacggctgggccgaggtgacctgcctgcgggtcaccggagacgtcgccctgttgaccgccgtcgtccccgacggcgtaggcgtggtgaagaaccacgcctactacatgaaggtcaccgacggaggctcccagccggaccagctcgccttcgtccaggcccagaacggcacggaacgcccgcccacccgctgtgtcgacttcgacgtcgaacacccgggcctggccgaccgatcccccgtctacaccggcggcttcaccatcctgaccagccgtatcacccccgagggctccgccggcagcacaaccgcccccgcgaacagccgcaccaccagcggcaccggccgcagcgacagcggcggcatcggcagtgtcggggggatccggtga

SEQ ID NO: 7086 - DNA, 1272 bp, Actinoplanes utahensis
gtgaccatcacttgccatgcggcgccgaagctgaccggtgtgggcgtgtggcggcggtgggccgcgacctggcccgcgtgggccgggtacgcggccgccggctggtcggccgcttacgccacgctcggcctgtattggacgttcggcgggaacggcttcccgttcgccccgatcgacgaagcccacgtgtcgggctccatcctggagggcacacccgtcaccgacggcgcgcccgtcatggccgtgatcggcctgctcggcaccgcggccgcctgggcaatggctcgtggagtcggcatctccggcagagcaacaggccggtccacccctcggccgccgggccgagcccggcccgctgttcgacccttggcgcgtgcgtcgcgtccgagtggacgcgacgtgggagccgggacgggagtcggcacacgggcgctggcgttgatcgccggtggttggatcgtggcggcgggcctgaccctgatcatcccggactacaccatgatcgccctggtggcgttcgcgccgttgctgctggtgttcagcttcaccggggtgccgggcgagcagaacggcatcggcgacattctctactggcatcgcaccaacctgatcatcattttcctcgggggtgtgctgtgggccgcggccaccctggcctaccagcggcgtgcccgcggcgcatgcctgcactgcggccgtcacccggatgccggcggcggccgatcgcgggaggacatgctccgttggggacgtcgcgcggtcgcggtcgccatcacggcaccgctgctgtacgagatcaccagagtcgcctggtatttcggatacccgctcggcatcactcccgacttcctgcggatgatgcaggacacgcccggcatgctcgacgtcggcctgggttgtgccatcgcctcgaccgtcggcggcgtactcacccatggtctggtcagcagttggggcgagacctacccccgctggctctggttcaagaagggcagaccggtcccgccggcgctcgccgtcgtcccggcgtcgatcgtcgcggtctccatcatcccggccggtctgatggtcctctggaccaccgaggtgcgcaccacctgggctctctgggtccccagcatgctctggctggcctggggcgtcggcctgggcgccgccaccatcacctaccacctgcgccggcgcggtgcctgccggcactgcggtcaaggtgacggtcaccccgagccgatcgcaagtccttccgaccggcccgaacccagcccgcactga

SEQ ID NO: 7087 - DNA, 297 bp, Actinoplanes utahensis
gtgacgatcgagcggatcgcggctatgagccgatgttcaggcgaggtgcccaatgaggtcgggacgccgctacagcgaacgcacgccccgatctgcctcccgggcgcgccgggcatcacgccggatccgctggaactcatccgccgtgatctggcgacggtggcgggtggcgggccggccacggtcgaggccggtgtcggcacccttgaccgacgggggtccatgacaccggccgagggctgtgcttcgcggccctcggccagccgcaactgttcacgtggtcagtgccggggctga

SEQ ID NO: 7088 - DNA, 936 bp, Actinoplanes utahensis
gtgccgcccacagtggtccgcatgttcggtcacaccaagcgggtactgctcccgtccatcgtgctgctgacggcggcctgtgcgagcccccaccccaccctcctcccggcggacgtgcgctcgatggcacagggcgccgacggcgccgccgtcctgcggctggccgaaacgatcctggtcggccggtgcatgcggaatgcgggtttcgaataccccctggatccggccgaggcacggcgagagctggccgccacgccgcccccggcgagcctcgagtcggcctggcaggacgacgacgagaaacgtgcggccgccggtcccaccagcccgcccccggagtcaccgcagccacggaccgacctcgaccgctacgtcgaaggactcgatccgggtcgcgtccaggcgttcaccaccgccctgtacggcgatcagaccacgggcccgtgggtgagggtggagatgcccatcggcaccgtgcggcaaagccgggccggctgccagagcgacgcgcagcgtcggctctacggtgacctcgacgcgtacctccgcggccggatcacccaggacaacctcaacccgatcattcaggcccgggtcaccggcgatgccgcgttcaccgccgccgagggcaggtggcggacctgcatggcgaaagaacattggcccgtcgctgaccaggccgagctcgacacccgcgtggccaaggcgaacgagaacctgccacccgagcagcagaaggagcggtcgcgggacgccgccgtgctctccgcccggtgcaaccggcaaaccggcctgtcggcgaccgcgcggcgccttatccccgtcgccgaacgacgggtcctggccgacctgagccctcagctgaccgatctgtcccgccggcagcaggccgcactgccctacgcgcggcgcctgctcgacggcgaggacgcctga

SEQ ID NO: 7089 - DNA, 399 bp, Actinoplanes utahensis
atgaaacgcaccctagccgtcgcactcaccttcgccggcgccgccgcgaccatcgcggtcgccgcgtcacccgcgcaggccgccccggcccagtgcccgtatcggtcgttctgcgtttacaacaaccagcactacaggaacggcgtctggagcactcccaacaacgacaacgactggtccgacaacctcttcagcaaccggtcggacaacgtggccaaccacgactcgtcctggttcaacaacggctcggcggccagtccgagcttcgtgcgggtgtacgaccggcccggccggaccggcggagtgaccatctgcctggcccacggcaccgggttcgagtccaagcccgcatccgtcagcgaccacggcgaatcgcacgagtgggcgaacggctgctga

SEQ ID NO: 7090 - DNA, 1128 bp, Actinoplanes utahensis
atgacttcgccagcaccctccaccgcccggatcagcgtgatcggggccggccccggtgggctcacctgtgcccgcatcctgcagcgtcacggcctcgccgtgaccgtttacgaccgtgaccagcggcgtgacgcccgcaaccagggcggcaccctcgacctgcacgccgacgacggtcaggtcgcgctccgtgcggccgggctgctcgacgacttcttccggctggcccgcgccgaggggcaggagatgcgcaggctgggcatcgacggcacgctccaggagcaccacctgcccgcgcctgacgagttggtcaaacccgagattgaccgtggccagcttcgtgacctgctgctcgactccctggagcccgggacggtgcagtggggtcgcgccctgacctcgaccgatggccgcgtcctgcggttcgccgacggcagcacagccgagaccgacctggtgatcggcgccgacggcgccttctcccgggtgcgcccggtcgtctcgcccgcggtgccgcactacagcggagtcaccttcctcgaggcctggttcgacgacgtgagcgagcgtcaccccgacctctccgatctggtcggccagggcggggcccacgccgcggacggcacccgcgccctgttcgcgcaacgcaacagcggtgaccacatccgcgtctacatcattcgcaaggctccggtcgactggatcaccgcggccgggctgaccatcgccgacaccgccgggatccgggccaggctgcttgccgagttcgccgattggtccccgcgcatgctgcagatggtgacggagaacgacggcgtttacgtcgaccgcccgatcttcgccctcccggtcccgcacacctgggacccgcacccgtcggtcacgctgctcggcgacgccgcccatgtcatgccgccgctcggcgtcggggtcaacctggcgatgctcgacgccagcgagttggccctggcgctggcctcgtcgccgacggtcgacgaggcccttcgccactacgaggccacgatgctcccgcgctccacggagtgcgccaagctcctggaaaacggtgctgagcagttgctcgccaccgacctgcacgacttcgacgaggagcggcttcagtcgtga

SEQ ID NO: 7091 - DNA, 624 bp, Actinoplanes utahensis
atggatgaacgccccgtcggtcgccgagaacgcaagaaggccgccacccgccaggcgctcgccgacgcggctctccggctgttcctggagcacggctacgaccgggtgagcatcagggacatcgccgaggtggcggacgtttccaccaccactctgttcaagcacttccccgggaaggaggcgctggtcttcgatcaggaggaggatcgggacgcgcaactggtcgccgcgatccgcgaccgcccggacgggcaatcgatccccgacgccctgcgccggcacgtcctcgacacgtatcttccggtggtcgcccacccgctgcgggaggattacacgaggctcgtcgactccactccggccctgcgcgactactcggagcggatgtggacccggcacaccgagacgttggcggccgccatcgccgacgatctcggagtcccgcacgacaacctggaatgcgtgacgctcgcccgcttcgtcctcgacattccgtccctgacccgcggccgtcccgatcaagaggtcgccgtcgagacggtcttcgccatcatcaccgatggctggcacgcccgacggcccggttccgacgcagcgacacccgaccagctcgccgcggaaagctga

SEQ ID NO: 7092 - DNA, 2259 bp, Actinoplanes utahensis
atgatcggctggtcggcggtggtccgccatgcccgtgccgcggccttcctcaccggtctgctggtgctgctgttcagcgtgttcaccagtgtggtgaccgcgcgcgacaagcaggtcgcgacccaggatcacgcgctcgacctgagcctcggtcagcaggtggcggcggtccgcaactacttcgaccaggcgcgggcgatcgccgaggtgttcgccaacaatccggtgttcatcgacttctatcaggcgcccgggaccacccgggagaagatcgccgcgggtggcccgctgatcggtcgggtcaacgacgcgctggcctacctggagcagctgtatccggggcggatccagtcggccagtttcgtcgaccgggacggccggcagatcgcccgggtggccggcggggtgccggtgcgcgccgtcaacctgcgcgacaacgagcagctgcggccgtacttcgcgccgacgctgcagctcgggccggagcgggtgtaccagacggcggcgtaccggtcgctggacaccggcgacatggtgatttccgattcgaccctgctgatggccaacgggttcaccgggatcgtccagttcgaggtgtcgctgtcgagtttccggatgccggacaccagcggcggccgggtcgcctcgatcctcggcgcgagcagcggcgaagtgctgatcgactcccggaccacgggtgtcggcgaccgcacgttcgcgccgatcgcgcgggccggggcgctggccggcatgacgaatctgaacgggctgcgggtcgcctaccagcggatgccggccaccctcaacaacgccaacgactggtacgtggtggtctccgaccaggcgtacggcgccggctggaaccggggtttcccggtccgctcgctggcgctggtgctggccgcgctgctgaccattctgatctccggggtgagctggcgggcccacgcccgctcggtgcgccgggccggcacgcacgacgcgctgaccgggctgccgaaccggaccctgtacaacgagcgcacccaggccgcgctgcgcgggggccggccggccgccgcggtgatcatcaacctgcgcgggttccgggacgtcaacgacgtgctcgggcaccggcacggcgacctgctgctcacccaggtggcgcagcgcctgaccgcggcggtgccggagggcgccacggtggcccggatcggcgccgacgacttcgccgtgctgctgcccggcgccgacgcggcgaccgcgcgggcgaccgcggaggcgctgctcgccgggctgcaccacaccttcgtcatcgacgacttccagctggatgtggaggcgaacgccggggtggccgccgcgcccgagcacggcgtggacgccgagaccctgctgcggcacgccgacgcggccctgcacctggccaaggagcaggtgtcgggggtgcagcagtacgacgcggccaacgacaccggcaccgccagccgtctggaactgctcggcgacctgcgccgggcgatgggcaccgacgatcagctggatctgcactatcagccgaagatcgacctgcggtccggccgggtgaccggcgtggaggcgctgatccgctggcagcatccgaaactgggccggatggcgccggacatgttcatcccgatggccgagtcgaccagcctgatccggccgctgaccgggcatgtgctgtcgatggcggtccggcaggcccggatctgggcggaccggggcaccccgatcccgatcgcggtcaacctgtccacccgctgcctgctcgatccggggttcgcggcgcaggtcttcggtctgctgtaccggaccgggctgccggcgcacctgctcaagctggagatcaccgagagtgccgcgatggccgacccggaccgggcgctggcggtgctgcgggcgctgcacgacggcgggatcagcctgtcggtcgacgacttcggcaccgggcactcgtcgatgacctacctgcagcggctgccggtcgacgagctcaagatcgataagtcgttcgtgcaggcgatggcggacagcccgggcgacgagatgctggtccgcacggcgatcactctcggacacaacctgggactgtcggtggtggccgagggcgtcgaggacgaggcggcggtcgccgcgctgcgcgagctgggctgtgacatcgcgcagggctaccactacgcccgaccgatgcccgccggggacttcgacagatggttcgccgaatactgccagaaagcggccgctccggtcgcctga

SEQ ID NO: 7093 - DNA, 1800 bp, Actinoplanes utahensis
atgaccctgaccctgctggcatccgacggcggcgtcgtcactctccgcccggcccggcccggcgaccgcaccggcatgctgcgtttccggctggccgccgccgccaccgaccgcatcattctggtggcctgcgccggcccaccaccgcccgacgccgcgaaagaccacgccgcggagaaagacgccgcgaacgaccacgccgcagagaaagacgccgcgaacgaccacgccacagcgaaagacgccgcgaacgaccacgccacacagaaggacgccgccaagaaagcggaacgagcggaaagagccgaacaagccaccgccagaaagggcgcaccacccgtgatcggcgtggcggcctacgcccgcctggacccggccggccgcaccgcggagatcgccgtccacgtcgccccgcaccaccgcggccgcggcatcgccaccctcctggtcgagcagctcaccgcccacgcccggcaggccgggatcaccgaactcatcggccccggccccgatggcggcaccgagctgcgcccgatgctcaccccggcctcggtggtcgtgatcggcgccggcccgcggcacggcggcgccggccacgaaacgctgcgcgccctgcgcgactacggtttcgccggccggttgtacgcggtcaacccggccggccgcccggtctgcggcgtccccgcgtaccgcagcgtctcggatctgcccgagcccgccgacctggcggtggtcgcggtccgcgccgacctggtcccggccgctctcaaggaggccggtcggtgcggggtccgctgcgccgtcgtgctcagcaagggtttcgccagttccggcccggtcagccggcagcgccgcgccgaggtcctgcaggtggcccgggagcagggtgtccggctgctcggcccgagcagcatcggggtgctcaacaccggcccggacgcccggctcaacgcctgtctctccccggagcgcccgccggcgggcggtctggcgctcgccgcccagtccggtccggtcgggatcgcgctgctggccggcgcggcccgcggcggctgcggcgtcgccagtttcgtctcactcggcgagggcctcgacgtgaccgagaacgacctggtcacccactggttcgacgatccggccacccgggcggtggggttgtgcctggagtcggtgcgcgacccggccggcttcgccacgctggtccgggcgctgggccggcgcaagccggtgctggccgtctcacgggccggtgcgctgctggaatcggccggggtcatctgtaccaccgggatcggcgagatgctggacaccgcccggatgctgatcggtcagccggccccggcgggggcgcggatggcgatcgtcggtaacggcggcgggctgaccggtcaggccgcggacctggcggaggcggccggtttcaccctgctgccgctgacctcggcgacccgccggcaggtggcgcgcggccgggacaatccggtggatctgggcatcgacgcgacaccggcgtcgatcgccgcggccgccgagacggtggcgaacagcggcgaggccgacaccctgctgctgatcatcgtgggaacccgggcgaactgtccgatcgccatcatgaccgcgctgggtgaggtggtcgacggccacccggacgtcaccatcgcggcggtcctgaccggcggcaacgacggcatccagaccttcggctcgcgcgccgcgccggtctatccggacgcggcccgcgccgtccgcgccctcgcctacgcccaccgctacgcggtctggcgcaacaccgacacctga

SEQ ID NO: 7094 - DNA, 582 bp, Actinoplanes utahensis
atggcctaccgtccacgcatggaggtcgacagcgaacgtgacgtggtggccctgatcgagtccgacccggccgccatgcgggttctgcacgccgcggccaccctcgccctgccggactggtggatcggcgccggtttcgtccgcaaccgggtctgggacgcgatcaccggccgcccgccttccccggagcgcgatgtggacctcgcctactacgccccggattccgtggatcctgccgatgacgcccgtgccgaggctcatgccgccgaactcctgcccggcgtgccctgggagatccgcaaccaggcccggatgcatctgcgcaacggcgacgccccgtacacgtcgactctggacgcgatcgcccactgggtcgagacggcgacctgtgccgcggtcaccctccgcgccggcacggtccacctggccgcctgccacggcctcaccgacctgaccaccatggtggtccgccccgcgcccagcttcgacaacgccgcgggccacgccgcggttcgcgcccgcgtcgaggccaaaggctggctccgccgctggcccaccctgcgcctggagctcggacggtag

SEQ ID NO: 7095 - DNA, 318 bp, Actinoplanes utahensis
gtggccggttgcgcgggcaggccggcggcgggacccggatcaggggcctcgccgaccggccgtcaccgtgcgatcggtcccggtcgacgctggacggcctcggtcaccatcgcgatcgagatcggcgacggccaccaacaggcccgcgcccacaccggcctcggccacgtccaccacgcggtgggcgacctcgcccgggcccgccggcactaccggcacgccctgaccctctgcgcccacctggggctgcccggggccgagcagatccgcagccacctcgccgccgtcgggtccgccgtcgcggttccggggtgctga

SEQ ID NO: 7096 - DNA, 996 bp, Actinoplanes utahensis
gtgctgatcggtgacgtggcccgccgcaccggggtgagcgcgcggatgctgcgccactacgacacgctggggctggtccggccgaccgggcggacccacggcggctaccgtgagtacactgcggacgacctgcgacggatcctctacgtcgagggcctgcgcaccctgggcctgtcgctgcggcagatcgggcgcaccctcgacgatcccggcttcaccccggccgccctggtcggcgacctgatccgccggaccgaggagcgcctggccgccgaccgcgaactcctcgaccggctgcacgccgtcgacgtgtccgaaccggccggctggccggacgtcgcccggatcgtcggcctgctgcacggtctggactcgcccgacgcggcccgccgtcagcaggccgtgctggccccggccgcggtcccggccgacctgctggcccgcgcggtgctgtccgaatccgatccgaacgtggcgggggcgctgcgctgggccctcgcccgggccggcgccgacggcatcgccggtctggccgccggtgcggcgtccgccgacgccgatgtgcgccgccgagccctgcaggcggtcgccggactgcccggcgacgaggccgtcgccctgctcaccgaggccctgtccgacaccgacgccgctgtccggcgtcaggccgcccgggcattgggcgtacgcggtgtcccggccgccgtgcccaccctgatcgccatggtcgtcgacggtcccaacgatgtggaggcgggcgaactcctcggcgccctggccgcggacccgacgctggccgccccgatcctcgcggcgctgaccgccgagctggccgccccggacaccggcccggcggcccggctgcggctcacccaggccctcgccgagctccccggcagcctcgcccacgacctgctccgcgacctctcgaccgacggggaccgtccggtgtccctgctcgccaccgcgctgctgagccgcagcgatcggcagtga

SEQ ID NO: 7097 - DNA, 666 bp, Actinoplanes utahensis
atgaccgagaccaacgcgtccgcccggttgcaggccgttctggcgatcgggacgaaccctgacccggacgacctcgagatgctgatggcgcggtgcgcggccgaacccgacttcttcgtccgggacatgctcacctgggcgctgacccggctgccgcccgaggtcaccgtgccgcggctgtgcgcggagttgggctcggaggtggcgcaggcccgcagtcaggcgttgcatacgctgtccaagatcggtgaccggagcgcctggccgtcgatcaccccggccctgctgcacgatgtggacgacgaggtggcgcgggccgcgtggcgggtggccgcgacactcgcgccggaacgggagcgggcggcgctcgccgtcgaactgaccgccgagctcggccgcggtgaccgggaggtgcggatgagtctgagccggtcgctggtcgcgctcggcacggtgatcgaacccgtcctgcgggcggccggggacaaccacgatccggaggtacgtacgcatgccctcgccaccgagcagctcctgcgtgacccgcaagccgggtttcgaccacgccgtacacgaggcgaccaggatcgtcgcgctggcccaccatgcctcccggccgaggtgaccggtgaccgggcccggctcgggagggcgccgtcgtgctga

SEQ ID NO: 7098 - DNA, 837 bp, Actinoplanes utahensis
atgaaacgggctctcgtactcggcggcggcggtgtcaccggcatcgcctggcacctcggactgctctgcggcctgcagcgggccggtctcccgctcggcgacgcggacaccatcatcggcacctcggccggctcggtcgtcggcacgctgctggccgccggcgtcgacctggaggccgcggtcgccgcgcagcaggtggaggcggccgcgccgccgcgctccggcggttccgggcggggcaccagtcagtggctggccgccatgtcggtgctgatcgacccgtcggtgccggcccagcaggcccgcgcccaggtcggcacgatggcctcggccgccgacaccaccgacgagcagacctggctgcgccgcatcggtgacctgctgccgatccgcgactggccgcagggccgtgacctgcgcctggtcgtcgtcgacacggccgacggccgggatgtcgtgctggacgccgccgccggcgcccccctgctgcaggcggtcgccgcgagttgcgcggtgcccggcctgatgccgccggtcaccatcggcgagcaccgcttcatggacggcggggtccgcctcggcgcgggtgccgacctggccgccggcgccgaccggctcatcgtgatcgccccgatggcgatgctgggccgcgagcgcatcgaggcggagatggccgccgccggcgctgccgggtcgctgctgatcgagccggatcaggaggccttggaggccttcggccccaacttcatggacccggcccgccgagcgccgtcggtcgccgccgggctgcggcaggccgaggaattggcggacgccgtacgaggtgtctggcgctga

SEQ ID NO: 7099 - DNA, 1395 bp, Actinoplanes utahensis
atgcgtcgatccgtgatactcgcggcagcggcggccgtggccgctgcgtgctcaaccgtctatgtcgccgccaccgcgagtgccgcggtggcctgtgctccggtctggagcgcgtccgtcgcctacgtcaaggacaacgtggtgtccaagggcggcagcaactacaccgccaagtggtggacccagggtgaggacccggtcgtcaagagcggccagtgggatgtctggatcaacaacggcgcgtgcggcggtacgacgaacccgtccccatcgccgtccgtgaccagcaagtcgccgtcgcccagcacgagcccgagccccagtggcagcccgagcacgtctccgaccacccccatcccggccggaaacctgcccaagcatgccctcgtcggctacctgcacaccagtttcgccaacggctccggctacctgcggatggccgacgtcccgagtgactgggacgtgatcgacctggcgttcggcgagccgaccagcgtcacctccggcgacatccgcttcagcctctgcccggtcagcgagtgcccgggggtggagtccgaggccgagttcgtcgcggcgatcaaggcgaagcgggcggccggcaagaaggtgctgctgtcgatcggcggtgccaacgggcaggtgcagctgaccacgaccgcggcccgggacacgttcgtgagctcggtcagcgcgatcatcgaccggtacgggctggacggcgtggacatcgatttcgagggtcactcgctgtcgctgaacaccggggacaccgacttcaagaacccgaccaccccggtgatcgtcaacctgatcagcgcgctgaagagcctgaaggcgcggtacggggccgggttcgtgctgacgatggcgccggagacgttcttcgtccagctcggataccagtattacgggtcggggccgtggggcggtcaggacccgcgggccgggtcgtatctgccggtgatctacgcggtgcgggacttcctcaccatcctgcacgtgcaggactacaactccggctcgatcatgggcctggacaaccagtatcactcgatgggcggcgcggacttccacatcgcgatgaccgacatgctgatggcggggttcccggtggccggcaacacggcgaacctgtttccggcgctgcgggaggaccagatcggtttcggcgctcccagctcgacgaacgccggtaacggctatgtcgcgccggccgcgatccaacaggcggtgacctgtctggtgaagggcgccgactgtggcgggtacacgccgcgcagtggcctgaacccggacttccgcggcctgatgacctggtcgatcaactgggaccggttctcgtcctgggagttccggaacagtcacaagccgttcctgaccgcgctcggctga

SEQ ID NO: 7100 - DNA, 642 bp, Actinoplanes utahensis
gtgggcggcattctcaggtccgacttcgtaggctccgcagaacgggcaacccgccggggcgtaaacacgggcgagtcccaaggcggtgtctatatcgctgggaatgtgagtgacctgtatatcacctaccctgaagggtataaccccgcccaggaggtgctggcacagcaacttgcgcggtccgcggaggggcttcgccgacaggaggccattctccgggagatctacaccttgggtttggtgcaggcccggctcagcttcaacctgagcatgtccttcgccgggatcggcgcgatccttctcttttgcggcgtcgggcttgccgtgtttcgggcgccgaccgacggcgcccaatatgcgtctgtcgttgcggctctttccggaactgtcgtcacactcacctccgcgctgttcttcgcacaggccaactcgaccaggaagaacatgacgacccaggctgttcagctgcgcgaggaaagccaggatgatcgccgcatcaccactgtccgcgaactcgttgtggcggttaccgaggagaagagcagaaacgagctgcacgctgagatagctcgctccctcatcaacaacctggcacgccggaccgaaccgggttcacccgaggcggctccggcccggggttga

SEQ ID NO: 7101 - DNA, 462 bp, Actinoplanes utahensis
atggccctggtggggcgtcgacccggccgcgacgatgtggagacatcccatggtgttcgggcgtccaggcctttgcggtcgtggttctcggtccggatagggctcgtcctgggtcactacgctgggggcatgacgcgggacggcattcgaggtggtcagcaacgggtcgacgtgttgctcgaccggctgacggacgctgaggagcggctgcatcaactcggggatggtcactgggcgaactggctcgcccgtgatcgggcgcgtgtcgcgcagggcgacgcgtatggcctcgagcacttgaaacaagcgttcggcggcatgggcagcatcaacgacgcctacccgcaggatgacggcgccatcggcgccacattggccgacattcacaggttggcggcccagctactcgccgaccaccaggcagccgacggtccgggcgtgcatcgaagtccgccgcggtag

SEQ ID NO: 7102 - DNA, 1596 bp, Actinoplanes utahensis
atgaaccccgtgcgcagcgggactccggcggagccggtgcggccggagctggagatggtcaccggcgcggtgtcgcaggacgccgcggaccggctggccgcgctgaccgtgcgcggggcgcggggcgactccgcgatgatccatctgaccgacggccggcacatgcggctgatcggcgggcacgccctgccgcccgggttcgagccgatgcagcaggtgccgatgccgtcgacgctggccgggctggtgatccggaccgggttcccggtggtcatcgaggatgtcgaggccgatgaccgggttccgggtgacgcgccggtgcgggccgtcgggatccgggcgtacgccggtttcccggtccgtgatccgggcggcgtgatcgtcggggtgtgcgcggtgatgtcgttcgaaccgcggcggtgggcgccggaggacctgaccgcggtcgacgacggggcgcaggcgtgcaccgcgttcgtggcggagcagcgggcgcacgaggccgagcaccatcagcggcagtacctggacattctgctggacagcctggacaccggggtggccgcgtgtgacgccgaggggcgcatggtgctggtgaaccggtcgctgcggcaccggctcggggatcggccggtcgacggcagcgccgagcagtggatccggcggctgccggtgaccaccccggacgggcggcccagcgacccggatcaggcgccgctgctgcgcgcgctgcacgggacggacgtgcgcggggtcgagtatctgctgcactccggcgggcagccgcgggtgctgcgggtgaacgcgcacccgatctcggaccgacgggggcggcggctgggcgcggtgaccgtcttccacgacatcaccgaggcgcgccgggccgagcatctgcaggcgatgctgagccgcagcaaggacgagtacctgaacctggtcgggcacgagctgcgcaccccgctgacgctgatcgggtcgtacctcgaattgatgaacgacgccgatccggacgcgcccgccgccgagctgctgccgatggtggccgcggcccggcggggcagtgagcggctgcgccgcctggtcgaggcgctgctcgacctgtccgcgctggacgccgggcgcaacccgctgaatttcgccgacctggacctggtgaccgtggtgagcagcgcggcgtgccagatcgacgaccgggcggcggccaagcacgtctcgctggtccagacgaccccggcccggatgccgttgcacggcgaccagcgccggctgacccagctggtcatggcgctgctggagaacgcggtcacctacaccccggagggcggcacgatcagggtcacggtgagcgggacggacagcaccgcggtcctcgaggtgaccgacagcgggctggggatcccggaacacgagcggccgcgggtcttcgaccggttcttccgcggcgcggtcaccaccgagttggccattccgggtgccgggctgggactggccatcgcgaagctgatcgccgaacgccaccacggcacgatcgccatccacccgaacgaccatcggccgggcaccacggtccgggtcgagctcccccggcccctctag

SEQ ID NO: 7103 - DNA, 396 bp, Actinoplanes utahensis
ttggcagtcatcgttgtcgcggaagacgagcccgacctgctcaccgtcaccgagcggctgctccggcgggccgggcacaccgtcaccgccgtcaccgacggcgccgcggcctgggaggcggtccagcgggaccggcccgacatcgtggtcagcgacatcaacatgccgcagctgtccggcctcgaactgtgccggcggatccgggacaacccggacacccggctgctgccggtcatcctctacagcggggcgctggtccccggcgacccgggcccgggcgaggtgcgcgccaccgcggtgctgaacaagccgttcctggcccgtgagctgatcgactgcgtcgacaaggtgctcgacgccggccacatcgacggccaggtcccgaccgccttctag

SEQ ID NO: 7104 - DNA, 492 bp, Actinoplanes utahensis
atgatcagcgagttgcggtccgtcgacggcgtcggcctggtccggatcgaggaccggtttaacacgggcgccgccgacctgtgggaggcggtcaccgacccggtccggttgagtcgctggatggccgaggtcgagggcgacctgcggctcggcggcgagttccgggcgcacttcttcgccagcggctgggcgggcaccgggcgcgtcgaggcgtgcgagccgccgcggcggctgctgctccgcaccacccagccggaccaggtgggggagcacgtcatcgaggtgacgctgatcccggacggggagcagaccgtgctggtgtgggaggagcgcggcatgccgatcgagcacctccccgcgtatggcgccggcatccaggtgcacgtggaggatctggccgcgcacctgtccggcggggaacgctccgacggccccgcgcggtgggccgaactgttgcccgcctatcaggaatcggcgatcaacggcggctga

SEQ ID NO: 7105 - DNA, 327 bp, Actinoplanes utahensis
atggaagcggtggtgcgggcgctcgccgatgagagccggcggacggttctcgacaccctggcccgcggcccggccaccgtcggccagctggcggcggcgctgccgatcgcgcggccgggggtgtcgcggcatctgcgggtcctgcgggaggccggtttggtcgatgtccggcaggaggcgcagcgtcggatctacagcatccgggtggagccgctggccgagttggacgagtggctggggcgctaccgcgcgctgtggcagcaccggatggatgccctgcacaccgagatcgcccggggtaaacgggagcggaggagctaccaatga

SEQ ID NO: 7106 - DNA, 405 bp, Actinoplanes utahensis
atggtgcgtgaggtcgtcgaggagatcctgcgggtgggacgcgagcacgatgtggacgcgttcgtggcgctgatggcgcccgacggatacatcgagtggccgtatcgtccggacggggtgcctgagcggctcaccggtcgcgacgagatccggtcgcacctccgcgcggccgccgggttcatccgcttcgacgagtaccgggacgtggtgttccacgagaccaccgatccggaggtgatcatcgtggaatatcaggcgttcgggaccgtgctgccgaccggggcgccgttccatcaggtgatcatcgcggtgttccgggtccgcgacggcctggtcgtgtcgtaccgagactatctcaacccgctgccgctgatcgcggcgcgagaggagatcgcccgccggtga

SEQ ID NO: 7107 - DNA, 939 bp, Actinoplanes utahensis
gtggcccatcgtccggcgccaccgggggccctgatcgggcagactggccgggtgctgaccgacgatgcgctgccgggcttgctgcggcggctcgggctgcccggcttcgccgacatccacgtgcacttcatgcccgagcgggtgctgcgcaaggtctggcactacttcgacgccgtgccgcccaccctcggcatggactggccgatccgctatcggcaggacgagcccacccggctggagatcctgcgcggcctcggggtgatcgccttccccgcgctggtctacccgcacaagcccggcatggccgcctggctcaacgactggtgccgggagttcaccgccggcgtccccggctgtgtgccgtccgcgaccttcttccccgagccgggcgtcgagaggtacgtccgggccggcctggacgccggcgcccgggtggtcaagtcgcatcttcaggtgggcggctacgacccgcgggatccgctgctcgacccggtgtgggggatgctcgccgaggccggcacgccggtcgtctgccactgcggcagcggcccgatgccgggtgcgttcaccggccccggcccgatcggcgaggtgctcgctcgccaccccggcctgaccctggtggtggcgcactgcggcagcccggagtacgccgggttcctggagctggcggccacccaccgcaacgtccacctggacaccacgatggtgttcaccgagttcacgtcccgctacgccccgttcccggcggctttggtgccgcggctggccgacctcggcgaccggatcgtgctgggcagcgacttcccgaacattccgtacgcgtacgcccatcagatcgaggttctggaccgactgggcctgggggatgactggttgcgggccgtcctgcacgacaacggcgcgcggctgctcggggtcgcggggccggcgcggtga

SEQ ID NO: 7108 - DNA, 1710 bp, Actinoplanes utahensis
gtgctgatccggcaccgcttcgagcgccgcgagggtcgcgctgacgaccggcccgtcgaagccggtgagccgcaggtccttcaccgcgagcgcgaccgggaagtccgccgtggtgctggcggcccgccggtacgccgtcgcgagcggcccggcggcgagcaacccggccgcgagatcgcggtcgatgcccagcgcgccggccagcgccaggctctcccgcagcccggccagggcggtcagcatcgcggtgttctgcatcagcttcaccgccgacccggcgccggcttcgccgacgttccggacctcacccagattctggagtacgccgccggcccgctcgaccgcacccgccgcgaagatcgtcagcgttccggcggcgaccgcgtccacgctcccggccaccggcgcgtccacgaacagcgggatcccggccgcgatcgcccgggtctcgcgcggggcgatcgtcgacatctgcaccaccaccgtctccggcggcaccgcggccgccgtgaggacctcggcgaccgccggcccgtcggtcagcatcgtgatcaccacgtcggcccgggcggccgccgcggccgggctgtccgccacggcggcccccgtggccgccgcacggtccccggtccggttccacgccgtcacccgatgcccggtggccagcagccgccgggcgatcgcaccacccatccgtccggtgcccagcaccgcgatctctgtcatgtccgcgacgctaggccccgccgggccatgccaccagcgactgtctcgcatggctgccatgcccggctagcatggctggccgtggagacccagctgctcgaagtgttccggaccgtcgcggacctcggctcgatcaccgcggccgcccgccggctacggttcacccagtccgcggtctcccggcagatcgccaccctggaagccgaggtcggcgcccgcctgctggaccggctgccgcgcggcgtcgccctcaccgagcagggccgcgccctgctcccgcacgccgaggcgctgctggaccggctgcacgcggctcgccagtcggtcgagctcaccaccggccggctccgggtcggcgccttctccaccgcgctggccgccctggtcccgcgcgccgtcgccgcgttccgggccgcccggcccggcttcgcggtatccctggtcgaggggctcagcccggccctgctcgaccgcctcgccgccggtgacgccgatctggccgtggtcagcaccgcccccggcggcccacccgacccggcccgcttcgacctgcaccacctgctcgacgagcggatgctcatcgccgtgcccagcggtcaccggctggcccgccgccgccgggtccggctggccgagctggccgacgagccgttcatcgcgagctcggcccggcccgagcagaccctgctcggcgacagcgccgccgcgggcttccggccgcggatcgacgtcgcggtcagcgagtggaccgcgaaactgggctgcgtcgcggccggcctgggggtcaccctggtgccgtccctggcggcgcgcgccatcccggccgacatcacgctgctcccggttcatcccgacgacgagtcggtgcgccgggtgtacgccgcgaccctcgccggccggacccgcccacccgcggtggaggccttcctgacccacctgaccggtctgtgctctcctgccgggacgacacgagcgcgatggtga

SEQ ID NO: 7109 - DNA, 411 bp, Actinoplanes utahensis
atgcgggtcagcctggacagtccgctgcccacaccgttcgccgaccgcttcgccgacgtggcccgcgtcgacctgcccggcggagcactgctgaccctcgccgggcaggtcgcggtcgacgacaccggcacggtgatcgcaccgggcgacgccggcgcgcaggccgtccggatcttcgagatcatcggtggcctgctggccgcccacggcgccggcctcgccgacatcctgcacatccggacgtacctgacggatttccaagatcttccggcgtacgccgtggtccgccgccgcctgttcccgcagaacccgccggccagcacgaccgtgcaggtcagcgccctgttcctggccgaagcccggctggaggtggaggtgaccgccgcgatcgcccggccggcggccggctaa

SEQ ID NO: 7110 - DNA, 1317 bp, Actinoplanes utahensis
atgaccagctggacgcagacgttccgggagcgtgcccggacgagattggccgaggcggagagccgtaacgcaccaccgccgttcaccgggcccgacgtggtcgtcgtggagccgcggccgtccagtgccgacgtgctgcccagcagcatccgcacggccggggcgtgggcgtggcgcttcatcctgttcgtcgtcgcggcgtacctgttcctgcggatcatcgcgctgctgcacatcgtgctgatcccggtggcggtggcgatcctgctggccgcgctgttccagccggtctgcgcccgcctggtgcgcaacggcatgaaacgctcgctggccgccggcctggtcgaggtggccgcactgctgctggtcttcggcggactcgggttgatcgtgcggaccttcatcacccagttcgacaacctgtcgacacaggtgggcgggggcatcgacgagatccagcggtggctggcgaacggcccgctgcacgtgaccgacgcgcagttcagtgactacatcgacaaggcccgccagtcgatcacgcacagccaggggtcgatcacgacgggggcgctgaacaccgcggccacggtcggtgaggtggtcaccgggttcttcctggtgctgttcaccctgttcttcttcctgcgcgacggggggcagatctggtcgttcctgtgccggctgctgccccgggacgcgcgtgtccccaccgcccgggccgggcactactcgtggcacacgctggtctcctacgtgcgggccacggtgctggtcgccttcgtcgacgccgtgggcatcgggatcggcctggtggtgttgcgggtgccgctggccattccgctggccgcactggtctttctcggcgcgttcatcccggtggtcggcgcgacgatcagcggcgcggtgccggtgctgatcgcgctggtcgccaacgggccggtcaccgcgatcagcgtgctcgccgtggtgatcgcggtgcagcagttggagggccacgtcctgcagccgttgatcatgggccgggcggtggccctgcacccgctcgcggtgatcctggcgatcgccgccggcgtcgtggtcgccggaatcgtcggcggcctgatcgcggtgccgctgctcgcggtgctgaacacggcgatccgctacctggcgaaccacccggacggcgaaccgaccgcggaccgggagccgcccggcaccgagtccaccgacgagggtgaggccaaggcggaggagcgggaggaggcggccgagcgccgcctcgacccggccgacccgccggccgacgacacctccgtcgtccccgaccgcggttag

SEQ ID NO: 7111 - DNA, 636 bp, Actinoplanes utahensis
atgtggcgtgttctgcgatgggtgatggtggcgctgtgggtggtcgcggccggcgcggcctggtgggcggcgccccgcgagtcgaccgccgagcaggcgtccgccgacatcgcggaccaccgggtggtcgcctaccagttcggcagcgggtggcacgacaccgcgccggaccgctggttcagcgttccgtccgtggacgtcaagacctccgacccccaggcgatcttcgcgtggcgcacgccggaccaccgcacccactgggtccgcgacttgcaccccggcctggacccggccggttccggcacgctgatctcgctgagcaccctggtcaacggcatcggcctgctgttcaccgtggtcttcctcggcgtgctgtgggccggcccgcccccgctgaccggcacccggtggtactggtggtggctgttcgccctggtcccgttcgggctgggactgatctggtggaccttccgcgaatacccgtggaaccgcgagccggaactcccggagcggcgccgcaccggcttccgcggcttcggcaccgccttcgtcgtctccctgggggtctcggtggcgctgctcctgctccgccgggtcttcggcgacatcctgttcccggacctgctcaccccgtag

SEQ ID NO: 7112 - DNA, 834 bp, Actinoplanes utahensis
atggttgatcgatccctgaccctgatggcggtgcacgcccatcccgacgacgaagcttcgagcaccggcggcgtcctcgcccgctgtgccgcggaagggatcacgacagtgctcgtgacgtgcaccgacgggcggtgcggggacgggccgggcggggtcaagccgggcgcgccggggcatgatccaggggcggtggccgcgatgcgtcgggaggagctcgaggcgagctgcgccgcgctgaaggtgacgcaccttgaactgctcggctacgccgactccgggatgatggggtggccgagcaacgacgcgcccggctcgttctggggcgtgccggtcgccgaggcggcagaccggctcgccgacctcatccggcggtatcagcctgacgtcgtcgtcacctacgacgagaacggcttctacggtcatcccgaccacattcaggcgcaccgcgtcaccatggccgcggtcgcgctgaccggcgtgccggccaaggtgtattggacgaccgcgccgcactcggggatggccgcgctcggcgaggcgctgcgcgagctgggggtcgactgggcggaggccgaggtgaccgaggacgccccgcccccggcgatcggcctgccggatgcggagatcagcacgtgggtggacacccgggcgttcggcgcccagaagtacgacgctctgtcggcgcacgccagccagagcgagaacatcgagttcctgcgcatgggcaaggagcgtttcaccgacctgatgggggtcgagacattcgtccgggtccgggacaccaccggcgcgccgctgcccgaggacgatctgttcgctggactgcgctga

SEQ ID NO: 7113 - DNA, 465 bp, Actinoplanes utahensis
atgaaagcgaacgatcggttacaggaggcgctacgcctggccgtcgacccgcccggcggcgtgtcggtcgaggccttgcaggacctggtccgggaggacctgtccccgcaatgggacatcgcgacgacggccgaccacatcggggtcagcccgcacaccctgcgctactacgagcgagccggcctgatcacggtgccgcgcaacggtgccgggcatcgcgtctacgacgcggcgtgcgtgcggcgcctggtttttctgacccggatgcgcacctcggggatgccgatcagcgacctgcgccactatgtcaccctcgtcgatcgcggcgaggacaccgttccggaccgcctcgacctgctccttgagcaccgcgacacgttgcgggcccagctcacgcagatccagctggccctggcggccaccgaatacaagattgcgacgtacggaggagcaacacagccgtga

SEQ ID NO: 7114 - DNA, 426 bp, Actinoplanes utahensis
gtgaacgacccgcagcacgacatcgacagtgtggacaaccgggaacggcgggagcacggcctcgaggttctggcccggatcgacggggccgccggggccgcggtgatcgactcgctggccgacgtgtcaccggctctggcccaccacatcgcggcgttcgccttcggcgacatctacgaccgcccccgcctggacgcgcgatcccggcagctggtcacgatcggtgtgctgaccgccctcgggggatgcgaaccccaactcaaggtgcacgtcggagcgtcactcaacgtcggtctgaccccggacgagatcgtcgaggcgatcctgcacgccgccgtttacgccggcttcccgcgggcgctgaacgccaccttcgccgcgaaggaggtcttcgacagccgtggggtgcagaccactgcctcatga

SEQ ID NO: 7115 - DNA, 564 bp, Actinoplanes utahensis
gtggggtgcagaccactgcctcatgacagcggcctcggcgtgtgccgggagcgcgcggcggagatcggggcggacgcgggctcactgcccgcgttaggctggagagtgggccttacgcatcaggaattcttcgaacggtacatccatgccggtgcgatcagccgggacccggacgcggtcgccgccctgttcacggaggacggtgtggcggaagcgccgctggcgcccgacgaccatccgctccggcggctggtgggccgcgacgccatccgggccggagtcggccgttaccaccggcaactgcgcctgccgggaacgatgaatccgcaacggtcggcctacgtgctgcatgacaccgcagatcccgacgtcttcatcgccgagatcgacgtcgccctcgatcgggccgacgggcggcagaccaccatgtcgttcgtgcagatatttcgtcttcgcggcgggcggatcgccgtgctccgcgactacttcaccgagccgtcacccgtcgccgccgacgtggcggtggcggtggaacctggagaagggtccgcagcacccgcctga

SEQ ID NO: 7116 - DNA, 579 bp, Actinoplanes utahensis
atggtcggctcggggctcgccgcgtacggctatctcggtgtcgcggtgaccgtgttcgtcgagggcttcggggtgccggcgccgggggagacggcgatcatcgccgcttccggggcggccgggcacggccacctgaacatcgtcgcggtggcggtgaccgccttcgtcgcggcggtctgcggggacagcgtcggctacctgatcgggcggctcggcggccggcggctggtgctgcggtacgggcggttcgtccggctgaccccggcccgcttcgcccggttcgagaagttcatggcccggcacggtgccaaggtggtggccggcgcccgcttcgtggagggtttgcgccagctcaacggcgtggtggccggcgccaccggcatgccctggccccgcttcctggtctgcaacgcgatcggcgcggcgctgtgggtgggtgtctggtcgacggtcggcttcgtggccggcgaccactggaccggcatcctcggggcgctgcaccgctaccagccgtacgtgatcgccgccgtggtcgcggcggtggccggtgccctcctctggcaccgccgcgcccactga

SEQ ID NO: 7117 - DNA, 1200 bp, Actinoplanes utahensis
atggacgcactgaccggcctcgccttccgggaccgctacgggcggttgctggcgcttctctccgcggcctcgagtgatctcgccgccgcggaggatgcgctggccgacgccctcgaacgggccgtgcgcacctggcccgagcagggcaccccggccaacccggacgcctggctgctcaccgtcgcccgcaaccggctgcgcgaccgctggaagtccgccgagcaccggcgcaccgtcgctctcgaaccggactggtcgggtccggtccacgtcgacgacatcgacgtggaggcgatccccgaccggcgcctggagctgatgctggtctgcgcccacccggcgatcgaccgcacggtgcacaccccgctgatgctcaacaccgtgctgggcttcaccgcggcgcagatcggccgggccttctcggtcccggccgccacgatggccacccgcctcgtacgggccaagaagaagatcacaaccaccggcatcccgttccggttgccggcccgcgacgacctgccgcggcggatgaccgctgtcctcgaggcggtttatgcggtgtacgtgctggactggtcgaccaccggcccggagccccgcccggtcccgtccgaggccctgcacctggccgaggtcctggcgggcctggcccccggcgacccggaagcgcacggcctggccgccctggtgcagctctcggcggcccgggcggccgcccgcaccggtccggacggctcgttcgtgccgctcaccgagcaggacccggcgctctgggaccggcggctgatcgcccgggcgcaccggcatctgcgggccgcgcacgcccgcggccgcctcggccgcttccaactggaggcggcgatccaggcggtgcactgcgcccgtcccgccggcggacagaccgactggccgacgctgctgaccctgcaccgcgccctcgacgaggtggcgccgtcgctcggcggcagtgtcgcgctcgccgtcgtcatcgccgaggccgacggcccggccgccggactcgcccacctggacacgctggacgcgccccgcttccagccggcccgggtggcgcgcgccgagctgctgcggcgcctggggcggaccgcggcggcggccgtcgcgtacgaccaggccatcgccctgacccacgatccggccgaacgccgccacctgcatcaccgacgcgccggtctgggctga

SEQ ID NO: 7118 - DNA, 318 bp, Actinoplanes utahensis
atgaggtacgcgttgctcatgcactacccggagccggccgacggggagatcggcgaggagatgctggccgagggccggcggctgttcggcgtctacggcgcggcgctgcacgaggccggggtgctggtctccgccgacgtgctgcagccgtcgttcgccaccaccacggtcacccgccgcgacggggaactgcgggtgcaggacgggcccttcgccgagaccagggaggtcctggccggcgtcttcctggtcgacgtcgaggacctggacgcggcgatcggttgggcggagaagtgccccggcgcgcagtggggctga

SEQ ID NO: 7119 - DNA, 705 bp, Actinoplanes utahensis
atgagggagttggcgtggctggggatcgtccggcacgggcagagtatcgggaacatcgcggccgagcgggccgagcgtggcaacgccgaggtcatcgacctcgccgagcgggacgccgacgtgccgctctcccccaccggcgaacatcaggcgcaggcggtcggcagactgctggccgcgcagccaccggacctggtgatcgcctcaccgtatctgcgcacccggcagaccgccggcatcgcgctgaccggcctggacgtgccgctgctggtcgacgagcggctgcgcgaccgggagctgggcgtgctggacctgctgaccaacgcgggggtgcgggcccggttcccggaggaggagcggcggcgggcccggctgggcaagttctactaccggccgccgggcggggagagctgggccgacgtgctgctgcggctgcggtcggtgctgcgcgagctgcgcgaggaccacgccggcgcccgggtgctgctcgtcgcgcacgaggcgaccgtgtggctggtccggtacctggtcgaggggctggccgagccggaactgatgagcctggcccgcgggcaggcgatcgcgaactgctcgatcagcgcctggcgcgacgggacagccgagcggttcaacgacgtcgggcacctggcggaacacggggcgcccgcgaccgagcaggaggaagtccgtgccgagccggcctga

SEQ ID NO: 7120 - DNA, 828 bp, Actinoplanes utahensis
gtgccgagccggcctgagatcatcaccccgcggctgctgcgcgactggccgctgcccgacccgcaggcgtccgcctcgaagcaggaccgcggcaccgtgctggtggtcggcggggccaagttcacccccggggcggtgctgctcgccggggtggcggcgctgcgggccggcgccgggcggctgcagctggcggtcgccgacgaggcggccatcccgctgagcatcgcggtgcccgaggccaaggtggtggggctgcccgagcaggtggacgaactggccgccgacgccgacgtgatcctgctcgggccggggctcgacgacatcggggagaccgaggcgctgatgcggcgggtgctcggggcggccggcaaggacaccgcggtggtgctcgacgcgtacgccctcggtgcgttgagcagggagccggacctgctgccgcaaccggcggcggtcctcaccccgaacctgaccgaggccgcccacctgctgggccgcgaacccggtgacgacctggtcgcggcgagccgggagctggcccagcggtaccgggcggtggtgtcgctgtacggccacatcgccgacccggccgggaacgtgtggcgggaggagagcggcgacgccggcctgggcacctccggaagcggcgacgtgcgcgccgggatcgtcgccgggctgctcgggcgcggtgcggagccggcgcaggcggcgtgctgggcggcgttcgcgcacgcggtcagcgggcagcggctgtccccccggcacgggcgcaccggattcctggcccgcgagctggtcgatgaggtggccatcacactcgccacggtctga

SEQ ID NO: 7121 - DNA, 2190 bp, Actinoplanes utahensis
gtggcaggtgtggctctgctcgcggccctggccgaggtgctgctgatcatggtgggcacccacctcggcttcccccacctgctcgtctgggtgccggcggtggccggcccggcgctggcgaccgtcgcgttccaccgcgcctcgcggcgcaccgacggggtgctgcgcgccttctggcggcgggtggcggtggcgatgggcgtggtggcgctcgccggactgagccagacggtcgacatcagcacgatgccgtactccgacctgccgccgatcggcgcccgcacgctgctgctctacctggccggcgcgaccctggcgagcaccgcgctgctgcgcctgcccggcggcggcagctcgtggcggcggctgaccaccgcggtgctggacgtggcggtgctcgcggtcaccggcgggatcgccgtgtcgcagtacctgggctggttcatgaaccgcttcggtgtctccgcggccgcctggtcgctgaacatcgccatgctggccatcgcggtcgccggcgccgtggtggtcatcaagatcatggcggcgcggagcagcccggtcccgcgcgcggcgctgtggtggctggccccgatcggcctggccggcccgctgtccaccgtgacgatggcgctgctcaagccgtggccgcacctcaacggcagcgccgcggtcctgccgttcgtcgggctgtgcggcgtgctcgccgtccgcgcgcggccgcaggccgtgcggctggaccgcccggccgggcccggtcgcgggaccgcgatcccgctggtcgcgaccggtctgaccagcgtcctggtggccaccgtcttcctgcgcaccgggcacctgagcacggtccaggtggccggcaccacgctgctgttgctgctggtcgtggcccggcaggcggccgccctggcggagaacggcgcgttgctgtccacggtccaccaccaggccatgcacgacgagctgaccggcctgcacagccggcgctcgttcaccgcggcggcggccggcgcgcacaccgcggtcctgctcgacctgcgcgagttccgggcgatcaacgacgggctgggcccggccgccggggacgcgctgctgatcgcgtacgcccggcggctgaccgcgctcgccggcccggacgcggtggtggcccggctcggcggcgacgagttcggtctgctgctgcccgggccgacggacatcgtggcccggctgctcgcggccggcgccgaaccgctcgacgcggccggccacgacgtgctggtcgaggtgtcgatcggggtcgccgagggcggcaccgacctgtaccggcaggccgggatcgcactgcgcgaggcggccgccggcgccggcgaccgggtggtccgctacgacgcctcgctcgaacagcgcctcacccgccgcgccaccatcgccgccgacctgcgccgagccctggcggccggcgagttccacctgctctaccagccgatcgtcgaccttccggacggccggctcagcggcgtcgaatcgctggtgcgctggcagcgcgacgggcacacggtgtccccggccgacttcatcccggtcgccgaagacaccgggctgatcgtcgaactcggcgcctggatcatcgacaccgcgatcgcccagaccgcctcctggctgcgcgagcacggcgcggacacgctgcgctcggtcgccgtcaacgtctcggcccgccagctgctcgacccgaacctgcccgaggtggtggcgctcgccctggcccggcacggcgtaccgccgcaccgtctcaccgtcgagatcaccgagaccgcggtcttcgccggcggccgcgcgctggccaccgtcagcgcgctgtccgcgctcggcgtcagcatcgccctcgacgacttcggcaccggccactcgtcgctcggcctgctgcgcacctgtccggtcgacgcgatcaaggtggacaagtcgttcgtcgacggcctcggcggggcaccgcagcaggaggcgatcgcggtcgcgctgcacgccctggccgacacgatggggctgcgcacggtcgccgagggcgtggagacggccgcgcaggcgcggcggctgttcgagctgggctaccgccaggtgcagggcttccacttcgcgaggccgatgccggccgaggagatcacgcgccggctgaccgctgtggctccgaccacgattgccggggtacgggggtag

SEQ ID NO: 7122 - DNA, 2187 bp, Actinoplanes utahensis
atgctgttcctgcgccacccgccgcgcaccgacgagtggttcgcccgccgacgggaccggaccctcgccgacctcctcgatcaggcgctggccgagccggagttcgccggatggctcgatgccagggtcccggcggatcgactgcgtgccgaggtgtgcgcccgcgcgggtacggatgtcttcccgatcgtggccgcggaacagcaggcgtgggagcaggccaccatccaccgccttccctccgcggtgtccgagcggcagttgaccggtccgaggtggatcaacgggatcggcaaggcgctgatcgggctgttggccgcggtctgggccggggtgccgatcatcgcggtgatctgggctttcctcctggacgatccgcgggacgtactgcgcgtcgtcggcctcatcgtcctgatcagtggcgggacgggcgccgtgttcggcatgttcttcggactgacggacgcggccgccgcccggcacgacggagagtccggcagaggccacatcctgcccatggtcagcctccagagtttgatgctgatcatgctcgcggtcttcttcggcggtgccgggttcatcggggcgcacacccgtggtgggtgggggttcctcggattcggtcccgtgggcttgccggtgttctgcctggtgctcagcatcggcgtgggccttctcggtctcatgctgaccgtgggggtcagccagccgagcgatgcggatctggacctgccgatccgcgggcccggcggtgacgccgagcaggctttccagaactggcgccgcgagttgcgggaacgggcgctgctgccctttctgcggagccggatcaacgaggcggtcgccgcacggtattcgctgaccctcgacatccagggggaagcaccggggctgcgcagccgcagagccaccgaacaccacatcgtcaccccggccgtcgagcaactgttcgatcatctggagcagctcgacggtgcgagcatcgcgctcgccggtccgcgcgggacagggaagaccatgctgctgcacgccctgcgcgacggccgtcatcaccatggtgacgacccccgggatctggtcgtggtcgtctcggctccggtcgagtacgcgcctcgggacttcgtccttcatctctgtctgtcgatctgcgacgtggtaggcgactacttcgccgtacacggaccaggcccgatcctgcgtaccgcccggcgccggcgtgcccaactgcgccacctgcgatccgactcccgggagctttccggtcgggtcgggcgatggggcgccgagctgaccggcaaagtcggcagcagcagccaggcgcagccgttcacgtatccggaactggtcgccgccctgcatgagctgctcgacgaggtggtgacggcactgcggggactgccgggaccgccgaagctcgtgatcgggatcgacgaattggaccggatcggctcgggggagggcgccgagcggttcctcaacgacatcaaaggcgtattcgacacgccgggctgctactttctggtgtcggtgtcggaggacgcgctgcgcgccttcgacctggccgggcacgggctgcgcgacgtcttcgacagcacgttcgacgagatggtccgtgtggaacacctcgatttcgtgcgggccgtcgaactgctcggtcggcgggtggtcggactgcccgatccgttcgtggcgctggcctactgcctgtccggcggcctgccgcgccagctgatccgggtggcccgggagatggcccggcaccgcgggcacctgaccgatgtggcgcgggctctggtcagccggcacctggaacggatcctgcaggcgggcggcgcggcccgcggcccgatgttcgcctgggcggacaacccaccggccgagatgaccgagacggcgctgctcacctacgctcggctgggacctatcggcgagccgctgaccacgcacgtcgagttcctggccacggtggtggcggtgttcgacggctcgctggatgccgggcgggcgaaacggtcggtggccttcgaggcgctcgcccgggtgcgccgttacctcggggtggacgacgagatcgcggccggactgctggcgcaggctcgggcggagtggggcctggcgcggcgggacggggctacccccgtaccccggcaatcgtggtcggagccacagcggtcagccggcgcgtga

SEQ ID NO: 7123 - DNA, 954 bp, Actinoplanes utahensis
atgaagcaccgaccggccgcggcgttcgcgctggtgcccctgatcctgggcggcctggcggcgtgcggcggcgagaacaggccggagagcctgccgtccacccgcccgaccgtcgagttctcggcggagcggaccacccggtcgacgccgaccgaggagaagaccaccgaggccaccgacccgaccccgacgcgcacccggccgaccgctgaccagccgaccagggagccgacggcggagccgaccagggcaccgacgacccaggaagccaccaaggagcccaccccggcggcgacgtccacctcggccgcggtcgccccggtcgccgaccaggacgacggcgggctcgggccgtgggcctggctgctgctgatcggcctgctcaccgggctggtcggcctgctgctggtgaaccgggaccggcgggtcgccacctgggacgccgaagcccgcggcctggccggggagacccgcgccgtgctgggcgtgcgcctgccgcaactgctgaccgacctcgacccggcccggcgcgggtcggcctggccgccggtccgcgacgacctgaccgccctggaggcccgctggacggcgctgctcgaacgggtgccggacggcgaacgccaggcctatgccggccaggtcgccggcatgctgcgcgacctggtgaacgcggtcgacgcggagaacgcggccctggccaccggacgcgactggcggatgctgcgcccgcgggtcgacgccgtcatagcggcgctgagcgcggccctcgaccccggcccggccgcaccggcggccgcggccgccgcaccggcggccccgtcaccggcgccggaaccggcgacccgggagacgtcgatctacggcgaaccgctggacgaggacccgggcgactacccgccgcccccgccccgcgcgccccggcccggataccgcccgccggcctccaccgactga

SEQ ID NO: 7124 - DNA, 1101 bp, Actinoplanes utahensis
atgaccccgttcaccagcaaggaccacatccagcggatggaacgcgcggtggcgcaggccaccggcgccggactcaccgggctgctggtcacgcccggcccggacctcacctacttcaccggataccggccgaccgcgatcaccgaacggatgaccctgctggtgctggacgccgaccacgacccgcacctgatcgtgccggtcctggaacgtccggacaccgccggggcgccggtcgcggtcaccgactgggcggacggcgccgacccgtacgcggtggccggccggctgctcgacccggccggccggtacgccgtctccgactcggcgtgggcgctgcacctgctcggcctgcagcaggcgttgcccggcacggcgtacgtgtcgatgaccggggcgctgccgatgctgcgcgccgtcaaggacgccgacgaggtcgaccggctggccggggccgcggcggccgccgacgccgcgtaccgggagatcctcggcgtccggttcgaggggcgcaccgaacgcgaggtcggccgggacctggcgtggctgctgcgggagcacggtcactcgcaggtcgacttcaccgtggtcggctcgggcccgaacggtgccgacccgcaccacgagatgggcgaccgggtcatctggcgcggcgacatggtggtcctcgacttcggcggcctcaaggacgagtacggctcggacaccacccggaccgtccacgtcggcccgcccaccgccgaggaacgcgaggtccacgacctggtccggctcgcgcagcagacggcgttcgaggcggtccggcccggcgtgccgtgccaggagatcgaccggatggcccggcgggtgatcgacgaggcgggctacggcgagcatttcatccaccgcaccggccacgggatcgggctgaccacgcacgaaccgccctacctggtggagggggaggagcagacgctggtgccgggaatgtgcttctccatcgaacccggcgtctatctgcccggccgcttcggcgtccggatcgaggacatcgtcacggtcaccgagaccggcgggcggcgcctcaacaccaccagccacgacctgcagatcgtggcctga

SEQ ID NO: 7125 - DNA, 1443 bp, Actinoplanes utahensis
atggcggcgacggattcaccgatgcgcaccgaccgcgccgcgggactcggcgtcctgctcgcggcgtgcgtgtccgccctggtggtgaacgccaacacgtcggcggtgacgatcctgctcccggcgatcagccaggacgtcggcgccccggtcaccaccctgcagtgggcggtcaccggctacatgctggtcggcgccgcggtgatcgtcacctccggcgcgctcggcgacgtcttcggccgccgtcggatcttcctgggcggcctggtgctgttcgtgctctcctgcgcgatgatcgcgctgtcgtcgtcggcggccggggtgatcgccggccggatgatccagggtgcggccggctcgaccatcctggcctgcgggatgagcctgctctcggtggactcggcgggcgccgggcagatgcgggcgatcacccggtggggcgccgcgtcggcgatcggcgcggccatcgggccgctgatcggcggcgtgctggtcggttcgaccggctggccgggcctgttctggatcgacgcggtgatcgccgcggtctgcgtgccggtcacctggctcaccgtccgcgaatcccgcgacccggaccggccccgggagatcgacctgctcggcacggtcctggtcgcggtcgccctggtcccgctggtgctggcgctcagcgagggcggtagctggggctggttctccttctccacgatcgcctgcctgctgctggccgtggccggtgccgccggcttcgtgctcgccgaacggcatgccaccgcgccgctggtcgacctgtcgctgctgcgcaacccggtactggtcggcgccaccctggcgatcctgctggtggccggcgtgatcaacgcgctgatgtacctgctcagtctctatttccagaacccggacggattcgggatgagcgccctgcaagcggggctggccacgctgcccgcggcggccgcgatgatcgcgatcacgccggtgatcaccccgctggcggtgcggatcggcccgcggtacgccgtcgcgatcggcttcggactggccgcgatcggctgcgggatcctggtgttcaccaggtcgtcctgggcgtacggcgcgttcgtcgtcccgctgatcgtgctcgccgccggcctgggcctggcgaacggcccggcgtcctcggcgtcgaccagcgcggtcagccccgaccaggtcggccaggcgtccgggatctccaacatggcccggtacgtcggcgggtcgctggccgtcgccgccgcggcgaccgtgtccaacggggtcggcgacggccgcaccgccaccggcgcaccgcccgccgaggcgctgaccgccggcctcgccgggggcgcgctgctgctggccctgatgtcggccgccggcgtcgcgctggcgctcctgctgcgccggcaccgggccgcaccggtcgccgccgtgcacctctag

SEQ ID NO: 7126 - DNA, 1251 bp, Actinoplanes utahensis
atgaatcgccgggccgaccggtccacctaccgtcgcggcatggacgagctcgagctgcggcagttcctgctctacctgggcagcgccctgaccgccgccggggaggcggtcaaccggatcgaggagcacctgctgaccgtcgcggcggcctacggctcgccgcaggcgcgggtcagtgtcctgccgacgtacctggtggtgtcgctggaacccgggcaaccggccacgctggagccgacccgcgcgctgcgcggcgggctgcggctggaccagacagccatggtgtacgacgttctccgcgccgccggtcgcgccgagctgaccccggccgagggcatcgggcaggtgctcgccgcggtccggatgccaccccggttcggcgtggtgacccgcaccgccggacatgcggtgctgatctgcggcatctgcctgatcgtggcgccgacctgggctgacatcctgctggccgcgctcttcgggctggttgtcggcctgatgcggctggccggcgcgcggtgggccagcgctcagatgatcatgccggtggtcgccgcattcaccgtctccgcggtgaccttcgtgctggccgggaccggctgggcggccgccgacctgcgcgccatggtcgccccgctggtgaccttcctgcccggcgcgatgctgaccatgggggtggtggagctgtccgcgtacgagatggtcaccgggtcgagccggctggtcgccggcagcctgcaactgctgctgctcgccttcgggatcatcggcgccgcgcacgtggtcggggtgccggcgccggccgcgcccagcgacgtggtggcgaacacggtcggctggtgggcgccctggctgggcccgctggtcgtgggggtcggcaactatctgctgctggccgggccgcggcggtcgctgggctggctgctgctggtgctctactgcggatggatcagccagtatctgggcaacgtgctgctcggcggctacctgagcggcttcgtcggcgcgctggtgctgaccgtggtcgcgtattcggtcgagcgcctgcccaccggaccgccggcgctggtctccttcctgcccgggttctggctgctggtgcccggggtgctcaccctgatcggggtgaccgagtatctggggcaggacaccgtgcgcggcgcgcaggacctggtcggcgcggccgcctcgatggtggcgatcgcgctcggcgtgctgtgcgggcacccgctgttccgggcggtggcgcgatga

SEQ ID NO: 7127 - DNA, 456 bp, Actinoplanes utahensis
atgcagagccgcaatccggtccaaccgctgttgctgatgttcccgctggggctgctcgccgtggcactcatcctggatctggccaccctgctcggcgcgccggccatcatcggcacgctggcctactggaacatcctggccgcgctggtcggcggcgtcttcggggccgcgctcgaccgcccccgggtgctgatcctgctggccgacatgggcgtgctgttcttcttcgcggtgctcgccctgatccgggtgcgctccggagaccgcgcgaccgccccgggcgtgttcctgctggagctgttgggcttcacggccgcgctggccgcgtcctggttcggcgggcggctgggcgccaaccattccgcagggatgagacgagcgacatccaggcctgccgatgattccgcccaacggcatctcgccggtaccagctctcctcgaagggaggcgacgtga

SEQ ID NO: 7128 - DNA, 1431 bp, Actinoplanes utahensis
gtgagcgctgaggcggacaaccaggcggcagcgccgcccaggtccacacgcgcggtttcctacctctcctgggtcgcgctggccctgatgaccaccagttcggtggcgagcctgcgcccgtcgccgaccatggcggtgtacggcctcgccagcatcttcctctacctcgtgccggccatcgtcttcctgctgccgaccgcgctggtctccgccgagctcgcgtccggctgggagggcggcgtctacaactgggtcagtcagggcctgtccaagccgatgggcttcctcgcggtctggtgccagttcgcgatgaccatcttctactaccccagcctgctcgggttcgtggccagcacgctggcctacgtgatcaatccggagctggccggcagcggcctgtggaccgccatcgtgatcatggtctgttactgggccggcgtctgggtctcctcgcgcggcaccaagggcgtcgccgggctggccagcggcggcctgatcatcggcacgctggtgccgggcgcactgctggtcatcctcggcatcgcgttcctgggccagggcaacgagtcggccgcaccgatgaccgccgatcacctgctgccgacctgggccggcctgtccagcctggtactgatcgtcaacaacttcctgtcgtactccggcatggagatgaacgcggtgcacgtctcctcgctgcgcaagcccggtagggagttcccccgggcgatgttcctggcgatggctctggtgctgctcatcttcatcctgccggcgctggccatcagctggatcgtgccggccgacgagctgtcgctgaccgcgggcgtggtgcaggccttcgacgcggtgttcgccgcgttcgactcgcagtggctcaccccgatcctgggcgtcatgctggtggccgcgtcgctgggcggcatgctcacctggctggccgggccgtcccgcggcctgctgctgatctcccgcaaggagggttacctgccgccgttcctgcagaagctcaacaagcagggcgtgcagcagaacatcctggtcacccagggcctggtcaccacggtgatcgcactggcctacgcgttcatcccggacgtctccagcgtgtactggatcttctcggtgatcaccacgcaggtctacctgatcatgtacctgctgatgttcgtggccgcggtacgcctgcgccgcaaccagccggaccacccgcgcgggtaccgggcgccgatgctcaccgggctgtgcggcgtcggtttcgccgcctcactggccgcgctgctgatcggcttcgtcccgtcgtcgcagttcggcggcggcagtgtcggggtgtacctggccatcgtggccggcggcgcgctcggcctcggcctgctggtgccctacctgttctaccgcttccgcaagccgtcctggaaggaggccaccccgtga

SEQ ID NO: 7129 - DNA, 405 bp, Actinoplanes utahensis
gtgagccgctgggtctactacctgatcggtgcgctcctgctgctgctcgccggcttcggcgtcgtcaactaccaagggaagaaggtgaccgaggaggccaccgccaaggcccagcagctgcagaccgagctggccgccgccgggatgcgggtgccggccaccgaccagatcgtccgggtgctcagcaccgacggcggatcgatctgctacgagccgggcgccgccctgcgccgcggcgtcctctacggaatgatcaccaacggcgcggccgggcccggacagcggccggtgatcgtggacagcaggctgctgcagggccagatgaccatcatcaaggtctactgcccggagtacatcgagacgttccagcagatcgtcgacgacttcaccgccgcggaggggtga

SEQ ID NO: 7130 - DNA, 1338 bp, Actinoplanes utahensis
gtggacctgcgagcacacatcaacgagctgatgccccgggcccgggccgacctggccgacctggtcgcgatccggtcggtcgccgacccgcggcagttcccgccggccgaatgcgaacgggccgcggactgggtggcgcgccacttcgcccaggtcggtttcaccgacctgaccctgcaccggaccagcgacggcagcaaggcggtgtacgggcagcgccgcggcaccgagccggacgcgccgaccgtactgctctacgcccactacgacgtgcagccgccgctcgacgagaaggcctggtggaccccgccgttccagctcacgccggtcggcggccgctggtacggccgcggcgccgcggactgcaagggcaacatcgtcatgcacctgaccgcactgcgggccctgggcgacgacgtaccggtcaatctgaagttgatcgtcgaaggatccgaggagcagggcaccggtggcctcgaggatttcgtcgaacggcacccggacctgctgcgcgccgacgccatcctggtctgcgacaccggcaacgcggcggtcggcgtgccggccgccacgatcaccctgcgcggcctggtcaacgtcgtggtcacggtcaccgcgctgggcggcgagctgcactccggaatgttcggcggcgccgcgccggacgcgctcgccgcgctcatccggatgctggccaccctgcgcgacccggccggcaacaccacgatcaccggcctggagaacgagcagacctggctcggcgcgccgtacccggccgcccggttccgcgccgacgccggcctgatcgacgaggcacggctgctcggcgacggatcagtctcggacatgctgtgggcccgcccggccgtcaccgtgctcggcgtcgactgcccgccggtggtcggctcggcggccgccatccagccccgcgcccgggcccggctcaacctgcgggtgccacccggcaccgacccggtcaaggcgcaggacgcgctcatcgcccacctgcatgcggcggcaccgtggggggtccgggtcgaggtcgccaaggaggcactcggccagccgttcgaggcccgcaccggcggcccggcctaccgtgcgctgagtacggcgatgcgcgaggcgtacggccgcgagatgaccactctcggccagggcggctcgatcccgctgtgcaacgtcttcgccggggcgtacccggacgcggagatcatgctgatcggggtggaggaacccctcgcccgcatccacgcaccgaacgagagtgtggcacccggcgagatcggcgacctcgccctcgccgaggcgctcttcctgcagcgctaccgcaagtag

SEQ ID NO: 7131 - DNA, 321 bp, Actinoplanes utahensis
atgccgcgtcctcgagagtcgatgcagtcgatacgcggacgagtggagcggaccatgacggagatcctgagcatcgcggccggtcacccgtggccggcggcgatgatgatgttgtcggtcggcctgtccgccgtcctgcgtcgatggatcgaccacttgaccgcgtgtcaccgggaggagcaggtgacccgtcggttgttcgtggccctgcgcgactcgtcgcgccgcgaccgcccggcgatcgtccgggcgtgtggtccggtcggtggtggtgccggcccgggccgggtgcggcgcggccgtccgggaagggccggctaa

SEQ ID NO: 7132 - DNA, 3525 bp, Actinoplanes utahensis
atggcgggcggtcggccttcgcagggcaagcagcagcgctacgacgagctcgaagagctggccgcatggtttcggcaggctctcggcgacgcgggcttcggcagcgtgcacgagttcgtcgccaccggaatgttcgagaagaacgcggtgtacggggtcttcaacgccactcgtctgctgaccctggagaacacccagtcgctggcggtcgccctgcgccgcgatgccggcgatgtgcgcgccgtctggctgcgcgccaaggaagctcgcgaccgggagctgctggccgccgagcgcgccgaggagcgacgcctctgttcgtgggcggacctgccactcccgtcgctggcactgcgcaatctgctggagtcgcagagcatgtcggtcgaccgcctgccgtactcgatgctcggcgtgatcgagccgccgctctcgaccgtctatgtccgccagcacatccgttcacaggacaaacgggaccggcagccggcggtcagccgggaggggacgcccgccgaacgctcgccggtgtcgcaggcccagacaaccctgtccgtgctggaggcgatcgagcgacacgaccatctcctggtcaccggtgaggccggtgcgggcaagtcgaccatgacgagttacctggcccggaccctgtcccgggtgtggctgcgggagacgagcgccgcggggctgccgctcggcgagccggtcgtcccgctgcgcatcgcggcccggactctggacgtcgggggctcctggagcgtggtgctcgcccaggcggtcagccggagtctcggacgcagcctcctgcaggatcccgacccggccatcttcacccgacgggctcagggtgcccgctggctgatcctggtggacgggctggacgagattccggacgcccgccagcgccgcgagatcatcacctcgatcgcgcagcacgcccgggccggacgtgactaccggttcgtagtgacgacccggcccctgcccgatgacgacctgtcgccgctgatctcggccgacgtggcccgattcgccatccagccgttcgggcatgcggagctcgaccagttcgcccggcgctggttcggctcccagcggctcgacgatcccgaggaccgtgccgatcgattccttcgggagacctccgacggccggctcaaggagctcgtccgcaatccgctgctggcgaccatcgccggggtcagcgcggtgagagatccggatcgtcccctgccgaccagccggatcagcctctacgaacggttctgcggttacctgctggacgaccacggtgggcgccgggagaccatggcgcagctgcaccggcactatgccaacgatccggatcgactgacgtgtgtcctgtggatccacaagcaccgtaccgcgatcatcggtgccctcgccctcagccgcaccggcgaccagacttccctgtggtcgacggccaaggagtgggttcgccgccatgctccgcacagcgtcaccgaagtggaacagtggaaatcccatctgtgggaggagctgctcgcgaccgggctgctcgtggccaccgacggcgaactcgcgttcctgcaccagtcgttcgccgagtatctgtccgccaagagtcatgcgagcacgctggacgccgacttcgcggccctcgacggatggatccgccgaggcatcggcgaagccgaacgcaccttcgcactcttcgtcttcgggctctgggcggcccgggccgaccatcaggcccaccgcatcgtcgacgtcctgctgtcccgctacgacccgcgacgaacgttgctggccgggcgcatcctggcggagggcgtgcgagtcgacgacccggccgccgagcgcgtggtgacccggttggacgcgctgatccgcaacgagaacgacaccgaccgggcgctggaggcggtgcaggtgctcggcggtcttttcgactatcggtgggtgtcgagcagactggcgggcctcgcctcgctcgactcgttgccggtcaggcgccgggtcgaggcgatcgtcgcactggagcagttggccggcccctcggcgatcaccgaggcgttgaacgacgttctcccatcatgctacgggcgcccgttacgccggatggcgccgatggcggtacgcctgggagcgcccatcgtcgagcagatacgcgagcgggtccagcagatggtcgccgaagcggacgccgacgccgaggaatgggcgaacgcggtggaggttctcaagaagctggggctccaggacgacacggagcggttcgcctgctcggtgttgtccaatccgttcgccaggcaagacgacctcaagaaggccgcagaagcgctgttcgacgcgaaaggcatggcagcgctgccgcaggtcatcgagttcgcgcaaacgcggcccgccgccgactacacgggccgtgcagcgttggccgatctacttcgccgtgagggcgcaagggaggcgtccgcgacgatcgtggagcagatactcgccgacgattccggcacgtcatcgtcaggaatcgctgcggtcaccactgacttgcacctacgggggtctgaagcggttcccgccgtgcttcggcttgaggaacgctggtccagggacggatcttggctggcttccggcgacctgctggaggctgcggcaaaggtagtccccgatgaccgaatcgctggtcgtgcacgtcaacgcgccgtctccggcattcccctcggcgccgacctctacgtcagggcctggctggccgtagaaggaatcgcagccgttcctgagatcatgaaggtgactgatggtggccgccgcttgatttttctcgaccgtgtctgggtcgccaaggcgttgcatgacgtcggcgcgctcccggaggcgtgggaactcgcggagaacgcgttgcggtgcaaggatcgagggcttcgcaccaggtatcgggacgcgggaagcctgctgctgaaggtcgaccacgatcgcggaatcccggctctcatggagatcgttgaaggcgacgccaacaactttccgctgctcggcggactgctggacgcgctgcaggaacacgactcgccaacggccgagcgggcattgcgcgacctggccgacaagctcacccacaacccttatgtgtccagcgtcgagctccgggacgcactgatcaccctggtccgatgcggggagaagccggcagccgtggtcgccgcccaagcggcgatccaccggcagaacctgaccatcgacgatcgcaaggagatcgccgccgcgctggcctcctacgccgagttggagctggcccaggaggtgtggtcacacctcatgcgctggcaggagtacagcctgtcgagcgacgtgaccctggtggacgacatgatcgccgcgggcgcggccgactgggcggcgcaggagctccgggctcagctggacgaccctctgatggcggcgcgccggcgcacgcggcttcggcagatgctggcgcttctgacggccgcggcggacgtgccgggcccggcgcatccggatgatgcgccgggccggtga

SEQ ID NO: 7133 - DNA, 522 bp, Actinoplanes utahensis
gtgttccgtcgttcgggctggctcagtctgctggccggggtgttcgccctggtgctgggcatcgtcgcgttcgcctggccgtcggccaccctccacgtggtcggcttcctgttcggcctcaacctgctgatcctcggcgtggtccgggtcgtgcagttcgtcctcatcccggacgcgccggtcgccggccgggtcctcggcgtcatcttcggcgtcctggtcggcctgctcggcatcctctgcctgcgcgacctggccggctcgctgaagctgctgctggtcatcgtcgccctcggctggatgctggacggcctggccgagatcttcacctcggtcggctcgggcggcggcggtgcccggatcgccgtcggcctgtgtgtcgtgctggccgcggtcgcgctgctggtctggcccggcctggggctggccacgttcgtcttcttcggggcgaccacgctctgcttcgtcggcatcgccggcatcctgatcggcatcgcgggcctgcggtcccgctccgcctga

SEQ ID NO: 7134 - DNA, 456 bp, Actinoplanes utahensis
atgtccgagacacagcaggagacggcgtacgccgacgagcagccgtacaccccacccggagcgacccgggagcccaccgcgtggatcggcgcggtcgtcttcgccggggtgatgctgatgctcctcggtggattccaggcgatcgaggggatcgtcgccctggtccgcgaccagtactacctgaccacccggtccgggctggtgctcaccttcgactacaccgcctggggctggacccacctgctgctcggggtgctcgcggtgctcaccggcatcggcatcttcctgggccagatgtgggcccgggtgatcggcatcatcgtcgcggtgctcagcgcgttcgcgaacatgatgttcctgcccgcctacccggtctggtgcaccatcatgatcgccaccgacgtgctggtgatctacgccttggccgcgcacggccgtgaggtccgataccgctag

SEQ ID NO: 7135 - DNA, 426 bp, Actinoplanes utahensis
atgaccctgctggtcctgctggtgttcctcgtgctgctggccgcggtccgccgggagcggcggacccggcgggcgttcgccgaggacggcccggcattccggtgccgggtccggttccggcggcgctggtcgcggcggatgtgggcgtgctgggccggggagttgctgctgatccggcgtgggccggtgttcgaccggacgctgcggctgccggtgcgggtgctgccgccgggcgtgcaccggctgccggccgggacgggccggcggtgcgggcccgacccgatcgtggtgcggctggtcgccgccgacggcacggtgttcgccgtggtcgcggccggcgcggaccgcgtcgaactggtcggcccgtacctggcggcggcgttcagtgatctgccgcgggcgccggtccggcgccgcgagatctga

SEQ ID NO: 7136 - DNA, 225 bp, Actinoplanes utahensis
atgccggacgtgacctatcaggtgcgggtctccggggtgatcccggacgagctgctggccgaactgcgcgacctcacggtcagtgtggagccgccggagacggtgctgcacggcaacctcccggaccagtccgcggtggtcgggttgatctcccggattcacgggctcgggctgcggctcatcgaggtccgccgcctgccggtggacgacggcccggccggatga

SEQ ID NO: 7137 - DNA, 822 bp, Actinoplanes utahensis
gtgccgacatcgggcggtagaccactgcggcatccggccgagatgccgttctacgtgttcatggtggtgctcaacctgatcatcatctggctgatcgtgcaggccgcggtcaccctgccctacctgccggaccggctggccgggaccggctgggccaccacggtgcgcagcgccttcatcggcctgctcctgctggtgccggtgttggtgatcatccgggagacgcagcgcgcctcggtccgcggcaccgccgtcgagctcagcccgcaccagtacggcgagctgtacaagaccgccgacgacttcgcgcaccggctcgggctgccccgccgcccgacgatctacctggccaacggcaacgggacgctgaacgccttcgcggcccaggccaccgggcacgactacgtggtgctctccaacgagctgttcgccaacctgcagcagaacaaccgggagggactgcggttcatcctcggccacgagctcggccacatccggctgcaccacgtctcgctctggtaccagctgtcggtcgcctattcggagaggatcccggtgctcggcccgaccctgtcccggctgcgcgagtactcctgcgaccggcacggcgcgcacctgtgcccggccggcgcgtccgggctggtgctgctcgcctccgggcggcacaccgaacacaccaccgacgtgcagcagttgctgcggcaggggcgggcgctgcgcggcttctgggtggagctggcccagctgccgcagtcacacccgtacaccgtgcgccggatcgaacgactgttccggctcggcctgctgcacggcaccgactag

SEQ ID NO: 7138 - DNA, 1251 bp, Actinoplanes utahensis
atggccctgctcgcgttcgtcgcggcggccgccgccgtcgtgctggtgctcgcggtcgccgggatcggcggcagtctcgccctgctgctgaccggcgtggccggcggcgcggtcatgctgctggccgcgtggtggtttctcagccatcgcggcgtggcgcgctgggccgccgggtgcctggcggtgctcgccccggtggtggtcgccgtgctgttcgcccgggcccggctggtcggggtggtggtcgtgttcggcctgctctggtgggccgcgatcgccgccgcccggcgggccctggcggtgcccgtgccggagccggtgaccgagcgcacggcggcgccccgccacccgtacctgatcatgaatccacgctcgggcggcggcaaggtgggccggttccggctcgccgagcgggcccgggcgctcggcgccgaggtgttcctgctggacggttccacggtggacgtggccgaggtggcgcgccgggccgtgcgcgacggcgccgacctgctcggggtggccggtggggacggcacccaggcgctggtcgccggggtggccgccgagcacggcgttccgttcctggtgatctccgcgggcacccgcaaccatttcgccctcgacctcggcctggacctgacggatccggcggccggcctggacgcgctcaccgacggcgaggaggtccgggtggacctggggcgcatcggtgaccggacgttcgtcaacaacgcctcgttcggggcgtacgccacggtggtgcacagtccgcgctaccgcgatgcgaaggtgggcaccgcgctcgacctgctgccggacgcgctgaccggacgctcgcccctgcggctgaccgtggacggcgccaccctggacggtccgcacgccgtgctgatcagcaacaacgcctaccggctggacagtggtcagcgtccccggctggaccgggcggagctgggtgtgctggccgccggccgacggcgggtggtggtccgcaccacgcgggacgcggtcgtcgacgcggatctgccggagattccggtcggggtggacggtgaggcgctgaccttcgcgccgccggtgcgctgtgtgaccgtgccgggcgcgctgcgggtccgggtgccacggcagcgccccggggtgccggttccgcccccgcagctggactggcggcgcctgcgccacctggcgttcggccgggtgacgcaggcgctggacggggccgcggtcagcggcgaaccactcgccgcgtga

SEQ ID NO: 7139 - DNA, 543 bp, Actinoplanes utahensis
atggccatcggacccgtgcagctgatcgtgctgggcttccggcatccggacttccacggcgaggtgatcgccgagctggaacggctgcggcagagcgacaccgtccgggtgatcgacgcgctcgccgtctacaaggacgccgggggtgaggtggaggtcgagcacctgagcaacctgacccgggaggaggcgatcgagctgggcagcaagatcggcgcgctgatcgggctgggcatcgagggcgaggccgggatggaggccggtgccgcgctgggtgccgcggcggccgacgccgagggccgggtcgcggtcttcgacgacggccgggcctgggacgtgctcgccgagatcccggacgacagcgcggccgcgctgatcctgatcgagcaccactgggcggtgccgctgcgggacgcgatcgcgcgggccggcggcttccggatcgccgacgggttcatcagcccgttcgacctgatcgggatcggcctgctcaacgccgaggaggccaaggagttgcacgacctggagaccgccggagcctga

SEQ ID NO: 7140 - DNA, 399 bp, Actinoplanes utahensis
atgaagcgcatcctggtcgtcatcccgctcctggccggcctgaccggctgcgtctcccccgcggaggccgcgaagccgccggtctgcaacagctgggcggcggtgcagcagaccgtcggccacatccgtgaggtgaacgtctcggcgaacgggttgtccgccctgcggccgtacctgatccagttgaaaaccgagctcacccagttcttcgcggacgccaaggcgcagttcggtgcggacggcgaggcgttgaaggcatcggtggagcagctcggggccgatctgcggacggccagggccgatccgacggtggccaacctctccgtggtgcgcacctcggtcagcggcgtgcgtgacgacgcgaaccggctgcacgacaccatgctctcgacctgctga

SEQ ID NO: 7141 - DNA, 969 bp, Actinoplanes utahensis
gtggtcggtgatcgggatcgggctggccgcgctgatcacctgggcggtcgcggcgcacggcggcgagatggccggcgcgtacgggtcgtgatcggccgtctcgacgcatggcagcgcaggcaccgcgtggccgggttcggccacgcggtgctgcgcaagtatctggacgacggcggcccccgggaggccgcgctgatcacctactacgggttcctcagcctgttcccggtgctgctgctcgccgtcgacctgatctcccgggtcctggtgaaccggccggggctgcggagccgcacgatcggggccttcgtgcccgagccgctgcgcgccgacgtcgagcaggcggtggcgcacctgcccacctcggccgtggcgttggtggccggcctgtgcgggctggcctacacggccgccggggtgctgctgtcggtgtatcagacgctcaaccatctggccgccgtgccgtaccgcgagcggtccggcgtgctctcccgctgtctgcgggtgctggccggcctggtggtcctgctgagcgcggtggtggccaccgcgtcgctgccgccggccggcgcgttcgtcgtcgccttcggcgcgctgtggctgatcgcccggctgctgctggaccggccggcgccgctgcgcgcgctgtggccgggcgcgctgatcggcgccgccgcggtgaccctgaccctgcagctgggtgcggcggtgctaccccggctgatccgcggcgccgggccggtctacggcggcttcgccaccgtcgccggcatcttcaccctgttgtacgtggtgagcaacgcgctggtcggcgcggcggaggtggccgcggtccggtgggggcggctgtggccgcgagccatggaccgcggccacccgtcgccggccgacctgcgggcggtcgcgctgctcaagcgggagcaggagcggctgtccgcggaaggaaccaggcggcggccagaccgatga

SEQ ID NO: 7142 - DNA, 1389 bp, Actinoplanes utahensis
atggtggataccaccgcgcgagcgctgagacgggcgttgatcccgttcgcgctggcccagttcatctgcagtttcgccggctcgaacatgaacgtgatgatcaacgacatcagcgcggacctcggcaccacggtcgccggggtgcagctggcgatcaccatcttcctgctggtgatggccgcgctgatgatccccggcggcaagctcaccgaccggatcggccgcaaacgctgcctgaccgtcggcctgctggtgtacgcggtcggtgcactgctcagcgccgcggcccccggcctgggcgtgctgatcctcggcaactccctgctggagggcgtcggcacggcgatgctgatcccgccggtctacatcctgaccaccctgctgttcaccgacgtcacctcgcgggccaaggcgttcggcgcgatcagcgccatgggcgggatcggcgccgcgaccggtccgctgatcggcggcttcctcaccaccgcattcagctggcgggtggcgttcctgtttcagaccgcggtggtgctgctgatcgcggtgctcagccgtcgctgggtgcacgacccgctgccggccgacccgacgcgcccgaccgacctgggcggcgcggtgctctccgcgctcggcctggtcctggtcgtgtccgggatcctggccgcggacgacaacgtcgcggtgatgatcgccctgctggtcgccggggcgggcgtgctcctctggttcttcgcctcgatgcgggccaaggaacgcaccgggcggccggcgctgttgtcgatgacgctgttccgcaaccgcacctcgaacctcggcatggtcacccagtcggcccagtggctgatgttgatggggacctcgttcgtggtctcggcgtacctgcaggtggtccgcggctacaacgcgatcgagaccggggtggtgttcaccgcgaccacggccgggctgctgctgtcctcgctggccgcggaacggttcgcgaagcggcgggcgcagcgcacgctgatcgtcgccggcttcctgatcaccatggccggcgtggtcctgctgctcaccctggtgtacgcgtcgaagtcggtcgcgatgttcgtacccggcctgttcgtgatcggtttcgggctgggcggcatgctcaccccgtcggtcaacgtggtccagtccagcttcggcgaggacctgcagggcgagatctccggcctgtcgcgcagcgtgtccaacctgggctcggcactgggcggcgcggtcgccgggacgatcctggtggccgagctcggctcccggccgggcaccgggtacgcggccgcgatgatcgcggtcgcggtggccggcctcatcggtctggccgccgcctggttccttccgcggacagccgctcctgctcccgcttga

SEQ ID NO: 7143 - DNA, 558 bp, Actinoplanes utahensis
atgatcggcaggcggaggcgcagcgatctgcgccgcatctcggaccggctggagagcctgttggtgttcctgctggtgctcacgttcctcggcggggcaccgctgctggcccggtgggccggcggggccagctaccgctccgtccagcaggccgcggaatgggagcggacccacctgtcccaggtggacgcggtgctgaccgagaacccgagccccggcggggacagcgccacggcggccgccgccaacgcccggtggaaggcgccggacggcaccgcgcacaccggcctggtgcagcccgactccgggttgcgtgccggggaccggatcaggatctggatcgacgacaccggcgcgcagcatctgccgccggccgaccgggacccggtcggtcaggccgtgctggtcggcatcgcgacgacgctgtgcctggccgccggcctgaccgggatccaccggatcgcccgcggcgtcctcgatcggcgcagggatcgggcctggacccgggactggctccgggtcggcccggtgtggagccgcgacagcggccgatactga

SEQ ID NO: 7144 - DNA, 492 bp, Actinoplanes utahensis
atgacgcgcccgcggatccgcctgacccacaagaccgaggaggccaccgccgccggcatctacggcatcatcgtgggcgccgcggtgctggtcaccgcccacggcgtcgccgcctggcgggaggtcctggccgtcctggcgacgctcaccgtgtactgggtcgcggaacgctacgcccggatcgtcgccgaacgcatccacgagggacaccggcccacctggcacgtcgtccgcgagcacctgaccagcggctgggagctggtcaccgcctcgctgctccccctgctggtcctgatcaccatccgcgcctccggcgccgccctgctgaacgccgagatcatctcgctgtcctgcagcacgctgctgctctgcctggccggctggagcatcggttccggcggccgcctcacctacctcgaacggatcgtctccaccatggtcgccggcgccttcggtgtctccatggtggtgctcaaggccctgctgcactga

SEQ ID NO: 7145 - DNA, 528 bp, Actinoplanes utahensis
gtggtggcgagcacctattacctggcgatgccgctgttcggtgtgttgtcgctgttcggctggctggtcatcggcggatgctgggtcggggtggttgcgacctctgccctggcgatgctggcctcgtgtcgggacagggcgtatggctgggcggtggcgtgtctggtggtcgcggttctctccggggtcggggtggtcagcacggattggcggccggtctacaccgacagccagttccggttgcaccgtggggagctgggtgagttggccgccgaatatcaggccggccggttggtgtcggacagcgaattgccatggcggctgcggtacctgtccatcgatgggcaggcacatgttcgtgatggggctctctaccttccggtctgggcagactggagagccgagagcggcggaggtttcgcctacttcccgtcatcgcccgggccggacaccatggtcggcaccgctgccggggataccggccggccggtgcgggcgctcggtgacggctggtggtgggtggactag

SEQ ID NO: 7146 - DNA, 480 bp, Actinoplanes utahensis
atgtgccgcatgcagcagagccgacacgacctcgaacggcaggccaacgacctggccgggatggcggcccgagcgcacgccgccggccggccggatgaggcgttggctcatgccggccgggccgtcgcggtcgtggaagcgatcgtcgcggcacaccccgccgatgcccaggcgcactgggtgttggccggtcagctctacaaccgcgccggcatccacgagtcgctcggcgacttcgcggcggccgccgtcgacgccgcccggtccttcgagatctaccagcgcctggccgcggtggcgccgctgtgcctgccgcagcgcgccgacgccgaggcgaggctggcgcggacgtcggccttcgccggcgcgcagcagggggtcgatgccggacccacccgcgaacacgccgcggccgccggtgaccgggaactacgtgcgggccctgttcgtgctgggcgttctgcagcaggagctcggtga

SEQ ID NO: 7147 - DNA, 756 bp, Actinoplanes utahensis
gtgctgaccatcgcacacgtgtccgacctgcacctcggggcgcaccacgacgcggcggtgcagagcctgatcgcggacgtcgccgcggtccggccggacctcacggtggtgaccggcgactggaccatgcgagcccggccggtggagttcgacctggccaaggagctgctgaaacggctgccggaaccggtgctcagcgtgctcggcaaccatgacctgccgctggccggcccgcagcggctgctgcgcccgtacgaccgctatcgaacctggatctgcgacgacctggacccggtcatccacctggccggcctgaccgccgccggggtcgcctcgatgccgcggtggcggtggaaggacggccgggtcacccggcagcagaccacgtcgctgacggcggccttcgccgccgcgccaccggacgggctgcggctgatcgccctgcaccacccgccgaccggccggagactggtcggccggtcccggctgctgaccgcggcgcgggaggccggcgtgcacctcgtcctggccgggcacacccacatcccggaggtgcgccggctggccggcgggccggtgctgatcaccgcgggcacctcgaccagccggcggacgcgggggacaccgcgctcctggagccggatcaccgtcgccggcggcacggtcacggtggtcgaacgctacccgtccggcgccggctggcacaccggccgcctgaccaccgtcccgggttcaccggtcgcctccggcgggtga

SEQ ID NO: 7148 - DNA, 969 bp, Actinoplanes utahensis
atgcggatcgtcatcgcgatcggcggcaacgcgctgctgcaccgcggggaccggccggacgccggggtccagcgggccaacgcggtccgggcggtcgaggcgctggcgccactggccgccgagcacgagatcgtgatcacccacggcaacgggccgcaggtcggcatgctcgccctgcaatccgcggcggaccccggcctgcgcgcgccgtacccgttcgacgtgctcggcgcccagacccagggcatgatcggctactggctgctgcaggcgctgcagaacgcgctgcccggccggcaggtcgccgcgatcctcgaccagaccctggtctcggctgccgacccggccttcgccgcaccgaccaaattcgtcggaccggtgtacgacgaggacaccgcccaccgcctggccgccgaacgcggctggacggtcgccgccgacggcccgaagtggcggcgggtggtcccgtcgccccaaccgcagcggatcgtcgagacccggatcatccggcagctgctgttcgacgggaccgtcgtggtctgcgccggaggcggcggcatcccggtgatccgggacgacgacggccggctgcgcggcgtcgaagccgtcgtcgacaaggacctggccacctcggtgctcgccgagtccctcgacgcggacgcgctgctgctgctcaccgacgtgccggcggtgcagcgcggattcggcggcccggcacccgaaccgatcggccgggccaccccgggcgacctgcgccgggaggacttcccggccgggtcgatgggacccaaggtggaggcggtgtgccggttcgtcgaactgaccggcgacctggccgcgatcggcgccctcgacgacgcggcggcgatcctggccggcaaggccggcaccgtcgtcaccccggccggagactacggcggcccgcacgacctgcgcccaccccggcgtccgggcctgccctcccggtga

SEQ ID NO: 7149 - DNA, 1002 bp, Actinoplanes utahensis
atgtccgtgaaccttcgcaaccgcagcttcctcaaggaactcgacttcaccccggacgaatggcgcttcctgctgcggctcgccgcccagctcaaggccgccaagtacagcggcaccgaggtgccccggctgaccgggaggaacatcgcggtgatcttcgagaagacctccacccggacccgctgcgccttcgaggtggcggcccacgaccagggcgcgcacgtcaccttcctggacccggtcagcacccagctcggccacaaggagtcggtcaaggacacggcccgggtgctcggccgtttctacgacgccctggagtaccgcgggttcggccaggacagcgtggagaccctggcccggcacgccggcgtgccggtgtggaacggcctgaccgacgagtggcaccccacccagacgctgtgcgacctgctcaccatgcgcgagcacacggtcaagcacgacaacgaggtggcgttcgcgttcctcggcgacgcgcacaacaacatgggcaactcgctgctgatcgccggcgccatgatgggcatggacgtgcgcatggtcgcccccgagtcccggtggaacccggaggaggtgatcaaggcggcccgggcgatcgccgagaccaccggcgcccggatcacgcacaccgcggacgccgccgaaggcgtgcacggcgccgacttcctctacaccgacgtgtggctgtcgatgggcgaaccgaaggacgcctgggacgagcggatccgcctgctgcggccgtaccaggtgaacagcgaactgctgcgggccgcccggaacccggccgtcaaggtgatgcactgcctgcccgccttccacgaccggcggaccagggtcggcgaggagatcttcgagcacaccggactggaagcgctggagatcaccgacgaggtgttcgaatcgcccgcctccatcgtcttcgaccaggccgagaaccggatgcacacgatcaaggcgatcatggtcgccacgctgggagcctga

SEQ ID NO: 7150 - DNA, 1221 bp, Actinoplanes utahensis
atgccattccacgtcgactccgagaccggccggctgcggcaggtgatcctgcaccgccccggcgtcgaactcagccggctcaccccggacaacgtcaaggacctgctcttcgacgacatcctgtgggcgcgccgggcccgcgaggagcacgacgcgttcgccgaggtgctgcgcgagcgcgggatcaaggtgcactacttcgccgagttgctcgccgacgtgctggacatcccgcacgcccgctcctggatcctggaccggatcatcaccgagaacaccgtcgggccgaccctgaccgggccgctgcgccggctcgccgaccaggccgagagcggtcggctcgccgactacctgatcggcggggtgctcaaacaggaactcgccggcttcaccgtgaacagtctgcgctgggaactgatgagcgccgacgacttcgtgctcaccccgctgcccaaccacctgttccagcgggacaactcggcctggatctacggcggggtcagcgtcaacccgatggcgatggcggcccggcaccgcgaatcggtgcacagctcggccatctaccgtttccacccgatgttcaccctcgccgacttcgatttctggtacggcggtgacgatcgggtgcaccagccggccaccctggagggcggcgacatccacgtgctcggcaacggcgccgtcatgatcggcctgggcgagcggtccaccgcgatgggcgtggagaacctggcccatgcgctgttcacggccggcgccgcgaccagggtgatcgccatcgaactgccgcactcgcacgccatgatgcacctcgacacggtgatgaccatgatcgaccgggacaccttcgtgatgtacccgtacctgcaggaggcgctgcggtcctggaccgtgcggcccggcgacgacgaggacggcctcgacgtcacccgcaacgacgacctgttcgccaccatcgccgagaccctgggcatcgacaagatccaggtgctggagaccaccgaggacatccgggccgcccagcgcgagcagtgggacgacgggaacaacttcctggccgtcgagcccggggtgatcgtcggttacgagcgcaacgtcaccaccaacaccttcctgcgccggcacggcgtcgaggtgatcaccatcgccggcggggagctcggccggggccgcggcgggccccgctgcatgacctgcccgatcgaacgcgacgccgtctag

SEQ ID NO: 7151 - DNA, 1578 bp, Actinoplanes utahensis
gtgcttccgctactccagcgaggggcacagccggtcgctgttctacagcaccgcgatgaccgcgctgcaacagctgcatcccgaggtgaaggcgctgcgcgggctttccggggagacccggctggtggtctccgagccgctcggcgagctgaccggggcgtggcaggaggtgcccgaggcgtcgtacggcgtgatccagaagggcgccgacgaactgggccgcttcgaaccggccgcgccgtgaaccggaccctcgggctgccccaggcgaccgcgctgatcctcggcaccatcatcggggtcggcatcttcaacctgccgtactcgctggccgggatcggcccgatcagcatcctggcgatggtgctgaccacggtcggggcgctggcgctcgcggtgatgttcgcggcgctgtcccggcggctgccggccgacgggggaccgtacgcgtacgcccgcgcggcgttcggcaacaccgtcggcttcgtcaacgcctggtcgtactggatcaccgcctgggccgggaacgcggccatcgtcaccggctgggtcttctacgtcgagcatttcgtcaacaaggacggcaagaccctctggtcgatcgtgatcgccctggtcggcctctggatcccggcactgatcaacctcaccggcgtgaagaacatgggcgcggtccagctgtggaccacggtcatcaagttcatcccgctggtgaacatgtcgaccgcggggctgttcttcatcagcaccgccaactaccacccggccaacctcaccggcggcggcgacgggaaggcgatcggcagcgccatggccatctgcctgttcagctacctcggcgtggagtgcgccgcggtggccgccgccaaggtgcgcgaccccgcgaagaacgtgcccaaggccaccgtgctcggcacgctcggcgccgccgtcgtctacctgctgtcgatgatcgcggtgttcgggatcgtgccggccggcacgctcgccgacgacaaggcgtcctactcggcggccgcgaacctgatggccggcggcggcacctgggccggcgacctgaccgcgctcgccgtgatcgtctccgggttcggggcgctcaacggctggaccatgatctgcgccgagatgccgctcgccgcggcccgggacggcgtcttcccggcactgttcggccggctgtcgaaacgcggcgtgccggccgccgggatcctgtcctcgacgatcctgggcagtctggccatgacggtcagctacatgggggcgagcggggcgaccgtcttcaacaccctggtcctgatgaccggcatcaccgccgccatcccgtacgcgttctccgcactcgcccagctcagatggcgggtcaggggccggctcacccgggacgcggtgatcgccgtactggccctgatcttcgccatcctgttcgtctggtattcccgcaacaccggccaggaccactggtacgtggtctggggcccgttcctgatggccggcgccgcgttcctgctcggcgtgccggtctatctcgccgtccgccgacacatgaccgcgccaccgcccgtccccgcccacgagtga

SEQ ID NO: 7152 - DNA, 831 bp, Actinoplanes utahensis
atgccggagttcagcggtctgccggagcgcctgccgcgccggtggcgggcgcgggccgcgctgatcctgggcagccgggtcggcacggtggcgatgcgcgggttcgccgagttgatccgggtgcagatcttcgatcgggcgatgaccctggccgcgcagtcgttcacctcgatcttcccgttactgatcatgctgctggcgctgctcgggccggcctaccgggcccggctgaccgatctgctgcacctgccgtcgggcagtgagcggctggtgcagcaggcgctcagcggcagccgcagcaacgcgttcggcgtggtcggctgcctgatcgtgatcctgtcggcgaccgggctgagccgggccctggtccgcagttaccgggcggtgtggcaggtggcccagaccccggccgggccggccgcgaccgggcggcaggtcgggacggtgctggcgctggtcgccgtcctgctggtcgcccggctcctcggtcgggtcgccgcgcggctgcccgcgccgcacgtgtccggggtgctgttcaccctggtcaccgacatcgggctggccgtactgctgccctggttgctgctgggcgccgcggccccgcgccggccgctgctggccggcgcggtcgtgttcggactgctgatgatcgtggtgcgcgccgccggggtggtgtatctgccgcgggcgttgcagtccagcaccgaccgctacggcacgatcgggctggcgttcacctacctcggctggttgtacgtgctcgcgttctgtctgctgctggccgcggtggccggcgggatggtcagagcagccccagttgacgggcgatga

SEQ ID NO: 7153 - DNA, 2610 bp, Actinoplanes utahensis
atgcgggcaggcccaggctccgcgccaccggcccaggtggcgcgtccccgcccgccgcaggggttgatctggcgtccccggctcgccgagacgctggaccggggaacgcgacaggcggtgacattgatctgcgccggaccgggctggggcaagaccgcgctggcgtccgcctgggccggcgcccgcgcggtcagcggaccgatcgcctggctcacctgcgcggccgaccacaacgacccgtacaccttctggtccgacctgctgctggccctgcgcacgtcgggcgcggtccgcccgggccagtccgtcccgcagcgcggcccggtcgtgcccgccgaggggcccgacttcctgcgccggctcggctccggtctcgccgccctgcccggcccggtcgtggtcgtcctcgacgacctgcaggagatcaccgaccagcggatcctggtgggactcagcggcctgctgcgtcatccccccgaccggctgcgcctggtgctgatcagccgcaccgacccggacctgtcgctgcaccggctgcgcacggccggcgagctcaccgagatccgggcccgcgacctcgccttcggggtcgaggaggcggccgagctgctggccgcgcgcggccgccggctgtccgcggtggacctcgccgccctggtccgcgccaccgagggctggggtgccggcctgcgcctggcgatggacgcgccggccggggtcggcccggacgaggcgtcggccgactacctggtccgcgaggtgctggcggcgcagccgacgccggtccgggacttcctgctgggcaccagcgtgcccgaccggatcaacggcagcctcgccgaggcggtcaccgggcgccccggtgagcagttgctggcccggctggaacgggccaacctgttcatcgagcgggtcggcggccacggctggtaccgctaccaccggcagttccgggccgcgctgcgcgggcagctcgcccgcgagtgcgaggacgtggcggcccgggtgcacctgctggccgcccagtggcacgccgggcgggacaacccgctcgccgcgctgcaccacgcggcggccgccggggactggcaactggtcacccggctgctcgtcgaccacgggctggcgctgttcgtctcgccggaccgggtggagctgatcgacctgatgcggcgcatcccgctggcccggctcccggagaccgccgaatccaccctgtgcctggtcatgctgcggtacggcctgggcgacctcagtggccttgcgcgcgggatcgaccgggtccgggaactgctgcgcgagcgcggccacggcggccgcgagctgatcgcgacggtgctcgacctgttcgaggcggccctggtgatccgctggcgcggcgacatgccgcggctggtcaccacgaccaccggggtgctcaccgatctggcccggctgcaccgcgacgaggccccggcagtcctgcggtaccgggcgatggccctgctcaacaagggcatcggcctgctctggacgaaccggctggaccacgcggaccgctatctgtgggccgccgcgaccggggcccgcgcggccggcatcccgctggtcgaggtcaacgccctgggacatctggccctgctcgccctgatccagggctcgctgcgggaggccggcgagcatgccgacgccgcgctcggggtggcccgccggatcgacgcggaggaccggttctcggtcaccccggcgtacgtggtgcgggcctccctcgacctgtggcagggtgccgaaccggaagccgaggaggcgctgcgccgggccctgcactcctccggggagcagccggagacggcgatgaccgtgctgatggcggtgttccgggcctacctgctgatcgaccggggtgagccgcggaccgcccgcaccgtgctggcgaccctggccgcggaggccggcccggccctgcgggccccgatgctcgaccggatcgtcgagctggcccacagcgaggtcgacctggcactcggcgatccacgcccggtgctcacccgctatgcccaccgggacggcctctacccgccggagcagctgctgctcgcgcacgcccgtcagctgaccgggcggaccgccgaggccgaggaactgctggccctgctgcgcgacgggccggaccgggtcgccgcggtctccgcgtggctgctcaccgcgctggccgccgacgcgcagggccgcggccagcgggccggcgaggcgctcggccaggcgctggccgcggccgaaccgatcggcatccgccgcccgttccgccgcttcgacaacgcccgggtgctcgccctcgccgaacggcagcagtggctgaccgagccgcgcggccgcgtcggcgagggggtgctcgccgagatcaccggggagatcccgatcggtacgccgccgacggccggcccgctcagcgaacgcgagatcgacgtgctgcagtacctgccgaccgtgctgaccgccggggagatcgccgagaacctcggcatctcggtgaacacggtcaaggcgcacatgcgctcgatctaccgcaagctgggtgccggtcgccgccgcgaggccgtggtcatcgcccgtcaactggggctgctctga

SEQ ID NO: 7154 - DNA, 447 bp, Actinoplanes utahensis
atgtcgaacagttacgcgagtgaacgtcccgccggcgccgactccccggccccgcccgccacggactggaccggagtggtcgcgttcgccggcatcatgctgatcgccctcggcgtcttccaggtcaccgagggcgcggtggccctccatcatcaggagttccatctggtcagcccggacggcctgctgatcgagacggactaccgggtgtggggctgggggcacctgctgctcggcctgatcgccctggccggcggggccggggtgctcctcggcaggctctggggccggatcatcgggatcctgatcgccttcctcggcgccctggtgcacttcatgttcctggccgccgccccgctgtggtgcaccatcctgatctgcaccgaggtgctggtcatcttcgccctcgccgtgcacggccgggatgtccggcgtacccagggctaa

SEQ ID NO: 7155 - DNA, 2610 bp, Actinoplanes utahensis
gtgtccattgacctgatcgcggattcacccggtatatctgagcacgacgcggacggttccctactcgcctcgaagttcacggtcccggccgcgccgccgttcatggtggcccggccgggactgctggaccgggtgagtgacggcgtccgcggcccggtgacactggtcaccgggctggccggcagcgggaagacgcagctgctggcctcctgggcgcggtcgcgcgccgtgccctggccgatcggctgggtcacctgcgagaacggggacgagccggcgaccaccttctggtcgtacgtcctggagggactgcgccgcgccggggtgccggctccggaaccggccgtgcccggcgccgcggcgagccgggcggtgctcgcccggctcgccgccgtgatcgaccagcagcccaccccggtggtgctgatcctggacggcgccgcccagctgcccggccgggactgggcggccggcctggagttcctgctcgcccacgcgccggggttgcgggtggtcctcgcgggccggtgggacccgccgctgccgctgtaccgctaccgcctggccgggcagttgcgcgaggtgcgcggcgccgacctggcgttcaccgccgaggagacggcccggctgatggagctgcacggcgtgccgctggccgggccggacctgaccgcgctggtcgagcacaccgaggggtgggcggccgggatccggctctgcgcctgcgcgatgcagggcagcgccgacgtcacccggatggtcgccaccatctccggcgacgagtcgaccatcgccgagtacttcatcggggaggtgctgcgtacccagccgccggcgatccgccggttcctgctggagaccagcgtgctggacaccttctccgcggacctggccgccacggtcaccgcccggcccgacgcggcccggctgctcgccgcgctgacccgggagaacgccttcatccagccggtcggcgacggcaccgacctgtaccgctaccaccggctcttcgccgaactgttgcgcgcccagctgacctggctcgaaccggaccaggtgacggtgctgcaccagcgggccgcgggctggctgtcgcgcaacggacggctcgccgacgcggtcgggcacgcggtcgaggccggcgactggggcgccgcggcggccctggtgatcgaggacttcgccatcggccggttgatcgtggaaggcaccgccgggcggctcggaggactgctcgccgcgctgcccgagaacctcgacctgcccgaggtggtgatggtgcgggccgcgctggcctggggcgacgcccggctggacgccgcgcgtgagctgttcgcgctggccggcaacctgctcgcgacccggggcggcgactgcggggagggcatgaccctgagcagcttcgtgatgcaactgctgctgctggccggcggcccggacccggagcgggtggccgaactcgccccggtcgcgaccgcgttcctggccgtggcgccgatccgcaaactggcccggcacccggagctgcgggccgtgctgctggccgccgaggggaccgcgagcagcgccgccggcgacgtgaccggcgcggtcgaggtgctgaccgacgcggtggccgccgtcccgcccggcgacgaggcactcaaggtggactgcctgcgactgctcgcggtgctggaggcgcaccgcggccggctgggccgagccgagaacgccgcacgacaggccgtcgacctggccgggcagtgcgggctgccggccgggcgccggccgatcgccgcccaggtggccctggcctgggtggccctggaacgcttcgacatcgaggccgccgaccggcacctgcgcggtgccggcgccggcaccgatccggtggcggccgcggcgtacgccgtggtccggtcccggcgcctgcaggtccgcggcgagctgcgcagcgcgctgaacgtgctgaccccggtccccggcgcgccggcctggctgcgccgggagatcgagctgggtcgcgcccggctgctgctgggcgcgggccggctggacgacgcggccgcggtgctggccgactgcccgcagccgtccccggacgtcgcggtggtgcaggccgcgctggccctggcccgcggcgaatccgaccgggcgcacgaggtggcccgcacggtcgccgacgccgcaggggtgacggcgccggtggccctggacgcctggctgctgctggcgatgctggcggccagttcggacgacgagaccggcgcgcgggaggcgctgcgccgggcgttgcgggtggccggcccggagaacgtccggcggccgatccaccaggtctgggggacgctgcgccgggtgctgcgcgacgacgagaagctcgccgcggtcggcgggccgcagccgggctcggcggtcgccgagccggtgctggtggaggcgctgagcaagcgggagctggacgtgctgcgcgggatggccgagatgctgccgaccgaggagatcgccgcctcgatgtacgtctcggtgaacaccgtcaagacgcacgtccgcagcatcctgcgcaagctctccgcgtcccggcgcaacgaggcggtgcgccgggcgcgggccctcaatctgctttag

SEQ ID NO: 7156 - DNA, 1329 bp, Actinoplanes utahensis
atgaatccggtgatctacgagatcgacacctggccctggctggccggcctgggccgcaccctgggtgacgtcccggacgaggtgtgggatcaggtgtgcgtgcccgggctcgacgccgtctggctgatgggggtgtgggagcgcagcccggccggactcgaggtggcccgcaccaaccgggaactgcaggagtccttccgggaggcgctgcccgacctggccgggtcggacgtggtcggctcgccgtactgcgtgcgccgctaccgggtggatgaccggctgggcggcccggcgggcctggccgcggcccgtgcgcagctgcgccggcgcgggctgaggctgttcctggactacgtgcccaaccacgtcgccccggaccatccggcggtgaccgcgcaccccgactggttcgtgcacatggacggggcgatcgccaacggccgggacccgtacttcccgccctggccggatgtgatgcagctgaacgcgttcgcgccggggatgcgggcggccacggtggccgcgctctcctcgatcgccgagcagtgcgacggcatccggtgcgacatggcgatgctgctgatcaacgagatcttcgcgcggacctggggggagcacgtcggcccgccgccggagcgggagttctggccggaggtgatcgcggcgctgcgcgaccggcatccggatgtcaccctggtcgccgaggcctactgggacaccgagtggacgctgcagcagcagggtttcgaccactgttacgacaagcggctctacgaccggctggtgcacgaggacgccgcgtcgatccgcaagcatctgagcgccgggctggactaccagaaccggctgatccggttcctggagaaccacgacgagccgcgggccgccgcgaccttcccggacgggcgggggcgggccgccgcggtggtggtcgcgacgctgcccggggcgacgctctggcacgacgggcagttcgagggacggcgtacccacttgccggtctttctggccagatatccgaatgaggagtttaatctagaactgcgcgacttctacacacgtgtggtaggtgcggccgcaccgctgcgacacggccggtggcggctgctcgagaccggggccccggatctgctggcctgggcctgggaagcggccatcgtggtggtgaacttcgccgatcactggtcgcagggctgggtgaccctcccggaaccgggccgggcgtggcggctcgtcgaccggctggacggccgggtgttcgaccgggagggcgacgcgctcttcgtcgatctgccgccctggggaacgcatgttctagccgtgaagtga

SEQ ID NO: 7157 - DNA, 2607 bp, Actinoplanes utahensis
atggacgcaaccgagcatgccgaacagcggcgcctcaccgacgccgacagcggagccgtcgactggcgacgctgggggccctatctcagcgaacggcagtggggcacggtccgggaggattacagcccgggcggggacgcgtgggactacctgagtcacgatcaggcgcggtcccgggcgtatcgatggggcgaggacgggatcgccgggttcagcgacgaccaccagcggctctgcctggcggtcgcgctgtggaacgggcgggatccgatcctcaaggagcgcttcttcggcctgaccaacgccgagggcaaccacggcgaggacgtcaaggagtactacttctacaccgacgccacgccgacccactcgtatctgaagatggtctacaagtatccgcagcacgagttcccgtacaccgggctggtcgagggcaaccgggcgcgcgggcgcggcgagttcgagtacgagctgctcgacaccgggatcttcgccgaggaccggtacttcgacgtggtcgtcgagtacgcgaaggccgggccggaggagatcctgacccgggtgaccgtgcacaaccgcgggccggaggaggcggtgctgcacgtgctgccgacggtgtggttccgggcgaccgcggatcaggggttgctggtccgcgacggcggcgcggtccgcgccgagcagggctcgctcggccaacgctggtggacctgcctgggcgacccgacggtgctgttcaccgacaacgccgacgggcgcaaggacgccatcggccgctggctcatccagggcgagaaggaggcggtcaaccccggcgaggcggggagcaaggccgccgcggtggtcacggtgacggtgccaccggggggctcccacgtcgtacgggcgatgctctccgatcgtccgtccaccgggagtgaccaggattcccggagcttcgacgaggtcgtcgaggcgcgccgcgccgaggccgacgagttctaccgtaacctgttcgcgcccgccctcggggagccggagcggcaggtggcccggcaggcgctggccgggatgatctggtccaagcagtacttcggctacgacgtcgagcagtggctgatcgagcacggccgggatccgctggacgcgcccggcatccgcaacggcgagtggttccacctggacgcccacgacatcatctcgatgccggacacctgggagtacccctggttcgcggcgtgggatctggccttccaggcggtggcgttcagcgtcgtcgacctgaacttcgccaagagccagctggacctgctgctgagccggcgctatctgcatcccaacggccagattccggcgtacgagtggaatttcagcgacgtgaatccgccggtgcacgcctgggcctgctacctggtcaacgagctgcagaaggcgcggaccgggcagggtgaccacgactggctggaacgggccttccacaagctggccaagaatttcacctggtgggtgaaccgcaaggacgtcgacgggcgcaacgtgttccagggcggcttcctgggcctggacaacatcggcgtcttcgaccgcagtgccccgctgcccaccggcggccacctggatcaggccgacggcaccgcgtggatggcgctgtactgccagaacatgttgcagatcgccctggagctggccgggcgcgacccggtctacctggagcaggcgcagacctacttcgagcacttcgcctacatcgcggccggcagccggtcgatgtgggacgaggaggacgggttctactacgacctgctgcggatgcccgacggctcgtcgcggacgctgcgggtccggtcgatggtgggactgctgccgctggccgcgacgaccgtcttcgaccggacgctgatcgatcggcatcccgaggtgctggccgacgcgcaggagttcctggcccggcatgagacgctgcggctcagtgacgggcccggccggctgctggccctgttcgacgccgaccggctgcgccgggtcctggcccggatgctggacgagaacgagttcctcagcccgtacgggctgcgggcgctgtcgaagttccacgaggcgcacccgttcgagttccgcgtcggcgaccaggtgttcagcgtctcctaccagccggccgagtcggacagcgggatgttcggcggcaactcgaactggcggggaccgatctggttcccggtgaacgcgctggtgatccgcgcgctgctgaacctgtacgtcggatacggcgacgagttcaccgtggagtgccccaccggctccgggcagcagatgaccctgttcgaggtggcccgggagctgtccgcgcggctcacccggatcttcctgcccggcgaggacggtgcgcggccgtgctacggcggccaaacgatcttcgcgacggagcactggcgagacctgatcctgttctccgagtacttccacggcgacaacggggccggtctgggcgccgcccaccagaccggctggaccgggctggtcgccgtgttccccaacctgttcgccggtctgaccggccaggatctgctggccggcgggatggccggcgtgttccggaagttctccggggagggtgcggcgccgcgatga

SEQ ID NO: 7158 - DNA, 495 bp, Actinoplanes utahensis
atggcaacactggtcgccatcgggtaccccgacgagaccacggcgacggcggcgtcgctggaggcgaaccggctggccaaggacctgatcatccagccggacgcgatcgccacgatcatccgggaccgggagggcaagttccacgtctcgaccaaccatcacgcggtgggcggcggcgctacctggggcatgttctggggtctgctgttcgggatgctgttcttcatcccggttctgggcatggcggtcggcgccggtctgggcgccctcaccggcaagctcgccaagggcgcgatcaacaaggagttccaggagcggatccgcgacgagctgcagccgggcacgtccgcgctgttcctggtggtcgagtcggtcaccccggacaaggcggtggaggcgctgagccactacggcggcacggtgctcaagtcgtcgctgccgaaggagaccgaggaggagctccaggaggcgctgcacgggggcgcccagcggtag

SEQ ID NO: 7159 - DNA, 207 bp, Actinoplanes utahensis
atgcgcgagcgatacgagatccgggtccggggattcctcgggccactgctccggcggaccctgggcgacctgcggatccgcaccatgccccggcagagcacgatccgtggccggctctccgagcacgacctggaacgtctgctgacccgcctggaccgctccggtgtccaggtggtctgcctgacctcggtgggagagagccgatga

SEQ ID NO: 7160 - DNA, 1116 bp, Actinoplanes utahensis
gtgagatccgcgcctgacacgcgcccggccggcccgcggctgcggccgccggcgccggtcgcggtgctgccccgcggtgtcctcgtcctgctcggcttcgcctgcctggtcgtcgtggtggccgggctgcgctgggtggccggtctgatcggaccggtcttcctcggcctgatgctggtggtgaccgtcgccccgctcaccggccggctgcgtcggcgcggcctgccggtgtggctggccgcggtcctcaccgtcctggtcacctacctgatcctggccggcctcggcaccgccctggcggtgtcggtggcccggctgatcgacctgatgccgcagtaccaggcacagttcgccgccctgcgcgacgacctggtcagcggactgggcgcgctgggcgtctccgccgagcagatgcactccgcggtcgccggggccaccccggacacggtcgtacgggtgatcgggtcgctgttcggcggcgtcgccgggctgctctccaacaccctgttcctggtcgccgtgctgctgttcatgtgcctggacgcggtcgacttcccggcccggctgtccaccgtggtggccgaccggccacaggtcgtcgtggcgctccgctcgttcgcccggggcacccgccgatacctggtggtgtgcacggtcttcgggctgatcgtggcggtctgcgacaccctgctgctgtggtggctcggggtgccgctgccgctgctgtgggggctgctgtcgttcatcaccaactacatcccgaacatcggcttcgtggtcggcgtgatcccgccggcgctgctcggcctgctgcagggcggcccgcacctgatgctcaccgtgatcgccctgtactgcctgatcaacttcgtgatccagtcggtgatccagccgaaggtggtcggcgacgccgtcgggctgtccgcgacggtgtccttcctggcgctgatcttctgggcctgggtgctgggcggcctcggggcgctgctggcgatcccgctcaccctgctggccaagggcctgctggtggacatcgacccgagcacccggtggatgaacgtcctgctcacctcctcctccaccaaggatgaggcgcccggtccggacgcgccgtga

SEQ ID NO: 7161 - DNA, 498 bp, Actinoplanes utahensis
atgacgacgttcactgtgtggaagtacgacgatccgcagggcgcggaacacgcgttccgcgccatccgctacgcggccgacgacaacctggtcgaggtcgtcgaccacgcgaccgtgagctggccggccggcgccgccgaacccgacacccaccacgcccacgacagcaaccggcagggcgtcggctggggcgcgttctggggcttcgtgttcggcagcctgttcttcatgccggtggtcggcagcgcggtcggcgccggcatcggcggcctcaccaaggcctccgaaggcaccggcatcagtcaggagcagatggaccgcctgcgcgccgagatcatcccgggcacctccgcgctgttcctggtcaccgagtacggcgacctggaccgcctggcggaacgcctgcacgggatgggcagccgcctgatctccaccaacctcaccgacgccgaacgcgacgaactcctcgaagccttcggcgaccaccgcaccgcgtga

SEQ ID NO: 7162 - DNA, 96 bp, Actinoplanes utahensis
atgcggatccgtccgggaaagcgcggccgggccctcgtcccacccgagtcgggcccggccgccgcgccgacccgggactacctggaaccccggtag

SEQ ID NO: 7163 - DNA, 372 bp, Actinoplanes utahensis
atggcaaccagcgacagcccgacccggtccgcctccggaggcgtccggacggccgggtggcgaatcgcgaccgtcaccgccgtcatcgcggtggtcgtgcccgcgaccgccggtgccgcctacgccagtggcggtaccagcggcaggaccaacaactgctactcgacctggggcaacaccgggtcaagcgcgcactgcctgccggccacggccaccggctactaccagaaccacctggtgtgcaacggtgagggtgacaaggtcagcaactgggtgctgatctcgaacggcgcgaccgtggacaactggggtcagctgaactgccgcttcaaggccagcagtgccgatgtccgctaccggggttccaggtag

SEQ ID NO: 7164 - DNA, 1461 bp, Actinoplanes utahensis
atgcggcaccgaggacgtcgcctgcggcgacggtctatttgcacgaggcgacgacctatcggcacgctgggtcacatgtcgcgtacggaacgccctcttgatccgtcgtccgggccggccgccgccttcgccctgcagctgcgagagttgcgagtcgccgccggatccccgaagtacctgcagatggcgcgccggaccggccgatccgggactgccctggcggaggctgccgggggcgaccacataccgcagtgggaaacggtcgaggcatatgtgcgagcgtgcggcggcgatccggccgagtgggccgaccgctgggagcaggcgcgtgacgcggcatcccggaaggcccatggcgcaccgccggcgtccgtggcgcccgacccggccgtcggaccggaagacgccgcccgggacggctggtcacatcgccgggacggggtgcttaccgggcggcccatgctgctggcggtggcggcagtggcgctggtgctgctcggcatgatcacgccacggcccggcgcgcttttcgggcgacacccggacaccgccggcgtggggcagatccatgtcgcccgaccggccgcggtgacgcttgtcgccttcagccggttcggcaggttcgcctccgggaacttcgctgtcaccggtgccggcggtgcggtggagatctgggacaccggccccgtcgcgcggcgccacaccctcgtcaccggcgatgagcagatcaccgaggtgcagttcgatccgctgaaccgcgacatcctcgcgaccgccggcaccaacggcctgctccgtctctggaacacgacaaccggcaagtccgtcctcagcatcgcgggccaggcggccgggcacagcatgaccttcgcattcgatccgcgccgccgaggaatcgtcgccaccatcggcgccggcggaacgatccggatcctgcagacggagaccggccggatcgtccgcgaactgcacaccgggctgaccgatgtcaccgccctgacgttcgactgccagaacgagggacacctggccgccggcggcgacggcgccctggaagtctggaacagcggcgacggcacccgcgtcagcgtgggcgagaagataccgggacgggtcacctcgatccgtttcgacccgctgacccggaacactctcgcgatcaccactgccggtgcgccaccgggcatctgggatgccagcaacggccgagtggtgcgcttcctgcgcagcgacgcccgccccacggtgaccgcgttcaacccgctgatcaggaacagcatcgcgacggacgacgggcacggcgacgtacagatcttcgacgccagcaccggcctgccggtccacaccctgcacggtcgatacggcccgatcacctcgctcgagtacgcacccgacggcgccaccctggccgtcggcgcacgggacggcgtcgtcgggctgaacgccgtggacgactggtga

SEQ ID NO: 7165 - DNA, 543 bp, Actinoplanes utahensis
atgatcaccggggtgaatgcggaagcacccggatggctggtcgagctgttgcgccggcacaccgtcttcgacgagatgctgatgtcggcctggctggacaaggacccgccggagcgggcggtgatcttcggcaaggacgcccatctcggcgggccggccggttggctgtccatggtgctggcagacggggattactcactgcggctcagcggccccgaccggccacggctgcacgaggagctcaacgaggacgagttcgacgctgccgacgacgaggacacccggccgctgttcgtcagtgtggccggcacagtgatgagcacgtacttcccggtgcgctgccggagcgtgaccctgtttctcagcgccgagtccgaactggagaacggcgtggcgcgcgccgtgctgttcgacctgtccaccgggccgctgttcatcgacccgttccacctggacggcatccgcctggccggcgcggccgaggcggacgccctgcgcaccggggaccccgggatcaccgtgctggagatcccggtcggctga

SEQ ID NO: 7166 - DNA, 1530 bp, Actinoplanes utahensis
atgagttcgagcgggcccaatgccatgcgcccaccctgcggcaccgggcccggccgggcttcatccgcgcagggtgaaaccccgggcttcgggaccgttcacccctgccggatgaggtgccggaccgccccggtcagagaccgtcgccgggtgtccagctcaccggtgaccgctgaggcggaggaactggcccggctacgggccgaggtggcgtcgctgcgcgcccggctggccgagcggccgcccccgcagcgccagcccgggtggcaacggcgcacgctgcgccgcacgaccgccgcggtgctcgcggcgatcgccgcgttcgcgctggtcaccagcgtggtcgggctgtgggcggcgaccaccacgctgaacaccgaacggtgggtcgcgaccgtcgcgccgctgcctcaggacccgcaggtgtcggcggcggtcgccgaatacgccagcagccagctgttcgaggtgctcgacgtggagcatcggctgcgcaccgtgctgccgcaacaggccgcgttcgtggccggcccgatcaccgggcagatccgcgaccaggtccgcaagatcatcggcaacgtgctgcgcagcggccggttccagccgatctggatcgacctcaaccgccgggtccaccagcggatgctcgccgtcctcgacggccgcagcgacgtgctggccgcgcgccacgaccggatcgacatcgacctgctgcccctgatcaaccagggcctgcgcgaggtcggggacgaactgcccaccctgttcggcaagcagatcacgctgcccgacctgagcagcggcgccatcccggacaacctgcgccagcgggtcgaggaccagctcggggtcagcctgcccgcgaacttcgcgcagttcacggtgtacgacgcgggccggctctgggccgcccagcaggccgtcgccaccgccgaacgcgacttggcgctgttcgtcggcgccaccgtcgtgctgctgatcgcggcgtatgcggtctccccgggccgccggcgcaccaccctgcaactcggcctgtggctggtggtcgccgcggtcgcggtcaccgcgatcctgcgcgccgtccgccgggagatcctcgcccaggtgccggccggcacctaccgcgacggggcggccgccgcgatcaccagcgtgttcagcctgctacgggaacgcggcacccagctcatcgtgatcgggacggtgctggcggtgctcgcctatctggccggccccggacgcctgccccgctggctgcgcacccaggtggtgcgcggcgcccgtggcatcggcgtcggcagcgtccggctggtgggtcacgcaccgtcctggatcgccgcccatcgggacccggtgcgcatcgccggcatggtggtggccgccatcctgacgctgatcctgtcgtcctggacggcgctgctggtgatcgtggtcctgctggcggcgtacgaggtggcggtcaccctgatcgcccgcgcggtcgccccgaaggggcagtgggcggatcgggcgccgagccaggcgcggtag

SEQ ID NO: 7167 - DNA, 417 bp, Actinoplanes utahensis
atggcattgggcccgctcgaactcatgatcatgtcctttccggcggatcggctcaacgacggcgtgctgacgaccctggaccggctcacccgggccggcgagatgcggatcgtcgacgtgctggtggtgcgcgccgacgccgcgggcgtggcgtgcaccgtcgagctctgcgagctgcccgggctttccggggatctcgcctgggcccggctggcgaccgggctgatcaccgcgaccgacgtcgaggaggtggcgcgtctcgccgaccacgagaccgacgtgctcgccgtgctcctggagcaccggtgggtgaacgacctggccggccgggtcgccgcgtcccgcggcaccatcgtggcgctcaaccacatccccggtgcgcccggccacggacgagtgctgaccagcacgaggtga

SEQ ID NO: 7168 - DNA, 450 bp, Actinoplanes utahensis
atgagcgggctggacgagatgggaccggtcgactacctctgcatcgagttcccgaagggcggcctgcgcggccgtgcgctgccgatgctgctcgacctggtcgaccggcgggtgatccgggtgctggacctgctgttcgtgcgcaagtcgccggacggcacggtggtcgccctggacggacgggagctgcagctcaacgggctgggggcgttccacggcgcggcgtcgggcatgctcggcggcgacgatctgcgcgaagccgggcagattctgcaaccgggtgccgcggcggccctgctggtctacgagaacctgtgggccgcgccgctggcccgggagctgcgcgagtcgggtgcgcagctggtcgccggcgggcggatcccgatccaggagctgctggccgcgctggacgcgaccgaggcggctgccgccccggccggcgggcggtga

SEQ ID NO: 7169 - DNA, 276 bp, Actinoplanes utahensis
atgcccggactgctcaggggaatcgcccgcaccgcggtgatcgccggcacggcgaccgccgtctccaaccgggtgtcgcgccgccagcagggtcgctgggcgcggcacgacgccgaggaccagtatctggccgagcaggagcaggagccggtcgaccaggaggatccgatgacggcgaagctggaccagctgcgccggctggccgacctgaaagccgagggcctgctcaccgacgccgaggtcgaggtgcagaagtcccgcattctccattcctga

SEQ ID NO: 7170 - DNA, 1041 bp, Actinoplanes utahensis
gtgctcaccatcggtgtcgaagaggagttcctgctgctcaccgcggacggtgcggtgtcgccgacggccgccgcggcggtccgccacgcgcggctgcccgagcagatcaaacctgaatacatggcctaccagctggagaccagcacccgggtctgcgagaccctggacgagctgcgccgcgacctgacccggctgcggctgatcgccgccgacgccgccgaacgcgacggcgcgctgctggtcgcgaccggctcggcgccgctggacggcggcccccggcaggcgctcaccgacgatgcacgctaccgggacctggcccgccggttcccggacgcgaccgcggcgggcggcacctgcggctgccacgtgcacgtcggggtgcccgaccgggagctggccaccgcggtgctcacccggctgcggccctggctgggcgcgctgctgtcgctcgcggtcaactcgccgtactcgggcgccgccgacaccggctgggccagctcccgctacccggcccagctgcgctggccgacctgccggccgcccggggtgtggcccagcgccgaccggtacgacgccgcggtgcgcgaccacgtcgacgccggcatggcgaccgacgcggcgagcgtgtacttctgggcccggctttcgccccgctacccgaccatcgaggtgcgcatcggtgacaccgggctggacgtggccgactcggtgctgctcgccggggtggtccgggcgctggtcgcggcgctgctcgacgacgtgcggcggggcgagaagatcgtgccggtggcgtcggcccgggtggaggcggacctggagctggccgcccggggacggctcgggcacgggcggcggctgctcgagaagatcacgccctacctggccggcgatgtgggggaggtgtacgccgggttcgagcggctgcgccgggagggcaccggggcggaccggcagcggcggctgtgggcccggcactccggtggcgccgggttcgtccggtggctcgcgcacgcgaccacgccgctggccgtggcgtactga

SEQ ID NO: 7171 - DNA, 723 bp, Actinoplanes utahensis
atggaccctgctcgccgagcggggtgccgccgaacgcgaacgcggcaggcgcggcgcgcagcgggccgtcgacgccgccgtcgaacgcctggtccactccgaggtggtcggccgggtcgtcgacgcccagctggaacgggtgctgaccctgctggagaacgagccggaccggatccgcgcgctgatccgcggacagcgggagagcatcgtcggcgaggcggtcggccgggtgcgggccggcgcggccgccggggacatcgccgtcgaccggctcaccctgcggatgtcgcggcgcggcgagaccgcatgaccgggtacgccgggctggtcagccggaccttggcgtacctgatcgacaccgtcgccgtcgcggcgctgaccggggccggggtgatcgccctcggggtggtcgcctcggtggtcggctccgaggcgcgcgacctcgcgcgtttcgtcctgtcgtcctatctggtgttcctgcccaccctgctggccctctactgcgccctgttctggggtctggccgggcggacccccgggatggccctgctcggcgtccgggtggtccgggccgacggcgccccggtgcgctggccggccgccctggtccgcgcgctgctgctggcgtacttcccgatcggcgcgctgtggctgatcgtggaccgccggcaccagggcctgcccgacaagatcgccatgaccgccgtcgtccgggagggatga

SEQ ID NO: 7172 - DNA, 2631 bp, Actinoplanes utahensis
atgaccgcgacctatcacgtgctgaccgtgccggaggcgctggaggcggagaacgtcgaccagcagcggggcctcagtggtgcggaggccgacgcccgccggcagaagttcgggccgaaccggttcgccgaggcgaagcgggaaccctggtggcggtccttcgcccggcagtacgccgacccgatgcagctggtcctgctcttcgccggcctgggcagcctctacccgctgaaacagtgggggaccggcgtgctgctgctggcgctgaccctgctcaacgccgcgctcggcctgcaccaggagggcaaggccgcggcggcgatcgacgcgctgcagaagatgatgatcgtcaaggcccgggtgcgccgcgacgggacgctgatcgaggtgccggcagaggacctggtacccggcgacgtggtgcagctggaggccggcgacgtggtgccggccgacgggcggctgctgcgcgcggccaccctggagatcgacgagtcggcgctgaccggcgagagcctgccggtcgccaagaacgtggaaccgctggccgaggcggacgtggcgctcggcgaccggtccgacatggcgtacatgaacaccaacgtgacccggggagccggggaactgctggtcaccgcgaccgggatgggcaccgaggtcggccggatctccaagatgctggccaccgacaagggcgccgacaccccgctgacccggcagttggccaagctgaccaaccagatcctgatcatctcggggatcgcgctgctcgcctcggtgctgatcaacctggcccggggcaacgagttcaccgtggtgttcaccgcggcggtggcgttcgcggtgtcggccatcccgaccggtctgccggccgtggtcaccaccatcctgtcgcagggcacccagctgctggccaaggcgaacgcgatcgtgaaacggctgcggtcgaccgagacgctgggttccacctcggcgatcaactcggacaagaccgggacgctgaccctgaaccagatgaccgcgatcgagatggtcatcccggggcggcggtacgtggtgtccggcagcggttactccacacagggctcgatcaaacgggtggccggggagccggacacgccactggaggagttcctgctgccgatgatcctggcctccgacgcggtggtgaccgacgggtcgatgatcggggatccgaccgagggtgcgctggtcgtgctggcggagaagggtgggctcgacgctcaggccacccgggagaggtatccgcggatcgccgaactgccgttcgacgccgcgtacaagctgatggccacattccacgagatgtcgggaaagatccggtgttatgtgaaaggcgcgccggatcagctgctcgcccgcagcaatgtcacgcccgaccagcgcgaacgctacacggccgagaacgatcgcctggcccggcaggggctgcgggtgatggccaccgcctaccgggacttcgacaggctcggtgacgacctgctggagagcctgcaggacctgaccccgctcgccctggtcggcatcgtggacccgccccggccgcaggccagggacgcgatcgagcaggcgcacgcggccggcatcgaggtccgcatgatcaccggcgaccacgcggtgaccgccgccgccatcgccggcaggctcggcatccgcggccgcgcgatcaccggcgccgagttcgccgcgatgagcgacgaggaggccgaccgggagatcggcggcatcggggtgatcgcccgggtcaccccggaacacaaggtgcgcctggtcgaggtgctccggcgtaggggccacatcgtcgcgatgaccggcgacggcgtcaacgacgcgccggcgctgaagaaggccgacatcggcatcgcgatggggatcaccggcaccgaggtgagcaaggaagccgccgcgatgatcctcaccgacgacgacttcgccaccatcgtcaaggccgtcgcgctgggccgcgccctgtacgccaacctgaagaagtacatcttcttccagatgggcaccctggtcgggatgatcatcacgttcctggtggcgagcatcggcaacatcgccgccggcgtgccgttcgtgccactgcagaccctgtggctgaacttcaccacccagatcttccagtcggtcggcctcggctacggcaaggccgaggcggacatcatgagtcacccgccgcgccgctccgacgagccgctgctcagccgcgccgcactgggctggctcggcatcctcggcctgatcatgggcgcggtgaccctggtggtgatcggctgggcggaccacggccacgacgtcgactatgcccgcaccatggggctgaccgcgttctccatcgccaacctggccttctcgctgaccgtgcgcagcgacatccgctcggtgttcagtctggagaccttcggcgacaaacgcttcgtggtcaccaccggcctgtccgccgccgcgatcgtgctggccaccgagttcggcctgttccagaagatcctgcacaccagcagcctgggcgtccggcactggctgatctgcctgctcgccggcgtcgtcgtggtgatccccaccgagatccgcaaggcggtgctgcgccgccggaacgggagcgcgtga

SEQ ID NO: 7173 - DNA, 459 bp, Actinoplanes utahensis
atgagctccgaacctgtcaaaccgtccgtcaacgccgggaaactgtgggccggtggcggggccaccgcggcggtggcggcgctgatcgccgtcgccgggatcctgctcgggcgcggcatcttcgacatcggcgtgctcgccccgaagggcgacggcgcctggggtgacgcgagcaccggctggtacgcgctgggcgccgcggtggccgcgctcgccgctaccggcctggtgcatgtgctgatcctgaccaccccgcggccgatgcgcttcttcggctgggtggtcgggctggccacggtgtcggcgatgctggcgccgtacgtcaccgacgccgaacgggccgccaaggtctacacgtccggcctcaccatgatcctcggcatcgcgatcggctcattgatcgccggcgtggcccgctcggccaccaccctggtgcggccccggccgtcctaccggtga

SEQ ID NO: 7174 - DNA, 1452 bp, Actinoplanes utahensis
atgccgagccgtcggctccgccgtcgtggcccagcgggttcgcgccgccgtcggccgggccctcgtccggggtgccctcggtgtcggcggcaccgtccgcgccgccgtcgtgcccacccgggtacgcgccgccgtcggccgggccctcggtgtccttgtccgcagggtcggaactcacgatgtcgttctcattcaatgccatgcggctccagctacccagaatggatcttcctaatccacccgggacgtttgtccgcccgacaccggggcaaccggggacgcatgcttctcgatgacagtgtcggcttggcggtccaagggtacggctggctccccacggtgtggcggcgcgccggcggcggcccggtggtgcagacccggctgctcgggcagaaggtgaccgcgctgcgcggccccgaggcggtccgattcttctacgacgagtcgcacatccggcggcacggggcgctcccggaaccggtacagggcaccctgttcggcaagggcgccgtgcacaccctggacggcgacgagcaccacgcccgcaaggcgatcttcctgaacgtgctcaaggacccgcggcacatcgccgatctggtcgaccgggccgggcgggcctgggacgagacggccgccgggtggacgccgggccgtccggtggtgctcttcgacgaggcgagccgggtgctgacccgggcggtctgcgactgggccggggtgccggtcagcgacgccgaggtgccgcgggtggcggccgacctgaccgcgatggtggacgggttcgcgacgctggggccgcggcactggcgggcccggaccgcccgcggccgccgggaacgctggctggaaccgctgctcgggcacagctggatccgcggcctggacgcggtcgacatgctgaacatcctgcgcccgacggtggcggtgtcgtggttcgtggcgttcgccgggcacgcgctgcaccggtggccccggcaggccgagccgctgcgggacggcaacaccgcgtacgccatcgcgttcgcgcacgaggtccggcggttctacccgttcgcgccgttcgtcggcggccgggcggtgcgcgacctgtcctggggcgggcacgacatcccggccgggtcgatggtgctgctcgacatctacggacagaaccacgacgcggacctgttcccggagccttaccggttcaacccggcccgcttcctgggcatctcgccccaggctgacgagctgatcccgcagggcggcggcgacgcggcgaccaatcaccggtgcccgggagaggacgtggtggtgatgctgctcgccgacctggcgacccgactggctcggtgcgactactccgtaccggagcaggatctgaccatcccactgacccgcatcccggcccggccgtgcagcggcgtggtgctggtcccggccgccgcggaggtattcacccccgctggatga

SEQ ID NO: 7175 - DNA, 1167 bp, Actinoplanes utahensis
atgaccaccagcgccctggcccgcgccgtcgggatcggcgaggcggagttcgccgacacgtactggggaaagcagcccctgctctcccgcggccgtgccggcttcaccgatctgctgtccgtaccggcggtcgacgagctgctcagccgccgtggtctgcgcaccccgttcctgcgggtggcgcagcacggcaaggtgctgccggccggccggtacaccggtggcggcggggccggggccgaggtcggcgaccaggtgcatgacgaacgcgtgatgcgcctgttcgccggcggcgccaccctggtgctgcagggactgcaccggctgtggccgcccctgatcgagttcaccgggcggctgggcgccgagttgaaccggccgctgcaggtcaacgcgtacctgacgccgccgggcagccaggggttcgccacccactacgacacgcacgacgtgttcgtgctgcagtgcgagggccgcaaacggtggatcatccatccgccggtgctcagcgacccgatcgagaatcagccgtggggcggacacgccgacgaggtggcggcgaccgcggagggcacgccggcgatcgacaccgtgctcgaacccggggacgccctgtacctgccgcgcggctggctgcactccgcccgtaccgagcaggtgcgctccctgcatctgaccgtcggcatccgcagtctgacccggtatgcgctggtcgaggaactgctggcgatggcggtgcaggagccgcggctgcgcgccaccgtggcgtaccgccgcaatccggaatccgagctgaccgcgacgatcgaagcgctccgggagtggctgcccaccgtcgatccggcggcggtggccgcccggatgcgcgagcggaccgggccggccacccgcccggcgccgctgagcccgctggcccagctcgacttcgccgagcggctcaccgacaccgacgaggtcaccgcccgtccgggcctgagcgtcgacgtcgacggcggcaccgtgcgggccgccggctacacggtgaccttccccgggtactgcgagccggccctgcgcctggtcctcgacggcaaaccgcacaccgccggcgacctgccgctcgaccgcgacgacagcctggtcctgatccgccgcctgctgcgcgagggcctgctcacccccgcctga

SEQ ID NO: 7176 - DNA, 360 bp, Actinoplanes utahensis
gtggaccggccaggcgtgagcaacctcggagagtgggacgacctcgccgccctcgacccggccggcgccggcgaccaaccggccaccgggccgacgccgggactggacggggcgatcgccgcagcgttgcgctcgctcgacctgggcgccgcggtacaggctgcacaaaaagcgattcagcagcggatcgaccggatcgtcgccaaggtggtcacgcaggtcgtcgaccaggacgtcgacgccctcgcccggctgcgcaccagcgccgaggaatcggtcgccgcggcgctgaccacggccgccgacacgccgagcctgtactacccgagccttcgccgaagtgggcggtttggctcctga

SEQ ID NO: 7177 - DNA, 579 bp, Actinoplanes utahensis
atgctttactgctacgcccttcgaatccgacagccggtcgtcagtccttcgggggcagttgccacgttcccgctggtatatgcgggagtgggtgccgaggtcgagccgtttcaggccctgcaggccagcctgagccagtacttcgacggcgacttcgacgcggctctggccgaagatgagtcggccgcactggccgacgccgaccggatcatcgccgaacacgtccgcaccgcccaggttcggctggcccgggccgccccggccctcgactggtccgaccacaccaccctgaccgaagcgctgccggcgatcgcccgccgcgccgccgacctacggttcgtgcagatcctcggcacgcccgcccccaccgtcacgatcaccgtggaccaccaaccggccgaaacgatcccgcgggccgccgcccggcacgacctcgacgtcaacaccctcacgtccgcggtacgtcgtgcgaatctgagccccgccacccggctcgacgcccgtacaccgctgtaccggaccgacgggatcgaccgactgctccgcagccgcaggccgcgccagaatccagcgccataa

SEQ ID NO: 7178 - DNA, 1017 bp, Actinoplanes utahensis
atgccaccctccggcttgcgtatcagtggcaggaacgccatcactgatagcgtttgcgtcatgaaggtggcggtcctggtctacgacggcgtcttcgattccggcctcgcggccatcctcgacatcctcgacggcgccaacgcgatgggtcacgagatcggcggggcaccaacgtgggacgtgcgcaccgtgggtgttcggccgcagatccgcaccggcgccggtcacctcgtcgtcaccgagtcactcgcccgggccgaggaagccgatctgctgatcgtgcccgcgctggccgagcgccggccggagatgctgctcgcccacgtgggcggcgccgcctcccggccggtgcgggaccagatcgcccgctcccgggagcgcggcaccccggtcgcctccgcctgcaccggcacgttcctgctggcggaagcgggcatcctgcacggccggcgggccaccaccagctggtggctggcaccggtcttccgcgcccggtacccgcacgtcgaggtggaccagagccggatggtgatcgcctcggacggggtcaccactgcgggcgcggccttcgggcacgtcgatctggcgctggccgtcgtccgggccggcagtccggccctggccgacctggtcgcccgctacctcgtggtggatgagcggccgtcgcagtccgcgtacaccatctcgagcgccctggcgcagagcgatcccaccgtcgcggccttcgaacgctgggcccgcgggcgtctggccgacccgatcaccatcgccgatgccgccaaggccatcggcgtcagcaaccggacgctgcagcgctgcgttcagcgcaccttgggcacgtcaccgatccggttcatccaggacctgcgggtcgagagagcctcgcacctgctgcggacgaccgagctctcgctggagagcatcgctcacaaggttggctacgagcacccgaacacgctgcgcgtgctgctgcgggaaaggaccggcaagaccaccacggcgctgcgcggatcctga

SEQ ID NO: 7179 - DNA, 1041 bp, Actinoplanes utahensis
gtgaagcgcagaaatgtactggccgcggcggtcgtggcgatgacgtcggtgccgttgacggcaacgcgggccatggcggcgcagacgcaggtggaaacaccggcggaggcggagaacacgttcgtgcgctggctgtccacgcaggacccgcgggccatgatccgcagccgggcccgcgcggcgatcctgtccaccccggccgagaggaccacgttcctggccgagacctacacccgggtgctgccggacatcgcgctgacgcgcgcgcgccagacggactacgcgacccggatggtccgcacccacccggcgatctactacccctgggtgaacgcgaccggcttgcgggcgctggacggcgccgaggccaggatccgcgagttctccagcaccgactacaccgcggccctcaccaaggatcgcgacaaggtgccgttcgacaccggggcggccggcgtggtcgcggaggaccgggcattcgtggccgagctggccgtcagcggcctgagcccggtggcacgcgaacgcgcggctcgtgccgtgacggccggcaccgacgccgacatcgcggagttcctgctgtaccgctgggccatctccgcggaggtggacatcgagctgttccgcaccgattacgtcgccgccgagttcggctggtggacggatgtccgcaaggcggtggtcgcggcggagagcgccgagcagctggcgcgggacgcggtcggggacgccgcggaaccggcccgcgccgcggcggtgcgagcctgggaagcggtcggtgcgcaggcagccacggcgctggccggctgggccgcccaccagaggttcacgcaggtccagatcgacgactggcagcgcaccgcgacgaccgccgccgcttccaccagcccgacctggcgcctgctcaaggtcgacgccccggctgtgcgcaagctctggctcgccgagcaggcgaacgccgcggcgcgcacggcgtggtggaccgcggtgaacgagaacgcgcgcgctcgcgtggcggccctgaccaccccggccgtctga

SEQ ID NO: 7180 - DNA, 672 bp, Actinoplanes utahensis
atgacctcggtcttccagcacgccctcggtgacgacttcggccgcctgcacccccggctgcagcggcgtttcggcgtcgacggcgagcgcgaccagggctgcgtcggtaccggcgtgatggagcgggtctggcggggcggggcgtacaccgcaccgttcctgcacctcggcacgctgcggcacatcctgtttccggagaccggtgccggcatcccgttcaccatcgagaactacgcctaccgcgacacctacggccggcccaccctcaccttcgtccggacttttcaggtacgcccgcaccggcgccgccgcttcgacgccacgatggtctaccaccccggccgcgacgtgatcgtcgactatctgggcaccacccagcacctcgccgtcgacctggacgtgtccgtcgacgccaccggtgccctgcacctgcgcagcggtccgcagctgttccgcggcggcgtcggctgtccccgcttcctgaccggcgacgccgaggtgcacgagtggtgggacgagcgggcggagcggttccacatccgggtgaaggtcacgaaccggcacttcggcccgctgttcggctaccacggcaccttcaccaccgcctacgtcccgtccggcgccccggttccggccgccgtccgcccgctgcgcgaggcctgcccgcgctga

SEQ ID NO: 7181 - DNA, 657 bp, Actinoplanes utahensis
gtggcaaggatctacgtcgagacgaccatcgccgcgtcgatggatcgcgtctggctggcgacgcaggatcaccggcagcacccccggtgggacgcacgcttcggccggatcgatccagtgcccggcagcacgccagccgcgttcacctacgccaccgccgtgctacccggcgtcgagatcgcggggtacggcgtgcacagcggcgagcggcagcaggcgggcggggcggtgtccgcactgcggttcggctccgccgaccggcggtcgccgatccaggagggctccggctattggcgctacgtcccggttcccggcggggtgcgcttcctgaccgggtacacgtaccgcacccgctggggccgcgccggccggctcgtcgatctggtcttcgggccgacgttcggctgggcgaccgcatggtcgttcgaccggctccggctctggcttgagcacggcatcaccccggagcgggcccgcctgtacaccgcgctcgagctggtgctgcgcgccgctctggtggccaccgccggcctgctcgacgggcgcccggccgtcgtcctggtggcggccctgctggcgatcggcctgcccccacacccccacacgcccgcggcacgccggtgccggcggcgcccagaacaggagaacccgcgatga

SEQ ID NO: 7182 - DNA, 864 bp, Actinoplanes utahensis
gtgatcctgcgtcgccagccagacgcgatccatcgacgcggcgatggtcgtctcgacgtagatccttgccacgacacctccctggagtttgagcgaccgctcaaacctagcagttttgagcgaatgctcaatggtggtcgacgttggcttgccggacgcagggcgatgtggccgccgcgcgtccaggacgatcgccgccccctctccatccgctcccggtcacggaacccgtttcgggactcctgttcctccgtgccaggcccaggccgtgatcctgcgcttccacttccccgacggagacgtcacaccccgatcccggcccgagaccgcagccttgatcgaccgcgccttcgccgagcaacgctgctggatccccggcctcggtgccggcgacgagatctcgctcagctggctcgacccggacgacgcaccgtcgcacccggacccaaacccggaccggcaaccggacaccctgctcatccgggcgcgaccgtccggaagtaccgggactcgacaccccgatgggacgtcccggactgggcactgctctccggatcccggaccgtcgccggcctggccctgatcgccgccggcgaggacgacaccgagttcgcctatgccagcagcaacttctggagcaacctccatcacagcctgtgcagggcgaatcccaccccggactggccgctgctcacccggttccgccgcctggaggacaccgcccgccaccgcgaactgacccgcctgcacaccgagccggatgccaccgaggtcgtccgctcggaactggccgcctggtccccgcacgagccggtcctgcgggccgtcgccacggcgatcgtcgacgccgtcacccgccggtga

SEQ ID NO: 7183 - DNA, 864 bp, Actinoplanes utahensis
atgtcgaagaagaagcagcatgccgtcctggccggcgtcggcgtcgcggtgtcggctctgaccggcgtggccaccaatgtgctgaccggcggcaaggcgtcgtggacgctcggcgcggtcgtggtcatgctggtggtcgccggagtggtgctggcggtgctgaactcccggctggaacatcggatggccgaggagccaccggcccgccccgaccacagcggacccgcaccggcggcggccgagcctcgccgacagccagcgggtggagtgtcggtgacctccgcgggcgacgactcgataacggtgggcgggaactaccagaacagcggcatgccggcgggatacgtggtgctgagcctggtcgtcgtcgccgcggtggcgatcgggatcctggtggtcgcgctgcgcttcgcccggccgtcgacagcggggccgtcgtcggtgaacaccacgaccggcacgaccacgccggtcgtcacggcggcgccggcacccgaggatctgcactacgacgtcgccgccacccgcaaccgcgcccgcgaagtcaggatcaaggcgatggcgtacgggcagcccgagccggggctgacgtactggttcttcgtcgacgtcgactacggcaacaactacgtcgaatactatccgcgccgccaactgaccggccggacgacgtcgttcgacgtagtgctggtcgaggacgcggacctgaaatattcgcgcaccggccgcatctacggtctcaccggcgcggtgagcgacgaggcggcagtcaagctgaagcggcaggaaaccacgcggaagaacgacttcttcacggagccgcccggtcagccggcgtcggacgcggtgacactgccgttctga

SEQ ID NO: 7184 - DNA, 624 bp, Actinoplanes utahensis
atgacgacacccatcgagatcaccgtgctgggcgcctccggcgcgaccgggcgggaactgacccgccaggccctggaccgcgggcaccgcgtggtggcgatcgcccgcaccccgcaccgcatcgtcgccccggactcgccgcgactgctgcgggtcgccgccgacgtcggccgtcccgaccagatcgccgaggcgctgcgcgaccgtccgatcgtggtctcggccctcggcgtggccaagggtgaccggcccggcgcgctgaccgcgggggcgcgcgccgtggcggcagccggcccggaccgggtggtctggctgggagccttcggcaccgggggctccgcggcggtggccgggccgctcacccgcaccctgctgcggatgctcggtgacctcgacgacaaggtcaccgcggagcggatcatcctggccgcgggcgggaccctcctccacgccggaccgctgtccgacgggccactcagcccggaccgctggacggccggactggacgaggtgccccggcggctgttcccggcgcggatcagccgggccaccgtggccgccgccctgctcgacgaggcggagaagccggcccccgggcccgggatcgccgttccgctcgggtga

SEQ ID NO: 7185 - DNA, 783 bp, Actinoplanes utahensis
atgacttccgaccagcaacttctggcggcggcgacagccgccgtgcgggccgccgcggcccgcgtgtcccgccccgaacgcacgccggtgaccgaggcggacctggtcgccgcgctccgcgccaacgacgacgccgtcaccgcaaccctgcggccggcgttgctcgccgcgctgcccggcgcacagtggaccgccgacgagcacggctccgggccgatgcccggcggcgactggtgggtcgtcgacccggtcggcggcaacatgaacgcggtccagggcatgcccgactggaacatcggcgtcagcctggtccgcgacggccgcccggtgctcgccgtcctgcacgcgccggtggcgggagagacgttcaccgcgatcgccggcggcggcgcgtggctcggcggtgaaccggtgcgggtgtccgggaaaaccgatctcgggctcgccctcaccggcaccgggcaggcgaaacccggccgggacgcggccgccgccgaccgcgccggggcggcggtcgccgcgatgatgcggcacgccctgtacgtgcgcgcctcggtgccggtcggccaccagctcacccaggtcgccgccggacggatggacgtgcactggcagttcgacaacctgcgctcgcatatcgcgccggtgctgatcgtccgggaggccggcggcgtcgtcaccgacctcgatggcgaaccctggcagatcaccagcgacagctacctcgccgcggcgcccggcgtgcatgccgccgccctcgacgtcctgcggccgctgcgatga

SEQ ID NO: 7186 - DNA, 918 bp, Actinoplanes utahensis
gtgcaattggacctgaatctgctgaccgtgctggacgcgctgctggaggagggcagcgtgaccggcgccgcgcagcggctgcgcctgtcctcccccgcggtcagccgtagcctgggccggctccgccggctcaccggcgacgacatcctggtccgcaccggccgcaccatgaccccgaccccctacgcgaccgccgtccgccagcgggtcgccgagctgctgcggcagagccgggaggtgctcaccccgcgcggcgcgctggatccctcgaccctggaccgcgtcttcaccctgcagtgccacgacgccctggccaccgccgtcgctccggtgctgctcgccgacatcgccgagcgtgcgcccggggtccgcatccggttcctggccgagagcgcgctggacaccgacgagttgcggcacggccgggtcgacctggagatcggcgcgacactcccggccacccccgggatccgccacgagaccgtgggtcacgaccgtttcgtcgcggtcctgcgccacggccacccgcacgcgaagcacctcgacctggcggcgtacgcggcgctgccgcacatcctgatctcccgtcgcggccgcctcaccgacccggtcgacaccgtcctggagacgcacgccctgcagcgccgcgtcctggcgtcggtcggcaccaccgccgcggccgcccacgtcatcgcgcacggcgacgcggtgctgaccgccgcggagctcacctggcgcccactcctgcgggcgttcgagctggtcggcgttccactgccgttctccttgccggctccgccggtcatctgttgctggcatcagcgctacgacaccgacccggcccacagctggctgcgcgaccgggtcagcgccgccttcagcaccgtcctcgccgacgatcaggcacccctcgggtga

SEQ ID NO: 7187 - DNA, 306 bp, Actinoplanes utahensis
atgcgacgttcgcggccggcgtaccgcgcgggtgtctggctgtaccggctcgcgtttgtcgtcgccgccgtgtacgtgctcgcgatggcaacgcatgctctacctgtgctcagcggcccctcgctggccttcttcccgatcctctacctggcctgcctggtagccggccagtacctgttcgcccaggtcggtatgcggatcttcgcgcttgccctggtgcgcacggacgggccggtcggaaactcggatgaggtccgggcccatcgccggaccgtctttcgggatgtgttcggacgcggtcgctga

SEQ ID NO: 7188 - DNA, 1500 bp, Actinoplanes utahensis
atgccgacgttccgggattctgtactgcgcaccaaaccggtcgaggacgtcctcgcccaggcttccgcggaggccggcgacgacggcccgcgactgcggcggcggctcgggccgctcgacctgatgggcttcggcatcggcatcgtgatcggcaccgggatcttcacgctgaccgggatcgaggcgcgcgaccacgccggcccggcggtcaccgtcgcgttcgccctggccggggtggccagcctgctcgccgcgctctgctacgccgaactgtcgtccagcgtgccgaccgccggcagcgcgtacacctacgcctacgcgacactcggcgagatcttcgcctggatcatcggctgggacctggtcctcgaattcgccctcggcgccgcggtggtcgcccgcggctggtccggctatctcgcccagttgttccatctgcccggcgcgatcttcggtgagagcagcacggtcaacgtcggcgccatcctgatcaccctgctgctcggggcggtcgccacggtcggcatccggcagtcgtcccgggtcaccaacgtgctggtcgccgtgaagatcgcgatctgcgtgttcgtggtggtggccggcgccttctacgtcaagggcgccaacctcacgccgttcgtgccggccgcggaacacccggccggcggcgaatcggggctggcccggccgctgacccagctgctgttcggggtggcgccgtccacctacgggatggccggggtgctcaccgccgcggcggtcgtgttcttcgcgtacaccggcttcgaagccgtcgccaatctcggcgaggagacccgccggccgcgccgcgacctgcccctcggcctgttcggcacactcgggatctccgcactgctgtacgtcgcggtgtcgttcgtgctggtcgggatggtcgactaccgcagcatcgacccgggcgcgccgatcgcctcggccttcgccgccgtcggcgccggctgggccgccgacctggtgtcgatcgccgcggtcgccgggctgaccagcgtgatcctggtcgacatcgtggcgatcgggcggatcggcttcgcgatgtcccgggacgggctgctgcccgcggcggtcggctcggtgcacccgcggtggggcacgccgtaccggacgaccatcgtggtcaccgtcgcggtggcggcggtggccggcttcgtgccgctgtcctccctggcgaacctggtcagcatcggcaccctgttcgccttcgtcgtggtctcggtcgcggtgccgatcctgcgccacacccgcccgcagctcaaccgtggcttccgggttccgctgtccccgatcatcccggccctgtcggcgctcgcctgcctctacctgatgaccaacctgtccggcgagacctgggtgcgcttcctggtgtggatggcggtggggctggtggtctatctgacctatggccggcggcacaaccgtctttcggcagaggcccggggtgcacggaccggctaccgtccttga

SEQ ID NO: 7189 - DNA, 450 bp, Actinoplanes utahensis
atgattcttgtcgtggaacccagcccggtggccctggccatccgagacatgttgcaggccaatggcgaggcgacgcacagcctcgcggcccggctcggcatcggcgtgaccgacgcggtggcgctcgatcacctcatcgccagcggcgacgggctcggccccaccgaactcggccagcgtctcggcatccgctccgcgtccgccaccaccctggtcgaccggctccaagccgccggccatgccgaacgggtgccacacccctccgaccggcgccggcagagcgtggtggtcacggatcagacgtaccggcaggtcctggaagcccttgcgccgttgttcgaccgcgttgagcaggcggccgcccagctcaccgacgaccaggcggcggccacggcggccttcctgcaccaggtcgcggcggcgatgcgggagtacgcggcgggccgctga

SEQ ID NO: 7190 - DNA, 1590 bp, Actinoplanes utahensis
atgaccgcagagatatccccccggcgccgctggctcggcctgctggtggtcagcttcggcgtggcgatgatcatcgtggacgccacgatcgtgaacgtcgcggttccctcgatcatcgacgacctcggcgccacctccagcgacgctcagtgggtccaggagtcgtacaccgtcgtgctggccgcgctgctgctggtcgccggccggaccgcggaccgggtcggccgccgccggctgttcatgaccggcatcggcgtgttcatgctgggcagcatcggctgtgccctggccccggcacccccgctgctgatcgtcgcgcgccaggtgcagggcgtcggcggcgcgatgatcctgcccacctcgctgtcgctgctgaacgccggcttcaccggccgcgagcggggcatcgcgttcgccgtgtggggttccacgatcggcggcgccgcggcactcggtccgctgctcggcggctggctcaccaccgcggtctcctggcgctgggcgttcggcatcaacctcccgctcagcgtgctgattctgatcgccgcgccgatgctgctggccgagtcccgggagtccggcgaccggcggggcaacgaccgggccggcgcggtgctctcctcgctgtccctcggctgcctggtcttcgccctgatcgagggccgcagcttcggctggttcgagcgcaccggcccggtcagcgtggcgggtgtctcctggacactgcggctgtccccggtgccgatcgctttcggactcgccgccgccggcctggtcaccttcctctggctggaacaccgccgcaacgcggccggccgcccggtcctgctcgacctgcggctgttcgcgatcccgtcgttccgcaacggcaacctggtcgccgccgtggtcagcctcggcgagttcggactgctcttcgccctgccgctgtggctgcagaacgtgcgcggctacagcgcgttccagaccgggctggccctgctgccgctggccgcgggcagcttcgtggccagcgggctggccatcccgctcgccgcgaaacggggcgcgatcttcctcgtccggctgggcatcgtgctggaaatcgccggcgtagccggcatcggactcgtcgcggctccggacacggcctggtggcaggtcaccccactgctcttcgggtacggggtgggcgtcggcctggccaccgcgcagatcaccggggtggtgctcgccgacgtgccggtcgcgatgagcggtcaggcgtccggcacgcagagcaccacccgccagctgggttccgcgctcggcatcgcagtgctgggcacgatcctgttcagcacgctcgccggtcacctgagctcggccctcgacgaccgcggggtgcccgcgcagcagcggtcggcggtggtggcggccgtcaaggacagcgcgggcgcggcgatccccggcctggcgggtgatccccggaccgcgccgctggccgcggacgcgaagcaggcactgtcgacggcgacccggtggaccgcgttcaccgccgccggcttcctgctgatcggcctgctggcctcggcccgcctgacccgcaccaccccgggcggtgaccggtga

SEQ ID NO: 7191 - DNA, 1020 bp, Actinoplanes utahensis
gtgatcgacgacttcctcagcgcgcaacgcgacgtgctggccgaggtcagcgacgactgcgcgccgctggaacgctacgtggccgacctgatgggcggcggcaaacgactccggccggcgttctgctactgggcgtggcgggcggccggcgcccccgacggcccgggcatcgtggcggccgcgacatccctggagttcctgcaggccgccgcgctgatccacgacgacatcatggacgattcggacacccgtcgcggcgccccggcggtgcaccgcagactggcggccctgcactccggcggccgctgggccggggacgccgaccacttcgggctgtccgccgccgtgctcgccggcgacctgtgcctgacctggagcgacgcgttgtattcgggcagcggcctgcacccgtccgcgctggcccggggccggccggtcttcgaccggatgcgcacccagctgatgggcggccagtatctggacctgctggaccaggcgcggccgtcccggggcggcgtcgaccgggcgcgccgggtggtgcacttcaagagcgccaagtacaccgtcgaacatccgctgctgctcggcgcccggctcgccggcgcggacgacgatctgctcgcccggttgtccgcgttcggtctgccgctgggcgaggcgttccagctgcgcgacgacctgctcggggtcttcggcgacgcggcgcagaccggcaaacccaccggcgacgacctgcgcgagggaaagcgcaccacgctggtcatcctggccgcggaccgcgccaccgcaccccagcaggccgccctcaccgcgctgctcggcgatcgcggcctgaccggggccggcgtcgacaccctccggcagatcatcgtggacaccggtgcccgggccgaggtcgagcggatgatcgagcaactgctggcgacgagtctcggcgtgctcagcggcacgcccgtcgacgaggcggcccgctcggtgctgctcgccctcgccgaggcggcgaccgcccgcagctcctga

SEQ ID NO: 7192 - DNA, 237 bp, Actinoplanes utahensis
atgccggcacgataccgcggcgtcgccgccgccgtggagctgagctcgctgctgattctcctgatcaatctggccaccgtgcacgcccggccggtcacgtcgctgggcggtccgatccacggttgcgcctacctgttcgtcatcgtcagcaccgcgaccgacgccagggcgagccgcaccgcgaagctgctggcctgggtcccgggcatcggcggcctgctcgcccggcgccggtga

SEQ ID NO: 7193 - DNA, 474 bp, Actinoplanes utahensis
gtgggcaatctcgccagttctgtccgggcggatccggccctaacgttcgcaggcgtgacaaaactcctgctcagcgtgcacgtcctggccgccctcgtggcgatcgggccggtcaccgtcgccgccagcatgttccccgccgccacccggcgcgccgatcgcggggcgctgccgctgctgcaccggatctgccggatgtacgcgctgctcgggctggccgtcccggtcttcggcctggccaccgcgtcccgcctcggggtcctcggcgacgcctggctgctgacctcgatcgggttgaccgcggccgccgggctgctgctggccctggtgatcctgcccgcgcagcgcgggatcgtcgccggcgcggcggtcccgccggcccggctcgggatgctgaccggtgtcttcaacctgatctgggcggcggtcgtggtgctgatggtcgtccgccccggctcgacgacggggacctga

SEQ ID NO: 7194 - DNA, 936 bp, Actinoplanes utahensis
gtggcggtcctcgccctggacaccgtgatcccgttcgacctcgccaccccgatcgaggtcttcggccggaccggccacggcgcgctgtacgaggtgcggatctgcgcgcccacctcgacggtcgacgccggcgccttcaccatcaacacccggtacggcctggacacgctgctggaagcggacacgatcatcatcccgggctgcgccgacaccgccatgatcgtcccgccggaggtcgtcgaccacctgcgcaaggcggccgccggcggcgcccggctcgcctcgatctgcgcgggcacgttcattctggccgcgaccggtctgctggacggcctccgcgccaccacccactggctggccaccggcgcgctcgccgcccgctacccggagatcaccgtcgacccggacgtcctctacgtcgacaacggccagtttctcacctcggccggcgccgccgccggactcgacctgtgtctgcatctaatcaggcgcgaccacggctccgcggtcgccgccgacgccgcccgcctgtccgtcatgccactggagcgggagggcgggcaggcgcagttcatcgtcccggcgcagccgcctgccccgcgcggctccgtcctcgaaccgctgctgcgctggatgcaggactgcaccgatgtcgaggtatccctcgccgacctggccacccgcgccggcatgagcgtccgctcgctgaaccggcacttccgcgaccagaccggcaccaccccgctgcagtggctgctgcgcgcccgcgtccgccaggcccagcacctgctggaggccaccgacctgccggtcgagcacatcgccggccgggtcggtttcggctccccgaccgccttccgtgaccgattcaagcgggtcaccggcgccagcccccagtcctaccgagccgcattccggacccgtccgcgcccgtag

SEQ ID NO: 7195 - DNA, 207 bp, Actinoplanes utahensis
atggcactcaacgagcaggaaatcatcagctctgacccggccgggcaggacggggaagggccggcggacggcggggcgaacccgctggggcgcgacggcggggccgacggcggcgcggaaaaggagaagccgcacggcgaagggctcgccgacggcggagcgaacccggccggccaggacggcggggcggacggcggcgccgaatag

SEQ ID NO: 7196 - DNA, 186 bp, Actinoplanes utahensis
gtgaccagcccgacgacggtgtgccgatcgatcagccggccgggcggaagcgggacggtctacacgcgtaccggcaactggttggtgaacgtgttggtggtcttcctgatcgtcgggattaagtcccttttttgggggtatgccccagcgtatggcactcaacgagcaggaaatcatcagctctga

SEQ ID NO: 7197 - DNA, 1848 bp, Actinoplanes utahensis
gtgacatgctggagcaggcgcccggagcggaccgtcccggccggtgcccgccggctccggtcggtggcctggcaggtgtggtgcgtggtggcggtggcactcatcgccgcccacttcatcgtgccggccacgcatcccgtcgcgcagtcggtgctgtattgcgcggtgagcgccggcacggccgtcgctctggccgccggcatccggctgcaccggccgcgcaacgccgtcgtgtggtggctgctcgccatcggccaggcgatgtacgtcgccggggacatcgcctatttcacggccaccgccgccgccgggacgaacggctatccccttttcgccaacgccctctatctctcgcagtacgggttcgccggcgcggcgctggtgctgctcggccggcggcgctcaccgcagcggaacacggccgcgatgatcgacacggcgatcctcacggtggccgcggcggtgctctggtgggtgttcctcatccatcccgccgtcgccgtgccgggttcgtccccgctggatgctctgggcgccaccatctatccggtggccgacctgtgcgtgctcaccgtggcgatccggctcctgctcggcggtggcacccggcagcggtcctacctgctgctgctgatcaacctcgggctgacgctgctggccgacaccgcgtacggcctgctgtcgctgcacgaggtgtacgtgaacggtggctggtcggacgccgtgtacctggccgcctacgtcgcgctgggcgcgtccgccctgcatccgtcgatgcggcacatcgccgagccggtggagacccggtcgggggcgaccctgaaccgcgtggcgctgctcgcgctcgccaccctgatggctccggcggtcctgctggtgcaggatctgcgacactccacgagttcggacctcgtcgtggtgaccgcgtcggcggtgctgttcctgctggtcctcacgcgcatggcggctctcgtctcggcacagcgccggatcgcgatgaccgacggtctcacgggtgtgcacacccgccgcttcctgtccgaggcgttgagcgccgagggcgatcgggccgcccggcgcggcaccccgatcgcgatgctgctcctggacgtggatcacttcaagcgcatcaacgacacgtacggtcatccggccggcgaccaggtcctcgtggagctggcccgccggctgcgccgggcctgccgcggcaccgacgtcgtcgcacggttcggcggcgaggagttcgcggtgctggtgaccagggatcacgccgacctggccacgctcgcggagcggctgcgcgagcggatcgccgaggtgccggtggtggtcaacggccgcacggcgatcccggtcaccgtctccgtcggcgccgccgcgctgcccggcggggccggcaccgaagaactgctcagcgccgcggacgccgcgctgtacgcggccaagcgcggcgggcgcaaccgggtcgtcgtgggcgggaccgggcacgccgtcgccacgggggacgccgtgctcccggaccccgccggcgcacccggtcccgacgagcagatccggcgatggacggccacggtggccgaggccgcccgctgccgcgccgccgacccggtggtgccgaccagcctgctgatcggggtttgcgcggcgtgggcggtgatgcgacgcccgggcgccgggcgggccggactctccgccgagcaggcccgcgaccagctgcgtcgttgccgcggggtgcagttcgacccggacgcggtcgacctcttcctcgaactggagacggccggactcgtcggtgtgccggacccggcgaccaccggcgcggcgcacgaagagtacgcggtgagctga

SEQ ID NO: 7198 - DNA, 216 bp, Actinoplanes utahensis
gtggtggtgccggacttcgaccgcttctgccgcacccgcggcgcggacggtgccgcgctcgacggcggcacggtctacgactggcactgcgtcaccggcggcacccgctcggccatcgacgtgctggccgcctgccgggagacgacgttcggctacgccaccgtcgaccgcttcgccgacttcttcgacgcgcgctcctggcagtgccgggtctga

SEQ ID NO: 7199 - DNA, 123 bp, Actinoplanes utahensis
atgcgcaccctggtacgccttctgctcaccctgctgaccggtgccgtcaccgccctggccggcaccgccgcccccgccgcggcctccccgccccgccgcgggacctgggcgcgccgaacctga

SEQ ID NO: 7200 - DNA, 798 bp, Actinoplanes utahensis
atgcctcgcaccatcgccgtcatcatcctggcgagcgcggcgaccctggccgcgctggccggcccggcccaggcctcgaccgccgtgccctcgaccgccgtgccctcgaccgccgcgcccgtgattcacttcgcggctgacggcaccgaccgggtcgacggcgccatcgaggccggccggcccgtgatcgtcgactacgacctgtcccggctgccggaatgccgcaaccagtacgccggcggcgacgcctggagcatcggcgtctactaccgcgtcgacggcggcccgatccagacccggccggtcacccggctcgaccagaaccggcacaacgtcaccgccccggccggcatcgacctgccgcccggcgggcacgacctggaactgtggttccacgccggcgaccgtgccgggtgcagcgaatacgactcccgatccggcgccaactaccactacccgatcgggcagccggccgtcgtcaccttccgcgccgactggtccgagacggtcaccggcagcatcgaggcgggccaccggctggccctgcgctacgacaccgcccgccttccggagtgtcgcgaccaggcctggcgcatcgacgtcttccgccgcttcgacggcgggccggcccagtcggagaccctgaccaccggcgacggttcccaggtgccgggaagcatcgacatccccgccggcagccaccaggtcgagatctggttccaggtcaccgcggatcagggcggctgcaccgcctacgactccgacttcggcgccaactacgtgtacgccgtcgcctga

SEQ ID NO: 7201 - DNA, 936 bp, Actinoplanes utahensis
atgcgcactgtcgtgcgtgcgggcgctgtcgcgctcgcggccggaaccctgctgctgggcaacgccgtcaccgctcaggcggcgacgaccgggaaggtgaccgtcaaggtcgaccggctgatcctggagcccggccggtacgggcacaccggcacgatcaggatcgtcatcaagaacggcacggaccagccggtcagcggcggcaatctgaccatcaccgagccgctcccggcctcgttcaccaccttcgacggggccggtggctgcaccctggacgtcggcccggacggccgcgagaccgactactgcggcctggagcagaccatccagcccggtcagagcgggaccgtcacgatcggcttcacgtcgcccgccaagccgcagaagtacgcgcagatcgccccgaacgtcggcaccgtcgagtacgccggcagcaaggtcaggtacggcgcggtgttccggtccaccaccggcagcctgagccgtccgcgcgtctaccaccaggacaccgagtcgaagctgacggtgaccgcggacgccggcgtgaccctgaccaagcaggaggacggcaccttcgccggacacctgccgatcaccgtccacagcgacggcgacgccccgcacaagtggctgcacgcggacatcatcaccccggcgggcgtgagcccgtggccgatgctcgacccgagcggcccgtgcgtcggatccagcgacgacctgccgatcccggccggcggcgccggcgagggctgcgacctgttcggcgtgcggatcgccgagggcgagacgcagacctacgacctgcgggtgcgggccccggagggcacggcggccgggtccctcggcaccgtcaccacccgggtccagctgggtgcgggtccggcccagaccgacggtgccaacctggtcgccttcgcggtcaacgtggccggctga

SEQ ID NO: 7202 - DNA, 852 bp, Actinoplanes utahensis
ttgcagactcccggcatgacgatcgtggtgttcggggcccgcggacgggtgggccggcaggtggtcgccgggttgcgggcggcgggggagcgggtgcgggcgacgggtcgggaggcgcccgccggggccttcggccccgaggtcgagacggtggcggcggatctggaccgtccggagactctcgggccggcgctggccgatgccggggcggcattcgcgtacgctcatccggccggcgccgagggcttcgccgccgccgcgcgatccgccggggtgcgccgtgtcgtgctgctctccagcgccgccgtgaccaggccggacgccgcccagaacccgatcgcgcgccggcaccgcgcggtcgaggaggtgctggagcgctccggcctggagtggacgttcgtgcgcggcgggatgttcgcggtcaacgcgatcggcctgtggggcccgtccatccgggagcagggccgggtccggctcccgtacgcggaggcacagtccgccccggtccacgaggccgacctggcagcggtcgcggtcgccgcgctcaccgcggacgggcacgccgccatggcgtacaccgtccatggtccggaatcgctgaccctgcgccggcaggtcggcgcgatcgccgcggcggtgggccgcccggtggctgtcgaggaggtcgacgaggaggtcgcccgcgccgacatgctgcgtggtggcctgccggagttcgccgtcaccgcgatcctgcgcaactggtcgacgggggcggccgcggagacgtccaccgtggtgccgcaggtgaccgggcggccggcccgcaccttcgccgagtgggccgtcgaccacgccgccgacttccgatga

SEQ ID NO: 7203 - DNA, 816 bp, Actinoplanes utahensis
atggcagacgacggggacctgtccgcacggatcgacaccacggtgccgcacccggcccgacggtacaactactggctgggcggcaaggacaacttcgccgtcgaccgggcgtccggcgacgagatcgaggcgaaattccccggcatgcgcgccggtgtcgtggcgaaccgggacgtgctcggccggatcacccgccacctggcccaggacgccgggatcggccagttcctggatatcgggaccgggctgcccaccgccgacaacacgcacgaggtggcgcagcggcacgccccgcacagccgggtgctctacgtcgacaacgatccgatggtgctcacccacgcggccgcgctgctgaccagcgacccgcgcgggcacacccggtatctggaggccgacctgcgcgacccggagaagatcctggccagcccggagctggcggccaccctggacctgtcccggccggtcgcgctgatgctgatcgcgatcctgcacttcctgcccgaccgtgcgcaggcccgggcgatcgtgcggcagttgatggacgcgctgccctccggcagctacctggccgtcacccacttcaccaccgacttcctcggcgagcagcagcgggccacctaccgggcgatgctcgacagcggccgcagcgacgcctggccgtgcacccgggacgagttcgccgggctgttcgacggtctcgacctggtcgagccgggtatcgcggtggccagcgagtggcggccggcccccggtgcgggggccgtcgacccgtcgctggtcagcatctgggccggggtcggccgcaaaccgtga

SEQ ID NO: 7204 - DNA, 462 bp, Actinoplanes utahensis
atggtgcggggttgcccacccgctctatgctcacgccccgtgagcgaccttctcaaggagcacgtccagagcgtgctcgaagccaacttcgcctcggtcaaccagacccggcgccgcatcgaggacctcgaagcgcagggccaccggatcatcaccggcggtcagatcggcgaggacggctgggacatcatcgactggcggaccagcgagatcctcgccgccggcgacggcggcctgccggagtacgaggcggccgccgcggacctcgacccggacgacaagttcatccaccatgaccggatcctcgaggacgaggacctggagtacgtgtcgacgccgggcctgcccgacgggctggcgaacgcggtcgaggactgggtgctgaccgcggacgccgacgaggtcgcggaattcatcggctggccggtcgagaaggtcgaggaataccaggcagaggactga

SEQ ID NO: 7205 - DNA, 636 bp, Actinoplanes utahensis
gtgccgagtaccaaaccgctgcgcgaggggtccgcgacgaaacgggccgcgatcctgtccgccgcccgcgagctgttcctcagcgacggattcgaccgcaccagcgtggacgcggtcagcgcccgcgccggggtgtcgaaacggaccgtctacgactacttcggtgacaagaacacgctgctgcaggcggtggtcggggacatctccgactcgctggtggcggcggtgcgccggaccatcgacgccaccctgaccgggctgaccgagccggcccagctgcaggacgcgctgaccggtttctcgatgcggatcgccaccgacatgctcggctcggccgactatgcgacgctgctgaagctgctgggcggggaggggcacctgagcgaggcgccgttccgggacgcacccgaggaggcgctcgccgagcggttggcggtgctcggcgaggccgggctgctgaccgttgccgatccgcggctggccgccgaccacctgatcgcgctcacgttcggggtggtgctcaaccggcacgggtcgacgctgatcaccgctgacgagcgggtgcgatcgctggtggccgagggggtgcgggcgttcctgcgcgcctacgccggcacgcgcgcgacggcgccgtag

SEQ ID NO: 7206 - DNA, 1146 bp, Actinoplanes utahensis
atgaaggcactcgtctccggcgccggcatcgccggccccaccctcgcctactggctgcgccgccacggctgggacgtcaccgtcgtcgagaaggcaccggccgtccgcggcggcggctatcccatcgacgtccgcggtaccgccctcgacgtgctcgatcggatgggcgtcctgccccgggcccgcgccgcgcacatcgacacccggcagctcaccttcctcagcccggacggccgggtcgccggccgactgcgcccgcgcaacctcagcggcgacggtctcgaactgccccgcggcgtcctcaccacgatcctgtgcgacctggtccgccacgacgcccggttccgcttcggcgactcgatggccgcgatcgacggccgccgggtcaccttcgccagcggcgcgcaggaggagttcgacgtcatcctcggcgccgacggcctgcactcggccacccgccggctcgtcttcggcccggaggagtcgttcagccgtcacctcggttacgtcttcgccggcttcaccctccccaacgacctcggcctgcgccacgagggccaggtctggtcggcgcccggccggatggccaccctctacgctccgggttgctcggacaccgtccacggcctactgatgacccgcagccccgaaccaccgcgcgacggcctgaggttgctcgagtcggccttcgccggcgacggctggctggtcccccggctcctcgacggcctgcgcaccgccggcgacgtcttcctcgacgtggtcagccagatccacatgcccacctggtcacatggccgggtggcgctggtcggcgacgccgcgcacgccccgtccttcttctccggccagggcaccagcatcgccctggtcggcgcctacgtcctggccgaggaactggccacacacgccgatcccaccgcggcgttcgccgcctacgagcagaagacccgcgattttgtacgacgtaaccaggcgctcgccgatggcggtggcggcacgctcgccccggactcggcacgcgccctgtggttccgcaaccacgtgctgctcaaggccgctccgttgctcggcgccaccggcctgttgggccgcagcgtccggcacgcggcgaccgccctgcgcctgccggccccggtccactga

SEQ ID NO: 7207 - DNA, 732 bp, Actinoplanes utahensis
atggcactcatcgcatacgacaacgagcaagcggcggccttcgaggagacccggcatctgcaagacgatgacctcgcgacctggcgtgccgcgatcggccggcacttcgagccccgctccggggcgcgcctgctcgacctcggatgcggcaccggcagttgggcccgggcgttccggacctggtggcccggcgtcgaagtgctggcggtcgagccgtcggcggcgatgcgggagcgggcgatgttccagcccgtcgcggccggcgcggccgacgacatcccgcttccggacgccagcctcgacggggtctggctctccaccgtgatccaccacgtccccgacctggaggccgccgcccgcgagatccggcgggtgctgaagccgggcgcaccggtgctgatccgctccgcgttcgccggccggcacgaagcgatcaacctgttccgctggttcccggaggccgtcgccgtgctggaccgctacccgagcatccccggcgtcgaggcggcgttcgccaccgccggcttcgcgacgaccggctgcgaaccggtcccgcaggtgaccgccccgtcggtggccgatgccgccgccgccctgcgacgcgaggcgcacacgccactgcagttgatcagcgacgaggcctatgccgcaggcgtggcccgcctgcgggaggccgcgcgaaccgagtccggcccggtcgtcgacgccctggacctgctggttctccggtga

SEQ ID NO: 7208 - DNA, 1011 bp, Actinoplanes utahensis
gtgtcgacgaccagaacccgcgcgcagccgcgctctatcttcgcctcggcttccaggacatcgactgccactacctcgaccgctaccactacctcgacgatcacggcacccgccacgacttcgccgacccctgccggttccttgtcaagccgctccggaacgggcccggccgatgaccatgaggaccacgaacgacgacccggacgcgggatcgggctgccggcgccgggcgtctaccctgccgccatggtgatcagcattctcggctgggtggcccggcggcgactggcggtgctcaccgcggcgttgctgaccgcggtcgccctgcaggtggttctgcacgtcaccgggaccgtcttcgccccgtgggccagcttcgcggtctacgcgctgccacccgccgcgttactgctgtgcatggcggtcgccatccgggtccacgacgcggcgcacctggtggcgcggcccgagattcccgccttcggctccccgccgaatccgaccctcgtgctcggcgcggcatgcctgacctatctcgccgtctacggcgcggccggcggtatccgcagcatcgagccgcacccggacctggggcacacgatcgtcagcatcgcgctgtacctcactgagttggcggtcttctggtgggcgtcacggctgcgcaccggcatcagcatccgcccggacggcatcctcgaccggcagcccttcggcgacctcttcatcccctgggacgcgctggccaccccgatcgccgcccagccgcacgacgcccaccgggtgacgctccacctcgcccacccggacctgacccgcagacggggcctgcgacgcggcgccccggccgccctgtcggccgcgggcgtcagaaccgacctgctcgcctggatgatcaaccactacgccgaccaaccggccgaccggtccgccatcggctcaccagcggccctcacccggttcctgctccccctcgaccgactggccacgcccgaggtggcgaggcagccgtaa

SEQ ID NO: 7209 - DNA, 471 bp, Actinoplanes utahensis
gtgaccgactggcgtgccgaccggacaggttcagcgttacggggacagaatccgaccgttctcgcccgtctcacggccggcttcgcggtcatcggcgactcccagttcctccccggatactgcgtgctgatcaccgacgatcccgccgccgaccgcctcaccgacctgccccgcccgcgacggctcgccttcctcgccgacatggatctgctcggcgaagccgtggccaccgtgtgccaccgacacgacccccggttccggcgggtcaactacgcgatcctcggcaacctcgacccgttcctgcacgctcacgtgcatccgcggtacgactgggagcccccggatctgatcaacggcccggccacccactatccggccgacttccgcaatgccgcggacaacctcctgggcccgcgtcacgacgtcctccgagccgacctgaccgcagaaatccaccggctcgcatcatga

SEQ ID NO: 7210 - DNA, 498 bp, Actinoplanes utahensis
gtgtccgacccactgcgccgctccgcccgcgtgctcctgctgagcagcaccgaccgagtcctgctcctccaattccggttcgaccccgcggacgccgcgaagggccacggctgggcgactcccggcggcggcgtccaggacggcgagcctctcgcccaggccgcgacccgggagctccacgaggaggtcggcctcaaggtcagcccggaagtcctgggcgacccggtggcctacacctccggcttcgccgacctgggctgggcgagcggcatcttccgtgacgagttcttcgcgcaccgcgtcgacgaccacgaggtcgacaccagcggcatggaggaccacgaacggggctaccacgccgggcatcgctggtggacggtcgacgagctggccaccaccaccgagaccgtctacccgttcgggttggccgatctggtggaacgcctgctcaccgagggcaccccggcacagcccgtgcagctgccctggcaccactga

SEQ ID NO: 7211 - DNA, 579 bp, Actinoplanes utahensis
gtgatcgttcgccgccttgccgcctcggccgtcctggccctcgccgccgcgaccgtcttcgtcctgcgcctcggcgaccacccggccccgcaggcggccgccgcgcagaccgagaccaccccgtcggggatcgacgtccactacgcccagatgatggtcgaccaccacgagcaggcggtcgccatgagccgcaccctgctcgccaagggcggggtcccggaacgcgtccggctgatcgccgactacatcatccacgaccagcagcgcgagatcgacgagaccaccgactggctcagcgcctggaacgagccttccccgtccgccggcggccccgcccacggcatgctctccccggcccagctgaccgaactcgatcacgccagccgcgacgccgcgccgaacgtctaccttcgcttgatgatcgaacaccaccggggcgcgatcacgatgtcccgctccctgctggacgggccgtccggcaacccgtacatccacagcctggccaaacacgtcctcaacgaacaatcgtcggaggtcgacgccatggcggcactcatcaggtcagattcaccctcttga

SEQ ID NO: 7212 - DNA, 1311 bp, Actinoplanes utahensis
gtggcgtaccgtaaattcgctggtgtcgtaacgctgatgacctcggccgcgctgggcctgaccgtgccggcgcaggccgcgccggccgcctcgccgtgcggcgcgtcgtcgatggtcaaggagaccttgccgaacggcaccacctggcagctgtgctggcggatcaacgacaaggccggcctggtgctcgaccacgtcttcgtcgccaccaagcgctacccggcgccggtgcaggtgctcgactcgatccggctggcgcagctcaacgtgccctacgacaccggtgacaccgagtacgacgacctgacccagatcggcctcggcagctacggcctggagacgctgaccggcgacgactgcaagggcggctccatccggctcggctccgacggcagcagcgagccgcagcgccgcaaggtcctgtgcgtcagcgccgagccgcgcggcctcgcctaccgcctgcactcctgggacgacggcggcgccggcccgtccgcggagccgcaggacaaggtgtactcgcagcagggccacgacctggtgctgcggacggtcagcaagctcggctggtacgagtacgtcaccgaataccgtctgcacgacgacggccagatcacggcccggctcggcgcgaccggcgacctcgccccgagcgagtactccaccagcagcaccggctggccgatcggcaaggggccggccaaggactacgccaccatgcactaccacaacgcattctggcgggtcgacttcaacatcgccggaaagggcggtgagaaggtcgagcagctcgacacgaccacggccggccggggcagcgtgaccgcgaagctgaagaccacccgcaccgccgtcaccaacgagggcaccttcaccaaggtcaaccagcggtcctggcggctggtcagcccgaccagcaagaacgcggacgggcaccagcggtcgtacgagctggccctcggcgccaccgaccagtaccaggggcacccggagaccaagccggacgtcaccttcacccagaaggacgcctgcgagaagtgggccagcgacaacaactccgacccggaatgcccgctcgacaagaagaccatcatcgatttcgccaaggacaagcagaagctcaccgacccggtcatgtgggtccgggtcggcttccaccacatcccgcgcgacgaggaccagagcccgatgccactgcactggcagggcttcgacctgctgccccgcgacttcaccgagatgaacccgctgacgccgcccggcctggccggcgccaacggcaacaccagcggtgacggatcgcagggctga

SEQ ID NO: 7213 - DNA, 732 bp, Actinoplanes utahensis
gtggatcgttatcgaaaatgggcctggggcctgggtatcgcgacagtgagcgcggccagcgccttcggcctggcggcctggggggccagcgcagcgccgaccgcgccgccgaccaccggtgccgccgccggccaggcgcaggtctccgacccgagcccgctgcccgaggccgccaccggagccggcagcgacccgctgaccagcgccgaggtggaccgggcccgcgccgccgcgctcacccccgagctggccgcgaaggccaaggacgtgaccggcaaggccggccccgaatacctggctgccgagctcgacaccgacgggaccggccggcaggccgagctgtactactacgactacggcacgcagaagctgtacaagcaggtcgtcgacctggcgagtggcaagctgaccaagtcgtacgcggcgaccgggatgcagccgccggcgtccgagcaggaggccaaggtcgcactggacctgctggtcgccgacccgctcggcgcggacttcaagaccgcctaccgcaaggcgaccggccaggacctgcacggtacggacgggttggtgccgaccgcgcacgtgtacacgtccaagccggcggaccggggcgcgacgcagtgcggcaagagccgttgcgtacagctgatcatcaagacctccgatggtcacttcatcaatgtcaccgacgtgatcgtcgacctgtccgggcgccgggtcgcccgcctcaagtga

SEQ ID NO: 7214 - DNA, 909 bp, Actinoplanes utahensis
atgaccatgcaggtcccgtatgccggcggccggctggaccgggcggccgcgcgccgcgcggacccgcgatggctcgccgaggtccactcccgcccggatgtgcgggtggttccgatctggcgggacgagtgcgtcgtacacggcacacccgcgcgggcgatcgtcgccgccggcccggcagcccggcggttgctcgacgccaccgccgagccggtgttcctcgggctcgacgacggcgccggcatcttcgccgtcgacctgtccgaatacgacagcggcaccgcggtggcactggccggcggtgacgcgaccgcgtcggtgcgctccgtctattccgagcacaccccggccgaggccgccaccctcggctacgcgcgcggcctgctgcgcgcgatccgcgaccagcggcactgcgggcgctgcggcggtcccaccgagccgcgccacggcggccacgtgcgggcctgcccggcctgcgaccggctgctcttcccccggatcgaacccgccgtgatcatgctggtcgagtcggccgccgaccccggccgctgtctgctggcccggcaccgcggctcggcgtccggcgagtattcgaccctggccggcttcgtcgagaccggggagagcctggaggacgcggtgcgccgcgaggtggccgaggaggtcggcctgacagtgggcacggtcgcctacgccggctcccagccgtggccgttcccggccgggctgatggtcgcgttccgggccaccgcgatcgacgaggtgcccacggtggacggcgacgagatcctcgacgcccgctggttcacccgcgccgagctcgccgggcgagccgcggccggtcgcctcggccgggtcgactcgatcgaccgcctcctgctgcactcctggcttgaccacaacggctga

SEQ ID NO: 7215 - DNA, 1209 bp, Actinoplanes utahensis
atgagagaaggcggcgacaaggttctgctgggaggcactgtcatgggcattcgcccacggttcggcactctgctcactgtcctggtgctggccggggcggccgcactcgagggttgtggcggcgaccatgcggccacctccggcgcttcggcgccggccgccatccgcctgggcgccctggtgccgttgtccggtaccaacgcgcagtcgggccgggagatgcgcgatgcggcgcagatggcggtcgacgaggtcaacgcggccgggggagtgctcggccggaaggtggagttgctggtctcggacgacgcctgcgacccgggcaccgccgtggtgaaggccaacgatctggtggcgcaggacatcaccgtctcggtcggcggctattgcagcagcgccaccgtgcccaccctgaaggtcttccgggacgccggtgtgccgatggtgatcgccctggccacctcgaccgacctgttggtgccgaagtacgacagcgtcttcctgatcagcggcacggtcaccgccgagggcgtcttcgcggtcgccgccatgcgccggatgggcagcaagcggctgatcatcgtcaacgacggcaccagctttccggtcaccctcggccggacgaccgccgatgcggccgccaagcccggtacgggtatcgagacggtcgccacccatgaactcagccagggtgcgccgtcgtacgcccggctggccaggcagatcgtcggcgagaaggtcgacacggtgtacttcaccggctattacggcgaggccaaccagctcatcagggatctgcggaccgccgggttcgacggccggatcttcgtcggcgacggcgcgaccgacgggccgctgctcacgaatctgaccgccgcgcagaccaggaatgtgttcgggaccgcgttgatggtgccgacgctcatgccgtcgctggccgagtggtcgaaacgattcgagaaggtcaccgggcggcagcccggcgcgggcggaccggagtcgtacgacgcggtcacggtggccgtggacgcgatcaagcgggccggttcggtcgaccacgccgccgtgcgtgccgccatcgccgccaccccggatctgccgctgctgtccgggaaggtcaagttcaacgccgacggcacccgggagaacccggtgttcctgctgctgcaggtccgggacggtaagctggtggagattccggcgggctga

SEQ ID NO: 7216 - DNA, 2040 bp, Actinoplanes utahensis
gtgaaacggtggcggatgccctccggacccgcgggacgccggtcgtccgtgcgcgacggctcccggggacggcgacgggtcagcctgaacaccacggccgcgctggcgagcgtgctgctggcgctcggcgcgtacaccatcatcggaaccgcgttgaccgcccaggcggtgcacgaccacagtcgcgccctccaggtggacgcggacttcagcgaggcccgcggggcgatcacgctcgaagaggtgaatctgcgccactaccaggtggagccgtcctcggcggtgctcagccgcttcctgcaggccgccgcctcggtggacgtggcactgcacctcgcggtccagcacgggctgcccgacgccgaccgcgaggcggcccggttgctggaccggcaacgggactaccggacgaacgccgagcagctcatcgccctggtggcggaccgcgatccggacagtttcagcgtggacagtctcagcgtcacgccgtcctactacaccctgcagcaggacgtggacgccgtcagccgggcgtaccatgccagcgcgcaacggcaggccgacgcgatgcaacgcgccgaggtgcgcatgctgatcggcacgtcggtcggcttcggggtggggctcacgctggtcggggtgatctggcggctggtgctcagctatcagcgtcgcctggtccaggatgccgacgccagcgagcaccggtctctgcacgacccgctgaccgggctgccgaaccggcggatgttccacgagcgcctgaccgactcggtccgggtgtcggccaaccggcgggatgaccaggtggccgtcatgatcatcgacttggacggcttcaaggccgtcaacgacacgctcggtcaccaggccggcgatcagcttctgcaggaggccgggcaccggctgcgggccggcatccgcgacggcgacctggccgcccggctgggcggcgacgagttcgcggtgctcctgtccggcgtcaccgatctggcgaccgccgtcgaggtcgccgagcggctctccgacaagatccggcacgacttcctgctcgacgtcggcgcggcctcggtcagtgccagcatcggtctcgccctcggcaccaccgatgtcgccgacgacgagctgctgcgccaggccgacgcggcgatgtaccgggcgaaggcggccggcgggggcgtcgcggtctacgacgcgctgctggacgccgtggcgcccgaggagatgagcctgttcggggagcttcgcgcgctgctggacagcggcgacccggagaatcagctggagttgttcttccagccgcagatccggatcgccgacggctcggtggccgccgtcgaagcgctggtgcgctggcgtcatccgacccgcggactgctgctgcccggggcgttcctcgacatggccgcctcccggggtctggagatcgcgctgacctaccacctgctgaaggtcgcggtggcgcaggcggaccggtgggcggcggccggcaacccgatggcggtgtcggtcaacatctcaccgcgatgcctgctgcacgacgatttcctgacccagatccgcgacgcggtcaccggtgtccacctgccgcacggcatcctgcaactggagctgaccgagagcagtgtgatgctcgaaccggaccgtgcccggaccgtcctgcgccaggtccgcgaggagggcatcctgatctcggtcgacgacttcgggaccggcttcagctcgctgtcccagctccgccagctcccggccgacgaactcaagatcgaccggtcgttcgtgcagggtctcgcccgggacgtcgacggcctggtgctggtccgcagcgccatcgacctgggccacaacctgggcctgtccgtcgtcgccgagggcgtcgaggacctcgagacgctggccgtgctccgcgagatgggctgcgatctcgcccagggcttcgcgctgagccggccggtcccggccgatgaggtgccggccgcgtgcgcccgggcaagccaggcggccggccagcagcgggtgccgcaaccacacgccgggtga

SEQ ID NO: 7217 - DNA, 1050 bp, Actinoplanes utahensis
atgaggtgccggccgcgtgcgcccgggcaagccaggcggccggccagcagcgggtgccgcaaccacacgccgggtgaccgatatgccgaccgggtcacccgcaccctcacattcgcgatcaccctgatccagctctaccacgcagcactgccactgcgactacgacgccagcgaaacaaatcccgcgcccgcgactcgaaccagcatgtggcctccggccaggaccgccacgccgaccccgacgacagcgagcgagtctgtcgcaagccgactgcggccgttcggggcttctgcttgatcgatggagtgccgttggtgactacgctggcgccgatggaggcggagggtgaagcagcgctgggacggctgttggcgtatcggaggccgaagcttgccgcaacggcaggtactgtgcggccggaactgaaggaagtgctccaaggcggcgcgctcacggacgcgctggtgcggcgcctggcgccggcgctgggctggcgcaccgcggacctgttcgtgatcgctgggctcgatctaccccgcgatctggtccctgcaaacggcaccaagccttgggatgtcgggtcgatcctggagaaagcggcaaggctggcgccgcagtcgctccgccggctacacgagttcgtccgctcgcttcccgagcgtccgcccgcgtggccgccggctctgccgcgccatgcctacccgctcgggcccggcgagatgatgctgcgtctgctgcggaaccgtaatatccggccgtacagcccgaaggtgttgtacttcatcggcaacggtccgatcgtgtcgcactcgacgatggcgatgctgggaccaggccgtacgaagctgacgccgcagtacgtgacggctttcgccactgtgctgggtattcccgccgacgagctggcagccgtaacaggagtcgccgcggccgtggatccgatgcttcacggcaaccacgcggaactcgccgagttggcttgggctgcccggcgactggacggcaaccaacttgccgaggcactcgaactagcgacagagctgcgataa

SEQ ID NO: 7218 - DNA, 639 bp, Actinoplanes utahensis
gtgggtgacttcctcaagacgacgctggcccgggtgccggacggattcgacctgccggagccgctgcgcctgctcttcgcctgggtcgacgagcagggtttcgtggtgaaggggcacgacggtgacctgtacggctcgttgagcgacaacggccgggtgggtacctcgatcgagttgcgcggctacaccgacgagcagaccctgtcgtacgcacggtcctggttcgacgattccgtcccggacgcggccgcacggttgtggccgttcgcgcagaccggcggcgagggttcgatggccgcgctgtggcgcgacggcgagggacgggtcaggatcgtccatctcggttcgggcagcggttcgatcatgacgtgcgtgctcgccgacgacgcggtcgactttctccggctgctggcgatcggttaccgggagatctgctggaacgaggagttcggcgcgccgcctgagccgtgggacgccgaccacgaggtcgtcaatgcgccctaccgcgactggctgaaccgcaccttcggtgtcaccgccccggcgaccgggctggagatcgtgtcggagcccgccgagatgggcgacgaggacaccacggacccgttctgccgctgggtcgacaacagggacgcctga

SEQ ID NO: 7219 - DNA, 1347 bp, Actinoplanes utahensis
atgagttttcacgacaaggtcgtcgtcatcaccggggccgggtcgggcatcgggcgcgccctcgcgctcgaactcggccgccgcggcgcccggctcgcgctcagcgacgtcaacgacgccgggctgaaggagaccgccgagcgggtgaacgcgccggtgcacaccgcgtacctggacgtcgccgaccgcgacgcggtcgaggcgtacgcggcggcggtggccgcgcaccacggcgtcgtccaccagatctacaacaacgccggagtcagcggcggcgggcagaccatcctggacagcgactgggcgagcttcgaccggacgctgagcatcaacctgtacggggtgatccacgggacgaaggcgttcctgccgcacctgatcgcctccggggacgggcatgtgatcaacgtgtccagcctgaacgggttcatggcccagccgaccctcggaccgtactgcgccagcaagttcgcggtgcgcggcttcaccgaggtgctgcggaccgagatgctgcacgccggccatccggtgcgggtcaccgtggtgcacccgggcggggtgaagaccgacatcgcctcggccagcctgcggcacgccgaggaggcggggctgtcgcccagcgccgaccaacgggcgcgggcacggacgtacaacgaaaagctcctgaactgcctgcggagcaggccgcacggatcatcgccgacggcgtggcggccgggaaatcgcggatcctggtgggcggcgacgcgaaactcgtcgatcggctggtgcggctgctgccgcgcgcctacccgaggatcatcgccggttacgaacgccgattgttccgctgaccaggaccgcaccggcgaccaggacggccgcgacgaccgtgcggcgacgacggcggcggcgcagcacggccagcgcccgcacccgggcgtgaatgagctccagcgtcggcccgggaacgtggaagtcgtggtcggtcaccactcctggacgcggcgcgaggacgattcgtgcaccggtgcgcaccgcgggcagcggatcgggcagggcgtcagcgccgcggtcgtggccagaccgctggtgtgcaaaatcgtggtgaccgcctcctcgaagccgaccgtctcgtcgatcacctgctcgccgggcacaccgagcaggtcccggtcggtgtaccacgcacgcatcatcgcggcggtgaccgggatcggcggatcgcggcgctcgtgccggcggacggtctcgtcgaaaccgacctgcatccagaaggtcgccgccggccccgggtgctccgtgacgagggcgcgcagcagagggccgtacgagccggcggacaggatgccctccaggatcacgtga

SEQ ID NO: 7220 - DNA, 1479 bp, Actinoplanes utahensis
ttgtgctggcgcaaccggctcggggcacggattctttactgcgtggagcacatcgacgtcctgatcgtcggcgccggcatctccggcatcggcgccgcgcgctatctgacgaccgagttgccgggcaagagctacgcgatcctggaggcccggggcgcgtccggcggcacctgggatctgttccgctatccgggcatccgctccgattccgacctgcacacgttcggatacgagttcaagccgtggcgcgacgagcagtcgatcgccgacgcgccgcggattctcgactacctgcgcgagacgatcgcggagaacggcatcgagaaacacatccgctatcaccaccgggtcgtcggcgcggcctggtcgaccgacgacgcgcgctggacggtctcggtcgacgtcgacgggaccagcctggagatcacctgcgactggatcttctcggcgagcggttactaccggtacgacgagggtttcacgccgtccttcgagggacggttcggcggtacgctcgtgcacccgcagcactggcccgaggacctcgactacgccggccggcgggtggtcgtgatcggcagcggcgcgaccgcggtcaccctcgtcccggccctggtcgacggcggagcggcgcgggtcacgatgctgcagcgcaccccgtcgtacatcatgcccgtgtcgaagaaggacccggtcgcgaacgcgctcaagaagtatctcgggccggaacgcggatatgcctggacccggcgcaagaacatcgcccagcagaaggccgtctggtcgttctgccagcggtatccgaaagcggcccgcaaactcatccgctgggtcaacgcccgtcagctgccgccgggatatcccgtcgacgagcatttcaatccgccgtacgacccgtgggaccagcggttgtgcgcagtgcccgacggcgacctgttcacggcgatccggggcgggaaggcggcggtggtgaccgaccggatcgtccggttcaccccaggcggtgtcgaactcgcctccgggcagcatctggacgcggacatcatcgtgacggcgaccgggctgaacgtgcaggcgttcgggggagtgccggtgtcggtcgacggggtgccggtcgccctgccggagaccgtggcgtacaaggggatgatgctttccggggtgccgaatttcgcgtacgccatcggctacacgaactcgtcgtggaccctcaagatcggtctgttgtgcgagcacttctgccgcgtcctgaaacacatggaggccggcggataccgcgtgtgccgtccgctcgtggccgacccggcgatgccgaccaggccgttcctggacttcggcgccggctacatccagcgggccgtcgaccaactgccccggcagggtgaccggatgccgtggctgacctcgatggactaccagtccgacgtcaaactcctgcggggggacgacgtcaccgacccggagctgcatttctcatga

SEQ ID NO: 7221 - DNA, 1185 bp, Actinoplanes utahensis
gtgtcgccgcgggtcgccgagctgttccggcagggcgcgcaggcggcgctggacgcggaggccgagtcggtggaggcggtgcacgaggcgtcgctcagcggcgaccggatgcggccggtcgccgacgacccggtgctggtcgccgcggtgcgccgcagcaacgtggcgaacctgcggcagtggaccgaggcgaatgtgcgcgccccgggccgccgggtgccggccaacctgggcccggaggttctggaaacggcgcgcgacatggtccggcgcggcctcgaccagcgggccctcgactcgtaccggaccgggcagagcgtcgcgtggcggcgctggatgcggatctgtttcgcgctcgacgccgagccggacgagctgcgcgcgctgctcgacgtgtcgtcgctgtcgatctccacgttcatcgaggacacgatcaccgcggtgtccgcccggatggaggccgagcacaccgagctgacccggggcgcacacgccgaacgccgggccgcggtcagtctgctgctggagggcgcgccgatcagccggggacgggccgaggcccagctcggctaccgcctgaccggcccgcacaccgcggcgatcgtgtggaccaccgcggacaccgccaccgcgcgcctggaggccgccgcggaggcgctgacccgggccggcggcgccacccatcggctgaccgtgctggccggcgcggccgcgctgtggctgtggctgccggtcgcggtggcaccccggatgaccgattccggcgacccggacgtccgggtcgcgatcggccgccccggcgccgacgtcgagggtttccgccgcagccacctggacgccctggccacccagcggatgctgacccggctgacgtcgccgcagcgggtcgcgcactacgccgacatccagctggccgcgctgctgaccatcgatccggcccagtgtgcggagttcctcgccgacaccctgggcggcctgctgcacgccgacgccgagacccgggagacggtcgccacgtacgtccgcgagcagtgcaacacgctgcgcaccgcggaccggttgttcacccaccgcaacacggtcgtccgccggttggcccgcgccgacgcgctgctgccccgcccgctcgccgacaacgtgctggcggtcgccgccgccctcgagatcctccgctggcggggctga

SEQ ID NO: 7222 - DNA, 441 bp, Actinoplanes utahensis
atgcggttcatggtgatcaccaaggcgaccacggccagcgaggccggtgtcctgccgaagaccgaggacttcgcgacgatgggcgcgttcatcgaggagctcgtcgacgccggcgtcctgctggccgccgagggcatcggccccagctccaccggcgcccggatctacttcgacggcgagaagaagaccgtcgtcgacggcccgttcgccgagacgaaggagctgatcgccggcttctggctggtcgagatgaagtccctcgaagagtgcgtggagtggttcaagcgctgcccgatccagaagaccgccggcgaacccaccaacatcgagatccgccgtctgtacacggcggcggacttcggcgacgaactcaccaccgagcagcgcgaggccgtcgcccgccgcgaggagaaggccgacccgtcctaccgctcggcatag

SEQ ID NO: 7223 - DNA, 1293 bp, Actinoplanes utahensis
gtgccgaccgacacccaccgcgcgatcgagacggtctggcggatcgaggcgccgcggctgatcgccgggctcacccggctggtccgggacctgggcacggccgaggagctggctcaggacgccctggtcgcggccctggagcagtggcccgtccagggcgtcccggacaatccgggcgcctggctgacgaccgtcgcccaccgccgcgcgatcgaccggatccgccgcgccgagacgtaccggcgcagggtcgaggaggccggccgcgaccgaaaggactcggcaccggatgtcggcacgctggtcgccgaggacgacggcatcggcgacgacctgctccggctggtcttcatcgcctgccacccgatcctgtccaccgaggctcgcaccgcactcaccctgcgcctgctcggcgggctgaccaccgacgagatcgcccgcgcgttcctggtgcccgagccgaccgtcgcccagcgcatcgtccgcgccaagcgggccctggccaaagcccgggtcccgttcgaggtgccgcagggtgccgagctcgccgcccggctgtcctcggtgctcgaagtcatctatctgatcttcaatgaggggtacgccgcgaccgccggcgacgactggatgcgccccgccctgtgcgaggaggctctgcggctgggccgcgtcctggcccggctcgccccgcgcgaacccgaggtccacggcctggtcgccctgatggagatccaggcgtcccgcgccgccgcccgcaccaccccggacggcgaaccgatcctgctggccgaccagaaccgcgcccgctgggaccgcctgctgatcagccggggcctgtccgccctgcgccgagccgacgagctgcacgccggccggccgggcccgcgagagtcgcggaccggcaagcccggcccctaccagctgcaggcggcgatcgcggcctgccacgcccgggcccgccggttcgccgacaccgactgggtcgccatcgccggtctctacgagcggctggccgaggcggccccgtccccggtcgtcgaactcaaccgggcggtggccctgtcgatggcctacggcccggcggccggtctcgacctgctcgaccagctggccgccttcccggttctggacggctatcaccttctcccgggtgtccgcggcgacctgctggcccgcctcggccgccacaccgaggcccgggccgagttcgcccgcgccgcgtcgctgacccgcaacgaacgcgaacgcacggtgctgctgaaccgggccgccgcctgcgaacggctcggctaa

SEQ ID NO: 7224 - DNA, 609 bp, Actinoplanes utahensis
atgttcgcgctggaggggtcgatcgcgatcaccggatcgctggtgcagtggatgcgggacgggctcgggctgatcggcaccgcgtcggagatcgagacgctggccgggacggtgcgggacaacggtgggtgttacatcgtgccggcgttctccgggctgttcgcgccgcactgggacagccgggcccgcggggtgatcgtggggctgacctcctacatcaccaaggcgcatctggcccgggcggtgctggaggcgaccgggtggcagacccgggacgtggtcgacgcgatgaacgccgatgcggggctcgcgctgaccgcactcaatgtggacggcgggatgaccgcggacaacctgctgatgcagatcgtggccgacttcctcgacgtgccggtggtgcggccgatggtggccgagacggtgtcgctcggcgcggcgtacgcggccgggctggcggtcggatactggtcggacccgcgggatctgcgggccaaccggcatcatgcggggcggtggacgcccgcgatggatgccgggcggcgggcggccgagcaccgacggtggcggcgggccgtggactgcgcggtgttcttcggccgcccggattag

SEQ ID NO: 7225 - DNA, 234 bp, Actinoplanes utahensis
gtgagcttcgtgctggccatcgatcaggggacgacgtcgacgcggtgcatcctgttcgaccggcgggcgaccgtggtgggggtggcgcgggccgagcatccgcagtcctatccgcagccgggctgggtggagcacgacgcggcgcggatctggcgggacgtgcggcgactgatcgggcgggtgctgcgcgaggccggggtcacggaggtggccgcgatcgggatcgctagctag

SEQ ID NO: 7226 - DNA, 780 bp, Actinoplanes utahensis
atgcgtgcgacaatgtcgcacgtgcccggcctgatccagtcgatcgcacggtcctcggccgtgttgcggctgctcgcggccggtgacgaccggctgcgggtgaaagagatcgccgacgccctcgggatggcgaaatcgaccgcgcacagcatcctgcgcaccctggagcacgtcggtttcgtcgagcaggacccgcggaccgcccgctaccggctcggtcggggcctgcacgacctgggcgcgcccggcatcgacgcgaacgagctgcgcggccgggcactgaactgggccgacaccctggccgcccgcagcggggaacaggtgcggctcggggtgctcgccgacgggcaggtgctggtcgtgcaccacgtgttccggcccgacgactcggcgcagagcctcgacatcgggacccggctggcgccgcacgcgaccgcgctcggcaaggtgctgctcgcctactcggcggcggccacccgggcggcggtggcgggagggctcaccgcgtacacgcgacggacggtgaccgacagcggcgccctcgcccgggcactggccgcgacccgggccggcggctggggtctgtcggtggaggagtggcggcccggactggccgggatcgcggcgccggtgcgggcgtccggcgggctggtgatcggcgcggtcggggtggccgggccggtcgagcggctgaccgacacccggcggcaggcccggccggcgctggtggagcaggtggtggcggtggcgcgctcgatctcgcgggaggtgcaggcgtga

SEQ ID NO: 7227 - DNA, 243 bp, Actinoplanes utahensis
gtggggcggtacgtcggcgcgatcgatcagggcacgaccagcacgcggttcatggtcttcgaccggtccggcgcggagatcggccggtgccagctggagcaccggcagatccagccgcggtccggctgggtcgagcacgatccggtggagatctgggagaacaccctcaaggtgatcgcgggcgcgctggccggcaccggtctcaccccggccgacctggccgcgatcgggatcactagctag

SEQ ID NO: 7228 - DNA, 471 bp, Actinoplanes utahensis
gtgccggcgttctccggcctgttcgccccctactggcggccggacgcccgggccgcgatcgtcgggctgtcccgtttccacaccgccgcgcacctgacccgggccgcgctggaggcgatctgccaccagacccgcgacgtggtcgaggcgatggcgcaggactccggcacggccctggactgcctgcaggtcgacggcggtgtcaccgcgaacgcgctgtgcatgcagctgcaggcggacatcctcggcgtcccggtcagccggccggccgtggccgagaccaccgcgctgggcgccgcctacgccgcgggactcgccgtcggcttctggtcctccccggccgagctgcgcgccaaccggcacgaggaccgccgctgggaacccacctggccggcggaccggcgtaccgaaggcatcacccgctggcgggcggcgatcgaccgcaccctcgactgggtcagcgtcggctga

SEQ ID NO: 7229 - DNA, 1716 bp, Actinoplanes utahensis
atgaaaaccggagtgatctcgccggagtcccggcggcgggccctggccgccatgacgtccggggagctggacgtgctggtcgtcggcgccggcgtggtcggcgccgggtcggctctcgacgccgccacccgagggctcagcgtcggccttctcgaggcccgtgacttcgccagcggcacctccagccggtccagcaagctgatccacggcgggctgcgctacctggagatgctcgatttcagcctggtccgggaggcgctgcgggaacgcggcctgctgatccagaagctcgccccgcacctggtccgcccggtgccgttcctgtatccgctgcagcgccgggcctgggagcggttgtacgtcggcgccggcgtcgccctctacgacatcctggccctgtccggtggcggcgccggcgtgcccgtgcaccggcacctgagccgcctggaggcgctcaaggcgttcccgtcgctgcgcccggagaccctggtcggcgcgatccgctattacgacgcccaggtcgacgacgcccggcacaccatgttcctggtccgcaccgccgtggccaacggcgcgcacgccgcgtcgcgcaccgaggtcaccggtttcctccgggagggccgccgggtcgtcggcgtccgcgcccgtgacctggagaccggcgccgagctggagatccgcgcccgcaccgtgatcaacgcgaccggcgtgtggaccggcgacagccaggccctgctgaccggcgaacgcggccagttcaccatcgccgcgagcaagggcatccacctggtcgtcccgcgggaccggatcgccggccacaccggcatcatcctgcggaccgccaccagcgtcctgttcgtcatcccgtgggaccagcactggatcatcggcacgaccgacacggcgtggaatctcgacaagtcggacccggccgcctccggccgggacgtcgactacctcctcgacgaggtcaacagggcgctggccgtcccgctgacccgcgacgacgtgcagggtgtctacgccgggctgcggccgctgctgtccgccgaggcgtccaccaccgccaagctgtcccgcgagcacgcggtcggccacccggtccccggcatggtcgtcgtggccggcggcaaatacaccacgtaccgggtgatggccaaggacgcggtcgacgccgccgtccaggatctggccgcccgggtcccggcgtcctgcaccgaccaggtcccgctgctcggcgccgacggttatcgcgccgcctggaaccgccgccagactctggcccgcgaatccggcctcaccgtagcccggatcgaagccctgctccaccggtacggcaccctgctcgacgaggtgctcgccctgatcgaagccgaccccagcctggccctgcccctggacggtgcccccggccacctgcgcgccgagatcgtctacgccgccacccacgagggcgcccgccacctggaggacgtgctggcccgccgcacccgcatcgccttcgaaaccccggaccgcggggtgatcgccgcccgcgccgccaccaccctgctcgccccggccctgggctggtccccggccgacgccgagcgcgaggtcgccacctacgaggcccacgtgcgagccgaactcgccgcccagaccgaacccgacgaccgctccgccgacgccaccctccgagccctcaccaccagccccctgacctcggccgtctga

SEQ ID NO: 7230 - DNA, 363 bp, Actinoplanes utahensis
atggacgatgagccggaggccgtggaacccaccccgattcccccgtcccggtcggggagcgcgggcgcggtactcgccatcgtcgtcctgaccgccttcgccggttatgcgctggtgctggcttacctcttcagctgggccgccgggaaccgttgcgtccccgacgatccgggcttcttctgcaccccgaccggcgaatcgctggcctcgatcgttccgatgatcgccaccctggccggcgcgatctgcggctacaccggcatgagccgcccgccggggcaccgcggtcggctgatcctcgtcggctatctgatcatcgcgggtggactgctcgtcgggcgggtgctggtcgacgtcggctga

SEQ ID NO: 7231 - DNA, 414 bp, Actinoplanes utahensis
atgtacgagttcggcgagagcaccgtcatccgggccgacctgtccgcggtgtgggacacggtcaccgacgtcagcgcctggcccgcgtgggatccgcacgagcagcaggcccgcctcgacggcccgttcgcgacgggcaccaccggctggtccaagccgcgcggcggcccggccaccacctggcgtctcaccgaggtggtcccccgccgccgctgggccagcgagtgcgacctgcccggcgggacactgtccggggtcaccgcctacgagccgctcgacgaccggcggatccgctgcaccaagaccatccgggtcaccggcccactgaccccgctgttccggttctacttcgcccgccgcatccgccgcgacatgctgaaaacctgggccgccctggagacccgaagcgcatga

SEQ ID NO: 7232 - DNA, 534 bp, Actinoplanes utahensis
atgaccggacccgacgcgcagagcaggcccggccccggccccgaccccggcacggaaagcatgaccaggcccgactccggcccgatgctctcccccggcttctggctgcaccacgccgccctgacctggcgcgccgagttggacgcccgcctgcgcccgctcggcctcaccccgacccagttcatgctgctggcctcggccggctggctggagcacgtctccggcccaccgacccagcagcaggtcgccgacgaggccggcgccgaccgcatgatgacctcccgggtggtccgcaccctgcaggagcgtggcctgctgacccgcagccccgacccggccagcccgccgtcgctgcgcctgagcctcaccgacgccggccgcgccgtcacgcggcaggccacccgggccgcccgcgacgtcgacaccctgatcttcggcgacgccgccccgcacctgcgtaccagcctgcggcagatcgccgagtccggaggaccgacaagggtggcccgaccgcaccggccgggccacccttga

SEQ ID NO: 7233 - DNA, 2463 bp, Actinoplanes utahensis
atgtcccaattcctgtcccgaacccggcgccgcctgctcggcgccggactcaccgccggcgcggtgggcgccgtcatcctggcggcgcccctgccggcactggccggcgcgaacatcggcccgtggatcgtcatgccgggtggcaacgccacgctcagcgaccagagcgcggcgttcaccggcaactcggtcgtgcagctgaacaccagcccgtgcccgggcaaactggctaccgccggcggcaccggaccgtggaatcccaccgtcagcaaccgcaccggtacctcgctgaccttcaccgtgccggccagcggcgggccggcccccggccccaacggggccgtcaagctgtactacgcctgcgcctacgacggggcgacggccggcaccagcaacctgctcagcggcggcccgctgtacgtcggcgccggggccgccgcgagcagcaacgccggtctcaccggcggcggcaacccgctcaccctcagcaccggcatgcagaacccggtcttcaccggttacaacaccgtgtccgcggtcttcaccaccggacagtgcgccgccaccctgggcagcaccaacccggcgaacctcaccgtcgccggcctggcccggcagtcgaacagcacggtggcgctgaccgtcccgtccggggtggtcaccaacgggccggcacccaccaactacaacatctgcctgtacgacggcagcagcgccgccggctccctgctcagcatcgccggctacaacgcgaacgcgctggccgtcaccccgggcagcggttcgtactcggccagcaccggcgtcaccgtcagcgctcccggcgccttcctcaccggaatcaccacccccgccgtgctggtgttgccgatgaacgccggctgccccggcacctactccaccgggcaggtcaacggggtgaccccgctcgccctgaccgcgccgggcagcgtgcgcagactgaccagcagccgggccgcggtcaccctgccaccgttgacgctgcagcagccgggtcagcccacgacgtaccagatctgcttctacagcggcagcaccggaaccagcggcctgatcgggaccaccaactacaccgccggggtggtggccaacccgatgggcatcaacccgtccgccggcccgcccgccggtggcaacacgatcaccgtggtcggcaccgacttcccgaccgacgccggacggatcaccgcgaccctcgacggcgtgccgctgaccaacatccagccgatcagcgacaaggcgttcaccgcccaggtgcccgcgcacaccgccgacacgaacctcaccctggtggtcagcacgccggccggcaccaaggcgctgcccggcgcgtactcctacctgaacaccatcacggtcagccccaacaccgcgccgagcacgtcaccgacggtcgacgtcgacgtccagggcgccggcttcgtggcgatcaacttcggcaccggtggcaacgccggccgggtgttcctggtcaacggcgtctacaacggcgccgaggtgaccagcggggtgcgggccaacggcccggtcgccgaatgcgtcaacgtgctgccgatcagcgacaccgaactggtctgcacgctgcagctgaaccgcaaactgaacgcccagggcaccggcttcttcgacccgtccgcctacaccaacacgatcgcctccgacctgtccaccacggcgggcagccgggtggtggtctcggccgccggcaagttcagcccgaacgacctcggccagccgatcgtgcagggtggcaacgccaacatcccgccgaacagcctgatcacctcggtgctcggcccgaccaaggtggtcatctccgccccgtccccgctgaccggctccaccctgtcggccaccatcggtggcgcggtgccggcacacaccttcaccggatcgatcaccacgaccgcgggcagcgcgacggtctccacctccagcggcgcgttcacccgtgccgacatcggccgggtcgtcagcggcaccagcggtatcgcgaacggcaccacgatcaccgcggtcgcccccggaggcgccaccgccaccctgtccgcgccggccacggccagcactcagtacacgctgtccgcggccagcacgaccggcgggtcgacgacactcaccagcagcgggctgcagtccagcgacagcggcgcggtgatcggcaacaactcactgggcatcacgcccgggacgacggtcggagcggtggtcgcgggcaccagcgcgaccctgtcggcgcaggcggccgtcaccgccggaccggccgacctcacgctgaacaagccggtcaacgccaacctgtacgccgcggccccggtgccggacggcgcgtacaacctggtggtggtcagcaacggggcgccggatgcggcgaccaccgacccggcctatttccagacggacgtgaccagcggctcgacgttcacggtcagcccgttctga

SEQ ID NO: 7234 - DNA, 990 bp, Actinoplanes utahensis
gtgggaaaaagcgggaacacgggattggtccgtcgtgcgcagcagggggaccgccgggccttcgacgcgctgatgcgacacgagatcccggtcgtctactccgcggcggcccgggtgctggcgcccgccgacgccgacgacgccgttcaggagacgttgatcagtgccttccgcaacctgaaagacctccgggaaccggacaaactgcggccgtggctgctgacgatcgtcatgcgagaggcgcggcggcaggcccgggacgcagagctgccggtgggtctgccggccggttctgccgagtcggtgccggtcgacgtccaggaacgtgcggtcgccgaggtgacgctcgccgaacaacgtaaggacatctccgcggcgaccccgtggctcgacccggaggaccgggagatgctggcgctctggtggctggaactgctcggtgaagtcgaccgctcagggctggtgcaagcggcggggaccagcccgaaccacgtggccgtccggctcaagcgcctccgggaacgcctgactgcggtgcgggtgctcgtccgcgccctcgccgcccgggaccggccggacgggtgcgccgagttccgggtgctgctggccggttggccgggccggccgtcctcggtgtggcgaaagcgcttcgtgaaccacatctcgcagtgccccacgtgcggcgctctgcggcatggcctggtaccgcccgaactcctgctgtccaccaccgcgttgctggtggctcccgccacgctggcggctcaaccggccaccgcgggagcgatcgtccgggtcatggacgccggcaggcggttgctgcacgccggcaaggccgggatcgctcaaccggtcgccgcggtagccgcgaccgccgccgtgctgggcggcgccgccgtggtcatcgcccgcacgggtgagtcccgcccgctgccatccgcgcaggcgccgagcaccacctccccgcgggccccggttctagctagctag

SEQ ID NO: 7235 - DNA, 675 bp, Actinoplanes utahensis
atgaaacgcttcctccgcgagaactcgctcggcctggtcttcgggctgctgttcctgatcgtactggccggcgaggcgatcgccgggcacgccgacttcaaccagcagcagctcgtcgaaggcctgccgccgatcacgttcggccgctacctcacctcggccagcttcggcgccgacgtcctggagaactggcagtcggaatacctgcagttcttcctctacatcgtgctgaccgtctggctgctgcagaagggctccccggagtccaaagagctcgacaagccgggccgcgagaccgacaaagatcaaaaaattggggtgtacgccgacaaggactccccggcatgggcccgcgccaccggagtccggctgtggctgttctccaactcgttgagcctggtgatgggtctgatcttcctgctgtcctggctgggccagtcgatcgccggccgggccgcgttcaacgagcggcagctcggcgacctgcaggacccggtgtcctggtcgcagtatctgaccgagcccgacttctggaaccgcacgctgcagaactggcagtcggagctgctggcggtggcgtcgatggcgatcctggcgatctatctgcggcagcgtggctcgtcgcagtcgaagccggtcggcgccgcgcacaccgccaccggcgtggaggggtag

SEQ ID NO: 7236 - DNA, 156 bp, Actinoplanes utahensis
gtgatcagcgcggccgttttcggtcagcaggcccaggtacgcctcgccgacgacaccatcttcctcggcgtgttcccgggcggctggcgggtcctcgcggccggctgcaagccgcgtggtgaccagccctacgactgcaccctgcaggggagttga

SEQ ID NO: 7237 - DNA, 765 bp, Actinoplanes utahensis
atggaccatgatggcgggacacgggtggcgcgggtgaccggcgccgggagtccgaacgggatcggtgtcgcgatcgcccgggagctggcgtcggccggcatgcgcgtggtggtcacggccaccaccggccgggtgcacgaccgcgcggccgagctcggcggcggcgccgtcgggctggtcgccgacctgcgcgaccgcgcgcaggcgcagcggctggtcgacgccgcccgggccgcgaccggcgagatcgacgtgctggtgaacaacgccggcatggcgcagaccgggtacgcggaccggtccgccgaggtgggcgacctggacccggcggagttcgaccggcagctcgcggtcaccctgaccacctgcttcaacgtgacccggctggtgctgcccgggatgatcggacgcggccacggccgggtcgtgaacatctcgtcggtcaccgggccgctggtcagcgtgccgggccagtcggcgtacgcggcggccaaggccgggatggacggtctgacccggacctgggccctggagggcggccggtccggggtgacggtgaacagtgtcgcgccggggtggatcgcgacggcgtcgagcaccccggaggagctgcgggccggcgcggcgaccccggtggggcggccgggccggccggcggaagtggccgcggcggtcgccttcctggcctcaccgaaggccgcctacatcaccggccaggtgatcgtcgtcgacggcggcaacctgctcgacgaacgccgcgcctga

SEQ ID NO: 7238 - DNA, 105 bp, Actinoplanes utahensis
gtgctggcggtgcccaggcaggccttcagcatgccctacaccgcctggcccgacggtgcccgtctgctccacagcctgacccggtcgccggcatcgtcgtcctga

SEQ ID NO: 7239 - DNA, 945 bp, Actinoplanes utahensis
ttgcgtacacgcctgcgcaccattctggctaccgccaccgcactcctgctggcgccggccgtcgcgccgcagccggcccaggccgcgaccacggtccggctgaccgccatgcagtggaacgtcgacggcggctggaaataccagacgcccggcgcgtccgacctgctggtcgccaagatcttcgacacgatcaaggagaagaacccggacttcgtcgccctcaacgagatctgccagagtcagtacgccgccctcaccaagcggctgcagaacgagaccgactggccgcaggacaaggggaacttcgtccggttccaggcgacccgcaacggcacgaccgacgacggggacgtctgcgaccacaaggcggtcggcatcgcgctgctcagccggcagccgctcggcacggcgaaccggttcgcgctgaccccgaacccggatttcgacaaggacgagatccgccacctgctctgcgcaccgaccaccacgatgccggtccgctactgcgtcacccacatcaccccgaagccgttcggcacgatcgggaagatccaggtcaacgaggtgctctcgcacgtcgaggacttcgaggcggccggtgacacggtgctggtgggcggcgacttcaacgccacgccgagctggccggagctcaacgtctggtacgaccggagcgtcaacaccccggcgaacggtgacaacgtcggcgcgtaccgggagatggacgacgccgatccgtactgcctgggctacggcgaaggcaccaccggggcgaccaccggcagcccgtgcggcaccggcacgaagatcgacatgatcttcttccgggccaaccacctcaacggccagcacgccggtgacgcgctgccgatgagcacctgcggcagcgcgccctgctccgaccaccgcctcttctggggctgggccgacctgagcatcggctga

SEQ ID NO: 7240 - DNA, 114 bp, Actinoplanes utahensis
atggtcgtgggcgggccggtccggctcgcccacgaccgtctccggtcagctaccggcggtccggcgcggacccgggtccggctgagcgcgatcagtgccgcgccggcacggtga

SEQ ID NO: 7241 - DNA, 1215 bp, Actinoplanes utahensis
atgatcatgacggggacgggtctggcgttgcacgccacggtggggatgtcggtgctgatcggcctgccggtgacaggacgggcgaaggccgcggaagaacatcacggcgcggtacgtcgacggcaccggcccggcacctggctcctgatcgtcatcggactgctgtggctcaaccagatcgcgttcaccatctacgcccggcgggtccacggcggcgacctgggctacctcggcggctacgtgccgcaggggtggttccagctcgccgacggcccggtcgtctcctggctggtcgcccacacgccgcagccgcagctcctggcgttgtcggcgctgcggctgccgtcgctgctggagctgccgctggggatgctcgcctacctgaccatcgccgactggctcgacccgggcctgtaccggcggctcaccacgcccgccgtggtggcgttgaccagtgcctcgtactcgatcacgttcgggctgatcgagtgggcgatgcatacgacgtacaccatcgaagatcttgttctgcggttcgtctccggggtgctgaccgcggtggcgctgatccgtctggggcgccggccgtccgcgccgccgggcaccggggcgccccggaccgcccacgagttcctggtgttcgcggcgtcgaccgccgcgctcggccacctcatcctcggtctgtacgacagtgtgctgctctacagcctgggcagactgccggcgcacctgcccggcatgatcgccgacgtcgtcgtgatcgcggccgcccggttcgcggcggcccggctgcgccgccggccggtcacggtcaccgggcccggtctcgacacgctgatcaccgggctgtcctggtggctggcgctgttcctgattccggccatggcgatccggtacgagctcggcttcggctcacgcctgttcgccgcggccgcggggctgctcgtcatcggggtcgcgacggcggtggccctgcgcgaggtccacgaccggctgccactgagcgggcgtccggcggtgacccgccggtggctgctcgggctgggcgtcgcgggggtgccggcaagcgtggcggccctgatcggtttcgggctgcgcgttcccgggcggcaggagatccatctgctgaccgcggccggcctgttcgtcctgaccgccaccgtggtgtccgcgtcctgggaccggcgctggttcaccgtgccggcgcggcactga

SEQ ID NO: 7242 - DNA, 2364 bp, Actinoplanes utahensis
atgcgcgcggggctcgacacctcatacagtcactcgcttatcagccttttcacaggagatagcgttttgtcgcgaaaaatcggtatttgggtaggcctctgggccgtggtgatggcggtggccgtcgcggggccggccaccgccgccacccgacacttctatgtcgcgctcggcgactcgtactcgtccggcgagggcacctacctcgacgactccgactacgacgccggcaccggcggcgactgtcaccgcagccgcctcgcctggggccgggtgctggccgccgacacctccctcggtctcacgatggccgccggccggaactcgatcgccgggcacctcgcctgctccggcgccaccgtcaagaacatccgcgcgatcagccagcacaccggcctcggcacccagctcgcccagctggcggccctgccggtgcggcccgacctggccaccgtgacgatcggcggcaacgacgcggacttcgccgccgtggtccgaacctgctacctgtacggcggcctgaagtgcacgcaggcgatggccaccgccaagacgaagatcggcctgctgggcgactgcgcggccaacgacgactcgctcgggcggtactgcctgcgcgacgtctaccgggacatcaagcagcagatcagcggcggccgcctgatcgtggtgggctatccgcggctgttcgccaccggctaccgcgcggacggccggtgcctctgggccgcctccggggtcctggccaagctggacggcctgatcgccgacatggaggcccgggtgcacgccgaggcggacgccgccggagtgacctatgtcagcacctgggacgcgctgagcggccacgagctgtgcaccgagcactcctgggtccgcagcatcaccccggccagcgggcagaagagcctcagcgcccacccgctggcgcaggggcagcaggccatggccggcaaagtcgcgctctacctgcacaaccaccccttcccggccgagccttcagtccccaccccgacgccgaccccgaccccgacgcccacgccgaccccggtcaacagggcgccggtcgccgcgttcggctacacccggctgagcggcgcgggcaaccgcgtcaccctcgacggcggcgcctccgccgacccggacgggtcgatcgccacctggacctggacctccggcggccgccagatcgccaccggccgcaccgccacggtgtccttcgccggcgtcgccgccccctcggtgaccctcaccgtcaccgacaaccggggtgccccggggacggtcagccgcacgctgtcactgcagaaccgcgcaccgcggatcaccggcgtcaccccgcgggcgggcgcgatcgtcggcagcaccgtgccggacctcgccgtcgcggccaccgacccggacggcgacgacctgagcaccaccttccgggtcaccggccccgcggtcgacgtctcgtccggcccggtcggcgccacctggaccgtgcccgcgcaccgcctcgacccgggcgcccggtaccaggtcgcggtcaccgtccgcgacccgtccgggctcaccgcgaccgcgacgacctcgttcaccgtcgcgatgctgcccaccgccgccgacgtgaccgccacgtcgaccggcaacggctactggcaggtggacacgtacggtggtgtcttctcctacggcgacgccccgttccacggctccctgcccgggctcggcgtcaaggtgaacaacatcatcgggatgacccgcaccccggacgacggcggctactggctggtcggctcggacggcggcgtgttcgcgttcggcaacgccccgttctacggttcgatgggcggcaagccgctcaacggcccggtcgtcgggatggccgtcaccccgtccggcaagggctactggctggccgccgcggacggcggggtgttcgccttcggcgacgccggcttctacggctcgatgggcggcaagccgctgaacaagccggtcaccgcgatcggcgccacggccagcggccagggctactggctggcggccggcgacggcggcgtgttcgcgttcggcgatgccgccttctacggctcgatgggcggcaagccgctgaacgcgccggtcgtcgacatggacgtgaccccggacggcggtgggtactggatgaccgccgaggacggcggggtgttcgccttcggcgacgcgggcttcttcggctcgatggccggccagccgctcaacgggcacatcaccggcatgtcggtcaccccgtccgccggcggatactggctcaacggctgcgacggtgggatcttcgccttcggcgacgcccagttccacggatcgaacccgacctaccagtgccgcggtaactga

SEQ ID NO: 7243 - DNA, 615 bp, Actinoplanes utahensis
atgggggaggacgggcacgcggcggtgcgggacgcctactccgcgctctccggggtctacatcgaccttttcgggacggtggagcagtcccatcccgacgatgtcgcgttcatcgaacgccacctgaccatccggcccggacgggtgctcgacctggggtgtggccccggtcacctgaccggcctcctgcgctcgcggggtgtggccgcgaccggaatcgacatggtgccggaattcctcgcgtacgcgcgggcgacccacccggacggcgactaccggcaggggtcgctgaccagcctcgacgtggcggacgagtcggtcgccggcatcctggcctggtactcgctgatccacctgccgccggacgccctcgacgcggtgctcgacgggttccggcgggtgacagcgccgggtgcgacgctggtggtcggcatcttcgaggcgccggaactcgggccgttcgaccaccgggtggcgaccgcctaccggtggccggtcgacgcgttctcggcgcggctggcccgggccggcttcgacgaggtggagcgccagcggcggcccgccgacgcgacgacccggccgctcgccgcgctggccgcgacccgccgggcctga

SEQ ID NO: 7244 - DNA, 957 bp, Actinoplanes utahensis
gtgaggtcgggtgctgcggccggatattccggctatttccacgagtcggcgttctatgactcggacgagcggttcctggccgtgatcgtgccgttcttcaccgagggcctggcggcgggcgagccggtgctggcggcgttcgacgcgggccgtcaggagctggtgcgcgaggcgttcggcccgcgcagcggcatccggttcctggacggcgcgacgcagtatcggcgcccggccggcgcgatccgccgctatcgggagatcttcggggagtacgtggcgggtggcgccgcgcagatccgggtcgccggggacgtgccgcagccggcgaacggcgcgccgtgggactggtgggcccgctacgaggccgcggtcaatcgcgcctaccaggatttcccggtctggggcatctgtccgtacgacacccgcaccaccccgccggaggtggtcgccgaggtccgccgcacccacccgcacgtggtggccggcggcggccacgcggcgaaccccgacttcgaggatccggccgagttcctgcgcgcccgggccggatcctggcgcgatccgctggagcggcgcccgcccgacctggagttgaccgacccgaccacgccgcaggcccgggctgccgtccgggcggtggccgcgcccacccggctgcgcgccgaggatctggacaacctgctgctcgcggtgaccgaggcggtgaccaacgcgatgctgcacggccggccgccggtggtgctgcgggtgtgggccgcgccgcggcggctggtggcgacggtgaccgacgccgggacggggccacccgatccgtacatcgggctgctcccggccgaccgggcggtcggcaacggcggcctgggtctctggatgagccaccaggtgtgcagtttcgtcggcatgcaccgcggcccggaggggttcacgctgcgactcgtcgccggcgacctcgactga

SEQ ID NO: 7245 - DNA, 1728 bp, Actinoplanes utahensis
atgaaacgacgcggggccgggaatggtggccggagctggacacattctctgggggacctggtgcggcagagtgggcagcggcccggtgggcgggccacacgcgcggatctggcgcgcgccgcggtgctgatccggaccgcgtcgcggctggcccgcgtcgacaccccggacgacgtgctgcagatgctggccaccgacgcggtgcacgcgttcggggcccggtcgatcagcgcggtgatcaccgcgccgggtggtcccggattcctggccgtcgccggtgacggcgtgcggctgacccgcaatgaccggatcgcccggctcgacccggagtcaccggtggccgccgtgatgcgcgaccgctcccccgggcggcccgtcccggccggaccgctggtgctgcccatcctggtcgacgaccggacgctgggcgccatcgaaatcgacaccgacgacccggagctcgatttcctgtccgcgctgatcgcgcagttcgcccaggcctgggaccggaccgtggcccgcgccgacgccgaccgcgcccacgtccagttgcaggcgctcaacgacctgtccggccggttgggcagcgccgccgaaccggcccaggtgttccgggcgctgctcgacaccgtcgtgccccggctggcccgcggcgtgctgatccactatccgggcagcgacaaggtgccgtcgctgatcgccggcacgcacgccgaccggctgcgctggcagagcctggaggcggcggtcaacggcgatccggcccacccgcagaccaccgcaacgatcggcgaggtgctgcgcagcggggccagcgcgatcaccaccgtggacacggagtcgtggctggtcagcccgatgcaggacggcgtcgaccggctcggcgtgctgaccctggtgcgcgacgcagcccagccgttcaccgaccgcgacattccgttcgccagcgagtggagccaccgggcggcggtcgcgctggcccggatccgtgacgcgcagcggctgcgccgggtcgccgacgagctgcagagcggtctgctcccccgccggctgcccgcggtggccggcctgagcctggccgggcggtatcgccccggccggcgcgacctgcaggtcggcggcgacttctacgacgtcttccggacaggcggcgaccggctgtccgtggtgatcggcgacgtgtgcggcaccgggccggtcgccgcctcccgcaccgccctggtccggcacagcacccgcgccttcgcccgcgtgctgaccggccccgatcagatctgcgcggcggccagcgaggcgctgctgcagcaggaggagctgaacggcgcgttctgcagcatggcgtacgcgagcctgcgcaccggcggcgaccggatcaccgtcgacctggtgctggccgggcacccccggccgctgctgcgccacgccgacggccgggtctgcgagatcggcacctccggcaccgtgctgggggtggtccgcgacgtggcgtacacggtcacccgccaccacctgacccccggcgagacgctgctgttctacaccgacggcgccagcgaacgccgccacggcgaccgtttcctggctgccgacggcctgcgcgacctgctcgccgaggcgcccgccggctcggccgaggagctgctcgaccacctgatggaacggatcctcggcttcagcgaccagccgctcgccgacgatctggccctggtggccgtccacagtgaataa

SEQ ID NO: 7246 - DNA, 654 bp, Actinoplanes utahensis
atgaggctcacccgactcggcaagaaggccgccgccgtggccaccaccgccgtcgtcgccagcaccctcaccgccgcaccggccttcgctcacggcacggcgcagccgctgaagacccggtcgctggccgcggtcctcaccgcggacaagtccggcttcgaccgcaacggccgcgactacgacatcctgaccgccgccgtgcaggcggtgctgaaggcgaagccggccagcccggtcggcgtcctcgccgacggcaacaccgcgctgaccgcgttcctccccgacgaccacgccttcgagctcctggtcgccgacatccagcacagcaagcgcctgccgagcgagaaggccgcgttcaccgcggtcgccgggctcggcatcgacacggtcgagtcggtcctgctctaccacgtcgtgccgggcgccacgatcgaccgcaaggcggctctcaaggccgacggcgccaagctgaagacggcggccggcgccacggtcaccgtcgacgtgtacggcttctgcgtcaagcggatcgccctgatcgacgcggacaccagcgaccggaacccgcgggtcaaccgtttcgacatcaacaagggcaacaagcagatcgcccacggcatcgaccgggtgctgcgcccgatcgacctgccctga

SEQ ID NO: 7247 - DNA, 1071 bp, Actinoplanes utahensis
atggagtcacgccgacactctcaccgatcgtccccgggcgactccaccggtgccgccgaaccggcattcggaaataccgaatacgagaggccggttgaccccgacgtggaactccgtcatctgcgcgtcttcgacgccgtcgcccgcaccggcaccgtcaccgacgccgcggtgtcgctgggcatggcgccgtcgagtgtctccgaacagatccgcgccctggagaactccctcaccgtgtccctgttcgaacgccgcgccaccggcatgcggttgaccggcgacgggcaacgcctcgtcggctgggcccgccaactgctcgacctggcagaccgggcgaccgccgacatgacgggtcaacgatccgacgtacgactcggcgccctggagaccctcgtagccacctgcgtccccgcggtgctggcccggctcgctgaacgccggccccaccttcgcgtcggcatccagtccagcgccgaccggctcgccctgctcaccgacgtcgacgccggacggctcgacgcggctctgctgctggacaccggcagcaccctcggcgagctcggcttccggccgccggcggcatcgctacgcttcctggacctcgcccccgtcccgctcaccctcgtgaccgaaccccaccacgagctccaacgccgaccatcgcaccccaccagcctgcacggccagcggctgctcctcaacgcgccgaactgctccttcgccctggccgccgacaagctgctcggccccggccccgaacggaccttcgtcggctccctccccaccgcccgctcctgggcagaacagggactcggcgtcgccctcctgccggaattcgccatcgccgacgccgtccgaaacggaaccctcgccgtcctggacttccccctacccgcgctcacgctgcgcctcgtctggcgcgccgaccgcgagaacacgccccacgtccgggatctgctctacgccgccagtgcatacgcacccgaacgggcgccaggtctgacgcgaaggacagcaccgtcgtcatcccatcaggaggcgatcggcgatggtcggatcactcggtga

SEQ ID NO: 7248 - DNA, 1407 bp, Actinoplanes utahensis
gtggcggtgcgacgcggtattgcgctgtcgggtgtctcgctcggctatttcatggtcctgctggatatgacggtgctggctgtcgccgagccggacgtggcccgggcgttgcacgcgtcggtggccggtctgcagtggacgacgaccggctacacggtggtgttcggtgcgctgctgttgtccgcgggagcggtggccgaccggtacggcgcgcaccgggtctttcgtgccggggtcgcggcgttcgggctgctgtccctgctgtgcgcggcggcgccgacagtgtcggcattggtcgcgttgcgtgtcctgcaaggagcggcggcggccgcgtgtgtgcctgcttcgctggctctgatcgcccggttgtatccggatccggcgcggcgtacccgggcgatcggcacgtgggcggcgatcagcggggccgcggtcgccgtcggcccggtcgtcggtggtctcctggtggacgcgttcggctggcgggcggtgttcgtggtgaacgcgccgatcacggtcctcgtgctcgtgctggcctcgggtgcgtttctgcgatgcccggccaccgaccggcctgttcaggcggcggcccaggtcgtcctcggcgtcgcgatggccgcgggcaccgacgcggtgattgccgccgggcgggcgtcgtggctgcacgccggcggggcagcggcggtggcgatgctcgcggtggcggtgttcgcccgccgggaacggaccggcagcaccccggtgcttccccgcgagctgctggccggtcccggcatcccggccggcctgttcgtcggtgcggccgtcaacttcaccctcaacgggaccctgttcgtgctaccgctgctgctggtccaggaccgtcatctcgatgcggccggcaccggtctgaggttgctgccgttgaccctgccgttcgtcgtcaacccaccgctgaccggtcgcctggtgagccgtttcgggccgcgtccgccggtgctcaccgggctcgggctgctcgcggccggcagtgcggggctcgcctgggtggcctggtcgaccgccggggacgggtggctcgccgctgccctcctggtggtcggggtcggcgtgtcgctggtgctgcccgccgtggtcgccgtcgtgctcagcgccgcaccgccggccgccgcgggtgccgggagcggcctgctcaacgccgcacgccagctcggcgcgacggcaggcgtggcgatgatgggggcgctgctgcacaccggcgtccgcaccggcgccggcggtgcgctgttcctggccgccgtcgtctgtgcggtggccgcggcgtggttcggcttcggcggccggcggcgcggcggcccggagaaccggacaagattcgaccaaggacgattgccgcgtacgccatggcgatcttcacccgggcgatga

SEQ ID NO: 7249 - DNA, 1122 bp, Actinoplanes utahensis
atgggcttcagcgagatgccgcgcgaatccgagccactgtcaccgtggcgtccgtggaccttcgacgccgaccactccagcgaattcgacctgcccgtcatccgggagcccgatcgaccgttcgaccacgagtccgatctctccttcgaggcggagcccggaacgcatgacggcgtcctggccgacggcggggagcacgagagcgacctggcggacgggccgggatttcccgacggacacctggccgaccacgtctggatgacgaaagaggtcacgatctcgatcctcgcggacgccgtgcaggcgccggaggtccgccgggccacgctgaccaccgtgaccgatcgcgcgacgatcagtgacagtttctgcgtggtgatcggcgatcacggacagctggagtatcgggcgcgacgcgagatcggcaccgtcgagttcgctccggaccggctccgtgaggacctcgggttcatcgcccggtgggccctcgaccgtctcgtcgagaacccgggcaacctcctgctgaacggcatcttccaggccgccgtgtggggcgccatcgagacgccgtgcacccggacggtgttcggcaccggcaccgacggcccgatgcagatcgcggtcttcgactgcgcccgggtgatggtcggcgaccacgcgaaagccgtggttgccgaccatcgcagccaggaggtcgccgaggtcgacttcgcccggctcatccccggccatcccggcctggtgcgggcgctcgccgaggtgctcgccgacccgctggaccagggcctccgcgacgggctggaccgggccgcgcgggccgccgcggacgacttcgccccgggggacctgctcgacgcggcggcgaccgacggcggtgcgcggcgggggcggatcgactttcccggactcttcggcggcgaggtgaccgtcgacggcgtcatcggggccgtcatcgggacggacatcacgacgagccgctcggtcgaggtccgcatcgacgccatcgcgatcaccggcgactggggcggtgagatcgagccggccgcggccgacgagaggcgccggtggaacgagctcgagtggtttctcctgcaggaatacctccgcaaacgccggccgtga

SEQ ID NO: 7250 - DNA, 183 bp, Actinoplanes utahensis
atgcttgtcctggccgccgtcgcggggatcctgatcggcctgctcggcgggctgctcgtgggtcacaaccgcgggcgctggtgcccccgctgcggccgcacgctggactgccacgcctgccagcggttcccggccccgcgtccccgcgagccgcgcaatgccggccccgacgctttccgctag

SEQ ID NO: 7251 - DNA, 891 bp, Actinoplanes utahensis
gtgacagcttccgagacgaccggatccaccatcccccggcgcacactcgggctcgcgctgcgaaaggcgcgcgaggacgccgggatcacgatggcggcggcggccgacgtgatcggacagtccgtgcagagtctccgccgcatcgagcagggcaccgtctccacacccaagggcaaggtgaccctgttgtgcatgcactacggaattccgaaccagacccgcctggtgtacgagcagttggcgctggagacaagatccaaaggctggtggcagtccttcggagacgccgtgcctgcctggttcgagctctacgtggtgctggagcagaccgcggaccgaatccgttcattcgacccgctgctcgtgtccgggctgctgcaggagagcggctatatggatgcggcaattctggccgttgaaccagacctgaaagccgacgaagtggcggctcgcgcagaggtacggcgctcacggcaacggcagctgacccgttccttcccgcagcccccacaactggacgtcatcctcaccgagccggtcctgatggtcgatcttcccgaaggcgtgatgcgcgcacaactgtggcatctgttgaaggcaaccgaactgcctcacgtgtcagtgcgcgtcataccgctggcggcgggcttgcaccgagcgtccgttaccggcccgttcacgctcttggactttccgatcgaaggcggcaaccggccgccgagcacggtttacagcgagagccagaccggtgcgatctaccttgaccgcccacacgagatagaggcctacgagcgggtctggaatgggatcgacgccgcagcgctcgaccaggcgagatcggtaaagttgatgtcccagaggttgaaggagctgaacgatcgtgagtcttga

SEQ ID NO: 7252 - DNA, 216 bp, Actinoplanes utahensis
gtgagtcttgatctgtccggcgcggagtggcgcaagtcggcacgatccggcggaagcggccagtgcgtcgaggtcgccttggagctgccgagtgcgccgggcttcgtagcggttcggcacagccagcgtccgagtgccgaggtcatcgtctataccgacacggagtgggccgccttcctcggcggtgtccgcgacggcgagttcgacaagaagtaa

SEQ ID NO: 7253 - DNA, 216 bp, Actinoplanes utahensis
atgaccatcgatctgacggtcgccaactggcagaagtccacacgctccggcggcagcggagagtgcgtcgaggtggctcttaacctaccgaacgcgcccggtttcgtagcagtccggcacagccaccgccccgacgccgaggtgatcacctacaccgacgccgagtgggtggccttcctcggcggagtccgtgacggcgagttcgacaaaccgtag

SEQ ID NO: 7254 - DNA, 216 bp, Actinoplanes utahensis
atgccggaccaggcacgacgggaacgatggccgggcgcggtccgcgggaacggctaccgcggcgtcgtgccgggagcgaggttggccgaccagcgttcctcgacgcggccgaatttccagatggcgatcgcgagcagcccggtccgcgcccagaccgggcagagcatggacgacctgatcaaggaactcaccctgctgatggccgaccccccgtga

SEQ ID NO: 7255 - DNA, 1446 bp, Actinoplanes utahensis
atggccgtgacgcccgatctcgccgtgcccgaaaccgacccgacacccgtgaaatccggccggcggccgtccgccttcggcgctctgctggtgcgtctgcacttctacgccggcctcctggtggcgccgttactgctggtcgcggcgatcaccgggatgttgtacgcgttcatcccgcaactggaacacctcgcctaccgcgccgagctggtggtcaccgaccccggcggcccggcgctgccactggccgagcaggtcgcctcggcccgggcggcacacccggccggggatctgctcaccgtacggccgggggaggggagcgccaccacccaggtggacttcagcgacgccgcactggacgccgaccaccagcacacggtgtacgtgaacccgtacaccggccgggtcaccggtcagctcaccacctggtgggcggccaccccgctcaccgagtggctcgacaacctgcacgccaatctgcacctgggcgagaccggcgcgctctactccgagctggccgccagctggctgtgggtcctcgccctcggcggcgtgctgctgtggtggcgccgccagcgggaccggaagcggcggatgttcgtccccgacctgaccgcccgcaagggcgtgcgccgcacccgcggctggcatgccgccaccggcctgtggatcaccgtcggcctgctgttcctctccgcgaccggcctgacctggtccaaccacgccggtgccaacttcaccgcgttgatcgacgcgatgaactccagccgcccggcggtcaccaccgacctgaccggcaccgccgccgccagcggcgggcaccacgccgcaatggcgatgggtggcgcggacggcggcacggtcgacccggcggcgatcaccggcgtgtacggcgcggcgaccgccgcgggcctgtccggaccactgtcgatcaccgtgccggccgacccgaagaccgcctggagcgtcaccgagatcgacagccgctggccggtcggccgggacagcgtcgccgtcgacagcaccgggaggatcgtgcagcggatcgacttcgccgactggccgctgctcgccaagctcacccagtggggcatctacgcccacatgggccagttgttcggcctgcccaaccaactgctcctcgccgccctcgccctcggcctgatctgcgtcatcatctggggctaccgcatgtggtggcagcgccgcccgacccgcgccgcccgccgcgccccggtcggcaccgcgccggccggcggcaactggaccggcctgccggcgtggacgatcgtcatcggactgccgctgctcttcgcggtcggctggttcctgccgctgttcggcatcccgctgctcgccttcctggccctcgacacgatcgccggcctgatccggccacgtcgcggcccggccgtcccggtcagtccggccccggccggccggtga

SEQ ID NO: 7256 - DNA, 657 bp, Actinoplanes utahensis
gtgacggtgactcaccatcggttcgacggcatgctcggcgcctggctgcgcgcctggacccggtcccgcgggacgccggtcccggagacggtccccggcggctggcgtgtcgacgtcggactgcccggccaccgccagcggtatctgctgcacacctacgaccggcggtccctgtccgacctggcccgccgggagagcgccccgggcacctggatcaagacggccggcggcgaggccgacctgcacgcggccgtcccgcccgggtgggagcgcgccgacacttaccagttcatgacgatcaccttcggcgcgcgcccactgacgctgccatcgacgtacaccatggcaatcgaccgaaccggtccgctcagcaccgtcacgatcatcggcgagcagggggatgttgccgcctcggggcggctggtggccgacggtgcattcggcatggtcgaccggatcgagacggctgccgggcaccgccgccgcggcctgggcaccgccgtgatgaacacgctggcccgggccgcgctcgacggcggcgcccgcaccggtgtcctgatcgccaccgacgacggccggcagctctacgagtcactcggctggtccgctcgcgtcccgatcgccgccgccttcgtccccgaagtcacggactcctga

SEQ ID NO: 7257 - DNA, 426 bp, Actinoplanes utahensis
atgcgcgggaatcccttcagcgaggctgtctgggcgctgttccggggcgtgatcgggctgctgttcgccctgcacggagtgtcgacggtgttcggcgtcttcggcggcaaccgcggcagcgggcacgcggcggcggtgggcagctggcccggctggtacgccggcgtcatccagctggtctgcggcctgctcgtgctggtcggcctgctgacggtgccggccgcgatcctggcctccggctccatggcgtacgcctatttcaccgtgcaccagccgcacggcctgctcccgttggagaacggcggcgacgcgccggccctgttctgctgggcgttcctggccatcgcggtggtcggcgcgggccgctggtcgctcgacgcgctgcgccgctcgcggacgccgtcgctggagacggtcgacgcctga

SEQ ID NO: 7258 - DNA, 759 bp, Actinoplanes utahensis
atgaacctcgcgcgtcctagctcccttaacgacgcagcgcccggtaaagccgttggcgtcacgcgggccgccgcctactttctggtgatgcgcccacaactgacgaccctgaccgttgaagcacccgacccggccggaccgggccggttctgggccgccctgctcggccgcgagatgatcgtggacgccgccggcgtgcgcctgccgggcgacgacacccaggtcgggctgcggttcgtggccggccgcgccggccggctcggcaccaaccgcatccacctgcacctgaccagcgacgacccggacgatcagcagcggatcgtggcggccgcgctcgacctcggcggccggcacctcgacgtcggccagcgtcccgaagagggacacatcgtgctcgccgacccggcgggatacgagttctgcgtgatcgaacccggcaacgacttcctggccgggtgcggcccgctcggcgaactggcctgcgacggcacccgggaggtcggcctgttctggagccgggcgctgggctggccgctggtctgggaccaggacggggagaccgcgatccagtctccgcacggcggcaccaaaatcgcctggggtggcccgccgctgcgcccgaagaccgagccgagccggcagctgttcgagctggtgaccgactcggtcgacgaactgctcagcctgggcgccacccggctgggccccggcctgctcgccgacccggacggcaacgagtttcggatccggcccgcctga

SEQ ID NO: 7259 - DNA, 999 bp, Actinoplanes utahensis
atgagaatcccccgtccgttctgggccgtcagcgccgctctggtgctgatcggcgcgggcatcgtccacaacgcgtcacccgcgtcggcgttcccggccaccccgaagtccaccgtcatcaactacctgaagtcgatcaccggcacctcgatcgtctccggtcagcacaacaaggaaccggccagccagcccgcgcagtacaccgcacaggtcaaagccatcaccgggcagtaccccggcctgtggggcggcgacatgatgttcacctccaccgacatcgccaaccggcaggccgtgatcaaccaagccaggaccgagtgggccaacggctcactggtggcgctcacctggcacgcctgctcccccaccgtcggcgccagctgcaacttcgacggcggcgtgaagaccagcatctccgacgcgcagttccagcagatcgtcacgcccggcaccacgctctacaacacgtggcgcagccggatggcggcggtcgtaccgtacctgaagcagttgaaggacgccggcgtgccggtgctctggcggccgttccacgagatgaacgagagctggaactggtggggtcaccggtcgggctcgaacggtagcctcaagctctatcagcagatgcgtgactacttcaccagccagggcctggacaacctgatctgggtgtggaacgtgcaggacaacccggccggcggctggggcgacttctaccccggcagcaactacgtcgacgtggtcactctcgacgcctggtacaagagttacccgtcgtcggcggactactcgcagatccagtcgatcgcggccggcaaaccgatcgcgatcgccgagatgggcaaggtcccgaccagcagcctcttgaccagtcagccgaagtggacctacttcatgatctggtccgagcagctgcgcggcagtaacaccaacgccgagatccagacggcgtacttcctgccccgcgtcctcaaccagggcgagatccgcctgagctga

SEQ ID NO: 7260 - DNA, 966 bp, Actinoplanes utahensis
atgaaaagatctttcgcctacgtggtggcagccttgtcgttgtccggaatgctcgggtcacccgccgcggccagttccggtcactcggcctgccgacgcgcggccggagcgggcgagcagaccgtcggggtcaccttcgccggcaccgaatacccggtgaccgtctacgtccccgtcggagtgcggccgggcaccaggctgcccgcgatcctcaacctgcacggaacgcagagcaacggtagcaaccagctgcattacagcgacatggcagccgcggccgacgccggccgtttcctggtcgtggcgcccagcggcaacatcccggccgctggcggtttcgcctggaacgtgcccggcgtgggcactcccccggccggcgcccgcgacgacgtcggcttcctcagcgaggtgatcgccacagctgtgcggtcgctctgcgccgacccggcccgcgtctacggcaccggctactccggcggcggccggatgatctcggcgttcgcgtgtcaccgtgccgaccggatcgccgccatcgcgccggtcgccgggctgcgcgccgggcgacccgacccactcgacaagaccagacccgacccggcgtcgtgccagcccgtgcaacccgtaccggtcctcaccttccacggccagcaggaccacaccaacccttaccagggcggcggctcggaatactggagctacccggtcccggtggcgcagcagcggtgggcgcagctcgacgggtgccgcggggcggctcggacggtcgcggtcagcacacacgtgacgcggacgtcgtaccggaaatgtcgctccggaagtgaagtcaccctctacaccgtcgcggacggcgggcacacctggcccggcaccccgatcgacaacggcaacggcatggtgacccaggagatcaacgccaacacgctgatgtggcagttcttccggcgccatagacttcgcagtttctga

SEQ ID NO: 7261 - DNA, 1059 bp, Actinoplanes utahensis
atgcgccacgtccggcggcactggcggctgcgccgggcagcgccgccgcgcacggccgtgaccgacgccgagctgaccgccgatcccggcgccgacttcgtcgacctgaccatcaccgctctgcacctgtccggtcagcgccgcgaggtcgccgaggccacccgctggcgggaacccgacgatcgggagctgttgtcgctgtggtggctggaggcggccgggcaactcaccggaccagaactcgcggccgcgctcagcctgacgccggcccaggcggcggtgcgggtgcagcggatgaaagcccagctggagagggcccgctcggtcgtccgggcggtgtccgcggtgccactgtgcccactgctcagtggcgcgacccgcgactggggcggccgcccggccgggctgtggggcaagcggatcgcccggcacctccgcgagtgcgcgacctgcgatcgcgcgctcgcggacgtgatcccggccgagcggctgttggccggcctgccgttgctgcttccgcctcgcgtgttcccgccactgcgcgggccgcggcacaccgcccgtcggtggctgcccggcgtctccggcgccgcggtggtgctggtcggggccgtggccggggtcgtgctgacccggtcaccggagcggacgccggtccctcaagcgcggacagcaccggcagccacggccgcggcgaccaccaccgcggcgaccaccaccgcgccggcatcacgcccgcaccggtgtcgccgtcgacaccgagccggactccggcgaagcagccgccgtaaccaacgccccgtttcccgtccgggccgcgttctactatccctggtacggcgagaacttcaccgaggtcggcacacacttccactcgtcggcaggccggcattcggtcgacgacccagccaccgtcacccgccagatcgaagacatgaggtacgcggggctgcaagccggcatcacctcgtggtgggaggactcatgctcgtcaccggccagcccaccacaagaagtgaaccccgtcgcacgggtggaagcacgatttcagggcggtga

SEQ ID NO: 7262 - DNA, 1791 bp, Actinoplanes utahensis
gtgccgcgaccacggcccgacgcagtgatcgccccgctcgacacgtcattcgacggcagccggccgctacgcaccacatggcggctgctggcgcccagccggtggcgggtgctggccgctctgctcgccttcgggatcaaggacagcccggtctggctgctgccgctgctcaccgccggcatcatcgacgtcgtcgtggaacaccggccgatggggcaactgtggttcaacgcggccgtgctggccgtcgtgctgctgcagaatctgccggtgaccatgctctgggtccggctgatgagccggatcgtgcgcagcctcggcacccggctgcggtccatgctggccagccgcctgcagcacctgtcgatcggctaccacaccaggaccggcaccagcctcgcgcagaccaaggtcgtccgcgacgtcgagaacgtggaactgatgctgcagcaggtcacccagaccggcgcttcggcactgttcatcctgctcggcgcgctcaccctcaccgcgttgcgagtaccgcagttcgtcggcgtgttcctgctggtcgtgccggtggcggcgggcctcgtcgcggtggtgcgccgactgtcgggcgcccgcaacgaacagttccgccggcggatggagcagctgaacgctcgcgtcggcgaaatgtccacgttgatgccgatcacccgggcgcacgggcttgaacaagtggccctgcaccgggtccgtggaacggtggaggaggtcggcgcggccggcttccggctcgacttgatcaacgggcggctcggcgcgctgtcctgggtctcctaccagttgctcggcgccgcctgcctggtcggcgcgggctgggccgcgtacaccgggatgctgcccgtcagcgccggcgacgtggtcctgctcagcagctatttcgcgttgctgacctcggccgtcgtgatgctgttcggcctcgccccgatcatcacccggggcctggagtcgttgcgctccatcggcgaagtcctacaagcgccggacatcgagcacaacgagggcaaacgcgtcgtcacccaggtgaccggcgcgatcgagctgcgcgatgtccgatacggcttcgacccgcagccccacgtcgccccggccgtcgacggcatcgacctgcgcatcacgcccggtgagacgatcgcgctggtcggtgcgtccggggcgggcaaatccacggtgctgaacctgttgctcggcttcctgcggcccacgtccggaagcatcctgctggacggagtggaaatggaggagatcgatctgcgtacgtaccggcggttcctgtccgtggtcccgcaggaatcggtgctgttcgacggcacggtgcgggagaacgtcacctacgggcgtgcggacgtgccggcggcgaccgtgcgggcggcactgcgggacgcgaacgcgctggatttcgtggagcagcttccggccggctgggacaccgtggtgggggaacgcggcgcccggctctccggcggccagcggcagcggctggcgatcgcccgggcgctggtccgcgacccccgcgtgctgctgctcgacgaggcgacctcggccctggacggcgagtcggagcagcaggttcagcaggcgctggcccgcctgatgcacgggcggaccaccgtcgtcgtggcgcaccggctgtccacgatccgcaccgccgaccgggtggcggtgctggacgccggccggatcgtggagctcggcacacacatcgaactactcgcccgcggcggcgcctacgcccggctgtacgccgcccagtcaccgccctga

SEQ ID NO: 7263 - DNA, 138 bp, Actinoplanes utahensis
gtgcgcaaggcactgctcaccccggtcatcgccggcaacatccagacgacggcgccgggcgacgaagcggttaccgccgcagcgatccgcaccgggaagtacctggccgagtgccgcgaccacggcccgacgcagtga

SEQ ID NO: 7264 - DNA, 2481 bp, Actinoplanes utahensis
ttgagactgctgcgtgccgcgacgatcgtcctcaccctcgtgaccagcgtgttcaccgttccgtccgccgcctacgccaccccaccacgtcagggcttcgtcacccgcgccggcgcggaactgcggctcaacggcaagccgttccgcttcgccggcaccaacgcctactggctcggcctcgacgagaacgtgggcgggatcgactaccccacctatttccgcatccgcgacgcgatcgacaccgccaagggcatggggatgaccgtcatccggtcacacatgctggtgtcctccggccaccccaagacgctgctgccgtcgaaggagaccggctacaacgacgacgccttcaaaaccatcgactacgcgatcgcgtacgccggtcaggccggcatccggctgatcctgccgctcaccgacaactgggcgtactaccacggcgggcacgccgacttcaccaagccgtacgggctgcccgacgccgcgttctataccgacccccgggtcatcgcggactaccaggcctacgtctggcacgtgatgcagcacgtcaacccgctcaccggcaagcgctacatcgacgatccgacgatcatggcatgggagctcggcaacgagctggaaggcatgaccccggagtggatcggcgccaacgccgcgaccttcgccggctgggcaccccggcaactgatcgccgccggccgccggttcgacatcgacccggacaccctcggcgccgccgccgtcgacatcgtcgacgtgcactactacccgccgaccgcggccaaggtgcaagccgacgcggccaccgtcgccgcggccggcaaggtctacatcgccggggagtacgcttcgaccgccgccggcagtgccctgcttgaccccctggtcaccgaccgcaacgtcaccgggatgctgtcctggtcgctgttcggccaccacgaccgctccgggttcgtgcagcacgacgacgggttcaccttccactaccccggcgacgacgcgcggatgaccgctgccaaccaggcgcagatcgcgtacgcgaaagccctcggcgcctcgatccccaagcagcccgccggtaccccgctgatcactgcgatcgacaagcgcggcggcctcaatgtcctgcaatggcgcggcgccgccggcgccgccggctaccgggtggaacgcgcgccgaccgagcgcggcccctggcagcccgcctacaacgggctgctcaccgacgacgacaccccgtggaccgacctcaccgcgcccggcaacgcctggtaccgcgttgttgccggcaaccggcggtcgcagccgcagtacgtcggcgccaccgacaccgtgctggtcgacccgctggagagcttcggcctgaccagcggccacaccggcgtggagattcaccccggcaccgaccacgccaccgtgcggccgaccggcaacgggcccgcctgggtgagctggcagcacgccggaacccgcaaggtgcggttcgacattgccgcagaccggcaccacgatctggcgatccaggtctccgatgacggggtgatctggcgcaccgtcgggtcgcacgccgaccgggactcggtcacggcggccacggccggctccgcccacgtgcgggtcctctggaccggacgggggcgcgccggcatcaccggtgcgacgttctgggcggccgaccccgcgccgatcaccggccggcccgcggccttcggggtgaccgcgccggccgccggagccaccgacgtgatcggcccggaggccttcgcctgggaaccgtcggcgggtgccggctactacacactcaccgtctcgcggcatcccgacctgagcgacccggtgctcaccgcgaccgggctggccaccaccactcacaccccggcacacgggctcgacccggccaccacctggtactggagcgtccgcgccaccaatgcggccggcagcagcagcaccccggtcgcctcgttcgccacgcgggccctgccgtcggcgccggccacgatcgacgacttcgagggatacgccgacagcgccgcgctcgccgccgcctacccgcgcaacaccggtggcgacgtggtgacacccacgctgatcccggcgtcctccggtagcggtcacgccatgcaactcgacgtgaccgcgggcagctccggctacgcgggcgtcagccacaccttcaccaccccggtcgacctgtggggacaacagggcatcgaactcgtgctgaaccgctccgcgacccaggcaagcatcacccttcagttcgtcgccaacggggtctactgggagcacaccctcccggccggtacgccctccggcgtcgtccgggtgccgttcacgtcgttcgcgcagccgccgtgggctccgtccggggcgctcgacctgcggaaattcacccaactgtcgatctacctcggcggcagcgactccggccggctgaccgtcgacaacgtgtccgcgtaccccgccggacagtga

SEQ ID NO: 7265 - DNA, 2394 bp, Actinoplanes utahensis
atgacctcagtgcaagacctggccggctcctgggagttgcacggcgacggcgtcgacctccccgccacggtgcccggctgcgtgcacaccgacctgctcgccgcgggtcgcatcccggacccgttccaggacgacaacgagcacgcggttgcctgggtgggccgcgccgactggacctaccgccgcgaggtggcctggaccgggcctgcgcacgaacggatcgacctggtcttcgagggcctcgacacggtcgcgaccgttgaactcggcggcaccacgctcggctcttcccgcaacatgcaccgcagtttccggtacgacgtgaccgatctgctcgacggtgatccgcggccgctggccgtccggttcgagtccgcctacaccgaggccgaacgggtccgcgagctgctcggcgcgcgcgacaacgcgtaccccgagccgttcaacttcatccgcaagatggcctgcagcttcggctgggactgggggccgacgctggtgaccgccggcatctggcgcccggtccgcttggaaggctggagcacagcccgcctcgccgaggtccgccctctcgccacctacgccgacggcctcggccggctcgacctcaccgtcggcgtcgaacggacccgagatcgcgatctgcacgcgcgggtgctgctcgacgggtacgagatcgccgtactggagatccgggatggggaaacggtcgcgcaagcgatcgtcgatgccggggcggtgacgccgtggaatccgcgcgggcacggcgaaccggctctctacgagctgagcgtcgagctgctcgacggcgacaccgtgctggaccgctggcagcgccgtaccgggttccgcacggtcgcgatcgaccagaccggtggcgggttcgtgttccacctcaacggcgcgccgatcctggtcaagggcgtcaattggatcccggacgacatcttcccgtcccggatgacccgggcgcgctacgagcttcggctgcgtgaggcggccgacgccggcgtcaacctgatccgggtgtggggtggcggtctctacgagagccgtgacttctacgaggtctgcgacgagctgggcctgatggtctggcaggacttcctgttcgcgtgcgccgactatcccgaggaggagccgctgttctccgaggtggtcgccgaggcccgggagaacgtcgcgcgcctcgccccgcaccccagcctgatcacctggaacggcaacaacgagaacctgtggctgcacctggccatgccgtggaacgccgacggcaagtacgagacctggggttcccgctattacctcgagacgctgcccgagatcgtggccgagctcgacccgacccggccctaccaggccggcagcccctggtccggctcctgggaccacgcgcccaacgacaccgagcacggcaccttccactcctgggaggtgtggaaccgcgaggactacctcaactaccgcaactcgacgccgcggttcgtcgccgagttcggctggcaggcgccgccggcgtggacgacgctgcgcgacgcggtctccgacgagccgatgctgcccgactcgcccggcgtgctgcaccaccagaaggccgaggacggcaacggcaaactggcccgcggcctcgccccgcacttcggcgacccggcatcgctgagcgtcgaggcctggcactatctgacccagctcaaccaagtccgtgcgatccggaccggggttgagcactggcagtcgcactggccgcacaccggcggcagcatcctctggcagctcaacgacctgtggccggtcacctcgtgggccgcgatcgacggcgcaggccgacacaagccgctctaccacgcgctgcacgagctctacgccccgcgcgcgctcaccatccagccccgtgaccgtgccctggtcgtggcggtgctcaacgaccaccctgccgcgtggaccggaaccgtgctgatcgagcggcaggacaccggcggcgcggtgctcgcctccaccgtccagcacgtgtcggtggccgcgcgatcggtgaccctgatcccggtgcccgccgacctggtcggcgaggtgctggtggctcgactcgacgacgctcgcgcgctctggttccccaccgaatactcgtccgacgacccggcgctcaccatcgacgtcgagtccgtcccgggcggtctcgacgtgcacgtgcgcgccgtcgggctggcccgcgacctgctgctgcagcccgatcggatccacccgcaagccaccgtcgaccgcggcttcgtcaccctgctggccggcgagtccactgtgttccacgtccgcgcaccgatcgagctcgaccccacgctggtcaaaaccccgtgggtgctcaccgacctctcctccgtcctgaaccggggtaagaattga

SEQ ID NO: 7266 - DNA, 906 bp, Actinoplanes utahensis
gtgaccactgcgacccgcacaccccggcacgcgtccccgaggccgccggccccggtcaagcgcggtggcggccgcgacctggccgtcgcccggacggcgaccaccgcgaaatacgtctccctggtactggcgtcgctggtggtactgatcccgctggtggtcgtcctgttcgcctcgctcaagacgcacgtcgagtacaacagcaccggcccgctcacgccgccgcacaactggctgaacttccacaacttcgcgaccgcgtggaccgcgggggacatgttgcgcggcttctggaacaccaccttcatcctggtggtgtcgctgaccggcaccgtcgcgatcggcacgcttgcggcgtacgcgataagtcgtttcgtctttcccttcaagcgcctggtgctgggcctgttcctggtcgccgcgttggtgcccggagtgaccacgcaggtggccacctatcagatcgtcaagtcgatgggcctggtcaacacctcatggtcggccatcgtgctgttcatgggcaccgacatcgtgtcgatctacatcttcatccagttcatgcagtcgattccgcagagcctggaccaggccgcgatgatcgacggcgccggccggttcaccatctatcgcaaggtgatcctgccgctgatgaaaccggcgatcgccaccgtcgtgatcatcaagggcatcgccatctacaacgagttctacatccccttcctctatctgcgttcaccaaacctcagtgtcatctccaccgcgctgttccggttcaagggcccctacggagcgcagtgggagaccatcgccgcctgcacgatgatcgtcatcgtcccgaccgtggtgatcttcctgctgctgcagcgcttcatctacaacggcatcaccgcgggagccacgaaatga

SEQ ID NO: 7267 - DNA, 936 bp, Actinoplanes utahensis
gtgacgagccaggtcattcccggtgcccggcccgccaccacggcgggccgggcggccggcaagccccgccggcgccgtttctggcagaccccctacgtgtacgtcgcgccggcgctgatcctgctgatcgtcttcacgtacgtgccggtcggcaacatgatctggtacagcttccacaagtgggacggcctggacgtcaccatggacccggtcggcctggacaactacgtccgggtgttcaccgacgagcagtactggcacgtcttcctgatcagcctctactacttcgtcgcgtcgttcgcgcagatcgcgatcgccctgtacttcgcggtggtgctctcgttcaaggtccggttcaagaatctgttcaagggcatcctgttcttcccgtacctgctcaacggggtcgcggtcggcttcgtgttcctctacctgttccagccggacggcactttggacacgctgctcggtgcggtcgggctcggcgggcacacccagctctggctcggtgacccggacattgccaacatctcgctggccggcacctcggtgtggcggttcaccgggcttaacttcgtgctgttcctcggcgcgatccagtcgatcccgggcgagatctacgaggccgccgagatcgacggggcgaaccggtggcaccagttccggcacatcatcgtgcccggcatccggcggatcatcagcctctccttcatcctggcgatctccggcagcctcagcgtcttcgagatcccgttcatcatgaccggcggcgcgaacggcacccgcacgttcgtcgtccaggcctatcagacggcgttccagttccggcagatcggcttggcctcggccatggcggtcgtgctgctgctgatcgtcctgctgatcacctgggtgcagcgccgggtcctgcccgacgaggaggtgaccctgtcgtga

SEQ ID NO: 7268 - DNA, 1314 bp, Actinoplanes utahensis
atgatcaatagaaggacgttcctcggcctcggcacggtcgcggccctggcgctcaccgccgggtgcaccggcggcgcgagcgacgacaccggcaccagcggcgacttctccggcgacatcaagggcaacatcactgttctgaccaaccggaccgacctggtcagcacgacgctgccggaatacgccaagaagttcgaggccaagtaccccggtacgaaggtcaccttccagggcgtcaccaactacgacgacgacgtgaccacccagctcagcagcggcgactacggcgacgtgctgatgatcccgggcaccgccgccgtcgaccagtacagccagttcttcgagccgctcggcacccaggacgagctcaaggccaagtaccgattcctcggcccggccacctacaacggtcaggtgtacggactgtcggtcggcggcatcgccaagggcttcgtgatcaacaagcggatctgggcgcaggccgggatcaccaccccgccgaagaccccggaggagttcgtcgacgggctcaaggcgatcgccgccaagaccggtgcgatcccgtattacaccaactacaaggacggctggccactgggggagtggaacagctatcgggccgttctcggcgacccggagatcaacgagaagttcccggccgatgccagcccctggcagcccgggaagatccagtacatcaccgacagcctgctctacgacatcgtgcacaacaagctcagcgagaaggacccgctgacgaccaactgggagagctccaagccgatgctcgccagcggcaaggtcgcgaccatgctgctcggctcgtgggccgtcccgcagatccaggaagccgccaagagtgccaaggcggacccggccgacatcggcttctggccgttcccgtaccagaccggcggcaagttccacaccgccatcgacggtgacaagctcgccgcggtcagcaagaactccaagaacaaggcgaccgccaaggcctggctcgacttcttcgtcaacgagtccggcttcgccgccgaccagcaggccatcccgccggccgtctcccagccgctacccaagggcctgcaggagttcaccgccaccggcgtcgagctgatcgaggtgccggccgccactacgaacgccggcaaggaggacgagatcatccggacgtcggagatcgacctgaagggcccgatctaccggcagaagctggtcgacatcgcgcgcggcgccgccaagggtgacaaggagtcctacttcgccgacctgaacaagcggtggagtgccgcccagagccaggtcatgaagtga

SEQ ID NO: 7269 - DNA, 216 bp, Actinoplanes utahensis
atggcacgtcgagaagcgcccgccgcggggcccggaagccgcgccctgatcgtcgacgtcatccgctccgcggtgaccatcagtcggggtgagctcgtcgacctgaccggcctcacccagccgtcgatctccaacatcgtgcgcgagctcatcaccgacggcatcattcacgagatcggctcgctcgactcggcgcacggccggctagctagctag

SEQ ID NO: 7270 - DNA, 852 bp, Actinoplanes utahensis
gtggtcggccgcgaggtcgtccccctgctacccgatgaaccgtggcacgccgaccggctggccgaccggttcgagcacttcaccgccggtctcgacctgccccgggaccgcatcgagggcctggccgtcgtggcgcccggcgcctggccgcccgaagtgcgccctggcctggtggaccgcatcggggtgccggttctcgtcgagaacgacgcggcggccgcggcgctcggcgagttctggagccgccgggtctcccgcgaccaggtgttcggctgcgtctacctgggcaacgagatcagcgccgggctggtcttcggcggcgcgctgttccgcggcgccagcttcggcgccggagcgttcggccacatgtcgatccaccacgagggccgcccctgcccgtgcggcaaccagggctgtctgcagcagtacgcgtcgacccgggcgatcgtcgaggctgcccgcgaattgccggagctgcgggcccggctgcccttggacggcaccgagtccgccgcgtacgaggcgatcgcgcgggccgcggtcaacggcgacacggatgcctatgccgtactggatcaggcggccgggtggctcagcacggccgcgacctcggtggtcaacctgctcgatctcggccggatcgtgctcaccgggccgggcgtcgcgctcgccggatcgatcttcgcccgccggctgcgcacccacctggaccggaccgcgcactcccggcaccagcacagcgtgaccgtcgagatctccgcccagccccgcgacgccgccggtatcggtgccgcggtgctcgtcatccaagcgtccgtcgcacccggccacaccccaggacgctcctcatga

SEQ ID NO: 7271 - DNA, 870 bp, Actinoplanes utahensis
atgagaaacattcccaagatggaggaaccagtgacaccacggccacggcgcgtcggcctcgtgctggcccgggcctcgcaggtgctcggcgaggaaccgtactaccacgaattcatcgagggcctggaacggctgctgatcccggccggaatctcggtgctggtcaaagtggtcaccgaccacgccgctgagaaggccacctacgagcagtggtcggccgaacagcgagtcggcggcgtcatcatggtggacctcagccccggcgacgaccgcgtcgagctggtccgcaagctccgcctgccggccgtcgtgatcggcgacccgtccaccgcggacgggctgcccaccgtctggaccgacgacgccggatcggcgcgcgaagcgatccgcttcctcgccgaccgcggccacaccgtcgtcggccacgtcagcggaccacgctcgctcgcacacacccagctgcggctcggcggcttccaggccgaggctgccgcccggggcgtcacgctgatcggtgccgagggcgactactcgcaggagtccggccgggtcaccaccgcccgattactggccgcgcatccggtcccgccgaccgcgatcgtctacgacaacgacgtgatggcgctcagcggactggagacgatgatcaagcggggcctccgcgtccccggcgacctctccgtcgtggcctgggacgactccgcgcagtgccagctcgcccggccggcactctccgcgatgagccacgacgtcggacggatcggcgagatcgcggccaccgccgttctcgacgcgatgcgccagaactcggcagacaacgtctatgaggcgccccaggcccacatcgtcgaacgcgacagcaccggctga

SEQ ID NO: 7272 - DNA, 1200 bp, Actinoplanes utahensis
ttgagcaccacacctccggcggacaccgtccagcgtctgctcgacttcggccgtgccttcccccatccgctcggcggcgcggcctggctgcggaccgacggaacccccgatctcgacgcacccgtgcacacctggatcaccgcccggatggcgcacgtctacagcctgggcgacctgctcggcgtaccgggagccggtccgctgaccgacgccgcgctggccggcctcaccggcgttctagctgaccgcgagcacggcggctggcacccctcggtctccccggacgggctgccagccgccggaaagtcgtgctacgaccacgccttcgtcgtcctggcagcgtcgaccgccaccatcgcccggcgtccgggcgcgccggccctgctgaccagggcgctcgacactctggtgcgccacttctgggaccccgtgcaccagatgttcgccgacgcctgggacaccggctggcagcgcctcgacgactaccgggggctgaacgccaacatgcacgcggtcgaggcgatgctcgccgcgtacgacgccaccgggcggacagactgcctggaccgtgcgctggcgatcagcgaacgagccgtcagccgggggcgagaacacggatggcggctgccggaacacttcgacgcgcgatggaacgcgcggctggactatcaccgggatcggccggacgacccgttccagccgtacggggcgaccgtcgggcacgcgctggaatggtcgcggctgatcttgcacctggaagccgcgctgggcccggcgtcaccggactggctgctgccggccgctcgagccctgttcgcccgggcggtcgaggacggatgggcggtcgacggcgcacccggcttcgtctacaccactgactgggacggcacgcccgtggtgcggcaacggatgcactgggtcgcggccgaggcgatcgcggccgcggcagcgctgcacacacgtaccggcgaagaggattttgcccggtggttttcgatctggtcggactatgtgcgagggaacttcgtggacgtgcaacagggctcgtggtggcacgagctggacaccgacaaccagccggccgcgacgacgtggtccggcaagccggacctctaccacgccgtgcaggcgatgctgctcccccgggcgccgctctccccaggtctcgccgcggcgtgcgcgaacggagcggtccgatga

SEQ ID NO: 7273 - DNA, 927 bp, Actinoplanes utahensis
atgaggcgattcctggtcgtcggcgagtccatcctcgacgtcatctccgacgagcagcgggaactgcccggcggcagcccggccaacgtggcggtcgggctgggccggctcggcaacgacgtcggcctgtggacccacctgggcgccgacccggccggtgacctgctgcgcgcgcacctcaccggctcgggcgtcgacctgctggcaccgatcgccggagtgacctcccgggcgctggccgcaatccagccggacgggtcggcgcgctacgacttcgccgtcgagtggccgcgctggccgggcggtccggcacccgccgagaccgctcggcatctgcacaccgggtcgatcgcggcgctgatggcaccgggcggcggcgacgtcgagcggttgctggtggaccgccgggacgccatgacggtcagctacgacccgaacatccggccggcgctgatcggcgacccggacgactgccgcactcgagtggagtcgatcgtcgccggatccgacgtggtaaaggccagcgacgaagacctggcctggctctaccccggcatgccggcgctcaacgcggcccggcacctgctcgccctcggacccgccctggtctgcgtgaccctgggagcccaaggcgcgctggcgatcgccggggaggtccaggtgactgtcccgccggtggccgtcagcgtcgttgacaccgtcggggccggggacgccttcatgtccgggctgctcgacggactgggggaacgagggctactcggcgccgccgcccggccacggctgcacgccatcaccggcgaagacctccgagcggtgctcagccatgcggctctggtcgcggggctcacggttgcgcgggccggcgccaccccaccgaccagggcggagctcatggtcagaaatgagcgagcctcagcgacttaa

SEQ ID NO: 7274 - DNA, 1389 bp, Actinoplanes utahensis
gtgaaacgccgaccagtccttgtcaccctctccgtcctgttggccggcggcgccgcagtcgccgtgactctgccggcatcagccgccgccaccggtgcccttaccggcctggcgggcaaatgtgtcgacgtggccgcagggggcaccgccaacggcaccaaggttcagctgtggacctgcaacaactccgctcagcagcgggtgtccgtggcggacgaccgtaccatccgggtattgggcaagtgtctggacgtcaccggcggcgtcaacgccgacgggaccaaggtgcagctgtgggactgtttcggtaacgccaatcagcagtgggtctacaacagcgcgacgaaggacatcgtcaacccggcgaccggtcggtgcctcgacgccgccggccagtccagcgcggatggcacgccgttgcagatctggacgtgcaacagccagaccaaccaggactgggtactgcccggcggcggtggaccagtcaccccatcgccgtcggccagcggggcggcctgcaaccggaccgtgcagccgggcgagcgcaccatgccggtcagcttcgcaggcaagcaataccaggtggccgtctacgttccggcgggcgctcaacccggcacccggcttcccctggtcatgaacctgcacggctccggcggcaccggatccggtcagctgcagtacagcaacatgaagccgaccgccgacgccaaccaattcctgatcgtcgcacccagcggggcgatccccaatgccagcggcttcgcctggaacgtgcccggtgtcggcacagcgccggccggggcacgagacgacatcggcttcctcgagcaggtgctcaccacggcgacctcgaccctgtgtgccgctccgacccgcgtctacggcgccggatactccggaggcggccggatgacgtcggcgttcgcctgcgcacgaccggaccggctggctgccatcgcccccgtgggcgggctccgcgccggccggcccaacccgcagaacaccgcgcagccggatcccgcctcctgcaacccggcccggccggtcccggtgatcgccttccatgggcagcaggacaccaccaacccgtacccgggcggcggctccgagtactggcagtattcggtaccggtcgcgcaggcacggtgggcggcgatcaaccggtgcaccaccggtccgaccactgccccggtcaccacccacgtcacaagaacgaactacctcggttgcgccaacggcgccgacgtcgtgctctattcgatcagcgacggcggtcacacctggccggggacaccggtctccaacggaaacggcaacacgacgcaggagatcaacgccaacacgctgatgtggcagttcttccagcgctttcaactgccggcctga

SEQ ID NO: 7275 - DNA, 2217 bp, Actinoplanes utahensis
atgccagcagatcgggtaagaggccgcatcgtccgcgcgggcactcgggtggtcgccgtgttcgccgtgctggcactggcgtttggtctggccgatttccgtctcgtgcgggccgtgttcaccgattccaccgcaaccgggacgaacactttcagcgccgccgcgagctttcctgactatcccaccacgatcagcaacgacggcgcgtacttctatcaccggctggccgaggcgcagacctccagtgcgacgtcgaacgcggcggactccagctcgaacggcacccggaccggcacctacgacgggcgcaccgacggcccggccacctggtacgacttcgaggacatcgccggctcggcggtcgccgacgagtccggcaacggcaacagcgcaacgctgagcggcaccacgacagtggcgggccaccccggtagctccgtgagcttcgacggcacggcgagtcatgccgacgcggcgcgggcgggcatcagcgtcaccacggacttcaccgtctcggcatgggtctacctgcccaccggggccgacaatcaagaccgcgccgtcgtcagcctttccggatcggccaccagcgcattcctgctcaagttcgatgactcggacgacaagtgggaattcgagatggcgcagtcgaacatcggcgccccgacgccggacgccgccaagagcagcggtgctccggcactcgacacctggacgcacctcgccggggtctacagcgacgcgtcgaacctgctgacgctctacgtcaacggggtcgcgtcggccaccaccgccgcccacgccgacgccaatgaatggaccccgtcgggcactctccaactggggcgaacctggtacaacaccgcctgggcgaccgcgtactggctcggccggatcgatgacgtccgggtctatcagtccgcggtaaccagcaccgacatcctgggcatgtcgaccgaggcgccgacggttcattaccggttcgacgaaaccggcggcaccagtgtcgcggacagctccggcaacgccaacgacggcagcacctcaggaaccgccacctggaaccccgggggctggtggggaggggcgttgacgctggacgggtccggcgctgccgcgctgagcaacagccgggctgtcgccaccgatcaggctttcaccgtctcggcctgggtgtacctaccgtcgacggcagccaccatcacccgcgcgatcctcagcgagaacggtggcaacgccgctgccttcgaattgaagtacaaccaggcggcaccggaccgctgggagttggcgatgtgggacaacgacaactccgcctccaacgccgcgggcgccaagtcagcggcggtggcgacgaaagacgcctggcagatgatcaccggagtgtacgacgacgcggcggatcttctgcggttgtacgtcaacggggtgcagagcggcacgaccgcgcgcaccgacgccgtcgaatgggccattaccaatcggctgcagatcggccggtcgcggaactacggcgcttgggccaacccgttttccggaagcatcgatgatgtccggacctaccaggcggcgttgacgccgaatcagatcagccagctctacaagtacgggcgaaccatcccgaccggtatgaccgccggtggcagcggcgcgttgcagggtccgctgggcgggcaggccgggaacaccgcggtcgccttcaacgggtcgggcagtggcttcaacccgatctcgttcaccaacccgacgacgttcacgatcgagtgctggttcaagggctcggacaaccggggcgggcagatcctggcgttcaacgccgaccagacgtcgttctttcccacctacaccaccgaccggatggtctacatcgacagcgcacaacgcctggtcttcggtgtcaacaaagcgggcacgatcgtcaccgccgcgtacgccgggtcggcggccacctggaagaactggcaccatgtggcggccacgatgagcccggccaacggcatccggctgtatctggacggtgcgctggtcgcctccgacgcgacgggaacggccggcgggaactacaccggtttctggcgctggggcggcggtcacctcaccggctggccgaaccgtccgggccacgactacttcgtcggcatgatcgacgaggtggcttactaccagaccgagttgaccgctctgcaggtttcgcgggacttcaacgccaatcggtga

SEQ ID NO: 7276 - DNA, 693 bp, Actinoplanes utahensis
atgatctggctatccatgggcttgcaccagaagagcgtgcggcgggcgcgacggcgtcgctggcccctgcggttctggctgatcggcatcctcgtcgccgtcctggccacggtgcggtcgacgaacgccgtcttcacctcgcgcagcagcagtaccgggaacaggctcggagccggcacggtcgccatcaccgacaacgacggcggatcggctctgttcagcaccgcgtcgctactgcccggcgacagcgccaccgtgtgcacgggcgtctcgtacaccggatcggtgacgtccgcgccgatccgtctcttcgtcgacaagacggccgcgcaggagtccgacagtggagctgtttacggtgcgtgggcggacagtaccgcctcgatgatggacgacaacctcaccatgcggatcgaggtgagcagcaacgacctggccgccagccccggaagcaactgcaacccggcaggtgtcggctccttcaccgacgtcgccggaactttcggcacgaacatgcgtacgctcatcgccaccaactacgatttcgccaccggcctggtctcgcagtggggcaccgtcgtcccgaacacctggcgggtctggcggttcacgtacaccttctcgctcgccgcgactgccgccgcgcagagtgatggactgaaatgcgccttcacctgggcggcgcagaagtga

SEQ ID NO: 7277 - DNA, 699 bp, Actinoplanes utahensis
atgggccgccagagcaatcaagcgaccttcgcatcggtcgagaggcatcgtcgccaccgcgggattgcagtggccgtcggtgtgatcgcctgcgcggcggtggtctggcagtcctcgcacgccacgttctccgccacgacgagcagctccggcaaccggatcggtgccggtacggtcaccatcgacgtcaacaacggcggtgcggcgatgttctccaccgtcggaggcgacacggctctggcgcctggtgcgtcgcgctcggtgtgcatcggggtcgggtacaccggcactctggctcccacctcggtcgcgttgtactttcccaacggcgcgacgcaggcgaaggagatggacgccggaagcggcacatggaacgcctggcagagcgctgtcgcgggcggagcggagatggacgacaatgtcaccctgcaggtggaggtgaacaacgcggacctggccaccgaccctggcagcgtctgtaccgggacgttcggcgacgtcatcgcggcggggaccaacctgcggacgctgatcagcaccaagagcgcatggggtgcgactacgtcgtacaccgtgccgaccatgggcaacggcaagtaccggtcgtaccggttcacctacacgttgggcgccggcgccggtaacaacgttcagggcgacggtgtcgagttcactgccatgtgggaagcccagaggtag

SEQ ID NO: 7278 - DNA, 606 bp, Actinoplanes utahensis
atgcgtgtctctctgaagcgtccgtggtctgcggcgttgcccagcgatcgtgccggcgcccgagagcgcagacgactccgggcggtcaatctgctgtccgacgtccgggacgcggtggtcgcctgcctgttcgggatgctgctgatctccgtcgcgccggcgctgctgggatggaaacccacggtcgtggtctccggttcgatgcttcccaccatccgcccgggcgatgtggtcgtcgccgcgcccgtgccggacgatccccggtcgcgggtgaagcccggacgggtcgttctggttgatgatccggcactgcccgatgaactcctgatgcaccggttgatgcgatacgacactgacggccggatgatcctcaagggcgatgccaacgcgtcgccggacagtacgccggtaacgctggagagcctgcgtggtgttccgcggctgcgcgtcccgttcatcggcctgccgttcctctgggtgcagcaaggccggttcgtgccggtggtagcggccggtttcctgctgctgttccttgtcgtctggcagccgcggcgcccccagatgacgcgagacactgtgcccgatcagacctcggcggaggagtag

SEQ ID NO: 7279 - DNA, 654 bp, Actinoplanes utahensis
gtgaactggaccaggcgactacgagcccccggcgtgaccgccccgctcgcggtgcggccggagacatcgccggtcgccgatgtgcggccccgcgccaagcttccggcagccctggtggcgggcatggtggtgtccgccgggttggtgtggcaggcgagccacgcctcgctcgaggacacggtcaccaaccaaggcgactcgtggcagtccggcattgtggcactgaccgacgacgacaacggtgccgcgttgttcaccagcttcgggaccgacctggcgcccggaaccggatcgacgaaatgcatcgcggtgacctatgccggcgacgtcgcggccgacgtccggctctaccttgcccggctcgacgaccacggcgaagagctcgacacgttgctgaccatgaggatcgacatcgggtccggctcgtcctgcgcgtcgccgggcaactggacgcaactgagcgacaccgaccttcgtgccaccgcgaattccgccgggacctgggctgccggattgacacccggcgcgtggagcccatcgggtgaccagccggagacgcgtccctatcgcttcatccccaccctcgccgacgacaacgccgcccagggcgaccaggtcgagctggacttcgtctgggaggcacacagcacctga

SEQ ID NO: 7280 - DNA, 1131 bp, Actinoplanes utahensis
gtgacccggccggaccgcccgccgcacccttcgcttctgcggcgagggatcggcgcggtgctcgtggccgtcatcgcggtcgcgaccgccctgctgctccagcacaagcacacccggacacccgcaccgcaggccgatcgggtcctggcgtccatgccgctcaccggagccgcactgacggcgggctcgaatgccccgctgttcgacgtgcgacggatggcgccgggacaccgtgtcgagcgctgcatcgtcatcgccgccgcctcggggggctcggtcgtgcgattcggtgccagcggagtgtccggtgcgctggcaccgtggctgcgggtggagggcaccatcggaacggggacgtcgcgggactgcagcgatttcgcggccgacgccacgtcgttctacaccggctccatcgccgcgctgggcagcgcgggaacggagggcgtacccaccggctgggttcccgggcatgccgagagccgcacctttcgcatcgcggtcgaggtcgccgacgatgcccgcgctgcgggttcgtcggcgctcgccacgctgacctggcgatcgcaggctccgggggtgacgcccacgaccggtccggggacgagtgcgccttccctgcccggtacttccagcgcggccccgaccaccacaccgccgaccaccacaccgccgaccaccacaccgccgaccaccacaccgccgaccaccacaccgccgaccaccacaccgccgaccaccacaccgccgaccaccacaccgccgaccaccacaccgccgaccaccacaccgccgaccaccacaccgccgtccatcacggcgccggctgccgcacgaccatccgactcggccgttccgccggcgggtggtggcttgccgtcggggacggtgcccggtgactccatggcggcggctccctgcccgccgacgaccgccgcccgggtgggcgatctcctggccggagtggcccgcttctcctggctcgctctgctgctgttgctgctggtcctgctgttcctgctggtgcaggaccggctggaccgcggcgatccgaaactcgcgcacgctccgctgtacggcgagccgcaccaggccttcccggacaacggctcgatcccgtggaggacgcagtga

SEQ ID NO: 7281 - DNA, 1593 bp, Actinoplanes utahensis
gtgacgctccagcctcatccctcgcggttcggcttgctgccgttggcggatcggatcagatggtcgacctcgttgcggctgggtctcgccgccatggtggccgcgttctggatcttcctgccgggccaacgccgcaccgacgggaaggatctgttcgccgtcgcgctgctgtgcgcctgggcgaccgtgctcaccgtcgcggcgccccgggtcggccgcaggatggccatcgtggcggtcaacatcgccctgctcgtcgacgggctcggcctggcgacagccctgcacgcatacggcggcgtgagcggaccgatcagcgtcctgatggtgctgcacgtctgcggggtgagcctgctgacatcgtttcggtccggcggcaaggtcgcggtctggcatgccctgctggtgttgtgcgtgctacaggcggagcaggtcgggctactgaccgtcaagcagccggcgccactaccgatggccgggtacgtcacttttgtcgccctgcttggtgccgcggccttggccacctcgctgtacgccgcgctcaatgagcgcgaactgcgccgccgacggtacgacgcagaggtgctgcggagcctggccgtgcatctggaagccagcaacgacctgggcgagatcgccgcggcgttgacccgcctggccgtcgaggatctactcgccgtccgcgcattggtagtcatcgaacccgcctcggacgaggagggtcgtgggctccggttcgtggagaagggatggccgcctctgccggccgccctggacaccggcaaaacggcgcatgctcacgggtcgctgctggccgacactgaagcgggccccgtgctcgtccgcaatctcgacaagcagcgggattcctacgtcgtcagccggctgcccggcgcggagcgcctggccgtgctgcccatcccgctcgggccggcggggcgcggtcacctggtcctggacatgggccggagcaagcgcgtcgagcaccggatgatgtccaccctgatacaggcgaccgcgcatgtcgggctcgcgctcacccgcgccggactcgtcgagcggctgcggctggccgccgaaaccgacggcctcaccggcgtcgccaaccgcaagttcttcgacgcggcccttgcccagcacatcgaccacgccatgcgcaccggtgagccgttggcggtgacgctggtcgacctcgacttcttcaaaaaggtcaacgacacgtacgggcaccagaccggcgacgaagtcctgaaagccgcggccgccgcactcaggagcaccgccagggagggcgatgtggtggcccgttatggcggggaggagttcgccgtcatcctgcccggcgtaccggtcgacgatgtctggcaaacggccgagcgattccgcaacgcggtccgcacctgtccggctcctgtccccgtcacgtgcagcatgggtatcgccagccttcctcctggcggggtgccgcccaccgtactgctcgaggccgccgatcaggcgctctaccgggccaaggaagccggccgcaatcgcgtggagatcggccacttcaccgacgaatcgctcggcacggcagtgggtcgggggcattga

SEQ ID NO: 7282 - DNA, 564 bp, Actinoplanes utahensis
atgggtgcggcaccgcctctgcgacgccggcgccgcacaacctgcctgtgggcggccgggctgctgaccgctgccggaatggtcgtgcagagctcccgggcaacgttgaccagcaccacctcgagcggcggtaacagcctctcggccgggaccgtcgcgctgtccgacgacgacagcgcaggcgcgatgttctctgccaccggcatcaaacccggtgacaacgggcagaggtgcatcacggtgacctacaacggtaccgtcgcctcgctggtgaaggtctatgccgccacctcgatcagcactctccatccgtaccttgacatggtcatcgagcagggcaacggtggctccttcgcgaactgcggtggcttcaccgggtcagcgatttacaccgggacgctcagtgcgctggggaccagcttcgcgggcggtgccggcacgtgggctcccgccctcagcggtagcacgcaggtctaccggatcagctggactctcctggacaactacgccgcccagagcaaagcggccatccttgccttcacctgggaggcacagagcacgtga

SEQ ID NO: 7283 - DNA, 2310 bp, Actinoplanes utahensis
gtgaaccgcgtggtacgcctctactccaggcgtccggtgccggcatgcgtacagaaacgaccgatgcgcatgaagtgggcgttcagggcgagggtcagcctcacccgccgaccggcgtgccgcatgctggcgacgatgacggcgctggttctgctcctggcggtaccagcgttcacctgtcgccgcgtccgggcagtcttctcggccaccacagccaactcctcctccttcacggcagcggcaaacttcgacgccggccagatctgggccaacggccgggcactcggcagcctggttccggcgcaagtgggcacggccacctgggctcaactgaccgacggcaccttccacaactgcggcattcagaccgacgggaccctgtggtgctggggatcgaacaccagagggcaactcgggcagggcgacaccacctaccggtacgaccccaccaaggtcggttcagccacgtggacccagatctcggccggctatgagcacacctgcggcatccagaccggtggcaccctgtggtgctggggttccagcttgtggggtcagctcggccaaggcaatcagacgaacctcagcacaccggcccaggtgggttccgcgacctggagccaggtctccaccggcggttatcacacctgcgggattcagaccgatgcctcgctgtggtgctgggggtacaacgagcggggccagaccggcaatcccgcgaccctgaccgaccgggacgtgagtccgttcaacgtgacgtccgtggccgggccgtggcgagcggtgaccaccggctctggccacacctgcgccgtgaagaccgacaacaccctgtactgcttcggcgacggcggcgacggccggctcggaaacaacagcacggccaacagcgtcgccctccagcaggtgcccggcacgacgtggctcacgccgtacgccgggcgtaaccacacctgtgccaccaagaccgacaacactctgtcgtgctggggacgcggcacctccggtcagctcggcgacggcacgtggaacacctccctcaccccggtcacggtggccggggcggcgacctggaagtcggccggcggccgcaccgtctccacctgcggcctcaaatccgacgacaccatctggtgctggggcgacaacttcgccggtcagctcggcgccggggaccagaacgcgcgcaacagtcccacctcgtcaggtgccctcacctgggcttcgctggcctccgggttcggatcccaggggacgtgcgcgatccgcaagactctgaacaccctctggtgctggggcttcacccatcaccagtcgagtacgccggtggcatacccggggacgacctacaccgccgtggcggccggcaacgacttcgcctgttcggtgcgtacggacgggacgttgtggtgctgggggcccaacgacgtcggccaggcgggatggaacctgccgtacggatatcccaagcaggtgaccgccgcgacgacctggcggacagtgaccgcgggtgaccgccatgcctgcggcacccagaccgacaacacgctgtggtgctggggatatgcgtcctccggccagaccggccagaacaacaccgccacgcagaccgtaccggtacaggtcagccaggcacccgccacctcgtggagcgccatcttgtcggccggcgacaaccacacctgcgccatcaagaccgacaacaccctgtggtgctgggggaacaactccgccggccagctcggcatggcggcgggagacaccacgaaccggctggttcccgtcaagatcggctctgccacctggagcgcggtcgccgcgggcgcccagcaaacctgcgggatccagaccgacgggtcgctgtggtgctggggcagcggcgccaacggccgcctcggtcagggtgacaccaccggctatcaagcgccgaaacaggttgggacactcacaacgtggagcagggtcacggccggcggcggccatgtctgcgcgatccagaccgatggcacactgtggtgctggggcctgaacagctccggtcagctcggcgtggccgtcggggacaccaccgaccggccctcagtgacccgggtcgggaccgccacgtcctggaagtcgatcagtgccgggcagggacacacgtgcggcacccagacgctacgcacggtctggtgctggggccagaacgggtacggccagctgggactgggcgacaccatcaaccggaccgtgcccacccaactggcggggatcaaacgccggccgatcacgtcaggctcggcggcgaacaccacctacgcgatcgaatga

SEQ ID NO: 7284 - DNA, 1392 bp, Actinoplanes utahensis
atgctccgtctaccaggaacagcgagcgcgttctccgtgacgtcgaaggccacggtgatcagctacctgcagtcgatcaccgggaagaacatcatctccgggcagcacaacaaggaaccagccagcagcccgacccagtacacccagcaggctcgcgccgcgtccgggcagttccctggcctgtggggcggcgacatgatgttcaatcccgcggacgtcgccaaccggcagaccgtgatcaatgaggcgaagacccagtgggcggccggttcgatcgtcgctttgacctggcacgcctgctccccgaccgtcgccgccacctgcgccttcgacggcggggtgaagaccagcatcaccaatgcgcagttcaccgagatcgtcacccccggcaccaccctgtacaacacgtggcgcagccggatggctgccgtcgtcccgttcctcaagcagctcaaggacgccggcatcccggtgctgtggcgaccgttccacgagatgaacgagacctggaactggtggggcggacggccgggcgcgaacggcggcgccaagatctaccagcagatgcacgagtacttcgacagccagggcctggacaacctgatctacgtgtggaacgtgcaggacaatccgacggccaactgggctcagtactatcccggcagcaactatgccgatgtggtgtccctcgacgcctggtacaagaattatccatcggcggccgactacgcgcagatccagtcgatcgcgggtacgaagccgatcgcgatcgccgagatgggcaaggtgcccaccgcggccttcctgaccagccagcccaagtgggcctacttcatgatctggtccgagcagctactgggcagtaataccaccgccgagatccagagcgcctacgcgaacgcccgcgtcctcaaccgcggccagatcaccatcggatccggtggcggcaccgccgccccggccaccaccgccccgaacaccgcgcctgcggccgcgggcgccaccggcaagatccgcggcgtgcccagcaaaaagtgcgtcgatgtcactgcggccggcaccgcgaacggcaccgccgtgcagctctacacctgcgacaccggcggaagcgcccaggcgtggacccgggccgccgacggcaccgtgcgggctctcggcaaatgcctcgatatcaccggcggtgtcaacgccgacgggacccggctgcagatctgggactgcaccgcaaacaatcccaaccagcaatggcggtacaacgccaccgcgcagaccttggtgaacccggcgaccggaaagtgtgccgacgccgtcgcggaagccatcgccaacgggacccggctgcagatctggacctgcaacggcaaggccaaccaacgctgggccatgagctag

SEQ ID NO: 7285 - DNA, 1509 bp, Actinoplanes utahensis
atgatcgcgacaagcctggccatgatgaggcatcgctggtcgcggtcgggcctgcttcccaaagtccgcggcctgttcctgatcaatctgctggtcagcgtggtgaccaccgtgcagcaactcgccttcgtcagcaccaccaacggattgatccgtacggcatccggcatgagcatgctctggctgggcgcctcggccgtgtacggctggcgccggcagcggctgtccgccgtcaccgagccactcgaatggctcgtggtgttgttcgcgggcatcgccatcggccgcgtcaatccggcgcttgcctcgttctacgccgtgctggtgttccgtccgctgtacggcacccggtccagcgcggtgactcgcccgctgatggcggtcgccgtgctggcgatgctgccggtcgtcgtcgccgcgacgggtggcgtgagcgagctggacacgctggtccagatccccggcgtcgtcatcatcgctaccgtcaccttcctgctgggcaacgcgctcgccggtcagcagcgtgccgaagcccggcagcaggcgctgatccgtaccggaacggccctgaacgccctggacaagcgtgagtccgtccatgccgaggcggtagcggccggactcgccctgctcggcgacagccctggctactgcgcgatcgtcgtgtgccacgacgggacaccgcgggtcgcggcattccagggcaccacccgggaatcccttcccggcacctccgtcctgtcgtccgacgacaccctgcgggcggctttcgccgatcagcctgactccgcgaccgatcagcgggtcggctcggtgaacgacgagctgctgctgccactgcacggtaaacgcgggatcagcggcctgctcgtggtgggcgcggcgcgcggcgtccgcaaggaggctcgcgccgacctgagcacgctcgtcaaccaggtcgtctccagcctcgacgcggcgcaactcaccgccgaactggtgcagcgagccagctatgacgcgctgaccggactggcgaatcgcgccctgctgcacagccggctcgacgcggccgtcgccgcgaccggcccggaccgccctcaggccgccgtgctgctcatcgacatggatggcttcaaacaggtcaacgacacgctcggccaccatgtcggcgacggcttgctgatcggggtcggtgaccggctgcgccgcgtcgtccgggacgtcgacaccgcggggcgactcggcggtgacgagttcgcggtcgtccttgctggtgtcaccggcgctgaggaggctgtcgcggtcgcggagcgcctgctgcacaccctcgatgagccgttcgaggtggccggccacctcgtggtggcccgcatgagtatcggtatcgcgctggccggcggctcgcgccaggtcgacggcgcggatttgttgcgcgacgccgatgccgcgatgtacacggcgaagcgccgtcagaccagcagctggcaactggctgacgagcggagcccgcacgccgcgttgacctga

SEQ ID NO: 7286 - DNA, 1179 bp, Actinoplanes utahensis
atggcacgtcgagaaacctccgttgccgggccgggcagccgcgcgctgatcgtggacgtggtccggtcggcggtgtcgatcagccgggtggagttggcggagcgaaccggtctcacccagccgtcgatctccaacatagtgcgcgacctgatcggggacggtgtcattcacgagaccggctcggccgattcggcgcgcggcaagcctcgcagactgctggcgatcaccgcagccagccggttcgggatcggctttcaacttggaccggacacgctgacgtgtgtggccatcgatctgaccggcggggtggtgggccgcgaggtggttccgttcgacggtgcggacctgccggagcagctgaccgagcggttcgacgacttcatggccgatctggacctggcccgtgaccggatcgagggcctggcgatcgtgacgcctgccgtccgtcccggcgacgaggccaccgtcccgccgtggaccgaggtgcgcgccgttctggctgagcggctcggtataccggtgctggtggagaacgatgcggcggccgcggcgctgggcgagttctggagccggcgggtgtcgcgagagcaggcgttcggcagcgtctacctgtcgtccgggatcggcgccggcctggtcttcggcggcgctctgcaccgcggcgcgagcttcgatgccggcgagctcggacacatgtcgattgcgtacgacgggctgccctgcccgtgcggcaaccgtggctgtgttgagcgctatgcgtcgatggtggcgaccgtggacgcggcccgtgccgccggcctggcgctggagcaacagagcgtcttcggtgcgtacgacgcgatcgcgcgcgccgccgtcagcggcgaccccgatgcgttcgctgtggtggaccaggcggccggctacctgagcgtggcggtcacctccatggtcaatctgctcgacctgggccgggtcgtgctgaccgggccgggcatggcgatcgccggttcgatctacgcccggcggttgcgggaaacgctggcccgcaccgcccatgcccggcaccgccacgaggtcgtcgtcgagttgtcggcgcagccccgcgatgcggccggcatcggcgcggcggcgctggtcgtgcaggcgtcgatcgcgcccgggcacaccgccggcctgcccgccacgaacgacgcctga

SEQ ID NO: 7287 - DNA, 1122 bp, Actinoplanes utahensis
atgactcgctgggcctacagggcgctggacggggccgtgatcgtcgcgtaccccctcctcatggtcgtcgccgtccgaagcgtgcaggtcaacgacgacggattgcgcgtgctctggccggcggtcgtcaccctgctgcccgccgtcctggtcggacgccggccggtgaccgcgctgctgctcatcctggtcggcacggtgttcggattcacggtgatcggggccggcgactcggctttcgggctgcggctcatcaccgcgttcggcgtcggggcggtggcggccgcacgccgcacccgggtgggcgtcgctgccgcggccgtggcatgggtcgctctggtcggtggcgagatgtccgggtggatgatcgccaccggcgaaccggtcatggaacgggtccaggacgcactcagcgccgcactgctcaccttcgacgcgctgctggtggccgtcggactgaccgtcgggctgctgctgcggcagcgacgcgaacatgccggggcgatccgggcgcgggccgccgagcaggccatcaccgaggagcggctgcggatcgccagggagctgcacgactcggtggcccaccgggtcggggtgatcgcgctgcaggcgggcgccgccaaccgggtgttcgagacacagccggcgcgggcccggcaggcgatcggggtggtggagaattccagccgggaggccctggccgagctgcgccggatggtgggcggtctgcggtccgcggacggtgcgatgccgggcgccgggctcgccggcctgcccgacctggtcgccgccaccgccgaggcgggcgtgcaggtggaggtgctgtggctgccgaccgacctgccggccgacatcgaccggtcggcgttccggatcgtccaggaggcggtgaccaacgtggtgcggcacgccggggtgcaggcctgccgggtcaccatcgagcaggatgcggagatgctgaccatcgaggtgaccgacgagggccgcggcgggaccggcgtgcccgggcacgggctggccgggatgcgggaacgggtgtcgctgctgcacggcgagttcgaggccgggccgcgtccggagggcggtttccgggtcttcgcccggctgccggtggcggcatga

SEQ ID NO: 7288 - DNA, 651 bp, Actinoplanes utahensis
atgacggtccgggtcctgctcgtcgacgaccagccgctgatccgggcggccctgcagatggtgatcagcgaggcgcccgacctggaggtcgtcggcgaggccggcaacggcggcgaggcggtccggctggcggccgaactccgtcccgacctcgtcgtcatggacctgcggatgcccggcatggacggcatcgaggcgacccgccggatcgccgggcagacccgggtgctggtgctgaccaccttcgacgacgacgagaacgtgcaccgcgccctgcgcgccggggccagcggcttcctggtcaaggacatggcgctggacgacatcctggacgcggtgcgggtggtcgcggccggcgacgcgctgctcgcccccggcgtcacccgccgcctgctgcaggagttcgcccgccgcccggccgtcgcggcgccccgcgccccggagggtctgaccgaccgcgaggtggaggtgctggcggaggtgggccggggacgctccaacccggagatcgccgccgacctgcacatcacggtggcgacggtgaagacctacgtctcccggctgctggccaagctgggcgcccgtgaccgcatccagctggtcatcatcgcctacgacgccggcctggtcaccgcccgcgacgccgcctga

SEQ ID NO: 7289 - DNA, 1644 bp, Actinoplanes utahensis
atggacgtagccatcttgcagcggatccgccagggcctgatcggcgccggcgtgattctcgacgggccgtacgggccgcggcgtaccacgcatgcggactacacggcctccggccaggcgctcgatttcatcgaggatttcatccggttccgggtgctgccgaaatacgcgaacacccacaccgaggcgtcggcgaccggcgcgcagaccgggtgtctacgggaggaggcccgggcgctggtgcaccgcagcgtcggcggcgggccggacgacgtggtgctcttctgcggatcgggggcgaccgcggcggtcaacaaactcgtcggactgctcggcctgcgcattccggagaacctcgatgaggtgtacgggctgtcgccgctgatcccgcgggccgagcggccggtggtgttcgtcgggccgtacgagcaccattccaacgagctgccgtggcgcgagtcgatcgccgaggtggtgccgatcggcgccgacgcgaccgggcacgtcgacctcgcccagctgcgggcggccctggaacgccacgccgaccgcccgctgcggatcggcagtttctcggcggcgtcgaacgtgaccggcatcctgaccgacgtgtccgcggtgtccgccctgctgcacgagcacggcgcgctggcggtgtgggattacgcggcggccgggccgtacgtgccgatcagcatggccgacaaggacgcggtgttcctgtcgccgcacaagttcgccggcggcccgcagaccccgggcgtgctggtggtccggcggcagctgatgacgaaccgggtgccggtcgtgcccggtggcgggaccgtcgcgttcgtcgacccgaccggccacaagtatctcgacgacccggtcgcccgggaggagggcggcaccccggcgatcgtcgagtcgatccgggccggtctggtcttcaaactcaaggacgaggtgggtgccgaggtgatcggtgcccgggagcacgagctgtggcagcggctgctgcggcgctgggccggcgtgcccggcatcgagatcctcggcgatctgcgcgccgaccggctgccgatcgtgtcgttccagatccgggccggcgaccgctacctgcaccacaacttcgtggtggcgctgctcaacgacctgttcggcatccaggtccggggtggctgctcgtgcgccggcccgtacgggcaccgcctgctcggcatcgacgacgcgcactcgcgggagttccagaccgagatcgcggccggctgggagggcatcaaaccgggctgggcccggctgaacctgggctacttcatctcggacgcggtcgccgactatctgatggaagcggtcgccctgatcgccacccacggcgaccggatgctcgccgactaccgcttcgacccgcgtaccgccaaatggtcgcatgtgaatgcggcgcagccgcgggtgcatctgagtgacctgcggctgggcgacgagatcccgggtccggcgccgactctcggcgaggaggtgctgccgtcgcacctggcgcaggcccggtccctgatggagtcccgcccggcggccgtcgacggcgacgggcacggcctgccgcccagcttcgagaagctgcgctggttcctgctgcccgcggcatgcctggcacagcactga

SEQ ID NO: 7290 - DNA, 690 bp, Actinoplanes utahensis
atggatctactgctgctgcacgggctgggtgcgaccggcgaggtctggtcggggtgggatccggtgctgcgggatcggtggcccggccgctggcaagccccggacctgcccggccacggtgccgcggcggagttggacgagtacacgttcgacgcgctcgccgaggcgctgctcccgctcgtcgacccggccggacagaccgtggtgctgggacattcgctgggcggggtggtcgcgctggcgctggccgcccgggtgccggtggccgcggtcgtcgggctgggcatcaaggtggagtggaccgacgaggaactcgcccgggcccgggggctggccgggcggccggtcgcctggttcgacacccgggaggaggcgctcgcccggcacctgcgggtgtccggcctggccgggctggtcgccgacgatccgggcgggatccgtgccgacggcggccggtggcgcccggccctggatccgcgtgccttcggcgtcggcgcgcccgacatggccgggttgctcagccgctcctccgggccggtcctgctggcccgcggcgagcacgatccgatgagcaccggcgagcagctggccaagctgggcgtgccggtggcgacactgcccgggctgggccacaacgcccacgtggagaaccccgcacaatgcttcagcctgctggcggcgtaccactga

SEQ ID NO: 7291 - DNA, 756 bp, Actinoplanes utahensis
atgccgagcccgcgcgacgtcgcgcacctcaccaccctcgccgacttctgcgcggtgcgcgatgtcggtgtgctcagccgcgaggcgctcgggccggtggatgtcgcgatcctgttcggtggcagcatcctcgccggcggcgacctgttcgcgcgagcgatcaccgaccgggtcgccgaccatttcatgatcgtcggcggggagggccactcctccgacgtgctgcgcgcggcgatgcgctcccacctgggtggggatgacgtgccggcgctgagcgaggccggcctgttcgatcgttatctccggcggcggtacggcgttcacgccgacctgttggagcacgagtcgaccaattgcggcagcaacgtgcgcaacgcgctggcactgctggccgcccgcggtgtcccgcaccggcggatcctgctcgtccaggacgcgtcgatgcagcggcggatggacgccgggttccgccggcacgcgcccggcgcgcagatcgtgaacttcgccgcgcaccggacgacggtcgacctgatcgacggtgagttcgggttccggtcgccgccggccgggatgtggccggtggaccggtacgtcgcgctgctgatgggggagatcccgcggttcgccgaatacggcccggccgggcgcgggttcatcgcccacgtcgacgtgccggacgaggtcacccgggcgttcgcggctctgcgggaggccggggtggcggcgccccgggtcgccgatcagcggtgggcctga

SEQ ID NO: 7292 - DNA, 651 bp, Actinoplanes utahensis
gtgcgcgacgtcgcgcgggctcggcatcagcccagtgtgcccctcccgcatccgcccggggcgccggccgcgccgccacgtacctcaggcgttctccgggtcggcgagaatgacgccatgcccaccatcgagaccgcccggctcaccctgcgcgagtggcgcgacgaggacctcgacccgctcgccgcgatgaacgccgacccggaggtgatgcgctacatcctcgacggcgaggtccgcgaccgtgaccagagcgccgcgggcctgcagaagatgatccgcgactggcggcagcagggtttcggcctgttcgccgtccaggtccgggacaccggcgcgctgatcggctgggccgggctcgccgtgccgaccttcctccccgaggtcctgcccgcggtcgagatcggctggcggctgtcccgcgccgcgtgggggcacggcttcgccaccgaggccgccaccgccgccctgcggttcggcttcgacacgatcggcctggaccggctgatcagcatccgccacgtcgagaacgtccgctccgctcgggtgatggccaagctcggcctgctccaggagttcgagacggtcatcccgggcttcgaccaaccggtcgcggtccacgcccggtccgctgtgccgcgcctgggatga

SEQ ID NO: 7293 - DNA, 420 bp, Actinoplanes utahensis
gtgctgtcccccttcccggcccaggttggtgccggagcagacgacgggctgccccggctgctcgtcgggcagcccgagcgctgggccaccatcgccgacaccgtcaacggcgtcgaccgggccggacgcggtgagcgggtgccgaccgtcgctgaaggggcggccatcgccagccccgtacggctgccggaggccgtcgaggccctgcgtcgctgtggcggcgcggcagtcgccgttgccgaggaacagattcacggtgcggtccgcgccttggctacccgcggcctgtacgccgaaccgaccagtgccgtcgcggcggccgcactcgaccacttcatcgctgacggcaccatcactcctgatcagacgactgtggtcgtgctcaccggctcggggctgaagtcggccgacaagaggtaa

SEQ ID NO: 7294 - DNA, 726 bp, Actinoplanes utahensis
atggcacgcaggctgttcttgggaagcttcaccgccggggcggtaacggtcgcactgggtgagtccaccccagccgctgccgagacgaccaccacgacgtttccgggaccggtggtcgcgcaacgcttcagcacggactcgacgatcgagtctgcatatttcaagaccacgtcggtgaccgacaacgcggtgaccgtctatcaggccgccgcctcgggcagaggcgtggcgttgaacgtcgtctccgacaatcccgagaactcggccatgtatctggagggcacggagaccggccgcgggacgctcaagatcacccatcagggctacgacgacggctcggatcgcagcgccgccgcgctctcgatcgacctgcggacggcggggaccgccgcgcagggcatctacctgacggcgacgaacgggccgacgacgggcagcctgatcgcactgcgcaacaaccccggccgggatgacttcatcgtcaccggtgccggacggatcggtatcggggtcaaccggggtgacacaccgcgcggacaggtgcacatcgtccagcagccgggagtccccgcaggagtgttgatcgagggcgtggtgcggatcgccaacaccgccaccgtgcccacctctgccgactcgtccggtgggggaaatctgtatgcggtgaacggggcgctgatgtggcggagtgccaacggcaaggtcacgcagatcgcctcggcttga

SEQ ID NO: 7295 - DNA, 195 bp, Actinoplanes utahensis
atgcagttgacggcagatgagctggtatccgaattccacgatgcggtgatggagctgtacttcgcgcgaaagcgcatcgtggccctagaggcggagatcctggccttgagagcgcaactcgacaccggcgaacgcgagtgcaccgctgatgccgctgaggcgtcgacgacgccacaggaatccgcgagccgctga

SEQ ID NO: 7296 - DNA, 1698 bp, Actinoplanes utahensis
atgcggatgcaccctcgggcctggctggcggtcgcggtcgtggcggtcgtggccggcgggtgggtggcggtcagcgccggcgacgacgcaacgctcgatgacgataccgccgtcgatgtcctcaccggccacgactggacgcatttcgccggggccaccgtcggccccggcggggtgcggatcgtcggcctgggcgagcggatcgtgcggcaggacggctccggcggccaacccgacccgccggtcaatctgcgggggccgcggctcgcggtgcgcggcccgatggagatcatcgccggggtggatcgcccggccggccgggcggccgtgttcagcctgtacggcgatgtgccggtggtctacgacgagtggcggcacaacccgcccggtctggccgtcaccgtcaccgacggggagctgcgcctggcggtctgggacgggcggggcgacgatccggcggtccgccgccggaccacggtgaccgcaccgggcgcggccacgataaccgtcacccgggcgggtgggcggctcacggtccggctcggggacgccggtctgtccgtcaccgaccctggggtgttcagttccgggcgggtgttcttcggcgccgacgtcgatggcggcgggccggccggctggacgttgacctcgttgcgggccgccgggctggacgggggcagcgtcaccgtcgtcgacgccccggcgctcgggcaaccggcgcccgagcccgggtcgctgcgggtgctcgccgcggcccgccgggcgctgcccatcggcgccgcagtggccgccgagccgctgctggccgacgacgggtaccggcgcttgaccgccgcccagttctccatgctgaccacggagaacgcgatgaagccgcagttcgtccacccgcagccggaccgctacgacttcaccgggggcgacctgctggtcgacttcgcggcggccaacggcatcgcggtacacgctcacaccctggtcttcggcgaggccaacccgcgctggatgcaggacaccccggccgaccggcgcgagcggatcatgctcgatcacatcagcaccgtggtcggtcactaccgcggccgggtggccgaatgggacgtcgtcaacgaaccgctgtcccccgacggcgaggactatgaggacgggggagcggggctgcgccggcacctgtggcagcaggcgatgggggagacgtacatcgacaaggcgttcgtggcggcccggagcgccgaccccggcgccaagctgtatctcaacgatttcggcctggaagccgacggtgagcgctgggacgcgctgctcagtctggtcggccggctcaaacagcggggggtgccggtcgacggggtcgggttcgaggcacacatccacgaggccggcgaccgggtcaccgcggccgtcctgcaggatcacttcgcggacctggcccggctcgggctgtcggcccgggtgtccgagatcgatgtgtacggcgatgccgcggccgggcaggctgagcagtacgccaccgcgttgaccgcctgcctggccgccccgaactgcacctcgtacaccacctggggggtcagcgaccggtacgggtccaccaccgagtccggcacctatccaccccagctcggtgacgacctgatcttcgaccggaacctggcgcccaaggccgcgttcaccgccctgacccgggtcctgcgcggctga

SEQ ID NO: 7297 - DNA, 240 bp, Actinoplanes utahensis
atggtggcggctgccgccagcaacacggccgtcaggcggaacttcgacatgtcttctccttggtcggggaccgccacgaggcgggacgctgatcgtagtcattccaagctcggtggcagccgtcccgcccgccgcagcgtcaagccggacaagggctactgccggctcgactcggtccgggacttctggttcgggttcccgtcgatgctgctgttgttcaccgtcgcccgcggtcgctga

SEQ ID NO: 7298 - DNA, 627 bp, Actinoplanes utahensis
gtggctcgacgtaggcgccgtagaagaagcaggatcagcgacggtgctgcgctggccgcggcggccggtggtctcctggctgtcgggttgctggcccaggtggtccgcgagcacctggtcctgaccgcggtggtgaccgcggtggtgaccgcactggtgctggccggtggcggggcgtgggcgtatctgagctggtcggcgatgagtcggctcgcggcccacgagcgcgacgtggcggtgaccgaccacatgagcggcccggagttcgagcagtacgtggcgcggctgctccgcgagagcgactgccgcggcgtgcgggtcagcggcggcgcgggggacatgggcgccgacatcaccgcccggacgccggatggtcggcgcctggtggtgcagtgcaagcgctacgccgggaacctgcccagtccggacgtgcagcgcttcgccggcaccgcccgcgacattcacggcgcggacgtcgcgctgctggtcaccaccgggcgcccgaccgggccggccctccaggttgcccggcagtgccggatcacgctggtggaccggccggtgctggcccggtggatcgccaccggcgtcgcgcccgcagtgctcagcgaccgcgggcgacggtga

SEQ ID NO: 7299 - DNA, 798 bp, Actinoplanes utahensis
atgagaacgcgctcataccaacggaacctgggcaacggcacgcggcgaaaggtggccggcgtggtcattgtcgggggcgtccttgcggcggccggtttggcgggagtgcaactcgcgtcggccagcaccaccccgccaccgcccaaagcagccgcgaacgcgcagcaggcgcagggcggcaatgacgcgacactggcgtcggcgcaggcgctggagacggcttgtgacaccttcgcggcagatgccgccggggctaacggccagaacgccggcaaccagggtgccgacaatcagaatggcgacaacgcccagaacgaccagaacgcgggtgaccagggcgcggccggtggtaaggcggccggcaaggatggcgccaaggcgggtgccgcggccggcaaggcggcatccgacgcccggaacaagaagatcgcgaagaagtgggcgaaggcgatggccgaagccaacaagaagcgtggcaagtccggcaagaagggcggcaagtacggccagaacgggaatgcgaaccagaacgggaatgcgaaccagaacggcaacgccaaccagaacggcaacgccaaccaaggcgccgcgaacgccgcggtgacttcggctcaggcatcgcttctgcaggcgtgcctggcgctggccgacgccaaggctgtggccggcatctccaacaacaacggcaacggcaacaacggcgaccagaccgccgacccgtccgccagcgccactgccgacccgtccgccagcgccggcgccgacccggctgagtccgactccacggccgccaactaa

SEQ ID NO: 7300 - DNA, 339 bp, Actinoplanes utahensis
gtgctcgccctcgccaacatcaccttcgactgtgccgacgccaccgcgctggccggcttctgggcgcaggccctgcggcggccggtcgaccccggcgccaacccgttcttcgcgacgatcggcgccgcggagcccgggccgaccctgatgttcctcaaggtgcccgacgacaaggccgcgaaaaaccgctgccacctcgatctgaacgccgacgaccgggagcttgaggtgaaacgcctggccgagctgggcgcgaccgtccagtccgaacaccaggagtacggcaagcactgggtcaccctgcaggacccgtccggcaacgagttctgtgtggcctga

SEQ ID NO: 7301 - DNA, 774 bp, Actinoplanes utahensis
gtggacgacctactaccgatcggcgcgttctcccgtgccaccctgatctcggccaacacgctgcgggcctatcacgagaacgggctgctggagccggccgtggtcgatcagcgcaccggctatcgcggataccggatcgcgcagctcggcgacgccgcgacgatccggcagctgcgcgagctggacctgccactggccgacatccgggtcatcctggccgcccgcgacccggaggtgacccgccgggtgctggccgcacagcggcggcggctgctggaccggcaggcccgcctggagcggatgctgcggatcaccggcgacctgctcgacgacccggtggcgatcaccccggccgaggtgaccgcccggaccctgccgccgatcaccgcgttcaccctcacccgtgacgcccgtgaggaccagttcgccgacttcctcggggaggcgtatgcggagctcaccgcgcgcgcgatcgccaccggcccgtgtggcgcgatcttcccaccggagttccgcgacgagcccagcccgatcatcgcctacgtgcccgcggcgaacggtgacacgaccctaccgggcggccggttcgcggtcgccgagttcgtcggcccctactacaacatgtcggagggttaccgggcgctcggcgcctggctggcccgcaccggcctcgcgatcaccggcccggtccgcgaaagctacctggtcggaccaggggacggcgtccccgaggaagagttccgcaccgaaatctgctggcccgtttcccgttag

SEQ ID NO: 7302 - DNA, 783 bp, Actinoplanes utahensis
atgaccgagaaggctctacccggcgggaacatcaccggcgccgtgctgatcgacggcgtggtgcacaagccggcctcgccgtggacaccgaccgtgcacgcgttcctgcgtcatctggaggcggccggcttcgacgccgcgccgcgcgccctcggcttcgacgagcggggccgggagatgctcagctacctgcccggcgagacgatcggcggccgtgtgccctggccggcgtgggtgtcgtcggacgcgatgctggtccaggtcggccgctggctgcgccgggtccacgacctgaccgccggcttcgtgccacccgagggcgagcggtggttcgtcggcggcgagctgcggcccgggctggtcgtcggtcatcaggacgcgtcaccgttgaacgcggtcgtcgacggcgaccggctggccggcttctgcgactgggacatcgcgagcccgtccgtcccggagtgggatgtggcgttctccgcgctgacctgggtgccgctcgccgccccgcaggacggcaccccgctgaccgaggatgaccggcgggaccgagcccgccgattccacctgctgctcgacgcgtacggctatgccgaggaccgtcgtgccttcgcgaccgcggtgccgcagcgggcccgcaagcaggccgccgtcatccgtcaccaggccgcgtccggcgacccggcatcgaccgcgctgctgcccatcgccgacctgttggaccgctccgcggccgacgtcgatgcgctcccggagggcttctggatcaaggaccggatttag

SEQ ID NO: 7303 - DNA, 435 bp, Actinoplanes utahensis
atggcgtcggtcaaacagtttcaggtgactttcgactgtgcagacccggagcgggtcgcccgtttctggtgcgaggtgctgggctacgtcccaccggctccgccggccggcttcgccagctgggatgactacaacgcgagccggccggcggagaaacgcaacgccggcttctcctgcagcgacccgaacggggtcggcccgcggctgtacttccagcgcgtccccgagggcaaagtggtgaagaaccgggtgcacctgtgcgtccgggtgggcaccggcctggtcggcgacgagcgcctcgccgccctcgaagccgagtgcgcccggctcgaaccgctcggcgccaagcggttccggctcctgctcgccgacggcgagaacgagtcgtgcctggtcatgcaggacatcgagggcaacgagttctgcctcgactaa

SEQ ID NO: 7304 - DNA, 453 bp, Actinoplanes utahensis
gtgactacggtgaccgagtccgttgacgtcaacgtgcccgtcagcacggcgtacaaccagtggacgcagttcgaggacttcccgaagttcatggacggcgtcgaatcgatcacccagaccgacgccacccacacccactgggtgaccaaggtgggcggtcagatccgcgagttcgacgcggagatttccgagcagcaccccgacgagcgggtcgcctggcacagcaccggcggtgacaccaagcacgccggcgtcgtcaccttccaccggctgagcgacaccgagacccgggtgaccatccagctcgactgggagccggaaggcttcgtcgagaaggtcggcagcgcggtcggcgtcgacagccaccaggtgaaggcggacgccaagcggttcaagcagttcatcgaggagcggggcaccgccaccggcggatggcgcggcgacgtttcctga

SEQ ID NO: 7305 - DNA, 534 bp, Actinoplanes utahensis
atgtcgggagctccgcagacccgcgaggcgctgctggatgccggcgccgcgctggcggagcggcacgggctgagcggcgtcagcgtgaacatggtggtggcggaggcgggcgtcgccaagggcaccttctacgtgcatttcaaggaccggtccgcgttcgtcgacgccctgcacgcccgcttccacgcccgcgtcgaggccggcatggcggctgccgtggcggggttgcccaggggagccgagcggctccttcgcgccttcgaggtctatctcgacatctccctgcagaaccggggggccaaggccctctcgctcgaggtgcgctccggccccgagcagggcgcgatgaccgcacggcgcgagcgcctcgccgaaggcgggttcgccgacctcgaggcgatgggttgggaggacgtcgaagccacggctcagctgctggtcgcgatggtgcgggagatctccgcgttggagttcgacgccggccgtcccctgccggcgtcacggcgcgcgcttaggcgcctgctcgacaggtga

SEQ ID NO: 7306 - DNA, 1038 bp, Actinoplanes utahensis
atgcacgtagaaggtgcccttggcgacgcccgcctccgccaccaccatgttcacgctgacgccgctcagcccgtgccgctccgccagcgcggcgccggcatccagcagcgcctcgcgggtctgcggagctcccgacatgggcaggtcctgtgtcacgtcgagagtttagaccggacgatgggtgaccgaccggtcggtcaccgtgttacggtccatgccatgcccctcctcgacaccgcgaccggccggatcgcctacgacgcgcgcgggtccggtccggccgtcgtcctgctgcccagcggcgcccaccaccggcgcgactacgacgccttgcgggccctgctcccggaccgcttccgcagcatcggcatcgactggcccggccacggcgaatcccccgccggcagccgggcagcggatgaaccgcatctcgccgacctggtcgagcagatcctcgatcagctggctcccgacggcgcggtcctggtcggcaactcgatcggcggtaacgtggccgcgcggaccgccgcccggcgccccgccctcgtcaggggcctgatgctcgtcgacagtggcggcttcgagccaccccggctgcacagtcgcatgttctgcgcgctgatgggtcgcccctggttcgcgcgagcggtctatcccggcttctcccggtggtacatgcgctcccgcacgagcgccgaccggcgggcacgcaccgacgcgatcgccaccacccgcaccgccgcgggactgacagcggtcacgcagatgtggcacagcttcaccctgccggagcacgatctccgcgggctggccggacggatcaccgcgccgaccgtcgtggtctggggccggcacgacccggtgctacctctcgcggccgcccggaacgctcacgccctcatcccgggttcctcgctcgtcgtgatcgacagtgggcactccccgcacaccagcgacccggcatcggtggccgcgcacctcgtcccccttctcgacgcggcattccccgcgaaaggtccgagcaccacccgacagtaa

SEQ ID NO: 7307 - DNA, 546 bp, Actinoplanes utahensis
gtgggcactccccgcacaccagcgacccggcatcggtggccgcgcacctcgtcccccttctcgacgcggcattccccgcgaaaggtccgagcaccacccgacagtaaggatccgcgcaccttcccggcagcgataccgagccggcatggcgatcaccctcatcccacggttcccggtggacgaccagagctcagcaccctgcacgcccgcgccttcaacgccgacccctcggccatccgcccgtggtcccggcgactctcccggcacgccctcacctggatcggcgccttcgacgacgaccggttgatcggtttccttcaggtctgctgggacagcggcagccacgccttcctcctggacaccgccgtcgacccggaccaccggagccagggcctcggcgccgccctggtgcgggccgccaccgccgaggcccgcgccgccggctgcgagtggctccacgtcgacttcgaaccccacctcgaacacttctacctggaccgctgcggcttccgcccgaccccggccggcctggtccacctcgcgtga

SEQ ID NO: 7308 - DNA, 615 bp, Actinoplanes utahensis
atgggcacgacacgcacacctcgcgacaggtggatcgaagcgggactgcaggcgctggccgtcggcggcccggatgccgtccgcatcgaggtcctggccaagaaactcggcgtcacgaaaggcgggttctacggcttcttcgccgatcgcgacgcgcttctgagcgcgatgctcgacgtctgggaacgcgagagcaccgacgaggtgatcgaccatgtcgagcaggaggagggcgaccccaagaccaaaatccagcaagcgggacgactcaccttctcccacgatcgcctactgcccatcgacctcgccatccgcgactgggcccgacgcgacgaggcagtcgcagcccgcctacggcgagtcgacaaccgccgtttcgcgttgcttcgcgagatgatcggtacgttctgctccgatgccgatgaggtcgaagcgcgcagcctgctcgccttctgcgtggcaatcggcgagcacttcctcgccgctgaccacggtagccgcacccgagcccaggtccgcgcccatgccgctgacttgatcctcaaccgccatacagccggcacgacgccgtctgacgcatcagcgagggttgacagaaagcctggtcacgagtga

SEQ ID NO: 7309 - DNA, 516 bp, Actinoplanes utahensis
atgtttgtcgtgacagcttcggatctgcatgagcggccctcgggtgacctgatcaagatctggttcaagttcgtgccgcgtgagggctggttgccgtatgacacagagggtctgtgggccactcagttgggcgaggacacggcccgggtggcaaacgtggcgttcctgcagaacggcatcgcgcaaggtgacgtggtgcgcttccagacgaatgaggatggtttccgctgggcgacggaccgggtggaggcgtcggggcactgcgtcatccggatcctgccggtaccgtcgggtccgctgggccggagtgcgtcggctgtccaggctgcgttcgcgcgtttcgggttgggcggggaggtgttcagcgccgagttgccgttcgtggccttcgacgttcctgccgatgccgatttcggtgagatccagcaggtgctcgcagatggcgagtcgcagggctggtggcacttcgaggtcggttgtgggaccgaccgctggtggagctcagcggcctcctga

SEQ ID NO: 7310 - DNA, 1032 bp, Actinoplanes utahensis
gtggccggactctcgcggaccgagccggtgatctattgccggacgggatgcggaggctgttgcgatgggccgtttgcgacccgatgcaacgacgacgtggtcaccgtcgacacaggccgggccgcgtacgatgacggcgtgcctgagcgatcctgggaagtcgaacccggttccggagtcggtccgctgcggttcggcacctcgcgcggcgagttgcacgcgcttctggggccgcatcgggcgttccggcgcagtcccgcgtcggatctgacggatcagttcgaggcgggcgggctcatgctcacctgttccgaggacgagggtctccacctgatcgagatccccgacccggacggcgttcactaccggggtgtgcggctcagcggcacggtcacgacggtgctcgcggagctgcgggcagcgggcgtcgagctcaccgccgacgacagcggctggcttttcgccgacggcgcggtcgggctgtacacgccttcctcggagccggacgcccgggtcgaggcggtgacgatgttcggaccggggcacgagatgaccggcgaaatcgtcttcttcccggccgggtccgaggcgatgccgcccgtctcgtcctatgtcgtcacaccaggtacgggtgtcggccccatcaccctggggatgcaccgggacgaggtgcggcgccggctgaacggcggcctgtgcttccggaacgcggccggctcgcgggagccggagcaggacgaattcttcgaggatcacctgacggtccgctacggccccgatctgctcgccgtccacatctacgtgaaccgggcggacgccgtgctcctcgacggaatcaacctgatgccgacgcacccgctgaccatcgaggatgtgcgcccactactgatccgggcgggccgcacgctggccgagcgggaggccgggatcgatatcgtcggcaccggcgtcgagatgcggacgatgggcccgctgtcatccggctacggaccgcttccggtcgcctgtgtcgccgtcgccctgcagccctga

SEQ ID NO: 7311 - DNA, 510 bp, Actinoplanes utahensis
gtgctgagaccgcagaaggtagtcgcctacgtcgttcgagagggtcggcttctggtcttcctgcacgtggacgatgtcagtttcgatcagtccgggctgcaggtccccgccgggaccgtgcgcgccggggagttgcccgaagcggccgtggtgcgcgaggcggccgaggagaccggtttgccggggctgcgcgtcgagcgatacctcggggtgagtgaattcgacatgcggccgtacgccgatgccgtccacgtgcggcatttcttccacctgacggtcgacgcgccggaggtcccggagcgctggttcaccgaggaacgcggcgacggcgacggcacgccggttcggttcgagtgctactggctcccgctggcacaggggcatgtactggccgccgggcagtcggccctgctcgggcggcttttcgacggagtctccggcggcgccgtcggttcagggctgcagggcgacggcgacacaggcgaccggaagcggtccgtagccggatga

SEQ ID NO: 7312 - DNA, 558 bp, Actinoplanes utahensis
atggagacttcagcccttgccacggtcatccccctcgtcggcgtcgcgttgggggcggtcagcaccttcttcgggcagtacatcgcgctccggggtcagcgccgcgaccggcaggaggagctgatcgccgcagccagagccgagactcggcgagcgatcctcagcttcctgtcggcggcgcaggatgtcgagcgggaggtgagtcggatgaagcgggggctcgccaggcgcgatgagatcgccgatgagctgatcggcgacctctggctggcgaagaagacactggagctcgtctcgagcccggagctgtcgcaatgcgcccatgactacacgtccgtgctggagtccctggtgtgggacagcgtctcctcctccgccgtccaggagaagcgcgagcggcgatggaggttcatggaagcggcacgacatgaggtcggcgccggcgtgcggtcgatcgatcgatggtcggtttccgagcggctgagcggcaaaccgctggcgccggggaacagctctccgacagcttcggtggaacgcgagggcgtccagccgtcgtga

SEQ ID NO: 7313 - DNA, 561 bp, Actinoplanes utahensis
atgacgaccttcctggttctcttgcgcggcatcaatgtcggcggcaagaacaaggttccgatggcggatctcaggacgcttctcggcgagtgcggttttctcgacgtctcgacgttcatcgccagtggaaacgtcatcctcacctcggaccgggacgccggccaggtggcggcccggatcgaggcggagctgcccgaagccttcccgctcgacagcgagctcgtcaaagtcctgaccctgaccggcgatcagctccgcgctgtcgtgcgggaccgcccagcgggtttcggcgaccgcccggacacctatcacagcgatgcgatcttcctgatcggcctcgaggccgccgaggtcatgcccatcttccatccgcgcgagggcgtcgaccgcgtctggcccggaaacggcgtcgtctatgcgcagcgtctcagcgcccagcgcaccaggagccggctgagttccatgatggcctcgcccctctatcggtcgatgaccattcgcagctggaagacgaccgtcacgctggcggagatgctggacgcgcggacagcgcgcccctga

SEQ ID NO: 7314 - DNA, 534 bp, Actinoplanes utahensis
atgagtgttcccttgaccctgctcgggctgctcgaacgggccccgagccacggctacgacctcaaacgcgactacgacacgtttttcggcgtcggcaagtccctgccgttcgggcaggtctacgcgacgctgagccgcctcacccgggacggcaaggtggtgatggacgaggtggcacccggtgacgggcccgagcgcaagcgctatgtgatcactgagcagggcgccaccgaggtcaactcctggctgtccgacccggtgaccccggagccgcacctgcagagcatcctgttcaccaaggtggtcctcgcgctgatgctggaccggccggccgaggcctatctggacgcgcagcgccaggcgcacctggtgcggatgcgggaactgaccgcggtgaagcgctccggcgacctggtggagacgatgctggccgaccacggcctgttccacctggaggccgacctgcgctggatcgacacgacgtcggcgcggctcgatgccctgcgtacgcagatcaaggcgggcaaaccgtga

SEQ ID NO: 7315 - DNA, 684 bp, Actinoplanes utahensis
gtgaccgccgcgctgaccgcgaccggcgtcgcgttgtcgttcggcgcgacgccggcgttgcgcggcgcgaatctggcggtggccgagggcgagatcgtggcgatcatggggccgagcggttccggcaagtcgacgctgctgcactgcctggccgggattctggtgcccgacgccggggagatcgatttcgagggggtacgtctcaacgggctgaccgaggcggcccgcagcgagttgcggcgcgaccggttcgggttcgtgttccagttcggtcagctggtgcccgagctgtccgccgtcgagaatgtcgcgctgcccctgctgctcggtggcgtcaagcgggatccggcgatccggcaggcccgggagtggttcggccggctcggcatcgaggggctgcagggccggcgctccggcgagctctccggtgggcaggcgcagcgggtggccctggcccggggcctggtcgcacggccgcgggtgctgttcgccgacgagccgaccggggcgctcgactcgctcaccggcgagcaggtgatggagctgatggtcacctcggctcgggagcaggggaccacggtggtcctggtgacccacgaggcgcgggtcgccgcgtacgccgaccggctcgtcatggtccgcgacggcaaggtcacctcgccgtcggaggtgcccgtctcgtga

SEQ ID NO: 7316 - DNA, 2187 bp, Actinoplanes utahensis
gtgatcagtctcggactccgactggcggtggccggcggccgcgaggcgatcacccggctcgtcgtgctggccgcggcggtcgcgatgggtgtcggcatgctgctcgccacgatcgccgggatcaacgcggtgcacgcgcagaacatgcgctacccctggttgaacagcggcgtgaccagcgtcgcgaccggcccgcaagcgcccgacccggccatgtgggcgctgcgcgaggactacttccacgggcatccgctcgcccggatcgacgtggcggtctccggcccgcacggtcccaccccgccgggactggccgcgctgcccggccccggggagtatgacgtctcccccgccctggaccggctgctccgcgaccatcccgccgatgagctgcgcgaccggttcgcggggcggcaggtcggggtcctcggcgacgcggcgctgccctcccccgactcgctgatcgcggtcgtcggcggcacccgggaggaggtcggtcgcatcacgggggcgaccgagatctcccggatggtgacgatcgcaccggacaagtgcgacggttgcgtcgtgggcctcggcgaacggggcatcgtgctgaccctgtccgtggtcacggccgctctgctgttcccgttgttgattttcatcggtacggcgacccgcctgtccgccgcgcgccgcgagcagcggttcgccgcgatgcgcctgatcggggccacgccgcggcagatcacccagttcgccgtgctggagtccacggtggccgcggtgaccggcgcgatcgccggcttcggggtgttcttcgcggcccgcgccggcctggcgcagatcccgttcaccggtgagccgttcttccccggcgacctgtcgctgtcggtcaccgacgtgctcgcggtgctggtcggcgtcccgctggccgccgcactcgccgcccggatcgcgctgcgccgggtccggatctccccgctcggcgtcacccgccgggtcaccccgaaaccgccgcgcgcctggcggatcatcccggccctgctggccctggccgagctcggctatctggtcaaccaccgcccgaacaccacacagggccagacgatcggctatctgagcggcatcttcggggtgctgatcggcctgatgatcgccgggccgtggctgaccatggccggctcccggctgctggcccgccgcgcccggcggccggccacgctgatcgccgggcggcggctcgccgacgacccgcgggccgggttccgcgcggtcagcgggctgatgctggccctgttcgtgaccaccaccgccaccggggtgatcaccgcgatcgtcgccgagcgcggcggcggcccggtcggcgcgcgcggccacgacgtggtctggatggagctgggggcggaccgggagggcctgccgccgactcaggtacacgtacgggctcaacgggtccgggccaacccggacgcgaggccggacaacgatcatctgcccgggctgatcgcctgcgccgacctggcgaacatcccgggcagcggcacctgcccggccggggccgaggtggccgaggtcttcaccgacctgagcacctcgacctggctgccgcacaccgcggccggctcgacctggccggccgcccggcagaccacggcgcagctcggcgcactcaacgtgctgtccgcgctcatcccgaccgacggcagcccggccgccatcgagcgcgcccggacgacgctcgacaacgcgttcccggacgggcggggggccggcaccgaggccgacttccgcggcgacttcacccgccagctctcccagttcgagcggctggccgacgtcgtgatcatcgcgagtctggtgatcgccgggtgcagcctcgcggtcagcgtcaccggcggcctcaccgaacggcagcgtccgttcgcgatgctgcggctgaccggggtgcggctcgccgaactgcgccgcgtgatcgcgctggagacggcggtgccgctgctggccgtctcgatcgtcgcgatcggtgccggcttcacggccgcacacctgttcctgcgctcgcagatgcagtacgacctgcacgcgcccggcacggcgtactacgccatcgtgtctctggggttgctcgcctcgatcgcactgatctcgtcgaccatgccgctgctgcggcggatgaccggacccgccgcggcccgcaacgagtga

SEQ ID NO: 7317 - DNA, 462 bp, Actinoplanes utahensis
atggcaggcacgctgctcccgtggcccgagatcgagaagggcgccaaggaacacccggtaccgaccctgcagtacctgctgcgggcccgcgggcagacgatcgcggtcgacggcatcttcggcccggagaccgagaccgcggtgctcaccttccagcgggcgaacggactgtccgccgacggcatcgtcggcccgcacacctggagcgcgctgatcgtcgaggtgcggcgcggctccgagggggacgcggtccgcggcgtccaggaggagttccagtatcggaacctgtccggcatcccgggcaacggcctcgcggtcgacggcatcttcggcccgcggacagaggccgccgtccgggcgttccagaccgcggtccacgccgatgtaccgaccctgacggtggacggcatcgtcggcccgatgacctggcaggccctggtcagcggcatgtattcgttctga

SEQ ID NO: 7318 - DNA, 612 bp, Actinoplanes utahensis
gtgacgccgatccggatcctgctcgccgacgacgagcacctcatccgcggcgcgctcgcggcgctgctcgggctggaggacgaccttaccgtcgtggcccaggccgcgaccggtgccgaggcgttgtcgatggcccgcgccctgcgccccgacgtggccgtgctcgacctgcagctgcccgacctcgacggggtggcggtcgcgcgggcactgcacgacgagctgccggggtgccacacgatgatcgtcacgagccacggtctgcccgggcatctcaagcgcgccctcgccgccggggtgcgcgggttcctgcccaagaccgtctccgcggagaccctggcgggcgtggtgcgtaccgtgcacggcggcggccgctacgtcgacccgcagctggctgccgaggcgatcagcgcgggcgacaacccgctgaccccgcgcgaggccgacgtgctggagctggccgccgacggggcggcggtcgaggagatcgcccggcgggcggcactgtcacccggcaccgtccgcaactacctgtcggccgcggtcggcaagaccggcgccgccaaccggcacgaggcggtccggatcgcccgcgggcacggctggatctga

SEQ ID NO: 7319 - DNA, 1200 bp, Actinoplanes utahensis
atgacggtggctgcatggtggcgttcacgcggcagggcggcccgcctcgacctgtatctgcgcggcaccctctacgccaccttcgccgcggccgtaccgctcgcggccggcagcgttcccgggcgtgccgccttgtgggtggcggcggctgtggcgacggtgcacaccgtcctgtccgtcctgctggtccgcgccggcgtggatcactacctcggtaaccggcccttcccggcccgcctggtcgcggccggcggcgcgctgaccgcggcgggggtggcggcggccgtcctggtgtatccggacgcggcgccggggcagccggacggcccggccaacgcggtgctgctcatcctcgtcgtgtcgtacgtggccgcgctgtcgacggcggtccgtccggtcgtggcgctcgccgtgggcgggctgggcagtctggcgttgtacgccctcgcggccggccagggcgccgcccggccgggggccccggccctcgccatggtgatcgtcaccgggttcgtggtcgcctccttccgcgtcacggtgtggatgctgggcgcgctctgggagctcgaccgctcgcgcgaggtgcaggcgaaactcgccgtggccgaggagcggctgcgcttcgcccgggacctgcacgacgtggtcgggcgcaccctctcggtcgtcgcggtcaaggccgagctggccgcgcagctcgccaagcgtggacgcgacgaggcggtcgacgagatgctggaggtacgccgcatcgcgcaggagtccctcgccgagttgcgcgcggtggtgggcggctaccggacggcggacctcgacgccgaactggccggcgcccggtcgctgctcacctcggccggcatcgcatgccgggtgatcggcgacggtggtgggctgtccgcagcggtgcagggcaccctcggctgggcggtccgcgagggtgcgaccaacgtgctgcggcacagcgaggcgcggcactgcaccgtcgcgctgcgcctgtcgaccgacggcacggtgacgctcacggtcgacaacgacggagccgcggcgggcgacgcccgggtccgcttcggcagcgggctgatcgggctcgccgaacggatcgccgggatgggcggtaccctcaccgccgagcgcgagccacccgagggcttccggctcaccgcgcagctgccgatggcggcggaggaggccaccgcgtga

SEQ ID NO: 7320 - DNA, 792 bp, Actinoplanes utahensis
atgacccacctgaccggcacgatgagacggatccgcgcgatcggccgggccgagctgacgctgctcctgcgggacgggatggccctgtgcaacgcggtggtgccgccgctggcgatcgtcggcctggccgcggcggcgaaggccgacccgggcgggttgccgggcaacgcgttccgggtcaccggccttctcgggctcgtcctggtgggcgccgtgtacttcactctggtcgggacgtacgtggcccggcgcgagcggctcgtgctcaagcggctgcgggtcggcgagatcaccgacgtggagatcctcaccggtaccgcgagccccgcgatcgtcctggccctcgcgcagatcgtcgtgttcacggtggcgggcgcggtgttcctgggactgcccgtgccggtcaacgcccccgtgctggtgctcggggcactcggcggggccggggtgttcgtgctgctcgcggcggcgtcggcggcgttcacccggactgtcgagctggcccaggtgaccaccatgccgctggtgctcgcctgtctgctcggctcgggtctgatgatgccgctggacgacctgcccggctgggtcggcgaggtcgtgcggttcctgccgctgacaccggcggtcgagctcatgcgcctgggctggctgggcacgacgggcgcaggtgcgccggtgggcttcgtcgccgtcttcgccgcggccgccgggccggtcgctatcctcgcggcgtgggcggcgctgggcgcggtcgcggtgcggcgccggttccgctgggaaccccggcggtga

SEQ ID NO: 7321 - DNA, 1188 bp, Actinoplanes utahensis
gtgggcgcatctgcgcggcccgcgccgcgagttggagctggccgactcggggcacatgtcgttcaccgatctgcaggtgctgcttccccaggcgggcgccgcgcccggcaccctcgaaccggcgttcggcaccatcgacggcgagcgagcggtcaccgtcgagcgcgcctacctcctggccttcttcgaccggtacctgcgccaccagcgccgcgggctgctcgacgcgccgtcgccggcctaccccgagatgcggttcgtccgatgacggccgccgccatcgaggtacgcgggttgagccgccgctacggcgggcccggcggattcgaggccgtccgggacgtgtcgttctcggtccagcggggcgagctgttcgccctgctcggcacgaacggcgccggcaagacgtcgacgctggaggtggtcgaggggcagacccggccgaacgccggcaccgtccgcgtgctgggccacgacccccacgccgcgcgggccgcggtgcgcccgcgcatgggcgtgatgctgcaggagggcggcttcccggccgacctcacggtcgtcgagacggcccggatgtgggccggcacgctcgccgtgccacgcccggtgagtgaggcgctcgcgctggtcggcctggatcaccgcacggccgtacgcacgaagcagctctccggcggcgaacgccgccgcctcgacctggccctggcgctcctcggccggcccgaactgctggtcctcgacgaacccaccaccggcctggacccggagagccgccacgccacctggcagttgatccgcggcctcctcgccgagggcgtcacgatcctgctgaccacccactacctgggggaggcgcaggggctggccgaccggctcgccatcatgcaccgcggtcaggtggtgacgaccgggtcggtggcggacgtggtcgccgcgtacccggcgcgggtcagcttcggcctgcccgccggcattcccgtcgacgcgctgccggagctgcccggcgcgcaccggccggagtccggcgccggcgggcaggtcaccgtccacaccgccgcactccaggcgacgctgacggcgttgctgtgctgggccgaccagcgcggcgtcgtcctcgccgggctcgacgccagatcggcgtcgctggaggaggcgttcctgtcgatcgccgccgggaggcagccatga

SEQ ID NO: 7322 - DNA, 687 bp, Actinoplanes utahensis
atgattcaggtagggactaccgcgttgcacgttggtgtaacgggtcacgggcctgatgttgtcgtcctaaccggcggtccaggttgtgtgcagtacctggagcgggatgaaatctcgccgctgggccatcgcgcctggtaccccgagccgcgcggcgttggccgctcgggcggcagcccgcacaccatggaagaagcaatcgctgatctcgaaggaattcgtgaggcggtcggtgtcagcgcgtggactgtggtaggccattcgtggggttctgatctgggtatgcgctacgcggtcgaacatccggaggcggttgctgcattggtcggcatcgccgggaggggtccgcagcgtgaccgcacatggtctgaggcgtatgaggccagcaaggccacggagccctttgtcgacatcgactgggtgcccgaagtgcacgcagctctcggcgagtcgttcaccgaatggattcatcgaccgagcctatggcgggcactggccgactgcagcgtgccgatgcatttcatcgcggccggcaacgacatccgcccggcgtggtccctggcgcagcttgcggagctggttccacgggggcagttctccaccgtgcctggggtgccgcatgacttctggtttacccaccctgaggtgtggacccagacagtcacaaacgcatgcgccgctgtgtaa

SEQ ID NO: 7323 - DNA, 348 bp, Actinoplanes utahensis
atgggcttatcggtgaccgtggctggcacttcagggatgatcctgggcgattggacttcttctccctggtggatctccccgatggccaacggcgtgatgattttcatggcgctctacccgctgagatatctcaaaacgaaggtcgaccggctcggcaaggccgacttggtttaccttctcacgactagcgtgatctcgatcgcggtgactgccgcggtggtagtcacgctgcagaacggaataaccacttacctgctcgcgggagtggcgagcctcgcagtatggatgtcgaccgcatggtgggtgggacggagccgcaccgacgcgccgggcactcgcgagcgatga

SEQ ID NO: 7324 - DNA, 714 bp, Actinoplanes utahensis
gtgcgttccgcgttcgtacttgtgcacagcctgctgttgggtcctctgacatgggccccggtggcagccaagctggcgtcctcgggcgcatcggcggtagtgccgtcgttggtcgacgtcaccgatgcggacgatccgccgttctggccacgcgtcgtcgacagggtccacaatgctgtcgcccggttgccgccgaatcaaccggtgttcgtggtcgcacacagcaacgccggtctgttcgttccggcaatcgtgcacgcggctccgcgcccggtcgccggctgcctgttcgtcgaggccagactgccctctcgaaccgggccgacgccgaccgcgtcgcccgagcggctgacccacctgcgtacccaggtgaccgagggtcggctgccacagtggacagcctggtgggacgaggaggacgtcgcggcgctgtttcccgatccgcagaccagattgacgatctcggccgaacagccacggctgccactgagctactacgagcagcagattcccgtacccgacggctgggatcgccggccatgcgggtatctgctcttcgggtcgccgtatgaccagatggcgcaggacgcccgcgaacgtggctgggatgtcgcccaggtcgcgggacaccatctccaccaactcgtcgatccggacgcggtggccgccggcatcgtcgccatgaccgacagatggcgcttgtcggccagctga

SEQ ID NO: 7325 - DNA, 1083 bp, Actinoplanes utahensis
atgacgacgtctcctctaggacctgacagtgcgcttctgcaaccggtgacagccggtgcgttgcaggcgtcaaaccgcatttggatggccccgctgacccgtaaccgggcgaacccggacggcaccccgaacgagctgcaggccgagtattacggtcagcgtgcgggcgctggcgtgatcatcaccgagggcacgcagcccgcggcggttggtcagggttacccgaacaccccgggcctgcacagcgacgcccagcaggacggctggcggcgcatcgccgaatccgtgcacgccgccggcggccgggtcgtggtgcagctcatgcacgtcggtcggatctcgcacagcagcaccatcggcgggcagacgccggtcgcgccgtcggccgtccgggccgcgggcgagatcttcacggcagagggtctgcagccgttctccgaaccgcgcgccctggcgaccgacgagttgcccgcggtgatcgcggagttcgccgacgccgctcgccgcgcggtggccgccggcctggacggggtggaactgcacgccgcgaacggatacctgctgcaccagttcctcgccgacggcgtgaaccggcgctcggactccttcggcggctcaccgcagaaccgtgcccgcttcgtcgtcgaggtcgcgaaggcggtcagcgccgcgatcggcgcggaccgggtcgggatacggatctcccctgcgcacccgttcaacgacatccacgaggatgacctcacggtctacgaagtgctgaccagccagctcgccgagctgggtctggcctacctgcacgtgctggccaccccggacgacccgatcgtcggcaaactgcacgcgatctggccggcgacgttcgtcctgaacacaggtttcggcgtggagtcagaccgcgatggcctcgagcggctggtcgccgacggcgtcgccgacgcggtcaccgtgggccggcccttcctggccaaccccgacctggtccagcgctggacgctgggagctgagctcaacgagcccgaccaggccaccttctacgccggcggcgcgaagggctacacggactacgctccgctgtcctga

SEQ ID NO: 7326 - DNA, 351 bp, Actinoplanes utahensis
atgcattccaacctcaccgaacacgctcggtgccgctacggtgatgaataccgacccgccgtcatcgcgcagtgctctgaggatcgcgacgatcgatacttcatcgagaggttgaccttcgccgacgcggaggcgatcgcggcgatgttgcatgagctgtgtccgaatatcgttgacggacttctcccggtatgggtgcgcaacctggcctatcggctcttgcttctgcaacgcccggacgaccccgccttgatgcgcgaggctgcacagagcctctgggtgcatgggccggactgggatgacatcgccgcaggcctggaatgccgcgccacggcgctggaagcgggctga

SEQ ID NO: 7327 - DNA, 489 bp, Actinoplanes utahensis
atggacgacaagctcagcgccgaggaccgggcgtcggccgtacgcggtgcgaaggtcaccgtcggctgcacagtggacggcgcgaatcatcgcccgcagccgtcgattgaccctacgatgggtcgagaacgtactttccaggagaggcagagggtcgtggagagcgccggatcaggcgacgcgatcggggatctccgcgccgcggtggcgaaggcgaacgccgagctggcgacgctggcgcccggcccggcggcatatcgtcagcggcggcggcaggtggtgcgggcctcggggcggctgcgtgagcgggagacgttggctcagcggcgcgccggccacctccgggacatgcgactgctgggcgtcctcatcggcggcatcgtggcggtcgccggcgccggctcgtgggtggcgatcctggccggcctcggcctcgcgctgctcttcggctggatcgtgggccggctgccggaccgcatgttccgctga

SEQ ID NO: 7328 - DNA, 204 bp, Actinoplanes utahensis
atggttccagcagaccttcatgccgctgcgcgacggcacggcgtcgtgatcggcatcgtcgcggcggtcaccgaccgcaccgaacaggccctggcctcgcggcggctcgccaccctgaccgaactcgccgccatcgcggccgatcggggccggcgcgaggcgttggacacggcgctggtccggctggcgggtccgaaaatgtga

SEQ ID NO: 7329 - DNA, 501 bp, Actinoplanes utahensis
gtgccgcagctctaccacgtcagcgaccggggcccgttcaccacgatgcgtccgcggccctcgccgcccggcaccccgcacgaggggcaggaactggtctgggcggtcgacgaggagcacctgccgcactacctgctgccccggcagtgcccgcgggtgtgctgggcggtgggcgggccgcggcgggacctgctgtgctcgccggccgcccgggtggtcgccgtcgagcacgggtgggcgtcacgcctgctcgccgccgggctgaacgtgcacctgctcgacccggcggggttcacgctgctcgacgccaccgccggctactgggtgtccgcggagcccgcccgggtgaccgcggtgcgccgggtcgacgactgtttcaccgcgctggccgcccacgacgtggagctgcggctgaccccgtcgctgtggccgtacgtcgacgcggtggtgcaggccgggggagagttcagcgccatccggatgcgcaacgccgcgcggtga

SEQ ID NO: 7330 - DNA, 468 bp, Actinoplanes utahensis
gtgcaccgccgggacctgggccggcagcagaccgccgcccgggtcgccgagctcctcgacctggtggccctgcccgccgcgtacgcccgccgtttcccgcacgagctcagcggcggccagcgccagcgggccagcctcgcccgtgccctcgcgctgcggccgaaactgctgatcgccgacgagccgacctccgcgctggacgtgtcggtgcaggccaccatcctggagctgattctgcgcctgcaccgggaactcggcttcgcggcgttgttcatcagccacgacctggccgtggtggaggcggtggcgagccgggtcgcggtgctgcaccgcggccgggtggtcgaggtcggaccgaccgcggacgtcctgcaccaccccaccgatccgtacacgcgacgcctgctcgcggcggtcccggtcgccgacccggcccgccaggccgcccgccgccgggtgccactctga

SEQ ID NO: 7331 - DNA, 285 bp, Actinoplanes utahensis
atgaacgcccggcctgagtcctcgaatgggccttcgccgctccgccagccgagggccggcgacgtggtccgcctgaccacgaaggcgagcgtgcagttcgccggcgcctgcgcgatggtcttccggatcatccgcgttgatccgcgggagacgtacgccggctgggtctggctgatcgggtactccatcgacgcgagcggcagggcaatcgagcgtcgggaggtcttcgtgcagatcgccgggttggtctacgtaacgacgccttgcgtgcctccggcggagtga

SEQ ID NO: 7332 - DNA, 1542 bp, Actinoplanes utahensis
atgcgtaaaagggtcggccgcaataccctttcaacccattccgcggcggtatcccttgacgggataggcgatcggcaggccacgatggatcacgagacgtcgaagccctggcggagggacgtgccgttgaagtccgaaattcccggctccacctggaaccggcccgacatgctcaccgcgttgcagtcgcgcgacattgctcacgtgttccgcttggtgcgccagcacgccgggatgtcgcagaccgcgatcggcagcctgatcgggatgagccagggcaaggtcagcagcatcatggcgggaagccagcaggtcaccacgctggaggtctacgaacgcatcgccgacgggctccggctaccggacaccgcgcgcatgacgctcggcctggcgccgcgcagcatctcggcccgggatggttcccactccgacgcaacgggcacggtcaacccgacgcgtagcgtggagagagatccgcgaccggaggaggacaacgccgtgcgacgtcgcgagttcgtcggcctcaccggggccgccctcttcggcgccatcctggcgaagaccgagccgaccgatcaacccacaaccagcggcaccgacgacctggccacagccctcaccgagttgccgacgccggccgccggcccggtcaacctctcccgcctatccgcgacggtcgccgccgccaagcgcgtctaccaggcgtgcaagtacggcgaagtgctcacgatgctgccgccgctcctgcggtccctgcgcaccgcgttgaccgccaccgacggcgctcagcagcgcaaggctcaggcgctgtcggccgaggcgtaccacgtcgccgcctcaatcctgctcaagcagggtgataagggacttgcgtggctggcggcggaccgcagcgtccagaccgcgcagcaaaccgcagtcccgctgatgatcgggtccagcgcccggatcatcacccacgctctcatggacggcggccaccaccgcgccgcagccaccaacgccagcagcgccgcccagcacatggacgcggtgctcacccagccgaccgacaatgacctgtccgtctacggatccctcttgctccgcggcgcgatcgcagcagcccacaacgccgaccgccacaccaccatcgaactcctcgatgaggcagagcaggccggcggccgtctcgggcacgagggcaaccacatgtggaccgcgttcggtcccgacaacgtgctctgccaccgggtcaacgcagcgctgcgatttggcgacgctggcactgccatcgacttcgcccggcgcatcgacttggacgcgttgcccatcaacgaacgcaaggccgtgctcctgctcgatgtcacccgcgcgtttctcatatggggcaagcacgaacaggctctccacaccatgcgggccgccggccagattgcccccgaggagatcaccggccgcccgcggatccacaaactcgtcggcgacctggtcgctaccgcgccgatcaccgtccgccgcgaagcccgcgagttcgccgacgcctacggaatcgccgcatga

SEQ ID NO: 7333 - DNA, 690 bp, Actinoplanes utahensis
gtgcgcgtctggatcggcgggctcgggtccgcctccacggtggtgttcgccccggtgaccggccatccggatctggccgtcgcgggtcgtcacctgcttgtcgacctgatcggcagcgggtggagcgatcacgacgacacgttcggccacaccgtcgacgagcacgcggcgaccgtcgccacggtgctcgacgccgtcggggtggccggggtgacgctggtcgggcattcgctgggcgggtcgatcgcgatcagtctggccgcgcagcgccctgatctggtgaagcatctgatcgtcgccgagccgaatctggatccgggggtcggcacgttctcggccacgatcgccgccttcgacgaggacaccttcgccgccaccgggcacggccggatcgtggccgcgttgcgggccgagccgggcgccgtcgaccaggagttcgcccgcacggtggcccgctggtcgccgcggggactgcaccggacggcggtgtcgctgctggccgggcggccggcgacgttccgcgagcagctggccgcgttcgacggcccgcgccgcttcatcggcggtgagctgtccggggaggatctcgggccgctgcgggacgtgggctgtgaggtgctggtggtgccgggcgccggccacgtgatgatggccgacaacctggcgggtttcgtcgcggccctgcgatga

SEQ ID NO: 7334 - DNA, 192 bp, Actinoplanes utahensis
gtgaccgcagtactcgcagcgttgacccggccggctcggttgatccccgccggtgacctcttcgacggcggtgacgagcgggcggagttgctggacggggtcgccgcccacctggcggagacgttcgccgcgcggatcgccgcggtgacgctggtgctcaacgatgcccgggtgcgttcactgctcggttag

SEQ ID NO: 7335 - DNA, 699 bp, Actinoplanes utahensis
atggagtccgcatggtggttaaggtcgacgacacatcgatcggcacaacagcgggggctgggcatggacagtcgcatcgagcggtcacggcagctctacgaacgcatggctttcgacggcgacggcagtggactgccgatcgcggagcgcgaactcgacggtgtcgaagctgaccttgcgctggcgcgtggacgactcgcgcacggccgcttcctccgggacggtcaggaagatccgcaggaactggcgtttttcgcccgcgccgcagaactctacgaggccttggacgacagccgcggtgccgctgaggcactgctctggatcgggatcttccatcagttcatccgggacgacgatgatgccgcgatgccggcacttcatcgatcgcgcgagctcgccgagcaggccggcgaccggctgggcctgtcttacgcacttcggcatctcggcatcgccgagcatcgggccggccggttggataccgcgcgagagcacctggaggagtcgacgcggctgcgacgagaggtggactttctgcccggcgtggcggccaacctggtcggactgagctacatcgccgctgcccaggggcgccgggacgatgccatgaccgcggcggcggaagcgggcaggatcgccgggtcgaccggcgcgctcgccatcgcccgtcaggccgaggaggcactgatccgcatatga

SEQ ID NO: 7336 - DNA, 873 bp, Actinoplanes utahensis
atgcactcagccgggtggcacctcaccgaagacgtcgaccacttcctcgtccacgccggagacttcctgcgttcgcgccccgcgctgcacaccatgccgctgacgcggatcgaaaccttccggacgcgtacggccgaccgggccggcgcggtgttcggctggctggaatcgggaggcggggtccgcgccttcttctaccggctgcgccccttcggccttctgaccctcaccggcgtctcccgcgagcagtccgacacccttgccgccgagttggccgcccgcggcgattccctgaacgccgtccacgccgagcatgacaccgccaccgccttcgccgaagcctggaaccggcacaccggcgctgacccgctcctggtggcacggacgccgctctaccgtctcgacaggttgaccccgccacggcggccggccgagggtcatgggcgcaccgccgacgcgcgcgaccatgagcacgtcgtgcgctggtgccgtgagttctgcgccgccgtcggcgaagaccggtccatccagatgatcgatgtcggagactgggccgccagccgcttcggcgacaagcattacaccttctgggagaccccggacggcactgccgtctccatggcgggttggacctcgatggtctgcggcatggtccgggtcgaccccgtctggacgccggcccactaccggggccgcggctacgccggcgcggtgaccgtcgaggtcagcagagccgcgctcaccgcgggcgcgaccgacgtcgtcctgttcgccgatgccaccaaccccaccagcaacgctctctaccagcgcatcggatatgtcccggtcgccgacttcgccctctaccgactcccccggaccgcggcatga

SEQ ID NO: 7337 - DNA, 696 bp, Actinoplanes utahensis
gtgccgatcacctttcccacccatcccgccgctgtccttccgctgaagttgtggcggcccggatggttcgacggggtcgcgttggccctgggctcggcggcacccgatgtggcctatgcgctggacggcagcggcctgccggtctggccgctgtcgcaccaggtgcgcggcctggtgctgtggtgtctgccggtcacgctgctcggctgtctcctggtgcgccgcgccgtcccggtggtcgccgcccatctgcccggcggcgaccggctcgcgttgcgcgactacggcgccttgcgcagctcggcgcatccctggtggatcacggtgctttcggccctgatcggcgcggccagccacctggccctcgacgggttggagaaactgatgccggcggtggaactccccggccacgcggtcggcgcggtcaccatgacggtgctgttgctggtgatcggccggcggcgcctgatccgccgctggcacggcgcgccgccggtgcgggagcggcgtccactgctgttctggtccgtggcggccgcggtggcacttccggtgctcacggtcaccccgctgctgccgggcgccggcctgctgcacaccacgggcgtacgcatcctgtccgcgaccgccctgggcctgctcctgggcgccgcggccgtcggagctctccatcccgagccggcccgaacctcctga

SEQ ID NO: 7338 - DNA, 309 bp, Actinoplanes utahensis
atgctgcggtgcgaacgacccccgcttaccaaggagctcgacgtgcacgtttccgggatcatcaccgccatcatcatcggcttgatcatcggcgcactcggccgactggtcgtgcccggcaagcagaacatcccgatctggctgaccatcgtcatcggtatcgtcgccgccatcgtcggaaccttcatcgcctccgccctcggtgtcaacgacaccaagggcatcgactggatcgagctgctcatccaggtcgttctcgccgcgctcggcgtcggcgccgtcgccggcctctacggccgccgcgcctga

SEQ ID NO: 7339 - DNA, 891 bp, Actinoplanes utahensis
gtggacgttgtcgtggtcggtgccgggatcgccgggctgtcgtgtgcgcgagcattggcggacgctggggccagtgtgcgcgtcgtcgaacgcggccgggtcgtcggcggacggttggccagcaagcgctacggcggccggtatgccgacatcggagccgcgtacctcgtcgccgacgacccggacttcgccgcccaggtcgccggttggcaggccgctggactcgcccggccgtggaccgagtccttccgggtctacccgggcggccgggatgccaccggcccggtccgctgggctgctcccgacggcctgcgatcgctggccaccgacctcgccgccgggctggacatacgtctatcaaccccgctcgacgcagtgccggccgacgccgacacggtggtgctcgccatgcccggcccgcaggctctgcggctggccccaccgccggggatcgcggcggccgcggccgcgcagacctggcatccggcgatcgtggccgttctgcgctacccgctgcgtgagtgggacgacctgcgaggcgccttcgtcaacgaccatcccatactcgccaccatttgcgacgacggcgaccggcgcggcgacggcgcgccggtcctggtcgcccactcaaccgcagaactggccgccaggcacctgaatgcgcccgaggcggccgggccgatcctcgccgaggccgtcggcgagttgctcggtctctcggccaagccggaggtgagcgtgcaccgctggacctttgcccagcccgagcccggcaaggccctgtatgccgtggacggccgggtctggctctgtggcgatgcgttcggccgcccgcgggtccagaccgcctggctgtccggccgctccgtggcaaaagccctactcggctga

SEQ ID NO: 7340 - DNA, 519 bp, Actinoplanes utahensis
gtgccggtgcccgaccctggcgggcctagcccaggtgcggtgttccgccgatggtctccgtccgccggtacagttgcgcaggtgacggacgagctgtgggacagctacgaccgggacaagctgcaggctggctggtcgtatccggtcgggcgaaccaccgtcgaagcaacgctgcgagccgctggcgtccatctgctttcgctggacttcatcatgcacggcggcgccacgacggaccccctcctgctccgggcgacccgttatcgggacatgggcaacacgtacttcctgcagcgtgggacctccgagcggtcgcgctgcgtgctcgcgctctatgccgttcctagcggcgttcgcgcccaggcccgtgctgttctcacgacgggaggcgggcttgatcgcgcttgcgcatggctcgcggccgcggaggccgcagacccgacctggcactacaagtcacacggctggacggcttccctgatcaacggcgctctgcagatagcagagacaactgaatga

SEQ ID NO: 7341 - DNA, 1578 bp, Actinoplanes utahensis
atgtcgatcgataccgccgggatcgcggacgccgccatcgaggccgccctggtcgtgctggaggagacgccgcgccaggatctcgacccgcggccgaccctggccgaggccggccgcctgggccgggccgcgctgcgtggcgggcgctgcgacctgggaatgcgggcgcggttgctggaggccgacgcggtgagccggaccggcgacgtggccaccggcgcgcggatcttccaggaggtgaaccggtgggccgtggaacaccggcacccgcggctgctggcgctgagtcacatccggctgtcgctgttctacagccacctgggggacacggtcgtcgccctggaccacgcgatccaggcgcagcaggccctggccgcgatgggcgccgaggcctcgccgatgctgcggctgcgcggcaccgtgcagctggccaacgtgcacggcgacaacggcgaccacgcgtcggcccgggcccggtacgccgaggccgaacggatgtccgcggggcagatcgcggccggccgggtcgacgcccgggtccggatcaccgtgctcaacaacctggcctacaccgagtacgaggtgggcgacatcgacgccgcggaggcggccgccgaccggctgctggccgccgccgccttccacgggctggacctggaccacagcggcgtggacacggtggcccggatccggatgaacgccggccggcacgccgaggcgatcgcgctgctcgaaccgctcgtcgcggtggagaccgacgacgccttcagcgagctgaacacgacggcgagcctgctgctcacgctggccgagacgtaccggcgctgcggcgactatccggcggccggcgcggcgctggatcgctgccagaccctggtcgaccagcgcggcctgcgctcggtcgggatcgagctgctgcgcgaacggtccgaggtgctcgccgcgtccggccggcacgtcgaggcgttcgaggtgcacaagcggttccacgccgcggcgatggcggcccagtcggcggaacgtgacgcccgcgcccggaccctgcacgcgctgcaccagttggacgaggcgaccggtctgcgggagatggcgctgcgtgatccgctgaccgggctgtacaaccggcgctacgtggatgcggagctaccgctgctactgcaccgggccgccgagaacggcgagccgctcgccgtcgcggtcgtcgacctggaccacttcaaacagatcaacgaccaaggctcccacgaggccggcgaccgggttctgcgcgagatggcgaccctgctgaccgccgccgccggagccgggggctcgttcaccgcgcggctcggcggggaggagttcctcctggtgctgcccggggccggcgccgccgaggccgccgagcggatgacgttgctgtgcgaaaccgtccgccgcttcgactggcggccgatcaccggcgacctgccggtgacggccagcatcgggatcgccgtcgcgccgctgggccgcgccgggtccgccgagctgctgcacgaggccgacagccggttgtacgaggcgaaacgttccggccgtgaccgggtggccgcctga

SEQ ID NO: 7342 - DNA, 642 bp, Actinoplanes utahensis
atgagcagcgccggttccggccgtccccgcgaccccgaggtggaccggcggatcacccgggccgtcctggacgtgttcggcgaggccggctgggccggtttcgcgatggagaccgtcgcccgccgcgccggcatcggcaaagccaccctgtacctgcggtggagcagcaaggaggaactgctgaccgacgcgctgaccaccgggctggtccgggtcggcgatgtcgacaccggcaccctgcacggcgacctggtcgagctggccacccaggtgctcggcctctacaccggcccggccgggcgggccgcgatgcggctcaacctggagaccgccatcccggaggtcgccgagcactaccggacgatgcgcgcctcccagatccaggccgcccgcgacatcgtgcgccgcggcgtcgcccggggcgagctgcccggcacggtctcggtcagtctgctgttggagacactgatcggcggcgcgatgatgcacgccatgaccaccccggccgaccggcgggccgcgctggccgaggaggccggcagccacgcccgccagctggtcgacttcctgctgcacgcggtggccagcccggtcgcggatcggcgggcccggacggggccgttgttccgcgcgccggcctga

SEQ ID NO: 7343 - DNA, 432 bp, Actinoplanes utahensis
gtgggaccgggtgtgatcatggtcgggatcgacggttccgagtcgtcccgccgggccgccgcctatgcggtcggcctggcgcgccgggagggcgcccggctggtcggcgtctacgtccggccgccggccggcgccatggtgtcgatggccgactcgtccggcacggtcgccgccacgatggtcgcctcgcaggacgcggtggtctccgagttccgcgacacgctgcagcaggagcggacccggctgggcgtcgacatgcagatcgtggtgcgcgacggcgacccgttcaccgagctgtgccacgccgccagggagttctgggcggacgcggtgatcgtgggccgttcggagcgcctgctgcaccggatcgccggctcggtcgcgcagcgcctggtccgctgcggccgctggccggtgacggtggtcccctga

SEQ ID NO: 7344 - DNA, 1428 bp, Actinoplanes utahensis
atgaccctcaccacgcccctgcggcgtcgcctcacggcggccgccgccctcggcgccctgctgttcttcggcggcgtgcatgccaccgctgcccaggcggccgtcacccggacccgggccggcaaccaagcggacgtctcccggaccggatggaacggtccggcgttcgtcttctccggagccggcgcgatcgtgccggccacgttcacccgagccgtcaccgcgatcaccggaggcgccggcaccatggacgtcgtggtcctggccgacgccccgcccggttccggcagcgccaccccggagtgtgatgccgtcctggcgctcgccggtgtcaacgcgtgcacgaccctcgtgctgacctcggcgcgcgacggcgacgacgccgcggtcaacaccgagatccgcaacgccgagttcgtctacttcgccggcggggaccagtgcgcgtacgccgcctggaagagcaccgcactgcgggcgtcggtgcaatcggtcgtggccaaggggggcggcgtcggcggtggcagcgccggcacccacatcaacagtgacatcgtctacgacgcctgcggtgggagcgtcacctcggccgaggcgctggccgacccgtacaccggcgccgtgaccttcacgaccggcatgttcagctggccgcactacgccggcaccatcaacgactcgcatttcgtgacccgcgaccggatgggacgcaccatggccttcgtcgcccgctccctcaaggacggcctggtcaccggtggtaaggcctggggtgtcggcatcgagcagggtggctcgctgttcgtggatcgggcgggcctggccacgctcgccggtgcggacgcctacatcgttctcggcgaccacgctcccgagcaggccgtcgccgggcggccgctgacctacaccggcttcaagatctggcatctgaccgggggcggcaccttcgacttcgccaaccggccgacctgtggctattacctgcgcagcgtcaccgccggggtggccgacccgggcctctacagcggaacgccgatcgcggactgctcgggcggcgccggcgcggtgaccgagaccgagccgaacgactcgcggggcaccgccaacgacctcagcaccgggacctacccgctgaccgtcagcggctcggcgaagtccgcctcggaccgcgactacttcaagctctcgctcacccagaatcagaaggtcaccgtctcctgctcgattcccgaccagtacgacgccgacctgtacctgctggacggctccggggccggcctggcgcgctcggtgaacgacggcaagggcgccgacgaacgactcacctatacgcgtaccgccaccggcgccggctcgtactacctcgacgtcgaggcctacagcggatccggcaccagcccgtacgcctgtgccgtcgtcaagggctga

SEQ ID NO: 7345 - DNA, 1209 bp, Actinoplanes utahensis
atggtcactcgtcgcaccctgctcgccggctcggccgccgccgccaccgcagcactcaccggcacccccgcggccgctgccgcgcgtcccgccaccggcccgctgatcctggccggtggcggcctggccgacgacaacgccgctgtctacggggagatcgtccggcgggccggcggcgccggggcctacatcggggtgctcaccgccgcgtcggtgccgcccagtcaggatccggacgccggcacgcccgacgcgtccaacagcgccgccaacggcgagttctaccggcggttgctgctgtcgtacggcgccgggcgggtcgagtggatccccgtcgacctcgaccatgtcggcgccgccgacgatccgcagctcgcggcccgggtcgccaccatgaccggcttcttcttcggcggtggcgaccagttccgctacgtcacctgcatgatgcacggcgccgcgcacaccgactccgccgtgctggccgccatccgccgccggcatcgcgccggggcggtgatcgccggctccagcgcgggcgccgacatccagcagggacacgacatggtcaccggtggagacagctacccggcgctgcgcgacggatccaccgccggctacttcgacgactccagcgtgtccgggtactggcccgcgggcggcttcggcttcttcacctcggcactgctggacacccacttcaacgcctacggccggctgggccggggcatcgtgctcgcccgcacggtcggccggcaccacctggtcggcgtggatccggacaccgcctacctcgtcgagcatcccggaaccgcccacgagtgcggccaggtcatcgggaccggcggggtcaacgtgatcgacctgtaccgcgacgtccggtggagcttcctgaccgccggttaccactatcagcccggcaccggccggatcaccccgccgccggcggtgcgcccgctgcgggcggatcccgcgcaccgcggcgtccccgacaacaacgacatcttcggcgaccatcagcagctcaacctcgcgctcgccctgaccgcggcggacacccgccgcgccgtcggctacacggcacagagcgacccccggttcgcggtcacgctgaccaagggacacgacttccgcggctacacgcgggacggacgcaccgccgactccttcctcgacctcaccgtggcgatctccgccgtaccggcctga

SEQ ID NO: 7346 - DNA, 882 bp, Actinoplanes utahensis
atgtcgaccccgaacgaagacctcggccccgcggtgggcgtcgccggcctcatccgggcacgctgggccgagtgcagcccggcggagcggaaggtggcccgcgtgctgctggcggcctatccgcaggccggcctggagacggttgccgccctggccgggcgggccggcgtcagcgcgccgacggtgctgcggctggccggccgcctcggcttcaccgggttccccgagctgcagaaggcgctgcgccaggagctgacggaacgcgacgtgtcgcccctgacgacctacagcgccgggcgctccaccgcggccgcggacggtggcgccctggagcgcgcggccgccatcctgcccggcgtgctcgccaccgcgctggccgagacgccgccggcggagttcgacgccgcggtccggctgctggccgaccggcaactgacggtgaccctggccggtggccggttctcccggctgctcgccgaatacctgctgctgcacctgatgcaggtgcgcggtggggcacggctgttgccggcgggggcggtcgaacgcgccaacacgctggtcgacgtgggccgccgcgacctgctcgtgatcttcgatttccgccggtacgaggattggtcgctggcgctggcccgcgcggcgaccgaggccggcgcccgggtcgtcctggtgaccgaccgctggctgtcccccatcgccgcggtggccgaggcggtcctggcctgcccggtcgactcaccgtcggcatacgacagtttcgtgccggctctggccgtgctggagaccgtgatcgccggtgtcatcgaccggctgggcgccccggccggggagcgcctggcccgcatcgaggaggccagccggcggttcactctgctctga

SEQ ID NO: 7347 - DNA, 957 bp, Actinoplanes utahensis
atgagaatccgatacccacgacagaccgccgtcctggcggcggtcggcaccgcccttctgttgaccgcctgtggctccaccccgtccacggccaccaccggtgggtcggccgccgccaccccggtcacggtcaccatcgccggcgccgggacggtcaccaccgacccggcgctggccgcccgggttccggccgacgcccgggccaagggctcgatcacggtggcgaccaacgccccctacgcacccttcatcgacttcaagaccaagggcgaccagagccatttcgtcggcctcgactacgacctgttcaccgcggccgcggcccggctggggctgcgggcgacgttccagcagcagccgttcgacggtctggtacccggcctgcaggccggcaagtacgacgccatcgccggcggcgtcaccgacaagcgggaacgcgaacaggtcgccaccttcgtcgactacacggcttccggcaccgggttcctggtcaccgccggcaacccgaagcaggtgtccaccgtggcgaacctgtgcggcctgcgggtcggcgcgcagaaggccagcaaccaggtcgacaatctgacggcgtacagcaaggcctcctgcccgggacagccgatcgtgatcagtcagtacccggccaacaccgacgccgtgcaggcgctgctggccggtcaggtcgacgtggtcgcggccacccgggtcaacctgaccgacgtggtgacccagctgtccggcaaggtcgccctcgccgacgacccggcggcgcccaacggatggctggccagcccgaacggtttcggcttcctcaagtcccggggcgagctggccaccgccttccaggccgcgctgcagtcgttgatcagcgacggcacgtaccgcaagatcctcgatcagtggaagcaggccccgatcgggctcgccacgatcaccgtcaaccagccgatcaactga

SEQ ID NO: 7348 - DNA, 894 bp, Actinoplanes utahensis
atgagtgtcgatgccgatgccgccacggcggccagcgtcgccggaacaccgctgcgcgtggtcccgctccgccgcccgggacggtgggtcgccgccgtgctggccgtcgccggtctggccgcgtttctgcaagccctgctgcgcagcccgaacctgcgcctggacgtgatcggcgagtacctgttcaagccgtacatcctgcacggtgtgctgaccaccgtgtggctgaccgtcgtcgcgcagctgctcggcaccgccggcggcaccgcgatcgccatcatgcggctgtccgcgaacccggtcctgcgcgcggtgtcgtggctgttcgtctgggtgttccgcggcacaccgctgctggtacagatcatcttcttcggcttcctcggggccctgttccccaccctcaccctgacggtgccgttctccggggacatcctgtggagtcgccccaccagcgtcgtcatcaccggcaccgtggccgccgtgctggccctctcgctcaacgagatggcctacgccgcggaggtcatccgcgccgggatcctctcggtcgaccgcggacaactcgaagcggcgtacgcgctgggcatgcggccccggctgaccatgcgccggatcgtgctcccgcaggcgatgcgcgtgatcatcccgccgatgggcaacgacaccatcaccatgctgaagtccaccgcgctggtgtcggtcatcgccggaagcgacctgctcaccgtggtgcagggcatctacaccgccaactaccaggtcatcccgatgctcatcgtggcggccctgtggtacctcgcgatcgtgtcggtgctctccaccgcccagttccttgtcgaacgccgcttcgggcgcggcgtcaccaccaccaaccgggggatcacgcgatga

SEQ ID NO: 7349 - DNA, 1188 bp, Actinoplanes utahensis
gtgaccgtgacccctcccgaccccggttatctgcagcgcctggagaccctggtcaacatcgactccggctcccgtcacctcgccgggctgtccgcggtcaccggcctgctcgccggctggtgcgagcaggccgggatgacgaccacccggcatccggtcgacgtcgccggcgacccgcacggtgacgtgctcgtcgcccggatccgcggcaccggcacggggcggatcctgctcgccgggcacctggacaccgtcttcccgcccggcgaggcggcccggcgcccgttcgcgatccgcggtgaccgcgcctacgggcccggcgtcgccgacgaccggggcggcctgctcgccggcctggccgcggtgcaggccctgcagcgggaccggcggcacaccttcgccgagatcgtctacgtcgccaccccggacgaggagatcggctcacccgccagccgggccctgctcgccgagctcgccggcgcctgcgatgtcgcgctctgcctggaatgcgcccgggagaacggcgatctggtcaacgcgcgcaagggcatgaccgacattcagatcaccctgtacgggcgggcggcccacgccggcatcgaaccgcaccggggtgccaacgccgcgctcgccgccgcccggctcaccgtcgccctgcagcgcctgaacaacaccgggcgggacgtgacggtcaacgtcggtgtgctgcgggccggcgaacggcccaatgtgatcgccgaccgcgccgacatgctcgtcgacgtccgcgcctcggacgacgacaccttccgccggacgctgcgccagatcgaggatctggcccgggcccggtacgtcgagggggtcagcgcgtcggtcgccttcatcgcgcccaccccgccctggcacggcaccgacgcggcgctgctcgacgcggcccgcgccgcgggtgccgcgaccggggtgccggtgtccttcaccggcaccggcggatgcgccgacgccaacctcatcgcgggcgcgggcatcccggtgctcgacgggctcgggccggtcggcggcgacgaccacagcaccgacgaatggatcgatctcgactcggtgcggccacggatcgccctgttggccgaactcatcgccaccgttcccaccgggcggtccgcggactccccgtcccgggccgggctccatgggcatccggtgcgctga

SEQ ID NO: 7350 - DNA, 3450 bp, Actinoplanes utahensis
ttgagcgacgccgacccggcgatgcgtgaccggcccgccgcgcgggagccggcggcggcagcgcgcgccgcgcagatccgggccgagcgccggttccggtcgctggtcgaggccaccgacacggtcgtctgggcacacgatgcgtccggggcgatcaccgaggagcagccggccctggccggctacaccgggcagccgtggccggagcaccgcgagaccggctggctggcgatgatccatcccgaggaccgggaccgggtcgccggggaccttcgcgggctgcccggccggaccgccccgctcgaacagcggtatcggctgtggcgtgccggcgaccaggcctaccggcatgtggtgggccgggcggccgcgatccaggacgagcacggcgtggtggtggagtggctcggcgccatcacggacgtccacagtcaggtggaggccggcgtcgcggtccgccgcaccaccgcgatcatcgacgccatcctgcaggaggcgccggtcgggatcggctgggccgacctggacctgcggctgcggcacatcaatccggccctggcccggatcaacggcctgccggccggggaccacctcggacggcgtccctcgcagctctggggcgagaccggccggcggatcgaggagctgatgcgcagggtgatggtggacgggccggtcaccggggtcgagttcaccgcgccggagccggagtcggcactcgtgcggcaccgggtggccagctacttcccgatccgcatcccgggctccgaccaggacgtcggcgtgggtttcaccatcgtcgacgtcaccgaacggacccgcctgctgcaggctctcggcgagcagcggacccggttcgagcggctgctgaccaccgacgtgctggccgtcttcggcggggtcgacgaggcgatcctcgaggccaacgacgcgttcctgagcatgctcgggtacacccgcgacgacctggagcaggggcggctgcgctggcccgacctcaccccgcccgagtgggcggaggccgaccgccggtccctggccgagctggccgccaccgggcgcagcagcgcgttcccgaaggagtaccggcacgccgacggccaccgggtgccggtgctgatcggggtggtcgcgctggaccgggcgccgctgcgctggctggcctacgccgccgacctgaccgccgagcgctccgcccaggccgagtcgcggctgttccgggccctggtggaacgctccggtgacctgatcgcggtggcccgcatcgacggctcggtgcgctacgtcaacccggccggcctgcggatgaccgatcgcaccgcggcgcccgagcggctcaccgacctcatcggtgagccgctgcagccgcgggagaccgcccgggaaccacgccggcacaccgcccgggcgctgcccaccggccggggcggtgctccgctcgaggtggatctgcaggcgttcacggtcgccggggacaccgagaccacgccgtacctggccgtcgtggcccgggacatgaccgaccggcagcgcaccctccggcaggccgaggggctggcccggttcgccggggcgctgagcacggcgacggaccgggcggcggtcaccgcgacggtggaggggctgctgcccgccgtcgtcgaggcggcctcggccacctggatcccggccagcgacccggccggtgcgccggacgacgccgcggcgttcgtcatgccggtgccgctggaggcgggcaccgtcgccggctccgtgctgatccgctgggaccggccggtcgagatcgacgagctgcgcaacgtgctgcagaccgtcgccggtctcagcggtcaggcgctgcagcgggccgagctgatcacggccgcctccgggatggccacgctcgccgcccggctcagcgtcacccgcaccccggacgaggcgatcgcggtgatgctggagacgattcccgccgccctcgacaccacgctgtgcggtctgctggtccgggagcagggtgaccggttgcggatgtgtcaccgcgacctgccggcggcgctggccgccgcgtacaccggcctgcgcctcgacgatccgcagccgatcgtggaggcgatccggaccggccgccgcatcgtgctacccggccgggaggcgtaccgcgaccggtttccggccgtggccgacatcgtcgccggtcacggcatcgtcagcacggtcgccctgccgctgcacgactcgcagggccgcacggtcgccgcgctgggactgggctggccgtatcggcggccgttcggcaccgacggcctggcccggctcgacacggtcgccgacctgtgtgagcagaccctggaacgaacccgcctggtcgccaccgaacaccagctcatcacgcggctcgccacgcgcctgcaccccgcttcggcggtggtgccggcggagctcgacatcgccgtacgctatcggccggcgctctccggcctggaactcggcggcgactggtacgacctgatcaacctgcccgagggacgcttcgccgtggtggtcggcgacgtggtcggccaccacatcgacgcggcggccgacatggcgcagctccgcaccgtgatcaacacgctgatccggctggaggtgccgctggaggagttgttcgcccggttcaccacgctggtcggacgcgacttctggggcaccgccgtggttctcgtcctggacccggcacgccagcgggccgacatcgtccgggccggccatccgcaccccgtcctgctcggcccggagcacccgccgacggcggtggcgaccgatcgcacaccgcccctgggactggtcaaccgcggtattccggtcacctcggtgccgttcgtgcccggggccgccctgctggcctacaccgacgggctcgtcgagcggcggcacagcgactacgaccgtggtgtcgacgacctgcacgccgtgctcgccggcacggctgccgacgcgtgcgccgacgacgtcgccgacgccgtactggccgcggcccgcgccagcgaggacgaccaggccctggtcgtcgttcggcaccgtccgccgcaccgcaccgacggggtcgacgtccgggtgccgttcaccggggagacgatcggcggcctgcggcacaccgtccaggcggcggcgcgggccgccgggctctcccccgagcgtgtcgaggacttcaccatcgcggtgtacgagctgctcaccaacgccgtgcggcacggcgggggcggcggcgagctgaccctgcgcaccaccgcgacggcgttggtgtgcgaggtccacaacgacgcgacgaccggcggcgacgtccgggtcgggccggtggcgcccgcgccggactcccagggcggccgtggtctctggctggccagccggctcgccgacgagctcgacctgcggctgacccggtccggcgcgctggccgccgccctggtgatgcgtctgggcacctga

SEQ ID NO: 7351 - DNA, 2289 bp, Actinoplanes utahensis
gtggcggctccggacgcgggaacgtgctgttcttatcgggtgacgaatcatgacaagccgggagacccgagcgctgccgtgctgcgctggtatctcggtcttggcgtcatcgtcgtcgccgcgatcctgctggcgccggtgcacctgctgatgtggctgtacatggcggtggccgtcggggtcctgtccgcgctggtcaccggcatccaccgctaccggccggtctggtcgcggccctggtggctgctggtcggcacggtgggcgtctcggtgctggccaacactgtctgggcgctgatgatgaccccggccggcataccccggtttccgtctctcggtgacctctgctacctggtggcgatggggctcctggtcagcagcgtgtactgctgggtaccggggcgctcccgggacgggctgatcgacaccgcgatcgcgctgaccggcggcggcgcggtggtctgggcgctcgtcgtgacaccgctgctgtccagcgggcgcttcggcggactgcggctggccagctacctcctctacctcgggatcgacctgctgatcctggcactgaccgtgcgggtggtcgtggtgtcgcgggtgcgcaccgcggcgtaccggctgatggtcggcgcggcgacgctgtgggccaccaccgacatcacctactacgccgtcctgttccaccggccgtcggcgccgccgggctggatccaggtcggctgggtctcgacgtatctgctgatcggcgcggcggcgctgcatccgtcgatggcgcgcagcaccggcagcatgccgcgcaacgccacgccgttgtcctggctcaggctgtcgacctacgtcgtgctgaccgtgctcgtggccgggctcggcatcctcggcacggcgagcgcggcaccggccggcacggcgtggcggctggtcgtgccgctgttcctcggctgcgctacgtccgtgctgctgatcggccggctggcgcagctgggcgccgccctgaaccagcgggcctacctggatccgctgaccgggctcggcaaccgggcggctctgcagggtgcgctcgagcgccgcggcaccgacgaccgggtgctgctcgtgctggacctcgacgggttccgcgacatcaacgccgccttcgggcacaaggccggcgacgccgtgctggtggaggccggccaccggctgcgggccgcggcaccgagcgacgccctggtggcccggctcgacgccgattccttcgcggtgctcgccgacggcgccgacggggtgctgcaccggctggccgaacgcctccgggcggcggtcgccgcgccgtatccggtgccggggctgcaccatcgccgggtccgggccagcgtcggcgccgtcgtggtcggcgccggtcaggacggcacgaccgcgctgcgcgacgccgacctggccctgcagaacgcccgggcgcagggcgacggcctggcgctgttcaaccccgcggagtacgcccagtggcgcgccaaccgcgacctgatcgccgatctgcagcacgccctcggcgcggacgagttcgccatgcactaccagccgatcgtcgaactcgccacgggccggatcatcgccgccgaggccctgctgcgctggacccgggccgacggaacgccggtctcccccggccggttcatcccgctggccgagcagagcggcgacatcatcgtcctgggcgagtgggtgctcgcccgggtctgcgccgacctggcgggcctctggaccgacttccagctgccggtgacggtgaacgtgtcggcacatcagctgcgcgacaccgggttcgccgcccgcctgctgaccctgctggccgacaccgccctgcccggcgcggcactgatcgtcgagatcaccgagaccgtgctggtgaccaccgtcaccgacgccgccaccaccatcacgcagctgcagcagttgcgcgaccgcggggtccggatcgccatcgacgacttcggcaccggttactcgtcgctggcgtacctgcgggagctgccggtggacatcctgaagatggacggctccttcacctcgcagcagatcgcggacggcggcccgcgggagatcgcattcgtgcgcaccatcgtggatctgggccgcagcctggacctgagcacgctggccgaggcggtcgagacgcaggcccaggcggaccgcctgcgtgagctgggctgcgacctcgcccagggctaccacttcgcccgcccggcacccgtcggccggctgcacgagctgctcgccgcgcagcgctgcgggatctccgacacggcggcctga

SEQ ID NO: 7352 - DNA, 783 bp, Actinoplanes utahensis
atgcgcacacgcgtcgaccagatcagcgaccggatctaccgaatctccacgtgcatcccggatatcgccccaggaggattcaccttcaaccaattcctggtcgatgccgaggagccgctgctgtatcacaccggcatgcgtcaacttttcccgctggtgaaggaggcgattgaacggatcatgccggtggagcgcctgcgctggatctccttcgcgcacgtcgaggccgatgagtgtggcgcggtcaacaacttcctcgccgtcgctccgcatgcacaggtcgtccacggcgatctcggctgccaggtttcgctcaacgacctctgcgaccgagatccccggccgctggcggatggagagaccctcgacatcggcggcgccacactgcaacggcgcctgatcgcgctacccacgccgcacgtaccgcacaactgggagtcgcacatgctgttcgagcaggagactcgcacactgttcctcggcgacctatgcacccagttcggcgacgggccgcccgtgacggaccaggctccgttcgaagcgatcatcgccgccgaggacctcttccaccagacatcgctaggcccggcggtgctgacaacctaccggcgccttgccgaccttgagcccgtcactctcgcagtgatgcacggttcgtcctacaccggggactgcccaaccctgctcaggatgatcgcggacatctaccaggagcgctacggatgcgggacaccgctgctgggtcagccgctaccggcgcacaagcttgtcggttcagattga

SEQ ID NO: 7353 - DNA, 369 bp, Actinoplanes utahensis
gtggacagcacccagctgcgtgtcgaccggatcgacgtttggcagaccgatagagagcacacgctgagccttgctgctgcgggcgtccacgtgatgctggtccggctgcgctatgacggctgggtggacgaggtgatcaacggcgctgggacggttgcgccagggccaggcgcgtggactctcatcggccgacggttgaccctggagttcgacccacgggccgcatcggccctcggcttccaccgcgactgccagctgtatctggatgtggacgcggacggaatccggcgtgtcagggccgcgctgttggaaattctcgactgcgcgtgtttcgtggtcgacaccgacgaaggccgcttgaccagctga

SEQ ID NO: 7354 - DNA, 684 bp, Actinoplanes utahensis
atgccgagctggacgcgatcgacatcgcctgagcgacccggaaacatgttcggggggaccgctgttgcacatcacgtggttatcaacttcgcggttctcggggattcgatcgcctacggtcagggggcgtcgcgggcggccgacaccgtcgccgcccgcctgtccgccgacctgaccgcggccgggctggcgcaccagacccggaacttcgccgtgccgggggcgcgcagcgccggcctgaccgcgcagctcaccgcggcggttgcctggccgcccgacctggcgctgatcatcgtgggagccaacgacctgacccatctggtccccgcgccggaggcggccgcgcagctggaggccgcggtgcgcgggctgcgggcggtcggcgccgaggtggtcgtggcgcccgcgcccgacctgagcgtggtcccgcggctgccggccgagatgcgccccgcggtccgggccgccagcaccctgctgcacgacgcgcaggccggcgccgcgcgggcggcgggggcgcacgtgaccggcatcgggatcagctcggccgccgggttcgccgccgaccccggcctgttcagcgccgaccggttccacccgtcgagcgccggctacgcggtgatcgccgacgcgctggcacccaccgtgcgcgccgtcgcacgaagcctggccgtcgcccgctag

SEQ ID NO: 7355 - DNA, 1398 bp, Actinoplanes utahensis
gtgatcgtgtcccgcatcccacgcggcgccctgctcctggccgccggcctgctcaccgccgccaccgcggcacccgccccgaccctggccgcgacatcgtccccgacggcggccgcgccgagcgccgacgtggccgggccggtcatcgacgagaacttcgccgatccggacgtgatgaaggccggccacacctactacgcctacgccaccaacagcgacggccggaacatcaggtgggccacctccaccgacctggtcggctggaccgtgcaggccggcgacgccctgcccgcgctgggcgcctgggcggacccgacctggacgttcccgcccggcggcgcgggtgatcacggcgtgtgggcgccggaggtcttcgccgccggaccgaagagcttcgtcatgtggtacaccgctcatgaccgtacgtccggaaagcagtgcatcggggccgcgaccgcgacgtcgccgggcggacccttcgtgccccgcgacgccgcgctggtctgcaccccggagatcggcggcgcgatcgacgcctcctcgtacagcgagaacggtcgccggtacatcctgtggaagaacgacggcaactgctgcgcgcaggacacctggctgcatctccagcaggtcagcgcggacgggctgcgccggatcggcaccgaaacccggctgatcaagcagaacaagccgttcgagggcaccctggtggaggctccgacactgtggaagcacggcaagacgtacgtactgttctactcggccaacttcttcggcaacggcagctacgtgagcagctacgccacctcgaccagcctgggcgggccgtacaccaaggccgaggcgccgctgatgaccaccgacgcgttcgccggctcggtgcgcggccccggcggccaggtcgtcgcgaccggccccgacggtcacgaccggatcctcttccacggctgggacgcgacgttcacctaccgcgcggtgtattcccaacggctcgactggctgggcgaccgcccggtcgtggccggtgccaagatccgctatgaggccgaggacgccgacttcacccgggcgaacgcccggtacgccgtcgggggcgccagcaacggggtcgtggtcggtggcatcgacttcgccgacagccgggtcaccttcaccgtccgcgtgccccgggccggcacctaccgcctgtacacccggtacgccaacggctcggacgccggcgccgccagccacaccctgaccgtcaacggggccgcggccgggaccgtggactatccggtcaccggctgggacaactggcagaccagcgagcgggaggtgacgctccgggccgggaccaacaccgtggcgtacggcaagggcaccaactatgccgagctggacgcgatcgacatcgcctga

SEQ ID NO: 7356 - DNA, 1032 bp, Actinoplanes utahensis
gtgcgcactcacctcaagcgcggggtcgcggcggtcaccgggctggtcgccgccgtcgcggtgaccggcaccccggcgcaggccgccggatcgggcagcaaggtttcgcagaccaccacggtcggcatccacaatacgtacgacccggccaccttcgcctacctcgcgcaggcgctggaccagcggcccggcctgatcgagctggacgtctggcccgacgtgatcacccgggagtggaaggtcagccacagcaacccgctcggcaacgccaacaactgcgtggcggcgaccagcgcgtccgggctgtactccggccgcgccaacaagaacctggagtactgcctcgacgacatccggctgtggctcgccgcgcacccggacgccggcccgctcgtgctgaaactggagttgaagaccggcttcagcggtcgcaccggccaggggccggcgcagctggacgcggcgatcgcggcgcacctgggcgcggccgtgttcaagcccgccgacctgctcggctcgtacgcgtcgctggacgccgccgcgaaggcgaacgcctggccgacccgggcccagctggccggtaaggtgatcatcgaggtgatcccgggcaccgtcgaggagggcaacccgaccgacacgctgtggaccgacaccgagtacgcgaggtatctggcctcgctgaaggcggccggcacgctgagccgggcgcagatcttcccggcggtgcacaacgcggccaagggcgacccgcgcacccgctacccggacacctcgctgcgcccgtggttcgtcaccttcgacggtgacgcgaacacctacgtgaccggcggcatcgacaccgcctggtacgacaccaaccactatctgctggtgatgaccgacgtgcaaaacatcgccccggtggtcaccgccggcgacaccgccgcggcgaaggcccgggtggcgcaggtcgccgccgcgcatgccagtgtcgcctcctccgactggtcgtcgatgcccgccgtggacgcgatcgtggccgaccgcggataa

SEQ ID NO: 7357 - DNA, 150 bp, Actinoplanes utahensis
gtgatcgacctggacggcttccaggcggtcacccgacatctgcgccccggcgtccgcggccgcaccgcggtcggccgaaaggcccgaggtcgtgctctgttcgcccgagggtcggcggcaggcatggacatgttcatgattttcgattga

SEQ ID NO: 7358 - DNA, 1314 bp, Actinoplanes utahensis
gtgtccgcaccgccgtcccgcccgcgtcgtcccctgttcggccgcggcagctggcccgaggtcagccggatcggagacatcctgcgcgccgagaccgtcggcggggcactgctgctgtgcgccgcggtcatcgccctgatctgggcgaactcgccgtggtcggccgcctatcaggcgctggtcgcggcccgggccgcggtgccggcgctgcacctggatctgaccctcgcacagtgggcgtccgacggtctgctggcgatcttcttcttcgtcgccggcctggagctgaaacgcgaattcgtcgccggtgacctgcgggacccgcgccgggcggcgctgccggtggcggccgcgctgggcgggatggcggcgccggcgctgatctacacggcggtcaacgtcaccgccgccggcggggtgccgtccgggtgggcggtgccgaccgccaccgacatcgcgttcgcgctggccgtcctcggggtgatcgccacccacctgccggcggcgctgcgcaccttcctgctgaccctcgccgtggtggacgacctgctggcgatcgtcatcatcgcggtcttctacaccgacgccctgcatccgctgccgctgctggccgcgctgctgccgctggccggtttcgcggtgctggtgcagcgccgggtgcgggcgtggtggctgctgctgccgctggccgcggccacctgggtgctggtgcacgcctccggggtgcacgccaccgtcgccggggtgctgctcggcttcgcggttccggtcgtgcgccgcgcgcaggggcccggcccgggcctggccgagcatttcgagcaccggtggcggccgctgtcggccggggtggcggtgccgctgttcgcgttcttcgcggccggggtcccgctggccggcgccggcgggctcggcgccaccctgcgcgacccggtgactctggggatcgccgccggcctgatcgccggcaagtgcgccggggtgttcggcgccacctggctggtgcagcggaccacccgcgccagtctcgacgacggggtgagctggtgggacgtgttcggtctggcgctgctggccggcatcggtttcacggtgtcgctgctgatcggcgagttggccttcggcgccggcagcgtgaccggcgagcacgcccggatcggcatcctggccggctcggtgaccgcggcgctgctggcgtccgtggtcctgcggctccgcaatcgacactaccgccggctctgcgcggccgaggcggtggacaccgacgccgacggcgttccggacgtctatcagcacgacgctcaccccgaggtctga

SEQ ID NO: 7359 - DNA, 462 bp, Actinoplanes utahensis
atgaccaggcctgacgttcccgccgatcccgacgacctgcgggaggagatccagcagacccgcgccgacctgggcgccacggtcgaggcgctggtcgcgaagaccgacgtgaagggccgcgccaagcaggccgccagggagaaggtcgagaccgccaaggccaaggccgcggagacggtcgagaccgccaaggtcaaggccgccgacacggtcgagaccgccaaggtcaaggccgccgagacggtcgggaccgccaaggtcaaggccgccgacacggtcgagaccgtcaaggccaagagcaccgagatcgccggtacggcgaaggaccggatcgccgaggcgaagagcaccgtggtcgagcagaccagcccggcgacccgccgtgcggtcccgccggccgtcatcgccgcggccgccctgctcggcgtgatcgtgctgctcctgcgccgccgccggcgctga

SEQ ID NO: 7360 - DNA, 438 bp, Actinoplanes utahensis
atgagcgactcattgcgtaccgggacgccgggcacggcgtccacagccgacctggtcagccaggcggccgcgcagatctccacgctggttcgcgacgagctggccctggccagggcggaactgaccgagaagggtaagcgcgccggtgtcggcggcgggctcttcggcggcgccggcgtgctggccctgtacgggctcggcctgctgctgaccctcgccgtcgtcctgctcgacctggtcctgccgctgtggctgtcggtgctgatcgtcgcggtcgtcgtcttcgccgcggccggcgtcgccgcgctgctcggcaagaagaagctggccgaggcgacgccgctggcccccaaggccgcgatcgacagtgtcgaggccgacgtcaagaccgtgaagaccgcagcccagcgaggacggaaccactatgaccaggcctga

SEQ ID NO: 7361 - DNA, 2634 bp, Actinoplanes utahensis
gtgtcgcctcgacaacgcaagcttttgatctccagcgtggcgctggtcaccgtggtcgggttgatcccgtccggtgccgcggccgcgcccggtggccaaccacggcccgagccgtaccagcgtcacgtgcaggccgcccagcagcgggccgcgctgcacgccgggttcagctcccgatccgccaaggccgacgaggacgagggcgaggacccggaggagatcgccgaacaggccgagcagtacgccgaggcgcgatccgctccgggcatcgtcgccccgggcgcctacaccgccgcctggcagcagctgcggtcgctgaagtcgaccgggggcacctggcagcaggtcaccgaccggccgtacaactccgacgacccccgctaccgcgacgtcaacagcaactcctccggcggcgccggcttcgtcaccggccgggtcaccggcctggccgccgacgaccacggcttcgtgtacgccggcgcggccaacggcggcgtctggcggtcccgcaccggcggcggccactggcagccgatcgccgagcgggtcccgtccccgtcgaccggcgatctgcggctggaccgctccggccggctgtggtgggccaccggcgagggcaacaccagcgccacctcgttcgtcggcagcggtgtctacgtgctgagccacccccggaccggccgcttcaccacccgggaccgggtgggtggcaccgagctggagagcacgatcatccgcaagctgcggatcttcggcgacaccgcgtgggtggcgacgaaccgcggggcgttcagccactcgatcaagaagctgtccgggccgtggaagcaggagttcgtgccgaacccggacttcctgcccggcggcgcgcaggcgggcgacgccaacgccccgtacaagaacattgtcaacgacttcgccgccgacccgaaagacccgtcgaaggtggtcatcgcggccgggtggcgcagcggcgacacgtacaacggcttctacacccgcgtcggcggcgtctggcagcggaccacgctggccggcgacatcgcctcggacgcggcgaacgtgggcacggtgaccttcgcggcggccgcggacggctcccggtactacgccatcgaggagtcgccgacccagctgaccaccaacccggacagcgcgctgcagggcatctacgtgtccgcgtccggctcgccgttcgggccgtggacgctgtcggcggactaccacaagctggccgcgtccggctcggcgctgaccgatcccggctacatgcccggcatccaggcctggtacaaccagttcctgcaggtcgacccgaccgacgccaaccacgtgtacctgggcctcgaagaggtcttcgagaccaccgacggcggggcgaactggaccgtgcccggcccgtactggaacttcggcttcccctgctggtcgatcgacccgggcaagcagaccggtgactgccaccagacggtgcacgccgaccagcactcggtgacgatcggatcgaaccacggcaggacgtacgtggtggtcggcgacgacggcggcaccttccgccggcccgtccgcggcgccgccgacgccgccgggcacgccaccgactggaccccgctcaacgacggctcgatggacgtgctgcagtactactcggtgggcgtcgggcgcgacggcaagggcctcgcggtctccggcggcctgcaggacaacggccagtccatcctgcgccccggcgaccgggcgatgggctccaacttcggcggcgacggcggggacaccatcgtcgacccgggcaacggctgcaacatcgccgaggagtacgtctacctcgacgtgtgggtgaccaacaactgcgcggtcaacgacggcgcctggaccaccgaccgcagcaaggccaccagctacgaggtcgcaccgccggacaacaagaccggtgaggcgcgcttcatcgccccgctcaaccaggacccgcgcgacgccacggtctgggtcgccggcggccggcacgtctggctcaacaccaagggctacgcgatccgttccggtgccgagtggaccaacctgttcgacctgggcgccgggcacaccgccacggccgtgtccacctcgggcggcctggtctacgccggttggtgcggtccgtgcaacaaccagggcttcacccgcggcatcgcggtcgggcacaccgacggcaccggctggcaccagctcgccctgcccgacctgcccaaccgatacgtctccggtttcgacgtcgacccggcgaacccgaaccacgtggtcgtcgcgatcaacggcttctcccggcgctggaccgagggccccggcgcgggcatcggccacgtcttcgagtcgaccgacgccggcgaacactggaccgacatctccggcaacctgccggacatcccggccgacgcggtcaaactggtccgcggcggcgggctcgtcgcggccaccgacaacgccgtcttctaccggcccgcgcacgcgcggtcctggctggtgctcggccgcaacctgccgaccacggcgacgctcgaactgcgcaccgacccgaccgggcgcacgctgtacgcggccacgcacggccgcggcatctggtcgtacgacgtgagcaagcttccgcgctcgcgctga

SEQ ID NO: 7362 - DNA, 1029 bp, Actinoplanes utahensis
atgagcaacgatccgccgcagctgctggacgcctccctgacccatggcgacgccggggcagctaccggcgggtcgtcgccggcgggctggtacgccgaccccggcggcacgtccacgttccggtggtgggacgggcagcagtggaccggcttcgtccagccggcgccgcccgcgccgccggtcgtggaaccggcgatcggcgagccggtggtcgcggccgggacggcatcccccgccagccgcggacgaagcccccgccgagccaccgtggtcgtcgcggcgatcggtgcggcggttctggtggccggtggcgccatcgcggccgtagtcaactcgtcggccgagtccgagctctgcggcctgatcggtgaccggcagtcgttcgcccgcgccgccggggatgacgctgacgacgtgggcagggtcgcggcggtggccgagcggatccacacgctcgccgggcgactcgtcttctcccgcgacctcaaggatgcgggcgcgggcttcgccgatgccgtgcagaccatggtcgccctgcgccgcgccggcttcgatgacaccgcgacagccggttccgccaccaccgcgcggatggcggagacagcggtgtccgccgtcgagaatctgagccggatgcagcgatcctgcgggctcccggtcaccgggcagctcgccgctgacacgggcgcctcagccgagaccgccgaccgggcggcccagtcggacgtgcgcggcgccatcgccgccgtcgaggaggcctacaccgagatgggcaacacctacccggacaccgcgatcgccggcgacaacagctctggcggcacgccccaggtggcggtcggctcgtcgacggagaagatcacgctgtccgacaagacgaagctgtactacgtccccacctctgccgacacctacaggatctgcgcgacgaacgtcggcggcagcggcaagtggtaccgctacgactcgtcacagggcgggtctgtcggcgccgtcagcccgcccgccgacccggcgagctgcgcctga

SEQ ID NO: 7363 - DNA, 546 bp, Actinoplanes utahensis
gtgccgtcgtcccgcaccgccaacgtcaccggccgcgccccgcgctccgtcaacggactacccgcgcacatcctgctcgtgcacgcggtcgtcgccctgctcccgctgagcgccctgctgctcgccctgaccgcgctgtggccggccgcccgcgcccggctggccctgttcaacgtcgtcctggcgtgggtggtcgtgctgctcactccgctgaccaccagcgcgggggagtggctggaacagcgggtgccgcgcagcgacctggtccaccggcacgccgaactcggcgactcggcgatcttctacgcgctgccgatcgcggtcctcgccgtgctcgtctggtggcggcaccgggaggccaccgccacgccgggcggccgggcgttccttgcgccgcgctcggcggccgtcaccgggatcgtgaccgtgctggcggtggccgcggcggcagccggcgtctacggcatgtaccggatcggcgactcgggcgcgaaggccgcctggaccggcggcttcagcaccaccgacaccgggcgtggcgactga

SEQ ID NO: 7364 - DNA, 231 bp, Actinoplanes utahensis
gtgacgttggcggtgcgggacgacggcaccggcttcgccccggcggacgccggacggctgttcgaccggttcgcccgcggtcacggcgaccagcgccggttcgggctcgggctggcgctggcccgggaggtggtcaccgggcacggcggcgtcatcgaggcggtcggcgagccgggccgcggggcggtcttcacggtccggctgcccgccgcgcggacccgatcggattag

SEQ ID NO: 7365 - DNA, 372 bp, Actinoplanes utahensis
gtgacggcggtggcgatgctggccgcactggtcgcggccggcggttggggcttctccgatttcctggccggggtgctggcccgccggatcccggtgttgaccgtcctgatcggttcgcagatcgccgccatgctggtggtgctgcccgccgcggccgtgcacgagcgtccggcggcctgggacggccggctctggctgggggtggcggccggcctggtcgggttgccggcgatgggcctgctgtaccgggcgatgcgggacggttcaccggccgtggtggcgccggtcgccacggtcgccgcgatggtcccggtcggctgggggctgcggcacggccccggggtcggcacggtgacctggctggctagctag

SEQ ID NO: 7366 - DNA, 336 bp, Actinoplanes utahensis
ttgcacgaggccggtgcggcggacccgttctgggcgctcgcgggtgcccgggtgagcggcggcgcgggggcgctgctgctggcgctcggcctgcgggagcgacacactgtccgattccggtcacccatcctgctggtcggtctcgccgacgtcgtcgcggacggggcgttcctcgtggccgcggccgcggcgctggccccggcagcggtggtgacctcgctctacccggcggtcaccctgctgctgaaccggtggttcctgcgggaacgtctgcacgcggtgcagctgtacggcgtcgtcgccgcgctgttctcggtggcgtgcctggctcggtga

SEQ ID NO: 7367 - DNA, 705 bp, Actinoplanes utahensis
atgcaaccgtccaataccgcaccaccggcccgccgcggcgggctggccgccgcgctgcgcacctgggtgcccacgatggtgttcaacctggtgctgccgctgatcacctatcaggtgctgaccggccacggcgccggtgaggtgaccgcgctgctggccagcggcgtgtggccggtgctggagacggtggtgctgctcgcgatccgccgcacctgggacgagttcagcatcttcacgctgatccttctgctgctcggagtggtgtcggcgctcggtttcaacagtccgcggctgatcctggtcaaggagtcggcgatcaccggcctgttcggcgtggccctgctggtctcgctgctggcgccgcggccgctgatgttctacttcgggcgcaagttcgccaccgacggcaccccggagtcgatcgcctggtggaacgggatgtggcagttccccgggttccggcacagccagcgcctgatcaccatcgtctggggcatcaccatgctgtccgaggcgctgatccggatcgccctggcctacgtgctgtccaccggcacgatgctggtggtgtccagcatcctgccgtacgtggtgttcggcggcctggtcttctggaccgtcacctacggccggcgtcaggggcgtcgcgccgccgcccgccaggccgaagaggccgcccgccaggccgaggcgaaccccgcgtga

SEQ ID NO: 7368 - DNA, 1359 bp, Actinoplanes utahensis
atgcgcccactatccgcgatcgtctggacggtgccgatcctggccgccggccccgcctcggccgtgcccgtcgccgcggcaccggcaccggcaccgggcggctactacctgcagagcgtcatcaccggctttgccgccgcggcgaccggtgacacgctcgcgcagcatcggcccaagggcgacgaggaccaccagcagtggaccctgcgggccgacggcgacgcctggcggctggagagcatcgacgggccggggcgctgcctgggccgcacggcgacggctccggccatgctgccgtgcgcggatgcgaacacccggtggcagatcaccggcgccggcgacgatcagtatctggtcagggaccccggcgcggagcgctacctgagcctggtgcccggcggtgccggctgggccgaccagctcgggctggacgccgccgggccgcaggcccactggtatctgacgccgttgaccccggtgcgcgccgcgctgccggccgagccggatcggacgctggaccaggtcaccttcctcaccgcgcacaacgcgtacgccaacggcgccgacggtggtttcgcgccgccgatcatcaacctcttccccaatcaggtacgcggtatcgaccggcagctcgccgacggcgtacgcggtttcatgctcgacgtgcaccagacgccggacggtgcgatcctctgccacgacagctgcacgctggtgtcccgtccggtcgcgctgtgggtcgacctcaaacggatcaccgacttcctcaccgcgcatccggacgaggtggccaccgtcttcctggaggactatgtggaccccggcgtgctgcgcgccgagctggcccgggtgcccgcgctgcccgccatgctcctgcgccccgacctcgacggtgtccgggagcggggctggccgaccctggccgagctgcgccggaccaaccaccgcctgctgatcttcaccgaccacgaccgggctgcggaccaggcggccggcctgacccgggacagcttcggagtgcagtaccagcgggagtggaccgtcgagaactactggtcgatgggctccggagcgggcgcctcggactggtcctgttacagccgctggcccggtgccggcccggccggcatcccgctcaccgcgaccgcgcccgggttccgcccgctgttcgtcatgaaccacttccgggacgtgcccatggcggccaccgcggccggtgacaacgccaaggcgctcaaccgggccgagcggttctgcgcaccggccgcccgcaagaagcccaacttcctggccgtcgaccggtacgacctgggtgcggcggccggcgcggtggcacagctcaatacctatgcgtactga

SEQ ID NO: 7369 - DNA, 1548 bp, Actinoplanes utahensis
gtgaccgccgggaccgcgctcaacgccgggcgccgcgctcgcgagctggacgagctggccggcggggccacggtcgacctgctggtcgtcggcctcggcgtgaccggcgccggggtcgccctggacgccgcctcgcgaggcctctcggtggccgccgtcgacgcccacgacctggcgttcggcacctcccggtggagctcgaaactggttcacggcggcctgcggtacctggccggtgggcacctcgggctggcctacgagagcgccgtggaacgggacatcctgctgcgccgggtggccccgcacctgatcaccccgctgccctcggtgatcccgttgacgccgctgctctccgccgggcaggccgggctggcccgggtcggcctggccgccggcgacctcctgcgcgccggggcgggcacgccggccgggcggctgccccgatcgcggcgcatcaccccggtggaggtgcaccggctggtgcccgcggtccggcgcagcggcctgcggggtggtctgctcggctgggacggccaactcgtcgacgacgcccggctggtggtggcgctcgcccgcacggcggccggcttcggggcgcgggtgatcacccggtgccgggtcgaggagctgaccgggggcggcgcgtcggtgcgcgacaccctcaccggcgagcgccaccggctgcgcgcccgcgcggtggtcaacgcgacgggcgtctgggccgaccggctcgacccgacgatcagcctgcgcccctcccgcgggacccacctggtgctgcgccccggcgtgctgggccggctcggtgccgggctgaccgtgccggtcccgggcaccaccagccggttcgtgttcgtgctgccgcaggcggacggccatgcctacctcggactgaccgacgagccggtcgagggtccggtgccggacgtcccggagccgacaccggccgagcgcggcttcctgctcgacgtggtgtcgacggtgctggacgtgccgttgaccgaggccgatgtggtgggtgccttcgccggcctccgcccgctgctcgccggtggtgccggcagcaccgccgatctgtcgcggcggcacgcggtggtcacctcgcccgccggggtgaccacgatcgtgggcggcaagctgacgacctaccggcggatggcccgggacgccgtcgatgccgccctgcggtccgcgggtctgcccgccgggcgctgccgcacggcgggactgcccctggtcggtgccgcgtcgccggagcggctggccgggagcggcgcgccgcgccggctggtcgcgcgatacggcgccgaggccaccgcggtcgccgccctggccatcgaggatccgggtctggccgagccggtcgccgaggggatcgcggtgaccggggccgagctgctgtggggggtgcgcgccgagggtgccctggacgccgcggacctgctggatcggcggaccaggatcgggctggtgccggccgaccggacccgggcggccggcgtggccgagacgatcctgcgccggggtcttgccatgcaggggtcgtag

SEQ ID NO: 7370 - DNA, 591 bp, Actinoplanes utahensis
atgtccagtcgtaacacccccgggagccggacggacgacgacgccctgctcgacgcggcacgccagtgcgtgctcgccgtggggctgcgtcgcaccacgctgaccgacgtggcgcggcgtgccggcgtgtcccggatgaccatgtatcgccgctggcccgacatggcgtccctggtcgccgacctgatgaccagggagtggggtgagctggcactgcgcgcccaggagggcgcggccggccggcacacccgcgaccggttggtgaacgggttgaccaccggcgcgacgcggctgcggcacaacgcggtgttccgtcgcatcctcgagctcgaccccgaggtgctgctgccctatctggtggaccggcgcggcaccagccaggaccgcatgctggcactgctggcggagacgatcgccgccgggcacgccgacggctcggtgcgcaccggcccgccggccctgctcggccgcagcctgctgctcaccctgcacggcttcgtcgtctcgtcggccaccatgaccgacgaggtcaccgaggcggacctggacaccgagctgcgcctgctcctcgaccgttacctcgcgccgtga

SEQ ID NO: 7371 - DNA, 1563 bp, Actinoplanes utahensis
gtgaatgagcttaccgacccggcgcggtggggcacgcccgccgccgccatgaccctctcccccaccgtgctcgacatcctcgggtccgccctcggggtgaccgggccgcggcccgccgccgagtcggtcgagctgcccgccgccggcctgtccgaagcggtgctgcgggatctgcgcgcggcgtgccccgaggtggccaccgacgacgccgcccggctgacccacgcggccggcaagtccaccgaggacctgctgcgcctgcgcgccggggtggccgccgacgccccggacgcggtggcccgcccggcgaccgaggacgaggtgaccgggctgctcgcggtctgcggacgccaccgggtcgccgtggtcccgttcggcggcggcacgtcggtggtcggcggcctcaccgcacgccgcgacggatacaccggggtgctcgcgctcgacctggcccggctggacgggctgcggcacctcgacccggtctcgcgcaccgccaccttccaggccggcatccgggcgccccgcgccgaggagctgctggccgcagcgggtttcaccctgggccacttcccccagtcgttcgagtacgcgtcgctcggcggtttcgccgccacccggtcgagcgggcaggcctccgccgggtacggccggttcgaccggatggtggtgggtctgcgcgtggccaccccgatcggtctgctcgaggccggccgcgcccccgagtcggccgccgggcccgatctgcgccagctgatgctgggctcggagggtgtgttcggggtcatcaccgaggtcaccgtccggatccatccggcgccggccgagcggcactacgagggctggagtttcgcgtcgttcgaggccggcacggcggcggtccgcgcgctcgcgcaggacggcccgctgcccaccgtgctgcggctctccgacgagaccgagaccgcgatcaacgcgatgaccggcggcccgcggggcgacggctgcctggccgtcatcggcgtcgagggtgagacgcgggacgtggcgcgacgccgcacggagctggagcggcggctcaccgagctcggcggcaccccgctgggtgcggcgcccggcgaggcgtggcgggccgggcggttccgcgcaccgtacctgcgcgacgccctgctggacgcgggggccgtcgcggagacgctggagacggcggcgttctgggaccggctgccgcagacgtacgcggcggtccgtgacgccctgatcgacacgctcgccgaggccggcacaccgccgatcgtgctgtgccacatctcgcacgtctacgacagcggagcctcgctgtacttcaccgtcgtcgccgcccaggccacggatccggtggcgcagtggcgcgcggccaagaccgccgccagcgaggccgtcgccgcctccggggcgaccatcacccaccatcacgccgtcggccgcgaccaccgcccgtggtacggccgggagatcggcgaggtgggtgccgccgcgctgcgcggcgtcaagcaggcgatcgacccggccggcatcctcaaccccggcatcctgctgccatga

SEQ ID NO: 7372 - DNA, 882 bp, Actinoplanes utahensis
atgagccgggacgtcttcaccgcggtggtcaatccggcggccggcgcgggcaccgccgcggcccgcatcacggcggtggcccgggcgctgcgcgaggccggggcgaccgtccacgtggcctacacccggtctctgcagcacgccaccgagctcgccgcggccgccgccgagcacaccgtgctggcggtcggcggtgacgggatcgccggcgcggtcgccgccggcctgctggacaccggtgccgagctggccgtggtgccggcggggcgcggcaacgacctggcccgggccgtcgtcccgctgccggccgatccggcggcggcggcacaggcgctgctgcggacgccgagcggactcgtcgacgtggccgaggccggcgggcgggtggtggcgggcagcgtgtgcaccgggatcgacgcggtcgccaacgacctggccaaccggcggctgccccgccggccggcggcctaccagctggccgcgctgctggtcatgctgcggtggcgcccggtgcggtacacgctcaccgtcgacggggtgaccgcgtcgttcaccgggcacaccgtggtggtcgccaacgccccgtggtacggcgggggcctgcgggtcgccccgcacgcccgcctcgacgacggcctgctcgacgtggtgaccgtcggcccgctgccgcgaagccggatgatcggcgcgctggccgctctgcggcacggcaggcacctcggccttcccgggatcaccacccggacggtccgggagatcaccgtcgcggcgaaccggccgctgccggtctacgccgacggcgagttcctgggcacgggcccggtgaccatacgggtccggccggccgctctgcgactgatcggagcgggcggcgccggctga

SEQ ID NO: 7373 - DNA, 645 bp, Actinoplanes utahensis
atgtccgcgacatcgatgaacggggcgagtgtccggtacgcccgctggcgccatcgcgacgccgcggcgcacgcacacctgggcgagggcgccttcctcgacgacgtggccggtgaggcgagccgggcctaccggctcggcgcgcggttcgtgtcgatcgccgacccgatcgcgctcgggcccgagccgtccgccgagcacaccctcgccgcgctctccttcgtccgcgaactgaccagccacgggatggacgtcgcgtggcacgcccagctgtccgccgacagcgcgccctggtgggtgttcagccacctgttcccacccgcgaccctcgacggtccgcacgccgccgagacgctggcggcctggcgcgcgaaataccatttgggccggtgtttcctgcgtcgcggaccgggcttcgtgcagatccgcgaccgtcggcaccagggttttcgccgattgacggtcagcgaccccgaccacctcgccgccatcgacgcgctgctggccggccggggccgcgaggccgtaccggagcggatcgtcgcgctgttcgaacgtcagcatctcgtggtcccggtctgcggtgacgtctggtgggcaccctaccggctccagcgctggccgctgccgtcctgggaggtgtga

SEQ ID NO: 7374 - DNA, 1914 bp, Actinoplanes utahensis
atgcacgtcgtcctggtcagtgtgccgtggagcccgatcgagatgccctcgctcgccctcggactgctgaagagcctgactctgcgggagttcccgggcgcccgcgtcgacgtggtgtacggaaacctcgagttcgtcgactgggtgaccgagcgccgcgccttccggtacgacgactacaagtactacgaccgggaaagctgctacctcggccacggcgactgggtgttctcctccgccctgtacacggacccgtcgtggcgggtgccggagttcgtcgaggcgttcgcgccggacgacgtgcccggcttcgaccgcgcccgcctggcgacgaccctgtggctgcacgaacacgccggcgagttcatcgaccaccttgccgcccggatcgcggcggacgcacccgacgtggtcggcttcaccaccacgttccagaccgtcacggcgtcgctcgcggtcgcccggcggctcaaggagctgtccccgcgcaccgtcaccgtcttcggtggcgccaactgcgaggacacccagggcgaggccatgcaccgcaacttcggcttcgtcgacttcgtcgtacgcggcgagggcgagctggccttccccgacctgctgcggtcggtgcgcggggaggggccccccatcgcggagatcggtggcctgtgctggcgtgacgacagcgggaccccggtgttcaaccggcccggccgcaagccgctggccaccgacgccatggtgctgccgcactacgacgagtacttcgaacgattcggcgcctcgcaggcccggcggtgggtggagccccggctggtcatcgagggggcgcgcggctgctggtggggcgagcggcaccactgcacgttctgcgggctcaacggggccagcatgacgttccgcagcaaacgtccgtcgaagttcttcgaggacatcgtcacgctcgccgaacgtcaccgcgtcctggacctgctcgtggtcgacaacatcctcgacatggcctacctggactcgctgctgccgcggctcaccgccgccggcatcgacctgcggatgatgtacgagatcaaggcgaacctccgttacgaccagctgaaggtgctcgccgacgcgggggtggtgtgcgtccagccgggggtggagagcctcaacacgaacgtgctcaagctcatggacaagggcgtcaccggctgccagaacgtacggatgctgcgcgacgccgaatcgctcggcctgaccgtcatctggaactacctgtacgggtttccgggtgagaccgacgacgactaccttccggtcatcgagcagttcccgaggctgcaccatctctgcccggccggcgccgacgaccgcctcggcatccagcggttcagcccgtacttcgagaagccggagctgggcttcgccgaccgacgcccggctcgccagtacgaactctgctatgacctgccgcaggcggatttgttcgatctcgcgtacctgttcgaggcgccgcagcggggcatcggcgacgatctggcggcgcggctgagcgccgggctggacacctggcgcggcgagcactggcgcagccaactgtcctacttcgccgacgacgacggcatcacgatcgccaacacccgccccggcttcgactggcgcaccgtgcgcctgggcacgccggtggaacgctcactgttcgacctgctggaccaaccgcggaccgccgcgttcctgcaccgggaggtgggccggcgcaccggcgcgaccgtcgccgagatcgacgcggtcctcgagcgctgggatggcctgggcctgtacttcagcgacgccggccgcatgatccacgtggtcacccaggaccagaaccagaggctgctgcgcattctcgccggccggcaatggcgagcggccgatcggccaccggcgccggtggccgtgtga

SEQ ID NO: 7375 - DNA, 1059 bp, Actinoplanes utahensis
gtgcacgtgttcgtgacgattccgatgagtgacggcgcgccgggacgcgttcatggcttccttaccgacctgttcgcgtccgcccggccctggcccggcgagtactggttcgtccgcacctgggaacagacgtccggcgccgactgcttccaggtcagcctcgcctcggcccacctcggcgccggcgaggcggccgaccgggtacgccgggtggccgccgcccacgacctgcggccggacgtggtcgaggcgccggtcgaggaggtgccgtcaccgctgtggaacgccgggctcggcgggccgggattcggcgccgtcgcccggcggctctaccgggcggcggcccccctgctcgtccagctgctgccggccctcggcggtgacccggccgatcgctaccggatcgcggtgcggctcatgctcgccaacgccggggccacactgctcgagtcggagcaacgcgacctgccgtcgcgcggctacgccgaattgttgagcctgcgcctgctcagctaccggtcgcactacgaaggggtgtacgcccgggccaccgatcccgactcgtttgaacgccggtacgccgcacactacgaacgcctcggcgggtacacccgcgacctcgtgcgctcctgtgcggtttccggtccgtccagcgacgacccggtgacgggcggctgggtcgcgatggtgcgacggcacttcagtccggtgcgcgacgagttccgcgccggccgggtcgtcaacgccggcctgagcatcgaggacctgaacgcgggccgcgcggtgccgctgccgccgacccgcttccacacgtacctgtcggccgagctggagcatctgctgcatcgcgatccggacttcctggccttccggctggccaccagcctgctctacagctgtctgcacacgctcggcttcagcctggtggagcgctacctgttctgctacctactggcccgggccaacgaggacgtctcgggccgggaaaccgccgacctgcaacgcgaactcggcgccctcgcccggcaactcgtgtgcacgtcgcccgtgacaccttga

SEQ ID NO: 7376 - DNA, 159 bp, Actinoplanes utahensis
atggagaacatcgatgaggagctcgacctgaacgccctggagatctcggatctgatcgaggactcgggcaccgaggacgagacgctgtcgcagatcatggcggcctcgtgcacgaccagcggctgcgcctgcagctcgtcgtcctcgtcctcgtcctga

SEQ ID NO: 7377 - DNA, 915 bp, Actinoplanes utahensis
ttgagctctaccgagactgaccgatggcgtgccctgcacgtctacctgccgcactcggtgcagacgcggttcctgcgcgaggtggtcgacccgctcctgcgcgacgccgggctgcgggaccggttcttcttcctgcgctactggcagggcggcccgcacctgcggctgcgggtgcgtggcacgtccgctgccgcggtggagtcgatcgggcgggcgctggcgtcggcggtcccggccggaaccccggagctggccgccgagtacgcgtacgaggtgtctctgcaggcgcacctggccgagcgggagggggagcagccggcgccggagcggtcggccggcaccgtggaggaggccgagtaccggccggagtacggcaagtacggcggcccggcgggggtgcggatcgcggaacggctgttcggccgcacgtcggcggcggtgctcgacctgatcgccgcccgggccgacccggcgccccgagccccgaccggggatgccatccggatcatggcgatgtcgttgcgggggtccgggctcgacgccgagcagagccgggcgttcctcgagcgctacgagcagtggtggcgcccgtacctgccgccgggcgccgaccgctcgtggcccgggatgtacgagcgcacccgggaccggatccgtcacctgtgcgaggcggtctggcacggccacgccaccgacaccttccacgacacgtacgcggaggcgctggcggcggcgcgcgaggtcggtggcccgcacggcgacctcgcggagctgacactcgggacggcttcgtacgcccggtgcatcgcccactatctgcacaccaccaacaaccggttggggatcatcccggccggcgaggcgttcctggcatatgtgatgtgccgatcgttgaccgaattggagcccgtatga

SEQ ID NO: 7378 - DNA, 2670 bp, Actinoplanes utahensis
atgaccgtgcgatcaccggagatcctgcagcgttctacccgggcatccgcgacactcagcccgtacgtcgtgttccgccgggcccgcctgccggtggccgagctggccgccctggggctcgaccggtactgggcgcgggtcgacgggtggcgccggcgggccgccgccggagcgcgggtggcggcggaggtcgcggaccggttggcggccctggtgccgggcgcggaccagaccgtgcgagcggaaatcgtccggctgcgccgtgatgtctacaacggccggtccgaccccgcccggcgccggctcaccctcaccgaaccgcacctgggcgccgccgccggccaggtgcgtgcctggctggagctggccgacgaggtgcgccgggaggagagggatctccgtacgctcttcgacgccgagctggcggcggcccgggccgggatccgggcgctgttcgagcacgacgcgatggccaagggcatccagctctccggcgaccagctgtatgagagcctgcagaggtacgtccgcgacgacggtcccgcactcaagccgagccggttgcgcaccgcggagtcgtcgctggtgaacttcgcctaccgggcggcgctgaaaccgtccccgttcggccggttcaccgaggtcggcgccttcccgccggacctgcccccggaggccggcggcgcgccgggcacacagtcgtcgaccaccctcaaccgggtgctgctcaactggatggtgggcggctggcagcggctgccgggcggtgacgacctgggtcggatgctgctcaactcctcgctgtccatcgatgagaaatcgattcgcttcatcggcctgcgaccggacgggcgcgccaccgggtacggcggtaccgagcaggtcgtccggctccggcgcgacccggtggtggaccgggtcctgggcgtgctggccggcggttcggccccggtgccgcagctgcgacaggcactggccgaggtggccggtggcgacgaggcggcccggaaggtcctgcgggcactgctgcgtacgggtctgctgtcgttccggcccggcatcgacgagcaggacccggcgtacgcggcgaagctcgccgatctgctgaactccgcgcccgccggaccgctgtcggtgctggccgccgacctgcggacgctgcggcggctggagaccgacttcccggacgcgtcggtggccggccgtcgggcgctgctggccgtcgggaaccgggccatcgccgaggtgggcgcggtctgcggcgtcggggcaccgccggaggcgatcgtgcgggcaccggtgtacgaggacgcgtggacccgcgcccgccccgccacgtggaacgccgacgcgatcgccgcggcccggccggccttggcgagcctgtggcgcttcgcctcgatgctcgactacggccaggtgaagcggctggggctgtactccttcgcggtggaccggttcggcgaccgggagaccgtgccgttcctggacttcttcgaccaactggtccggctgcccgaagccgagcaggacgcggtgttcgccgggcacggatccgccctcgcacgggcgtacgcccggcggcgcgatgcagcgctgcacgagctcggcgaccggatcgtgccggacggcgacggtgtgctgcggttgagcccggaggccgtcgacgacgcgtgcgcgcgggtcgaggaccgcgtcgatccggcgtcgatcacgttccgggtccagttcgcccggcgcgccgaccggcagccggccgtggtggtgaacggcgtgctcaccggatacggcgtctacttctcccggttctgccggttcatcgacgggtcggcgatgccggggtggacgctgcggtcggccctgcgcgatcacctccgggacgccttcggcgggcaggtcgacctgaacgcggtgctcggtttcaacttcaacctgcacccgccgctgaccgaccgggtcctcgactatccgggttcctggccgtcggcgacggcgcaacgccggtacggcctcggcgacctggcgatccgggtcgaccacgggagccaccggctgctgctgtgggacccggccgccggcgcgccactcgacctgatgccgatgaacttcctcatcccggtcggggtgccggtgctgtaccagctgctggaggcgctgagcccgacgacccggtacccgtggcacccgctggacgacatccgccgcgtacgggatcccggcggcgccggacgcctggtcgtcggggacgtcgtcgcggaccgccgctcgtggacggtgccggcccgggacatcccgatgctggcggaggtgagccgggactcgtacccggccctgctgcggttcgacgagtggcgccgcagccgcggcctcccgcgggacgcgttcgtgctgtgccagaccccggacgagtacgcggtgctgtccggccgcacccgtgggctgccgcgcagctggtccgacttcgagcacctgcaccgggcgagcgtgcacaaacccatgtacgtggacttccgcaacccgctgtcggtgcggagcctggccaagtcggcgctgacccgcgacgacgtccacctgtcgattcgagaatgcctgccggcgaccgacgagtacgggcgcggggacggtccggcggcggcggaggagtttttcgttgagctctaccgagactga

SEQ ID NO: 7379 - DNA, 1827 bp, Actinoplanes utahensis
atgacgacgctgctcgacgacccgctggccgcgctggccggggacgcgccgccgcccacggaggtgttgctcggcccgctcaccggcccggcccggctgtccgggccggacggcgggcaccggcccggccggggcttggccgtgctgttctggcgcggccggatccacgtgctcgcctaccggcccggtgccggcggctgtcccacctgcctggcctggttcctcaccggcccgcaggcgccgcccccggcgggcgctccggcggatgccgcccgggctgatctgctgtggcagcggctcggtccggcgctgcgggtagtcgtcggccggctggcggccaggctgctgcgcgacggcaccgccagcgggactctcgccaccgtcgacgccgcgaccggcacggtccagccggggcgggtgcctccgagctcggcgtgcccggcgtgcgcgcccgagccggcggacaccaccgtcgccttcggctccaggccggacctgctggacaaggccgacgggacgctgcgcagccggcgcccgctgccaccggacctcacctccgactacgtgggggcgcactcggtgttccgggaaccacgggtcgacctcgacgggccggtgccggccgcgcaggtgggcttgccgctgcgcgacggcgggcgggaacccggcatcggccgctgcctgagtttcgctcgcagccgccggacggcggtgctggaagggctggaacgctacaccggcttccaccgccagcccaccggccgggcggtcgaggcgtcgctggccgagctggacgctcagggcctggatcccaggacgctcggctaccacgacgactcccggtacgcggagccggacttccccttcgcgccgctcggccggcacgaacggctgcgctgggtcccggtcacgccgctcggcggcggcgtcccgcgctacctgcccgaaccggcgctgtcctgggcacaccggcccgggtcgcgccggccgttcttctacgacacgtcgaacgggttcgccctggggcagagctacgaggaggcggccctgcacgggctgctggagatcgccgaacgtgacgcgttcctgctcacctggtaccaccgcctgctgctcccggaactcaccctgggtcccgccgaccgcgggatacggcagctggtggaccgggtcgcggtcgtcaccggattccggctgcggctgtactgggcggcggtggacaccggcatcccggtggtgctggcactcgcccggcgcgacgcggcggcgggcccgtgcacgttcgtgtcggccggcgcgaacctgcatccgcgggcggccgccgaatcggcgatcttcgaggtggccgcgatcctgtccgcggtcacccacaccttcgaccgggaccgcgcccacggccggcggctcgccgccgacttcgggctggtccgcaccatggccgaccacagcctgctcggcgcgctgccgcagtcgcggccctggttcgacttcctcaccaccccggagcgacccgaactcgccctggccgacgcggtcgcggcacatccggtggcggcgcggctcgacgccgacctcgaccacgtgcgggcccggctccaggcggccgggctgtccgcgtacgcggccgacatgaccacacccgagctgcgctggcgaggtctggtgtgtacgcgggtgttcgtgccggggtgcctgccgatgacattcgggcaccacactcgccggatggccgggctgccgcggttggcgcgccaggtgaccccgtaccagtccggcctggcgcccgggcagtccccggccgacgtcccaccccacccgttcccgtga

SEQ ID NO: 7380 - DNA, 1608 bp, Actinoplanes utahensis
atgtccccggcatcggcgaccgccaccggcttcgtgctcgcccgccccgacgtcgcggtccggcggagggccggcggtgtgtgggtgggcgtcggctcggcgtccttcaccgtacgcggtgccgccgcggccgacctggtgacggcgctactggaccgggcggacggcacccggaccgcgtccgagctgctccaggacctgccgccggcggcggcgcgcctgctcgaggtgctcaccgcgcgggactgcgcggtgctgctggacgcgccgatgagccggtacgcggacgagccggcgccgccgtggctgatcctctacttcgcccagctgacccggcacccggagcgcgcgctgcgccggatgcgtgacaccgtcccggtcctgtacggccggccgtcgtggctcgcccgcctgcgccacgtcctcgacggcgtgcccgccgactaccggtcgctgtccgagaacccggcggacggcgcggccctgccggtcgtggacgccgacggcctgccgcacgggcaggtcgtccggatccaggacgcgctgcgggccgccggccggccgcacgggatcgccggctcggtggggtcccggtactggctggtgtggtccgacggcgacgcggccgggtgctgggactgcctgcgccggcacctcggcgccgcttccgcgggcacctcggtggacgagtggacggcggccggggtggtggcgcactcgatctgccgccgagccgccggtctgggcaccgtggcgaacgccgcgctgtcgctcgacccggaccggccggaggtacgggcacacccggccgtgatcgaggccggctgccgatgccgccgcgcccggcggcgcccggccgccgaagcgccggatccggtggtccggcgggacctggtggacccgcacgacgggacggaccggcacggcgagcacgatcggatcgtcgccgcgctggccggctggaccgacccggttgccggtccattcctcgacctcgacggcggcgagctgccgcaggtgccgtacgggcgggcccgggccaccgtcctgctcgacggcggcgggcggcgcccggtgcacgccgccgcgctgtcgtcgcgggaggccctctatcaggcggcgctcaacgcggtcgaggtgctggccggcccacccgcgcggaaccggggcgccggctggaccctcgacgaggcgatctaccgggcgctgctccggtcgtcggcccggcacccggccggcgcggcggcggagctgcccgacgacctcggtccgcagccgtgcgtccgggtcagccgctatctggaacgctcggccggtctcggtccgatcgggtggaccggcgaacgcctgcccaacggcctgtaccgggtcgccggccgcccggcgtccggccccgccctgcacgggctgggcgcctgctacgccgaggccgtcgcgacggcgctcctcggccgggtcaacgacgacggtgtcctggtgccggtcaacccccatttccggcgatggcgggacgcttggcagcagctcacccggccggacgtcaccgagccggaccgggcgccggtgcggttcacccagggccggctccgggtggtggaactggcatga

SEQ ID NO: 7381 - DNA, 699 bp, Actinoplanes utahensis
gtgcgatccgacctgtccaccatgcggcctctgctggccggcttcgccaccaggacgagcacgagcgacgggcgagccgccgaccgccggccggcgccgttcccggacgccgcgccggtcgccgtcgacctcgacgagctgctggccgagccgcacgccgacctgcgcgacacgctgctggcccgccgctcgtcgctgcggtacgccgacgagcccgtacgcaccgagttggtgatcgccctgctgcacgcggcgctgcgccgggatcggctcgactggcggctcgacgacgcggccgggccggtggaggcgttcgtcttcgccgtgcgcagccgcggactacccgccggggtgtaccgggtgacggcgcacgactgttcgttcctggccccggtcgaggcgctgggcgacgtcgaggacctcggcgtgcagcgggagttcgccggtgccggggggatcgtcgccatgtacgcctcgctggaccgggcggactcgtgggccggcccgcacggctaccggatgtccgtggtgcgcgcggcggccgcgctctacgacttccacctcggctgccagtcgtacggcctgaccggcaccctgttcggcggcttcatcgccgcggcggtccggcggctggtccgcggggacggcgtgacccggcatccgctgctgtccgccacctacgcccacccggagggctga

SEQ ID NO: 7382 - DNA, 1620 bp, Actinoplanes utahensis
atggtggtcgaggtgaacgccgagacgatcggccgggcagcccgccgcgacatgcagattgcggtgccggtgcgcccggcggtgcgccgcggtgtccggttgcgccggtccggcgacacggtcgtgctcgacggcgcggatcggccccaggctttcaccggccggttcgcccgcgaccatctgacccagctggtcgcggcctgtgacgggacgctgggccaccgcgacctggccgcccggaccggactggacgagggaaccgtctacaagtcactcgcgctgctgtgggccgccggcgcggtcgaggagggcgatccgccgggcgccctgccagcggcggcgccggagttcgcctgcctgctgtcccggctgggtaactccaccggagcgaaccggtcctggaccggcgccgcgcggcggctcgcgcggacggtcgtgcacctggccggcgacccgtcactggtggcgacggcggcccgatgtctcgacggtgccggccggccggtgaccggagagttgcggccggcggccgccggcgaggacggcctgagcgtgttcttcgagacccgcggctcggcgcccgacctggccgccctgcggcgccgctgctggaccgaggggcggccgctgctacgggtccgggtcggcgccaccgcggtgacggtcggcccgtacgtcgatcccgccttcacgccgtgtctcgagtgcgggaccgcggcggagggtgcacccgacggcgatccgccggccgggaccggcgacctggtcgccggcctggtgacccatcacgtgacggcgctggtcggccgggccacgatgacccacctcccgctcgacgcggccgaggtggacctgagcaccctggcgacgcgctaccgcgccgccgtgacccgcccgggctgccccacctgctcgttcgccgccggggtgcgggcggccgagccgcccgccgcggcccggtacgaggccgcggtggcgatacccccacgccggttcctcgacccgaaggggcacctggcccactaccagtcggcgaacatcgccctgtcgtcgcagttccggacgtggccgacctgcccccgccggccgctgccggccgcggacctgacgcggctggccggggagccggccggcggcaccgggcggcgtcccggaccgcgcgaggtcgcgctgctgctcgcggtcgcgttcggggtacgggaacagtcgccggtcgacggtgcggtacggcgctggaccgccgcggccgggaacatcggctcggccaccgcgtacctgctgtgccgggacgacaccgtgctgccggccggcgcctacgcgtacgtcgagcaggagcacgcgctggccggcatggcgtccggtaccccgccgcccggcaaccggccgctcctgctggtgatcaccgccaacctgcgcaaggtggtccgcaagtacggcactttcgggctccggctggcgctgctcgacgccggatgcgcggtggccgcggcccgggcggtcgccggtcacctcggtctggcgtacgacctcgcccgcgacttcgacgacgacgtcctcgccgagtgcctggggcttctcccgtccgacgaacccgtcgccgccgtcctggaattggggtga

SEQ ID NO: 7383 - DNA, 612 bp, Actinoplanes utahensis
gtgacatccgaccgacccgaggacgacgtgtacctggtacgggacgcgttcggcaccgggtacgccgaggcgtacggcatccgggcggcgattccggtgaccggcagcgtgcttcccgacgacgcgcggctgagcacggcccggatcatcgtggccctgcacgccgggcgcgacgacgaccttcgggacgcgctcgaccgggccgggttcgaccggggtgtcccgaccgtcggcgtggagttgctgccgacccggatcgtctgtggcccggcggtgatcccgggcgccaccgcgtgtcacgcgtgctaccggcggcgcatcgagcagcaccgggacccgggccggccgtacgacctgagcgccgcgacccgggacctgcccgagggattcggccggccgcacctggcggtcacgcacggcttgctggggctggcgctggccgagatgcgtggcggcccggtcggtctcggcggcacggtccgcacgttcgacctggtcgccggcacgctgtcgtccgcttccacggtggcggtggaccgctgccggcggtgcggggcccgattccgggacggcgcgcccgccggcgccggagcggtcgccgggcttccctga

SEQ ID NO: 7384 - DNA, 1347 bp, Actinoplanes utahensis
atgtcacggggcattgtcgcggagccgtgcggtcctgaactgcgtcggctcgcattcctgatatcgccgttcggcctggtgtcgcgcaccgtgtccctaccgccggccgacgccgatccgccgttcgcggtgcatgtggcgggcatcggtgacccggcgcgagtgctcgacggcatgcgcggctggagcgacgccggcgacatgggcaacatcaacggggtcggcagcgcgctcaccggcgaacgggcccggctgacgtcggtcgccgaggcgctggagcgctactcgatctgctcctggcacgacgacgagatgatcttcgccgctgaggacgcgctgaccgaggagtgcgtctcgcccgcccgctggccgcgatgctcggccgccgagttccggcgcgaggactgcggactgcgaccctacgatccgggcgtcccgatccggtgggtgcgtgcctggtcgttgacccggcgacgggccgtgctggtgccggccgccgcggtgtacctgcacctggccccgcggaccgccgcggaactgttcacccggggcgtgaccaccggggcggcggtccactccgacatccgccgggccgtcctcggcggactgctcgaggtggtcgagcgggacgccctcacgctcgcctggctgcaccgcctgccactgccggagctggcggtcgaccccggcctgctcgacccggcggcccgcgccgcccgcgcggccggtaccgccggccacctcgaggtacgcctgttcgacgcgacgacggacttcggcatcccggtggtgtacgccgtacaactcgccgagcacgaggacgcgctcgcgcagatcgtgtgcgccacctgcgacctggatcccgggcaggcggtcggcaaggtgtaccgggagctggccgccctgcggctcgccttgcgcgaccacgtgacccgccggccgatacggcggccggacgacggcacggtcaacgtgctcggctcggccgcctacaacgccgcggccgcccggcgggacgcgttccggcacctgctcgccggcgaacggacggtgcggcggctacccgatctgcccggcctgccggccggtgccgacccgctgacgaccgcggtggatcgggtggccgcccggggtgccgaggtgctcgcggtggacctcaccaccgacgaggcccggcaagccggcatgtacgcggtgaaggtcctggtgcccgaggcggtgccgttgtcgttcatccacagcgagcgctacctgggcacgccccggctgtatgcggcaccggaggcgatgggccacggccgccgcgacgagcagtcggtgaaccccgacccgcaaccgttcgcgtag

SEQ ID NO: 7385 - DNA, 1104 bp, Actinoplanes utahensis
gtggcctgcagctcaccgtcaccggaagcgatctgcggatcgccgccgccgcctcgccgggctgcccgtaggcactatcgattcgcgctgatggcgggcacactcacccgcatgacgcgccgtctgatcaatcctcgccgctggaccccgcccaccctgaacgaccccggcccgaccgccccgctgcgcgtcgaccggctgctgcccaccgacggccacggccccgaggacgtccagttcgaccacaccgggcagctgctcaccggcaccgccgacggccgcatcctgcgcatcgacccggacaccggcgagcacaccgtcctggcgaacaccggcggccgcccgctcggcctgcatccgatgccggacggcggcgtgctggtgtgcgatcacgacaaaggcctcttggcggtacgcccggacggaacgaccaccgtgctctgcgacaccgtggacggcgtcccgctcaccttcgccagcaacgtcgtgcaggccgctgacggcaccgtctggttcaccacgtccaccagccgctggccgctcgacgaccacctcggcgacatcatggaacacaccagcaccggccggctggtgcgccgcgacccggacggcacgctgaccaccctgatcccggacctcaaattcggcaacggcctggtcctcgcccccgacgagtcgcacctgctgatcgccgagaccgccggataccggatccggcggcaccacctgaccggcccgcacgccgggcgcaccgagatcctggtggagaacctgcccggcttcccggacaacatgtcgctgggcagcgacggcctgctctgggtggcgatcgcggcgccgcgcaacccactcgtcgaccggctgctgccgctgcccggcttcctgcgcctgctggtctggaacctgcccgaagcggtccgcccgaaagccaccccgatcgcctgggtgatggccttcaccctggccggcgacctcgttcacgacctgcgcaccgacgacgggtcgtacggcttcgtcacctcggtcgccgaacaccacggcaccctggccctgggcagcctcaccgagaacgacatcgccctgctgcacctgccgagcctctga

SEQ ID NO: 7386 - DNA, 411 bp, Actinoplanes utahensis
gtggccgacggcaccagggccgcggcgaccggcgcgggccggctcgccaccgaagccggcaagggtgccgacggcggggccgccgccacccgcggcgccggacgattgcacagcgacggcacacagaagctgaccgacagcatcgtggccggctcggcgacaccggccgaggtctccgccctgttcaccgcgatggaccggcgagccgcgcaggcgctgccgtacggcgcgcccgagggggccaccggatcggcgatgtggcagttccggatggacggcacggccgcgtccgacccggccggcgcctcgaccggcgacggcacccggatcacggtcgccgtcggcctgctggtggcctgcgtgctcgtcaccggcctggtccgccggtggaaggacggggccgatgcgtag

SEQ ID NO: 7387 - DNA, 1818 bp, Actinoplanes utahensis
atgactagctggactccccgccgtgcgggcgccgtcaccaccacgctggtcctgaccggcctgccgctgccggtcgtcccggcacgcgccgccgagccggacgcgctccaggtgaccgaccaggagaccgtgaccgtgcggctggacgccagcggcgtgccggtcggcgccacgctggtcgacgtcctcgccgcccacggatccggcacggccgtactgcgcaatccctcggccaccgccggcctgcgcaacctggtgggctacggccggccggacacctccggcgaccggctggtgcagagggtgacggcgggcgaccggctcgccaccgcatccaccgtgaccggcgccgtaccgatcacgctgcacgcccactacgaactcgacggcgcgacgatctcgccggccgccctgcggggacgcagcggccacctcaagatcacgtacacggtgacgaaccggaccgcggagcccaccgcgatcacctaccgggacgccggcaaaacctcgcacaccgtcaccgagaaggtgttcctcccgctcgtcggtgacctggtcgccgacctgcccagccggtaccgcgacgtgtccgccgagggcggcacggtcgccggcaccgccaccggcggcagtcacgtcgcgtacaacctcgtgctggcaccaccgatgggcaacccgcaggcgacggtcaccctctccgcggccgtcaccgacgccgagatacccgacgtcacgatgcaactgatcccggccaccaccggcaccgacccggcgagccgcttcgccgggcagacgttcaccagcaccaccggggcgaacacccatctggccgacgccgccggcagcgtcgacgaccaggtggtgtcgctgcgcgccggcgtcgccggactcgccgacggactcacccagctcgccaccggcgcggacgccctgcagcggcaactcaccgggcagctggtcccgggcgccgacgccaccgccgccggcgccgcccggaccagcaccggcgcgcgccggctagccgagggcaccggcaaggtcgcctcctcggccgacgcgctctccgccggcacccgccagctcagcgccggactcaccgaactggacaccgcgctgagccggctctccggcgccgcgggcatgtcggccagcctgcaggccgcccaggcgctgcagaccgccgtcgagcagatcgccgcccagctcggctccgcggacgacccggacaccgtgctgggcgccctgcacacgctcggcgccggtgcggcccggctccacggcacgctgagctccgccgcgggcgacgccacgaccatcgccgcgggcatcgccaccggcgccggcaccgcgagcagtctgtccacggccgcctccggcaccgcgacgctggtctccggcatcgtcgacgccgactgcgggccgaacggcccactgccggccgccgactgtgcggatctgcgccgggccgcgcaccagtgcaccggcagcgcggccggcatgcacgccctcagcggcgagctcagcaaggccgccaccggcctgcgcgccctcggctccgggctcggccaggccgaggacgccgccgccgtgctcagcgacggcatctccaccaccgcggcggggctgcagcgcctcaccctggcgttgtccggcccggccggcggcgacaccgccaagggggtggcgcagggcctggacgcgctggtcgccggactcgcccagcaggttcacggcatcaccgccctggcgtcggccaccggtcgcaccaccggcgtggccggccaggtgaaccagggcgccgcgcagctcgccgcctag

SEQ ID NO: 7388 - DNA, 2769 bp, Actinoplanes utahensis
gtgtcgaaccttctctaccggctcggccggttctgtgcccggcacggccgatgggtgaccgtcgcgtgggtcgtcgtggcggtggcggtcatcgtcgtcggtcaccgcctgggtggtggcagcaccgacgccgtcgccgtcggcggcagcgacagcgcggtggcgcagaccctgctggaccgcgagtttcccggcaggtcggccgacgccagcccgatcgtgctcaaggcgcgaagcggcggcgtcaccgacccggcgtacgcggacgccctgcgcgacactgtgcagcggatccgccggatcccgggcgtcgggcaggtgagcgacccaccggcggccggcgacgcggcgctgagcccggacggccacatcggctacctgaccgtgaccccggagtcggactccgcctcgaccctcgacctggccgagcgggtcagggacgccaccggcccggccaccggcgccggtctggacgtcgccgtcggcgggcagctcggtcagcagctgtcgaagagcccggtgcacaccagcgagctgatcggcatcgtcgtggccgtcgtcgtcatgctgttggctttcggctcggccgtcgccatgggcgtcccgatcgtcaccgcggtgctgtccgtcggcggcggcctcgccctgctccagctgctgggcaacgcggccggcatcccgacggtcgccgccaccctggccaccatgatcggcctgggggtcggcatcgactacgggttgttcctggtggtccgcttccggcggctgctcgccggcggcctcaccgccgaggaggccgccggccgcacggcgggcacctccggcggcgccatcgtcttcgcggccggcaccgtggtcatcgcggtctgcgggctggcgctctccggcgtcgccttcgtcggctggctgggctactcggcggccatcgtcgtcgcggtcagcctgggctccgcggtcaccctgaccccggccctgctcggctggctcggccccggcgtgaaccggctgtcgctgcccggccgccggcgcggcgcggccgtcaccggtcccgaggacctcgccggcaccgcctgggcccgcctggccgtacgcgtggccgggcggccgctgaccaccacgctggccgccaccgcggtactgctcaccctggccgcgcccgtcctcgccctgcggctcggtcagatggacgccggccggctgcccgccgccaccgagtcacgccgttcctacgacacgctcgccgagggtttcgggcccggcgccaacggcccgttgcgggtcgtcgtcgagatgttcgctccggccaccgccccggacggcgcctcgacgacggacggccaagatccccgggcccgggacgaccgtctggtggcgctgcgcgccgcgctggcccagagccccggcgtccgcacggtgagcgacccggtgatcagcgccgactccgccgtggcggtcttcggcgtcaccgagcagacctcgccgtcggacgagcgcaccgtggagctcgtgcaccggctgcgcgacacgacgctgccgcgggcgctggcgggccggggcgccgagggacacgtcggcgggctcaccgccaccaaggccgacctggccgggcggatctcgcagcggctgccggtactgatcggggcggtgctggcgttcgccggcctgctggtgctgctcgccttccgctcgctctggctcgccgccaaggccgccgcgatgaacctgctgtcgatcgccgccgcctacggcgtcgtggtcgccgtcttccagtggggatggggcgtcggcctgctgggtctggacgggccggtgccgatcgagtcgtacgtgccgatgatgatgttcgccatcctgttcggcctgtccatggactacgaggtcttcctgctcagctcgatacaggaacactggcacgccacccgggacaacgcccgcgcggtgagcctgggactggccgacaccggccggatcgtcagcagtgcggcgctgatcatggtggccgtcttcgccagcttcctgatcaacgcgaatccggtcgtcaagatgttcggtctcgggctgtccgtggcggtggccgtcgacgcgacggtcgtgcgctgcctgctcgtgcccggggtcatggtcctgatcggcgagcggcagtggcggctgcccccgctcctcgaccggctcctgcccgggatcgccatcgaagccgatcccgcgttcttcgacagcccgccggtcgcaccggcccggaacggccacgacgtcgcgatcggtggcggccggtggagcacggccgcggtggccgtgccgctcatcgtcctgatcatcgtggtgaccgtgcaccgcggcagcgtggccgccgcgacgccggccgtcgtcgctctgctgctcggcgcgttcgtcgccggccggcggcagcgggccggcgtcggcgcccgcggcgccggcctgctgatcggtgcggccaccagcaccctggccttcgccggggccgccgtcggactgccgcagctcccgtcggcggccggactgaccatcgcgctcaccgtgcttctcgctgcggttccgccgctgctcagccggggccgcatcccaccggccgccaccctggcggcgacggtcgccggcaccgtcggctgggccgccggcgaaccggaagccaccgtcctgctgtgcacggccgccggattcaccgtgtccctgctgggacgcctgctcggcaccggcctccggcgccggcagctctcgccggatccctcgacgatcggagctgatcgatga

SEQ ID NO: 7389 - DNA, 1485 bp, Actinoplanes utahensis
atgagggggctcgcggcccggcggggctccggcgcctggcaggggctgcggggccggctgctggccgggacgctggcactgctcgccgccggcctgctggtcgccgacgcgtccgcgtacgccgccctccggacctttctcggcgaccgggtcgacgtgaccctgagatcgttggcgagccgcatcgacgagcaggccggccgggggaccggggcggcgatcagctgggagacggtgcgggtgctcgcccccggtacccagtacgtcgccgtgctggatccggacggccggctgctggtggcgcacgccgcggtgtcgggcagcgaggacctgacgccaccggtgctgccgacgccgatcccggccacgtccgagccgttcaccgcacccagcgccggtgccggtcccggctaccggctggccgccatcaccctgccgggcgcgccgccgcggatcacgctgaccatcggcggggtgcgggtccacccggccgccctgatcgtgggggtgtcgctggccgacgtcgacgccacgctgcaccggctgctgctggtggaggtgatcgcgtcgacggccatcctggtcgccggggtggcggtcgccacgctggtgctgggcttcggtctgcggccgctgcgcaccgtggcggacaccgcccgggcgatcgccggaggccagcgcgagcgccggatcccggtgccgcatccgcacagcgagatcggtcgggtggcggccgagctcaacgccgccttcagcgaacgggaggaggccgaggcccggatccgccgcttcgtggccgacgcgtcgcatgagctgagaacgccgctgaccaccgtccgcgggtggagcgacctctatctcaacggcggggtctcgcagtgggagcaggccgatctggcgttcgcgcgcatcggtgcggagaccggacggatgcagcggctggtcgaggacctgatcctgctggcccgcctggacgcccggcgcccgctggaccgggccccggtcgatgtcggcgccgtcctcggcggcctggtcgccgacctgagcgtggtcgagcccgaacgcagcgtgtcactccgggtcccgccggggccggcgatcgcgctgggcgatgaggcttcgctggtgcaggtgttccggaacctgctcggcaacgcggtccgccacacccccgcggacagcccgatcgaggtggtcgtcgacggcgtggacgacgatctggtgatctccgtccgggatcacgggcccggcctggatccgcagctgctggcccgcgcgttcgagcgtttctggcgagccgacggcggacgggcggcgggcgggggcagcggtctgggtctcagcatcgcccgggagatcgtcgagcagcatgcggggacgctgaccctgcacgaccgcggcgacgacgggggcggcctggaggcccggatcacgctgccggcgagtcctcagcgaaccgtcagggtcagcgacggtacccggtaa

SEQ ID NO: 7390 - DNA, 1557 bp, Actinoplanes utahensis
gtggcgggcggccaggccgtggaccacggccggcacgtggccggctccgtccaccaccgcgatctcgatctcctggtcgtgccgttcgtcgtgcagccgggacagcgcgtccagcaggcgctgatcccggtcgccgagcatcgcctcgtcgaagcccgggtagcgatcggtcaccgcctcgtcctgcgcactgggcaggtcgtccatctccacctcccgggtccagatcatccgggtgccaccgaccatccggaccatgagcacggccggcagcaccagccagaacagcatccggtgcaggaccggtatccgccgccagccgtgggcgaactcgtccgcggtgacgtccggttcgatcaccggccggcccagggcccggtagtcgatgtcctcctcgaccagtccggcccgccggttgaaccgcagaatggagtagctcatggtgagcgcaccggagagcagcgacggacggctcccgccccggacgccctccgccacgatcacgtcagccttcgtcaaccgccgggtgaccgcggcgtagaaccccggctgcgccatgtgaatcatcggatagatcacgaactgcatcggtgtgccgcggcggcgcaaccggatgacggccgagcgaacgcccagatcggtgaattcgatgatctgcatggccacctccccgcgctcagggtgacgactgccggcaacccgcgatgtccccgggcgggagccttcagccaatcggcaggttcccggcaggcggcgggaagatcatcggccgcgccggtacggcatcgtggaaccgtgactactccgaacccggcggatccccggcaggcgggcggcctgcgaccacgcacggccgggctcgtcgccctgcggccggcccgcgtcctggtggtcgacgacgaagcgcccatcgccgaggtgctgaccgcgatgctctcgttcgccggcttcgaggtccgggccgcggcgagttgtgcgcaggcgcgggcgctggcggcggagttccggccggaactggccgtcctggacatcatgctgcccgacggctccggcctggatctgtgcctggagctgcgggcgcgcgacgagcagctggcggtgttgctgctcagcgcccgcgacagcatcgaggaccgggtggccggcctgaccctgggcgccgacgactacgtgatcaagccgttcagcaccgccgaggtggtggcgcggctgaacgtgctgctccggcgcaccgccggcgcggcgccgacgaccgcacggcgggtgggtgacctggaactcgacgagcagacccaccgggtggtccgggccggccgggtgatcaccctgtcgccgaccgagttccggctgctgcggtatctcatgcgccatgtcgagctggtgctctcccgccggcagatcctgcgcgaggtgtggggctacgagtggggcggtgacgcggcggtggtggagaagttcatcagccagctgcgcggcaagatcgacgcggacggcgcggtcccgctgctgcacaccgtgcgcggcttcggctatgcgatccgggagccggtcgcatga

SEQ ID NO: 7391 - DNA, 1143 bp, Actinoplanes utahensis
atgaacgttcggtggtggcgcgccctggcggcggcgtcggtcggcgtgctgctgaccacggtcggtgggcacggcgcgtcggcggcgccgcccacgcccctgcagcgtggtctcgacgatctgcaccgtctcggcgtcgccggggcgcagggcctgatccgcgacggcagccgggtgaccgccgcccgcagcggcgtggccgaccgggacaccggcgcgccgatgccggccgacgggtacttccggatcggcagtgacaccaagacgttcgtgtcggtggtgctgctccaactcgtcggggagggccgcatcacgctggacgacccgatcgagaactggctgcccggtgtcgtcgacggccacggcaacgacggccggcacatcaccgtgcgccagatcctgcaacagacgagtgggctctacgacggcaccggtgacctcgccgtgctgaagtcggccgacgagtaccgggcgcaccggctcgaccaccacaccgaggcacaactggtggcggcggcgatgcagcacccgccactgttcccggccggcacccggtggagctactcgaacaccaactatctggtggccgggatgctcgtcgaacgggtcaccggacgctgctggttcaccgaggtgcgttcccggatcctggcgccgctgcacctgacccgtacgttctaccccggcgaccggtcgaccctgccccggccgcacgccgaggggtaccagcatttcaccccgggtggtccgctgatcgacgtgacgatcgtcaacccgacggtggcgggttcggccggtgggctggtcagcaccaccaccgacatggcgcgcttctggcaggcggtgacgtccggccggctgcttccgccggcgcagatggccgagatgcgccggacggtgccggccggcgacttcgaggcactgcggcccggcatcacctacggactgggcatcatgtgggtgccgaaccggtgcggcggctactgggcacactggggtggcatgcccgggatggagatcatggaggcggcggcgcccggcggccaccgatcggcggtcttctacctgaccaccgacctgaccgaggcggctcccgtcatgcagcgcgggatgaccctgctcgacgacctgatctgcgactga

SEQ ID NO: 7392 - DNA, 384 bp, Actinoplanes utahensis
atgagcgtgctgcgtaccggcctgctcgccaccctcgcggcgatggccgcgaccaccgtcaccgcggccctcgcccggtgcgccggcgtcgacttcgaactgccggacggcggccaatccatcccactgcccggcttcgcggtgatgaccggcatcttctcgaccgccggagtgctcatcgcggtggcgctgcgccggtggagcgccgtacccgccgtcaggttcgtcacgatcaccgcggtcctcaccgtgctctcgctgatcgccccggtgctctccgggggtaaccccgccaccgtgctcgccctgctcgcccttcacctgatcgccgcggcggtgatgattccggggctggcccggagtctgtcgcggcctgggggttga

SEQ ID NO: 7393 - DNA, 789 bp, Actinoplanes utahensis
atggcggcggcgggagaccttcgagggccggtcgaccttccgggctggctgtaccggatcgccacgaacacctgcctcgacctgctggccaggacccgccccgaaccggccaccggcggcgaggtgctctggctgcagccgtatccggaccggctgctcgacgacccggagaccgccgccgtcgaccgggagaccatcgaactggcctacatcgtcgcggtccagcacctggcgccccgcccgcgggccgtgctgatcctgcgcgacgtgctcggctggccggcccggcaggtcgccgacctgctcggcgactcggtgaactcggtgaacagcgccctgcagcgggcccgggccggcatgcgcgaacacctgcccgccgaacgccgggactggaccggcggcgccggcgaccccggcacgcgcgacctggtgcgccgcttcaccgaggccagcgtcacccccgacatcgcccggctggccaccctgctgcgtgacgacatccgctactcgatgccgcccaccccgggcctcgtggtcggccgtggggccgtggtcgaggactggaccgccagcggcttcgccgggatgaccggcctgcgcgccgtgccgaccgcggtgaaccggcagcccgccgtcgccttctaccactggcgggccgcgcggcaggcgtgtctgccgctgaccctggacgtcctgcggatcaccggcggggcgatcgccgagatcatcaccttccaccgcgaccggttcccgtcgctgggcctgccggagggcctgggtgcggcatga

SEQ ID NO: 7394 - DNA, 1206 bp, Actinoplanes utahensis
atgaagaagattctcattgccgcggccggcgccgtggccctggccggcgccggcatcgccgtcgccactcaggccgacgccgcgacgctgtccagcaactggtacgcctccgcgccgtatctgatgccgttcgacaacagcccgcccgacccggtcgaggtcatgaacgccaccgggcagaaggccttccaactggccttcatcctggcccccaacggcggcggctgcacgcccacctgggacggcacccgcccggtcgccgacgacaccaccgccaccgcgctgatcagcaggatccgcggcaacggcggcgacgtcagcgtctcgatcggcggctacggcggcaccaagctcggccagacctgcggcaccccggaggccaccgccgcggcgtatcagcaggtgatcaccaagtacgggctcaaggcgatggacttcgaccttgaagagccggagtacgagaacaccgccgcggtgcacaacgagatcggcgccgcccggatcctgcagaacaacaaccccggcctgtacgtgtcgatcacgaccgccgggacggcggccggcaccggctggttcggcacccagatgctcaacgaggcgaaggcgcagggcttcaccccggccaactactcgatcatgccgttcgacggcggtttcagcggcggcagcgcccaggtgtccgcgctggaagccttccacaccctcctgatgaacacgttcggctgggacagcgccaccgcgtacgcccacgagggcatctcccagatgaacgggcgcagcgacgccggtgagtacttccggcaggccgacttccagaccaccctggactacgcgctgaaccacaagctggcccgctacaccaactggtcggtcaaccgtgaccggcagtgcgccgaccccaaccagagcaccacctccggcacgtgcagcagcgtcccgcagaccccgtgggagttcaccaagtactcggcgcgcttcgccggcgccaccccgccggtgaccacctcgccgtcgaccaccaccggcactccgccgaccggcggcacctgcacggtcgccgcgtggagcgcgacggccacctacacccagggcaaccaggtgagccagaacggccacaagtacaccgccaagtggtggacgcagaacgagtcgcccgccacgcacagcggtcagtgggacgtctgggccgacaacggcacctgctga

SEQ ID NO: 7395 - DNA, 1269 bp, Actinoplanes utahensis
atgaaccgcaaacggctctgtgccgcggcgctggcgaccgccgccggtgtggccgcggcgatgacggtcgtgcacgcggccgacgccgccgccaccccgctgccggcccacgtcttcgccccctacttcgaggcgtggaccggcgacaacccggccaccctggtgcagcagtccggcgccaagcacctgaccatggcgttcctgcaggccgccaccaagggctcgtgcaccgcgtactggaacggcgacaccggcagcccggtcgcggcgtccaccttcggggccgacatcgccgccatccgggccggcggcggcgacgtgatcccgtcgttcggcggctacaccgcggacaacaccggcaccgagatcgccgacagctgcaccaccgtcagctcgatcgccgcggtcttcgagaacgtcatcaccacgtacgacgtgacccgtctcgacctggacatcgaggacaactcactgaccaacaccgccggcatcgaccgtcgcaacaaggcgatcaagctggtcgaggactgggccgcggcgcagggccggaccgtgcagttctcctacacgctgccgaccaccacctccgggctcgccgactccgggctggccgtgctgcgcaacgcgatggccaacaacgcgcgcatcgacctggtcaacctgatgaccttcgactactacgacggggccacccaccagatggccgccgacaccaagaccgccgccaccggactgcacgaccagctgcaccagctctacccggccaagaccgacgcgcagttgtggaacgcggtcggcgtcaccgagatgatcggcatcgacgactacggcgcggccgagaccttcaccaccgcggacgccccggtggtcgcgcagtgggccacccagaagggcctcggcctgctgtccttctgggcactgcagcgcgacaacggtggctgcccgggcaccgcgggcagcgacagctgctccgggatcagccagaccacctggcagttcagccacgccttcgcggcgttcacctccggcggcggtacgacgtcgagccccggcccgtcggcgtcggtctccacctcgccgtccagctcccggtcgacgcccccggccggatgcaccgcgccggcctggaacgcctccagcgtctacaccggcgggtcggtcgtgtcgttcaacggccacaagtaccgggccaagtggtggacgcagggcgagtccccggccacccacagcggccagtgggacgtctgggcggaccagggcacctgctga

SEQ ID NO: 7396 - DNA, 321 bp, Actinoplanes utahensis
atggcacgatccgaagagttgttcggagatgacgactaccccgcctacacgatgggccgcgccgccgagatcgtcggtgccacgcaggacttcctgcgccgcctcgacgaggagaagctgttcaccccgatccgctcccccggcgggcaccggcgctactcccggtaccagttgcgcctggcggtgcgggcccgcgagatggtcgacgccggcaccgccctggaggccgcctgccggatcatcatcctggaggaccagctggccgaggccctcgagatcaatcggcggctgcagcccgactcgccggccgaggcaccctga

SEQ ID NO: 7397 - DNA, 597 bp, Actinoplanes utahensis
atggccgtggccgagcagcccggcgtgctgcgcaaccggctgctggagaagctcgccggccgggcgcggcagcacgacgggccgcacgccgccgagcaggagcggactcactcgtggtggcgggtccggcactcgcacgaggtcatcgtcacgctgttgttggtcgcgctggcgggtgcggcgatcgcggtcgtcctggtctgggtgtacctgggcctgaacgtcgtggtgatcggcggcgccccccggcgggtggccacccatccacaggtggtcaccggctgggccacggcggtgacagtcgcgcatggcagcccgccggcgatgaccgggatcgctctgctgatcttcccgaaacctgcgctcgggcggtccgggttcgagaccggggtggcggtcatgccgcacatcgagggacctcgaccgccggatccgcagcggccggcggctgctgaccaccgccgcaatcgagagcgtggtcgcgaacttcgcccgctacctgacctggcccggggcttgaatgccgggccggtgcaccatctactcgggtgcgaacggatggcggagccgaagcatcgcctgctctccgcggtctga

SEQ ID NO: 7398 - DNA, 204 bp, Actinoplanes utahensis
atggctacaggtaccgtgaagtggttcaacggcgacaagggcttcggcttcatcagccaggacgagggcgggcccgacgtgtttgcccacttctcggccatctcggcgaatggcttccgcagcctggacgagaaccagcgggtggagttcgacatcacgcagggccagaagggcccgcaggccgggaacatccgcgttatctga

SEQ ID NO: 7399 - DNA, 429 bp, Actinoplanes utahensis
atgatcagatcgcgtcggcggtcgctcgggcgttggaccgctgaaatcattcgcgtccgcgcggttccgggccgctggtcctccggatcatggggaaggccggaaatccaacgctcgggacccgtgctactaaggggaggctacctatgttggaagggtgcctcgcatcgtgccaccgcctcgacccgtcccggcgtgctcgccgacgtgccgtcgggccgccggatgaccctggtgggtgtcgcccccggcgcaccggccgccaccgcgcgccggctcgccgacctcggattcaccccgggcaccacggtggaggtggtgcgccgggcgccgctgcgggatccggtgatctaccgggtgcgtgactacgacgtgtgcctgcgccgcgagcaggccgcgctgctgctggtcgcggagtgcgcggcgtga

SEQ ID NO: 7400 - DNA, 888 bp, Actinoplanes utahensis
atgtccgtactaccgatcctggtactgctgtcgggcctggtggcatgcggtgtattgctgacgctcctgatgcgtaggggcccgcgccaaccggctgccgcgccgggcgacatcccgagggcgatcgcccgacgcaccgccgtgctgcggtggacgggcgtgacgctcggcgtgatcgtcggtgtcgtcgccgcgcgatcgggcgacctcggcacaggactgttgatggccgcaccgctgttcgggctgtgcaccctcatcggcgtactcgccggcgagctgacgatccggccaccgcacgggccgacacgcaccgcggccgtcgaggtccgccgcatacgcgactacctgccacgccacctcagccgggtggtcgccgccgccggcggcgggctcctggtcctgcttaccgccacgaccgcggccggcggtcccgacgacatgggccgccccggacgctcgctcacccggcagtgcacctccgacacggtggagagccacggcccgtggccgggcctgttctatacctggcccctgctggtcgtcgtactggtcgggctgctgatggggtacctcgccgtgcgcaccatcgtccggcgaccgcgctccggcagcaccggcgacctggcggtcgacgacgcgctgcgcaggcgcgcggcccgggtcgtcaccggcgcggtcggcgtgctcatcgccatcccgctcgccggggtcagcctgatcgcggccggtggcctactcgacatctcctgcgcgccgacgtggtggacgatcacgggctgggccctgcttgccgtggttcccgcatcgcttgccatggtgacctggtgtgcggtcgcgctcgtgaccccgctggaccgagccgacccgctggtgggggcccggtga

SEQ ID NO: 7401 - DNA, 138 bp, Actinoplanes utahensis
ttggacggcgtgaagattgacgaactcgacccggacgcctccgccggtcagcgtccggacgagccggcgcaggtcgtccaggtcgcggggaggcggtccatggagtgcgcgaagacggtgtcgtcatcgcggacgtag

SEQ ID NO: 7402 - DNA, 2040 bp, Actinoplanes utahensis
gtggtgcgggagcacggcgacgtccagccgggtgcgcaggcggctggtgacagcggtgtcacggtctcccatgctcagggtcagcaggtgggtgaccgcaacgtccagcacaaccatttccctgccgccgccgtgtcgccgatgtcggtgcggccgtcttcggtgccggcgccggacggattggtcaacgtggcggtggcggcgggtgtgttcgtcggccgcggcacgcagctccagcagctcgatgaggtgctggccgagccgggggccgcggtggttcaggctgtccacgggttgggtggggtcggtaagagcaccctcgcggcacggtgggcgtggcagcaccgtgaccggtaccggccggtgtggtggatcgacgcggacacgacggccggtatcgacgccgggttggccacgttggcgaccgctttgcagaccgacctgcccgatggcctgtcgctggaggtgctgcgggaacgggcgttgcagtggctggcctcgcacgacgggtggctgttggtcctggacaacgtcaacgacccgggtgacgtcgcccgcttgttggctcgtgtcggcaccggccggctgctggtcaccagccggcgggccaccggctgggcgggtatcgccaccgccatcgcgttggatgtgctcgaccttgatgacgccgccgaggcgatgcggcaggtcctggccggcagcggccgtgccggtgatgctgacgggcttgagcgggtgtgccgggagttgggctgtctgccactggcggtggaccaggcggcggcctaccttgccgaaacgggtctgtccgccgccgcctacctgcagctgttgcagcagtatcccgcccagatgttcgaccagggcggtgaaggtgccggtgggcgcaccatcgcccgggtgtggcgtgtcactttggaccagctcagtgatacgccgctggccggcgacatcctgcggatcctggcctggtacgccccggatgccgtcccccgcaccctgctcgacgggctggccgaccccgccacgaccgcccgggcggtcggccgtctcgccgcctacagcatgatcaccgccgatgaggacactgtgagcgtgcaccggctggtccaggccgtcgcacgcattcccgacccggacgacccgcaccggcaaccccacgacatcagcaccgcccgcacccgcgcgatcgagcacctgcaaaccgcgatacccgacgactggcgtacgccacaggattggcctgtctggcgggttatgacaccgcatatcgaagccctcgcccagcacgaccgcaaccaccccgaacccgacgctgcagccagccggctctacaaccagaccgcgaactttctgcacgatcaaggcgtcatcggccgggcgattccgctgtacgagcaggcctcggccgactgtcgtcgggtggtcggcgacgaccatctgcagactctgaccttggtgaacaacctcgccggcgcctatgagaccgccggggatctgggccgggcgatgccgctgtacgagcaggccgtggccggctgtcgtcgggtgctcggcgacgaccaccctgacacgctgacctcgatgaacaacctcgccggcgcctaccaggcagccggggatctgggccgggcgattccgctgtttgagcaggtcttggccgaccggcgccgggtgctcggcgacgaccaccctgacacgctgggctcggtgaacaacctcgcctacgcctaccacacggccggggatctgggccgggcgattccgctgttcgagcaggcctttgccgaccggcgccggctgctcggcgacgaccacccgcagacgctgaccctggtgaacaacctcgccggcgcctaccgaacggccggggatctgggccgggcgatcccgctgtacgagcaggccttggccgaccgtcgccgggtgctcggcgacgaccacccgcagacgctgggctcggtgaacaacctcgcctacgcctaccaggcagccggcgatctgggccgggcgatgccgctgttcgaacaggccgtctag

SEQ ID NO: 7403 - DNA, 786 bp, Actinoplanes utahensis
gtgggccctggtctcatcgcggcaccggcctgcagactgtgccccatgcctgtacttgatgcccacgaatcgacggcgacgggtagccgactgccctccgttcgcgctctggtggaggagcgcatcatcttcaactaccgtctgcccgccgaccacctggaacgcctgctcccggttgcctggttgaccccgcagctcgtcgacggcgatgcggttgcctcggtgtgcgtgttgcggctcagcaaggtcacggccggccctgtcccctccctgttcggcgtccggagcgtcagtgcggcgcggcgctacggagtgctcgatcagaggtcaggcggccgccctgccgtcttcgtcaccgagcgcacgaccgactcggctctcggctccctcttcaccggggccgggttctcggcccagcacgagcatctgtccgcgaacatcagcagagacggcgagtcggtgctggtcgccttggggaacgaccgcttcaacggtcgagcggtcccggcgcaacgatggtcgtcgtcgctgttccccgcgctcggggacttctcggccttcctggccgaggggatccggagctacggaacgtcccggcacgaagggcagctcaccatcctcgacctgttcaaggaggacaagggctatgaaccgctggccgctcgcgaggtccgtggatcgctggtgcagccctggctggacgccggagccgtgctggacagtgtcgcccgcacaacgaacgcgaaatatcgctggacctaccacggcctcactcccaagccctga

SEQ ID NO: 7404 - DNA, 657 bp, Actinoplanes utahensis
gtggatcgcctgcttgttcctttgactccggttatcgcgctgctcctgtggggggtgatctcgccgcgatcccaatggcagaagcttttcgcctggggctatcgcaaccccgaggcgaacgagccgagcgacgcggcgtacatgctgacccgcatcggcaacgtcgtgatgctcggcgtgctggcgtgggcggtcctggggctacccctgccaggcggccacgccggagcgcggcccgcggccacccctcagcgacccgccgtcgaggacctgtacgaagcgttcggcgtcgacgaggcgacagctgtcatgcccccggtagtcaccggctcgccgaagtcgacccggccggtgaaggtcgtccgttaccagaaggtcgacgcgacgaggccgccggtgtacctggggcaggcactcaccgggaagaccggcgactggctgattctcggggtgcgagccgatacgccgcccaccggcgtccggatcaatgagcaggtgccgttcgacttgtatgtcggtgtccttaccggttgcacggtgtcttgcccgacaacgccgatcagctccggcaagaagttctacctcgtgccggtgcggctcagccgaccgctcggctcccgcctggtgtacgacgtcactggtgaactggtgccgtga

SEQ ID NO: 7405 - DNA, 129 bp, Actinoplanes utahensis
atgatatctacgaccgccaacccgaaccgctccggtcggctacggaaccccgcccacccggcgtaccggcgtggcgatcagttcccggccggccgggtcgagatcggccggcgacgcctgactttatag

SEQ ID NO: 7406 - DNA, 3279 bp, Actinoplanes utahensis
atgctgaaacccgctcgggtctccgttctcctcaccgtgctgctggcgctggtcgccacgccgggcaccgcgctcgcggcgccgcggcctccgcgggtgcacggacagagtgtgcaggccgggcatctgcgggtgcaggtgctcagcccgacactgctgcgtctcgaatacgccgccgacgaccacttcgaggatcaggccaccttcaacgccgtcgaccgggcaccggggcggacctggttccgggccggcaccgcccacggcgagctgcgggtgtggaccggtgcggtgaccctgcactaccggctggacagcgggccggtgaccgccgccaacaccacgctggacctgaccgtggccgggcgccggaccagtgtgcacccgggcttcggcatgcagccggccgacccgctcggcggttggtaccgggggctggactactacgccgggcaggccgggccggtcgaccagctcagcctgcatcccgggctgctcgaccggcagggctggtatctgctggacgacaccgcgaccgcgctgcgcaccggaaacggccagctgggggcgcggcccgcgcggaccggcgcctatcaggacggctacctgttcggctacgggcacgactacccgcgggcgctcgccgatctgcggacgctgaccgggccgtcggtgctgccgccggagtgggcgttcggcacctggttctcgaagtaccaggcgtacagcacggccgattaccgcaccacgatcctgcccgccttcaagaaccaccgggtgccgctggattcgctggtgatggacaccgactggaaggcgccgaaccagtgggccgggtggaactggaatccgggcctgttcccggacccggacgcgttcctcaagcagctgcgcgccgcgggagtcaacgcgacgctgaacgtgcacgcggcgatcagcggggacgatccgcggttcgcgcaggcgcaggcgaccgcgaaaggcagactgcagccgtcgacgaacagtttcgcgccgaacccgtaccggttcgactggggtgacccggatcaggccgccgccttcgtgcagttgcatcaacccttcgaacagcagggcgtacgacagtggtggctggactactgctgcgacgacagcaccgtcagcacgccgggcgtcaccccggattcctgggtgaacgaactgtaccggcgcgagggtgacgcgcggggcgtccgcggcttcgcgttgtcccggatcggtgcggcgtttcccgcgtacaccgcaatcggcccttccggtccctgggccgaacatcggagcaccgtgcatttcaccggtgacaccgaggcgacgttcgcgacgctcgccttcgcggcggcgatgaccccgggtgagggcgccgccatcgggcagtcctatgtcagccacgacatcggcagtttcgccggtaggcatctcagcgacgacctgtatctgcgctgggtgcagctgggcgcgttccagccgatcctgcgcctgcactcggaccacggcgaccggctgccgtgggagtacgacagcgcggtgagcgggccggccgccgatttcctgcggctgcgcgaatcgctggtgccgtatctgtacaccgcggctcggcagaactacgacaccggactgccgatggcgcgggcgctctatctgaactggccggagcagagcgaggcctatcggcacgactcggaatacctgctcggcgattcgctgctggtcgcgccggtcaccacacccgggctgagcaccaccgcgccggtgtggttcccgcccggcacctggaccgatctcttcaccggggagaccttccgcggaccggtcacccggacggtcggcgccacccccgaccacatgccggtctacgtgcgcggcggcggcattctggcgcagcgcgccggcgacgtgaacgtcgccacgcaacccagggacaggctgaccctgaccgcctacccgcacgggtccgggaccgcctcggtgtacgaggacaacggtgacggcctcggctaccgcaccggccggtcggcgcggatcccggcccgttacaccgagggccggcgggccgccctgaccgtcggaccggtgcagggcacctatccgggcgccccgaccacccggcagtacacggtcgcgttcgccgatgtcgcgcggccgcatcgggtgaccgccgacgggcattccgcggcgtggacctacgaccccgggaagcaccttctcaccgtggccctgccggcgattgccgccgggcgcgcggtcaccgtcgagcacgacggggcgacgttgaccgtggcgcagaagccggccgtcgacaccacgttcaccgcacccgacgggctgcagtccggggcgaccagcaccctggtggcgaccgcgaccaaccacggtccgggcgcgatcaccgacgtggcggccaccgtcacggcgccggccggctgggtggtcaccccgaagtcggcgacgaccgcggcccggctggcacccggcgcgacgttcacggcgacctacgccgcgacaccggccggggcggcaccccggacgcaaccggtgacggtgcacatcgcgtaccgcaatccggatgggaccgcgacgagtgcgcccgccgcgctcaccgtccccctgaaaccggtcgcggtgaccttccgggtgctcgcgccgcccgggacgccgccggacgcgacgctgtacgtgccgggcagcatcgcccagctcggtccgtgggaccccggcaaacaggcgatgaccgaccgcggcggcggcgtctgggaggcgaccgtgtcgatcctggacggcaccgacctgcagtacaaatacacccgcggcacctgggaccgggtcgaggagtgggggtcgatcaccgggaccgacaaccgcagcgtcagcgtcgacggcggcctcagccacaccatgctcgtcgacgacacgtcgaccgcgtggggcgacgcgagcgtgccggacagccacaaggccatccggtactggcgtgatcctctcgtcgtcaccaccgaggcgacggcgcgtgcggtcaccgtccgcttcgaacgcgacatccgtccgaccggcgccgactattccggatcggtcaccgtggccggcccgtccggcacggtcgcgggctcggtcgccgaaccgtcgccgggcaccctggtcttcacgcccggcgcggcgctgccggccggcacctacaccggcacggtcaccggcgtgaccagcgcggtgtcggacggcgtgccgatccagaagccgtacacgttcaccttcgcgatagccccgtga

SEQ ID NO: 7407 - DNA, 603 bp, Actinoplanes utahensis
atgatcgtcgtcgtccgcagcgagctgtaccgcagcgtgagcatcctgtcgtcgtggctggcgctgatcgggttcgccctcatggccgcgctggtcggctggttcagcaaggaggcgtggtcgctcttcgccgggctgggcgccttcggcatcgcggtgaccgtcaccgcccagcactaccagcaccggaccatcgtgccggtgtacctgagccacccgcaccgctggcgggtcctgatcgcccagtgcgtgtccgcggccgtgctgggcatcctgctgacggccgtcagcggattgccggtgctgctcgacggccacgccgcccagtaccggtcgacggtcctggtcgcgccggtgatggccgtgttcggcacgctgtgcacggccgtgctgcggcatccgatgtggctgctcggtggcgtcttcgcctggctgctgttcgccgaggggttgatcaaccggatggcgatcggcctgccgttcgcctcgttcgcaatggcttccggcggcaacgtcaaggcgctgctgtacctgctggcctggaccggcgcggcgattccgcccgcggtctgggcgatccaccgggacgtcgccagcgactga

SEQ ID NO: 7408 - DNA, 873 bp, Actinoplanes utahensis
atgatcgagatccgggacctgacgaagacctacgggcaggtggctgccgtccgcgacgtgacgttcaccgccgcgccgggccgggtcaccggcctgctcgggctcaacggctccggcaagagcaccacgctgcggatcctgctgggcctggcccggccgaccaagggcgtcgcgctgatcaatggtcgccgctaccgggaactcgaccatccggtacgccacgtcggcgcggtcatcgagcagggtctgagccatcccggccagtccgggtacgcccacctgcgcacccaggcgctgctcggcggtttcccccgcgagcgggtcggccggttgctcgagtacgtgggcctggggcacgcggccaccaagcggaccggcgactactcgctcggcatgaagcagcggctggcggtggcgacggccctgctcggggagccctcggtactcgtgctcgacgagccggtcaacggcctggacccgccgggcatggcctggctgcgcgagctgctgaccaaacacgcggcggacggggggaccgtgctgatctccagccatctgctcgccgagctggagcacttcgtcgatgacgtggtgatcatcggccagggccggatcctggcgtccggaacgctggccgagctggccggcacggagcggctccgggtgcgcggcggtgatccggcccggctcgcggcgtacttcgagcactacggcgcgacagtgacgcccgacgggccggtgctgttcgtctccgggatcagcgcggaacaggccggcaccatcgcgctcgccgccggggtcccggtcttcgagctggtggccgaggcccagcacctgcaggagatcttcatgagtgtgtcggaggcccgatga

SEQ ID NO: 7409 - DNA, 963 bp, Actinoplanes utahensis
atgtccggtgaactggtgaccaaggccatcgatctgctctgcagcaactacatcttcgccgacaaggcgcgcaccgcggccgacggcatccgcgcccgactggccgccggcgagtacgacgggctcaccgaacaggccctcggcgagcgcttgaccagcgagctgttcgcggtctgccaggacagacatctgcgggtacgggtacgggacgagagcctgcacgacgcgctcaccgaggatgaggtggaggcggcctggcgcgaacaggaccggctcggcaaccacggcatcgcccgcatggaacgcctcgacgggaacatcggtctgctcgagctgcgcgccgtgaccgcggccgacctcgggggccgggcgatcgcggcggccatggaactggtgtcacacacccatgccctgatcctcgatctccgcaggaaccggggcggatccccggacggggccgtcttctggtgcagctacttcttcccggacggggaaacccacctcaacgacatctacgagggggccaccggccgcacccgccagtactggagccacgcctggctgcccggcgagcggtacgtcgaccggccggtctacctgttgaccagcggaacgaccttctcggccggcgaggagatctgctacaacctgcaggcgcagaagcgggcggtgctgatcggggagaccacccggggcggggctcatcccaccgaggcgttccccatcaccgccaccttcgagatcacggtgccgacggcgcgctcgatcaacccggtcaccgagggcaactgggagggcaccggagtgatcccggacgtggcggtgcccgccgcggaggccttcgacgtcgcctaccgcacggcgctgcggcacgtgctgacgacctccgccccgccggccgtgctgaccgaggcgcgagccgccctggagaggatcccggacggtcgagacgcgcgggcgtga

SEQ ID NO: 7410 - DNA, 753 bp, Actinoplanes utahensis
atgggcgcgaagaccgcactgcttgccttcaccacaggcgatctacgccccgcgctgcgcgaagcggtggacgccgaccccgccgaggcgctcgcgctggtgcgcggattccaccccgactacgacgtgacgccgatcggtgacggcgtgctcggagaggacgtctacccgccggatgacaccagctacgcgacggtgctggtcggggctgagctgttgtgcgatcgccgcctcgtcggcgaccggccgtcgcagctgccggcccgtctgctccaagcgggagccggccgccggatcatcatgcacggaatgcactcggtctccgattggctgtgcttcgcggtctgggagaacggctcgctggtccgttcgctgagcctttccccggatggcggcatcgtggagaacatcggcgagccgtacgatttcgagcgaccctattgggcgggcgagcggccggccggcgcgacgttcacgggagatccgtatccgttgccgtttcacccgctggagctgggtgaggacgccctgcgcgcgctgttcggcttcatcctggaaggtcttcgggacccgagcgacgtcgatccgtacgaggttccgctgcgcggcttccgggtggccgacccgaccggccgggagcaggcggagcgcgaggccacgatggagcggctactgcgacagatggggccgccacgccgtttccgcatgaagcccgacggcaccttcgaggagatccgcgacgctgaggcatga

SEQ ID NO: 7411 - DNA, 156 bp, Actinoplanes utahensis
atgctgaccttcgggctcattcttctgctgctgggcatcttcctgcacgtgtcgatcctgtacacgatcggcatcattctcctggtggtcggtgccgtgctctggatcctcggtgccgtcggtcgcccggtcggtggtcgaaaggtctggttctag

SEQ ID NO: 7412 - DNA, 774 bp, Actinoplanes utahensis
gtgggcgccctttcgcatgtccgcggccgtgggcgccgcgaagggcgccggcatcacccggggacactggcgacactcccccgtgtcatgatcgcggccgtggatgagtgggtcttcaacgagcggccggccggcgtgcggttcctgaccgaccggatcgatgagccgggtcggacccgggtcgaggacgagatctggagctggatcgtgcgcggcgagaccgacgcggccgatttcgtggactgcttcgatgtcgaggaggaccggcacggcgccaccgacgaggagctggcggcggcgtacggccgggcgctcgacgcccggcgggcgcagcagcgcgcctgggggccggtgcgcaccaatctgaccagcgcgttcgccgagctcaacgagctgggtgtggtcgcgcgggagaacttcgcctgctgcggcacctgcgctgccgcggagatccacgacgagcgggacggcagccggcactggcgcggctacgtctggttccaccagcaggacaccgaggcgctggcggagagcgcgaacggctcggtctacctcggctacggcacctgggcgccggagaatctcgaccgggccgcgtacgacgatctctcggccgccgagcgccaggcccggtaccgggccgacgtggagcagatgctggacgagatcgtcttcccggtgctgcaccaccacggtatgcaggtcacctggaaccgcagcctggccacgcgggtgcacgtcacgggcgcccggtggtacgccgcgctgccgtaa

SEQ ID NO: 7413 - DNA, 399 bp, Actinoplanes utahensis
gtgagccgccgtccccgccccgccgccggcgggacgccacccggctgcaccgtcaccgtgtgccgcggctgctgctgcggcacacccgaggtccgcgccatcgaccacgccgctcaactggcccggctgcgccaatcgctggccggggcggcgcaggtccgggtcagcggctgcctcgacgcgtgcgaacacgccaacgtcatcgtcgtgcaaccttctcccgaagggcggcgtgccggcggccggcccgtctggctcggcctggtcaacgaccccggcgccaccgacgacatcatcgcctgggtgcacgcgggcggccccggcctggccgacccgcccggcctgctcgacctccacctcatcaacccggcccgccggatccgccaacaactcacctga

SEQ ID NO: 7414 - DNA, 1974 bp, Actinoplanes utahensis
atgaccccgtccaccgccgcgcctcatccggccgcgggcgcgccgaaacggcggttggtctcccggatgggggcgcttccggagatccgctgggcgacgctggccacgctgctgttcgccgccggcggcatcacgcagctggccggcgcgcccacgccgctgtggtgggtcctgtatctggcctgctacgccgccgggggatgggaaccggccctggccgggctccaggcgctgcgggagcgcacgctggacgtggacctgctgatgatcgtcgcggcgatcggcgcggccgccatcggacaggtcttcgacggcgcgctgctgatcgtcatcttcgccacctccggcgccctcgaagcgttcgccaccgcccgcaccgccgacagcgtccgggccctgctggacctggcccccgagcgggccacccgggtcgacgcggacggcaccgagcacagcgtgcccaccggtgagctccaggtcgatcacgtgatccggatccgtcccggcgaacgcatcggcgccgacgcgcgagtcatcgacggggccagcgaggtcgatcaggcgaccatcaccggtgagccgctgcccgtcgccaagaccggcggtgacgaggtgttcgccggcaccctcaacggcaccggcacgctgctggccagggtcgacaaggcggccggggagtcggtgatcgcccggatcgtcgccctggtcgaggaagcctcggccagcaaggccgagacccagctgttcatcgagaaggtcgagcggcgttactccctcggcgtcgtggtcgccaccctcgccctgttcgccgtgccgctgctgtccggtgcggacccgcgaaccacgctgctgcgggcgatgaccttcatgatcgtcgcctcgccctgcgcggtcgtgctcgccacgatgccaccgctgctgtcgtcgatcgccctggccggccggcacggtgtgctggtgaagtccgcggtggtgatggagcggctcgccgacaccggcatggtggcgttcgacaagaccggcaccctgaccgcgggtacgccgggcgtcgccgagatccacccggccggcccgttcaccgagcgggatctgctgcgtctggccgccgccgccgaacacgccagcgagcacccggtcgcggccgcggtggtgtccgcggcccgcgaacgcggtctggtccggcccgtcgcggaggacttcgcctccgcccccggccgcggcgtgcgcgcgctcgtcgacggacggctggtacaggtcggcagcccggtcctgctcgacaccgtcaccgcacaccgcgacgaggtcgccgaggtccgcgccaccacggcccgcgcccaggacgccggccgcaccgcggtgatcgtgctggtcgacggcaggccggccggggtcatcgggctggccgaccgcatccggcccgccgccaccgcctccgtgaccgccctggctcagctcaccggcgcccggccggtgctgctcaccggcgacaacgcgggcgccgcagcgcgtctggccaccgaggcgggcatcaccgaggtgcacgccggcctgctgcccgccgacaaggtcgagcgcgtacgcaccctgcaggacggcggccggcgggtgctgctggtcggcgacggcgtcaacgacgcccccgccctggccgccgccgacctgggtgtcgccatgggcggccgcggctccgacctcgccctgtccaccgcggacgcggtgctggtccgcgacgacctgaccgctctgccggcggtcatcgccctgtcccggcgtgcccgtcgcctggtggtcgcgaacctgatcatcgcggcgagcttcatcaccgtgctggtctgctgggacctgttcggccacctgccgctgccgctcggcgtggccgggcacgaaggctccaccgtcatcgtcggcctcaacggcctgcgactgctgtcggccagggcctggcgccacgccaccaagggggccgcggcgtga

SEQ ID NO: 7415 - DNA, 342 bp, Actinoplanes utahensis
gtgcacacctcgctgccggatttccggatgcccgacgacgagcaggttcacctcgccgccgagggtttccggctgcttgccgacccgacccggatcaagatcctgtgggcgctgctgcagggcgagtcgtcggtggcatgcctggccgagatggtcggcgcggcccccaccgcggtcagccagcacctggccaagctgcggctggccgggctggtgaagggtcgccgggaaggcacctatgtgcactactcggctgccgatggccacgtgcgggccctgctggccgaggcgttgttccacgccgaccacgccggggcgggcatcagcgacgagcaccggtaa

SEQ ID NO: 7416 - DNA, 2265 bp, Actinoplanes utahensis
atggcatccgtcgccgggccactgccggtggccccgaaccgggtcgagctgtcgatcggtggcatgacctgcgcttcctgcgccgctcgcatcgagaagaaactcaaccgcatggacggggtcaccgccaccgtcaactacgccaccgagaaggcctcggtcagctacagcggcgacgtcaccgccgatgacctgatcgccacggtgcacaagaccggctacaccgccgcgctgccgccgccccccgcgccggccggtgcggaccgggccgagccgacgcaaccggccgacgaactgcacgacgcccggacccggctgtggatctccctggtgctcagcgtcccggtggtgctgctggccatggtgccggcctggcagttcacctactggcagtggctgtcgctgaccctggccgcgccggtcgtcgtctacggcggctggccgttccacagggccgcctggaccaacctgcggcacggcgcagcgaccatggacaccctcgtctccctgggcaccgtcgccgccttcggctggtcgctgtgggcgctgttcttcggcactgccggcacccccggcatgacgcacccgttcgcactcgccatcgggcgcggcgacggcaccggagccatctacctggaagccgccgccggggtcaccaccttcatcctcgccggccgctacttcgaggcccgctccaagcgccgcgccggcgccgctctgcgcgccctgctcgaactcggcgccaaggacgtcaccgtgctgcgggacggcgtcgaacaccgcatcccggtcgccgaactgagagtgggggaccggttcgtggcccggcccggcgagaagatcgccaccgacggcgtcgtcgaggacggcacctcggccgtcgatgccagcatgctcaccggcgaatccgtgccggtcgaggtcaggtccggcgacagcgtggtcggcgcgaccgtcaacgccggcggccggctgatcgtgcgcgccacccgggtcggcgcggacacccagctggcgcagatggccaagctggtcgagcaggcccagaccggcaaggcgccggtgcagcgactcgccgaccggatctccgggatcttcgtgccgatcgtcatcgccctggccgcggcgacgctcggctggtgggtcggcaccggctccggctggacggccgcgttcaccgccgcggtggctgtcctgatcatcgcctgcccgtgcgcactcgggttggctaccccgaccgcgctgctggtcgggaccggccgcggggctcaactgggcatcctgatcaagggcccccaggttctggagtcgacccgcgccgtcgacacggtcgtgctggacaagaccggtaccgtcaccaccggccggatgaccctggtcgacgtgatccccgccgacggtcaggaccgtgaggagctgctgcgcctggccggcgcgctcgaggccgcctccgagcacccgatcgctcaggcggtcgcccgggccgccgccgagcgggcaccgctggcgccggtcgccggattcaccaacctggaaggcctcggcgtccgcggcaccgtcgaggaccgcgacctgttgatcggccggctacgcctgctgcacgagcacgactacgccgttcccgccgacgtcgaacaggcggtgaccgcggcgcagcaggccgggcggaccgcggtggtcgccggctgggacggtcaggcgcgcggcgtgctggcggtcgccgacgtcgtgaagcccaccagccgcgacgcgatcgcggcgctgcgccggctcgggttgaccccggtgctgctgaccggcgacaacgagaccgtggcacgggcggtcgccgccgaagtcggcatcgatcaggtgatcgccgaggtgctgcccgccgacaaggtggaggtggtcaagcggctgcaggaccggggcaaggtggtggcgatggccggtgacggcgtgaacgacgcggccgcgctcgctcaagccgatctcggcctggccatgggcaccggtacggatgtcgcgatcgaggcctcggatctgaccctggtccgcggtgacctgaccgccgccgtggacgcgatccggctgtcacggcgtactctgcggatcatcaagagcaacctgttctgggccttcgcctacaacgtcgccgcgctgccgctggcggcggccgggctgctgaacccgatgatcgccggtgcggcgatggcgttctcgtcggtgttcgtggtcgcgaacagtctccggctgcgccggttcaccaccatcagccggtag

SEQ ID NO: 7417 - DNA, 951 bp, Actinoplanes utahensis
atgaacaccgctgtgaagctggccggcttcgggatcgggctggcggccgtgttcacggccgccctcggcctcggccgcatcgccggccacaccccggcttcggcgccggccgcccatggccacgccgcggcgacagccgcccacgggcacgacgggacggcggccgagccggtcgccgcgctgcccggcgggctgcaggtcacccaggacggataccggctcactccgctcaccaccgtgctgtcgaccggcgtaccccggcagttccgcttccagatcatcgggccggacggtaggccggtcatcggctacaccaccagccacgacagggacctgcacctgatcgtggtccgccgtgacctgtccggtttccagcacgtgcacccgcgactggccgacgacggcacctggtcgattcccgttgccgtgcccaccgccgggcagtaccgggtgttcgccgacttccagcccatcgggcacgacgggatcacgctgggggccgacgtgcccgccgcgggggactaccggccggtgccgctgccggcggccgcccgtaccgcgacggtggacggctacaccgtcacgctcgccggcgacctcgccccgggcgcctcgtcccggctggccctgtcggtcagccgggacggccgcccggtcaccgacctgcagccgtacctgggcgcctacgggcacctggtcgcgctgcgcgccggcgacctggcctacctgcacgtgcacccggacggcgagccgggcgacggacgcaccgcggccggtccggaggtcgtcttccacgccgaggtcccgtccgccggcacgtaccggctgtacctggacttccagcacagcgggacggtgcacaccgcggagttcaccgccgtggccggtccgcccgtcagcgcaccgtcgagtccggccgggcatggcgccgacggccataaccacgattag

SEQ ID NO: 7418 - DNA, 207 bp, Actinoplanes utahensis
atggccaccgagacctataccgtgaccggaatgacctgctcgcactgcgtcaactcggtgagcgccgagatcgggcggctgcccggcgtgaccgccgtccaggtcgatctggcctccggcgcggtcaccgtcaccagcgacggatctctcgacgaggccgcggtggccgcggccgtcgacgaggccggctaccggttggcgaggtag

SEQ ID NO: 7419 - DNA, 108 bp, Actinoplanes utahensis
atgtccctggacaccccgctcgccttcgccgcgagcaccctgccggccctgctcagcaccgcgctgtttgacctggtggtagccctggaacgctggctggtgccgtag

SEQ ID NO: 7420 - DNA, 1002 bp, Actinoplanes utahensis
atgcggatcaccgtgctgggcgccggatcgtgggggaccacggtggcgtccgtgctcacccgccgggatcatgagtcgctgatctgggcgcgcaacccggacaccgccgacgagatcaacgtcaagcacaccaacgatcggtatctccagggtttccggctgcccgcccggctgcgggccaccgcggatctcgccgaggcggcggcccacgccgagctgctggtggtcggcgtgccgaccggggcgttccgggccacgctggagagtgtccggcccagcctgcatccgtggatcccggtggtcagcctcagcaagggtctcgaacgtgactcgctgctgcggatgaccgaggtggtcaagcaggtgctgcccgggcatccggcggccgcgctgaccgggccgaacctggccaaggagatcatgtcggggatggcggcggccaccgtgatcgccaccgaggacctgaccgtggccgccgagatccagcgggtgttccgccggggactgctgcgcgtctacaccaaccacgacgtgatcggctgcgaggtcggcggcgccctgaagaacgtggtggcgatcgccaccgggatcgcccagggcctcggggtgggtgacaacacccgggccggcgtgatctcccgcgggctggccgagctgaccaccctggccgtcgcgatgggcggcgaggcgaccaccctggccgggctggccgggatgggtgacctggtcgcgacctgcatcagcccgcacagccgcaaccggcacgtcggcgagcagctgggccgcggccgcggcctggacgacatcctggccgagatgggccaggtggccgagggcgtcaagacggtgcacgccgcggtgcggctcgccgaccggcacggcctgccgatgccgatcacccggaccatccaccgggtcgtgaccggcgagatcaccgcggagcgggcgtacgcgggtctgctgcgctcacatccggccgggcacgagtcggagccgggctga

SEQ ID NO: 7421 - DNA, 1044 bp, Actinoplanes utahensis
atgagcaagcgcaccgccaccggcctgctcggcgcggccctcaccctgctgctgtcggcctgctcggcggccatggtcccggtcgccccggccgactcttccggcctcggccggcagagcgtgcacgtcgggatcgcgtacgacagcgccgggcgcggcgacaagagtttcaacgacgccgcggcggccggcgtcgaccgggccaagcaggagctgctggtcgaagcctcggaggccaagacgcaggccgagagcgacgacgcccgggcggcggcgctgcgcgggctggccgccggcggcagcaacccggtcatcgcggtcggattcctgtacgccgcggcggtcggcaaggtcgccaaggagttcccgggcaccctgttcgcgatcatcgacgacgactcggtgaccgccgacaacgtggtcgcgctgctgttctccgaggagcagggctcgtacctggtgggcgtcgcggccgggctggccaccaaacgtcaccgggtgggtttcgtcggcggcgtggacgtgccgctgatccacaagttcgcggccggctacgtcgccggggtgcacagcgtcagccccgatgtccaggtggacgtgcgctacctgaccaagccgcccgacttcggcgggttcagcgcgccggccaagggcaaggccgccgcccagcagatgatcgccggcggggcggacgtgatctacgcggcggccggcggctcgggcaccggggtgttcgaggcggcgacggccgcgcccgggcacgtctggacgatcggcgtcgactccgaccagtacgccaccgccgccgaggcggtgcgcccgcacatcctgacctcgatgctcaagcgtgtcgacaacggcgtgttccaggagatccaggccttcgtcaagggcgaccgggccggcggccggaaacgctacgacctcaaggtcgacggcgtcggctacgccacctccaacaaggccctgggcccgtacgtgccgggcatggagaaggcgcgataccggatcctgagcggcgcggtacgggtaccggtgtcctga

SEQ ID NO: 7422 - DNA, 1608 bp, Actinoplanes utahensis
gtgcgccgcttcagcatcggtgcccggctgttcggcgccttcgccgtggtgctggcactgctgttcgccgttgccgtggtcgcctatgcgaccatcgttgcgcagcgtgacgctgccacccaggtccgccggctggaactgctcacccgccaggccggcgagatcaagacccatgcgaccacgctcaacggctggcaggccgggttcatcaacgacatctaccggctcggggccggccgcgcgctgggcggcgactcggtggcgtacaaggcctggcagcaggagcgggacgcgttccgcggattcctggcacaggtcgacaccgcgagcatgaccgaggccgaacgcgacgtcttcaacaggctcaccaccgagctggccacgtacgtagacatcaacgacaaggtcgtcgccgcataccgcccgggcaccccgaaagcgctctggaacgccgaccagatcgccctgtacgacagctggaacagctactaccggatcatggtgtccgcgcagcggctggccgcgtcggtcgacgaccgcagcgtggcggcggtccgctcgtcggcggacgacgcccgccgcgccgagctggtcatcctgatcgcgaccgggctggccctggcgctcggcgcgctgtccgcggtcgtggtgacccgcagcatcgtgcggccggtcggctcggcccgggacgcgctgcgccggatggccgaccgggacctgaccgtcgagccgccggcggacagcggccgcgacgaggtcgcccagatgtcggccgcgctgggggaggcggtcgtcgcggtccgcaccatcgtctccgacgtggcccggcaggcggagatcctcactcacacgtcggcggagctggacgccgtctccggcgccttcgccaagtcggtcggcgacacctccgagcaggccggcctggtcgccggggcggccgaggacgtcaaccgcaacgtcgacacgatggccgccggatcgcagcagatgggcgcgtcgatcgaggagatctcccgcaatgccgcggaggcggcctcggtggccgccgaggcggtggccgcggcacactccgccaaccggaccgtggccaacctgggcacctcctcgtccgcgatcggtgacgcggtgaagctgatcaccagcatcgccgcgcagaccaacctgctggcactcaacgccaccatcgaagcggcccgggccggcgacatgggcaagggcttcgccgtggtcgccggcgaggtcaaggatctggcgcaggagagcgcccgcgccgccgacgagatcgatgcgctggtgcaggccatccagtcggacaccggtgcggcggtcaccgcgatcgagatgatcggcgaggtggtgggccggatcagcgactaccagaccgggatcgccggcgcggtcgaggagcagaccgccaccaccggggagatgaaccggggtgcggtggccgcggccggtggcaccgccaccatcgccgagaacatccgggcggtcgccgccgcctccgcggccacctcggccgaggtggcccgctcccgggaagcggccgccgaactgagccgcatgtccgcccagttgcgcgacgcggtcgcccaattccggtactga

SEQ ID NO: 7423 - DNA, 795 bp, Actinoplanes utahensis
atgactgtcatcgctgagaccgcaacccacgtcgacgccgcggcgagcaccgacccggccagtgagctgatcaccgcgatggcggcgctcccggccggacatccgtcccggcccggcctgcgcgaccgggccatcgaggcgtggctgccgctggcccgccacctggccaaccggtacgccaaccggggcgagccgcgcgacgacctccaccaggtcgccgtcgtcggcctgatcaaggcggtggaccggttcgaggcggaccgcggcgtcgacttcgccggcttcgcgatccccaccatcgccggcgagctcaagcgctacttccgggacaagacctggtcggtgcgggtgccgcggcggctgcaggagctgcgcctggcgatcaccacggcgaacaacacgctcagccacacgctgggccgctccgccacggtcgccgacatcgccgagcatctcggcatcaccgaggacgaggtgatcgagggcctggagggcgcccgcgcctacaactcgaccagcctgtccaccccggtcagcgagaacggctcggagctcggcgacaccctcggcggcatggatgccggcttcgaggaggccgaactgcgcatcgccctgggcccggcgatggccgccctcgacgagcgcgagcagaagatcgtgagcctgcgcttctacggcaacctgacgcagtcgcagatcgccgagcagatcggcatctcccagatgcacgtctcccggctgctgaccaaggccctcgccaagctccgctcccgcctcgacggcgcgatcatctga

SEQ ID NO: 7424 - DNA, 3408 bp, Actinoplanes utahensis
gtgaagggggtctccggcacctggaaggacctcaccgagtcggtgaacgtcatgggtgacaacctgaccgcgcaggtgcgcagcatcgccgaggtgaccaccgcggtggcccgcggcgacctgacccagaagatccgggtcgacgcgcgcggcgagatcctggagctcaaggagaccatcaacacgatggtcgaccagctctccgcgttcgccgacgaggtgacccgggtggcccgggaggtcggcacggagggccggctcggcgggcaggcccgggtgctgaacgtgggcggcacctggaaggacctgaccgacaacgtcaacgtgatggcgtccaacctgaccaaccaggtgcgctcgatcgcgctggtggcgaccgcggtggcgcagggcgacctgagcaagaagatcaccgtggaggccaagggcgaggtcgccgtcctggcacagaccatcaacacgatggtcgacacgctcggcgcgttcgccgacgaggtgacccgggtggcccgcgaggtcggcaccgaaggacagctcggtggccaggcccgggtgccgaacgtggccggcacctggaaggacctgaccgacaacgtcaactcgatggcgaacaacctgaccggtcaggtgcgcaacatcgcccaggtgaccaccgcggtggcccagggtgacctgaccaagaagatcgacgtggacgcccgcggcgagatcctggagctcaagaccaccatcaacacgatggtcgaccagttgtccagcttcgccgccgaggtgacccgggtggcccgcgaggtgggcagcgagggccggctgggcgggcaggccgaggtggagggcgtctccggcacctggaagcggctcaccgagaacgtcaacgagctggccggcaacctgacccggcaggtgcgcgcgatcgccgaggtgaccagcgcggtcgccaccggcgacctgacccggtcgatcaccgtggacgcctccggcgaggtggccgagctcaaggacaacatcaacttcatggtggagtcgctgcgcgagaccacccgggccaaccaggagcaggactggctcaagaccaacctggcccggatctcctcgctcatgcagggccaccgcgacctcgaggtggtcgcctcgctggtgatgaacgagctggtcccgctggtggacgcgcagctgggcacgttcctgctggtcgacgacggcacggcgggcgcggagctgcgcgtggtgggcagttacgggcacgtcggcgccggactgcggttcgccttcggcgagtccctggtgggacaggccgcgctggcgaaacgacggatcgtggtcgacgacgtgccggccgactacttcctcgtctcctccagcctcggatccgcggcgccgatgcaggtggtggtattgccgatcatggtggaggagcaggtcctcggggtgatcgagctggccggtgtcaagccgctcaccgaggtgcaccacgacttcctgaaccagctgatggagacgatcggcgtcaacgtcaacacgatggtcgccaacgcgcgcaccgacgtgctgctcaccgagtcccagcggctcgccgccgagctgcaggcccgctccgaggagctgcaggcccgctcggaggagctgcagcgctccaacgccgagctggaggacaaggcgacgctgctggcccggcagaaccgggacatcgagacgaagaattccgagatcgagcaggcccgccaggaactggaggcccgcgcccagcagctggcgctcgcctccaagtacaagtcggagttcctcgccaacatgagccacgaactgcgtacgccgctgaactcgctgctcgtcctggcgcagctgctcgcgcagaacccgacccgcaacctcagtgccaagcaggtggagtacgccacggtcatccactcggccggcaccgacctgctccagctgatcaacgacatcctggacctgtccaaggtcgaggccggcaagatggacatcgctccggaagccttcgagctgcgcaacctgctcgactacgtggaggcgacgttccgcccgctgaccacctcccgggggctggacttcgaggtctccaccgccgccgacgtgcccaccctcctggtcaccgacgagcagcggctgcgccaggtgctgcgcaacctgctgtccaacgcggtcaaattcaccgagcagggccgggtgcggctggagatcggcctggcccgaccggaggagctgtcgccggccctggccgagcagcagacggtggtcgcgttccgggtggtcgacaccggcatcggcatcgccgagcagcagctgaccgcgatcttcgacgccttccagcaggccgacggcacgaccagccgccgctacggcggcaccggcctgggcctgtcgatcagccgggagatcgcctggctgctcggcggcgagatcagcgcccgcagcaggctgggcaagggcagcaccttcaccctctacatgccggtccagtcggcgaccgtggccggcgcgtcgatcgccgagccggccttcaacccgggcccgctggtcaccatgccgccggccggaccgggtgggccgcgccgcctgctggtcgtcgagccgcatccggagggcctgctcacgttgatcgcccggggcgccgccaccacgcttgccgagacccacggcatgttcgaggtggtcaccgtggtcgacccggaggccgcgatcgccgagctgcggtcgcagaccttccacctggtggtgctggacccggccctgcagggcttcctcaaggcgctgcacgacgagaccgggctgcgcacgctgccggtgctggtctaccagacccagcacgcgccgctgggcaacgacaccctgctgcaggcgttcgcccagacccggccgctggagaccctgtccagcctggacgacctgcgggaacggatcacgctgcacatgtcggcggaaaccgggcagccggtgatgccggcgacccggccgatcgagtcgatggccgagctgacccgggccgccggcaacctgtccgggcgcaaggtgctggtcgtcgacgacgacgcgcgcaacgtgttcgcgctgaccaacatcctggagctgcacggcatggaggtggtctacgccgagaacggccgcaaggggatcgaggtgctggcccagaacgacgacgtcgacctgatcctgatggacgtgatgatgccggagatggacgggtacgccgcgaccgcggcgatccgggccatgccaaagtactcccggctgccgatcatcgcggtgaccgccaaggcgatgcacggcgaccgggagaagagcctgtcctcgggcgccagtgactacgtcaccaaaccggtcgatgccgaagatctgctcgcgtgtatcgaacgctggctcgcgcaaccgccgatgggccaggaatag

SEQ ID NO: 7425 - DNA, 738 bp, Actinoplanes utahensis
gtggagagtgctgtgggcgacgagatgacagtgcaccggcagacggcgggtgcggcggtggccgaccgggatctgcggcagctgctggccggtttgaccgcggtgcgcgacggtgacttcggtacccggctgcccgaggacggcgacgggctgctcggcgagatcgccaccgtgttcaacggcatggtggaccagctgtcgctgttcacctccgaggtgacccgggtggcccgcgaggtgggcaccgagggtcagctgggcgggcaggccgaggtgccgagcgtctccggcacctggaaggacctgaccgactcggtgaacgcgatggccggcaacctgaccgaccaggtgcgcgacatcgcgcaggtggcgaccgcggtggcccgcggcgacctgtcgcagaagatcaccgtggatgtccgcggcgagatcctggagttgaagaacaccatcaacacgatggtggaccagctgtcgtcgttcgccgacgaggtgacccgggtggcccgggaggtgggcagcgagggccggctgggcggacaggccgaggtgcccggggtggccggcacctggcgggacctgaccgactcggtgaacttcatggccggcaacctgaccaaccaggtccgcaacatcgcccaggtgaccacggcggtggcccgcggtgacctgtcgcagaagatcaccgtcgacgcgcgcggcgagatcctggagctcaagagcaccctagctagctag

SEQ ID NO: 7426 - DNA, 3846 bp, Actinoplanes utahensis
atggcaacccagaacctgacctgcaccctgctgccccggggcgccggccggcacggcggactccgcttcgacgtgcacgtcgcgccgcaactgaccggcgacggcgccgacgtcacgctcggcgggcagttccccgacttcaccgactggccggccgcggcgacccggctgggcgtgtccctgcgcctggacgacggcggcaccacgacagtcgtacccgggcggcggctgtcggccccggacagccgggtgtggacggcgatgttcaccccgcggaccccggtgcgcacgccaagggtcaccgaagcgctggacgacgtgcgggtcgcgtcgtacccgatccggcaggtggtgcagttcctgagccggcagtggggggaggtcggcgtctcggccggccgggaactgccctgcctcgcggacttcgatcggtcgccgctgcgggcgctcggcttccaggacggcggcctcgggcaacgccggctgaaccagctccgggaggacctgcggacccggtaccaacgcggtggcggcgcggtccgcgccgaccggggcggcctggacgacgatcaggtggtcgggatggccttcctgcaggccggcgagttccacagcggcacgctgacggcgcgccggaacccgccgccgcggctggcccggcgggccgcccccgcgccggccggccacgacttccacgacgcggtcgcgctcgccgccagccacggcccgctgcagcggctgctcggcctggtgctggagttcgagaccgagccgtccccggtgctgaccgcactgctgaccggcgcgtcgcgcaccgatctgcggttcaccctggcactcggcacggacgcgctgcgcaccaccacgaccctgcgggtgcccaccgtcgtctgcctggccggcgccggacggttcgagccggcgccccgcggcgccggggtcggtgccgggctgatccggttcgccgccgacacgtacagcgtgacctgcctggatgcggacgccggagcgcaggcggtgaaccagttcgccgccaccctgaccggcgccagcgaccgggacctggcggcccgggaccggcgcgaggcgctgcccgcgctgcggaccggcccgatgacggtggccaaggacgaccgggccggcgagctcgtcgaccgcctccgggaccggcgcaccgaggcggacccggtcctgttcgccgaggacctggtccgcggtctgcgctgggacgtgcgggacggcgacggtccgtggcgcagcctgatgtgccgcgagggcttctacgagttccaccggctgcccgggaagggcaccgtcacggtgtacgacgaggccgccgtcgtcaccgcgaccaccaggggcaaggacgcggaccaccacgacgtgcccggcgaccacctgatcaccgagtcgatgatgtcgtggagcggctggagcctcgccgtcgaaccgctcacccggccggtcggcaccgacaaccgggtgcgcgacgcggccggcgacatcgacccggcgtaccagttcggcacccgcttccgggtgccacccggcagcctgccccggctgcggttcgggcacagctaccggttccgggcccgtaccgtcgatctcggcaatgccggcgtggcggccaccgaggacgatctcggcgagccggacatggtgaccccggcggccaccttcctgcgctacgacccggtggaggcgcccaccgtggtgccgcgccagccgcccggcccggccgaggggccgcggtacgcggtcgtgcacgagtcgcgcccggtctcctcccggcacgtggtgccgccgcgcaccgcgcagaccatgctggagtggcacggcgaactcgaccgcggccgggccggcacgccggacccgcgggcctggcagacgctgcgcgcccgggacgacgccgacctggccgacctgcgggccgaggacgccgactgctatccgcaggagctgctcgacccgccgtacctggtggatgctctggcgcaggccgccctggtgcgcggcctgccgggacgcaccaccgagacggtcgtcgacctcgacggctcgttccgggtggacctgcgcccggtgccgcccggcggggccggctggcgcggccgcggccggatcctcgaggtgggcctggagccgggcgacatctaccggctgcggatctcgtcccggttcgacccggacgacctcgccgtgatgggcgtctgggacctgatgcggacctcggccgtcggcaccgatgccgacgtcgacacgctgcgccgggacgcctgcgagggccggctgtggccgctcaccccggcccgcgacctgatgctggtccacgcggtccgcacgccgctgcccgccccgcgctggctcacactcaaggccgaccggctgttcggcgaggccccggccacgatcaccgcgaccatggagatcagccagaagagcacggcgaccctggacgtgcgcggcgcctggcggatgccggtcgacgacggcccgggcttcgacaccgatcccggcatcgcgcgggatttccggagcaccgcctactcggtgaaggtcacccacccggagggtgcggcgccggacaccgtccagctcccggtcggcggcacccaccacttcaccgaccaccgataccgccgggtctcctacaccgccgtcgccacctcgccgttcgtcgaacatttccgggaggagacgacggtacggctgtccaccgccgccccggcccggctgtccggcgacaccgagccgttcaccgtccgggtgcgtgacgcgctgaccggtgccgtcttcgcccccgcgcccagcggcgtcaccgacccggccagggcggccggggacttcctggtcgacccggaccgccggctgctgcaccgcaccgccggcggccggatcgcggagggcgccaaggtcgtggtcagcctggtccgcggcccgttgacccgggagagcgcgcccatcgaggtggacgtgctcagctcggtcccgcgggccccgccgcggatccactccgtggtgccgaccttcgcctgggacgactcggtgcccggcaccagccggcggctcggcggcggcctgcgtgtgtacctggaacgcccctggtggtcctggggcgacggggaactgctcggcgtggtcctgcacgcctacccggaggtcgaaccgcagggcggcttcggcggaacccggaccgactgggccgccgacccggtgaccaccgcgccgcggaccgtcgcgggaccgatgctgtcgtccttcccgctggccgtcaagaccgccgagatgctgccggtggagggcgggagtgcgcacgtggccgggcacaaggtggccttcgacccggcccgcgacctctggtacgccgatatccggatcaccgaccacgacgacgaggaactcagcgcgaacctgccgttcgtgcggctggcgctggcccggtaccagccgaacgcgctgccggactgcctgctgtcgccggtcgtcgccgccgacttcagccagctcgtcaacgggcgcaccgcgacggtgacccggcagggctccgactacgtcgtcaccgtcaccggtcacgccgggaaggccgacgaccgcgacctcacccacctgtgcgcgttcgccgagggccgcaccgcgatcgccgacccggaactgacctggcgggcgctcggctcgccggtcgagctgtccccgatcgccgccggcgccgggcaggcctggacgggccgggtgccgcggcccggcgaggcgcaccggatcgtcgtccaggagtacgagctgcaccccaccgacaacggcacggtgcgccgcgtggtctacaccgacatcctcaccccacgctga

SEQ ID NO: 7427 - DNA, 1821 bp, Actinoplanes utahensis
atgccgttcacccgggtggccgcgaagctggaggtcaccccggacctggtcctgcaggacgtgccggacggcggcggcgcgcggatgctgctgaccgccgacaggaagatgctgcagttcccgtggcgggggaccgaccacgccgggcaggacaccgacttccaggcgcccgcggtgttcgtgccgctcggcccgaacgcccggcgcgccccggccgacgatccgctcgacccgctgaccaggtggtacgagggcaacgccgaagcctgcacggccgcggtgggcggcctgccgatctcggtcgcgccggccgacgacccggcggccacccggttgaccgtgcacaccatgtcgctgggcggcaagcacctccccggggtggcgttccccagggtccaggacttcacggtggagatgccacagctggcggcgatcaccggcgcaccgcagtcggtcggcgccaggttcaactatttcagcggctacctgcagcagggcttcaaggacaacggcggcgaggtcttcctgcggatggccgacaaggtcgtccccgagctggcggtgcccggcgcgatgaccggggtggccaccccgcagatggcgatcagcggcctgtcccggtcgctcggcccggtcgccggtccgctgagcgacgtcgcgaaccagaagctggacccggcggcgatcctgaaggacggcgcccggctgctgggcgatctgcggctgatcgacgtgctggccaagccggcgggccgggccaaccccgagcaggccatgaagatcaccacccgggacctgccggacggcgccgagaccaccctgcactgggcgccgaagctcacggacttcgccattctcaaggtgaatccggccagctcgctggtgctcgacatccggatcgccgcccggctcggccatccgcccacccacgacatgcgcggcacgctcagcgacgtcacgctgaacttcttcaccgacgacgatccgttcatcgccgtgcaggtcaagaccctgcggttcaccgacagcagcggggcgaaacccgatgtgcactgcgacatcggtgaggtgaccttcggcggcccgctgaggttcgtccgggaactggccacgctgatcggcttcggtaggggcaacggcgtgtccgtcgtgccggccggcgaccgggtgaccgtggccctggacgtcgccgtgcccagcctggcgatcggcctgctcgcgatctccaacatcgcggtgcacgtcgggctgctgctgccgttcaacggcgacccggtggtgttcgacgccggcttcgccacccgtgagcacaagttcgtcctcggcgtcgggatcctgcgcggcggcggttacgccggcgtcaagatcagcgcgagcggcctgcagtccctggagttcgccttcgagttcggcgcgggggtcagcatcgacctgggggtggccagcggctgtgtcgaggtgatggccggtatctacttcaagctcaccgcgaccggcgacaggcagaacatcgagctgaccgcctacctgcggatccggggttcggtgtcggtgctcggcctgatcaccgtgaccgtcgagttctatctcggcctcacctacgactccgacggcgaccggctgaccggcgaggcgacgatgaccgtctccatcgacctgttcctgttcagcacctccgtgtcgatcacctgccggcgggaactgacccgctccagctcgtcgttcggccgcaccgcgcccgccatcgcgtcggcgccgatccgcttcggcgacgtcttcacccccgacctgtgggcgcagcactgcgccgccttcgcctga

SEQ ID NO: 7428 - DNA, 738 bp, Actinoplanes utahensis
atgcgagtgacgctgaccaggtcggagatcgccaacggggacgagtcgcgcccgaccacgacttggatgccggatgacctggccgtggcccgggcggtggcgctgcgcccggatctgcaccacggctacacctgggtcgcctacgcggacggcggccggccgctcgccgtcacccgcgacggccggtggtggctcgtcggacacccggagagcaccctcggcgagctgggcgtcaccgagatccggtacgacccgtacgaccaggacccggacgaggcggtgcgggtgctgcgggccggtggcagggccggccggcggggcgggcgcctcctcgtccagccgcgcgacacgatgcagtcgcgggtgtgggagctgctgccccggcaggtggccacaccgctcatggtgcgactcggggacgacggcatgcggttgcgcaaggcgctgcggctcacggcgtacctccatgatccgattttggaaaccgacatccggaactggttcgcctgccgtcgggagccgctctggcagctggccgatttctgcagccgcctcctggaggcccacggctacctcgaccggcagcgcgccctggagttccgggtggcgggccgcctgcccgcgccgcgcggcggctggcaggccgacccgccggtcctcggcccggacttcaccgcggtcccgatcaccgacccgaccgcgcggcacgcgctcgaccatctcgcccggtatctctga

SEQ ID NO: 7429 - DNA, 993 bp, Actinoplanes utahensis
atgacgacgatgcgtgcggcggtgtgcgagcgggccggcgggcccgaggcgctggtggtgcgagaggttccggtgccggcggtacgggacggctggagcctggtgcgggtgatggcggccgggctgaaccgctccgagctgcggacccggcaggggcattcgccgggcgtgaggttcccgcgggtgctcggcatcgaatgcgtcggcgtggtcgccgaatccaccgatccctcggtgccggccgggacgacggtggccgcggtgatgggggagatggggcgcgagttcgacggcggatacgccgaatacgcgctgctgcccaacgcgttgctgatgccggtccgcaccgacctgccatgggaggtgctgggtgcgctgcccgaaacctatctgaccgcgcagggctcgctggacgtgctcggcccgccgcccggccggctgctgatccgcggcggcacctcgtcggtggggatggcggccaccggcctggcggtcgcccggggcttcgaggtgctggcgaccacccgccggcccgcccgcaccggcggccgtctgatcctggacgacggacggatccgcgacctctggccgggcggccccgaccaggtgctcgacctggtcggggcgcggaccctgaccgactcgctgcgcctggtccggcccggggggacggtctgcgtgagcggatcgctcagcgggtgggcggtgccctccttcgaaccgatcgcgatgattccggccgggacccggctcaccgccttccacagcggcacgatgacgggcccgcgcggggccgcggtgctgcaacgcctcgtcgacggggtgcgggccgggaccgtcgcgccgaacctggaccgggtcttcggcctggacgacatcgcggccgcccaccgctacatggaggacgacgcggcgaccggcaaagtggtggtgacgatggtcagagataccgggcgagatggtcgagcgcgtgccgcgcggtcgggtcggtga

SEQ ID NO: 7430 - DNA, 756 bp, Actinoplanes utahensis
atgcccatcgcccgccaaccggtctcgcgcctgtggccgtccggcggcgcgcacctctggccctccggcgggatcagcgccctgcactcacacccgcgcggccacctggtctatgccgcgcgtggcgttctctccgtgcagtcggagagcggcacgtcgatcgtgccggcgaaccgggtcggctggaccccggccggatccgggcaccggcaccgggcgcacggcagcaccgacatgcggatcgtgttcctgcccgccgccctgtcccggctgctcggcgaccgccccgcggtgttccgggtgtccggcctggcccgggaggcgctgctggcgctgaccggcacccccgagcgggagcgggccgtggcggcccggctccgccgggtgctggtcgacgagctgcgggtggccgacgagcagccactgcggctgccggaaccgcgggacgaccggttgcgggcggtcgcccggctgctctacgacgatcccgcggacacctcgacgctggccgcgctggggcgggcggccggcgcgagttcgcggacaatgagccggctgtgccacgacgagctcggcatgaccttctacgagtggcgcacccagctgcggatcttccacgccctggtgctgctcgccgagggccatgacacggtgcgggtggctgccgcgtgcggctgggccaacccgagcggtttcatcaccgcgttcacccgcctggtcggcaccaccccgggccgctaccgggcgcggggatga

SEQ ID NO: 7431 - DNA, 162 bp, Actinoplanes utahensis
atgtcccgattccggagcttgcagtttccgcagtccgcgcccgacgcccggatcgtggcgacggtcccggcccgcaccacggtcagctatcccgcggccgccgccgcggacaccggcaccccgccgccgcgcgaagccggagacgacagcagctcagtctga

SEQ ID NO: 7432 - DNA, 165 bp, Actinoplanes utahensis
gtgaagacgacggtgcgcaccaccgactggcggatcgtcacgggcgcctcctcctgcgttgccgatccctctgttcggtcgcggcgctgtcagactgagctgctgtcgtctccggcttcgcgcggcggcggggtgccggtgtccgcggcggcggccgcgggatag

SEQ ID NO: 7433 - DNA, 2073 bp, Actinoplanes utahensis
gtgacgatccgccagtcggtggtgcgcaccgtcgtcttcaccgccctgtacgtggtggcgacctacgcgggccggctgacgatcatggacggcacgaacctgagcctggtctggccggcggccggcatcagtgccctctggttcatctgccagcgctcgtcgcggtggcggtcgctggacgtggccgccctggccgcggccaccgtcgcggtcaacatggccaccggcgcgggaccggccctgtccggcttcttcgtggtcgcgaacctgctgcaggccgccaccttcaccgtcctttaccagcgctggctgcccgggttgtggggcagcggcggcaccgccccggtggcccggccgcaccagctgtggcgcctggtcgcgatcgcgatcatcagcacgttctgcggggcgctggtcggcccgaccggggtgtggctggtcagcggccactattcggcgccggcggccgcggtgtggatggcccgcaactccgccagcatgctgctgatcgggatcgccgggctgcggctgggcgccctcgccgggaggttcaccggcactccgcggcagcgctggccgcagctgtgcgcggcgacccgcacggtgccggggcggacctgggtcgagggcggcgcgttgctgatcgtctccgccggcgcctacctcgccgtcttcgggttcacccacggcctgccgttggcgttcgtgctggtcaccatcacggtgtgggcggccacccggatgagcaccaccttcgtcatcctgcacgacctgttcttcggcagcctggcggtcgtcttcacgctgcacggcaacggccagttcgccgggatcgcctcgcacacctcgcgcgccctggtgtcgcagatgttcgtcgccgtggtggcgatcgtcgggctcgccgtcgcactcggccgcgacgaacgcgtcgccctgcagcgggccgccgccgagcaggcccgcgtcttcgccacgatcttcgacgccatgggcgagggcctggccgtgctggacgcggacggccacttcctgctgcgcaacccggccagctcgcagctgctcggcggtctgcgcagtccgaccggcaggatggccggcaacgacttctacggtctgcggcacctcgacggcaccccggtcgcgccgggcgacctgccccatcagcgagccctggcgaccggcgacccgcacgccatggacatcctggtgagccacccggccgtcccgggcggccggatcctgtcggtgcgggccaccccgctgccggtcgacgtcggcggccgccggtacgcggtcagcgtgttctccgacgtcaccgccgaccggcggcaccgcgacgaactggccgcgttcgccggcatcgtcgcgcacgacctgtccaatccgctgaccaccgtcgaggggtgggccgaggacgtcgccgacctgctcgggccggacgccggccgggccggtgacggcatcgcccgcatccagcgcgccgcgacccggatgcgcaacctgatcaccgacctgctcgcctacaccaccgcccgcgacgccgcgctgggcctgaccggcgtggacctgaccgcgatcggcaccgacatcgccgtggcccgcatcgaccaggccgagaccaccggcgccccggtgccgcacgtgcggatcggcgagctgccgccggtgcacgccgatccggcgctgatccggcagctgttcgacaacctgatcggcaacgccgtcaagtacaccgcccccggggtcgttccggtgatcaccgtgaccggcgaccgggacggcgaccgggtccgcatcgcgatcagcgacaacggcatcggcatcccggccggtcagcacggcgccgtgttcgacaacttccaccgcgcccaccgcgacgccgggtacaccgggaccgggctcggcctggcgatctgcaagcggatcgtggtacggcacggcggcacgatcaccgccgccgacggcccggccggctcgggcagcaccttcaccttcaccctgccggccgccaacctgccgcccggtgtccccgacccggccgcgccggtcccggagcgcagccgactcgcctga

SEQ ID NO: 7434 - DNA, 582 bp, Actinoplanes utahensis
atgagcctgatcgaggtcgaacgcaaacgggcactgaccgacgtcgccgccctgacgggacggctgagggtgcagggctaccacgaggcggccaccagcgtcgaagtcgacacctactacagccggcctgacgtcgacttcctggtcaccgttgaatgcctcagagtccggcaacgtgacggattcgctgagatcacctacaagcccgcgtcgaccggtcgcacgcgctcagcatcgggcgtgatcgccaaacgggagaccaacgtgctcctttccgggccggagcaggccatcgcggccgacgagttgatgactgcactgggcatggtccggctgtgccgggtggagaagacccgcacggcgttccgaaatcctgaacatgacagcgtgacggtcaccgtcgatcgcctggccggcgtgggaagcttcgtcgagaccgaggtcatggccgtcgacgaggacgccgccgcgaggctgctcggtcaggtggaacgacgactgggactcgtcgaccacgcggtggtgaacctgccctaccgcgatctggtgcttcagcaggaacgtgccgcgactgcagaatga

SEQ ID NO: 7435 - DNA, 1413 bp, Actinoplanes utahensis
atgccggtaacaaccgccggactggccgacaggcccaacttcgcccgcgatgccaagacgagcaccgcgtatctggacgtcgccgccaacactcacggcgcggagaaaggcaagctgatgcaccgcgctctgcagcgcgtacagcgccgagcgccccgagccgtcgagctcggtccgggcggcggcgccgcagtcgcctatctggccagcaagctcgcccagaccgcgaagcccgatcggcaggtgtccctgaccttgatcgaggcgcctggcgtacgttcgcaatccttgacggacgcgatcgacgacttcaaacggatcgggcactgcgaattacggcatgggctcgcgcaagacctcaacacgctgctaccggaaccggtcgacgtcatctcagcctccgcgctgctgcacgaggtgtactcctacggcaccggctacgccgggctgcacgccatgatccgtaccctgccgcaagttctgacccccggcgggttcttcgcctaccgcgacgtgtacgccgtcgacgcgcccagcctgtatgaacgcgcgacccagacctaccactctccgacctggctgaccttcctgcggctgttcacaccccggtacctggctgagagcacccacccgtaccaccgcgccgacgacgaggtggtggctcgccagaactcgcggatggtgccgctgggcgacctcgacccacggacctgcgcggtgatcagcgcacccgtcggactgttccgggagatccaacgccactacctcaccttccgcgaccacgtgtggcgttccggcctgctcggtttcacccccgtgctcgacggcgaccaggcagacgactgggtcgacctgcacgccggccacaaacgggtgcacttccgtatgggcggcgaggtgaactggcttccccagccgcagtcgatgatgctggccgcgatgagcgagccctacctcgaccaccacaccatcgacagtgacatcttcgactccgtcaccgaagtggcgctcctggctttcctgaacgccgtcaccggtgatgccgcctgccggacagcttgggaggcgtggctgctccgcgaaggccgcgagacgtatgcgtacctgactgccgaccagttactcacggcgttcgtcgtgcattcgaccgaggctgaccgcgacaccgtgctgatgcccatcgtggccggcgacgtcggccgcgtcgaccggcactactacaatcggttcctcgcgaggcaactcgccaacccgctacgagacgccaaacagctggtgctgttctgtaacgtgccgcgcaacgacacagacaccctgcgcaacggtctcggtgtgctggccgagcggtgcagtaaaccgagcctggctcgcatctacacggtcatcaccacggacggcggcaccgcctcatga

SEQ ID NO: 7436 - DNA, 1104 bp, Actinoplanes utahensis
atggcgttcacccgcgtggagagcagtgcaatcggcccaggcggggttagtgtcggtgcgaccatagctggaaggggcgatccggtgcgacgacgtgatgtcttgtcgggcttgaccgcgagcgctgccgcggccgcgctgcctcaccctgaccggcgggccacgcctgtagccaacctcgcggacctgctcagcgcggaaacgatgagcacggcgccgatgaagcgggagatcctcacccagcggttggcatcggcacgtcgattgttcagcaccagccgatacgacgaactgaccggcgatctggtcgccctgatcgcgggcgccgctgcaacgcgccgcgacggcgcgtccgctgttcgagaggccgccacggtcatcctggccgcgggataccggctcgcttccgagctggcggtgaagcgcaacgacgacgctctgggttgggtcctggcggaccgggcgctgaccgccgcacgtgccagcgggctgccggcgccggtggcgcacgcaagccgatccgtcgctgtcgcgatgcggcgcgccggacaccacgatgacgcgatcgctctgctgatgaccagcgcccagcagctccgactcggtccgcagccccgggacttggagctggccacgtacggctcgctgctgtgtacggccgcctacgccagcgcccaggcaggtcggcgcggtgaagccgaaaccctgctcagcgaggcgagtgccgcagcggcacgcctgggcgccgcggtctacgccggtgaactcgttttcagcgtcaccaacgtggccgtctaccagatcggcgtcttcaccgccctgggtgacagcgctacggctctgcaccatgcgagcaccgttgaggtcgcgacgttggaaacagcggagcggtacgcacgctattgcatggatacggcccgcgcgtgggaacagcagggacgtcacgaccgcgccacgcaagcgctgtgcgccgccgagacccgtgccccgcaggaactgcggcgtccctcatcgcacgaattgatcacgcggttgttgtatgcaccggtggtaatgccgagtggcctgcgcagcctcgccgcgagggtaggagcgatccgctga

SEQ ID NO: 7437 - DNA, 105 bp, Actinoplanes utahensis
gtgcaagacccgacggccgggctgatgatcggcaaggcggagttcgatcggcaggccggtctggtcaggcaggcctggcgtcgccggcgggtcggtgtttcctga

SEQ ID NO: 7438 - DNA, 906 bp, Actinoplanes utahensis
atgaaaccctatctgtccgcgacgaagcgcgggctcgccgccgcgacggccaccgtgatcgccggcacgctggcgctggcgtcgaccgccgcgccggcgctcgcctcacccggcccgaccggggtgcagtacgcatatctgaacatgtacccggccgtcccgcccaccagcaccaatccgctggtcagcgtcaggcagacggtcacctgcccggccggcaccaagctggtcggcagcggtggcggtggcggcccctacctcggtgcgatatcgccgtccgacgacgcggccaccgtcgacggccaggtggtgttcgataacggtgaccatgtcgtcggcgagctcgtgtgcagccccgccgcccagttcgccaacgtgaccacgctgatggtcaccgacaaccgggtccggccgaacaccatcagacagacgttcgcgaaatgcccggtcgaccggtacgcgatcggcggtggcggcggcttcaacggcgcgacctatctgggtggcacctcgatcttcagcaacgggccgacgccggacggcaggagctgggaactggtcggcatgccgccggccggcgccagcaagctgcggatgttcgtcaagtgcgccccgaagaccgggcaggatctgctgatcaccgcgaccagcctggtcgcgcagacctccagcttgcagccgctgtccgggcgcgcgtactgcccggcgggctatctggccgtggccggcggctaccacgtggccaacccggacggttcctcgttcctcggcggcgtccagccgccgatcatgacctggtcggtgccggttccaccgacgacggtcggcaacgactcgaactggtacgcgtcgggcgacctgccgaccaagacgagactgatcatcagcgcccaatgcgtcaaatag

SEQ ID NO: 7439 - DNA, 711 bp, Actinoplanes utahensis
gtgagcggcggcaggcgtcgtcgtccaggtccgcgctttcggccggctgcccgccctgaccgccgcccgcaccaccggataacctcacgcgtggtcacctcgcagcatgcttcgaaccatcccactgtggtcttctacggcgactcgatcgtcaccggctggcgcggcacgacacacccgcgcgcccgctggtccagcctggtcagcgacgagctcggctggcgcgaggtgaacctgtcgatcaacggcatgggctacttccgccgccgcggcccgcgcggcggcgacgaccgctacctgccgtcggccaccgacacgacactgctcgacgccgccatccgtctcgacccggacgccgtcatcgtgtgcctggccgccaacgacatccgcatgctccccgagcacgccgacgaggtccgcgccgccatcgaccgcgacctgacccgcctgcgcgacgaacttcccggccggccgatcctcgtcgtcacctactatccggtcgccgaactctccgagcgcgccaccctgatcaacaactgggtcgccggcaccgcggagcgcctcgggctgacctacgtcgacgccttccggcgcaccgtcgacggcgacgagaaactgctctgcgacgaccacacccaccccaacgacgacggccaccgagccctcgccgacgcgatcctgccggcctgccgcgccctgacgctgcgctga

SEQ ID NO: 7440 - DNA, 597 bp, Actinoplanes utahensis
gtgaggttatccggtggtgcgggcggcggtcagggcgggcagccggccgaaagcgcggacctggacgacgacgcctgccgccgctcacgatcgcggcatgggatgctgtggcatcggcatcccggcgggacgatcatgaacctgagcatcatcggacaggccgcgggcctgttcgcggtcaccaacatcgacgacatcctgatcctggccctgttctccgcccagggcgccggccaccggcacaccacccgcaacatcctcgccggccagtacctcggcttcgccggcatcctcgccgtcgccgtggcggccgcggtcggcgccacactcctgcccgagcgggccgtgccctatctcggtctggtcccgctggcgctgggcatcagagccgccgtccaagcctggcggcaccgcaacgacaacggcgacgaccggaccgaagcgaccggcgacgctcccggcatcgccgccctcgccgccgtcacgttcgccaacggcggtgacaacatcggcgtctacgtgccggtcttcgccaccgcgggagtcggcgcgatgaccgtctacgtggtcgtcttcctgctcctggtcgccgtgtag

SEQ ID NO: 7441 - DNA, 216 bp, Actinoplanes utahensis
gtgtcccgttacctaaccgctagaacggaaggtgaaggaactgactgggcatggccgcagggagttcttccgatcctcgactggggttgcgcgatgtacgcctgcgtcgactgccgcagcgtcgacggcacggttctcctgttcgaaccgaacccaggcgatctagacgaggcctggtacgtagactcatcgtccttggcggtgatcgcgtcctga

SEQ ID NO: 7442 - DNA, 795 bp, Actinoplanes utahensis
atgatcgcccaagtccccgccgtctggaacgtcgacaccaacctgagcaccgtgcgagatgttctcgacgaggcgcatcgcggcgatgtcgtcgttctgccagaggggatgttgtcgggctacgacgaagacctgactccgctggacgcactggatcccacagcggtccatcacgccgtcgcgcaggtggcgcggctggcagtggacaagcaggtgcacgtcttctgcggatcgctgctgccgcaacctgacggatggtgcaacgccggtctgttcttcccagcggacggcggtcgtcatcagatctaccggaagatcaacctggcaatgaacgaacgcggccggcttcacccgggcgatcagctgccgaacgtcgacattccgctgcctggcgggcccgtcaccgtgggaatgcagctgtgccgcgagatccgtttcccggagcagtggcagtaccttgcgaccactggcgcccggttgttcgtctacctcaccaacgccgccaacacccgcgagcctgaaggcgtctggcggagccacctgatcagccgcgctgccgagaaccagcgcttcctggtatccgccaacatcgcccaccccgaccggcactgccccagcatgatcgtgtctccgcgcggcgaggtcatcggtgaactgcccgccgggcagcacggagttctccggcaggtgatcggcctggacgaagcggggagctggtatctcggacagcgacgacaggatgtcctgtcactcgactaccacggaagcccgctccggccggaacagcgctcatag

SEQ ID NO: 7443 - DNA, 408 bp, Actinoplanes utahensis
gtgagattggtggcgacgatccgggaagtgggcgagtccacatcatcgtgggacccgtatacgcggggctgcccgtcgcgtgacctgctcgaccagatcggcagcaaatgggccgtcctggtgatgggcgagctcggcaggcagggggcgcgccggttcacgcagctgcggcagcagctcggggggatcagcgagaagatgctcacccagacgctgcgcacgctcgaacgcgacgggctgatcctgcggacggtgtatccggaagcgccgatccgggtggagtacgagctgacgccgctcggccagaccctgcgcggtcccctgaaggcactcaccgagtggtcgacgcagcacatcgaggaggttgtcgacgcccgcaagaggtacgacgaacgcaccggaggatag

SEQ ID NO: 7444 - DNA, 1125 bp, Actinoplanes utahensis
atgtcgatcgttgtcactgcagcctccggacgtctgggccggctcaccgtcgaagcgctgctgacccgtggggtgccggcctccgagatcgtcgcgaccagccgtgacatcagcaggatcaaggacttcgccgaccgcggtgtcgaggtccgccgggccgacttcgcggagtccggcagcctccccgccgccttcgcgggggtggacaagcttctgctgatctccaccacgaccccgagcgagcgcgtcgcccaccaccgccgcgccatcgacgccgcggtggtggcgggcgcgtcgctggtcgcgttcacgagcatgctgcacgcggacacgtccaccgccagtctttcgaccacccaccgggccaccgaggagtacctgcgcgagcgcctccccagcgtgatgctgcgcaacggctggtacctggagaactacaccgaccagctccctcaggtactgcagggcggagcgctcgtcggggccgtcggccggggcaggatcagcgcggcgacccgagccgactacgccgacgccgccgcggtcgtgctgaccaccgacggccacgacggcagggcgtacgagttgggcggcgatgaggccgtcaccctcacgcagctggccgcggcgatctcggccgcgacgggcaggcggatcggctacaccgatctgccggtcgacgcgttcgcccgggtgctggtcggcgcgggcgtgcccaccgagctggcgcaggtccttgcggacgccgaccgcgccatgagccacgacgagatgttcaccgactccggcgacctgcggcgcctgatcggacggccgacgacgactccggcggaggcgatcgccgccgcactccgcggaccgggcggcgctgcgctgcctcctcccgtgattgatcccggccggatgacgggcgatctgccgcacgcccgcaccggtcgcagcatgctgcgaccggtcttgtcccggcccggccggcgagcgccgggccgatcacttcccgcgcccggaaccccggagatcacgaccggggtcacggggccggtcagcgggcggaccacacctggttggcgccccggttgcagtcccacagttggacgatcgtgccgttcgcggtgccgttggcgttga

SEQ ID NO: 7445 - DNA, 2358 bp, Actinoplanes utahensis
atgcgtcacttgctcatggtcgcggtcaccgcggccgccatcggcaccctcgccgcacccgccccggccgccgcggccaccaccgtcgccctcaacggcggcatcgtcggccgcgccttcgacggcgtcggcgcgatcagcggtggcggcggcaactcccggctgctcatcgactacccggaaccgcagcgcgggcagatcctcgactacctgttcaagccgggctacggcgccgcggtccagctgctcaaactggagatcggcggcgacgccaactccaccgacggctccgagcccagccaccagcacgtacgcggcgacatcaactgcaacgccggctacgaattctggctcggcgagcaggcggtcgcccgcaaccccgggatccggctggtcgccctgccgtgggccgcgcccggctggatcggcggcggttccttctggtccacggacatgatcaattacgacgtctcctggctcaactgcgccagacagtacggcctgacgatcagctacctgggcggctggaacgaacgcggccacgacagcacctggtacaagaacctgcggaccgggctcgacaacgccggatactccgcggtgcagatcgtcggcgacgacagcggctgggggatggccgacgagttcgccgccgaccccacgttgaaaaacgcggtcggcgtgctcggcaaccactacgtctgcggctatctgtcccaggccgactcgtgcagcaccacgggcaacgcgcgctccagcgggaaaccactgtgggccagcgaattcggctcccaggacgacaacgcgggcgtggtgccgtacatccgtaccgtcaaccggggttacctcgacgcggagatcagcggatacatgaactggccgctgatcgcggccatcacccccaatctgccgttcgccacggtgggcctgatggatgccggctcaccgtggtcgggggcctatcgggtgggccggaatctgtgggcgaacgcgcattacgcccagttcacccagcccggctggcactatctcaacagttcggccagcggatacctgggcgggaaccgggccaacggcagctatgtgacgctcaaatcgacgaacaacaccgactacagcaccatctacgagaccagtggcagcaccgcggcgcaaaccgtgaacgtcaccgtctccggtgggctcagcaccggcaccgttcacgtgtggtcgaccgacatgggctcgtcgaattccgccgactggttcgtccggcaggccgacatcacgccggtcggcgcgacgtacaccctcaatctgcagccgaatcggatctataccgtcaccacgaccaccgggcaggggaaaggcaccgcggcgggtccggctccgcatggtctggccctgccgtacagcgacaatttcgacggatatgcggtccgtaagctgccccactacagcgaggacatgcaggggtcgttcgaaacccgggcctgctcggccgggcgcggcgggacgtgcctgcagcaggtcgcgccgctgcggccgatcaattggcaggacgacagcgacgccttcacccttttcggcgacaccggctggaccaattacacggtcagcctcgacgtgaacatgcagcaggccggcaccgtcacgctgctgggccgggccaacatccagaaccgtccgcagaaccggcaggccgcctatcagctgcgcgtcaccgacaacggcggctggtcgatcgtcaaacacaccaatgccgacacggacacgacgctcgtctccggcacccgcgccgcgctgggcctgaacagctggcacaatctacgactcggattctccggcggccagatcaccgccgccatcgacaacaccacggtgggcaccgtcaccgactatgcgtacggcgcggggcaggccggcgtcggcgtcgtcggctaccagaccgaccagttcgacaacctcagcgtcacccccaacagcggcccggccctcaacacgctgcgtggcgtcgaatccggccgctgtgccgacgtgcccggcgccagccagaccaacggcacccagctcgccctctgggactgcaacggcggcagcaatcagaacttcaccctgacagatcagaaacaattgctggtgtacgggtcgaagtgcctggacgtcaacgccggaggaaccgcggacggcgccaaggtgcagatctgggattgccacggcggaaccaaccagcagtggacgctcaacgccgacggcacgatcgtcggaatcggctccggcaaatgcctggacgccaccggccacggcacggccaacggcaccctgctcgaaatctggacctgcaacggcggcgacaaccagaagtggagccggtcatga

SEQ ID NO: 7446 - DNA, 1302 bp, Actinoplanes utahensis
atgacacgtttcgactccgccggcctgacccggcggtccctgataggactcaccggcgccgccgcgaccgccaccctgctcgccgcctgcggcagtgacgacaagagcgggacgaccagcgtcagcgacggcaacgggccgatcacgttcggctccaactactccgacgaggcgcccaaggcggccttcgcgtcgctgatgcagcaggcgaccaccagcaccaccgtcccggtcacggtcaacaccacggaccacaacacgttccagaacaacatcagcaattacctgcagggcaccccggactcgctggccacctggttcgccgggtaccgcctgcagttcttcgccgcgcaggggctgctcaccccgatcgacgacgtctgggacaagatcggcggcaccttcaacgacgccgcgaaaagcctctccaaaggactcgacggccactactacctggtgccgctctacaactacccgtgggtcgtcttctacaacaagagcgttttccagtccaaggggtacgaggtcccggccagctgggaggcgttcatcgcgctggcccggaagatgcagtcggacggactggtcccgctggccttcgccgacaaggacggctggccggcgctgggcaccttcgacatcctcaacctgcggatcaacggctacgactaccacatcaagctgatgaagcacgaggtgccgtggaccgaccccggggtcaccaaggtcttcgaccagtggcgggaactggccgcgtaccagcagaagggcgccaacggccggacctggcaggacgccgccaaagctctggagaacaagcaggccgggatgatgttccagggctccaaccaggtggccgccaactacagcgcgaagaaccttcccgacctggacttcttcgtcttcccggcgatcaacccgcagtacggcaccgactacatggacgcacccaccgacggcttcatcctgccgaagaaggggaagaacgccgccgcggccaagaaggtcctgcaatacatcggcaccgccgaggccgaggccgcgttcctcaagaccgaccactgggacgtcggcctggccaacgggctgatcgcacccacctacaacgacatccagaagaagtcggtcgccgagatcggcaaatgcaagagcgtctcgcagttcatggaccgcgacaccgtgcccgacatggccaacgcgatgatcaagctgatccagcagttcatcgaccagccgaccccggagacgatcgcgaccgttcagaagagcgctgaggaccaggcgaagacgattttccgctga

SEQ ID NO: 7447 - DNA, 981 bp, Actinoplanes utahensis
atgaccccgaccattcgaccggcgccggccgcccgccggcgccgccgcacgctcacccgccgcgacgtcgcggtcgccgccgccatgctcggcgtgccgctactgctcgacctcgccttcatctggttcccggcgctcgcctccgtgctgctgtccttcaccaaatggaccgggatcggctcgatccggatgcggtcctgcgcggatttcccgtccgcgcccggcatcccgcaaccgggttgcctgaacggcgtcgacaattatcgccaggcgttcaccaattatccggacttctggccggcggtccggcacaacgccatctggctcgtggtcttcatcctcctcgcgacgccgctgggcatgctgttcgcggtggtgatcgaccgcggggtgcggggcagccggttctaccagagcgtgctgttcctgccggtgatgctgtcgctcgcgctgatcggcatcatctgggagctcatctactcccccaacttcgggctgatcaacacggtgctcgggcacaaccacaacgacaacctgatcgactggctcggcaatccccggctcaacctctgggcgctgctcgtcgaggcgagctggcggcaggccccgtacgtgatggtgctgtatctggcgggtttgaaagcggtcgatccggcgctgcgcgaggcggcgatcgtggacggcgcgaacgcgtggcagacattctggcgggtcgtcttcccggcgatgcgaccgatcaacatcgtggtgctggtcgtgacggtcatcgagtcgttgcgggccttcgacctggtctacatcaccagcaacggcaatccgctgcgcggcctcgaactgctgtccgtggcggtcacccagaacatcgtcggggaaacccagcggatcggcttcggctccacgctgggcgtggtgctgctggtcatctcgctggtgccgatctcccttttcctgtggcaggcattccggcgggaggaacggtga

SEQ ID NO: 7448 - DNA, 846 bp, Actinoplanes utahensis
gtgaaacgtaccggatcgcagctcttcctgctggtcatggcggtgttgtggctgatgccgatcgttttcgcgctgtacgtcgcgttacgaccgatcgaagagaccaatcagtcagggtacgtgtcactgccgcaccagatgaccctgtccaacttcgcgcatgcgtggacccgatccggcatgtggcgattctttctcaattccgtctatgtcaccgtgccggccgtgctgatcaccctgttgctggcctccatggcggcgtacgtgttgtcccgcctcggtttccggttcaacattccgctgctgatcctgttcaccgccggcaacctgctcccccagcaggtcatcatcaccccgctgtaccgcatctacctggccgtccacctgccgtcctggctgagtggaagcggcctgctgtacaactcgtacgccggcctgattttgatcaacgtctcgttccagctgggcttctgcgtcttcgtcctgtcgaattacatgaagaccctgccccccgccatcgacgaggcggccctgatcgacggcgccacgctgtggtcgcgttactggcgcctgacgatgcccctgtgccgcccggccctggccgccctggccaccctgctcaccacgtggatctacaacgacttcttctgggccatcaccctgatctccacgggtgaccgccgcccgatcacctccgccctggccaacctgcagggccagttcgtctcgaaccagaacctgatcgccgccgcggccctgatcgccgccatccccaccctggtggtctacctgctcctgcagaagcagttcatcgccggcctctccctcggctccaccaaggggtga

SEQ ID NO: 7449 - DNA, 2175 bp, Actinoplanes utahensis
gtgcaacgtcacgccaggcatgccatcgccgcggcggtagccgtttcgctgctgccgccgtcactgccggctcatgccgccggggcttcggccgtggtgccgtacgccggtaacccggccagtctcaagcaggacctctgctaccagatcgccaccgaccggttcagcgacgggaacccggcgaacaacaatccgggcaacgtgcccggcatgttcgccgacaagaccaagctgaacgaccggcaggagtggctcaaatacatgggaggtgacttcgccggcatcacccagcggatggagtacctcaagaacctgggcgtcggcgcgatctggatctcgccgcacgtcgacaacatcaacgttccggcgaacggcgccaccggttaccacggctactggccgcgcgacttcaagcggctcgaagagcacttcggcaccgacgaggagttcgacgcgctggtgtcggcggcgcacgccagcaacatcaaagtgatcatggactggacgccgaacggcaccaacccgccgaaccaggccgaggacggcgccctctacgacgatgggcagctggtcggcaggtacggggcggacagtgccgggcacttccaccacggcccggcgatcggcgacttcaacgatcgctaccaggaccagtactacagcctggccgacatcgccgacctcgaccagcagaacccgcgggtcgaccagctgctcaaggacgacgccaactactggatggaccgcggggtcgacggcatccgggtcgacgccgtcaagcacatgccgctgagctggcagcggtccttcgccgacgcggtcacctcgcacaagagcgcggccatcttcggcgagtggtacatgggcgaccagtccgatccgctctacgccgaccaggtcaagttcgccaacaccagcggcatcgcggccatggacttctacaccaaccgctcgatccgcgacaccttcgccggcgccggctcgatgaagtccctggacgcggcgatcaccaagaccaaccgggactacctctacgagcaggatctgatcacgttcctggacaaccaggacacccggcgcttcgggacgctcaacagcgatccggcggccctgcaccgggcgctcgccttcctgctcaccacccggggtacgccgtgcctgttctacggcaccgagcagtacctgcacaacgacaccggtgagggcagcaacaagggcaaggacccgtacaaccggcccccgatggccagtttcgacaccgacacggtcgcctaccgggagatccgcgccctctccgacctgcgccggtcgaaccccgcggtggcctacggggaccaccagcagcggtggatcaacgacgacgtgtacgtctacgagcgccggttcggcgacaacgtgctgctgaccgccatcaacaagggctcgcacgagtaccggctcgacgggctgcgcaccgcgctgccggccggcacctatcgcgacgtgctcggcggcaccttcggcggctccgacctgaccgtcgaggacggcgacggcaccgaccggtcgaccgtcgcgccggtgctgggtgccgggcaggtcgccgtctggtcgtaccgggcgccggtggacaccgagccccggatcggcggggtcgggccggtcgtgacccgggccggcgccaccgtcaccgtcgagggcaccggcttcggctccggcggaaccgtcgcgatcggcggagtccccgcgaccgtccagcagtggacggcggaccgtatcaccgccaccgtcccggtcggcgttcccaccggggccgtccaggtgaccgtcggcaacggctccggcaccagcaacgggtacccgatcaccacccgtaccggaaaaccggtcccggtgcagttcaccgttcagaacccgccggccaccgcgcccggggagtcgctctacctgaccggtgacgtcgccgagttggggcactggtcgaccagcccggaccagaccgcgggacagctgctgcgggtgccgaacgagtcccggggcgtcctcgtcgccgacctgccggccggggcgccggtcgagttcaagttcgtcaaggtcgcggccgacggcacggtgacctgggagggtggtgccaaccaccggtacaccgtcccggccggcggcaccggcacgaccacgctcacctggcagcgctga

SEQ ID NO: 7450 - DNA, 3102 bp, Actinoplanes utahensis
atggatgaaagactgaaatctcatatcgtccgggcgctgctgcccgtgctggtgggggccgccggtggcctgccggctccgcgggccgcgcaggccgaatcgccgccggaccggccgtcccacgccgagcagctctacctggtgatgcccgaccggttcgccaacggcgacaccggcaacgatcagggcgggctgaccggagaccggctcaccaccgggtacgaccccaccgacgccggcttctaccacggcggcgacatccagggcgtgatcgacaaactggactacatccaggggctcggtaccacggcgatctggctgacgccgatcttcaagaacaagccggtgcagggtacgggtccgaacgcgtccgccggctaccacggctactggatcaccgacttcacccaggtcgacccgcacttcgggaccaacgaggacctcaagcggctggtcggcctcgcccaccggcgcggcatgaagatctacctcgacatcgtggtgaaccacaccgccgacgtgatcaagaacgccgagggcaccgcctacgccgacaagggaaccgcgccctaccgcgacaccgcgggtcgtcccttcgaggaccgcaactacgccgacgggacacacggcttccccaaggtcgacgagaagtcgttcccccaccggccgttcttcgagaagccgtccgacgccaccgccaaggcacccgcctggctcaacgacccgaccatgtaccacaaccggggcgagaccaccttcggcggggagaacgccgaatacggcgacttcaccggcggcctcgacgatctgtggaccgagcggcccgaggtgctgcacgggctgaccgacatctacgccggctggatccggcggttcggcgtcgacggctaccggctggacaccctcaaagccaccgacctggcgttctggcggcctttcgccgagggcgtgggcaaggccgcggacaaggcgggcaagcgtgacttcttcctcttcggtgaggcctggagcaaggaccaggaagtcacctcgacgttcgtccgccggggcggcctgcccgcgaccctcgacttcccgttccagggcgcggcccagagctacgtcaccggcaaggcaccggccagcagcctggccggcctgtacgcgaaggacgacctctacaccgccgccgggaccgacgccggccggctgcccaccttcctcggcaaccacgacatgggccggatcgccactctgatcaaggccggctccgatccgaacgggctgcgccggctcgaactggcgaacgagctgatgttcctcacccgcggccagccggtggtctactccggcgacgagcagggcttcaccggcgccctcggcgacaagggctcgcgccaggacatgttcgccagccggacaccggactacctggacgaccgcctgatcggcaccgacaagacccacgcgagcgacaaccacgacaccgggcacccgctctaccgcaccatcgccgagctgggcgcgctgcgcaaggcccacccggcactgcgtgacggtgagcagatcacccggtacgccgccgaccgcgccggggtcttcgccgcctcccgcatcgaccgcgaccagcgtgccgagtatgtgatcgcggtgaacaacgcgaccaccgcgcagaccgtcaccttcgacacctacaccccgggctccggcttccagcctctctacggcaccggcgagacggcggccaccggtgccgacggccggctcaccatcaccgtgccggcgctgtcggcggtggcctatcgggccgagaaaccgatccccgcggcggacggcgcccccgccgtgacgatcaccgcacccgcggccgggaccctcgtgccgggccgcaccgaactgaccgccgccgtcaccggcgacccgctgtccaccgtcaccttctccgcccgcgccggtaacgggccgtggcagccgatcggcacggccggacgggccccgtaccgggtgttccacgacctgaccggactggccggcggcgccgaggtgcagtaccgggcggtcgcccgggacggccgaggccgtaccgccaccaccaccagccggatccgggtcggcaccgtgcgggccgaggcgggctacgccgtcgtgcactatcagcgtcccgccggcgactacgacggctggcgcctgcacgccaccggcgacgtcgacgcggccgcgctcgacccgcagggagagccgttcaccgggacggacgcctacgggcgcttcgcctgggtcaaactgcggcccggcgccacgaaggtcaccttcaccgtgagtgacgccaacggtgtcaaggacgtcgacgccgaccgctcgctcaatccccagcagacacccgggatctggctgcaccagggcgacccggccatctcctaccagggtccggcgcccgcacccgcgccgaacaccgcgatcctgcactaccggcgtccagccggcgattacaccggctggggcctgcacctgtgggacggtgcggccacccccaccgccgactggggcgcgccgctgctgccggagtcgttcgacagcttcggtgcggtcttccggatcccgctggcggccggggccaccggtctcagctacatcatgcacgccggcgaggccaaggatctgccgaccgaccagcggctggagttcgccgacgcgggccgggaggtctgggtgcaggcgggcgtccaggaacggctgctgccgtcggtggtgaaaccggcgaaactcgatctgaccagggccgacgcggtgcgggtggaccgggacacgatcgcctggcagaccggtacgcccgacacgctggaaccggccggggcagccaccgacgggcgcgtctacgacctcgtgcacgccccgaacggtgggctgcgcctggtcgacggtgacctcgccggcgactatcgcagcatccggctgaccgcgcagcgcgacggcctcaccgagaagcagcggcggcaggcaccggaactgtggcagtacccggcgttccaggcggcggccgccctgccctccggtgacggacagttctatgtgactgagcgggatgcgcaaggccggctcatgtcggtgaccggagtccgctga

SEQ ID NO: 7451 - DNA, 978 bp, Actinoplanes utahensis
atgccgccaatgggtgcccgatgttcggccgagccatttacggggcttgctgatatggtcggtcacgtgcgcggaatattgctggccgggggaaccggctcacggcttcgaccggtgacctgggcggtttccaaacaactgatgccggtctatgacaaaccgatgatctactatccgctggccacgctcgtcagctgcgggatccgggagatcctggtcatcacgaccgagaccgaggccgcccagttccagcggttgctgggtgacggctcgcagtggggcctgcgtctggagttcgccgtgcagcagcgccccgggggcatcgccgaggccttcctcatcggcgaggagttcctggccggtgggccggtggcgctcatgctcggcgacaacctgctgcacggggtggacttccgcccctgcgtgcagcgggcacgcgagacggccggtgggcacgtcttcggagtggcggtggccgacccgtcggcctacggggtggtcgagttcgacgccgccgggcgggtgctgtccatcgaggagaaaccggtccgtccccgctcgccgtacgcggttcccggcttctacctctacgacgccgatgtggtcgagacggcccggtcgctgcggcccagcgcccgcggggagctggagatcaccgaggtcaaccaggcctacctgcggcgcggcgcactctcggtgacgctgctgggtcggggcgcggtctggctcgacaccggcaccctggccgactgcatgcgcgcggtcgactacgtgcgcgccatcgacgagggccagggcatcaagatcggctgtgtggaggaggcggcctggcgggccggtttcctcgacaccgcgcagctgcgtgccctcgccgagccgttgatgagcagcggctacggacagtacctgctggctctgaccggcgacgggctcagccgtaccccgcagtggccggccttgaccgccgccgccgggtga

SEQ ID NO: 7452 - DNA, 963 bp, Actinoplanes utahensis
atgaaaatcttggtcaccggcggagccggctttatcgggtcccattttgtaacttccctgatcagtggcgacattgccacaccacaacccgtgacgcaggttacggtcgtcgacaaactgggttacggaggcaatctcagaaatctcgccgaagcgtcggcggaccctcgtttcagcttcgttcggggcgacatctgtgacgaaggtctaatcgaggggctgatggcgcggcacgacaccgtggcgcacttcgccgccgagacccacgtcgaccgctcggtggtcgcctccggccccttcgtggccagcaacctggtcggcactcaggtgctactggacgccgcgctacgccaccatatcggccgcttcctgcatgtttccaccgacgaggtgtacgggtcgatcgacaccggctcgtgggccgagggccatccgctggcgcccaactcgccgtacgccgcgagcaaagccgggtccgacctcctcgctctggcctaccaccagacgcacgggatggacgtcgtggtgacccgctgctcgaacaactacgggccccggcaattcccggagaaaatgattccgctgttcgtcaccaggctgctcgacgggctcgacgtaccggtctacggcgacggccgcaacatccgcgactggctccacgtcagcgaccattgccgcggtctcgccctggccctgggtgccggccgggcaggcgaggtctatcacatcggcggtgggtgggaggcgacgaatctcgaattgaccgagatcctcctcgaggcgtgcggcgccccggcttcgcgcatatctttcgtgaccgatcgcaaaggtcacgaccggcgctattctctcgactattcgaaaatcgccggggaactcggttaccggccgcgggtcgatttcaccgacggcatcgcggaaacggtcgcgtggtatcgcgccaaccgttcctggtggacctga

SEQ ID NO: 7453 - DNA, 1980 bp, Actinoplanes utahensis
gtggcggctggcgccctcgggtgcggcggccatccggctggccgcggcggtcggtgccgacgggatccagctcgacttcggcggcccgggccgtggcgtgctggtggacggcccgggccgtgccgggcagctgcgggcggtcgccgacgaggcgggagtggacctgctcgcgctggccggcaacctgctcaacgacatcgggctcacgtcgcagccggcggtggtccagccggtgctggcccggctggccgacacggcgaccgagctcggggtgccgctgctcatcgtgcccagcttccggcgcagcgcgatcaccgacgcgatgtccttcacccgcacagcagccgccctgcgctgggccgtgtcgctggccgaggcccggggaatcgtgctggccagcgagaacgtcctgcccccggcgcgggcccggcagctggtcgaggaggtcggctcaccggctttccggctgctgctggacaccttcaacccggtccggtacggactcgacccggcctggctggccaccgagctccggccgtggtgggccgaccagatccacctcaaggacggcccgccggacaccgggccgtcgccgctgctcggtgcgggacagggcggggtgcggcgcaccctgaccgcgctcagggggagccccgcaccggtacgggccctggtgctggagaacgactaccgcgacggccacggtgcgcggctgcgagcggacctggagtgggcccgccgggccgcggtgaacgcgagagaatccgagaaagggaagctgacgtgagtggtgtcgagacggtaggggtgcacgcggatgcgcaccgcgactcgtggcaggtgcgggcccagaagcagatcacctacgaggtgcgcttccgggacgacgtgttcgggctggactccaccgacctgctggaggccggggcggacggggccggttcacggcggcggttcgtggtggtggacagcgccgtcgacgccttgtacgggtcccggatccgggagtacttcacccatcacggcatcgatcattcgatcctggtgatgcgggtgggcgagacggtcaaggacttcgacacggcgggccgcatcgtcgccgcgatggacgccttcggactggcccgccgccgggagccgatgatcgtcgtcggtggtggggtgctgatggacgtggccggtctggtggccagcctctaccggcgcggcacgccgttcctgcgggtgccgacgacactggtcggactgatcgacgcgggtgtcggcgcgaagaccggggtcaacttcaacggccacaagaaccggctgggtacgtacgccccggctgatctgaccctgctggaccgccgcttcctggccaccctggaccggcgccacctcagcaacgggctcgccgagatgctcaagatcgcgctgatcaaggatgccgagctgttccagctgctggagcggcacgggcgggtcctgatcgaggaacggttccagggccgtaccggaaccggtgaccgggccgccgtccgggccctgcgcgcggccacccatggcatgctggaggaactcggccccaatctgtgggagagccggctggaacgcagtgtcgactacgggcacacgttcagcccgaccatcgagatgcgcgcgctgccggctctgctgcacggcgaggccgtgtgtgtggacatggcgctgaccacggtgctggcgtaccggcggggtctgctcgacgtcgcgcagcgggaccggatcttcgcggtgatgaccgccctgggcctgccgacctggcatccgctgctcacgccggaggtgctggaggcggcgttgcaggacaccgtccggcaccgggacgggtggcagcggctgccactgccggtggggatcgggggtgtcacgttcgtcaacgacgtgacggccgccgagctgcaggccgccgcgctgatgcagcaccggctcgccgaggacgccctgctgctgcgcgcctag

SEQ ID NO: 7454 - DNA, 756 bp, Actinoplanes utahensis
atgagcgggactctggtgggccgccgcgccctggtggtgggcggaaccacgggcatcggccggggcatcgccgacgcgtgggccgcggccggcgccgaggtgaccgtctgtggccgcagcgagccggccggcgatggcgccgccgggttgcactgggagccgctcgacctgacccggaccggggaggccggtgcgcgcctggaacggatcgccggtgaccgggtcgatctggcctgcttcgccgcggtctcctacggggcccggcgcgccgtcttcgaggacgtggcggtggacgaatggcgtacccagctggacatcaacgtgcacggcctgtggctcaccctgcgggcggcactgccggggctgcgtgccgcccggcccggcctgttcgtgggcgtctcgtccgaggtggtctacaacgccgggcccggccgctccgggtacaccgcctccaaggcggccgcgaaggcgctgctggagtcggtggcccaggaggaggacgagagccgggtccggatcgtgcaggtgctgccggccgggatggtcgatactccgagcatccggcgccgtcgcccggccggcttcgactacagcgactacatggtgcccgccgatttcgcgcgcaacgcgctggaactcgccgccacggccggcgccggccaccacggggacagcctggtggtcgacaggggcggcgactggtggtcggtgcgcgagcggatgccggtgtcgcagagccggccggtgcggacgtga

SEQ ID NO: 7455 - DNA, 1101 bp, Actinoplanes utahensis
atgagccggcaccgcgcgatcgtgcgcaccggcaccggcgtggtggtcgccgacgtcccgaccccggtgccggggccgggagagctgttggtcggcaccgagtgggcgggactgtgcggcaccgacatccagatgctgcgcggcctgcgcgacgatcccgaaccgatcatcggccacgaggggatcgcccgggtgatcgcggccggcgacggcgtgcccggcacgctgcggccggggaccctggtggcggtcaacccgacccaccgggacgatccgtcgttcctgctcgggcacaacgttcccggcctgctgcaggaacggacgctgctgccggccaccgcggtctccggtggcttggtgctcccgctgccggacggcaccgacgtcacgctgggcccgctgctggaaccgctggccgtggtcagctatgcgctgagccagctcggcgccgtccgcccggccaccctggtgatcgtcggcgacggaacggtgggtcacctggccgcccgggctgcggtgacctggctggcggagcggccccgggtggtgctggtgcaccacacggcagcggggcgggacttcagcgcggccgggccgcatccggcggacgttctgctcaccaccggcgagctggcgggcagaccgctgccgggaccggtggccgccctgctggcgaccccacgggacgcgactgtcgaggccctggaggcggtcctggccgcggccggcgccgatgtgctgatcgacgtgctgggcggcctgcccccgggcgcgcgatcggcgatgctgcccggtgtcgatctcaccgccgtgcgggcggccaactgcggcggcttcccggaaccggctctggtcaccaccacctccggcggaacccggctcttcgggcatcgcggggtgggcaacgcgcacctgcgggcggcggccggcgagctggcccgcgacccggaccggtaccgggatctcgtcacccatcgcagcgatctggccggcgcggcccggatcatgaccgcgctccggagcggccgggaccggatcatcgacggccgccgactggtgaagctcgcgatccaggtcaatgtcagagaggatcatcgatga

SEQ ID NO: 7456 - DNA, 1143 bp, Actinoplanes utahensis
gtgcaccatccccgccacccgggccggcgccatcgaccgggccgcgctgctgcggccggcggcgtgaagcggccaccgcaccacccggtcacggtggccgacgtgggcggcacccacctgcgctgggcacggtggtcaccggacggcggactgggcgaagtgcacaccacgccgtctccggggcacgcccggcggcccggcgccggtgccgccgacctgcaggcggaactgatccgcgagctggcgtcgcgggtcgagccgggtgcgcgggccggtgtctcgctcggcgcggccatggaccaccacagtggtacggcgtacgcctccgcgccgttgtggggtccgcaggtcagcccgttcgacgtgccggccgccctgcgcgccgcccggccggacgtgcactggaccgtggtcaacgacgtcacggcggggctgctgcacctggccgagatggttcgcgacgccggcgtccgcaaggcgtgcctggtcacgatcagcaccggcatcgcctgccggacgatggacctgcgcaccggcggtatcccggtcgacgcggccggcctccagggcgagatcggtcacctgccggcgaccgtgctggccgacggggtgccggtggtgacccgctgcgactgcggtgagccggggcacgtggcggcgtcctcgtccgggccgggcattcgacgggtcgcggccgtcctggcccggcgtgacccggccacctgggcgggctccgggccgaccacccggatgatggcgggctcgggcttcgaggacgcgttccgggccgctctggacgacggcgatccggtcgcggcggacctgctgacggcggtgaccgccccgatcgcggacctgctgcggaccgccctctgcctggacccggaactcgacctgatcgcgctgaccggtggagtcgcccacgggctggaaccgcactactcggcggcggtgcacgaccacctgcggcgccgggggctctacctgacctccgagcgggagccggactggttgaccgggcggatccgggtcgtcccgccggcgacggccgatccgttggtcggcgccggtctggccgcactggcggcggggccggtcccggcgtactccggtggtggccgggaagcgttggtcgggcgatga

SEQ ID NO: 7457 - DNA, 900 bp, Actinoplanes utahensis
atgtcggagcacaccgacgtcctcgtcctcggcggcgccggcgtcgacaccatcgcctacgtgcccgaactgccgctgccgttccaggacagctacgtggtcgcggccatcgaaccacgagccgggcagaccggcgacaacgtcgctctcggcctgcacacgctgggcctgcgcacgatgcacgtcgacgtgctcggcgacgacccggaaggtgacctggtccgggccttccacacccggcacggtctgccgttcgccgccctgcccacggccgccggcaccaagcgggcggtgaacctggtcggcccggacggccgccggctgtcgctgtgggacggcagccgggaagccgaggaggaccgctacccggccgccctgatcgccgcgcacaccgcccacgcccggcacgtgcacgtctgcatcaccccgcccgggcagcacgtgttcggccagctcaacgacctgccggtcaccgtctccaccgacctgcacaattgggacggcgcctacgagggcttcgaggtctacgccttcaacgccgacctggtgttcctgtcggcgaccgcgctgaccgacgtggccgcgacgatgcgccgcgtcatcgaccggggccgggcccggctggtggtggccaccgacggcgcccacggcggatcggtgctggtgcgcggcgagacggaggtccggcggtacgcggcggtggcccccgaggcgccggtggtggactccaacggcgccggtgacgcgttcgtgtccggcttcctcttcgggcacctggccggcgaaccgctggagacctgcctgcgctacggcgcgatcgccggcgcctacgcgtgcaccatccccgccacccgggccggcgccatcgaccgggccgcgctgctgcggccggcggcgtga

SEQ ID NO: 7458 - DNA, 2097 bp, Actinoplanes utahensis
atgaccaccacgacggatgccgcgctgatcgagctggccggacggtacggggtgtcggtcgactggaccaccgaccgcggcgagccgcggacggtgccggccgacacgatccagcggatcctggctgtgctcggtgtggacgcgagctccggccccgcgatcgccgccgcgctgcgtgccgcggacgacgacgcccggcaccggctgctgccgtcctgcgtggtggtgcggcagggggaaccggccaggggagtccacccggtggccggggccgcctatgtggtggcgaccgaggacggtggccggcacgagacggccgacccgcgcaacgacctcggccgccttccgatcggataccacacgctgcgcgtacgggtgggcgaccggtccgccgccgcgccggtgatcgtggctccggccgtcctcggcaccccggaccggcggcactgggggatgctggcgcagatctactccgtactgtccgaacggtcctgggggatgggcgacctcggcgacctggccgacctgacccgctggtcggcccggctcggggcgtcgttcgtgctggtcaatccgatgcacgcctacgtgccggaccgcctggccgaccccacgccctaccggccgggcagccggcggttcgccgacccgatgtatctgcggctggccgacgtcgccgagtacgcgaccgcggaaccggcggtgcgggccgaactcgaccgggccgcccgtcagggacacgaactgaccgccgaggtgctgcaccggaacgcgctgatcgaccgggctcgggtgtggccggtcaagcggaacgccctggagcggctctaccgggcaccccgcacggccgggcggtccgcggctctggccgccttcaccgcccgcgagggccggggtctcgaggactacgccacctggtgtgcgctggccgaggtgtacggcacccgctggcgttcctggccggccgctctgcaatccccgcacggcccggcggtcgccgccgcccgccgcgagctggtcgaccggatcgatttccaccgctggctggcctggctcgtcgacgagcagatggccgcggcccaggcggccgccgtcgggtccggcatggcgatcggcgtgatccacgacttggccgtcggcgtcgacccggagggtgccgacgcgtgggcggtgcaggatcatctggccggcggtgtcacggtgggctgcccggccgacgacttcaacccgctcgggcaggactgggggttgccgccgtggcgcccggacaccctggccgaagccggttaccggccgttcgccgacgtgatccgcggcaccctgcggcacagcggggcgctgcggctggaccacattctcggcctgttccggctctggtggatcccggccgggagcggcgcccgcgacggtgcctacgtccgctacgaccacgaggccatgctcggggtgctggccgtcgaggcgttccgggccggggcgatgatcatcggcgaggatctgggcaccgtccatccggcggtccgtgccgaactcgccgaccggggcatcctcggcacgtccgtgctgcgcttcgagtaccagggcggatcggagaaccgcagcgggccgctgccggccgaccagtggcgtgccggctgcctggccaccctcaccacccacgacctgccgagtacggccgcctggctcagcggtgagcacgtggacctgcaggaccggctgggcctgctgaaccggccccgagccgaggtggccgccgacgcggcggccgaacgtgacggctggctggccgagttgcggcgcaccggtctgctggagcacgagaccgccgtaccggggatgagcgccgagtcgctggccctgcaccggttcctggcccggaccccggcccgcctggtcggagtgtggctgcccgacctggtcggcgaccggaggccgcagaacctgccgggcaccagcaccgagttcccgaactggcagctgccggtcgccgacgccgacggccggccggtggcgatggacgacctggcgtcctcggccggcgcccaagcggtcgccggcctgtacgccgcatcggccgagccggccaccacaccctga

SEQ ID NO: 7459 - DNA, 852 bp, Actinoplanes utahensis
atggacggcatcggcaccacacccccgcgcgaccaccgggtcgtcgcgaccgacctcgacggcaccctgctgcgctccgacctgaccgtgtccgcccggacccgcgcggcgctgcgcgacgcccgggcggccggcatgatccacctcgcggtgaccggccgcccggtgatcgacacccgccggctgctcgccgggctgggctacaccggcccggcggtctgcggtcagggcgcccaggtgtacgacttcggcaccgaccggctgctgctgagccgcagcctcgacaccgacctggtgcgcgagctggtgcgccggatcgcgcagcggaccggtccgctcgcgctggccgcggtgagcgccggcctgggcaccgagttcctggtcaccgccggtttcggtgccccctaccagcagcatcgctggcagctcgtcgacgagccggacctgtggcgtgcgccggtcgccaaggtgctgatccggcacccggaccacgacgacgacacgctcgcggcactcgccgacgaggtctgcggcgcggcgctgtcggtgatgcacgccggtccgggcctggtcgaactgctgcccggtgacaccagcaaacgcaccggcctggcctttctcgccgccgaactgggcttcaccggggccgacaccatcgccttcggggacatgcccaacgacctgccgatgttcgactgggccgggtacggcgtcgcgatggctaacggccacccccggctgcgcgaccgcgccgacgagatcactgtcagcaacgacgcggacggcgtggccgtggtgctcgaacgtctgcccgccgtccgggccggaaaccgaaaggcaagcctgcgatga

SEQ ID NO: 7460 - DNA, 2205 bp, Actinoplanes utahensis
gtgcacgtggtgagcttcgccttcgaagccctcgccttcgacgtagggatgatgcgcggcgggctcgccccgctggcctgggaactggcccgccactacgccgcccagggacaccgctcctcgatcgtcaccccggcgcacggccgcctgccgtacctcgccgagcggtacgacctggtcgaactcgactaccgggacgagcatgtcgttcccgtggtcccggaccccgacgtctgggcggggcagccccgcgaactgggcctgcccctggtcacccgggcccacctgctgcggcacgagggcgtcgacatctacctgctcagcgacgagtacctcgatctgctgccggagcggctctacccggccggcacgagtgagggcagcgacctggcgtacttcaaaccgctggtgttccaggtcggtgggctgcgcttcctgcagtcccggctggccggtgacgagcccgccgtcgtgcaggcctacgagccgtactaccactacctcctgcccccggtgctggccggcgacccgcggttccgggtgatgtccacggtggccagcagcatgccgatcgacctgggtgtgtaccggccccaggtggaccgcctgctcgagcacttcggcgccggcaccgacctggaccgctatgtggagagcccggtcgcggccggcgccgaccatcccgcggccacccgcgaggcggcgctgggcgcggcgatggccggatacctgccgacgacccggctctccagcgggcggcggcgggccgactacgtgggcctgttcgcgctgatcaccgaccactgcgacacggtggacttcctgaccccggggcagcggcggttctactcgacgttccgggacaccccgtacgaggcggcgttccggcggaccgcggtggcccgggtggtccgggagaacgcggcgaaacagttcgtcggcggctgtgcgctgccggagaactggctgcggcgggacccggccgaggtggaccgggcggcgtacctctccgggctcgggctggacccggcgctgccgaccttctaccacgtgggccggtactcgccgcaccacaagggtcaggtggagctcttccgggcggtcgagcggatcctcgccaccgacacccgggtcaacttcgtgctgcgctgcgccacctcggccggcggcggcggcgccaggatcggtgaccccgccttccaggcggtggccgaccggcaccccggccaggtgcggctcttctggaccatggccgacgaggacgaactgttcaccgaggcggtggcggcggacttcgggttgttcccgtccaagtacgaactggacaccttcctgaccgcccaggggcagctgtgcgcctgcggcgcggtgccgatcgggaccgcgcaggagtcgacccggcactaccggcaccagctggccaccgaccatccgctggccaccggattcgccctgccgcgctccttcaccccggacgacgaacgtctgaccggcgctctggtgcgtaccatgcgggaggcgctgcggatgtaccgcgacgaaccgggcgagtaccggcggctggccggcaacgccgccgaactcgcccgcaccttccgctacgccgaggtgtcccggcgacggctcgcccacttcgcgaagctgctcgacggcacgccgacagcggccgacccggagcacgtcatcgggtgcggctggttcgaccagttggacgccgcgcagtgggcggcccacctgccgcagatccggcgcgaagcgatccgcctcggtgacctggagacgctgcgccgctgcggcccggtcgacccgggcgcgctcggcgcactgtacgaggccgcgtaccggcgtgccgacttcgaccggtgcgtgcgggtcgcggaactgctgggcgaccggggcagcgaggcggtgtcgctgcgccggcgctgccgggtacggccgcacgagcagggctgggagatccagtaccgggcgccgggcgccgagcaggtggccctggtggtcggcggtaccgcccaccggatgcacggttcggccggccggttcagcacggtgctgcccacggtgccgatgccgtcaccggtgttcctgctgacgctggcctccggacggtacgcgtgggacgccccaccggccaccgcacacctcgccgacctcgccggtcagccgcacccggcgcagccggtcggggccgggggccgctga

SEQ ID NO: 7461 - DNA, 588 bp, Actinoplanes utahensis
atgaccggcgccgtccgggccgtgcgatcccgtgaggtgtaccgcaacccgtggatgagcgtgcgcgaggacgacatcgtgcacgccgacggctcgccgggcagctacggggtcgtcaccaaacccgattacgcgctgatcatcccgcgggacaacggcctgctgcacctggtggagcagtaccgctacccggtcggcgggcggttctgggagttcccgcagggctcgtggccggccgacgccgccggcggtgccgctgacctgctcgcccgtaccgagttggccgaggagaccgggctgcgggccggccggctgacaccgctggggcgcatccacgtcgcgtacggctacgccagccagggctgtcacgtcttcctggccgaacagctcacagcggggcgctctcagcgggagcgcaccgagtccgacatgcgccagcgtgccgtggacgccgccggctgggccgacctggtcggctccggccggatcaccgacgccgcgacgctcgcggcctacaccctgctgcggatgtacgacagcggaacgcgacagcccatgccggaaggagccgaatcgtgcacgtggtga

SEQ ID NO: 7462 - DNA, 1092 bp, Actinoplanes utahensis
atgagcacgggcgtacgggcggtgctgctcgccggtggtgagggacggcggatgggagcgctcggcgcgggccggctcaagccgctggtgccgttcgggggcgcggcccggctgatcgacttcagtctggccaatgcccgcgactccggcctggaccaggtgctgctgctgtcgcagtaccaggagcggcagctgatggacgacctgcggcgcacctggtggcagccggggttccgggtgcacttcgggccgtacgaccgggcctacaccgacgggatcccggtggagtacgagccgccgaccgggccaccggagcggggcaccgcggacgcgctgatccgcaaggccccctacctgttcgggccggatgtcaccgaggtgctggtgcagcacgccgatcacgtgtaccgcttcgactaccggccgatgatcgccgagcaccgcgcgtccggtgccgcgttgaccgtgtcctaccagcggatcgaccgccggtacgtgcacctgttcgggatggtcgagttcgacgaccgtaaccgtctggtctcgttcgtggagaagcccgccgaaccgaccagcgacctggtgttcgccgcgttctgcgtgttcgacgccgcggtgctgcaccgctacctggaactgctggacggcaccgactggcagcacgacatcagccgcgacgtcatcccggcgatgctggccgccggcgagcacatccgcggctgcccggtgcccggctactgggccgacatcggcaccgtcgagcgctatcacgaggcccacctgtcgctggtgggcacaccgccgtcgctggccgtcgacgccatgccgtggaccgtggcgccccggaccgcccgggcactggtgacctcggccgacggtgtgcggcacagtgtcgtaccggcggacctggtcaaccacggcaccgtcgagcgcagcgtgctcttcccggcggcgcggatcgggcccggcgcgacggtgcgcgacagtgtgctgctgcccggagcggtggtgccggccggcgcggagatcgacggcgccgtggtgctcgaggacggcaccgtccagcaggtcaccaccggagcccggcgatga

SEQ ID NO: 7463 - DNA, 2130 bp, Actinoplanes utahensis
atgcacatcatcgagacgtacttcgaatgcggcggcttcgaccaccggttcatccagggcggcacctcggtctatctctggcagctgtcgcgtggcctggccgacctgggacaccgggtctccatcgtcacaccggcgcacggccgcctggacgatctgcgccggctgcacgaggtcgaggacctgcccggcaccgacgagtacgaactgccgctggtgctcgacccgcgcgtgtggggcgaacggttcccggcccagatggacatcgccctgcggaccaccgcgcatcggatccggctggcgggcgtggacctgtacttcctctccaacgaactgctcgatcagttgccggaccggttctatcccccgtacgagagcaagggggttgatctggtcttcttcaagccgctcgcctatcaggtggcggccatccggttcatcaggtcgcacttcggtgaccagcgcgcgatcgtgcacgcacacgagccgttctaccactacctgatgccggccgccttcgccgcggacccggccaaacacgtggtcagcacggtgcagagcaacatgccgatcaacaagtcggtgtaccgggccgaggtggcgcggctgctcggcttcctcggcgccccgaacgcgctgcccgccgacgatccggccggcagccgttcgccgcacaccgtggcgatgagccagtaccagcagctgacccacctgcactacgaatacccgccggaccacgtgcgggtctacgacctggtggccgagcacgccgaccggatcgacttcctgtcgccggggcaccgcgactactacacctgcttcgccgacaccccgttcgcgcagctgttcgccaccctgccggtgtcgcggacggtacggcgcaacgcggacaagacgttcgtcggcggctgcgccgtcggtgacgagtgggtgaccggcgagctgcccccggtcgaccgggagaaggtgctggccgggctcggcctggacccggacctgccggccttctaccacaacgcccggtacgcggtcaaccacaaggggcaggtcgagctgatccgggccgtcgaccgggtgctgagcggcggcgtgcgggccagcttcatcgtgcgctgcctcagcgacgccgggatcgccgacccgctcttccacgaggtggtggcccgccacccgggccgggtgaatctggagtggcaccgggtgccggaggaccagctgcgggagtacgcccgagccgcggacttctgtctcttcccgtccaagttcgagatggacaccttcctgatcgcccagggtgaggcgatggctgccggtgcggtaccgatcgccaccgcccagctggggatggcgcacttcggtcacgtcgccgacccgctgaccgggccggacgcggcgacggccaccggattcgccgtcaaccgctcgttcgccgaggacgatccgctgctggtccagggcctgaccgagcagatccgccgggccgtcacgctctggaacgagcagcccggccagtaccgccggttgtccgccaacgccgtcgcccgggcccgcgagttcacctggcggcgggcggcccaggcgcacgaggccgcgttcgccggggtgtgggccggccgtaccccccgcctgccggtcggtgacctgctgcggttcggctggttcgacgagctgcccgcggacgcctggacgctgcaccgcgacgagatcgcggaggtggccctggcccacggcgacgccgacgcctacctgcgctgccggcccgacgacctcgacgccctggcggcactcttcgagcgggcctgggcccgggccgacttcccggcctgcgcgcggaccgtagagctggccgaggagcaccggcaggagcgggtgccgcagtggcgggcccggctcgccggccgcggccgcatcgaccgcgacggtcggctgcactaccgtccgccgtccgccgaacgggtcgaactggtcttgcccgacctggccgaacccctgcgcggaacggtcaccgtgaccgcgatggctccgaccggcgacaccttcaccggacagctgccggccggaacccggcgtgccgacctgctgctcaccctcagtgacgggcgcaccgtctgggacgaggtgacggcatga

SEQ ID NO: 7464 - DNA, 1479 bp, Actinoplanes utahensis
atgacaccccggccggtcagcacgatcgacgtgagcctcgccagcctgctgcgcaccgccgactggccgcacgaggatctgcgcggtcccggcggggtgcggatcctcgacgaggcgatcctcggcccgtcccggttgctgatcgtcgcggccgaacggaaccccgagagccgctacttcgtcgccgttctgcgccacgatccgtcccgggaggccgtcggcgacgccgcccacgaccgggccgtggtccaggcgatgcgcgagcggctggcactacccaccgcagccggccatctgatcgtcttcgacggtgaccccgcgccgttccgagccacccggccgttcgaccccgggtggtcgaccaacgccctgtcgctggccgatctggacgggacactgcacatccacaaggcgtaccggctggtgtcggccgccacccgggaaccgcatctgctgcggctgatgcatcgcggcggccgtacccagcgatgggccggcgactaccactacgtggagcagccctccgggcgccgctacccgctgggcctgctctacgcctatgccgaaggcgacagcctcgacctgccgctgcggcacagcatccggtcgatgtggccggcgctgctgggcggcaccgaaccggccggcgcggtgacggccgcgcagcggtccatcgcgggcgagctgcccggcgtcggccggttcctccgcgacttccataccgaactggcgcagcggctggaacccgcgccgacgttcccggtgaacgcctacctgcgggagaccgccgagcgggtggcggcgctggggtgccggatcagcgccgacgaacgttacccccggccggtgcgcgaggcggtcgtcgccgccctgaccggcgaactggaccaggccaccaccagcgcggtgcgggtgccgtggccggccggcccgtcgcacggcgacctgcacctgtcgcacatcctgcgccggcagacaccggacggctggcggctgtgtgtgatcgacctgtccacgcccgcccccgacccggccgacccgctcggcgccgcccagtcaccgtggcaggacctggtggcgctgctgcgcgggctggagatcttcaccgccgacgagttcgtgcaccaggcggccctgcggctcggcgccgaccaggacgacacctgccggaccgtgctgctgatcagtgccgggcagaccccggacacgccgggttggaccgggtcccggctcaccgcgctgcggcggatgcacgacgcggcgtcggtgtgggccggacaggtccgccggatgctgctgtccggttatgccgacggcggcgaggcggccgaggagcaccccgcctggcggatcttccggctccgccgtctgttgcacgaactggactacgcgtacgcccacgaccagcactaccacgcggcgatcaaccttcgacacgtcctccagacctaccggccgccggtcaccggggagagctga

SEQ ID NO: 7465 - DNA, 1350 bp, Actinoplanes utahensis
gtgttccgagccggttcgtttcgacaccggcgccgcgacccggcggcggttccggtgagcaggcaggccgacctgctcgcccgggagtcgcgtcacctggctccgggagcctccgaagaggcggcgctcggccggcgggtgttcgtcgagggccgcggcgcgaccctgcgcgacgccgacggtgtggaatacctcgacttcgccgccggtactttgacccagtcactcgggcactgccaccccgaggtggtggcccggctcaccgaacaggccgggaagctgtggaacgtccacgacttcgcgaccgccgaccgcgccgcgctctgcgaactgctcgccgaactgctgcccgaccacctcaccacgctcgccttcttctcgaccggcgccgaggtggtggaggcggcactgcggacggtccaggccgtcgccgaacccggccgcaaccgggtcggggcactgcggcacggcttccacggcaagacgatgggcgcccgcatgctggtgcactgggacgtgggggaccagtcgttcgccggcaacagcgtgctggggtacgccccgtactgctaccggtgcccgctggagctgagctatccgtcgtgcgaggtccgatgcgccaccctggtacgccggcacatcgccgagaaacccaacgtgagcgccctgttcttcgaaccggtgctgggcgcggccggcgtgatcgtgccgccaccgggctactgggagcagatcgcggccgcgtgccgggacaacggcgtactgctggtcgccgacgaggtgctcaccggcggcggccggaccggaacctttctggccagcgaggcgatcggggtcgccccggatctggtcacgttggccaagggcaccgcgtccggtttcccgttcgccgtgctcgccgggcgtgacgaggtgctgcggcatccccgggccgggctcgccggatcgaccgcctccacctacgccggcaacccgctcgggatcgccgccgcccacgccaccctctcggtgatctcccgcgaccggctgatcgagcaggtccgggacctcggcgcggtgctggccgaccgcctggccgagatgcacgaccggcacccgcacctgggcgacgtgcgcggcatcggcctgctgcacgggctcgagttcgtgcacgaccggcagagccggcggccggccccggagatcgcccggcgggtctacaccaccgccctcgacgccggtctgcgcaccgccatcggcgggcacatcatccggctcgcgccgccgttcgtcatcgacgagaccgagctgctgcgcggcctggacctgctggaccgggcgattaccgaggccgggcgggtgacggcatga

SEQ ID NO: 7466 - DNA, 1074 bp, Actinoplanes utahensis
atgcccgggtacgcccggcatgcccggccggacggcacgaccggcatgatcgtcgccgagcacctcagcaagcacttcaagcgctaccggcgcgagccgggtctgcggggcagcctgcgaaccatgttctcggcccggtacgacgtggtccgggccgtcgacgacatcagcttcgaggtcccgtccggtgtcaagatcgcctacatcggggcgaacggcgcgggcaagtccaccacgatcaaactcctgaccggcatcatgcgcccgaccaccgggcgggtccgggtcgacggcctcgacccgcaccggcagcgcacccgggtcgccggccggatcggcgtggtcttcggccagcgcagccagctctggtgggatctgccggtcctcgactcgttccgcatcctgcggcacgtctacgaggtgccgcaggcggtgtacgaccggaacatgcgcctgttccgggaccggctggacctcggcgccctcggcaacaccccggtccgccagctgagcctgggccagcgcatgcgggccgagatcgccgcctcgctgctgcacgacccggccgtggtcttcctcgacgaacccaccatcggcctggacctggtcctcaagcaggcggtccgggacctgatcaaccacatccacgccgaactgggcaccacggtcatgctgaccagccacgacatcggcgacatcaccagcatctgcgatcaggcgctggtcgtggaccgcgggacgatcgtccaccagggaacgatgcgggacctgctgcggtcggtggacacccgggcggtcaccttcgagtacgccgccggcagcgtctccgaggccgccgcgctgcgcatcatcaccgaaggactgcccgaggtggacgccactccggccgagtccggccggatccgggtcgagttcccggtggaccgctggtcggcccggcaggtgatcgccttcctgctggaccggttcgacctgagcgacgtgctggtgccggacgccgatctggagacactgctgcgccgcatctacgccgggtcgcgcccggagccggtcaccgccggggacggcgcatga

SEQ ID NO: 7467 - DNA, 804 bp, Actinoplanes utahensis
atgatccgcgccgcgcgccggtacgcgccgttcgccctcgccggactgcacgccgtcacccgttaccgctcgaccatcgtcctgagcgcactcacggcggctgcggccacctcgttgcaggtgttcctgtggcgagccgtctacgccggcggaccggcaccggccggcctcccgttcgcacagctcacctcgtacatcgtgctcgcgcaggtgctcgggatgctgcacaccaaccggatcgacgagatgatcgccggcgaggtgtaccgcggggacatcgcggtctccctggtacgcccggcgaactacgcgctcagctgtctggcggtgaacctgccgaccgccgcgctcagtgcgctgctggccggcgccccggtgctcgccggtttcgcgatgttcgcgtcgctgcccgctcccccgcccgccaacctgctgctgttcgccgtcgcgctgctgctctcggtgatcctcgccttcgagatcaacttcctggtgggtctcgccgccttcgtcacgaccaacacctggggcatccgtacgatcaagaacgcgctcgtcgccttcctggccggccaggtcgtcccgctcgcgctgttcccggacggcgtggcccggctgctgcggctgctgccgttccagggcctgatcgacagcccgttgcggctgctgctcggcggctactccggcggttccggcgccgctgccatcctcggtgtccaggcgctctgggcggtactgctgtacggcgtgctggccctggcctggaaccggtcgctgcgcagggtggaggtgctcggcggatga

SEQ ID NO: 7468 - DNA, 804 bp, Actinoplanes utahensis
atgaccgtctccacggcgcgccggtacctgcgcctcacggcggtgctgtgcggggcgagcctgcaccggctcaccgcgtaccggatggacttcctcatcggggcggccagcttcgtcatccggatcgcctgccagatcgccctgatcggggtgatcttccagtacgttccggcgctcggcggctggacccgccagcaggcgctgttcctgctcgggttctccctgctgccccgcgggctggaccggctcttcaccgaccagctgtggatcctggcctggcagctggtgcgcaccggcgacttcttccgctacctgatccggccggtgaacccgttctacgcgctgctgtccgaacggttcctctatccggacgggttcggggagctggccaccggcatcgccatcgtggtcaccgcggccgggacgatggacctgcacctgaccgtggcacagtggctgctgttgctgcccctggtcctcggcggcgccctgatccacaccttcctcaaggcgttcctggcctccctgtcgttctggatgaccagcagcctcaacgtgatggtggcggtcaaccagctcagcgagttcaccgcgtacccgctcaacctctaccacccggtgctgcgcggggtgctcacctgggtgctgccgttcgcgttcaccgcctacctaccggtgcgctacctgctcaccggggacgccgggccgctgctgtggatgctgccggtcaccacgctcaccgtcctgctggggtacggcaccttccggctcgggctgcggcgctacgagatgcccggcagctga

SEQ ID NO: 7469 - DNA, 3228 bp, Actinoplanes utahensis
ttggttctgtcccgtcatcgcgacgtcatgcgtcgcctgtccgccgtgctggcgctcggcctggtggtgcccctgctgctggcgccaccgtggcgggcgtcggccgcgccggccggcgcggccgagccgagcgccgcggccctggcccattggggagccgaccggccggcacccgccgaacagttctacttcgtcctgcccgaccggttcgccgacgggaacccgaagaacgacaccggcggtctctccggcgaccggctctccaccgggtacgaccccaccgacaagggcttctaccacggtggggacatccagggggtgatcgacaagctggactacatccaggggctcggcaccaccgccatctggctggccccggtcttcaagaatcggccggtgcaggggaccggcgccgccgcctcggccggctaccacggttactgggtcaccgacttcacccaggtcgacccgcacttcggcaccaacgccgacctcaagcgcctggtgcagctggcacaccggcggggcctgaagatctacctggacatcatcgtcaaccacaccgccgacgtcatccagaacgagggcggcaagagcacgtacgtggacaaggccgacgccccgtaccgggacagccggggccggccgttcgaggaccacaactacgccgacggctcgcggccgttcccgaaggtgaacctgcagtcgttcccgtacacgccggtcttcgccagccccgccgacgccacggcgaaggtcccggcctggctgaacgacccgaccatgtaccacaaccgcggcaattcgctgttcagtggggagaacagcgagtacggcgaccacaccggcctcgacgacctgtggaccgagcggcccgaagtggtccgcggcatgaccgagatctacgccgactggatccgggacgccgacatcgacggctaccggatggacaccgtcaagcacagcaacatcgagttctggcagcagttcaacccggccatccagcaggccgcgcgacgggccggcaaacccggcttcttcatgttcggcgaggtcttcagcgccgaccaggaggtggagagccgatacgtccggcagggcggcctggccgcgtccctggacttctccttccagtcggcggcccgcacgttcgtctccggtgacacgccggccaccgcgctggccgacctttaccgacacgacgacctctacaccgcccgcgacaccggggccggccggatgcccaccttcctcggcaaccacgacatcggccggatcggctcgttcatcaccaccggcggcgccgaccggaccagttacctgcggcgcgaccagctggcccacgagctgatgttcctcacccgcgggcagccggtggtctactccggcgacgagcagggcttcaccgggccgggcggggacaaagacgcccggcaggacatgttcgccagccggacgccggactacctcgacgacgacctgatcggcaccgaccggacccacgcgagcgacaactacgacaccgggcacccgctctaccgcaccatcgccgagctgggcgcgctgcgtaaggcgaacccggcgctacgcgacggcgtgcagatcacccggtacgcggcgcccggcgccggcatcttcgcgttctcccgggtcgacccggtccgacgccaggaatacctggtcgcggtcaacaacgccaccaccgcacagacggccaccgtcggcaccgccacgccgggcagcaccttcaccggcgtctaccgcgcgggcggtaccgccgccaccggctccgacggcaagctcacggtgaccgtgcccgccctgtccgcggtggtctaccggggcggcagccccatcgcggtcccgtcggcccggcccaccgtgcggatcagcgcaccggccgcgggggcgtccgtgccgtcgcgggccgatctggtcgccgacgtcaccggcgatccgctggccacggtgaccttcgcggcgcaggccggatccggcccgtggaccgtgatcggcaccgcgcggcaggccccgtaccaggttcaccacgacctgaccggtctggccggcggggtcaccgtgaggtacaaggcggtggtccgggacggtcgcggacgtaccgcgagctccacctcgtcgctgcgggtcggcaccccggacacccacgtcgcgccggagcggatggtggtgcactaccagcggcccgccggtgactacggcgcctggcggttgtacgccttcggcgacatcgacgcgtccgcccagaccacctacccggacgggcagccgttcgccggccaggacgagtacggcgcgttcgcctgggtgagactcaagcccggcgccaagaacgccggtttcgtcgtggtggacggcaacggcgtcaaggacgtccagcaggaccggttcgtcgacccgggccgacaaccggagatctggctgaaagcgggcgacgcgacggtgtacccgtcccggcaggacgccaccggccggcccgacccgcaaccggacccgaagaccgccgtcctgcactaccggcgcgccgacggcgactacaccggatggggcctgcacgtctgggacggcgcggcccagcccaccgagtggacggcgccgctggccccgtccgggcgcgacgcctacggtgtcacgttccgggtgccgctcgccgacggcgccactggggtcagctacgtcctgcacgccggtgacaccaaggaccagccgaccgatcagcggatcgacttcgccgccggccgtgaggtgtggctgctcgacggggtggccgagcgcctgctgccggtgacccgccggaccgcggccggcgccgggatcgatgtgacgacctcgcgcgccgggtgggccagccgggacacggtggtctggaacaccggtgtgggcagcaccttgcagccggtcggcggtggcaccgacgggcgggtgtacgagctggcctacgccccggtcggggggatcaccgtggtcggcggggagctggcgggggcgtaccggaccctgcggctcaccgcgcagcgtgacggcctgaccgagagccagcgagtccggttcccgaagctgtggcggtacggcgccttccgcgtcgccgacgccgaccggcaccgtctcgccacggcgttgcgcggtcaggtggtgatcaccgaacgggacgcctcgggcaagctgctcgcggccaccggtgtgggcgccgccggtgacctcaccggctga

SEQ ID NO: 7470 - DNA, 1272 bp, Actinoplanes utahensis
gtgatccagaggaacaggcaggtgtgtgacgcccggaacgagtctgtcgcgctcatctcccgtgtagtggccgagcgtgccgttgagccgctgttccagcccatcgtcgacctcgatacccgccggctggtgggggcggaggcgcttgcgcgtgggccggcaggatccccgctggagttcccggaccagttgttcgaggccgctgcgcgggttgacctggtgccggagctggaccagttgtgcgccgcccgggcacatgagatcgctcaggcccccggagcggtggtgccaccgctggtgttcatcaacaaggaacccgccggggcggatcggccgctcagcgaggacctgcgattacggctcgcctcgatctcgacctaccgatacgtgctggagttcaccgagcgtgccctggcggcgcacccgtcggcgctgcttgaggtcgccgcccgggcgcaccgcaccggcggtgcgctggcgctcgacgatgttggtgcggaccggctgtcgctggccttcctgccgctgttggagccggaggtcgtcaagctcgacatgcacctgctgcgcgacccgtactgcgcacacaccatcgagacgaccgcgctggtgtgcggatacgcccagcggaccggtgcgatggtgatcgccgagggcatcgagacggagcaggatctccaggtggcacgcgccttgggcgccggctgggggcagggatggttgttcgcccggcctgggccgctgtccgccgtgcgggattggccggtcgacccgtcggctcggttgcgtgctccccgccctgagttgtacgtacccggtgccagcccgttcgatatggcctcggctcgccaccgcgcccggaccggggaccggcatctcctcgacgggctcaccgcacacgtcttgaggcaattgccgttcgccggcccgtacggcgtggtcctgggcgcgtatccggacctcgcgacgggacacggctggattccgcggctggccgacgcggcatcgaccgcggcgctggtgggtgtctccggtcccggcccgggcctgccagctccttcgccgattcgcacgtcgatcaccgatggactgagcggggtggagtcggaggcggcgctggtgatcgtggacccgcatgtcaccgtggctctgtgcacgcgacggcgccacgacgatgccatcgacttcgtgctgaccttcgatcccgacgaggttcatgcggtggcgcgaacgctgctgcaccggctcggcccgcaggatctacccggttag

SEQ ID NO: 7471 - DNA, 1503 bp, Actinoplanes utahensis
atggcacctgacctgccccgccgcttggccagggcgacgctggccctggcgatgaccctgaccgccgccatcggaacattgttaacagcaacaacgccggcaacggccgccgccaccacgtccaacctggtggctccggcaccgtacggcgctgacccgtggatgggttactacaacggcaactactacctcgccgccacgacctggaacaaccaggtcgtggtcaagaaggcggcctccgtcacccagctgtcgggcgccgcctacagcgtcgtctacaccggtgccggctcaaccgtctgctgcaacgcctgggcgccggaactgcacctgctcgacggcccgaacggcaagcgctggtatctctactacaccgccggcaccgcggcgtgctgcgacgggcaacgctcggtagttctggagagcagcggcaccgacccgatgggtccctaccacttcgccgcgcagctgccggtgcagaacaacggctgggccatcgacggcagcgtcgccacgatcgccggcaaactgtatttcttctactcggcctgggtcggtgaccagcagagcctcttcatcgccccgatgagcaacccctggacgatcagcggcgccgctaccaggatcgccgcccccaccaacgcgtgggagacgtccggggccaaggtcaacgaagcgccacacatcctgcagcatggcggcaagaccttcctcaccttctccgccagctcctgcaccacgccggactacaagatcggcatgctgaccctcaccggcgccgacccgatgatcgccacttcctgggtcaagaagagcacagctctcttccagcgctccgacgccaacggcgtcttcgggcccggtcatcacgccttcttcacgtcgccggacggcaccgagacctggatggtctatcacgcgaacgactcggccacgcagggctgcgccggcacccgtaccgcccggatcaccaaggtgaactggaactccgacggcaccccgaacctgggcacgccggtcgcctcgggcaccaccatcacggcgccctccggggaccccggcggcaccgtcaccttcccggttgcgggcacccggtatcggctcgtcaaccagagcagtggcaaggtcctggacgccaccgactgcggcaccgccaacggcaccggcgtacggcagtggagctcgctgggcaacagctgccagcagtggagcttcacccgggtggccggcggctactacaccatcaccagtgtcaacagcggcaaggtgctcgactcggtcaactgcggtacggcggacggcgccggcatcgacctgtggacagcactcggcaacgcgtgccagcagtggagtgtcaccccggtcggtacccgctacctgatcgccaaccgcggcaacggcaaggtgctcgacgtggcggactgctccgccgcggacggcgcggccgtccgtcagtggactgccctcggcaacaactgccagagctggaacataacgccgtaa

SEQ ID NO: 7472 - DNA, 1566 bp, Actinoplanes utahensis
gtgcaaggacgcggagcggtacaccggtcagcgccgcgaggcgaccagcgcttcgtctgggccggtctgctggcggcgtgtgccaccagtgcgttgtggctggtcgtgcaggccctgaaccccggatggctaccgaacgttgcgtggatcccgggcggtgtcactctgctcctcggagcgtgggcggcctggcggatcgcccggcgcggtgcggcgtccgcggacggccgacggttctggacccagatcgccataggcacagctctggtgactccgggcgcctgcctcatcaacgcggtcaacaccggggcgttgccggccgcggcggctgttctcgtcgtggcggtaagtttcatcgcagtcgcgctattgctgatgatcggggcattgctgcggcttcccgtcgctgaccgcgcccgcggtcaggcggtccgactcggcctcgacgccgccacgatcatggtagtggcggcgaccgtgttgtgggaataccaggtccgccccatgatcgggtcggacccgcaattgcgtacggtgatcggtcccctgctggtgtgcgccatctgcatgggcgccgtcctcgccgtggtcaagctcatgctcgccggcaccgacgcggtgtccgtccggtcgctgcaggcgttgggcctgctcgtcctgatcggggcactggcttcagcgctgaccagaatcctggaacacgacgcccgctggctgggcgttggtccgctgatcagcacggtggagggtgttctcgtcgtggtggcggccgggcaaccgccggccgcggccggtgctgcggcggatcgccgcagcaccttcagcgtcatgccgtacgtcgcggtcggcgtcatcgactcgctgctgctgatccacaccctgaacgggcgccagaacaccgcgatggtgatcgggtccgtcctggtgaccgtcgtggtcgtcggccggcagatcatcgcgttccgcgacaacacgcacctgatcgactcgctgcgtgagcaccgtcggatgctgcagcaccaggccacccatgacccgttgaccggcctggccaaccgggcgctgttctacgaggacgtgtcagcggcctgcgcgcagcacgatgcgacggtcctgctcctggacctggacggtttcaagccggtcaacgacaccttcggtcatgcggccggcgacgcgctgctggtcgaggtgggccggcgcctgagggacaccgccgcgcaagctcagcgagtggcacgcctaggcggggacgagttcgccgtgcttcttccgtcgtcagatcaggacacggcacggacggccgccgatcgcatcatcgcggcgctgcggccaccgatcgcgacccacggcgtcacgctacccgtgcgcatgagcatcgggatcgccgtgtataccgacggcgatgacgcggagtccctgatcaggcacgccgacctggcgatgtacgaggcgaaggccgccggcaagaaccggcacgccacctacaccgcggaggggcggcacagaatcgacgcggatgccgacggtcggctgtgcagccccctgtccgaggcttccgcctga

SEQ ID NO: 7473 - DNA, 1770 bp, Actinoplanes utahensis
atggcaatgcggatcgaggactacgcgatcgtcggtgacctgcacaccgcggcgctgatcggccgggacgggtcggtcgactggctgtgcctgccccgcttcgactcgccggcctgcttcgccgcgctgctcggcgacgagggtgccggccgctggcggatcgcgccggccggggcgggcgtcgccacccggcggcggtacgacgacgacacgctggtgctggagaccgaatgggacaccccggacggcaccgtgcgggtcaccgacttcatgccgccgcgcggcgaggccgccgacctggtccgggtggtcgagggggtcagcggctcggtgcggatgcgcgtcgacctgaccctgcgcttcgactacgggcacatcgtgccgctggtgcgacggacccggcacgggtggcacgcggtcgccgggccggacgcggtctggctgaccaccccggtgccgctgcacaaccacgacctgaccacgaccgccgagttcaccgtgacggccggcgagcgggtgccgttcgtgctcacctaccgcccgtcgcacgagccggcgccgcagagcgccgaaccggacgccgcgctgcgggacacccggcggttctggcaggagtggctcgggcgccacgactacgacgggccgtacgcggacgccgtacgccgcagcctgatgtttctgaaagctctcacctacgcccccacgggcgggatcgtcgcggcggcgaccacctcgctgccggaacaactcggcggcccgcgcaactgggactatcgctactgctggctgcgcgatgccacgttcacgctgcaggcgctgctcggcgccgggcacgtcagcgaggcccgagcgtggcgcgagtggctgctgcgcgcggtcgccggcgatcccgccgacctgcagatcatgtacgggctcgacggcacccgccggctgcccgagtacacgctggactggctgtccggatatcagggcgccggcccggtccggatcggcaacgcggcggccgggcagttccagctcgatgtctggggcgaggtcctcgacgggctgcacctgagccgcgagtccgggctggcggtcaaggacgacgcctgggacgtgcagcgctcgctgctcgacttcctggagagcaactggcagcacccggacaacgggttgtgggaggtcaggggaccgcgccggcatttcgtgcactccaaggtgatggcctgggccggcctcgaccgggcgatcaccgcggtcgagaagcacggccttccgggcccggcggaccgctggcgggccatccgcgacgcgatccacgccgaggtgtgcgaccgcggtttcgacccgtcccgcggtacgttcacccagtactacgggtcggcggggctcgatgcggcactgttgctgattccccaggtcggttttctgccgtacgacgacccgcgcgtgatcggcaccgtggaagcggtcatgaaggacctgtgccacgacgggttcgtgctgcgctaccgccccgaccaggacggggtggacggcctgcccggcaccgagggcgccttcctggcgtgcacgttctggctggtcgaggcgttgcacgggatcggccgcaccgtcgaggcgaccgagctgttcgagcggctcctgtcgttgcgcaacgacgtcgggatgctcgccgaggagtacgacccgggcagcggccgccacctgggcaacaccccgcaggcgttcagcctggtcggcctggtcaacgcggcccgccgcctgggccggccgcaggggtag

SEQ ID NO: 7474 - DNA, 573 bp, Actinoplanes utahensis
gtgcaaccttcttccgatgcggcgccgggcgccgcggtgcaggcgctgatgctggccagccgggcgttcgtcgggatcaccgtgcgggcgctggcggcggtgccgggcgaggtgacgctgccgcagttccgaacgctggtggtgctggccgcacggggcccgcagcgcagcatcgacatcgccgaggagctcggggtgaacccgtcgaccgggacccggatgctggaccggctgatcggcaagggcctggtgcgccggacccggtcggccaccgaccggcgggtggtgcggctacggctgaccccggacgggcagcggctggtcgagcagatcctggaccggcgccgtcgcgagctggagcggctcgtcgacgggaacccggggctgtggtcgccgccggtgatcgaggcgctgaccgcgttcgcgacagcggcgggggagcaggccgcggcgacggagcggtctgcggccggaaagccgcccgcggtcggagcgcaggctgccggcccgagcggcccggactggtggctgggctggaccccgggcgacgcggtaggcgagaacattgcataa

SEQ ID NO: 7475 - DNA, 951 bp, Actinoplanes utahensis
atgaccaggaccggagcggcggccggacaccacggctactaccacgaggcgctctgctacgcggccgacgacgagctgctcgcggtggtcgtgccgttcctgctcggcgggatcgcggccggcgagcccacgatgatcgcgctcggtgagcgcaccggtgagctggtgcggtccgcgctgccggccggcacaccggtcaccgtcctggccggtggggcgatgtacgcgcggccggcctccgcgatccgcgcctaccggaacctgttgaccgggcacgtcgccgccggcgcgacccagatccggatcatcggcgagctgtcgccggacaccttcgggccgctctgggactcctgggcgcggtacgagtcggcgatcaaccacgcgtacgacgacttcccgctgtggagcatgtgcgcctacgacctgcgggtcaccccggcgccggtgctcgccgacgtgctgcgcacccacccgcgcaccgcggccccgcacggcggccacgtgccgaacgccgactacaccgagccgatgctctatctcagcgaccgccgggtgccgccgccggacccgctgcagtgcgacgcgccggccgccgacctgtcatcgcccacccccggggaggcccggcaggcggtccgcgcggccggcaccggcgtggtcgggccggacgagctggaggacctcgtcgtctcggtcagcgaggcggtgtccaacgcgtaccggcacggccgccccccggtccggatgcggctgtggtgcgggcccggccggctcgtggtcagcgtgaccgacgccggctccggcccgaaggagccgttcgccggtctgctgccgaccggcgacggcgtcgacggcggcctgggcctgtggatcgcccaccagtcctgcgaccacgtcgccctctaccgcgacaccgacggtttcacgatccggctgaccaccggccggtga

SEQ ID NO: 7476 - DNA, 783 bp, Actinoplanes utahensis
gtggagcgcgccgggcacgagtgttggtcgtacgacgatcagcgggtgatcgacgcgtacgcgcgggaggtgatcctcgccgggatcgccggcggcgaacgggtctggtacgtcccgggccgggagtccgagctgaccgcgcaggcgctgccgggcggtgacgcggtccgggtggtgcacttcggcgatgcgtattcgggccaggccgtcctcgatccggtcgcccaggtgggcgcctacgcggcggcgaccgaggaggcgctggccgacgggttcaccgggctgtgcgtggtcgccgacgtcaccgagctggtccgcggcgacgagcagcgcgacgccttcgcccgctatgaatacctgatcgggcgctacatgcggaccgacgcgatgcgggcggtgtgcgcctacgaccggcgggtgctgggcgccgcggcggtcgccgagatcgcctgcctgcacgagtcgagcaccggggcgggcgtgccgttccagctgcatccggcgctgtcccgcgcggaggcggtgctcgacggggagctcgacccggccggcgaggagctgttcgccaccgcgctgcgacgcaccgacctggcgccggccggtggggagatcgtggtggacgccgccgggctgcggttcatcgaccatcgggcgctgctggtgctgcagcgctacgccgagtcgcgcgggctgaccgcggtgctgcgcacccggttcgaggccgcggcgcggctggccgagctgatcggcctcacccacgtgcgcgtggagccggccgcatga

SEQ ID NO: 7477 - DNA, 1179 bp, Actinoplanes utahensis
atggcgcgtcgggaaacgccggcggcggggccgggcagccgcgccctgatcgtggacgtggtccgctcggcggtctcgatcagccgggtggagctcgccgaacgcaccggcctcacccagccgtcgatctccaacatcgtccgcgacctgatcgccgacggggtgatccacgagacgggatcagaggactcggtacgcggcaaaccccgcaaactgctcgccatcacccccgccacgcggttcgggatcggcttccagctcggccccgacacggtcacctgcgtggccatcgacctgaccggcggcgtcgtcggccgtgaggtggtcccgctcgacgacaccgggctggccgaccagctcgccgcacgcttcgacgacttcatcgtggacctcgacctgccccgcgaccggatcgagggcctggccgtcgtcgcggccgccgccccgcccagccaccgggacaaccctccggagtgggccgccgcccgtcgcgccctcgccgcccggctcggcatcccggtgctggtggagaacgatgcggccgccgccgccctgggcgagttctggacccggcgggtgtcccgggagcaggcgttcggcagtgtctacctgtccgccggggtcggtgccgggctggttttcggcggcgcgctgttccgcgggaccagcttcgacgcgggcgagctcgggcacctgtccatcgcctacgacgggcggccgtgcccgtgcggcaaccgcggttgcgtcgaacgctacgcctcgatggccgccaccgtcgaggccgcccgcgacgccggcctcgccgtcgaccagaagagcatgttcagcgcgtacgacgcgatcgcgcacgccgcggtcagcggcgacccggacgcgttcgccgtggtcgaccgggcggccggctacctgagcgtcgcggtcacctcgatggccaacctgctcgacctgggccggatcgtgctgaccggcccggggatggcgatcgccggctcgatctacgcccgccgcctgcgcagccacctggcggcgaccgcgcacgcccgctaccgccacgacgtcgtcgtggaactctccgcccagccgcgcgacgccgccggcatcggcgctgccgccctggtcgtgcaggcgtctatcgcccccggtcacaccgcgggcccggccggccccgacgggccctga

SEQ ID NO: 7478 - DNA, 909 bp, Actinoplanes utahensis
atgtcgcctgacctccatgttcgagctgccgcagtgtcaggcgataccgtacctgtcgggtcggagggtacggaggaatcggtggcacagtcgcagcggcgggtcgggctcgttctggcgcgggcctcacgggtgctcggcgaggagccgtattaccacgagttcatcgagggccttgagcgggtgctcaccccggacggggtctcggtgctggtcaaggtggtcaccgaccgggcggcggagaacgcgacgtatcagcggtgggccgccgggcagcgggtcgccggggtgatcctggtcgacctgcagcccgacgacgagcgggtcaccctggtgcgggagctggggttgcccgcggtggtgctgggcgcgccgtcgaccgcgtcggggatgccgacggtgtggacggacgacgccgggtacgcacgggaggcgatccggttcctggtcgacggcgggcacgcgacgatcgggcacgtcagcggtcccctgtcgttcgcgcacagccagctgcggcgggagggcgcgcaggccgaggccgccgagctcggcgtgacggtggtgccggccgagggcgactactcgtacgagtcgggccgcgccgccaccgccgccctgctcgacgcccgggccaccgcgatcgtctgcgacaacgacctgatggccctggccgccctggacacgctacgcgagcgggagatcgccgtgccggccgacatgtcggtggtggcctgggacgattcggcgttgtgccagctggcgacgccggcgctgtcggcgatgagccatgacgtggtgcgggtcggggagatcgccgcgcgggcgatgctggatgcgatggccgggaaacctcctgcggtctaccaggcgccgctggcgcacatggtggttcgggagagcaccaactga

SEQ ID NO: 7479 - DNA, 1011 bp, Actinoplanes utahensis
atgctcagcgccatgaccatcccccgtcccgtctgggcggtcggctccgtgctggccctcgccgccgccctgatgatccacaacgcccccgacgcctcggcgttcgccgccaccccgaagtccgccgtgatcaactacctgaagtcgatcaccggcacctcgatcgtctccggtcaacacaacaaggagccggccaacctgcccggccagtacacccagcaggtccacgacgtcaccggccagtggccgggcctgtggggcggcgacatgatgttcaccgccaccgacatcgccaaccggcagagcgtgatcaaccaggcgaagaccgagtgggccaacggctcgctggtcgcgctcacctggcacgcctgctcccccacggtcggcgcgacctgcaacttcgacggcggtgtcaagaccggcatcaccgacgcccagttccagcagatcgtcacgcccggcaccacgctgtacaacacctggcgcagccggatggccgccgtcgtcccctacctcaagcagctcaaggacgccggcgtgccggtgctctggcggccgttccacgagatgaacgagtcgtggaactggtggggccaccgctccggcgccaacggcagcctcaagctctaccagcagatgcggcagtacttcgacagccagggcctggacaacctgatctgggtctggaacgtgcaggacaacccggccggcgggtgggccggcttctaccccggcagctcgtacgtcgacgtcgtcaccctcgacgcctggtacaagaactacccgtcggcggcggactactcgcagatccagtcgatcgcggccggcaaaccgatcgcgatcgccgagatgggcaaggtgcccaccgccgcgctgctcgacagccagccgaagtggacctacttcatgatctggtccgagcagctgcgcggcaacaacaccaacgccgagatccagacctcctacttcctgccgcgcgtgctcaaccagggcgaggtcaaaatctcttga

SEQ ID NO: 7480 - DNA, 942 bp, Actinoplanes utahensis
ttgagacgattgacggtgtacgcggtgaccgccctgtccctggccctgacgaccgccgcgccggccgccgccggcccgggtacctgcccccggccgggcgggcagaccatgacggtcggctacggcggccgggagtatccggtcaccgtgtacgtccccgccggggaccggccggccacccgccggccgatcgtcctcaacctgcacggctcgcagagcaccggcggcgaccagctgcactacagcgacatggcggcggccgccgacgcgggcggctacctggtcgtggcacccaccgcggcgatccctgccggggacggcttctcctggaacgtacccggggtcggcagcccgccgcccggggcccgggacgacgtcggcttcctcgaccgggtgatcaccacggcggtgcgcgcgctctgcggcgacccggcccgggtgtacggcaccggctactccggcggcggccggatgctgtccgcgtacgcctgccggcgcgccgaccggctggccgcgatcgccccggtcgccggcctgcgcgccggccgcccggacccgcaggacagcacccggccggacccggcgtcgtgtgagccgtcccgcccggtcccggtaatcaccttccacggcctgcaggacgccaccaacccgtacgccggtggcggctccccgtactggggttacccggtgcccctcgcccagcagcggtgggcccggctcaacggctgccgcggcgcggccaccgagtcggcggtgagcccgcacgtcacccgcaccgcgtaccgccactgccgcaccggcgccgaggtcaccctctacacgatcgcggacggcggccacacctggccgggcaccccgatcgacaacggcaacggcacggtcacccacgagatcagcgccaacgccctgatgtggcagttcttccagcaccaccggctctga

SEQ ID NO: 7481 - DNA, 378 bp, Actinoplanes utahensis
atgacataccgaccggtccagcaagcccatgaacccgtcggcccgtgggtcctcgccatcggctcgatggtcatggctttggtcgctccggctgtcggcgcgctgtcggcgtggtcgtacctggacgtcacaccgcactgccggtcgacatggatctatgtggtcgccgtggccttcctgatcctgatcgtgccgtcgttgctgtgcctgggcgtggcatccttcggactcgcccgctatcgggccggcaccggctcgctgcgagtcgtgtcgagggtcgccctggcggtgaccgtctgcctgaccgctccggtcgtcgtgggtggtggcgtgctcggcgccacgatggtcctcttcgcggacgacctgcgctgttga

SEQ ID NO: 7482 - DNA, 513 bp, Actinoplanes utahensis
gtgctcggccacgacggtcagcagggcggcgccgatcgcccggcgctgcgcgtcccggtccacgactttcggcatcttcctcctttcggatacagtcgtatcttaaaggaggtcgggatgagccacgacgacacgcgcgccgccgacagcgaccgggcggcaaccatcgagcgcctgaccgcagccctcgccgaggggcggatcgatctggccgagttcgatcggcgcacggtggtcgccgccggggccaccacggtcggcgagctggttccgctgaccgcggatgtgccggtcccggcccgacaggcgcaggccgagcagcgacgccgtgaccgcagcgaatggctgaccgagtggcggtactggctgggcggcgcgttgatcatgaacgctgtctggggcacgcagtgcctccgtgacggccagctccagcggtactggccggtcgcgccgctcggtatctgggcggccgtcctcatcgcggtggcgatctggccgcgcgacagaagctga

SEQ ID NO: 7483 - DNA, 627 bp, Actinoplanes utahensis
atgccgaaagtcgtggaccgggacgcgcagcgccgggcgatcggcgccgccctgctgaccgtcgtggccgagcacggactggaagaggtcagcgtccgcacggtggccgcccgggcgggccgctcacccggtgccgttcagaagtacttccgatccaaggaggagatgctcctgctggccctcgacatcgccggcgagaaggctgagcagcgattgcgggccgtcgaccggtccggcacacctcgccaggtgctccaccgcctggtcgtcgcgacgctcccgctcgaccccgagcgccgggcggaggcgatcgtgtgggcagcattcgccgcaatggccgtccgccatccaccgttcgccgaagtgctccgcgagatcgaccgggcggtcagcgccgacctggtccgctggctcgaggccggccgcgccgacggcaccgtcgccctgcgcggcgatccgcgccggaccgcggacgctgtggtggccctctccgacggcatcgcggcccggctgatctaccaccccgaagccgccgacgaactcctcgcggcgctcgacaccgccctggacgcactgctctcaccgccgaaaccaccccaacccggcgatacggctcaaaccacataa

SEQ ID NO: 7484 - DNA, 1623 bp, Actinoplanes utahensis
gtggatgctgggcccctgaccggagagcgggcgcggtggcgctcgccggccgacctcggtgtcggcgtacgaatcctcagcgccgtcggcctggccggagccgtcgcgctgaccgtcggcatcaccggcctggccgggctgcgcaacaccagtgacgcggcgagggcgatctctacgaagaacgtcggcggcatcaaggcggtcggcgagctcatgagcgccgccgcccaagcgcaggccgactcggcgaacgccgcgctgtcgcccaccgagtccgcctcgcagtacttcacccaagccttcgagagcgacctgacccgcttcggcgacacgctcagcgcctaccggcgtacggcgccggccgcctcggccgccaccatcgacgaccttgcccagcggtggagtgcgtacaccgcgatcgccggcggcaagttgcaggctctgggcgacagcaacgacctgggcgcgtggtcgcgggttcgcgacgcctccgtcacaccggtggtcgaaaagctcaacgccgacctggcggtgctgcgggacgccgagaccgcggccgcccgggccggctcggccgccgcggacaccgagtactcgcacaaccgcacggtgagtctcctcgtgctcagtgtcggcctgctgctggcgctgaccctgggtgttctggtgactcgtcgcatcgtgggatcgctgaaccgggtcaagcgggtctgcgaggcgctcgccgccaaggacctcacccgcaccagtggcttgaccacccacgacgagatcggcgccatggggcaggcgatggacaccgccgtcggcgcgctgcgcggcacggtgaccaccattgcgggatccgcggcggccctggccggagcctcggaagagatgaccggcacggcggcgcagatggcggcctccgcgcagatgacgaccacccgggcgcaggaggtgtccaccgcggcggaggagatctcgcgcagcgtggaagccgtctcggcgggtggcgagcagatgggcgcctcgatcggggagatctcgcagaacgccgccgaggcggcacgggtcgccggggaagccgtcgcgctggccgccggggcgtcggcgagcatgcggaagctcggcgagtcgtcgatcgagatcggcaacgtcgtcaaggtgatcacggcgatcgccgaacagaccaacctgctggcgctcaacgccaccatcgaggcggcccgcgccggcgagatgggcaagggcttcgcggtggtcgcctcggaggtcaaggacctcgcccaggagaccgcccgggccaccgaggacatcgccgcgcgcatcgcgacgatccaggccgacaccggcagctcggtgaacgcgatcgaggagatcagccgggtcgtggcccggatcagcgacttccagaccaccatcgcctcagccgtggaggagcagacggccacgacggccgagatgaatcgcagcgtcggcgacgccgccaacgggaccggcgacatcgccgccggcatcaccggggtggccgacgcggcggagcggacgagcgagggtgtgtcgcggacccagcaggccaccaccgagttgtcgacgatgtcggccgatttgcgagccctggtgcaggccttccgggtctga

SEQ ID NO: 7485 - DNA, 1146 bp, Actinoplanes utahensis
gtgcgcacgagaaggaaagccgtcggcgccagtggggcgaacacggccggcgcccgcggccgccgacatcgcgggatgggcgtgcggctcatcggaatcggccagagcgccgatatgaatgccgtgggcaagtggtacatgcaccgcgtccggaccaacgcgcgttccggcgatctcagggtgaccagcggcgtgaccatcggtgccctgttcgccagctgcggtctgtacgcgctggccatgacgctgctgccggcccagcccgacgccgggcgcgggaacaccgtcatggtcgccctcgtggcggtggcgttcggcgtggtgttcatgcccctgccctgggagcggatctccgacggcatgcggcttgcggtcggccccctcgggatgggcctcaccggcctctacaacatcgcctccgggctggatccgttccggtacggctatttctatctcatggtgatcctctggtacggcatgtgcgaacgccgggggatgacgctcaagaccagtccgttcctgatcgtcgcctacctgttgccgctgatcctggacggcgcctcggcctcggatctggcctccatcgggtacgcgctgccgatctacctgctggtcggcgagacgctggcgtggcgcaccgatcgtgcccgccgcctgcagcgacggctggagcagctggcgcaccacgacccgctgaccggcctgcctaaccgcgccgtcttcaccgccgagctccggcgacgctgtgccggcccggagccggtggcggtgctcttcctcgacctcaacggcttcaagcagatcaacgaccggctggggcacgcggccggcgacgacgtgctggtccaggtcgccgacacattgcgcaccgccaagcgccggggcagccgcgacctggcgtgccggctcgcgggcgacgagttcgtggtgctgctgccggacacgcagctggaggtggcccgtgccctggcggagcggatcgagcgtcggctcggtgaactcagcgccaccgacggcaccccggtcggcgccagcgtgggcgtcgccggcggcctgtcgatggacccgaacgatctgctcgccgccgccgacgaggcgatgtacctcgccaagcaggcccgccgcccggcctccgaagcatcctga

SEQ ID NO: 7486 - DNA, 921 bp, Actinoplanes utahensis
gtgatcatgaccgtggacacgaataccagcgcgcagccgcccacgccgcgtccggcggacgggctggcggcgccgatgaacccccacggacttcctcccgccgtgttcgacccggcgcggctggctgccgtgcgctccacgggcctgctcgacaccgggccggaggaggagttcgacgcgttgacccggctggccgtgcaggtcaccggcgccgggcgagcattcgtgaccgtcgtcgacgaccggcgctcgttctggaagagctgcatcggcggccccgacctgctggtggagcagcggcagaacctcgtgcatgagagtccctgccatctcctgatcgccaccaaccgggagctgatcagcgatgacgcccgtcgggacccacggatccgcgacgtgcccgcggtggagcagctcggcatcggcgcctgggccggagtgccggtgcgcgaccgcgacgggcaggtcatcggcgggctgtgcgccgtcgacgaccagcggcgggcctgggaaccccatcaggtggaaaccttgcacaccctggcggaggcggccagcgcgcagatcaaactgcggcaggagttggaccgcagccgtgcacaggcggcccgactcgacgctacggctcgtgcggaacggcaactgcgggccgaggccgaccggcgcgccgccgccgccgcggaactggccgcgcagatgcgtgtcgccgtcacggcgcaggccacgctgccccgcccggagcactgtcagctcggcgggaccggcgggtgcaccgcaccggcggacctcaagatcgctgactcctggggtgactccgcgtggggctgcaccgcgcacgtcgaggaggccctcatcaccgtacggtcggtattcgtagccaacgaggaactcggcggcctggccgcttacctccatcgctga

SEQ ID NO: 7487 - DNA, 624 bp, Actinoplanes utahensis
atgctgatcgcgctcgggccgatcctgttgctctggcttctcatgtcccgcgcgccgcggacgcggtggatcatcgccgcgggcctcgccggtcaagccgcgacggcgtgcctgctcttccacgtctttccccgcggcgtcctcgagatctctctgtcggtcctggtgctgagcgtggcgaccgctgtcaccggccgtctcgtcgaacggcgccggctcggccccgcgaagcagacccgggtgggggtggcgacgcacctcctggccgggtggtcgttgctggcgctgctctgcggcggtggcatcgcgcggccggggccgttcttcccggagaccgatggcgtgctcccgttgcccgagggcctgcatgccaccgtccgtcccacccacgatgcggactgcggctcaggctcgtgcacccggacgatcacggtcaccggccgacccgggcaacgcggcgatgacctctatgacgagctgaaacggcacctcgagaagcgcgggtggggctcaggatgccgccccgtcggttggctgttggaccggagcaccgcgtgcgtcgagctgttcgtggccggcaacgaggtgaccatcgatctttccggcaaccggggcggccggtag

SEQ ID NO: 7488 - DNA, 945 bp, Actinoplanes utahensis
gtgccgcggtggccggatataggagtcccgggaatcgtcgcgcgggccggccgggcggacatccgggttgcgccgcccgatgatgatcatcaaactggcgccgtgtcatcgaacccccacgacggcgagccgtcctccgccgcacccgtctggtccggcccgccggccatgtatccggcgcatccggctgcggccttcccgccgggtccgcccggttcctggccgccgggattgccgtcgtacgccgttgcgcacccgccgcgccggtcgagccggacggcgtggatcatcggctcggccgtggtggcgatgctgctcgtggtctgcggcgggatcggtgccgtggcctacaccgtgcgcgaccaccagccgaagcgcaccgtggcggtcggtgagccgacggtgtcgccgggtgcggaggatgacccggagccggcgccgggcccgacccatccgggcgacctggcgcagtacctgatcccggcgccgaagggctcgcgcaagtggccgaccgcgcccgccgatcaggcgctggccgactcggcggcgatgagcaaactggtcgcgaagccggccgcgttccaggcggtgctcgaccgctacgagttccggcgcggcttcgcccgccggtggatcgacggccggtccctgatcgtcgacgtgcgcgcgttccagttcgagggcaccggcaacgcccggtacttcgccgacttccagcaggcctcgctgcggttcgcggggtacggcgagccggtcccggtggcgggcgcggacgacacgtcggcgcaggtccagccgaagaaggacaagatcgggcggatccgctccagcggcctggtggtccgcgccgacatggtggtcatgatcgacacgtacgcgctgccgcccaacgatccgaaggcgctggacgcgctgctgctgcaggagtcccgcctgctgccgtga

SEQ ID NO: 7489 - DNA, 921 bp, Actinoplanes utahensis
atggcgacccctccacgcagcaaggctgatcaacggttcgagttgtttctcatcctgctgctgtggctgttcgtcggctacctgtacctcttcgtcggtcccggaacgttcttcaccaacctggttgacggaggcgggggtgaccaagggggtaatggcaatgtccaagaggatgttcagcgccgaagagccgcagccgaagcggcgttgtcccaaggaaccgcgagcgctgaataccgtaaagcggtcaaagtcggcgaaacggttgaggtgcggttgacgatctgcggagccgcggcgaaggactgcaaagacagcccctccgctacatctcatgaccccgaccatgccgtcgtgatcgcaccgaccaagaccggcggcaacatcgaggtcacattggtttcgcctgacaaggaaggtctgccggaggacctcagcggtaacgggacgaagtttgtgccggccaacggcaccaaacgttgggcttggtcgcttaaagcagagcgtccaggcacctacaaactcaccgcgcgggtcatcatccattggggtgagaccgaggcggagttggacaccactgaggtgcctcccataacggtcgaggtcgaggacactttcagtgcttggacggctcgatgggccaaacgcgctggtgacttcatgaacagcgtgggaggcgcgttggccgcccagttcgccgcagtcgtcggcttcctggtgtaccgccacagcaagcggaacacgccggccaccgcggcggcacaggccctacccacggtcccgccgcggcccgccccatcgacggcgcaaccgcagccgcagccgatggcgccaagagcatccggcgccacacgccggtcgccccctaaaccacggcagcccgttgcgacgacttcccccgacagagtccgcaaaaggtag

SEQ ID NO: 7490 - DNA, 906 bp, Actinoplanes utahensis
gtggaccgatccgtgggtcagccgcgacggcgggtcgctgcgggtgcacgcggacggcgacgacgcgatcgggcggacaccatgaccgcggagacccagccgatgccgcacaccgtgggaagcctggccgccgacctccgggatctggggctgtcgactggtgacaccgtgctggtgcatgcgtcgacgcggtccctcgggttcgtggccggccgggtgcaggcggtcgtccgggccctgctcgaggtggtgggaccgggcggcacactggcggtgccgacgcacacgccgttcaactcggatcccgccgggtggcgcaatccgccggtgccgccgcggtggtggccggtgatccgcgagcagagtccgggcttcgacccgcggtgcacgcccagccagcacatgggtgtgctggccgagacggtgcggacctggccgggggcggtgcgcagcggccatccgtcggtgtcgttcgccgcggtcggtgaccgggcacgggccatcgtcggcgggcaccggctcgaccagccgctgggggagaactcgccggtcggcgcgctctaccgggcgcacggcaaggtgctgctgctgggatgcggacacgatcggaacacctcgttgcatctggcggagagtcgccggccgcaggcgccgatgatggattacggggccgcggtggctgacggggagggcggcagccgctgggtcacctggacggcgccggtcaccgacgcctcggatttcccggtgatcggcgcggcgtacgaggcggtgggcgccatcgcggtcgggccggtgggcagtgccgttgcgcgcctgatgccgcagcgggacgtggtcgacttcgccacgtcctggatggaggatcaccgcccgccgaagacggcgtgcaggatgtcgacgtag

SEQ ID NO: 7491 - DNA, 747 bp, Actinoplanes utahensis
gtgggacgcggtgagaagacccgcgaggagcggatcgtgcgcgcgctgcggcagccgccggaggagctcgaggtgcgtggcgcccgccggtggcggggcgtggacgaacagtggaagtcctggctgcggggttcggcgacggctctggagttgtacacccggcgacaggaggctgacgaataccggcacctgctgggcgacgacgcgtaccgcgaccagctgatcgaagtgctgtcccgggcggtcccgcgggactgcgcggcggccggcttcggctgcgcgcagcggatcgaccgcccctgccggcagccggcggtctgcgcccgggaccggccctgtcacgcctattacctggaacacggcaccgggcacgtgtggatcgacttcagcccggccggccggcaccgggcggtcctctggtgggaccgggcgaacgccggccggctgtgggtggacgggcagccggtcggcgacgggatcgtcctggacagcgtcgggcgatgggtcgacgaccggttctacacggtgcaggccgccgggccggacgaccatccggcgcaggaatgggagatgggcggcctgggtcgccggatcagatcgctgctgctgtacgacgccgggcatgcctcggcccggctgctcgtgcccgccgccggggagtcgtggaccgatccgtgggtcagccgcgacggcgggtcgctgcgggtgcacgcggacggcgacgacgcgatcgggcggacaccatga

SEQ ID NO: 7492 - DNA, 5034 bp, Actinoplanes utahensis
atgccgcggccgagtgactggtgggtactcgaccttgatgcggacccgactcccggcgagccggcgaatctggtcacgacgggtaatcggctgctggacttcgccgacgacgcgcaccgcgcacagcgggcggtggattcgctgcagggcgacggtgcggtgctgacctggatcggccagtccggcgacgcgttccgtgagcagttcggcgagctccccgcgcagctgcgcaaggtgtacgactcgcaccggatggccggcgacgcgctgcacgccttcgcgcccagactggaggccgcccaggccatggccgaccgggcgctggccgacgggcgcgcggcccgcgagcagctgaccgggttgaccgggcagctccagctcgcgcagggcgacgtgacggcgatcgggcagcaggcgacggcgttgcagcagcacaccgaccccgatccggagcaggtcaagcaggcgatccgcgactccgaggcggccaagcaacggctggccgacgtgcagggccgggtggccagcggacagcaggcgctcaacgcggcgaagtcgctcgccgagcaggcccgccagctgcgcgacggcgccgctcaggagtgcaagcgggagatcgccgcggcctccgacgccgggatccagccgcggtcgttctggcagaaactgggcgagttcctcaaggggctgtgggacgtcgtctgcgaggtcgccaagtgggtggccctggtggccggcatcatcgcgatgatcatcggcggcccgctggcctggatcgccctggccgccggggcggtgctactggtcaaggcgatagtcgacttcgcccaaggcaagggcagcatcaccgatctgctcttcgcggtcctcgggatcatccccggggtccgcgggctgacctcgctctcccggctgtccgcgctctacaaggccggcggtctcaaggcgatcgcccaggcggcactgacctcgatgaagaacaccgtgcgcggcctggccaccacggtcaccaccgcggcccgcggggtggtcgacgtggtcaagacggggttcagcaaactgaccggcaagatcaacaagattccggtcaccacttcgaagcgtacgttcgagatccccgcctgcggcgacccggtcgacgtcagcaccggccgggtgttcctgccggagaccgatctcgatctacccggatcgccgccgttgctgctggagcgcacccaccgctcggactaccggtccggccggctgttcggggtgtcctgggcgtcgacactggaccagcggatcgtggtggagtccgacgcggtccacatgctggccgcggacgggacgctgctgacctatccggtgccgggtgccgaggggccggtggtgccgggccacggacgcagcctgccgctgcgccgctccggcgacggcttcctggtcaccgacccggcgaccggccggtccctgctgttcgccgcgccggtggcggatccggagccggacctggtcgccccgctgctcccgcgggaggtgctgccggaatcggccggcacggtcccgtcccggaccgcagagctggtcgcgatcgtcgaccgggagggcggccggatcgaggtgctccgggacggccggggcgctccggtggaggtgcggcacggcgacggccggcggatcgccgtcaccaccgaggacgggcagatcacggcgttgcacctggttccggccaccggcggtgagccggtgctgctgcgtaccttcggctacgcggacgggcacctggtcacggtggccggccccgcggggcagacgatgcggttcggctacgacggtgacggccggatgatccggtgggacgacagcaacggccagtggtacgcgtacacgtacgacgcggacgggcggtgcgtgctcggcgagggacgggacgggtacttcggctaccggttcgactacgacccggaccagcggcggaccagcgccaccgactcgctcgggcacaccacggtctaccagctcaacgaggacctgcaggtggtggcggagacggatccgctcggcaacaccacgcgcagtgagtgggacagccagcaccggttgctgtcccggaccgatccgctgggccgcaccacccggttcctctacgacgccgacggcggcctggaggcgctgctgcgccccgacggcagctcggccaaggtcgtacaccggggcgggcggatcgcggcggtcacggtgaccggggacgacgggcgactgtgccggcgtgactacgggcgggccgaggcaccggaccccaccgtcgatccgctcggcgccggcccgcggccggccgaacggcaccgggccgggacgacggccccggcccgggcgtcggacccggcctcgccccggatgctcgtcggcggcgccggaccggccgtatcggtcgaggctcgggacggcttcggccggatcagtgcactcggcgacacgaccggccggcgcatcgtgcagggctggaccgtcgacgggcagccggcctggcgggagaacgcggacggcgatcgccggcagtggcggtacgacgccgagggcaacgcgatcgcgcacaccgacgaactgggccgcaccacccgcaccgaatacgggccgttcgaccttccggtggcgaccgtgacaccgtccggcgcccgcaccacctacgactacgacaccgagctgcgactgatccgggtcacgaatccggccgggctgcagtggcactaccggtacgacccggcggggcgcctgatcgaggaggcggacttcgacggacgcctcagccggtacacccgcgatcccgccgggcagctgacccgcctggtcaacgcggccggggagagtttcgcattcgagtacgacgtgctcggcaacctgatccgccggacggccgtctcgccgaccgaaacccgtacgacgacgttccggtacgacgcggtgggacatctcgtcgaggcgatcggcccggacgctgtgctggagatcacccgcgacgccttcggccgggtcaccgccgagtcgatcaacgggcgggcgatcacgcacgcctacgacgacagcagccgcacggtgacccgggagaccccggccggcgtgggaacactgtggtccttcgatccggacgggttcccgatcggcatccgcatggctggacacgaggtggcgctcttccacgacgcgggtggccgccccgtcgccgaacggctcgacgagtcggtgaccgtggtccggcagttcgacgccggcgaccggctcgtccggcagcggctcagcgacggcgccggcgcggaggtggagcgcgcgttcggctaccgcgaggacgggtcgctgacgctcgtcgacgacagtcgcgagggcgtcacggtcttccgcctcgacgatgagggacgcgtcaccgccgtcgacgggccgggccgtcgtgaggactaccgctacgacgccgccggtgaggtggtcgaggcgtccgcttcggtcgccggagcgaccgttcccggcgaccggcgctatcagggcacccagctggttgaggcgggcgggatcgagtaccgctacgaccccgccggccgcctggtgcagcgccgggatcacgggcgggtctggaccttccggtgggacgccgacggccgcctgcacggcgtgatcacccccgacggcggccgttggcggtaccggtacgacccgctgggccggcggatcgccacgcagcgactgaccgacgggccggccgacgccccgctcgacggtcccgtgctgaaccagacggacttcgcctgggacgggccggtgctggtcgaggagtcggacgccaccggccgcaccgtcacctggcagcacgacctggacggatcgcggccgctggtgcaggtcgacggcgaccggctgcatctgctgatctgcgacccgaacggggcgccgaccgacctggtcgccgccgacggcaccgtgatccgcggctccgcgccgtcgctctggggtcaccacgccggggcggggacgccgctgcgtttccccggccagtacgccgacgccgagaccgggctgtactacaacctgcaccgctactacgacccccggaccggccgttacctgagcccggacccgctcgggctgagcgcgggacccagcccggtgcggtacgtcgacgatccgctgctgcagaacgacccgctgggcctgtcgccgcgctcctgcacgatcggcaaacggccccgctacgacgacgacgccccgaccgagctggacgatctgctcaacgacccggagatgctgctcgccggcagcgcgctgaagaaattcaagatcagcgccccgccgaagaccaagttccccacgccgccgggcaacctgctgatcggcgacatgaagacggcgctggcgaagtacgactccgacttcgccaacgcgtccctcgccaagttccacggcccgcaggaccagagcgcggtgctgtccgacgtcttcaacatcggctccaagaccccgaagctcgaaggctggtcggtggagtggctcaacaagttcgagcgcaccggcggcgtcagcgactacctcaagaacgccgacgtcgagaactcctgggtccgcgggcacctgctcaacgaggacttcgggttcaccgggcacacgcacaacttcgcgccgatgaccaccatgggcaacaacgccttcaagaacggcttcgagcagcgggtgaaggacgccttcgtccggatggaccagctgcaacggctccacccgcagaagttcgaccagctcggctcgacgttcaccgtcgacatcagggtgacgccgagccgggagggcctgttcgacggggtgcccggggtggacgtcgcggagctggcgatccccaagcacatcagggtggaagcgcagtacatgatcgacggcaagccgctgcccgacagcgtgctgaaggacctcaacagcaccatctggaaggaacgaccggtcaagccgctgccgtcgaacaacaccatgaacccggtgaccggcgagtgggacccgcccgtccccaccaaattctga

SEQ ID NO: 7493 - DNA, 303 bp, Actinoplanes utahensis
atggcttcgtccgatcagctgaaggtggacctgaccggcctggaggacctggccgggactctcgaccgcatccgggacggcctgaacagcaccggccgctggatcctgcagttcaccggcgacctcggcggcgacgacgtcgacgacgcgttggaggacttcgagtcgcactggagtgacggccgctcccgggtggagaagaactgcgagcggctcgccaagagcgccaagcaggcggtggagcacttccgcaaggccgacgacgagttgaccaaggaacttcaggaacaggtgaagagttga

SEQ ID NO: 7494 - DNA, 612 bp, Actinoplanes utahensis
ttgacagaccccaccggcttcgcgatcaccgtcccggactcctggttcgagatcgacgtgcaccccgacacccgcaacagcgcgatcagctcgctggtgaacgagcgggtccggtcggtgcccgagctcaacccgcaccgcagcgcgctgacccgggcgctgcgcggcgtggcgcggaccgctcacgccaacggcgccgcctactgcggggccatggtgcagggcttcgacgaggcgttgctgaccgcgagcgtcaccgtgaccatcgtgcgggcccccggcgaggaggtcgaggcgtcggcagtcgccgcccagctccgtccgctgccgcgctccggtgcggacgggccgtggcgtgaggtggtgcaggccgagctgcccgggatcggcggtgtcccgcggacccggggcgtcacggacgtcgtcctgcccgaaggcgaggggtggatccggtcggtcacgatgcagactttcgtgcccttccccggggtgcggtccgaccggatcgccgttatcaccggcagctcgccgatcctgccgctcgccgaggatctgctggacctcttcgacgcgatcaccagcactttccgattcatctcgccggactcctga

SEQ ID NO: 7495 - DNA, 297 bp, Actinoplanes utahensis
atggcgaacgtcaatgtcacctatggggagatgcagaatgccgcgaaccggctcacccgcggcaaggacgaggtcctggacaagctgaacgagctccgccggatggtgaacgagctggtcaacggcggctacgtcaccgactcgtcgagcaagcagttcgagcagtcgtacgacgagttcaaccagggcgccaccaagatggccgacggcctggagggcatgggcaagtacctgaccgccgcggccgacgcgttcaagcaggccgacgaggagttggccaaggcgctcaagagctga

SEQ ID NO: 7496 - DNA, 4338 bp, Actinoplanes utahensis
gtgcgatttttcctgactgtagtcgatccgcgaaccagcgaacacgccgacgtcgcggtgacggccgacgccggcaaccggatcggtgatctcgcacgggtgctgcagaccctgatgcgcgacgccgccgaccgcaccgccggtgcgctctatctgagcggtcggccgctcgatcccgctctcaccctgaccgagtcgccactgcgggagggagccgtcgtcggcctggacgctccggtcgacggctcgatcaccgagattccgggactcctcgaggtacgcgtcaccggcggccccgcgatcggtgcgacgcaccccctcggcgcgggcgccggcgacgtgggctccggcgacgactgctgggtgtccgtgcccgaccccgggctggccaccgtggccgcgcgcctgaccgtcgacctcagcggggactgctggatcgagccgctcgccgggacgatcctggagatcgagcgggagccggtcgaggcgcgggtccggtggtcgcccggcgagcaggtcacgctcggctcgacgatcctcgaactcgccgactacgtgctgccggacgcggccctgcagatgtccgccgacgacgtcacgatcgactacaaccgtccaccacggattctcccggtgccgcggcagacgcgattccggctgcccgcgccgccccaggaggcctcccgatcccggttgccgtggctgatggcgctgctgcccctggccgccgcgctcgcgctggtgatgatcaccggcaataccagcacgctcttcctggctctgctcagcccgctgtcgatgctcggcaaccatctggtgaaccggcgcaacggccggcgttcgtacaccgagcagatggccgagcaccgcacccggcgggccggcatcgaagccgacatccgcgaggcggtccggctggagcggcgggaacgccggcaccggtatcccgacccggccgccgtcgcgggcatcgcgaccggcccgcggcaccgcctgtgggagcggcgccggcgggacaccgactacctgcggctgcgcgtggggagcgcggttcagccgtccgaggtgaccgtcgaggatctggcgctggaggagcaccgccgctcgagccggtggagttcgggcgacgtgccggtgacggtcccgctccgcgagtgcggtgtggtcggcgtcgcgggtgcggacggcaccgcccgggcgctgggccgctgggcggtggtgcaggcggcggtcctgcacagtcccgacgatctgcacgtggtggtgctgaccgagccgaccggccgggagtgctgggactgggcgcggtggctgccgcacgcccggccgccgggtgcgtccgggccggccgtgctgatcggcaccgacgcggactcggtgagccgccgggtcgccgaactgctggagatgtgtgtgcaccgggccagcgtgcggtccgaggcgggtgaggtgcccgccggcgagcccgacgtactggtggtgctggacggttcgcgccggctgcggtcgctgcccggggtggtgcagttgctgcgcgccggtccggcggtcggcatccacgcactgtgcctggacgacgatcggcggctgctgccggccgagtgccaggcggtggtcgaggtcaccggcggcggcctgcgggtgacccaggccggcagcgacgagatcgccggcgtgcgcccggacttcctcgaccccggatggtgtgcccgggtggcccgggcgctggccccgctgcgggacgtcagcgacgacgacgaggacgccgtgctgcccgcctccagccgcctgctgcaggtgctggccctggagccgccggccgcggacaccatcctggcccgctggcggatgggtggccgcagcacggccgtggtggtcggcgagtcctacgacggcccgttcgagatcgacctgcggcgcgacggcccgcacggcctgatcgccggcaccacgggcgcgggcaagtcggagctgctgcagaccgtggtggcgtcgctggccgtcgccaaccggccggacgcgatgacgttcgtgctcgtcgactacaagggcggcagtgccttcggtgactgcgtacgcctcccgcacaccgtcggcatggtcaccgacctggacgaacatctggtccggcgggcgctggagtcgctgggcgccgagttgcggcggcgtgagcatctgctggccgcggcgggggccaaggacatcgacgactacgtccgggccgccgaccgtgatcccggccgcgccccgctgccccggctgctcatcgtcatcgacgagttcgcgtcgatggtccgtgacctgccggacttcgtcaccgggctggtcaacatcgcgcagcggggccgctcgctcggcatccatctgctgctggcgacccagcgtcccggtggtgtggtgtccccggagatccgggcgaacacgaacctgcggatcgccctgcgggtcaccgacacctcggagagccaggatgtgatcaacgccccggacgcggcgcggatcagcaagagcacaccgggccgggcgtacgtgcggctcgggcacgcctccctcgtgccgttccaggcggcgcgggtcggcggccgccggtccggccggcgctcggccgacctgcccgacccgtcggtacgcccgctgggctgggccgacctgggccgcattcccgaggacgggccggtggagcgtcgcgacgaccgggacgacgtcaccgacctgcaggtgctggtggcggcgatcagcgcggccgccgaggccggtggcatcccgccgcagcacagtccgtggctgccggcgctgccggagagcctcggcgtggagacgctgcgggcggacgcgggtgccccctacggcgtcgacgacctgcccgccgagcaggccaggcacaccgccgtggtggagctggagcggttcggtcacctggtggtggcgggtgcgccgcggaccggacggtcgcaggttctgcgcaccatcgccggctcactggccggcacctactcgaccgccgacctgcacctctacgggctggactgcggaaacggcgcgctgctggccgcggccgagctgccgcactgcggcgccgtggtcacccgggtccaggtggagcgggcggtccggttgatccgccggctggacgaggagatccgtcgccggcaggcggtgctggccgccggtggcttcgccaacctgaccgagcaacgtgcggcggccaccgcggacggaccgctggcgcacatcgtgctgctgctggacagttgggagggcttcctgtcctcactcggcgaactcgacgccggcgcgctgaccgacatcctgttccggttcctgcgggagggcgccagctgcggcgtgcaccttatcgtcgccggcgaccgctcggtgctgaccgggcggatcgccacgctgaccgaggagaagatcgtcctgcgcatgcccgatcccggtgacatgtcgctggccgggatctcgccgcgcgacgtgccgcagcggatggcgccgggccgggcgttgcgggccggatccggcgtggagacccagatcgcgctgctgcccggcgaggcgagcgggcccgggcaggcggccgcgttggtcgagatcgggcgccggacacgcgaacgggacgccccggtaccggccgcggcccggccgttccggctcggcgagttgccggcccagatcgcgtacgccgaggtcgcggccctgcgcccggcggaggcgggtgccggctggctgttgttcggcgtcggcggcgaccagttgaccgcgttcggtcccgacctggccgagggggtgccggcgttcgcggtgggtggcccgccgaagtccggccgcagcaccgcgctggtcgcgatggcccggtccgccctggacgccggacagcaggtgatcatcctggcgccgcgcacctcgccgctgcgcgacctggccggccggccgggggtggtcgcggcgttcaccggccccgacgtggatgccgcggcgttcaccgcggcgctggacgccacgaccggccgggcgttgatcgcggtggacgacgccgaggcactgcgcgatgtcgccgcctccaccgagctgcggaccatcctgcgcggcggcgatccccggccgctggggatcgtgtacgccggcgaccccgaggatctcagcgccggtttcagcggctggctggtggacgcccgcaagtcccgccggggcgcgttgttgtcgccgcagaaccgtaccgacggcgacctggtcggggtgcgcctgccccggaccgcggtgggtcagccggtccagcccggacgggcactgctctacctgggtgacgccgagccgaccgtggtgcaggtgccgcgctga

SEQ ID NO: 7497 - DNA, 420 bp, Actinoplanes utahensis
atgcgaagccgagcgctaccgacaccgtccaccctgcccctgctgctggtcgccgccgtgctgggcctgaccggtgtggtcgccgcggaacagccggtccgtccgccggcccacccggtcgcatacgccgcccaggagtcggtgaagtactacgtcgtcaggaagtcgtacaagggcgagccggagttcctctacgagatcgccgaacggttcctcggcaacggcgaccgatatgccgagatcttccggctgaaccagggacgcctgcagcccgacggccgggccatgaccaagcccgaggaggtcggtgccggctggatcctgcaactgccggaggacgccaagggcaagggcatcgtcgtcggtccgctgcccgtcgtgagcgcccccgccgccgcgagcgccggtcccgccagctag

SEQ ID NO: 7498 - DNA, 915 bp, Actinoplanes utahensis
gtgggtggcggtctcctgctcgccggcgcggtcgcggccggcctgctgctgcgccggcgccgcgccgcgggtggcacggtggccggcgacaccgccccggcttccccgctgccccgggccggggcgatcccggcaccgtcggcacggctgaaacggaccccggctccggtgctggtcagccaggtggacgccgcagcgaactgggccgtggaccgggcgctgcgcgtcgtcgccacggcctgtcaccaggccggccgcccgctgccgctgttgtacgccgtgatgatcgacgccgagcggatggtgctgcgactggccgtgccggacgaccggccgcccgcgccgtggacggtgctggagaacggccgggcgtgggaggcaccgctgcgcgatctgcaggccgccccggtcgacctcgccgtaccggtgccgaccctgcacctggtgaccatcggtaccgcggaccggacccgggtgctgctcgacctgggccagtgccacggtctcatctcgctgaccggcgacaaggccgcgatccgcgctctcgcgctgatgtgggccaccgaactggccaccaactcctggtcggcggagagcggcgtgctgaccgtgggcctgggtgacgcgcccggcgatgcgggacggatccgggccgccgacggggtccgggctgccctcgacctggcctccgcctccggtacgccgagcgcgctcttcctggccgccccgccctccggccgggacgcggcggccctgcggacgctgatcgccagccccgagtcgggttccgccgcggtgatcctgggttcggtggcggacgcccggtggaccttcaccctgcagccggacgggcggttggacaccggcgcggtcggcatcgtggtgcacgcgccgctgaccaccgcccgaggctga

SEQ ID NO: 7499 - DNA, 606 bp, Actinoplanes utahensis
atggccaccccacaccggacccgcaccgccggacgccgcgacggagcggagacccgggcgctcgtgcgccggatcgcccttcgtctgttcaccgaacagggctacgaggcgacgtcgctgcgccagatcgccgacgaactcggcatcaacaaggcgtcgctgtactactacttcgacagcaaggaggcgatcctgcagtcgctgttcgacgagcgcggtgtcgaggccgagcagctggtgacctggctgcgtgagcagccccgcaccccggcgctgctcaccacggcggtcctgcgctgggtggactccttcaccgccgagaagctgcaaggcatccggttcatgagcgccaacccgctgctggcccgcaccctgaccagcggacccgacggcaaccgcatcggggcgagcctgaaccacttcgtcgacgagctgaccaccctgctgccggacccgtcaccgcagaacgtgctcctgctgcggatggcggtgctcagcatcaatgccgccgttcaggccgcaccctccaccgatcccggcgacgaggtcgtcatcgccgtcgcccggcgggccgcacgagccgccctcagcgaaatcacgaactga

SEQ ID NO: 7500 - DNA, 468 bp, Actinoplanes utahensis
atgagcgagtacgccgtgatccgtgaatacccgttccccgtggcggaggtgtggcatgtcctcaccgatccggagcaggtcgcccagtggaccaccagcgggcagggcggacgccccgaggatttcgctcccgtaccgggcacgcggttccggttcgtcggcaagccgaccatgggctgggccggcatcgtccactgcgaagtgatctccgtgaccgcgccgcactccctgcactacacgtggcggggcgacgaagacgcgggtgatgtcaccgacgtgacgtatcagctccaagagatcaccgggggcacccggttcacctggcatcacacgggcttcaccggcgtcggcgggttcgcgatgtcgcggctgctcggctcggtccgcaagaagatgctgaccgagggcattccgccggtcctcgaggcgtatcaccggattcagcagcgcactaatcctgatacgtga

SEQ ID NO: 7501 - DNA, 192 bp, Actinoplanes utahensis
gtgaccgccattgtgaagtccgccgacctgcccagcggtacgaccgtccacgacgagaccctggaccggtggtatgtcaagcggctcgtcggcatgttcccctggcgcgcgagcaacggggagaaactgaccgacttcgaggtcgacaaattcctgcgatccggccgcatcgtgatcacgtatcaggattag

SEQ ID NO: 7502 - DNA, 855 bp, Actinoplanes utahensis
atgtccccggtccgacacctgtggcagatgtatgagcccctgcacgcggtcacctacttcgcaccgcaggcccgggtggctttcgagggcgccgggctgcgagggtactggcgcggatacttcgcggggcgagcggctccgctgggcgcggtgtcagcagctccggtcaccgcactgttctactccttcgcacccgccatggtggcgcgcgccgtaccggaggtgtggcagcgggtgtcgccggaacaagccctggccgcccgcctcgacggcgcggtggaggcgctgcgggccgtcctgccgccggagccgcagcgctgggcggaggccgccgagctgctggagatcgcggcccgcgcggcggtgaccgacggccgggcgctcggtgcggccaacgccgcgttgccgcagcccggcgacaccctcgcccggctgtggcgcgccgccacggtgttgcgtgagcatcggggggacgggcacatcgccgcgctggtcgacgccgagatcaccggctgccaggcgctcgtgctgcgcagcgccctgttcgggggccgggagcaactgcaacccaaccggggctggaccgacagcgagtgggacgccgcggcccgggcgttggcccagcgcggctggctcgaccgggaggggcgccccaccgagcggggcgctgccgcacaccgaggcgtcgaagctcgcaccgaccagctcgccgcccagccctggacggcgctcagcccggccgatcagagtcggctggcgcacctggtgacgccgctgaccgtcgccgttgccgcggtcgtcccctatcccaacccgatgggcgtgccacgcgccggcggttcctttccgcgatga

SEQ ID NO: 7503 - DNA, 1818 bp, Actinoplanes utahensis
atgacgacgagcgggccgtcggtgtgtcctgaatcatcgtggccgcggggcgggcgggcgcaccggtccgggcgaacaggccggtgggtcgattctgctaaagctcggaccgcccggtgccgatcctgcaccagcttgtccgcgaccgaccgaaggacccccgacgcgatgcccctcagctcccgccccgcggccgccgtcctggccaccgccagtgccgtcgccgccaccctgatcgcggccactccggcgcacgcggccaccgtgaccgacacatccacgacatccacgacgctggccgcgccgcagagcatggcggccgccggcggccgtctgttcgtctccgacggcaacaccgtcgccgtcctcggcaccgacggcgtgacgcagaagagcgtcaccgggatgttcggcgcccgggacgtcctggcgtcgccgtccggtgaccgggtctacgtcgcgctcagtcaggccggcgccgtcgccgttctggacaccgccaccctgaccgaggtcgcgcgctacaccaccgggcagtgtccggtgcacctcgccttcgccggttcccggctgttctacggcgccggctgcgaccagtggggcggctccctcggctcggtcgacgccgccaccggcaccgacccgcagaccgtgacgaccgctcgcatgtactccgcaccgctgctcgacggtgccgggaacaccctcgtcgccggtgtgggcgggatcagcagcggtccgctctccacctaccgggtcgacggggcgaccgtcaccccgctggcgcagaaggacaccggggggttcctggcccgggtctcggccggccccgacggtacgaaggtcgccacggcgtcccgctcgccgtaccacctgacgcagtacgacgccgccacgctggcggtggccggctcgttcgacacgggcgcgtccccgaccgacgtcgcctactcgcaccgcggcgccatgatcggtggcggggtggacagcggctccgggccggacgggaacatcgtcgcgttcgacgtcgccgcgggcacccaggtcctcgccggcaacgcccacccgaaggccgcgtacaaccgcccggccccggtcgccggaaccctgacctggtccgccgacgacactcggctctacgcgattctcgacgacttcaccggccgggctgagcagccgcacgtctactacctcgcgcggggcttcgagacggtcgccgccccggccgcgaccaccaccaagcttgccctggtccagcccgcgaaggccggcgccaaggttcgcgccaccgccaccgtggccggccacccgggcgtcccggtccggttcgtccgcaccagcccggcgggcgccctcaccatgaccgccaccacgaacgcgggcggcgtggcgaccgtcgacatcccggcaccggccggcgggacggtcaccgcctactacgacggcgacgacagcaacaagccgtcgtccgccaaggccgcctacaagaccgtcacgatcgccggggtccgcctctccgggcagtacaagacggtgaagaaggtcgcctactaccacgacaagaaggacgtcgtcatcaaggtcgccgtgtcctcaccggtcgccggccgcaagatcaccatcgtgctccagggcaaggccggcagcacgtggcggacggtacaggccaaggacttcagcctggacgcttccggcgtctactacatcgggctggtcagcgcgaccaggaaggtgcagttccgcgtcatggtcaagttcgccggggatgcctacggcaagccgtcctcagccaccggcggggccatgaccatcggctga

SEQ ID NO: 7504 - DNA, 810 bp, Actinoplanes utahensis
gtgacaccgaatctcgacgcgccggtcctcggcggcccgcgggaagcatccatcccggtctccggcgacggtcggctgtgggccgagcgcgttggcaccggcagcccggttgtactgctgcacggcgcaggcatggactcccgactgtgggagcgcatcgttcccgagctggcccggtaccacgacgtggtccggtatgacgcccgaggcctgggccgctccacgccaccgaacaagccgttcaacgacgtcgatgatttgcgcgccgtcctggactacttcggactgcgccgggccgccctggtcgggctgagcatgggcggggaaagcgcgctggacttcgccctcacccaccccgcgagagtcgccgcgctcgccctggtcggcgcctcggtcagcggacaccgctggcctcaggagcccgacctgagcgcctacgccaccgcacgccgggaacgggacgtgagcgccctggccgaactcgaactctccatctgggcaggcatgggcccgacagccccgggatgggagctcatcgacgcgatggtcacgcacaacgccgcgcggcgcatcgtcagcgaacagcaatgcgtcacaggccagaacgccgaagcgcacctcgcggacatcgccgcaccgacactggtcgtccacggcgaccgcgaccacccggagatcggcgtcatcgcccgactgctcgcggcccgcatccccgacacccacgccgtaaccatcccgaacgccgaccactacctgccgctgcgtacgcccgaggccctcaccgaagttctcctggaacacctgccctga

SEQ ID NO: 7505 - DNA, 1323 bp, Actinoplanes utahensis
gtgcgggcggctcggctgcgtcgagcggtacgcgtccaccgcggcggtggtggcggcggcccgggccgacccggtcatgcgggccggattgagcctggacggtggcacggcggcggcgtacgacgccgtggcccgggccgcgatcaacggcgacccggacgccttcgccctcctcgaccgggccgccgcccggctgggggccgccgtgacctcgatggtgaacctgctgggcctgggccgcctggtgctcaccgggccgggcgtcgccctggccggatcgatctacgcccgccgggtgcgcgcctgcctggaccggcccgaggtcagtgtggagatctccgcccaaccccgggacgcggccggcatcggcgccgccgccctggtcatccaagcctccgtggcgcccgggcacacccccgggcgcgtgtcatgagaaaggagtccgctgtgccggatgcaacggccggacggccccggcgggtcggtctggtgctggcccgggcctcccgggtactcggcgaggagccgtactaccacgaattcatcgagggtctggagcggctgctcatcccggccggcatctcggtgctggtcaaagtggtcaccgaccacgccgcggagatcgccacctacgagcggtggtcggccgagcaccgggtggacggggtgatcatggtcgatctcagccccggcgaccaccgcgtcgacctggtgcgccggctcggtctgccggctgtggtgatcggtgacccgtccaccgcggacggcctgccgaccgtctggaccgacgacgccggctcggcccgcgaggcggtccggttcctggccgaccgcgggcacacggtgatcgggcacgtcagcggaccgctgacgctcgcgcacacccagctgcgcctcggcggcttccgcgccgaggcggccgcccgcgggatcatcctgaccagcgccgagggggacttctcgcacgagtccggccgggcggcgaccgcgcggctgctgtccgccggcgcggaggttcccaccgcgatcgtctacgacaacgacgtgatggcgctcagcggcctcgtcgcgatcaccgagcgcggtctgggcgtgcccgccgacgtgtcggtggtggcctgggacgactcggtgcagtgccagctggccgggccggcgctgtccgcgatgagccacgacgtcggccggatcggcgagatcgcggcgaacgccattctcgacgcgatgcgcgacatctcggcgacccaggtgtacgaggcgccgcaggcacacatcgtggatcgcgacagcaccggccgaccgccgcttctctcggcccggtga

SEQ ID NO: 7506 - DNA, 186 bp, Actinoplanes utahensis
atgtacgtactcggcggcctcctccgcgaccgcggcgccaccgacgaagccgagcactggctccgccgctccgaccaggtggacgacgacgacaccatgcgcagactgcgcgggaccctccgcaacgacggcgtccgccccctccgcgacctccacacggaaggcgacctccacccggcaggttga

SEQ ID NO: 7507 - DNA, 864 bp, Actinoplanes utahensis
atggccgttgtgagccgagtcccctggcggcgctggctgcgccccgccgaccagccgcccgccaaccctgtcaaggcggaggcgtggcaccgccgggccatcgccgccgacccggcccgcaccacgtcgatggtggaactcgctgacctgctgtggaagcgcagcgatacagccgaggccgagatctggttccgtcgcgctgtcgaagcgggccacgactacgcgatggaccgcctaggtgatctctacttgagccgcggcgacaaggtccatgccgaggcctggttccgtcgcgctgtcgaagcgggcaacaactccgccatgtgcagcctcggtgaccttctcttgagccgcggcgacgaggtcagcgccgaggcctggttccgtcgtgccgtcgaagcgggcaacgacttcgcgatgtgcagcctcggcgacctccacttgagccgcggcgcccacgacgaagccgagcactggttccgctgcgccactgaagcggacaacgactacgccatgtacaaactcggtgaccttctcttgagccgcggcgacgaggtgagcgccgaggcctggttccgtcgtgccgtcgaagcgggcaacgacttcgcgatgtgcagcctcggcgacctccacttgagccgcggcgacgatgacgaagccgagcactggttccgccgcgccgccgaagcggacaacgactacgccatgtacaaactcggcgactttctctgcgaccacggcgaaaccaacgaagccgaacgctggttccgccgcgccgccgaagcgggcaacgactccgccatgtgcagcctcggcgacctcctctgcgaccgcggcgcgaccgtcgaggccgaggctagctag

SEQ ID NO: 7508 - DNA, 2883 bp, Actinoplanes utahensis
atgccggaaatctatcctccgcgatcaacggtctcggacgggcgaacttccgcggcaagcgcccggtgcccggtggcggtccccgaccatgccgtcatggctgccaccgatccctccgcaacggcccggccggtcgtgcgggtgctgctgtggacggtcctgacgatcgctgtcgcagtgctcgccgcgctggccggcgcgctgctcacctcgttcgcggcgcccgcgtcccggctggcggtcgccctgctccggtacgacgcgtcgggggtgcgggcggcgtccgacgcctggctcgccgccccggacggcagcgtgcgactggacgtgacggtcaccccgggccgagtcggtggcggctcccgatacttcgacgtcgacgcgacgttcacctttccgggcgcggaccatcccgtggtgtccctgctgcgctcgggtgccgaccagcaacagattccggccctgctgggcagcgccgccgtgcggttcacctacacggcccactgggaggatccggtcgtcaccgtccgccccggtgcggcgaccgtgcggttgcacggctcggtgctggtcccggtgcgcgaccggacgacgatggccgttcccgcgacgatgttctgcgggaaattccggtcccgaacggtcgtggtcaacaccggtcgactcgtgccgaggcggctgaccgccgagccggcgggcggggactgccccaccggcgcctgggacgagcagaccgccggatcggtgaccttccacggcctcggcggcgcgcacctcgacctggaacagccctcgggtccggccgatgccgccggcacccgtccgcggccgctgttcggactgccgcgccagatcaccgtggcgctgcggaacctgtggttcgggctgctgcttctgctgccgatcctgatgatgtggcgctcgatgcgaggccgggcgtggcccggcgagttgccggcccgggtcgtgcacgtcttcgggtcgatgacggcgttcggcgtcctcgcctgcgccggctcggccacccagagtgtggtcagcgagatgctgttccactggagcctgaccggccatccctggcccacgtcgctgtatgcgccctatgaactggtcccgctggccatggtggcgtgcaccgcggtgctgtggcgctcgctcgcgctgtggccggtgctcacggtgcggcacccccgcgcgagacggttctgggcgatgatcttcgtagccttcgtcgtgctggccgtccccgcttcggcgatgctgaccgccggggcttcgccacagtcggaggccgtcacggtcccggcgacccgcccggccgcgatcggcggggtaccgccggtcgcggagccgtccccgctgcactggctgaccggtaccgcggccggctacgccatcacgctgctgctggtgtgcctgctgctggtcaccgcgtccgcggccctggcctggtcgatccgggcctgcggccacaccgtgcggacggcggcggccaccgccgcggtgctgctcgcgctgttgtacctgacgccgttcggctcccggatcgacaccgtgagcacggtggtgcagggcgccgtctcgatcgccgcgggggtggcggtgtggacggcgttcgaacggatcctgcggcatgccgtcaccgccgacccgccgtcgtggtggctcggcctgcacgcccggctgcggccctggcggagtctgcggctcctggcggccgtcgcgctctcggtgcccgtggtcgtctacggcgacgaggggccacggttctccttctacgacacgctgtcgctgagtgtgtcgatcgccggcacgctgcgcgccgtcgcggtactccttctcgtgttgttgatgtggcacttcggccgagccgtgccggacgggggcaccgcggtgggcacccgggggcagctccgggcggtcgccgcgctgctcgcggtgaccgggctgctgtcgccgaccgccaccacggccggtctgccgctggccttcgccttcgggctcctcgcgatccaccgctggctgctgccgccgcggcccgttccggatctgtcgccgccggtcggaccggaccaggagttcgtcgcccgtgccgaggtcggggagctgacccggacggcggtccgggcgcgggtcaccgagtcgctcgtccgcgacctgcgcagggccgtcgcggacgggcatcccgacgccgcggtgcaggacgcgcgcgccgagcgggtcgcggacctcgccggcgcgccgtgccggtcggcgacggtggtctggtcggcactgtcgtcgtaccgcggcctgaccccgtggcgcctcgccctgacgctggggctgctcgccaccctggtgggcctgccctggtcgctgatcgacctgtcgacggtgctcgccaccctctcctcgggcggaccgttccgcctggtggacgcggccggcgggatcctggtggtggcccggttcaccatcgcgggcctggtgctcggcatcgcgtacccgatggtgcgcggccgcaccgggctcggcaagggcctgagcctgttcgtcacgatgaccgtcccggccctgatcatcaccctgctgccggatccgacgcgggcctcggcactggccgcggcgggtctgcagacgctgcagtggctggccttcggcctggtgatggggctcgccaccgatctgctcacgctgcgccgcttcggctacggctgggcgcacctgcgcgagctgcaccggatgaacgtgctgaccgcctcggtgtcgaccatgctggtctcggtcgtcaccgcgacggtcaccgcggtcggcaccggcgcggcggcggtgttcgtgcagcgggtgctgccgccaccaccggccgccacgcagccgcagacctccgggaacacgccgtag

SEQ ID NO: 7509 - DNA, 3282 bp, Actinoplanes utahensis
atgtctgagcagtggcgcgtcggcgcggtcgtcctgggccgctacgaggtgaagggtgtccacgagggcggcgccatggggctggtctaccgggtccggcaccggcagtggaacaccgacctggccgtcaaggtgccccgccccgccgtgctgaaccagcccgccttccgcgggcagttcgtcgccgaggccgagacctgggtcggcctcggcatccacccgcacgtctgcacctgccactacgtgagcaccgaggacggcgtcccgcgggtcttcgccgaatatgtggacggcggcagcctgcgcgactggatcgacgacggccgactctacgagggcggtcccgccgacgtggtggcccgggggctcgacgtggcgatccaggtgtgctggggtctggaccacgcgcacacgaaccggctgatccaccaggacgtcaagcccggcaacgtcctgctcgacgccgacggaaccgtcaaggtcaccgacttcggtctggcacgggcggccgcctcggtgccgcccgccgggccggggccggtcgacgggacgctgatggcgaccaccggcgggctcaccccggcatacgcctcccccgagcagatcgccggggcgaagctcacccggcgcaccgacgtgttcagcttcgccgcccttctcctggagatgctgaccggcgaccgcacctggacgttcgggccgatggccgccgccgccctcgccgagtacgtcgccgccggccggatgccggcccggctcggcggactgctgactcgctgcctgcaggaggacccgcagcggcggccccgggacatggccgcggtggcggctgagctgatcgacatctaccggacgatgctgggccggccctatccgcgtccggtcccccggatcgccggtctgcgcgccgacgaactgaccaaccgcgggctctcgctgctcgacctgggccgcaccgccgaggccgaggccgcgttcgccgaggccctcgccgccgacccgcagcatctggaggccacgtacaacgccggtctgctgcgctggcggcaggggcagctgtccgacaccgccctgctgacctcactcgacacggtccgcgccaccaccggggacccgtggacggcccgctatctgacggccctcgtccatgtcgaacgcggcgatctggagtcggccgaagccctgctcgccgatgccggtgacgacccggatgtgcgggccgcccgggacctgctgcgcgccggcgcggtcaccgcgagcggggcacacgccgtcttcgacggtcacgagagggcggtgctgtgcgtcgcggtggccgccgaccggcacgtcgcggtcaccggcgacgaggtgggcacgctgcgcgtctgggatttcgacgagccgatgctgcggtacgccgtgaaggcccacgatcacgccattctggccgccgcgctcagcgcggacgcgaaggtggtcgcctccgtcgacgccgacggcaccgtccgggtccgtgacctggagcgcggctggcgcccgcggccggcgcaacgcaccctcaccgggcacacggacaagccgagcaaggtcgcgatcagccacgacggccgccgggtggtcaccaacgacggcccgcagatccgcgtctgggacgccggcaccggccgctgcctgcgggtgctgaccgggcaccccggccgggtggtgatcgtcgccgtgaccgccgacggacgccgcgtgatgtcggtcgacgccggccgggtcatgcggcactgggacctggacaccggcgtctgcctgcacgaactgcccgcccccgactggccgggccacggggcggtcagcgccgacgggcggctgggcgtcgccgcgagcaccctctccggcgcccacctgtgggatctgcgggccggccggctggtgcgcacggtccaggcacactcggacacgcaggtgttgttccggcacgccccggtcgcgctcagcgccgacggcagtcggatgatcacctccggtctgcatcggacgttccgggtgtgggagaccgccacgggccgctgcctgcgcacctacaccgcacacgaggccgaggtgtgggcggccgggttgacccgcgacggccggttcgccgccaccgccgaccgcgacggcgtgctgtactggtggcggcttcccgacccgcggccgagcccgttccggctgtgccggccgcgaacccacgtcgagctcagcggcctgcagatccgggtcgaggcgctgctggccaaggccgacaaggagctggcggccggcaaccggccggccgcgctcgccctgctccgcgaggcccgggccattcccgcccacgagcgtgagccgcgcgtcatggacgcttggcggcgcctcggcgagcacaccacccggtccgggatccgggccgtctggccggtccgcacgctcgccgaggacgccggcatcacccgcggcgtcagcctcagcgccgacggcaccctcggcctgaccgccagcgacaacgcggtccgtttctggcgcaccgacggcagcggggcgtacgccgtccacgaccccggcgactcccccggcaccgcctcgctcagcgccgacgccaccgtcggcgtcaccggtggcctgcgcctgcacatctgggacgcccgcaccggcgagttgcggcgctcgttcggcgggcacacccactacaaggtgctcagcattcaggtggacgccgcggcccggcgggtcgtgtccggcggcggcgaccacgccgtacgcctctgggatctggagatctacaaacagatccgcgccttcaccgggcatcgcacccgcgtcacgtcggtccgcttcgaccccggcgaaacccggatcgtctccgccggcgccgacggccaggtgcggctctgggacgtcgccagcggcgaatgcctgcaggtgttgaccggtcatcgcggctgcgtcaacaccgccgtcctgaccccggacgggcacaccctgctcaccggcggcgaggacggcaccatccgctgctgggacgcggcaaccggcgaatgccggtgggcggtgcaggcagacggcgactgggtgaacgacctggcgccgaccagcgacagccgcttcgccgcatccgccggctacgacgccacgatccgcttctgggatctcaccaccggcgcctgcctgcaggtcgtggagggccacacgtacccggtgtggtcggtgtcgctgagcgccgacgaccgctatctgctctccggcagccacgaccagagcatccgcctctgggaggtcgactgggacctctag

SEQ ID NO: 7510 - DNA, 726 bp, Actinoplanes utahensis
atgatcgttgaggggctcgggtgggtcgcgcggcggcgggtggcggtgctggtcacggcagtcctgctcgcggtcgctcagcaggtgtcgctgccagccgtgcactcccggccgctggacctgaccatccgcatggtgccgtcgaccgcgctcatcctgggcgcggccctcgccgtccgcgtcttcccgccggcgaagctcgtcgcccgccccgcggtgcccgccctcgacaccccggcgagtccggcgctcgtcctgatggccgcgagctacacgtcgttcgccgccctccttctgaccaccctgatccggaccgtcgagaccgtctccgatgtctggttcgcggccctcccggtgctcatcatcggggccaacctggccgccgtcggtcggctgatgctgacccggtccggggttcgcctcaccccggacggcatcgaggaccgccggatgtacggcgatctgttcgtgccgtgggcggcgctgaccagcccggacccggcccatgtcaccggccgtcgacaggtggggctcgccatcgcccgccccgacctggtccgcgtccgcggctggcgggtcggcccccgcaccctgctccccgccgtcggcgtcgaccccgacgtgctggcccgcacgatcaacgagtacgccaccatcccggacgcccggtcgaccatcggctcggcgatgcccctcgccggctctgccacgaccgcggtggcctga

SEQ ID NO: 7511 - DNA, 7152 bp, Actinoplanes utahensis
gtgagcagtgacatcgcgattccctccagcgaacggtggcgatgcggccatttcgcccgtccggccggtttccggcgatatcatcgttgtctatggtgcgttcatgctgcgagaacgcgctcacggccggatccggcgccggaatgctggacgggtcgcccggatcgtgcggtgaccgagcctgaggcgccgtccgcccggcgcttcgccgacgagctccaccgtctctacacggccgccggctccccggagtatcggatcctcatccgccaggccggcgtccagcggccggcgatccggctgtcggacagcagcctgagcgactggctcaccggcaagtcggtgcccaccagcgcggcggccgtcaagttcgtggtgaccttcctccaggaccttgtcgcgaagcgcaccgggcaacggccgcccccggtggaggactggctgcggctgcaccggcaggcccagcaggaccgccgcgcccagcgcggcggccgccccggcaagcgcgccaccccacgagcggcagccccgatcccggcggcggtgatcggactgctgcggctgatgaggctgtacgccgaagagcatccgtacgtgcagcagccgggtcagcacctgcaggcgctctccacggtctacgtcagccaaagcgtcgccagcccggtcgaggccgtgcgtcaggtctgggatcgcgagctcgacgaggtggcgatggtcgaggaggaccgtcgcgtcacccggctcgcccagcccttcgacgaggtgttcagcgagtacgaccacttcgtgatcgcgggcgcggccgggctcggcaagtcgaccctgggccgtttcctcgtcggcgacctcatcggcacgatgctggacggcaggacgagcagtcttcccaccgccggcctgataccggtgatgctgcccgcccgggtgctcgccaggcacatcggacgaccctgggcagaagcgctgcacgaggcggtgaccgctgagtacggagcactcgaaggcgtcagcgcggacacctttcagcggccgatcgccgggcggaactggctcgtggtcatcgacgccctggacgagattcccgatcaggccgaccgggaccggctcctcaaggtgctgtcgacccggatggccaccccggagccggcgcgcttactggtcaccagccgtccactggtaccgggcgagatcgcccagctgcagggcccgcgggtggggttcttcgaactccagccgttcgacgcgacggctctggagatgttcgcccagcggcacttcaacccggacgggacggccgggggagcggccgaggcggcggaattcctcagccaggtccgcctcgccggcctcgaacaggtcctcaccgtgccgttgctcgcgacggtcgccgcgcaggtcttcaccgaccgccgccgcgaccaaccgttgccgtcgaaccgatacgagctgtacgaggcatacatcgcccacctcgcgacccgcaatgcctccgcggccgaagtgttcggcgccgccgccgacccggcctggtgcgcatggctcgacgcgcagcggaccaccctgctggaaacgctggccgccgagtacacccgcagcgagacaccgctggccgaggtggccataagctacgtccacgaacacggcccgaggctgacgatgctgccggtcggtggggagagcctgctggggaactggctgtctcgggccggcctgctcggctggcacggggtgcggctgcgatttcagcaccagaccttcgccgagcatctggcggccactgcccgggcccgtgccctgcccggcagattcgcccctgccgagccggtctggcgagagctgatcaggcaattcctgctcgacgacgagtccgctgaaagaaccctggcccactacctccatctgcacaggtcggacagcggtctgatcgggtatctgcaagcacgtagccaggcggagcgggagaaggccggagtcctcatcctccagggcacgccccgcaccgatgcggagttggccgctttcctggacaccacggaagggcagatcttcgccgacgtggatctggacctgcgaccggcgtccggtctcactgtccaccccgccgtgcgggaacggatgtacacctggctccgcgacgagcggactccggcccggatcaaactggccatcatcgacatcatgcgggaacgcagcccgcaggtgcggcacgaaggcgcgagaaccctcgaagggctgctcgaagatcccggacaacctggcgagatccgctccggtgccgccgaagtcctcgccaaactcggtgcgccctacgcctcgatggccgtggcggcgctgctgcggatcgcggcgaaccgtgacctctcaggcaattgccggaccgctgccgccacggcactggcctcgatcggcgacgagcaccgaacggctgcggccgacctgctgcaccaggtcgccgaggatgcgggcgtcgagggctggtatcgccgccaggccgcggagaacctcgcccggctcggctcggccggccgcaatcgtgccgccgatctgctgtcccgactcgccactgacaccgcgctcgacccacaagcgcggcgcagcgctgcggagagcctcgcggcgttgggcggcgaccatcgtcgccgtgccatggtcgccctgcggctcagcgcgagctcctttggctctctgtactccgatgaccgccggctctggctcgccgccgtgtcgctgctcgaagcggatgggaggaatcgcgctgcacagctgttgcaggaagtgtgcgaggacccgtgggtcgccggtcacctccggctgaacgctgctcgtgagctggccagcctcggtgggtctgcccgcagaagcgcggcaaggtccatgagagacatggctttctccacacagttgggggttctgcgtaccatggcggcagaggctctcgccgcgctcggccccgcctaccgggaatggagcttggaggcgctgaccgctgtcgtcggtgatccggcggtcagcttctcgcggcgtcgtgcggcgcgcctgctggcccgtcatgagggtgccgcgcgtgagatggccgcgcaatgcctgctggaaatcgcctccgccgccaccacggatctcaatgatcgtgcgcaagcggcgctggaggcggccaacctcgacgaacagcgacgtacccaggtcaggacccgattccgggagtggctggccgatcccaccatcactccggccagccggatattggcggccgtgatcctggtttcactggagccggattccgctaccacggaggctgacaccctgtatcacctggcggccgtcgccgacggccaccacgtagcccgattggcggctgcccatgctctggcgcagttggccggtcacaacctcgaccgagcggcacggttgttactgatggccgcgaccgatccgctctctcccgacttttcacgccgagcggctgcggtacgactggccgaggtggcggagactcaccggagccaggccgccgagctcctgcgtgagatgatctcgactgcgggtgatccttctgactacggggatagtgtctccgacctggccggactcggggacgcatatcgagcagaggcgagtgccctgctcctccagtgcttgaccggcccctggcccgccgaaggtgacctgcaatcgatcgtttggcggctgcgctccttttctcagaactcggcggtgaaggccgcggaaacggtcgctgagatcttgaaggatccgctggtaggtgcactgtacctattttctgatgatatcgtcattctcgaacgttttcgtccaggcttggcgagaattgtcttcgaccattttcgacggtatggcgaactcgaggtgatcggtctctgtcgagccgcggaggaccttgtccaggcagacgagaagtatcgcgatcaagccgtcaaagtgctgcgttcggcgggcgaggaagtacaagcagagcctgaccgaagcctgttgatttccttcgccgaatcgctggaaagccgtgatcaaggcatcttcgcgaccgctctcgtccaggttctcgagagtcgagacgtttcaccgtcgctgctcccggaagccgcgcggcgtctggagcaagaggagtcgcaccgacagaagctcatcgacctgtgccgaaagtggtgtgctgacccccgtctggatgaatggtggcgtttgtgggtgatggaacgactcgaaaagtctgacgcgcccatggtcgcgcagatcgcccgggagctttggacgaatccgaccctgcccgtggctacgcggctgcgagccgttcgatgcctccgggatccatcactcacaaaagatcattcactcacgattctggcgggttacgaacgcgtgcccttggcggtgaacgagcgcagcgcggtcgcatcggcgctgtgcgacctcggccctgaccatactgatcgagccgcggacatattcgccgggcttctgaccgatccaacggtgccgctccatgaccgcctgtcggcaggccaatccttggccgagctgggtgggacgcggtcggctttggcgggcgctctcgccgagcgcctggtggccgacgagcatgccggtccgctcgaccagaccgtcggtgccgccttcctcgcctggttgcggccagagacccatgtccttgccaggcaggtgctcaccggcatggcagccggaccccacgcggagcaccgcctcaccattgcccgggagctgggcaccctccgcggcggtgccgccgccgctcagcgtgccctcgccgagatcgtcgccgaccccgccacggacgacccgacccgcggggaggcgctgcagtcgctgaccggatgggtcaccgggcaggagcatgcgtgtcgcctcgccggcgcgctggcctccgatccgttgatcaacgcaacggtccggatagcggcggcgacgttgctggcccgtctgcagccggacaggcgtgtgcaggcgatcaccgagctgagccggatcgtcgtcgcggtgacggccggccccgagcgggtcagggccgcccacctggtggcccgggccgaccacccgcgccggccgcagatcgccgagattctgctggagctcgcctcggacccggcgcaggacgacgagacccggcgggaggccgcgaccctggtgacccgattcggcgaccaggccgcggatcgggccggtgatctgctcgccctcatcgccggcgaccccggcgcgtggccctcgacccggctcgacgcggcgcaggcactgctccgtatccacgggcagcggcggcgggcagtggacctgctccggggcatcgccgacgacccgcatctggatgatgaggatcgcgtccccgtcctggccgagctggtcaaggtcgattcgggccggcgggcgtcggcgatcgcgatgttcgccaccctcgccgcggacagcgaggtgcccgccgggggccgcttggcggccgcccgggagctggtctccctgggcggcgccggaatcgacgaggccaccacgacacttcgccggctcgccgtcgaccccgtcgcccccgctgcatcgcgacgaggtgcggccgtctcgctgtatcggcagggcagtgcgcatcgcgcggaggcatgccgccttctccgcgagctcgccgccgacggcacggtcgcggcggatgagcggatcagggcgatccaggatctcgcgcagcgcgagccggcgagcaccgacctgcaccgtgacatgctgcgcgacctgatcagggaacgcggcatcgcggccgcggatcgtggccaggccgccgaaaccctcgccggtttcggggagtccgcccgggccgacgcggcccggctgctcgccgacgaggcggaccgcgccgccgtgccggaccggttcgtgctgatcggccacctcgccgggttgggctccgcagcgcgtggtctcgccgcggaacgcctgcgcgcaatcgccctcccggccgaccaccccgggcggctgcatcaggccatggccaccgctctgttggtcggtatcgagggtggatccgatggccgtgcggcgcgtttgctcaccgaggtggccgccgacgccgcgaactcgccgaacgaccggctctgggccgcggcgtacctggtgcgactcggcccggcacacatcgaggcagccgcggaactgctcgacgccgtgaccgccgacgcgaacctgcgcctctgggagcggcgggaagcggcccggatggcggcccgcctcggcccggagcatcggcgccgtgccgccgccggtctcgcgatcctgatgcgcgaccccgacgccgacgtctgggaaagggcggactgcgcggtcgcgtacgaggccctcgacccggcgcaccggccggcgacgatccaggtgctggagcagctggccggccacccggcggtggccgctgaccaggtccgctacgtggtggaccgccttcttccctacggcccgccggcccgccccgccgccctggccgccctcgaccgggtcgccgccgaccgcgcggccgacgtccgggaacgcgccggggccgccgccatcctggtccggctgggcggcaccaccgccggccttcagctgctccgcgacctggccgcagacggtgagctgtccggatgtgagcaggccatggcgcacgcgatcctggcggaggtccggccggcgcggcgggaagccgccgctcgagcactcaccgcggtcgcccacgacccgcagtcgccggtggagcatcgacgcacggccgccaccgcgttgaccaccctgtccggcagaacccgccgggacggcctcgacgtcctgcggtccctggtcctgaaccggatcgacgatgcaccgacagccctggccgcggcgacactcgccggatgggatgccaggttgcgcccgatcgccgtcgcggccgcggaccggctcgtcaccggcccgctgtcgccgaccgaaaccctggcggtcgccgaagccctggcgcgactcgccgccgacccgagccggggcgcccggctgctgcatcggctcgcccgggatcccgccatcacgccgggcgaccgccgacgtgcctacgccggctggatcgcctggtccccggccggcaccacgacggggcctgcccgccttccacggccggtaccgccgccgcggtga

SEQ ID NO: 7512 - DNA, 1332 bp, Actinoplanes utahensis
atgatatcgccggaaaccggccggacgggcgaaatggccgcatcgccaccgttcgctggagggaatcgcgatgtcactgctcaccgatctcgtgccggaagtcctgcatccggacgggggcctgctgaccggggcggcaagtctcgtctatgccggcaccgtcaccggcgccacgatcgcggcgctcttcagccgcgaccccggacgacgccgtgccgcccggtacgttctcgcactgctcctgcgtcggaccgggggcggtggatccgacacgcccgagagctgaccgggacggcaccgtggccgaatggggttgcccggcaatcggcccctgtccagaatggcccggtgcaggtgcgagcgctcgatccccatgacccggaggccggcccgtggcatgcggcgttccgtgccggtctggtcgccggccgcgagcagccgaccgtggccggtgccgagtcgacgctgacctcgctgcgcaccatcgccgacaacgccgtcctcgaccgccgggcgttcggcgcgtgggacggcggcgagtgcctcggcggcgtcatcgtggacctgccccgggtggcgaacacgcacaccgtcgggttcgagctggcggtggcaccccggcatcgcggccggggcgccggcacggcgctgtgggaggcggctgtcgcggtggcccgggagcacgggcgccgggtcgtctcgaccgagcttccggtcccgctgaccgcatcgctcgcccagcaccccggcggccggttcgccctggcccgcggcttcgccggcaagctgcaggagcgccgctacctgctggggttgcccgccgagccggtggccgccgaggtgcccgccgggtatcggctgcactcctggacgggaccggtgccggccgggtcggcagccgacttcgccgcgatgtgcacgctgatggagcgggacgtcccgaccggcgaccgcgaccacgatccggtcgtcgtcaccgccgggcaggtgctgcgcggcgacgagcggctggccaccgggggctgggggctggtcacgacgctgctgggtgccccggacggcaggcccggcgggtacacccggatcttcgtcaacgccgaccgccgccacgctcagcaggacgacacgttcgtgctgcgggcgcatcgcggccgccgtctcggcgccgttctcaagtccgccaacctcgcccggctcacggagcatttcccgggcgttcgcctgctgcactcgtggaccgccgatgacaacggcgcgatgatcgccaccaatcggcgcttcggtttccgccccgtggagatcctgcacaccatggagggcccggtcccgtga

SEQ ID NO: 7513 - DNA, 807 bp, Actinoplanes utahensis
atgcccggccgctttcttgcgttccgccgtccacgaccggccgcgcgacctgccgtcaattcaaagtcatcgattagtgtgtacgacgtgacccacacgttgacaggcagagtagtggcggcactgaccgtggccgcgctggtgaccctcggtgcggcgcccaccccggcgaacgccgccggccaccatggtgtgtcctgcgcctacacccccaccccggacgatccggccgcccgcccggtgtccccgccccggaacacctcgcacaccccggaccacggcaccgtcgaggtggtcctgcgcaccaacctgggcccgatcccgctgcggctggaccgggcggccgcgccgtgcaccgtgcagagcttcctgcacctggtgcggcaccgcttctacgaccggaccatctgccaccggctcaccgcatacccgacgctgagcgtgctgcagtgcggcgacccgaccggcaccggcgagggcggccccggctaccggttcgccgacgagctgccggtcaacctgccgcccgcgcccaccgacccgaccggcgtgcggcgcctctacgcccgcggggtgctggccatggccaacgccggcccggacaccaacggcagccagttcttcctggtctacgccgactcggcgctccgtccgaactacaccgtcttcgggtcggtccgcccggccggcctgacgaccctggaccgggtggcggccggtggcatcaccccgaccgcggacgacccggccccggtcgacggcgccccggccctgcgcaccgagatccgccgcgccaccgtctgctga

SEQ ID NO: 7514 - DNA, 3207 bp, Actinoplanes utahensis
atgccattcgatggtttcatctcctacagtcacgccgctgacggacggctggcgccggccgtccagcgcggtctgcaccggctggcgaagccgtggcaccggcgacgcgccctgtggatcttccgagatcagacggggctggcggtcacgcccaagctgtggacgtcgatccaggacgcgttggacggctccacccacttcgtgctgatggcctcccccgaggcggccgcctcgccgtgggtgaaccgtgagatcgaacactggctggccaccaagtcggccgatcagatcctgccggtggtcaccgacggcgagtggtgctgggacggcaccgcccgcgacttcaccgaggattccaccgcggtgccggccgcgctgcgcggcgtgttcgaggaggagccgctctatctggacctgcgctgggcccgtgacgacctgcacctgaccctgcagcacgtccggttccgggacgcgatcgcccagctcgccgcgccgatgcacggggtcagcaaggacgagctggagggtgaggacgtccggcagcaccggcgggcccggcggctgtccaccgtggcggccgcggtgctggtcctgctcaccgtggtcgcctcggtgaccagcgtggtcgcggtgcgcaacgcggagcgggcgaacacctcggcggccgaggcgcaccgccagcagcaggtggccgcgcagcagcggaccaacgccgagcgggccaccgaggagtcggtgcgccagcagcagaacgcccaggtgcaggagaaccgggcgcgcgacgccaaggcggagaccgagcggcaggagaagctggccgccgaggcggccgccaacgccaagcgggagcaggacgccgccgcgcggtaccggatcaccgcgcagttccagcagaagctggccgaccaggcggcctcgcgggccaaggaccagaaagcgctcgccgagcagtaccgggacctggccgaccaggccgatcaggagcgcaagaagcaggagaagctggctcagcaggcgcagcaggaggccgcgaagcagcgggccgaggcggaccggctgcagcgcatggaggtcagccggcggttgatgatccgggcccgcgagctgatcgccgacgatccgcgtcaggcgctgcgggtgggcgcggccgcggtcgccctgagcccggacgcgagcgggcgcgagcagctcggccacctggtcatgtcgacccactacgccggcacgctgaccgacgtgaccagcgtcgcgacgctcgccgggcagatgaccgcgaccaccggcgcgaccggccgggtgtcgctgtggaacgccgccaaccccgccaagccggtccgggtcggctcactgcccggcacggccgcggccaccaccgtggtgggtcgcccggaccggcccacggtcgcggtcttcgacgggagcccgacggcgacggtgtggaacgtgaccgatccggcccacccgtcccgggtcgccacgctgaccgacccggccgggatcgtggcgatgagcatcagccccgacggacacaccgtctcgaccagcaacctggccggcgactcccgactgtgggacatccgggacgccacgccgaccgcgctgaccaccctgaccggtgtctaccccctgaagttcagcccggacgggcggaccggcgtgaccagtggcgccagcgtggtgatctgggacctgaccgacccggcgcacccggtgcggggtgtcaccctggacccggccctcgccgacctcgccggcgcggccgtggacttcaatccccgggtgcccgcgttggccgtcgaatcgaaggtcgccaacgtgatgttcttcaacctgagcgacccggcaaagcccgtgatgagcggaagcacgccctactcgtacgacgacgcccggccgaccgcgatggggttctccccggacggttcgttgttcaccctcaccaactcggacggcgagaccgggttgtggtccttcgacacgagctcccaggggatgagtgtcaacagcaagctcgccgccctgaacagccccgacggtggggtccggtcgctgggcttcagttccgacggggcgacgctgaccacggcgagcgcccaccacgtcgcgaccatgtggagcacccggggccggtatccgagcagcccggtcgggtccatggagcgcccgttcggcggcacgctggtcggtctcgcctacgcgccggccgccggaccgctgttctccgcgggctacgcgggaacggcggtgccgtgggacgtgacggaccgcacccacccggtgcggggcgccaccttcccgctgctcaacggaaccgtggaggggctcgtgctgagcccggacggcaggaccctggtcgccgccggttccgacacctcggtgccgctggtcgacgtgtcccatccggaggcaccggtgccgctcagcgtgatcaaggaggagggcggcgcgatcaccgcgctcgccttcagcccggacggacacaccctggcgatcggccacagcgaggggcgggcctcgctgtggaacgtgaccgaccgacggcggccggttctgctccgcgcgatcaccatgcgccagtacgtgtgggcgctcgcgttcagcccggacggacacaccatggcggccggtgagggcagcaacatctcgctctgggaggtcaccgacccggcagccgccgagcagctctcgtcggtggtactcaaggagtacatcctctaccacgcgaccgccatcacgttcagtccggacagtcgcctgctcgccaccggcaccaccgcgcacacggtcatcatgtgggatgtcgcggacccggcccggccccgccagagcgcggtgctgggcgggcacacctgggagatcaccaatgtgatgttcagcccggacgggcagaccgtggcgtcggtcagctcggacggcctgacgatgctgtgggatgtcgccgacgccgtccgtccggtcccgttcgccttcctcaaaccggccgccccggagtacctcgccgccgcgttcagcccggacggccgtaccatcgtggtcggcggctccttcggcaaggcgccccagcacgcgacactctgggacaccggcgtcccgaagtcgctggccctcgacccggtcggcaacgcgtgcgagatcagcggccggggtctcaaccgcgacgaatggagccgctacgccccggagctcgactaccgcccgacctgctga

SEQ ID NO: 7515 - DNA, 3030 bp, Actinoplanes utahensis
ttggcggcggagttcggcgtgctcggtgtggtcgaggcccggatcgacggcgtgtccgtcgatttgggacacgcccggcagcgatgtgtgctcggtgtcctgctggtggaggcgggtcgcccggtctcggtggaccagctggtcgaccgggtctggggccggcaggccccacagcgggcggcgggcgcgctctacagctacctgtcccggctgcgccgggcggtggccggcgcgcccgaggtggagatccgccgggagccgggtggttatctgctcaccgtggagccgcaaacggtggatctgcaccggttccggagcctgatggcgcagggccgggccgccggcgccgaccgggtcgcggccggcctgttcacccaggcgctgggattgtggcggggtgacccgttcgccgggctggacacgccgtggctggacgggatgcggcgcaccctgctgggcgagcggttcgtcgccgagctggaccgcaccgacgtgctgttgcggctgggccggcatgccgagctgctgccggtgttgtcggccgcggtggccgagcatccgctggacgagcggctcgccggtcagttcatggtgacgctgtaccggtgtggccggcaggcggacgccgacgagcagtatcggcggatccgccgggcgctcgccgacgagctgggcagcgacccgggggtggcgctgcgccggctgcacgagcagatcctgacggccgatccggcgctggtggggccggtggagcaggcgatcgacaggctcatggaacggccgggggagaaggccgccgacaggccgggggagaaggagccgccggtccccgcccagttgcccgccgacgtgcgcgccttcaccggccgtaccggcgaattggcggctctggacgccttgctggtgtcgccgggcggcgccgagccgccgctgaccgtggcgttggtctccggcaccgccggtgtcggcaagtcggcgctggcggtccgctgggcgcaccgggtccgggacgcgttcccggacggccagctctacatcaacctgcgcggctatgacgcggagcagccggtggcggtcgcggatgcgctggccggtttcctgaccgcgctcggggtgcgcggcccggagattccgcccggtatcgaggagcgggccgcgcggtaccgctcggagctgaccggccgccggatgctggtgctgctggacaacgcgtcgtcggtggagcaggtccggccgctgctacccggcaccggctcctgtctggttctggtcaccagccgtgattcgctgcccggcatggtcgcggtacacggcgcccagcgggtcaatctggatctgctgccggttccggatgcgctgcggttgctgcgcaagcttgtcggcgtacgcgtcgaccaggagccgtccgcggccgagagtctggcggccgcgtgcgcccggctcccactggccctgcggatcgcggctgagctggccgccgatcgtgccgacgtgccgctggccgagctggtcgccgacctgggcgatcatcggctgcggctggatctgctggacgcgggtgacccgcgggccgaggtgcgtgcggtgttctcctggtcgtaccggaatctgccggaggccgcggcccgactgttccggctgctcgggctgcacccgggggagaccgtgcacgtggacgcggtggccgcgctgaccggaactgatccggtggaggcgcgacggctgctcgccgtgctggtccgggcgagcctggcgcaggccggccggggcggccggtacggcctgcacgacctgttgcgggcgtacgcggccgagctcgccgaccggcacgacagcgaggcggcccggcgggcggccctgaccgggctgttcgaccactacctggcgcggtcggcggaggcgatggccacgctgtacccggacggcgccggggcgcccggcgatccggacgcggcccgggactggatcgaggccgagcggcccaatctggcggtgctgtgcacctacggcacggcgcacgggttccatccgcagaccatcgcgctggccggcacgctgttccggtatctggacgcgggcgggccggtcgcggaggcggcgaccatcacggcgtgcgcggtgtccgcggcccgggcgatcggggaccgggatgcgcaggcacgggcgctgtcccatctggggcggctgcatcgccggctgggtcgtccgcacgaggcggccaccgcgtaccggcaagccttgagcctctatgccggtctcggtgaccgcgcggcggaggccatggtgcagcggaacctcggcagcgtcgactggctgctcggcgactatcgggcggccgccgaccacttccagcgggcgctgaccctctacggcgagctcggggacggcgccgggcaggccgacgcgctggtccggctcgggatgatcgacgcccggctgggggatccgctgggcgcgacgcagcggttcgaggcggcgctgcagcggtacgcgtcgctcggcgacaccttcagcgaggcgtacgtgctgtccctgctggcccggctgccgcaccggccggcgtcgctggaccgggccgccgcccggctggagcagagcctcggcgcggtccgccactcgggcgaccgcaccgccgaggcgtacgtgctctccgatctggccgcggtgcacgcccgccaggaccggctggccgaggcggccgggcatctgcgccgggcgctggtgctgcaccgccggatcggggaccgggccagcgaggcggaagcgctcaacgacctgggccaggtgttgcgggccgccggtgacggcgacgaggcacgggcccagcacgcgcaggcgctgggtctggccgaggagatcggcgaccggtacgagatggcccgcgcgcacgacggcatcgcggccgcgttcctcgacgccggcgacccggaccgggcccgtccgcacgcggagcgggcccggcggctgttcgccgagctggaggtgccggccccggccgggcccgcgggtggtcagcaggtcgggcggtag

SEQ ID NO: 7516 - DNA, 780 bp, Actinoplanes utahensis
gtgcggggcatggagacagtgacctcgcgggacggcaccaccatcgccttcgaccgttacggcgacgggccgccggtggtcctcgtcggcggcgcctttcagcaccggtggatcgaccagcagaccgcccgcctcggtgagctgctggcccaggccggcctgagcgcgctgcactacgaccggcgcggccgcggcgacagcggcgacaccccgccctatgccgtggaccgcgagctggaggacatcgacgccctgctggaggcggccggcgggtccgcgatgctgttcggcatgtcgtccggggcggcccttgccctgcgcgccgccgccaccggccggcccgtggagcgggtggcggtctatgagccgccgttccgcgccggtgccgaccccgagacgacggcggcggtcatcgcggcggcccgcgaggggcgacgggcggacgcggtgcgcggcttcatgcgcctgaccgggatgcccgacgcgatgatcgaccaggtccagcagagcccgggctgggccggcctggaggcggtcgcgccgactctggcctacgacctgacgatcatgggtaacggcgacgtcccggtggaggtgctggccgcggtcaaggtgccggtgctcgccatggatggcggagccagcccgccgtgggccggcgaggccgccgccgcggtcgcgtccggggtcgccgacgggcgccggcagaccctgcccgaccagacccacggcgtcgacccggaggtgctggccccggctctgatcgatttctgccgctga

SEQ ID NO: 7517 - DNA, 1497 bp, Actinoplanes utahensis
atgacttttcgcatctggcctcggctagcagccattgcggtcatcggcctggtgctgcaactggtggtacagcagctctcgcactccgtcggcctcgtcgcaggaagtattccggtcgcactggcggggttctatgcgacggtgggattcgtgcggctcgctcgccgagagcgtggccgtctgcttgccggttgggcggtaggagccctgtccgccggtctgctgggtgtggcgtacgtgctctacaccatggaagcgatctgggcccgcacccccgcaacgcccgacgtggccggcctcctgtcggtgggcgcggcagcggtggcgctcgtcgcgttgctgttggtcgcgccgccgctgtccggcgttgtggcccggctcacacttcttatcgatgtggctaccgtcggcggcgcgctgctggtgctggcttggcagctggccctgtccgaggtggcagcggctctcgacgcgccgacgcgcctgatgttcctgacgaccgccgcactggaaatcgggggcgcggcggtggctctggtcctgatgtcacgttccacgcccaccgcgaacggatatgcgctgcgcctcctcgccggcggcctcgggacgttcgcggccacggccatcatcgcggtgtacaaccgcgccgaaggctcgccgtggtatgccaccggagcgggcgcgggctacctcatcgctgcgctgctcatcgcgctctccagcaggacggcactgccctcggccgacagcacgggccggcgtgccctctccggcatctggcctttcataccgtacgttccggcgatcatcgccgtcgtcgaagtgatccgggtgtacctgcgcaccggcacacttccgccgcttctcatgtggctgctgctgtcggccatcacgatggcgatgctgcgacagctcctcatgctggtcacgattcgccggctcatggccggcctgcaccaccaggccaaccatgacgttctgaccggcctgccgaaccgcgccgcgttccaggccgtggcggacggcgcactggcgtccgcgccggacggccggtgtacggccgtcctacttctcgacctcgacggtttcaagctggtcaacgacacgctggggcatgccgccggtgatgcgttgctggtcacggtcgccggtcggttcgcggccgcactcggaccgggggacaccgcggcccggctcggcggcgacgagttcgtggtgctgctgacggggcttgccgcggcggagcaggccgatgagtccgctcagcggatcctggacgccatcggtatgcccatgacgctcgccgaccgcacgtaccgggtacgggccagcatcggcatcgccgtgggttacggcggtggccacgatctcgaccagctgctccaggacgctgacgcagcgctctaccgagccaagaacgccggaaagggcaccttccgcagatacgagaccgaggcgcccggcgagaccgatcccgccaaggtcgccgcagcatga

SEQ ID NO: 7518 - DNA, 570 bp, Actinoplanes utahensis
gtgctggtgattgctcatgatgagggtctcccctgttgtggcgggctgtccggccatgctgcgcggcgggtctataacgatcctgtcggccgtgacggcacgtcttactctcaggtcatgttgaccgccagcaagacgagcgtgtggcgtggccggtatcagatcgacgcggacgggcgtccggtggctgtctgggatccgtcgtggtggcgcaacggcggtgctttcgagatcgacgggcagcggttcgaggtgcgggccaacgggtggggcaccaagtatcgaatgtacgacgccgccggcaacgaggtggcactggtggagcgggcggggcggaagtactggtcggtgcaggccgacggacgtatgtacgaattccgtcgttcctcgttcttcggaaaccggcaggagttggtggtcggcggggagccggccggcgaggtgcggcgcaccggggcgtggtcgggcaacatcgaggccgatctgccgggcctgccgctgccgttgcagattttcgtggtcggcgtgcagatcgcgatctggcaggcacagcaggcgtcgagtagctga

SEQ ID NO: 7519 - DNA, 387 bp, Actinoplanes utahensis
atgcctgacctggacgacgagacgatcgcgtacgcccaccgcatgttcgacctggcccgcgccggggacaccggggagctgctggacaacgtcgcggccgggctgccggcgaacctgaccaacgacaagggtgacacgctgctgatcctggcggcgtatcaccagcacgcggacacggtggccgggctgctgcggcacggcgccgacccgaaccgggtgaacgaccgcggccagtcggcgctgtcggcagcggtgttccggcagagtgcccagacggtgcgggcgctgctcgcggccggcgccgacccgcacggcggcgccccgtcggcggtcgcgaccgccgaatacttcaagttgccggacatgaccgccctgctgcggggctga

SEQ ID NO: 7520 - DNA, 693 bp, Actinoplanes utahensis
atggtcgtcggcatgttggtgtgggagcggcccgagccgccggatcggccggtgccgagcccgctgagcaggcaacggatcgtcggtgcggcgatccggctggcggatgcggacgggttggaggcggtgtcgctgcgcaaggtcgcgggggcgctggaggtcggtccgatgcggctgtacggctacctcgccaccaaggacgagctgctcgacctgatggtggacgcggtccacgccgagatccggccggccggcgaggactggcgggcggtgctgcggtcgatggccgagcagacccgggcggcggcgcatcggcacgagtggttcgccgacctgctcggtgggcggccgcaactggggccgcacgcgctggcccggggcgaggcggtcatcgccgcgatgggtgcggtgaccgtggacgacgtgatgccggtggtcgaggcggtcaactcgtacgtgatcggcgcggtgcggcgggagatcaccgagcggcgcgccgagcgggccagcgggatggacaagcggcagtggcaggtcgcctccgggccctacctgatgcggaccttcgccagcggccggttcccggcgctggcggcggtcgtccgcgacgcggcgcacctggacgcggaccagaccttccgcctgggcctggagtgcatgctggacggtatcgccgcccgggtgccgaaatag

SEQ ID NO: 7521 - DNA, 537 bp, Actinoplanes utahensis
atgacgatcagctggcgtcggctcggtcagccggacttcccactcctgcgacgatggctcgaacaaccacacgtcgcccggtggtggaaccacgagaccactcccgaggcggtcgagcgcgacttcggaccggcggcccgcggcgagacgccgtccgaggacctgctcgccatgctcgacggcgggccggtcgggctggtacagcggtaccgcatcgccgacttccccgaatacatcgacgaactcgctccgcacgtcgatgtacccgccggttcgatgagcatcgactatctcatcggtgacccggcgctgatcggccacggcctgggcccccgcatcatcaccacgatcgtcgcgcggacctggctcgaccgtcccgatgcgacctgcgtcatcgtgccggtcgtggcggccaaccgggcttcctggcgagcgctggagaaggccggcctgcgccgggtcggtgcggggaacctcgtacccgacaacccgatcgacgatccctggcatttcatttatcgggtcgatcgcccctga

SEQ ID NO: 7522 - DNA, 495 bp, Actinoplanes utahensis
atgagccgacccctgctgctactcgacgtcgacggcgtcctcaacccccacggaaccactcagccaccggtcggctacaccgagcaccacctgttccccgaggacgaggaacccgttcgtatcaaccccacacacggcgcctggatcaccgaagcgagcaccgtcctggacatcgcatgggccacaagctggaacgacgaagccaaccagcttctcgctccgcttcttcacatcacacctctacctgtgatcaccatgccagccccacccttcgaccccagcgacaagatcccactcatcgccgcatacgcccagcaacggcccgcggcatggatcgacgacctgcacacacccgaagctcgcagctgggccgccacacgcaccaaccccaccctgttgatcaccgccgacccgacgatcggcctcacccgcgacgccatcgaccacgtcatcgcctgggccaaggccctcgacaccccattgacaaacccatag

SEQ ID NO: 7523 - DNA, 258 bp, Actinoplanes utahensis
atggcattctgccgacacccaccgacatttcggagaacgtctatcgccgggaccttgctcgcgcgtcgaccaaccgcgttcgccgccctcgctgatccggtcagccgcgcctactacgaccgcaggagagcccaaggcaaacgccacaacgccgccctgatctgcctggcccgccgtcgctgcgacgtcctattcgccatgctccgcgacaaggtcgattaccagccaaggccgatcgttgcggtcatcaccggctga

SEQ ID NO: 7524 - DNA, 903 bp, Actinoplanes utahensis
atgccatgcatgagggcagatctgggtacggtcgtcatcaccggggcagcggggcgaatcggctcggtggtgcgtcgacatctgcgcgccgatgttcgccggctcgtgctggtcgaccgggttccgttgtccgtcgagtcgccggtggagcagacgatccggctggacctggcggacctggacgcggtggccgccgcgatggcgggtgcggacgccgtggtgcatctggccgggctgccggatgaggcgccgatggccgatctgctcgacagcaacgtgctgggcacctaccacgttctggaggccgcccgcaggcaccgggtggggcgggtggtgctggccggcagcaaccgcgtcaccggcttctacccggtcggccaggtcgtcacaccggacgaccccgtgcggccggacgggttctacggggtcagcaaggtggccgtcgaggcactcgggcgcctgtatgccgacaagttcgggctctcggtggtgtgcctgcgcatcggcagcttcgaggacgagcccaccgaggcgcggtatctggcgacgtggttgagcccacgggacggcgtcggtttcatccgggccgcgatcaccgcgcccgatgtgcacttcgtgaccgcctacgcggtctcggcgaacacccggaggttctgggacaccgcggccggagcccagatcggctatcagccggtggacaacgctgaaacgtacgccgcgcgagtgcccggctcggaggccaccaccgactccgcagccgtccagggcggcgcttacgccagccctgaatactcgctgcggcacgccgtcacgccgccgccgtcaggcgtgcgcggtgtcggggccgagcacgctggtcagagcaccggtgagcacggcgatgaacggttccggcgggggtga

SEQ ID NO: 7525 - DNA, 681 bp, Actinoplanes utahensis
gtggtcgggcaacaggaaccggtgatctggctgcgccccgaacgtgccgcggccgggaggccggccgagcgcagccgcgccgagatcaccgcggtcgcggtgcggctggccgaccacgaggggctggaggccgtctcgatgcgccgcgtcgccgccctgctcggtaccggggcggcctcgctgtatcgctacgtcgccacccgcgacgatctcctggacctgatgatcgacagcacggccggcgaataccggctgtcggccgcgagcggcgactggcaggccgacctgctggccgtcgcccaccaggcccgcgacatcatgcgccggcacccgtggctgcccgccctggtcatcgcccgcccggcgctcgggccgcacgggatcgacctgctggagcacgtcctcgccgtcctcgacggccatcccgccgagccggcccgcaaactgcgggcgttcgcgctcctcggcggattgaccgcgctgttcgtccagaacgaggtggccgccgccgacgtcgcacgccagagcgcctatctccgccacgccgctgcggcaggagaccacccgtacatcgccgccgcgctcgccgccccggttgggtcacccccgccggaaccgttcatcgccgtgctcaccggtgctctgaccagcgtgctcggccccgacaccgcgcacgcctga

SEQ ID NO: 7526 - DNA, 942 bp, Actinoplanes utahensis
atgttcgcgtacaccgttcgcaaacaaaccgagaggagcgacatgaccacgcagtacgcgatcaacggcggggtccggatcgccgtcgaggagctcggcggcgccggcggcgctccgctgctgctggtgatgggcctgggcacgtcacggttctggtggccggacggcctggtcaccgagctggtgcggcgcggcttccacgtcgccgcctacgaccagcgcgacgcggggcagtccacccgcctgcccgccgttcggcgtaccggcccgccgatcgcggcgctggtgcgccgatcgacgccggcgtacaccgcggaggacctcaccgatgacgcggtcgccgttctcgacaccctcggctggcaccgcgcacacctgttcggccattcgatgggcggtctcgtcgcccagcgcatcgcgatccgccatcccggccgggttctcaccatgacgagctccgccgcgatccccagcgacgtccgcggcctgcgcaccctgcgccatctgcgccttgcgccgttggtcaggttcgcccgcctgcaccaccccgccacgcccgacggcgacctgcgcctcgccgtggccatcgcccggatcctggccgcgcccggccaggacatgaccgaacgcgacgtccgcgagttcgtcaccagggaggccgcccaccacgtcgccagcttccgcgacgacgaggcccagagccgccagaccggcgcgacatggtccggcggcccactgcaccggatcaccgcaccgaccctggtcctgcacggcgagcgggacccgatcgtccgggtcggtgccgcccgcgccatcgccgcagccgtacccggcgcacgactgcgcatcattcccggcgccggccacttcctttcccgcgacctgtggaacgtttatgccgaggagatacacgccatcggcgggccctcggcatgcggctga

SEQ ID NO: 7527 - DNA, 1026 bp, Actinoplanes utahensis
atgcgtgccactctcatgttcggcgccggtgacgtccgcgtcgagaccgtcgccgacccggccccgcagcgtccgaccgacgcggtcgtccgcgtcgtgcggtcctgcgtctgcggcagcgatctgcacccgtaccactcgatgcccgccgccgagcagggccggcaggtcggccacgagttcctcggcatcgtcgagcagaccggcgcggacgtggccacggtgaaggccggcgacctggtcgtcgcgtcgttctcctaccaggacaacacctgcgagttctgccgcgccggcgtgcagaccgcgtgcgcccacccggaagccggcttcttcgccggcgcccaggccgaactcgtccgggttccgctcgccgacggcaccctggcgaaactgccggtgccggccgactcggagctgctgccctcgctgctcacgctcgccgacgtttacggcaccgggtaccacgccgcgaagaaggcccaggtgacgccgggcgacacggtcgcggtgatcggcgacggcgcggtcggcctgctcgccgtcctgtccgccaaacagctcggcgccgggcagatcgtgctgatgggccggcacaaggcacgcaccgacctcggcgtcgaattcggtgccacggacgtggtcgccgagcggggcgaggagggcatcgccaaggtccgcgagctcaccggaggcggcgcgctcaaggtcctggaggcggtcggtcaccggccggcgtacgaccaggccgtcggcatcgtccgtgcgggcggggtgatcagccgggtcggcgtcccgcagtacgacgaggctccggtgggccgggccagcctgttcggccgcaacatcacactcaacggtgggccggcgccggtccgcgcctacgtcgacgagctgctgccgggcatcctggacggcagcgtcaacccgggcaaggtgttcgaccgcaccgtgtcgatcgaggaggtgcccgccgcgtaccgcgcgatggacgaccgtgaggtgctcaaggccctgatcgcgttctga

SEQ ID NO: 7528 - DNA, 654 bp, Actinoplanes utahensis
atgacatccatgtcggtcgattacatcgcgccgcactgggccaacgccgcactggtcaccatcgatctccaggtcgacttcgccgagggcggggccggcgcgatccccggcaccacggcggtcctgcccgcggtgcgccggctcgccgccggcttccggcgcgccggccttccgatcgtccacatgattcggctgtacgttcccggcggtgccgacgtcgacccgccgcgccgggcgttcgtggcggcgggtggtcagctggtcgcgcccggcaccgcgggctcggcgctgctgccgggcgtcaccggcgactcgggaccgttcgccctggacgccgcggaactcctcgcggggcgggcgcagtccgtgcgtaccgccgaaatcgtgttgttcaaaccgcgctggggcgccttctaccgcactgatctggaggaacggctgcgcgaggcgggcgtcgacacggtggtggtggccggctgcaacctgccgaactgcccccgggccaccgtgttcgaggccagcgagcgcgacttccgcaccgtgctgccggtcgacgcgatctcgcaggtcaccgcggagcgggtgaccgacctggcgcggatcggcgtggccacgctcaccgtcgacgagatcctcgccggcctgccgtcctga

SEQ ID NO: 7529 - DNA, 327 bp, Actinoplanes utahensis
atggtccgggacgagctggtgcggctccgggaggacgccgaggcggaagcggcgacgctggccggtgacctggacgcgctcttcgcggcgtcccgggattccaacgccgacgacgagcacgacccggagggcgccaccatcggcttcgagcgggcccagctgaccgcgctgctgacggccgcgcggcaacggatcgccgaggtcgacgacgccctggcccgggtggacgcgggcggctacggcgtctgcgagggctgtggccggccgatcgccgccgagcggctcgccgtccgtccgttcgcccggcactgcatctcctgcgcctga

SEQ ID NO: 7530 - DNA, 1674 bp, Actinoplanes utahensis
atggggatgtcacggaggctcgccgcgctggtgagcagtctcgtccttgtcgtcgggctcggctgcggcacgtcggccgcggtcgccgacgcgccgcagccggagaccgcggcgccgctgcgtttcgtggcctacaacctgtgcggcaacatgtgcgtggccgacgggaccggtgccgacgacgcgcaccgcaccgccaccgtcgtcgctcaagccgcgaccggcggctggcgcgcggactacctcttcctcgaggaggtctgcaggtatcagtacgacgacatcgccgcgaagctgccggccggcttcaccggcgtgtacgccgagcgcctgccggccggcacggtgatcagcggccggaaggtgtgcaagggatccgcctacggcgaggcggtcttcgcgcgcggcaccaaggtcggcgagcagatcctgacgctgaccgtcggcgcggagcaggagccgatcaagagcccgtgcgtcaagagctgggtgcagaaccgtctcacctgggcgtgcaccgcacatctctactggaacgaggcggccttgcgggagggcaacgcgcgcaagctcaccgaccagacccgggcctgggaggccgccggccttccggtgatcatcggcggcgatttcaacggtcagcccggcaccacgaccaccgacgcgttctactcgcccggcacccagcagggcagcggcgacatgaccgaggtggacgagacggacggggaccacttcccgtccgggtgcaccagcgggcactgccggtccggcgagccgaccttccacgacggccgcaaactcgactacatcttcgtcacctcgcgcttcttccgcgaggtggtcggtgacgcactgccgcaggacgcgaccgtctccgaccaccggctgctgcgcggcggcgccgcctgggccgactgcggcgcgctgagcccgggcgcggcgggactgttccggatcgacgcggccggtctgctctaccactatgccggccaggccggtggcaccctggccggcgcctgcaagcgcggttacggctgggccccctcctacctcacccacgtcgcgcggcagggcaccacgctggtcgccgtcgaccgggacggcgtgctgtggcgctatccggcggacccggcgaacggacggtacaccggcggcaccaaggttcgggcgggctccggattcggcggcaccgagacgctgctggctccgggtgacatcgacggtgacggtcaacccgatctggtcgtccgcgaccggcagggcacgttgtcgcgatacccgggcacagcggccggtggttacggccctccgatcgcgatcccggcggccgcgggcgtcccgtggagcacgtacgatctgctgttctccccgggcgacttcgcccgcgacgccgcggacgccccggacctgatcggccgcactgcggacggtgccctctggctgctgcggggcgacggccggggcggcttcgggccggccacacagatcggcaccgactggcagatctacccggccatcgccgcggccggtgacgtggacggcgacggcaaccaggacttcatcggccgggacaccaccggcacgctgtggttctaccggggcgacgggaacggcggctacgccgcccgcagccagctcgtcacctggccggacggtgagcccctgttctga

SEQ ID NO: 7531 - DNA, 915 bp, Actinoplanes utahensis
ttgctcgccgcggcgatgatgtcgatcctggtgggtgtcgcggcgatggccgggctcaccggcgccgccaccgcggcgaccgccactccgcccggtaaccgggccaactacaccgtggtgctgatgcgcaacgccggcgccacgtcgttcgtccggctcgccgagtacagtctgcgcgccgacgggtcggcccgggcggactactgggcgtggaacagccagacacccgaggccagcgtcgcgtccgggttcaccaacgagggctgcggcaacagctgcccgatcctgaccaccgacggttttcagaaccccgcgcagcagcttttcggcacctggtccgtctccggcgacgatctgacgatctcctggacgagcggcaacccgcagaccgagcgctggaagttcaccaaccaggccaccgccaccagggtggagctggcaagccatccgaccgcgacgaacggctggggctggggcagccggatcagtttcggctccggcctgtccgcgcagcaggtgctcgccgcgaacaccacgctcagcggccggtacatccagaacgccgagggtgtgacgacgaacccgacgccgtggggcaccacctcgctcggcctgcgcccgggagccaccgtcaagctgtgcagcgccacctgcatcagcgtcggcaactccgccaacaaggcttacctcgccggcagcggcgccgaccgccggatgtactacaaccatgagcagttcgccgtgcacgccgacccgtgcatcgtgcacgggcacctgaagccggcgttgcaggtgctggacgacaacggcgccttccgcggcctgatcatggtggaggcgtcgctctacgccgacctcgggccgacgggcagcaccatcctcggcatctacgacctcaacgatttcaccagctga

SEQ ID NO: 7532 - DNA, 240 bp, Actinoplanes utahensis
gtgggcggcaatggggcgatgcggttaggtggaacagttcccgagccgttcgggccgtcggttcccgcccgcgtgccgtggcctcggcgtcatcgccaccgtgacgtcggcgcggcgacggtgttgacgacgtacacaagggaaaggactttgatcgtggaaagccgggaacgccgggaacgcggcgtggtggccacgttcccggcggatcgtcagctggtgaaatcgttgaggtcgtag

SEQ ID NO: 7533 - DNA, 2892 bp, Actinoplanes utahensis
gtgagaggccaccacgggccacaggtccggctccagctcctggggccgctgctcggctggcgcgacgacgagcaggtcagtctcggtccggtgcgccagcaggtggtcctcgccgtgctggccctgagcgccaaccggccgaccggccgcgccgagctgatcgaggcgatctggggcgagtccaccccggcgtacgcggtgaatctcgtccagaagtacgtgtccggtctgcgccgcgtgctggaaccggtgcggcccggccaccacccgtcgcaggtgctgtcctggaccgacgccggctacctcctgtcgttgcccgacggcggactcgacctcgaggagttcgagcgcggggtggcccgcgcgcgggccgctcgcgtcgagggtgacctcaaagcggcatcccgatcactgcacgaagctctggagctgtggcgcggtcccgcgctgaacggcttgtcgagcccgttgctggacgcggagcgcaaccgcctggccgagcggcggatcagcgcgctagaggagcgtatcgagatcgatctggctctgggcgagcaccgtgacctggccgaggaggcgggccgcctggtggcccagcaccctctgcgggaacggctgtgggccctgctcatgcgggcgttgtaccaggaaggacggcagggcgaagcgctcgcggccttccgcgaggcccgcgaccacctgagttcccagctcggcgtggagcccgcggcggaactgcaggccctgcacaagcggatcctcaacggtgatccggacctgctggcccccggcccgcgggtgccgcagacgggggccgtgccggcatcgcccggaccggccccgctccccgtccggccggcccggccggaaccccgacccgctcaactgccccacgggctgcccgagttcgtcggtcgccgggccgagttggaccgcctcgacgccctggccgccagcgggcagagcgtgatgatcgcggcgatcaccggcaccgccggtgtcggcaagacctcactggccgtgcagtgggcccaccgcatcagccatcggttccccgacggccagctgtacgtgaacctgcacggcttcgacccgtccgggtcggtcgcacggccggccgaggtgctgcgtggtctcctcgacgcgctcggggtcggtacgcagcagatcgagggtacggtcgatgagctggccgcccgttaccggagcctgctcgccggtatgcgcctgttgctggtgctggacaacgcccgcaacaccgagcaggtacaccccttgctgcccgggacgcccggctgcatggtcgtggtgaccagccgcagccggctctccggcctggtcgcggccggcgccgtcccggtgaccgtggagctgccgaccgccgaggaggccacggaactgctgagccgccggatcggtcccgagcgggtggccaccgagccgctggcggcggccgcggtggtcgcggcctgcgcccggctccccctggcgctggccctggtggcctcccgggccgcaccgcacccgcggtaccggctgtccgcgctggccgaggaactgcgcccggcccgggccgacgtgctggacgcgttcatcggcgagaccgagagcaccgacgcgcgggccgtcctgtcctggtcgtaccaccagctcagcgccccggcggcccggctgttccgactgctcgggctgcacccgggaccggacatcaccgcaccggccgcggccagcctcgccggggtcccggcgcgacaggcccgccggataatggccgaactgtccggcgcccacatgatcgaggagcacacacccggccgtttcaccttccacgacctcctgcgggcgtacgcggccgagcaggtcgaggaggaggaatcggtgaccgagcggcaggcggcgaccgaacggctgctcgaccactacctgcattcggcgcatgccgccgaccgcaccctgtatccgtaccgcacaccgatcgtcgtcgatcctcccgggccggacgccacggtgctggccttcgccggcccggacgaggcactggcctggttcaccgccgaacaaccggtgctgctgaacgcgatcgcccatgccaccggagccggattcaccgcgtacacgagccgcctcacctggacggtcaccgcgttcctcaactaccagggccagttccacagctgggcccgttgcctgcgggccgccctgctcgccagccgccagctcggcgaccgggccggcgtggcgcaggcgcatcagctgctcaacatcgcctgccgtcacctcggcctgatcgcggaggccgacacccacgcggagcgggcgctgcacctgttcgaccagctcggtgacaggtcccggcagggccggctgctgctcgacatcgcccgtggactggaacaccggggcgagtacgagcaggcgttgcggcgggccacccgggccctgtgccagttccacgaggccggcgaccggatgggtaaggccgacgcgctgagctgggtcggctggtactacagccggctcggcgaccacgacgcggcgatgcgccactgccacgacgcgctgcgcctgcaccgcgagggcaactggcccggccaggccgacacctgggccatcctcggcaacgcccatcaccacctcggccactacgacgaggcgctcgactcctatgcgcaggcgctcgcccggtggggtgagctcggtgaccgctacgaggtggcgatcaccctgcagcgcctcggcgacacccagcaggcatccggtcgcatcgaccaggcccggagccgatgggagcaggctcgcacgatcttggaggagctcggccaccccgacgccgtgctcctccaggcacggttggacgctcacggcgccggtggcgccgctaacgaaaggtga

SEQ ID NO: 7534 - DNA, 1917 bp, Actinoplanes utahensis
gtgggtaccgaactgccgctggtgagcaaggacgtccctgccaccccggtggggctcgcccacccggatgccgggcaacgggcgcaatggccggtggtgctggtggcgatgccgttcctggagaccggctggccctccattcagatcggcctgctcgcggcgatcctgcggcagcacggctacccggcgcagaccctgcacgggaacctcgacttcgccgcccggctgggagccgagtattaccacctcctggccgggcggcgggcccggatggtcgcggactggctgttctcggtggaggcgttcgggtccaccgccccggacccgaacggcaagctgctggacgactacgccgccgagttggcggagctggggggcgccgacgagtcgacgtggcgcgatcggctgctgcgggtccggcacgaggacgcgccggcctacctcgacgcgctcgccgccgacccggtcttccacggcgcccgggcggtcggcttcaccaccacgttccagcagaacaccgcgtccttcgccctggcccgccggctcaagcagcgctaccccggcctggtcaccatcttcggcggcgccaacttcgacggcgagatgggcccggaatgggtccgcgcggtgggctgcatcgacctggcagtggtcggggaggccgatgccgccctcccccggctgctggactgcctggtcgccggggccagccccggcgccgtcccgggtgtggtgcaccgggacggcggcgacgtcgtggtcacgccaccggccccgccgttacgccacctggacgaccagccgctgccggactacaccgagtatttcgagcgggccggccggctcggcgtgctgccccgtaccggcccgagccccgtaccgattcccttcgagaccgctcgcggctgctggtggggcgagaagcaccactgcaccttctgcgggctcaacggctccagcatgcagttccggtcgaagtccccgcagcgggtggccgacgaactggtcgcccaggcccgccggtaccgcagcttccggttccacggcgtggacaacatcgtcgacatggcctatctgtcggacctgttcccggtgctcgcgcgggccggcgtcaccttggacatcttctacgaggtcaaggcgaacctgaaccgcagtcaggtccgcgcgttggcccagggcggggtgaccgggatccaaccgggcatcgaatcgttgagctcgaacgtcctgcggctgatgaacaagggggtccgcgccgcgcagaacgtcaacctgctgcgctgggccgcctactacggcgtcgggtgcggctggaacatcctctggggcttcccgggcgagaccgaggaggactaccgcgaccaggccgcggtgctgccgcacctggtgcacctcgccccgccgtccagcgccgggcggctgtggatcgagcggttcagcccgctgttcaccgcatcgccgacgaagaccccggaacgggcgtacacctatgtctaccccgacgaggtggacctgcgccggaccgcctacttcttcgagtacgacctgcccggcgcgctgcccgagcacgcctacgacggcgtacgccaaggggtggccgactgggtcgcggcctgggacggcggcaaccggccgacgctgaccttctggtcgtcgccgggagtgatccagatctatgacggccggcgcccgggtaccgagggcacctacacgttcgaggggccgatcgccgatctgtacacgctgtgcagcgaccggccgatcggtgctgccgcggcccacgaacggctgggcgggcgcctgtccccggacgagatccgcgaggcgttcgacgagttccgccagcgcggcctgatgttcctggacgagtcgctcgccctgtccctggcactgccggccggcccgccacgctga

SEQ ID NO: 7535 - DNA, 2676 bp, Actinoplanes utahensis
atggcagcgcaacctgctgatgccgtgggcccgcagccaggtgtcgttcctcaaggacctggtgacgctgcgcaacccgcgcagccggttctcgttcctcaacttcctgcacgagagcggccgcctgaacgagttcgtcaacatggggaccttccacccgttccggtgggagttgtccgactatctgcagtgggcggcgtccagcctggagcgcgtacgcatccgctacaacgcgcgggcgtcggcgatcgaggcgaccgtcgccgccgacggctcgatcgccggctggcaggtcaccctgaccgacggcgacacgatccgctgccgcgacctggtcatcgggggcggacgagacccgcatattccggaggtcttcagcacgctcccggccgatcgggtcatccacagcaccaagttccagagccggatcggccagatccccgacgaccggcccgtccgggcggtggtcgtcggtggagcccagagctcggccgagatgttctacgccctgcaccagaacctgccgatgtgccagtcgacctgggtgatccgctcggtcgggctgcagaactaccagaccagcaagttcgtcaacgaactgttcttcccgtcgttcgtcgacgagttctactccagcgcaccggagacccgtgcccagatcctcgacgagatgcgcctgaccaactacgccgggctcgccccgccgttcctcgacgagctctacacgatgcagtatcagcagaagttcgtcggaccgcaacgctcgtcgatccgcccgatgtgcgaggtcgtcggggccaccatggacggcgaggacgtggtgctggacctgcgcgaccggaccagcggcaagaccgagccgctgcgctgcgacgtggtactgctgggcaccgggtacgaccagcggatgccccggatgatgcgggacctggccgaccggatcggcctggacagcgtcacggtcagccgctcctaccgggtcgacatcggcgactcggcgtggggcgcgctgtatctgcagggcttcaacgagcagacgcacggcatcgccgattcgctgatcagcgtgctggcccaccgctcgcaggacatcctcgaggacctgctggcccgccgcgccgagcagacggtcgcctgatggccgagcggctgatgatcgtcgcgcccggcccgaccgccaacggtgatctgcatctgggccatctggccgggccgttcctggccgccgacatctgcacccggtacgcccgggccgtcggccgggacgtgctgttcggtaccgggatccactcgacccagaactacatcgtcaccacggcccggcgactggacgaggcaccggaggagctgcgcgagcgcgcggcggggctggtccgcgaaagcctcgccacgctgcgggtacaggccgacgggttcgtcacgttcgacgaccggtacgtcaagacggtcatcgcgttcttcgagcgtctgcacagcctgggcaaactgcggctacggccggtccgcttcccgtacgtggcccgcaccggtgaatacctcaccgacgcgtacgtccgcggcagctgcccggtgtgcctcgccgacggctgcgcgggtctgtgcgagagctgcgggacctgggtggcctccggcgacctgatcgatccgcggtccaccctcgaccccggcgacgtcgtggagctgcgcgaggcgagcgtcctggtcctgccggtcgaggagtaccgggcggggctgaccgcgtacttcgagaagcacggacccacgatgcggccacggctggcccggatgatggaggagatgctgtcccggccgttgccggactatccggtcacgctgccgatctcctggggcatcgaggcgccgttccccgaggtcgccgggcaggtcatctactccgacgccgagacgatcgcctggagcatgcggtgcaccgcgttggcggcggaggcgcggggcgagataccgaccggcgaggacgagttgtgggacgccggcgccgacggccgggtcgtctacttcttcggctcggacgccacctacgcgttcgtggtggtgggcaccgcgatgctgctggcgctgggcggatacgttctgcccgagcagttcatcaccaacgagttctacgagctggacagcgacaagttctccaccagccgcggacatctggtgaccggccgggagctggccgccgaggtcccgcgcgacctcatccgcttctacctggcctcgaccgggccggagttccagcgcaccaacttcacccgctccgccatggaccgggtgaccgggcaacggctggtcgagccgtggaaccgggtcgcccggagagtcaacgccctggccggacgcgggccgctgccggtgtcgcaggcctcccgggatcgggcgttgctgatgatgcgacggttcggcggggatctcgcgccgcgccggttcagcatcagcgcggccgcgttcaccctgaccgagcagctgtcccggctggaccggtgggaggccggcgcggacgacgccggcgacttctgccacgaggtcgagatgttcctgcggtgcgccgcgccgatcctggtcgatctggcggagcaggcgttgccggacaccaccattccggaccggccgcgggccacccggatcatgccccggtcgatgccgctgctcgccctgtcggcggcgtga

SEQ ID NO: 7536 - DNA, 1059 bp, Actinoplanes utahensis
gtgacgatcgtggcccggacccgccgggtgctcgtcgtcggtgccggggtgaccggtctactgaccgcggtcgcctgtgcccgcgccggataccgggtgacggtgctggaccgtggcggcgcccccgatcccggggccgcctcgtacgaccagcaccgcgcgttccgggcgttcatcgccggcgacccgcaggccaccgggcagctgctcacggctcgccgtcgctggcgggaactggaggcgctgctcggcggcaccctgttccgccgggtcggtgtggtcaccagcaggccacgcgaccaggtggacgcgctggccgccgaggcgaccgcggccggcgccgcggtcgaggtggtcgacccgggtgaactgccgcacatggtccttccggccggctcggtgggtctgaaggaacacgacgccggggtgctgctcgccgcccgggtgctgcgcgccgcggcccgctggctcgccgggcaggacaccgtgcagctgtgcccgggccagaccgtctccacggtggacacgcagaccggccgggtgcggctcgcctccgggcgggtcctcggcgccgatctgatcctggtggcggccggcgcctggacccgcgacctggtcgacagcccggtggtgctgtaccggcagacgatggtgtacctgcgcccgccggacgacctgcggcactggtggaacggtgccccggcggccggggggctggggccggaccggcgggcctggctggtgccctccggtgccgggacgctgctcaagctcagcacggatgcggtgtgccgggtggtgagcaccgtccggccggacgacccggcgccccggtggacgcagcgggtcctcgccgcccggatcgtgcgcgacgcaggccggtacaccgtcgtcggcgtgaaggactgccactacgccgcggcggcggccggcggcggggccctgctcgtccgagccggcccgaccgtgtggtcacgcgccgcgtgcgggggcagcggcttctccacggcgccgctggtcgccgaccgcatcgtgcaggccctgagcgaggccctgtga

SEQ ID NO: 7537 - DNA, 1263 bp, Actinoplanes utahensis
gtgagcgacaacccacaaccgggagtcatcgccaccctgcgaatcacccccaccccggtccgacatctcctcaccggtgtgttcatcaaccagctcggtgcgttcgtccagaccttcctggtgctgtatctggcgttccgcgggcagtcggcgggtaccgccgccctgtgcctggccgcttacagcgtcggctccatcttcgggacgatggtcggcggcgagctgacccaccgcgtcggcgcgcggctgaccatcgtcaccgcgatggccgtcgccggcccgacggtgtgggtgatcccgtgggtcacccacaccggagtcgtggccgcgctgatggtcgtggtggcgctggcgggcctggcaacccaggcgtaccggccggccgccgcggtgatgatcagcgatctgatgccggaggaacaccaggtgatggcgttctcgatgatgcggaccgcgctgaatctgggagccgccctcgcgccgctcatagccgccgggctgatcctcgtcgactgggacctgctctactggttcgacggcgccaccgcgctgctgtacgcggcgttcgcgttcttcgtactcccccgggccgtcggcctgacaccggacagcgagccggagaccgatgcggcaccgaaagccaccggccgcgaggtctacgccctgctggtacgtgaccggaagttcctgtgctacctggccgcggtcttcctcggcacgatcgcctacacccagtcgaccagtgccctgcccctggcgatcgtggccgagcactacccggccgccctgtacagcgcggtcctgaccgtatcgtcgctggtcgtcatcctcgcccagctcaagatcaccacgtacgtcacccggctgccgaagaccgtggccgtgggcctcgggcacctgctcgactcgatcgggctggcggtgttcgtcctggccgcctggtggggcgggatcttcatcatcggcgtcgtgctgtccgtgggcggcctgatgatcgcggggccgagcatgttcgcccaccctgccacgttccaccccgtcgtgaaggcccggtacatcgccaccatgcagtcggtcgccgggctggccgccacgatcgggccgctgttcggagtcctcacctggcacgcgctgggcagcccgttctggctgctgtgcgccttcatcaacggcatcgccggtgtcctcgccgtccttgcgctgcgccgcacggccgaaccggttcccgcctccgcgaccgagaccgcaggagagacctcatga

SEQ ID NO: 7538 - DNA, 2568 bp, Actinoplanes utahensis
atgaacgtccagcccgggaccggccggccggtggtggtcgtcggctacgtcggcgtcaccctggccgctgtcgcccgcttccagcctgccggttcggtcgtctatgtcgaggaacccgacgtcatccgcaagcgtgccgtccgcgcgcacctcgacggcgtcccgttcgtccgcgacctgatcgcctgggagtacctgcggccgggagcggccgacgaattcttcgacgcccatcccggcctggacccggcatcggtcatcccggccatcgaatacgccaccccgttcgccgcccgcctcagcgaacgctacggccttcccggcgccggcagcggtgctgccgcgatcatgcgggacaagatcatgctgcgggaggtgacccgggcggcggggatcgtcaacccagccagcgccgaggtcgccggaccggacgacgtggcggcgttcctggccgggcgaaccgggccggtggtgctcaagccggccaaccgccaggcctcggtgggcacggaggtgatccacgatacgggtgacgtcgcggcggcctgggagcgctgtggccgacaggacgagggcatcttcgtgcccgaccggccgatggacgtgcgcatgctggtcgaggagtacgtcgccggcgacgagtacagcgtcgagatgctcgtccgcgacggcgtaccactgttcaccaacgtgaccggcaagcggctgtacccgggaccacgaccggtggagctggcccacatcgttccggcggacattccccgtgagctcgccgcgctgctcggctcgcacaccaccgacgtcgtcgcggcgaccggcttcggcaccggggccgtgcactgcgaatggatcgtctcgcagggcacgccgtatctggtggagtgcgccggccggctgcccggggacgggatcgtcgacctcatcgaagccgcgtatccgatggacctgctgcgctgctactacgccatgatgagcggggccgacgtcacggccggcctgccgcagcgggcgaccggcggggccgcggtgcacttcctgaccgccacgcccggtctggtcgaacaggtcagcggggtcgaggaggcccgcgccgtcgacggggtgctcctggtccaggtcaccgtcgagccggggcagctgtcccccgccgtgcgcagctcctgggaccgggccggcatcgtcatggccaccggcgccgacgccggccaggcgctacggcgggcgcggaccgcagccgatctcgtccgcatcgacacccgcccggcaacggaccggggcacgctgctggtcatcggcagcggcctgaaggtgtatcgcgagtacctgatccgaccgatccggcgccgcgccgaggaggccggcctcgacatggtgctggtcaacaacctgcggccgacctggcagagcgagtatttcgacgagatcgtggtcgccgacgtgttcgacacccggacgatgcgcgaggccgtcgaccggatcgccgcgcgccgccgcatcgtggcgctgatgtgctgggacgagccgctcgtgctcgacgccggcctgatcgccgccgagctcggggtgcccggactgtccgaggccggcgtacagggctgccgcgacaagcaacggacccgcgccgagctgaccgcggccggactgcaccagccggccttcgggctcacccacaccgtcgaggaggcccgcgcgaccgccgcgcggatcgggtacccggtggtgctcaagccccgcgcgatgggcgccagcatcggcgtggtgctggccgccgacgagtccgaactggacgacggcttccgggtcgcgctgtcggcgagcgaggtggatcccggaccgtaccgggcctgtgtgatcgtcgagcagtacgcccgcggtcccgagatcagcgtcgacggcgccgtgcacaagggcgagtacctgccgatgttcgtggctcgcaagcagagcggcgaggaaccgtacttcgaggagaccggccatctggtcgacgccgccgacccgctgctggccgaccgcgacctgatgcaggtgctcacccgcgcgcaccgggcgctcggcgtcgaggacggcatcacccacaccgagctgcgcctgacaccccaagggccgttgatcatcgaggtgaacggccggctcggcggcgacctgatcccgttcctgggccggaccgccaccggcatcgaaccgggtgaggtgctcttcgacgtggcgaccgggcagcggccgcacctgacggcgacccgccggatggtggccggcatccggttcggctaccccgaacaggactgcgtcctgcggtcgatcaccgtcccggacgcggcgcccgggttggtcgcggcggcaccgatggccgaacccggcgccctgctgcgcctgccgccaggcggttacctggcgcggcactcgttcgtggtgtgtgcggccgacgacaccgcgacctgcctcgaccggctcgccgcggcggcggccctggtgcatctcaccggcgacccggtcgggccgccggacgggcagaccccgttcgccatgccggccggtctgctcgacgtcgactccgaggagctgtga

SEQ ID NO: 7539 - DNA, 1191 bp, Actinoplanes utahensis
atgaccccgaccacgctctccgcggacgatgtcctcgaccgcgccaaggctctcgccccgctgctgcgggagcgggcggccgagatcgaacaggcccgcaccctgcccgccgacgtcgtcgagctgctgcgcggcaccggcgtgttccggatgtgtttcggcgaggactggggcggcccgcagctcacctccatgcagcagacccaggtggccgaggccttggcgtacggtgacgcctccgccgcctggtgcggcatcatcggcgccaacaccggcctcctcagcaatttcctggaacgcgcggtcgccgagaagatctatccgacgctggacaccatcacggcgggtgtcctggctcccgccgggcacgcggagcgggtaccgggcgggtaccggctgtccggccggtggtcgttcggcagcggggtgaaccacagcgactgggtgatgtcgggcgccttcgtcttccaggacggcgaaccgtacgccagccccgacggcagcaacccgcacgagtcacggcagttcctggtcccccgatccgacgtccaggtcctggacaactgggacaccaccggactgtgcggcagcggcagcagcgactacaccatgaccgacgtttacgtccccgaggagcacaccctcaccttcgacaccgtcaagggcacccccggccccctcgcccagcccgactcgttcatgcgcagcctgtgcggggttcccctcggggtggcccgcgccgcgctggaccacgcccgcgagatctcactgcgacggaccgaccggatgaccgggaccgcctgggccgacagcttccgcgtccaggtcacgctggccgagtgcgaggccgagtacaacgccgcccgcgccggcgtctacacggccatgacccggcaatgggaggtcctgtcggccggcggcaccctcgacgatctcacgctcgacgagcgggcggcgtccccgatcgcctggctgcacgccttccgcacctcacgccgggtggtcggccgcctgtacgacctgctccaggcctggtcgatcaaccgcagctcaccgatggaccggtggctgcgcgacaccaccaccatgtgccagaacctcagtgcccaggacgcgatcctcgagtccgccggagcctatctgctgggccggccgccgagattccgcatctgcctcggcatcgtccgctga

SEQ ID NO: 7540 - DNA, 1209 bp, Actinoplanes utahensis
atgaccacgacgcaggtgccggtcatctcaccaccccggacggcagccgaaatcctcgaccgcgcgaaagccctggcccccgtactgcgcgagcgggcggccgagatcgaaaaggcccgcacactgcccgccgacgtcgtcgagctgctgcgcggcaccggcgtcttccggatgtgtttcggcccggagcgcgaaggccccgggctcacctccatggagcagattcagatcatcgaggccctggcgtacggtgacgcctcggccgcctggtgtgcggtgatcggggcgaacagcggcatctacagccgcttcctggacccgggcgtggcgcgcgggatgttctccagcatcgacatggtcgtggccggcctgctccagccgtccggccgggccgaacgggtaccgggcgggtaccggctgtccggccggtggtcgttcggcagcggggtgaaccacagcgactgggtgatgtcgggcgccttcgtcttccaggacggcgaaccgtacgccagccccgacggcagcaacccgcacgagtcacggcagttcctggtcccccgatccgacgtccaggtcctggacaactgggacaccaccggactgtgcggcagcggcagcagcgactacaccatgaccgacgtctacgtccccgaggagcacaccctcaccttcgacaccgtcaagggcacccccggccccctcgcccagcccgactcgttcacccggaccatgtgcggggttcccctcggggtggcccgcgccgcgctggaccacgcccgcgagatctcactgcgacggaccgaccggatgaccgggaccgcctgggccgacagcttccgcgtccaggtcaccctggccgagtgcgaggccgagtacaacgccgcccgcgccggcgtctacacggccatgacccggcaatgggaggtcctgtcggccggcggcaccctcgacgacctgacccggtgggaacgagccgcctgccccacctcgtgggtgcacgcgttccgcacctcccggcgcatcgtcgatcgcctgtacgacctgctccaggcctggtcgatcaaccgcagctcaccgatggaccggtggctgcgcgacaccaccaccatgtgccagcacctgatcgcacaggatcgcatcctccagtccgccggggcgtacctgctcgactcgaggcccgagttcggcatctgcctcggcatcgtctga

SEQ ID NO: 7541 - DNA, 1722 bp, Actinoplanes utahensis
atgagcagcggtctgatcacactggtgaaccccaacaaggtgttccccccgattgccccgtacgggctggacgtgctgaccaccgccctggagcaggcggggttcgacgtcgacgtactcgacctgacgttccgccgggacgagtggaagtcgttcctggcggaatacttcgcggaacgcaccccactgctggtcggggtgtcggtgcggaacaccgacacggtgtacgccctcgagcagcgcccgttcgtcggtgagcacaaggagatcatcaccgaggtgatgcggctgtccgacgcgcccctggtctgcggcggcatcggcttctcgacgatgccgttcgccctcgtggagtacttcggcgtcgacttcggggtcaagggccccggcgagcagatcctggtcgacctggccgacgccgtcgccaccggccgcgatcccgccaccgtgcccggcctgatccgcaacacgcccgagggcgtcacccgggtgccgccgccggtgctacgcctgccgcacggcctgtcggcaccggtgtcaccgacggccgacggcgaggaccgggtgtggcaggtcgagcggtccggttcctaccggcgccggtcgggccagccgtacaaggtggacaatctgcagcactaccacgggggcggcctgggcagcatcctgaccaagaacggctgcacctatcggtgtgcgcactgcgtcgagccgaatgcgaagggcaatcggttcggccggcgggacgtcgccgccgtcgtcgacgagatgcagtcgctcaccgagcagggcgtgctcgacctgcacaccaccgacagcgagttcaacctgtcgatcgcccatgccaagagcgtgctgcgcgagatcgtgcggcgcaagcgggccgactcgggcaacccgctcaacgacctgcggttgtgggtctactgccagccctcacccttcgacgaggagttcgccgggctgctcgccgaggccggttgccagggcgtgaacgtcggctccgaccacatccgcgccgacctgctgcagggctggaaggtcaccggcggcggcagcacgtactacacgttcgccgataccgaacggctggtccgcctgtgccacgagaacggcctgaagaccatggtcgaggcgctgttcgggatgcccggcgagacgatggagacgatgcgcgagtgcgtcgatgccttcatggccctggacgccaccgtcaccggcttctcactcgggctgcggctgttcccgtacattccgctcggggtcgatctcgctcagcagtgcgacggggtacgcaccgcgcccgggctgcagtccaacacggcgaccgaaccgatcgtgctcaaaccgctggccgcctgttccgggccggccgagtacgaacgccagttcatgttcgatgaacacggcgacttccggctggtctgctatctctcgccgggcctggccgaggacgtcaccaacccgtccgtgcagtgggaacggactgtcgaacggctctgggatctcgtcgaccccgccgagcaccaccgggtcatgctgccgacactcggcggcaccagcgagatcgacaacaactacgccgacaacccgttcctgaccagcctcagtcagctggggtacaccggagcgttctggtcgcactggcgcgaccgggaggcgatcatgcgcgaggcccgcgaggccggaatcctcccgacacccgaggccgggcgacgatga

SEQ ID NO: 7542 - DNA, 417 bp, Actinoplanes utahensis
atgaccagcgaacggagcagaactgtgaccggagcggaaagcggcggcgtgcaggttcgccgccaggaacccgacgacctcgcccgcgcgcacgggctggacctcaagctgttgcagccgtggcccggcgtggacacgccgttcgagggtgcctggtgcgtgctgcgcccgggcgacgtgaccgacacccactcccatcccgaacgggagatcttcatcgggatggccggtcgcggcgtcctggtcaccgcgtccggtgaacggcacagcatcgtggccggtgacctgctgacgatgcggcccgggctggaacaccatgtggagaacgacagtgaccaggacttctcctactacgcgatctggtgggacggcgcaacggcggccgccttcctcgaccgtgccgcccagccgtcatga

SEQ ID NO: 7543 - DNA, 324 bp, Actinoplanes utahensis
atgatcgactacgacgggcggcggttccgtaagccgggcgacgccgacggcaccgtcgccacctatcaccaacagggcgacgtggtctgggccgacttctccggcggtgaggtgcgccgcggctcgatcaccggcatccggcagagcgacggaacgctgcacctgggctacaccatggtgctgaacagcggcgaggtgatctgcggacgcgcgctgaacacgccgatcgccaccggcgacggcccgctgcggctgcgcgagaactgggaacggtacggcccccacgccgccaccggcgtctcgtacctcgaagaggtggggtga

SEQ ID NO: 7544 - DNA, 1377 bp, Actinoplanes utahensis
gtgcccaccgtcagcgccgccgcttggcgcgccctggaaaccggcgtccgcggtcgggtcctgcgtccggatcagtccgggttccgggagtccagcacgccgttcaacacccggcatgcggccaccgtgccggccgcggtggtccgcgcggccgacgtcgccgatcttcggctggtgctggcctgggcccgcgacaccgccctgccggtcgtcgcccgcggcggcggccacagctacggcggttactcgaccggtagcgggctcgtcatcgacctcagcgcgctggacgaggtgacggtggacgcctccaccggccgcgtgacgatccagggcggcgtacgtaccgccggagtgtacgccgctctcgaaccgcacggcatcgccttcccgctcggcaacggcgcatcggtgggcgtcaccgggctcgcgctcggcggcggcacagccgcgacctcgcgcgcgttcgggctcaccgccgacacgatggtgagcaccaccctgctgaccgccgacggtcggctgctgacctgcgacgccacccagaatgccgacctgtactgggcctgccgcgggggtggcggcgggaacttcggcatcaacgtgtcgaccaccttccaggccgcccaggtctccgacgtctccaccttcctgctgctgtgggaacgcgccgcggctgagaaggtgctggaggtcatgcaggaggtgcagcggcgtgcgccgcgggagttctcggcccggctgggtgtcgccgcgaccgccggatccgacccggtggtgtccgcgatcgggttgcacctcggcccggcgggcgagcttcgcgaactgctcgacccggtcctggcggtggcccgcccggtccgggcggacatcgccgaccggacgttctggcaggcgcagagctacctgctgcacgacacgtcggccgaggcgttcgcggtgaagacgtccttcgtccgggacccgctgcccgccgacgcgatcgaggtgctgctttccgccgtggaccgctggccgaccagcaccaacccggacggcggcggcgtcgcactgttcgcctacggcggcgccgtcaacgacgtcgcgccggtcgataccgcgtacgtgcaccgcgagggtctgttcctgctcagcatggacacgtcctggaccgacggggacgatccggccacggtcggcgccggcctgcggtggctcgccggcctgcgcgaggcgatgacaccgtacgtcaccggcggcgcctaccagaatttcatcgacccggacctgccggactggcgcaccgcgtactacggggtcaactacccccggctcgtggagatcaagaatcaggtcgacccggaccgggtgttcagcttcccgcaggccatcggcacttga

SEQ ID NO: 7545 - DNA, 354 bp, Actinoplanes utahensis
atggtgagcctggtcggattcgctggtgcggcaagcgccgcaccggctgccgcgaccaccgcgaaaccggcgaaggcctgctccacggccaccgccgcggctctgcaggcggccgcgaagatgccggccggctggaagatcaagaagagcagcatcaactgctggaacaacacccttgccaaggccgagttcaccgcgcccaccgtcgagcagcagggcgacggcatgacggtcttcaagtaccggaccggcaccaagaagtgggtcaagatcaccgagggcagcagcatcgactgcgccgacctcggtatcaagaagcacgccgcccacccttcctggtgcatccccgcctga

SEQ ID NO: 7546 - DNA, 537 bp, Actinoplanes utahensis
ttgccgggtatgggtgtctgtccggaagggcacacagtcggctgcccggacagaacgggcggaaggcgaaccatggcggctgaactacgggcagacgaaatcgccgagatcggcaaggcgatcgcgcgttcaggtctgtaccttcagttcgtcccccagccgacagcgctggagacgtgctggtacacggtcggcttgacccggtacgggcatcctgagctgattctgttcgggttgccgccggacatctcccggcccgccctacaggccgttgccgaggagatcatcgccggccggcgcgtgctcacggcaggtcagcgtgccggcgacattctcgagggccaccaggtcgagctcgtcgcggtgaccgagccggatcgccacctgcccgttgccgcgcagttctacgaggccacgggtgccgtcgtggaggcgctgcagatcgtctggccggatcgccaccaccgctggccgtggcaacccggcacccgcgtggacgacatgccggtactcggccggccgacctcagcaggttga

SEQ ID NO: 7547 - DNA, 963 bp, Actinoplanes utahensis
atgcgcagtgactacgacgtcatcgtgatcggcggcggcgctgccgggctcagcggtgccctgacgttggcccgggcacgacggtcggtcgtggtcgtcgatgccggggcgccacgcaacgcggccgcccaccgtgtgcatggcctgttggggttggacggcatcgcgccggccgagttgctcgaccgcggccgcaaggaggtccgggcgtacggtggcgaggtcgtccgcggcgaggtcgacgcggtcaccgcggccgccggagggttcgacgtccggctcaccgacggccgccgggctgcggcgcgtcgggtcctcgtcgccacgggactcgtggatgagctgccggaggtcgcgggcctgcgggagcggtggggacgcgacgtcatccactgcccgtactgccacggctgggagatcagcgggatgcccgtcggggtgctggcgaccgaggaggtctcggcggtcgaggaggcgctgctgtttcggcagtggagcgacgacgtcgtgctgttcacccacaccggtccgacacccaccgcgcaggacgcggagcggctcaacgcccgcggggtccgggtccaggcggggaaggtgtcggcgttggaggtggccgacgaccggctcgccggggtgcggatgagtgacggcaccgtcgtcgaccgggccgtcctggtggtgtcaccccgcctggtcgtggcggcgcggttcctgcggccgttgggcctggtgccgtgcgaggaggagtccggcaccggcgagtgcttccgggtggatgccaccggccacagcgcggtcgccggcgtgtggctggcgggcaacgtctcggacacggctgcccaggtggggaccgcggcggccgcgggagcgacggccgccgcgcacatcaacaccgacctcgtggaagaagacaccgcacgcgcggtccacgccgcgcggcgtgaacccgaccacctgtcctga

SEQ ID NO: 7548 - DNA, 345 bp, Actinoplanes utahensis
gtgacggacgactactacaccatcgtccgcggccgcccctaccgcgccgcggacggcgtgaccaccgtacgggtgcggctcgacggcgaattcgacctggccgcccgtcccgccctcatcgacgagctgaccgccgccgccggggacggcacccggatcctggtcgacctggaccgggtgacgatgctcgactcggaggcgatcggcgccctgctggccggattcgaggccgtccggcacgacgcgacccggttccggctggccaacgcccgcggcgtcgtccgccgcgtcctggacatcagcggcctgtccttcctgttcgccaccgacccggccgccggctga

SEQ ID NO: 7549 - DNA, 1518 bp, Actinoplanes utahensis
gtggccagtcgtctgatgcggttgcacgtggtgatcgcggtcgtcgccgtcggcgggttcctcgccgtgccggacggcagcaccctgcagctggtgtggcaggtgacggccggctggctggccgcggtgatgatggtcatcgggatccggcggcgccgcgtcaccccggcggccccgtggtggctgttcgccatcggggtggccggcaacgccagcggcatcctggtcgagtacatcctcacccacacccaggtcgacccgggcttcccgtcctgggcggacgccgcctacctgtcgctgtacccggccgcggccgccggtctgctgctgatgatccgccggcgcaatgtgcagcgcgactgggccaccgccgtcgacgccaccacgctgaccaccggcatcggcctgctcgcctggatcttcatgatcaagccggcggccgaggacccgacgatcggactgctggggcacatcgtcagcgtggcgtatccgctgggtgacatcgtgctgctggccatgaccgtacgactgctgctcagcggtagcggtcagaacgtgtccttccgcctggtgtcggccgccctgatctgcttcctggccggcgacggcacctgggcggtgatcaaccagctggcgtgggagccgggtccggtcccgcaccgcctgctggccgacgtgttcctcgtcggattcctgctgttcggcgccgccgcggtgcacaccgacgcccgctcgctgagccgccgcgtcgccccgcggccggcccggatcagccggtcgttgctggccacgctgaccgcgacctcgctgatcgcgcccgtgctgctgatcgttcagacgctgcgccaccaggtcagcgacgcgctgtcgatcgcggtcggctgcatcgcgctgttcctgctggtcgtcacccggatgacccagctgctgcggcagctcgacgcgcagaccgagaaggcccgcgaactcgccgtcaccgacgagctgaccgggctgcccaaccggcgtgcctggaacaccgaactgccccgcggcatcgaacggacccggcgggccggcaccccgctcaccgtcgccgtggtcgacgtcgaccacttcaagcgcttcaatgacgcgtacggtcatccggccggtgaccgcctgctcaaggaagccgccgccgcgtggcaggagcagctgcgcaccgtcgaccacctggcccgctacgggcggcgaggagttcgtggtgatgctgcccgacgccaccgccgggcaggcgcacgccatcctggaccggatgcgcgccgccactcccctgggtcagaccttctcggccggcctggccgagtgggacggcaccgagacctcggacgagctgaccgcccgcgcggacgccgcgctctacgaggcgaagcacgccggccgcaaccggatcgccgtcgccgcctgagcgcgcctcgcctcagccccgcaggtaggccaggacggccagcacccggcggtgtccctcggtggcgaccggcaggtcgagtttggtga

SEQ ID NO: 7550 - DNA, 1302 bp, Actinoplanes utahensis
ttgaccgctgctgtagtcccgaaggtagagtccgctctactgcgcggcgccgccgcgatgccctacggtcgtggggtgcgaaaccggacagcgtggcaggcgatggcccagagcccgctcggtttcctgcgttccgcctggccgtggcgcgccctcgcctacctggtctcgggtgtcctgaccggcgcgctgacctgcgcaatcctggccgccctgatcgcggccggcgtggccggcctgatcgtcctgatcggaccggtgttcctgctcgcggccgccctgtccggcctcccggtggcccgcctggaacgccggcggttgcggctggtcgacgcggaccgcaccggcgacccgcaccagacgccggccgcaccgggcccgcgggcctggctgcgcacccggctggccgagccggcgacgtggcgcgagctggccttcaccctcctgtcggccaccgcgctgtgctggctggacctggtggtgctggcgttcgccttcgccgtgccgtggatctgcgtcgaggccgcggtcgaggacccggcggtgtggccgtgggcgatcgccggtgtgctgctgctgtcggcgtggccctacaccgtcacgtcgtgggccggcgcgcgcgccgcgctcacccgcaccatcctgtcgccccgcgaccgggaactgggggagcagctgaccgaggtgcgccggtcccgggcccggctgctcggcgccttcgaggccgaacgggtccgcatcgaacgcgacctgcacgacggcgcccagcagcggctcgtgtcgctcagcatgcagctcgggctgctgcggctggacaccgagccggactccgcgctgcaccgccggatcggcgaggcgcaggagcagctgaccaccgctctcgccgagctgcgcgacctggtgcgcggcctcaacccgcaggtgctcaccgacaacggcctggtcgccgcaatcgaggagaacaccagccggttcaccatcccggtggacgtcgacgtgcggctgcccgcccggctgccgcacgccgtcgagctggccgcctactacgtggtcaccgaggcgatgaccaacatcgcccggcacagcggcgcgaccaccgcgcggatcaccgggcgccaccatgccgacgtgctcaccctgcagatcaccgacaacggcgccggcggcgtcgatccggccgccggcaccggcatgaccggtctcgccgaccggctgggcgtcctggacggccggatgcggatctccagcccgcccggcgggccgaccctgatccacgtggagatcccgtgccccttcggatag

SEQ ID NO: 7551 - DNA, 399 bp, Actinoplanes utahensis
atgaccgccatgacgacctccctgaccagcgtccgcaaggtgtacggacacggcgaccgggccgtgaccgccctcgacgacgtctccctgcacttcccccggggcagcttcaccgccgtgatgggtccctccggctccggcaagtccaccctgctgcactgcgcggccgggctcgaccggcccacctccgggcagatcctgatcgcgggccgggacatcggcgcgctcgacgagaacgaccgcacccggttgcgccgcgaccggatcggcttcgtcttccaggcgttcaacctggtcacctcgctgaccgccgcgcagaacgtcgagttgccgctgcggttcgccggccggcggcccggccccgacgcggtgcacgcggcgctggcccgggtcggctag

SEQ ID NO: 7552 - DNA, 246 bp, Actinoplanes utahensis
gtgctgttcgccgacgaaccgaccggcgccctggacacggtcacctccggcgaggtgctggcgctgctgcggcaactggtcgacgacgagcggcagaccacgatcatggtgacccacgatccggtggccgccgcgtacgccgatgtcgtggtgttcctcaaagacggccggatcgcggaccgcatgacgccgcgccgggacgctcccgagctgatcgcggcccgcatgacccggctggagggctga

SEQ ID NO: 7553 - DNA, 2367 bp, Actinoplanes utahensis
gtgctcgccctcgccaacctccgcgaacaccggcgctcgttcgtcgccgccctcctcgccgtggccctcggggtcggtctgatcggcgtcacgctgctcgtctacgactcggcgcgcccgcgggtgccgtcccgcttcgcggcggccccggtgctggtcgtcccgcatcgggccgccgacgagagcggtcacctccgggatctgatcccgtggagcgaggcggacgccgccgcgctcgcccaccggctccgcgacggcgcggtgatcgaccggtcgttctacgcccaggcgttcctcgacgggcggccggtggccggcgacgcggcccgcgacgccgggcacggctgggcgagcacccggctggcgccgtaccggctggtggccggcgcggcgccgcaaacccccggcgaggtggcggtggacgcatcgctgggcgtccggcccggtgaccgcctccaggtcgacctggcctccgggccgcggcggctgaccgtgtccggcaccgtcgacgggccgggcttctacttcaccgacgaggctgccgcgcggctcgcccccggcgtccgggcgatcgccctgctgcggcacgacccgggcacggcccgcagcgcggtcggtgccgccggcacggtcctcaccggggacgcccgggccgcgctggagccgcagttcgtggcgcacaagcgcttcctcggcacccagctgatcacggcgatggccgccctgggtctgttcgtcacggtgttcgtggtcgccgccaccctggcgctcgccaccacccagcggcgccgggagatcgggctgctgcgcgcggtcggcgcccggccgggacagatccgccggatgatcctcggcgaggcggccgggatcggcctggccggctcgatggccggcgcggcgctcgcggtggccgccgcgccgctgatgaaggcgatcctgaccggcctggacgtgaccgcccccggcttcaccatccgggtgtccacctggccgctggccgccgccaccctgatcggcgtcggggtggccgtggccgggtcctgggcggcgagccggcaggccgcgagcgtgacaccgttggcggcgttgctggacgccccggccgcaaagcgcgcgatgacgccggcccgcggcctggccggtgccggcgcgctgagcctgggtgcgctgctcgcggtgctgaccgcggtctccggcgcggacgaccggatcaacacggcgatcggcgcggccatgtgcttgatcgtggcggcggcgctgctggccccggtcctgatcggcccggtcgtccgggtcgtcaccgcgccgctggtccgcagacgggcgtcggccggcccgctgctgatccgtgccgagctgctcgacgccgccggccgggcggcctcgaccgcggcgccgatcatcgcggcggtcggcttcgcggtgctgatcagcggcatggtgcagacgatgcggacggcgtacccggccggcgagaccaggaagctggccggtcaggtgctgatcgccccggacggcacaccgggcctcgacgaccaggtggtggcggagcacccggtcggcaaggcggcgctgcccacccgcgtcttcctggaccgcccgggccgggggccgaccgtgatcgacgctctgggctcccgggacccgcgctgggaccggccgggcgaggcggtgctgggggtgagcaccgcccggatgttcggtgtcgccgccggacgcaacgtcaccgtccgcttcgtcgacggcctgagcgagaccgtccggatctcccaggtcctcccggacgatccggcccgcggcgccttcgtgctgtcccgggcgctggtccgccggcacgacccggccgcactcaccgacaccgtcttcatcccgcaggcggacgccccgcggacggtggccgccggcgccgcactgcacgacgcgcagagctacgccctcgccgactacgacaccgacgcccgcctcaccgccggcctcgcgacgatgctgatcgtggtggcggtcggctacagcggcctggcggtggccaacagcatggcgatggccgcgtacggccgccgcgacgacttcgcggtgatgcggtcggccggcggcacggtccggcagctgatcggcttcgtggccggcgagaccgcgctggtcgccgccatcggcatcactctgggcgtgctggtcacgctgccgccgctggccggcatggcctccggcctgtcccaggtcaccggcacggacgtcacgatccacctcgacgccggcacggtcaccgcggcgatcctcggctcgctcgtgacggccgtcggcgccgccgtcgtggtcacctggcgggttctgcggccggatccgggtggcaccgccggtccgcggtga

SEQ ID NO: 7554 - DNA, 1290 bp, Actinoplanes utahensis
atgcgggggctggcgctcggtgacgcgttcggcgagacctggctgatggagccggccgcaaccctggcggacgcgctgctcgcgcggcacgtcaaggacgggccgtggctgtggaccgatgacaccgccatggccctgtcactgctgcgggtcctggaccggtacggccgcgtcgaccaggacgcgctggcggtggcgttcgccgagtcgtacgccgcggacccgtaccgcgcctacggccccgccatgcacgacgtgctgctggccatcggccgcggggtgccgtgggccgaggcgacccggcgcaagttcgacggcatgggctcgtggggcaacggcgcggcgatgcgggtggcgccgctcggtgcgtggttcgccgacgacctcgacacggtggtggccgaggcgacccgctcggcggtggtgacccacgcccatcccgaggcggttgcgggagcggtggccgtcgcggttgcggcggcatgcagcgtacggggggtgcctcccgccgagctcatcgcggcggtcaccgaccgggtgccggacagcgaggtcgccgcccgcctgcgccgcgccgcccggatcgcgccgagcgccgacccccgccacgtcgccgggatgctcggctgcggtcgggagatctcggcggtcgacacggtcccgttcgccgtctggtgcgccgccacccatctcgacgatctcaccgaggccctgtgggccaccgccctccccggcggcgacatcgacaccacgtgcgccatcgtgggcggcatcctcggcggccgcaccggcctgaccggcgttcccccggcctggctggccgcgtgcgaggcattaccgccgttcgtcgacgagatcggcgacgcacaccgcgcttcgatcggccgggtacacacaccctctcggatgtccgggctgcccgaactgaccggcgtccggaaggtgtggttcagcggttggtacgacggaccggtcaccggcatcgcggaacacgacggccacgagtactggttcgtcatggtcgtcaacgacggcggcggggcctgggacttcgaaccccgcgtctacctgctgcaccgcctgcccgaggagcagttggccgaagcctggcaggcacatcggagcttcacggcggccggcctgcccggatgcctgcactcgccgccgtgcccggtcaatcccgccgaagcgccgacccgggaggcgctctgggagcgctggccgccggagcaggaagaccactacgcggacgcgcccgccatcgggtggttccgggatgcggcaggctga

SEQ ID NO: 7555 - DNA, 594 bp, Actinoplanes utahensis
gtggcgcgcgtgatcatgcaggcggtcgtgtcggtggacgggttcatcgcgtatccggacgactcggtggggccgctgttcgactggtacggcaacggggacgtgaccgtgcacgcgaacgagcagtgggcgttccgggtgagccgggcgtccgccgaccatgtgcggccgttctggggtgacgtgaagtgcacggtgatcggccgccacctgttcgacaccaccgacggctgggcgggagtgccggccgccggggaccaggtgatcgtggtgacccatcggccgctgccggcggagtggctcgcccggttcccggacgctccctttcgtaccgccggatcggtcgaggccggaatcggcctcgcgaaggaggtggcgggtgacggcctggtctgtgtgaccgccggggatgtgggcgggcaggcgttcacggcgggcctggtggacgaggtggcgatggatgtggtgccggtggtcttcggcgcggggaagcgattcttcggtgcgcacaccggcaccgtcctgctcggggatccggacgccgtggtgcggggcgaccgggtcctgcacctgcactacacggtgcggcgctga

SEQ ID NO: 7556 - DNA, 684 bp, Actinoplanes utahensis
atggacgtggtgctctacaacatggtcacggcggccgtgctgatcctggcgttcaaggccgcccagcgactcgccccgcggcggcgcttcccggtggtcgccgtcgccctcaccgcgctgatcatcggcggcctgatcctgcaggccacctggcccggcgccatggccgcgctggacagcgacccgtcccgcagcggctggtggcggccgctgacctcggtgctcatgcagaacggcggcttcaccggcgatctgtggaacgtcctgacgatcgccggtatcgccgcctacgccgagtggtactgggggcggctcgccgcggccggactgttcctggccgccgccctgatcccgcactggctggacgtgttcgtcggcgacgcgcaggtcagcaacgagccgcgcaactgggcgggcagctccggcgtgacctacctggtcgcggccaccctggccggcgcgctcgcgatccgggcgctgcgcacccggcgggtcaaggacggcctgctcgcggtcgccgcgccgctcgtcgggctggcgacctggttcgtgcaggacaacgcgcacggcctgatgatcgtcgagggcttcgtcgccggcgccgtgctcgccgccctgttcaccgagcgccgcgtcgaccccgagcccgccactctggcgacggatcagcgccgcaccgtgtag

SEQ ID NO: 7557 - DNA, 612 bp, Actinoplanes utahensis
gtgaagctgaccagggagcgcatcgtcgaggccggcatgctcacgttcgccgagcacggatacgccgggctgtcgatgcggcaggtcgcggagcggctcgacgtgcacgccgggtcgctctactaccacgtgcgcaacaaggaggcgctgctcgtcctgctcgccgaccggctcgccagccgggccttcgaggccggggagaaggcgttggccgagctgccggagtcggcgggctgggccgaccgcgtcgaggcacaggcgggcgcgttgcgccagacgctgcgtgcgcacgccggtgggccgttgctgctggcaggcagcccggccatgctcagcgcccaggccctcgcgctgatggagcggctgctggccaccctgcgcgacggcggggtgcccgaggccgaccgcacggtgctggccgacgtggtgctgagctacgtcaccggcttcgtgctgcaggagcaggcggagccggagaccgcgccgcccggggacgtcgaccatgctgcgctgacggcccggttcccgctgctgttcgccgcgcccccgggaagctccgacgagatgttccaccgcggcatccgccagatctgcgcacgagccggcagctga

SEQ ID NO: 7558 - DNA, 222 bp, Actinoplanes utahensis
atgagttggtcgttcagcttcgtcgcggcggcctcgatcctcggcaactggctgggggtgttcctcgatctacccgcccggccgaggctcgctctgaccgcgtacgcggtgtcgttcctgatcgcgatcgtcgtcgtgcttcgcgcgcttcccagtgagtcgccggccgggcatcggtcgacagtgccggcgtccggtcatgaccttcgtcgaagatcgtga

SEQ ID NO: 7559 - DNA, 1008 bp, Actinoplanes utahensis
atgacgctcgggctggccacgtcgatcatcgggtcacgggtcgtcgatggtggctcgagcggagcggtggcggagagcgtcctgccgttggcatggctggccgtcctcgcgaccgggagcgccggcatcagtttcgctgccccgctgatcgccagattgaccgcgcctcacagcccggccagaaccctggtcgcatctgatctggctgaagccgtggtatccgtcatcgccctcatcctgctcgtggtgtctcccggcggaagatcgaccttgttgggtgggtatctgctggtcgtggccgtctttccggccattatggatgtcgtagaggagttgtacggtcagcagatagcgcaactggatgagaaagaggcgcttgccttcaacacgaacatctactcggtgctgggtttcgtagggctggcggtcggaatgccactgggcagttggctgaccggtcgatcgatcgtatggctggtggcggcgaatgcgctcttctccttcatcggtttttccttccggctcgtcagctcccgtacgttgatggtcggagcgatctacgaccaggacgtaagtgagtgcagcgcggtcggcggacgaatgaagctgcgagaatttctctccgatctgctgcggaccggtccgacgtcaccggcgatggagttcgtgctcaaggtcggggccaccatggcgggtgtcttcgtctacctgtgggtggcctcgttcacgccgtggccggcgggcaccgcgctcgctgcggtcctgcttgccttcggtgtgggcgcgaccatcggaccgtatgtcgctccggtcctccgccgcactctcgcgccgaggaccgcgttgctggtcacctactccttcgccgctgtggtctcgtctgccatggccgttttcgcgggtgtggtcgagagacaccgcctctgggtgatcggcttggcgttcgtcctggcgctcggcgtcgtatcccgcgcgcgtgcggtgttgacggtgacgctgcgtcagtag

SEQ ID NO: 7560 - DNA, 405 bp, Actinoplanes utahensis
gtgccgggtcagcttgaggtggaagaactcctcatcgcgcgcgatttgcatgctgtctcccctcttcgcaccgagtatctgccgggtgagctcgcgcagtgtgacctttggtttccgccggtcgacgtgccgttggggttcgggcaggtcggcaggccaccagtgctggtgacggtcatcggctattcgcgctggctgacagcgatgatgatcccgacccggcaggcccccgacctgcttgccgggcattggtggctgctgaccggcctgggtgcggtcccgaaagcgctggtctgggacaacgaggcggcggtcggctcgtggcgggccggcaggccgcagctgaccgcgaccgcacgtcccgagccggtctcggccggtatcggcgctcagcgcttcaggtag

SEQ ID NO: 7561 - DNA, 645 bp, Actinoplanes utahensis
gtgcgcgtcgtcctcgccgaagacctcttcctcctccgtgacggactgagccgtacgctcagggagcacggtttcgaggtggtcgccgcggtcgacaacgccccttcgctgcggcacgcgctgctgaccgagaaacccgacgtcgccatcgttgacgtacgcctgccgccgtccttcaccgacgaaggcctgcgggtcgctctcgaggcccgccgcgagctgccgggtctgccggtgctcgtgctgtcccagtacgtcgagcagctgtacgcccacgaactgctggccgacggcgccggtggcatcggctacctgctcaaggaccgcgtcaccaacgccgagcagttcctcgacgcggtccgccgggtcgccgccggcggcaccgtgctcgaccagcacgtggtggtcaagctcctggctcgcggcgaggcacgcggccggatcggcagcctcactccgcgcgagcgcgacgtcctcgaactgatggccgagggccgctccaacgccgcgatcgccgccggtctgcacatcaccgagagcgccgtcgcgaagcacaccgcaagcatcttcgcccgcctcgatctcgtaccctccgacgacgtcaaccggcgggtactggcggtcctggcctacctgaagcgctga

SEQ ID NO: 7562 - DNA, 2019 bp, Actinoplanes utahensis
atggcacacgcggcacggaaacggatcgtcgtgggtgttcctgtttccctgtcaagtgaggcgcatcgtggttcggaccgaggtagttcgtcgttcgcgggtatggccgatggccaccgtcttctttgccgtcgccacggtagcggccggggtcttcggcgccgtgcaacctttcaccggcattcccgaagaggtcatccagctgacccagttcgggccggccgttgccgtcgcggtgctggccggggtgtggccggcccgcacgagagcactgctccacggcgccggctccggcgaagcgcggacaggtccggtgctgttgagcaccgctgtactgatcgtcgccggcgcggtcggggcccatggcgtgatcaccggaggcgtcggtttcacccggcccgagcatccgttcctgctcatcgcggtcgcccagctgatcggtgcgtgcggcgaggagatcggctggcgctgcctgctgcaaccgctgttgcgtacgcggttcggcccgctcaccgcgtccgtgctggtcggcctgctgtggggtctctggcacgtccccgtgttcgccgagggcccctggtacggaggcctcttcctgctcgccacgatcgcgctgtccgtggtgatgggcctggcgctggaacgggcccggtcgtaccggctactgctggccgcgggcttccacacgttgatcaatctaggcatgctgctgttcatgaacgaggagtccggcgccgtactgcccatcgcccttttcggagcgtccgccgcggtggcggcgctcgtggggacggcatctcgccgatgatcagggggctctggcgatgccagctcatgagctggttcacaatcgtggggtggctcaccgggtccctgacgatgctcgcggtgctggcgctgccggtcggcgtcggattcctggcggtcacgccggccgcggtgctgctacgccgggtgtccgacgtcgcccgcggctgggccggggtgaccgaccggcccggcccgctgccctcccgcgcggtcgccatcctcggcaccgaggcgttctggcgcgacctgacctgggcgatggtcgacccgctgaccggcggcctgctgctcgccgtcccgatcgccttcttctggtacgggatcttcggcgtcctcgtgcagccgttcctctggcgttcgctcggccccggcaactggtacgcgttcatcccggtcgacagtgttgcgaccatgctggccgcactgatgctcggcgccggcttcgtcgcgatcgccctgaccagcgcgacggtcgtcctggaccggcacgcccgctggacccgacggatgctcgccgaaccgcgcaacgccgccctcgcgcggcggatcgcgcagctggccgacacgcgcgccgaggccctggacgcgcaggccaccgagctgcaccgcatcgaacgtgatctgcacgacggtgctcaggcccggatcgtagccatgggcatgaccctcgatcaggtcgcccggctgctcgacaccgacctgccgcaagcgcgccggctgctggtcgaggctcgcacgacctccgaccgggcgctgaccgaactgcgcgatctggtccgcggcatcaacccgccggtcctcgccgaccggggactcggtgacgccgtccgtgccctcgcgctcgacagcttcctcgacgtcgaggtcgccgccgagctcccgggtcggctgccggcaccggtcgagtcggccgcctacttcgccgtcgccgaactactcgccaacgccggcaaacacgcccgagcccgtaccgtccggatcagcatcacccacgacggcgacgcgctgcacctcacggtgaccgacgacggcgcgggcggcgccgatccggcgaacggcaccgggctgcgcggcgtgcggcgccggctcgataggttcgacggcaccctcgccatcgccagcccgccgggcggccccacccaggtgaccatggagattccgtgcgcgtcgtcctcgccgaagacctcttcctcctccgtgacggactga

SEQ ID NO: 7563 - DNA, 1605 bp, Actinoplanes utahensis
atggggcacggtggtcgacgcgcacagcacgttcgtcaaacaggtcgccgagctcggtgggtccatggcgggcggcgaggcgctcgcgcccacgacgacggccaccacgatcaagggtgccggcacggtgacggacggcccgttcgtcgagaccaaggaggccttcggcggcttctacgtcgtcgaggcgcgcgacctcgaccacgccgtcgagatcgccaggctgtgcccggctcccggcggcggtgtcgaggtccgcccggtcgtggacccgacgacgagcccgttctgatcgctgccgacgacgagccgaccgcgtccgccctgcaggcggacgcggtcgctgccgcgctggcgcaggcccaccgatccgagtgggccttcgtgctgtccgccacggtgcgcgtcacgggcgacctggacgtggcggaggaatgcgcgcaggaggcgtacgtcagcgcgctgcgcgcctggacccgggacggcgtcccggagcggcccggcgcgtggctgaccacggcagcgcggaaccaggcgctggaccggttgcgtcgcgaggtcaccctccggcgcaagctcccgctgctcgtggagccggcgaccgtcgatccgcacgacccggccgacccgaactcgcccgacgccgcggtaccggacgaccggctccggctggtgttcacctgctgccaccccaccctcgcccccgaggcccgcgtcgccctcaccctgcgcctggtctgcggcgttcccacgcccgacgtcgcccgggccttcctggtgtccgagccgacgatggcggcccggatcacccgggccaagaagaagatctccgaagcgcggatcccctaccgcgttccgggccgggcggagctgcccgagcgcctggacagcgtgctcaccgccgtccacctgctcttcagcaccggccacacggccggcgagggggacgcgctcgtccgtgcggagctctgcgaccgggccctgcacctcgcgcgcaccctcgccgcgctgctgcccgagcaggccgagacccgcggcctgctgggcctgctgctcctgaccgacgcgcgccgggccacccggaccgacgagcagggccggctgctcctgctcgccgaccaggaccggacgcgctgggatcagcgcgcgattctgcaggggctcacggtgacggccggggcactggcgtccggaccaccgggacggttcaccctgcaggcggcgatcgccggcgtgcacgcggtggcgccgtccctggagcagaccgactggccgcgcgtcgtgcacctctacgacctgctgctggcggtgtggaacaccccggtggtcgcgctcaaccgggccgccgctgtggcgttcgcggacggcccggccgccgccctgccgctgctcgacgagctctcgaccgagccccggctcgccgactacccctaccttcccgccacccgcgccgacctgctgcgccgcctcggcgacgccgccggcgcggctcaggcgtaccggcgcgcgatggagctcacggcgaacgccgcggagcgcgccttcctggagcagcgcctggccgaggtcagccgggccgccggcgccgagcccgcgcccggctga

SEQ ID NO: 7564 - DNA, 2454 bp, Actinoplanes utahensis
gtgacgggcaaccgggaacaccgcctgcccgcgacgagggagcaagaacctcgtcgaaggggcgagcctccccgttatggtcacatccccggtccggtgaccgatacatgggaagacatcggtgaccggacgtggggcgagcaggcgggagaatgcaggttgtcgacacgacggttgtctccctcgctgacgggcctggtcggtgcggtgatgtgggtgatcgccgcggcgtacacggtgggtctggttctgcagcctccgggtttcgtggtggcggtggacgtgtggctcaacatcgccgcgatcgccgcgccggcgctggtgtgctgggcggctgtcctgaccgcaggtggccggcggctggaactggtgttcatggcggtcggctgcaccagctacgcgatcggtaacgccctgctggccatggccgctgcccggcacgtcacggtggtgacccccgcttggagtgatgccggatttctgctgttctatccggcggtcctggccgcgctggtcaccgtggcgcgtcgtgcgttgtcgcggcgtagcggccaggtgtggtgggacgccgccgtcgccgccctcggcggggcgacaggcctcgccgtcctgctggccccggtgttctccggcatcagcggcagcccgttgcagatgatcgtggccgccgcctatcccgccgcggacatgacgctggtggcggtgctgctgggtctgatgtgcctgcacggggcccggttcccgcgccggtggctaccgctgatcgccgggctggcgctgttcgcggccgcggacatcagctacacgctgcgggtagccgccggcggctacacggtgggtactccgatggacggcctgtgggcgctggggctggccaccctggccacctggaccgtgcgctgcggccgggaacgctccggcgccggcatcgattccggggagcagccgtattcgcccagtctgctggtgcccgggctgtccagcggtgtggcgttggccgtgctggtggccggcagcaccgcctccctatcgcgcgtcatcctgctgctggcgaccgcgaccgtgctgacctcggcaggccgtacgcacgtggcttaccggcagctgcgacgtatggcgcagctcacgcgcgaggctcgcagcgacgacctgaccggcttggcgaaccggcgtgccttctacgaccacgccggccgccgcctggcccagggcagccccttcacgctgctgctgatcgacctcaaccggttcaaggaagtcaacgacagcctcgggcaccacgtcggtgaccagctgttgcagcaggtcgcgcggcggcttgccgcccagatacgggcgggggacctgctggcgcgcctgggcggtgacgagttcgtggtcctcgccgacgccggtgacgccgacgcggccctgagcatcgccgaccgggtgcacgaggcgttgagcgccggcttcgaactggacggcatcacggtgcacgcgcacgccagcatcggcctcgccctggccccgcaccatggcagggacgtcgccatgctgctgcgccgcgccgacatcgccatgtaccgggccaagagcggccggtacggcaaccagctgtggcagccgaacaatgacgaggccagcgccgaccggctgcggctgcagcaggaactacgcgagggcctgcgcaccggtcagctggtgctgcactaccagcccaagatcgatctgcacgacggtcaggtgcacagcgtcgaagcgctggtgcgctggcagcacccgcaccaggggctgctatacccggatgcgttcctgggcctggccgaggacgccggcctgatgcacgaactcacgacgaccgtcctgcacctcgccctgcgtcaagccgcgcactggcatgccgccggccatccgctgagcgtggcggtcaaccttccgccgtcggcgctgatggacgcgcagctggccgcccgcatgaccgacctgctgcgtcagtacgacctggctcccgccgcgctgcagttggaaatcaccgaagacgcgatcatgggcgaccgggaacgcgccgccgcggtcctcacccagctgcgggctgccggtgtgcgcatcgccatcgacgacttcggcaccgggttcagctccctggcctacctgcgggacctgccggtcgacgatctgaagctggatcgctccttcatcatgcccgccaccagcgacgaccgcgccgcagcactggtctcgtccaccgtcatcctcgcccacagcctcggcctgcgcatggtcgccgaaggcgtcgaagatctcgccggcgccgagcaactccaacgtttcggctgcgaccaggcccagggctacctgtactcgcgcccggtaccggccgaccagttgatcgcttggatcacctcccgtgcgtcggctgccgcggccgcagcgggctcagagccgatccctgccgcggtcgccgtcggctga

SEQ ID NO: 7565 - DNA, 2274 bp, Actinoplanes utahensis
gtgccggcacccgcagccgatgaggttttccgcggtgggaccgggctgcgacggcggctgtggtggctcaccattgccctcgggatcgcagcgatcggcggctacttcctgcttcccggcggcggcttcgcgcaagccgtggcgtacaacgccatgggtctgctgtccggactggcgatgcttgcgggggtgtggctgcaccggccgtcgcggcgggcgctgtggatcttcttcgcggccggacagttgatgaacgtcgccggcgacgtcatctggaacatctacgagtacgggctgcaccaggaaccgttcccgtccgtcgctgacatcttctacctgggcagctatcccctgttgggggcagggctggtgcgactggtgcgccagcaccacggccgccggccgcggcaccttctcgacgcggccatcgtggcgaccgggaccgggctggtgttctgggtgttcgtgctgcaccccgcggccgccgccgcggcgaacaccccgctggaacgcatgatcaacactgcctatccggctgttgacgtcatgctgctggccatcctggccggtctgttcacgctgcccggtgcccgcaccgccagcacgtggttactcgccggagcggccctggcgctgctggtcgccgacgtcggctactcggtgctgaccgctcatctcagcttcgacgacggcaacccgctcgacgcggcatggctgctgtcctacgtgctgtggggagccgcggcgctgcacccttccatgtccgcacggccggccgccatagcgcacggcgtggggaccgggctcggccgggggcgccaggcgttgctcgccgtgtgctccctgctggcacccggcctgctgttcgtgcccggcgtcgccgcccgccccgcggactggatggtggcggccgccggcacggtggcattgttcctgctcgtctcggcacgcatgtcgggattcgtgaaccgggtgcagaaacaagccggccagttggagaagctggccctacacgatgagctcaccggcctggccaaccgccgccggttccaggcacaactgagcgcggccctgggcaacggtccgtgctgcatcgccctgctcgacctgaccggcttcaagaagatcaacgaccagttcggtcaccgggtgggcgacctgctgctcgccgaggtggccggccggctcaccgcggccgccgaccatccggcctcggtggcacggatgggcggcgacgagttcaccctgctgctgccggccgcctcgcgggagagcgccaccgaggtcgccgagcacgtccgccgcctgctcgcgcagccgatccgggtggccggacacgagctgctgatcagcgcgaacatcgggctcacggaaacggacagcctcggcgacccggtggaggcgctgcgccgcgcggacgtggccatgtacgcggccaaggaactcggtgagccgtaccgctggtacgacctcggactcgaccggcgcgcgggcgaggacgcacgtgtcggggccgaactgcgtaccgcgctggatgccggccagctgcggctggtctaccagccgatcgtcgaactgcccactggccggcagatcgccgtcgaggcactcgttcgctggcaccaccccgaccgcggagtgatcagcccggcggagttcatccccgtcgccgaacgcaacgggaccatcgtggaaatgggtgcctggatcctgcgcacggcgtgcctgcggatggcccgctggcatgccgagcacggtccggccgcgccgcggcatgtgagtgtcaacgtgtccgctcggcagctggcccgccccggcctggccgaagtcgtggcgtccgcgctggccgacagcgggctgcccgcctcctgcctgacggtcgaggtcaccgagaccgccgtcttcgagaccgaccgtgccatccagacgctgcaccaactggacgcgatgggggtacggatcgccctggacgacttcgggaccgggcattcgtcgctcgccttgctgcgcaccgtgccggcgcacgcactcaaggtcgacaagtcgttcgtcgacgaggtgaccgtcggcggccgaacctcggtgattgcggcggccctgatccaggtggccgacgcgctcggcatgaccgctgtggccgaaggcgtcgaaaccgccgagcaggccgcagaactgcaccggctcggctaccggctggcacagggctatcacttcggtcgtcccgccgagcagccgctgccagccgagctgccactcatcgccgaagccgcctag

SEQ ID NO: 7566 - DNA, 360 bp, Actinoplanes utahensis
gtgcgcttgacgggtgactcttactgcgcccggcagcgccgggaactactggcccggcgccgtgccgcggacccgccggcgctgcgggtgcccgagcgaggcgaaacaccgattgccgccaacggtgtgaagatcatgctgcggcgccgcggtgcgctcgccggtgtggcgactgttcacgcgcatcggtggcggcacaacttcgcgcacgagtggaagctggccggcggtgataccggcgatctgatgctggtgcccggttgggcctcggatgacgtgccgagccgcgatggcgcgtatgcagcggcggagcgggcgcgggctcggtcattccagccgcagaccgaggaacctcactag

SEQ ID NO: 7567 - DNA, 2814 bp, Actinoplanes utahensis
gtggatcgtcgaacgctcctgacttccgtcgcggccgtagcggccgtgacaccgttcgtgggtggcggtgcggcgcgtgcggccgcgcccggctatgtgaccaaccgggccccgttgcagcccgaggcgttcatcaagctcaaacccggctcgaccaaggcggccgggtggctggcgacccagctgaattaccagctgaacggcctcaacggacggatgaccgaggtctcgcatttccttcagtacgacaacaccggatgggtccacccggaccttgccggctgggaggagctgccctactggctcaagggatactccagcctcggctacgtcacgggtgacgcgaacacgcagagtgtgaccgcgaagtgggtgaacggcatcctggcgacgcaggccggtgacggctatttcggcccgacagcgcagcgcacgagcctcaacggtggcccggacttctggccgcacatgccgatgctgcacgcgctgcgcacctttgccgaattcaccggtgatttccggatcgtcccagcgttcacccgattcttccacttcatgaacgctcagccggtgagtgccttcaaccagagctggggtgcccagcgctgggcggacacgctcgaggtcgtctactggacctacaaccagacaggcgacagcttcctgctcgacctggcccgcaagatccacggcaactcggcgaactacatcgacaacctgccgacgctgcacaacgtgaacctggcgcaaggcttccgcgagccggccgtctactcggtactcagtggggacccctcgcaccgggcggccagctacaacgactacaacatgatcatgaattcgtacgggcagttcgcgggcggcgggttcgccggtgacgagaacgctcgccccggcttcggcgacccgcggcaggggttcgagacgtgcggaatcgtggagttcatggccagccacgagatcctgacccggatcaccggcgacccgatctggggtgaccgcacggagaacctggctttcaactcactgccggcagcgctcgacccgcagcagacgggcatccactacgtcaccagcgcaaacagcatcgccctgctggaccggccgggtcacgccggccagttccagaacgggttcgcgatgcaggcgtacatgctgggcatcgacaactaccgctgctgcccgcacaactacggcatgggctggccgtactacgtcgaggagatgtgggtggccacccccgacggcgggctggccgcgacactgcacgggcccgcgacggtgacggcgaaggtcggcgacggcaccaccgtttcgatcaaggcggacacggtctacccattcggggaaacgatcacttacacggtgacgacgccgaaggcgctggcgttcccggtctacctgcgcgtgcccggatggtgcacaagcccgagtctcacggtgaacggcgccgcgcagactgtggcgggcgggcccgcgtacgcaaaaattgccagaacctgggcaaacggtgaccggatcgtcctcaaactaccgatgcaggcgaaaacccgcacctggacggcgaatcatcggtcggtgtcggtggacttcggcgcgctgaccttttcgctggcgatcaccgagagctggacccgggtgggcggctcggcggcgtggcccacgagcgaggtgcggcccggttcggcgtggaactacgggctcgacggcgccacccagttctccgtgacgaccggtctagggaacgtcaacgacccgttcaccgcggcgaacgcgccaatcaggatcacgaccccggcccggaggatcaccggctggaaggcggacgcggacaccatcgtcacgacgctgcaggacagcccaacgccctcgaccgaggcgatcgagcagatcaccctcattccgatgggcgcggcccgcctgcgcatcacctcgtttccgacgatcggggccggcacgccgtggcagagcgccggcgtcgcgttccgcatccagaaccagaacagcggcaaggtgctcggcgtcgactcgatgtcgaccacgaacagcgcacgggtcgtgcagttcggtgacaacggcacagccgatcacctgtggcgtttcctcgacaacggcgacggctgggtgaaaatccagaacgtcaactcgggcaagctgctcgccgtcgacgtgatgtccaccgcggattccgctcaagtcgtgcagttcgacgacaacggcacggccgaccacctgtggcaggtgctcgacaacgcgaccggctacgtccggatcaagaacaagaactcaggcaaggtgctcggcgtatcgggcatgtcgacggccgactcggcgaacgtggtgcagttctcggacaatggcaccaccgaccacaactggcgcctgatcccggacggcaccgtgaagctccaggtgacccacaccagcgacgtgctcgccatcaacaacatgtccaccgcgaacggcgcccagctgcagcagtacccggcggtcggctccgccgaccacatctggaggttcgaggacgctggaggcggtcacttcaagatcctcagcaacatggacggcaaatgcgtcgacatctccggccagtccacggctgacggcgccaaggccgtgcagtgggattacctcggcggcaccaaccagcagtggcggctcgtctggaccgcgcccaacgtcttcgcgctggtggcccgtcacagcggtaaggtcctcgaggtacagggccagtcgaccgccaacagcgccgacgtcggccaatggcccgaccttggcctcgccaaccagcgctggcgcatcatccccgcctga

SEQ ID NO: 7568 - DNA, 5487 bp, Actinoplanes utahensis
atggcagaggagctgctgtacagcagcgaccggacgcacgtcttgctccagagcgcggccgatggcaccgacccgctgatctgtaagcgcgcctcggggccgggggcggttcggcgaatcgagcacgagcgccgcgtgctgtgtcacctcgacggtgttgccggggttccgaagctggcggcccggcagggacgacaggtcctcatgctgcaggttgacggcgttcccgccgcgcccggtgtccagctgccggtgcaccgcctggtcgaggtcgcgtgccagctcgctgacaccgtcgccgctgtgcatcaggccggtgtgctgcaccgcgacatcaccccggccaacctggtgatcccggacctgggccgtcccgtcttggttgatttcgatctggccgtcctgctcgacgacggagcagccggtgtgccgccgcccgaagaaccgctcggcaccctgggtttcctgcccccggagcagaccggccggctgcgcctgccggtcgaccggcgcagcgacctgtacagcttcggcgccaccctgtatgccctggccacgggtatcccgccgtttcccggcgacgagccgctcgaatcggtgcgcgacatcctgactcggacaccggccttccccggcgaccgtgatccgcggattccccggcagctcggcgcgatcatcatgcggctgctggagaagaacccggaccgtcggtatcagagcgcggaggccctcggccacgacttgcggcgtttgaccgccgacccggacaccggatggctgctgggcgaacgtgacttcccggcggtgctgtccggcccggcacagctggtcggccgggacgacgatatgcgccggctggacacggcgctggagcgagtgctgtccggcggcggccccgctgtactggtcgccgggccgcccggggtcggtaagaccagcctggtggcggggctgcggccgagggtgacagcccggggcggctggttcgccgccggcaagtacgaccagttccgggccggcaccggcaccggcggtatcggccgcgccctggccgccgtcgccggcctcctgctggccgaaccggagcccgcgatggccgccgaccgaaaactgctgaccgcgacgctgggcccgaacaccgcgaccgtcgtcacggccgtgcccgagctggccccgttgctcgggccaccggcggagacattctcctacgatccgggcaccgcctcgagccggatcagcgccgggatcatcgggctgctgcgggtggtcgccggacggcgcccgatagtgctggcgatcgacgatctgcagtgggccagcagctcccagatgcgggtcctggacgccatcatctcggccggaccgatccccgggctgctcgtcgtgggcacctaccgcgatcagcagatggacgccggtcaccccctgacccccctgatgacacgctgggccgcgcagggtctgacatccccaacgttgcggttaggcgggctcgcgccgcacagtctcgccgacctcgtcggcgccgtcctgcggatgacgccggccaccgccctcgacctggccgagctcgtcagcgcgggcaccaggggcaacccgtacgccacggtggagatgctcaacgccctgcgcgccgagggcctactcacgctcggggcgaccggatggcgctgggatccggccgaggtccgcgggttcatcgcgcggtaccaggtccccgaccttctcgcgacacgtatcggccagcaacccgagcccacccgccgggtgctgggcgcgctggcctgccttggcggcaacgctcgcccaacgctgttgggagccgccctccagatgccggagagcacactggcgcggcacctcgcggcggccaccgcggaccggatgatcaccatggacccggccgggacggtccgcttccggcatgacctcatcatgcaggcggcccgggacggcatgtcggccgccgagcgtgccgacctgcagcttgacatggcccggcagttggcgggccgggaggactgccgacgcgaggcagccgagcagtatctcgccgcgacggaccggatcaccacaccgcgggagcgggcggtggccgcgcggttgctgcacgaggccgggcggcattgcgccgggctgaccaacttcacggccgccgagcaactgttcggctgcgccgagtcgctcaccgccaaccggcagggcgaccagtgcttgcgcgacgtcatcgccgtggaccggcatgccgcgctgtactgtctcggccgcctgagcgacgccgatgacgtctaccacgacctggtgggccgctctccggatctgctgaccctggcccgcgccgcggtcaatcagatcaacagtctcactcagcggggcagcatcacggaggccatcgagctgggcctggccgtgttgcgccggctggagatcgtcccgcccggtgacctgagctgttcgatcgatgcgggtctggaacggctgtaccgatggtccgctcagctcggcgccggtccgcgagccgacgccgaagtggagacgaccgatccgcggatcgtggcggccggtcggctgatcaaccggttgctttccccgactcggcagagcgattccccgatgctgtacgactggctcatcctcaaggcgcacgagttgtgggaacagtacggcgtatgcgcctcgctggtcgggtcgttgagcgccgtgacctgtgtgaccatcggcctgcgcgacgactaccgcaccgggtaccggctgacccagcacatcgtcgaggtcgggcagcggcacggctaccaggtggagaccgccatcgcccgctacattctgctctgcgaggcagcacactggttccagccgctcgaggacatcctcgatgtggcccgccaggccggcgacgaactggtggccgccggcgaagtgcaggtcgccagcatgctagcgaaccggctggtggcggcgctgctggacggcagtgaaaccctacaagccgccgaggacgagctgaccccgtacctgaccttcgccgagcggaccggcggccgcctgccgaccttcatcctcaccggctaccagcagctgattcgcgccctacagggccggaccgcgggccccggatcgttcgccgacgccgacttcgacgaggcgggataccgatcggcgatcggctcgctcggcacgccacgagcgacgtaccacgccaatcgcgccctcaccgccctgctgttcgacgactccgcggcgctcgacgagcactccgccgcggcgatggccgacgtcttgccgatgcgcggctactacgtctccatgctggcccggctgacccgcgcgctcagcctcaccgcccggatccgcgccgggcagcacgacccggcgctcaccgccgaactcgacagcgtccgaaactggctggcccggcgtgccgacgactgcccccgcaacttccggccgctgcggcacctgattgacgccgagcgggcctgggcgtacgacgacgccgccaccgcgacccgcgaattcgacgccggactcagcgaagtctccgggcggccctggcaccgcgcgctgctggccgagcgggccggtctgttccacctcgcccagggcttgcgtcacatcggcagacagctactcttcgaagcccgcgacgcctaccgggcctggggcgccgacggcaaggtcaccgcgatggaggcggcccacccgttcctgcgggccactcccgcgccgggcaccggcagcggcccaggcatcgccgaattcccggggatcgacctcatggcggtcctgcgcgccgcacaggccctcggctcgcagagcaccgtggccggcctgcaagcgagggtcggcgaggtgctcagcgccatcaccggtgcgaccgacgcgcatctcgtactggagaatccggagaccggccagtggtacgcctcgaccatcaccggtgccggcgcggacgccatcaccggggcaacccaggtcagagacccgcaagccgcgaccccgccggacatccacacggaccacaggctcccactgtccgccatccgttacgtgttgcgcacccacgagccgctgctggtcccggacgcctgccgggacgaccgcttcgcccgcgacccgtacctcgctggcctggacatctgctcgctgctggtggttccggtaccaagccacaacgtcgcgcacgccgtcctggtgctggagaaccgccagcagcccgcggtcttctccaccgaccgcctggaaaccgtgcggctcatcgccgggcacctagcagtctcgctggacagcgccatcgttcacgactcgctggagaccaccgttgccgcccgcaccgccgatctcgccgccaccaaccgccggctggccgacagcgaacagcgcttgcgctcacagttcgagcacgcggcggtcggccaggtcatccacggccccgacgaccggatcaaggaggtcaacccggcgttccggacgatgatcggcatgccgtccgagcggctgaccggccgaaagctgaccgacctggtcccggtgccggcccgcgacgagcatcggtgccagctgagcgcgctcatcgccgaccggcagtcgttgatcagccacgagctttccctactgcgcgccgacggcacccaactgcccacgcacgtcaccgtgtccgcggtacgtgacgccgacggtcgcccgggtcacctgatcagcatcttccaggacatcagcgcccgccgggcggccgaggccgcccgcgacgaggcccaccggcagctagccgagcgccaccgtgagctggaggcggccaaccagctcaaggccgacctcatcggcatgctgggccatgagatcaacaacccgctcgcgatgattctcggctacgtcgacctgggcctgagcgacgacgaactgactgagccggtcaccgacctcctggagcggatccgacgcagcgtccaccggctggagtcgatcgttcatgaagtgctggccctggtcagcatcgacgcgggtcggctgaccgcgctgccccaaccgatccgggtggccgagcacatcgacgcggcattgagcgccaccgccaccgccggcctacccgtcacctgtccaccggatctggtcgccgccatgcaacccggtcacttcgaccacatcctgaccaacctgatcagcaacgccgccaagtacggcggtggtgccaccgcgatcgtcgcggcgccctccgacagcggccaaagcgtcaccgtcgcagtgcatgacgacggccccggcgtcccgccggaattccgtacacacctcttcgagcgtttcacccgcgctcaccggaccgccggcacggtttccggcaccggcctggggctctacatcgtccgcgaactcgcccgggccaacggcggcgacgtcaactaccggcccgcgcccggccacggctcgatcttcgaactgacgctcccgatccccgccaccacgctactggacctggtttcgactcccacttga

SEQ ID NO: 7569 - DNA, 612 bp, Actinoplanes utahensis
gtgaccgggcgccgagagcacaacaagcggcaaacccgccgctcgctgcaggatgcagcccgcagactgttctccgaacgaggcttcgaccaggtctgcgttgaagacatcgccaccgaggtgctggtgtcgcggcggaccttcttcaactacttcgactccaaggaggcggcgctggtcgatccggacccgtcccggctcgacacgctcgccgctctgctggccgcacggccggcggatgaaccgctgctcaacagcctgtgcgcggtacacatccaattcctgatggccgatccggccgacttcgccagccggatgcggctggtgcgggctaacccggcgctgcgccaacgctgggtcaccgcgatcgagatcttcgacgccgaggtggtccgctgggcctgcacttgcaccgggctgcctccggaggcggtgtatccgcagttgctggctgcgcttgtgggcactgtttcccggctcgcgatggagcactgggatccggataccccgcccgagcagctcgccgaggtgatctcctgcatctaccgtttactcgccgtcctgggtaacgacgccgacctaccgccggccgaccccggctgcgaacactga

SEQ ID NO: 7570 - DNA, 459 bp, Actinoplanes utahensis
atgaccaattcccggcaactggcggtcgtcgctctcgacggcattcccgcggcgtgcgttccggggcgcctgccggtggtcggcatgttggagatcggcccggcattcgccgccaccgcgcggatccgggagccggtggttcggatccaatacgacaataggtaccacaccgctccgctcgacgggagcgccgcaggggacgttgacagggccggctccgcgattcttctcagcgacatcatgctgcgttcccgatccgacccgccgatcgccgatcaatggcgtgcccgtcatctcgacctccaaatggtgtacacgtccggttaccgcgacgacgagccacgccgtcggtacgacctccgcgcggggaccggcctcctgcagaagccgttcaccgccgtggaactactcgccgcagtcggaagaacgctggcccgcgcggccagccgacgcagttag

SEQ ID NO: 7571 - DNA, 2310 bp, Actinoplanes utahensis
atggggctcgcgatgacgcgtgagattcgtgatcgggccggtgccggactggtggcggtggcggttctcggggtgctcacagcggcggcttcgctgccgtggggcgcccgcgggtggctcgccggcagcatcggcggcgcggtggtggcggtcgccgcgaccgtctcctgtctgcgcctgcgaacggtgccgggaataccgtcctctgtacgacgtttctggcagctgtgggcggcgtcggccgccctgttgttcgccgctaccctaggcgccgcagtgggcatcgtccgcggagacgccggcatgcaggtgtacgaggccgttcctgcgctgctcagcgtggttgtcgcggtcctggcgttccgatacacccggctgggtcgccgcaccgcggtcgaccggatccggctgatcctggacggggcggcgatcgccgttgccggcgccctattgttcggccacgtggtcatcggcctggcaccgccggacactccgctgctgagccgctggacggtgggtgccgtcggggtgggttgcctgctcgcgctggtcgtgttcggccgggcggcggccagcccaggtggccgggtcgatccgggtgcgctcggcatcctggccggcgccccgctgatcgccctggtcacggccgtgtcgtatctaagtggcagcgaaacctcgctgatgctgctgtcgatgctgggatatccgctggtggcgcttgcgatcggcggagctgcgcaccgtcaggccgtggtcctggcccgggccggtgccggccgcgccggccgccggccgcggggctcactcctgagcccggtcccgttcctggcggtggccggcacggtcttcctggtcgtcgccgtctcgtcgcgcgacctcgacccgcggggacgcgcggtgctgaccggcgtcgtgctgattgccgcgctcgtgctcgcccggcagttgctcaatttgcgcgagaacggcgaggcgctacgcgacatccgtcggcagcaggccgaactggagcagatggcggtcaacgacccgctgaccggcctggtgaatcgcagcggattcaacctcgccttggctcgccggctccgcgaccggcagccggtgacagccctggtgatggacgttgacgacttcacgagagtgaacgacacactcgggcccgcggccggtgacgtgctgctgggccagatcgccgagcgactgcggaaggcgtgcgctgccggagagatcgcagcccggctcgccggcgacgagtttgcggtgctgctgccctccgccgaccggtccgccgctgacctggcagccgcccggttccaggagctcgtacgccgcccggttagcctcggtggccagcatcttctgctgcacgcgagtatcggcgtggccatcgcggtgcccggggagacggccgacgaggtgctgcgtaacgccggcatcgcaatgtccgccgccaaggatgtcgggcaggcctcctacgtgcggttcgagccgggcatgcggcacaacctcaccaatcacgcgcggatcgccggcgagctacacgacgccatctaccgcggtgagctgcgactgctgtatcagccggtgttcgatctggagaccgggcgcctacacggcgccgaggcgctggtccgctggcagcatccggctcgcgggttcatctcaccgggcgagttcgtcccggtggccgagcgttccgggttgatcgtcccgctcggcgcatgggtactgcgcgagtcgtgcgagcaactggcccgttggcggcgccgatacggtgacgccgcgatcaccgccatcaacgtcaacgtggctgtgcggcaactgcgcgagaccaccttcgtcgcggaggtcgccgccatcctcgccgccaccggcctggagccgaacaacctcgtcctggaggtcaccgagtcgtcggtggccgatggctggcgggtacgggagacgttgcagtccctgcatgacatgggcatccggctggccctggacgacttcggcaccggccactcatcgctcagcctgctacgcgccttcccggtggacgtgctgaaactggacaagtcgttcgtcgacggcatcgccgacggcgcagaccgtggccgtctcgcggtcgccgcggcggtcgcccaactcgccgaacacctgcagctgaaagcagtcgccgagggcatcgagacgcaggcccaacaggaccgtctgcgagacatcggctaccgctacggtcagggattccacctggcccggcctctgccggccgacgagtgcgcagcgataatggccggtgaaacggtgcctgccgcgcggcaatag

SEQ ID NO: 7572 - DNA, 495 bp, Actinoplanes utahensis
atgaacgccctgccccgaccggcggtcgaacgcgtccagccgccgaaagccccctatcggatggtcaaccgtgcgatgcggtggctgctcagctcgccgggccgcgctcggcggatcgggcaacatctgcttcttctccacgtcacggggcgccggaccgggcggcgattcactctgccggtggcctatcgtgacgccggcgacgggcggctcctcgtgttgaccaactcgatctggcgcgtcaacctgcgcgatcgcggcgacgtgtcggtcaccctgttcgggtcattgcacccggcgaaggcgcagctcgtcgaggatccggacctcgtcgccgcggtgtaccgcgagctgatcgaggcggtcggccacgacagggcaggccgccgcatgggaatccggatcaacgtggaccgcacgcctactctcgccgaattggccgaggcggcacgtcgcgacggcttggccgtcatctacctcgacgtcgcccgatga

SEQ ID NO: 7573 - DNA, 864 bp, Actinoplanes utahensis
atgaccccgccgatcctggtcaccggcgccaccggcaacgtcggcggcgccgccgcgcgctcgctgctcgcagccggattgccggtgcgagtcgcgggcaccgacctgcgccgactccaggcccgcttccccgacgtcgagtccgctcgcctggacctccatcagccggacactttcccggcggcggtcagcggcaccagcgggctcatcctcgtccggccgccggctatcgcccgcgtcaccccgaccctgaacgcgctcgtggacaccgtcgcccggcacgcacccggccacgtggtgttcgtctcggtcaccggtgccgacaccaaccgcgtggtgccccaccaccgtgtcgaaaagcatctgcgcgccacaccgttgccgtacacgatcctgcgacccggcttcttcgcccagaacctggccgacgcctaccgcgccgacatccgcgaccacgatcggatctacctgcccgccgcccagggccgcgtggccttcgtcgacacgcgagacatcggcgacgtcgccgcaacgatcttcgccgacaccaccgctcacgaatccgcggcctacacgctgaccggctccgaagcgctcaccttccacgcggtcgccggcctgctcaccgaagccctgggccggccggtcagctaccagcccgccagcgtcggcggatacctacgacacctgcgccggcagcggctcccgctcccccaatgcctggtccagaccgtcctgcacaccggcctgcgacacgggcaggccgaacaggtcgatcccacccttgccaggctgctgcaacgcgcaccccgcagcatggcacagtacgttcgtgaccatcgcgaggtgtggaagcagcgttga

SEQ ID NO: 7574 - DNA, 573 bp, Actinoplanes utahensis
ttgagccggtcaactgatcctcgtgtgctgcgcagccgcgccaccgtgctgaccagcgcgctggccctgctcgccgaacgaggcatcgccggcaccaccatcgaagcgatcgccgagcactccggggtcgccaaaaccaccatctaccgccagtgggacagccaggccgctctcatcctggacgctttcgacagcgtcctggccctaccggaggaccctgccaccggagatctgcgcagcgatctcctgcagctgctcaccggcttcgccgacgcactgcgcaccagcccggcaaccggcctgatgttcgcgctcatcgacgccgcggagcgcgatcccgccttcgccgccctgcaccggagacaggccgagacccggcatcgactcatcctggacgtcatcacccgcggcatcgagaagggcgaacttcccgccgacgccgatcccgacgaactactggaccttctcgccggtcccgtcttccaccgtcgcgcggtatcgggaggaagactcgatgccgcgttcgccgaacgggtagtggactgcgtcatcgccgcttatcggaccacctga

SEQ ID NO: 7575 - DNA, 174 bp, Actinoplanes utahensis
gtgccgatgccgaagctcggcatcccggcccgcaaagaccaaccgcccgcctgcggcggcaccgaaggtgcctgcgccgactggctggcctccctcaaacggatcagccgcaacgccaccagccctgggccaccggcgccacccggccctcccgccgcaccccacgagccgtaa

SEQ ID NO: 7576 - DNA, 453 bp, Actinoplanes utahensis
gtgctacacgcggcacggacactgctgacgaccgagccatggctgatgacatcacccctgaccgacgtcatggacagcctcagctggtcgatgtctgacttcgacccggaatacccggacctgggcgcgttgatcgactccggttgggggctgggtcccagcagcggcttcgtcggcttggacgagcagaccctggtgcagcagatcctgctcaacctcaccgagcgggtggccggacgaggcgccgaggccgacgcgttcctgcaggatgtcttcgcggccgcggcagcgactctgaccggcgcgttcgggcgtccggatcgcacgttgtacggcgaggagccgcagctgtggtggcagcggccggcgacgatgttcggactgctgacgagatctgattccgtcagcctgcaactgaccccgagcgagctgacgggtggcgagtgggagtga

SEQ ID NO: 7577 - DNA, 447 bp, Actinoplanes utahensis
gtggaagtgagctggacggcgtttcgcgacgggctggccggcagcatcgccaccctgccggacggcggcgcgctcttggtcggcgatcaggagcgcaccgagtgcttcgtgcagttcatgttcagccgaagcctcgctgaagtggccagcggctgggatccgctggaccggcccaacctcactgaggagcagaccgccgccctggaacgtatcggctggccggcgccctcgttcgatccgagccgcaaccatggtctgaacctgtcgtggccggcgccgtctgccgagtatcgccgggtcgccgacatgtcggtggtcgcgctgcgggaggttttcgagatcccgtcgccggcttcgctcgcctacaaggcattcgtcagcccgagtggctcgaatctaccaatgcctcacctgggaatcccgtcatgctccgacctgtgggactga

SEQ ID NO: 7578 - DNA, 426 bp, Actinoplanes utahensis
gtgaccggtctcgactggcagacgttccgggacggcctagtgcgtagcatcgcgtccctgcccaacagcggtgcgctgatcgtcggcgacgaggagcgtacggagtgctttgtgcagttcatgctcgactacgaccatgtggtcgccgaggtggctagcggcatggacccgcaggaccggccgaacctcaccgagcaggaggcggccgcgttggagaagctcggctggctgccgcaggccgccggggacgagtcggcgatcgaggcgttcaagcaggacgccttcacggcggcagccgccgctctgaccggtaagttcggccggccgaccgacccactgcccggcgaggagccgcagctgtggtggcgccgacagaacaccgcattcggtctgatcactagggcgacgcggtgggcatccagctga

SEQ ID NO: 7579 - DNA, 501 bp, Actinoplanes utahensis
atgacggaggcaggaatggttcagtggcgggaggttgacgaagccacggtgttgcgggtggcacagacgctgctgtcgttggaaccgctactgctatccgcttcggtccaggaggtggcggccaaggccggctggacggtgacccgtttcgaccccgaacggtcgaacaggagcgcgttcctggacaccggatacggcttcggttccagaagcgccttcttcaagactgacgccagcagcaaggtgacatccatcctggtgagcgtgaccgaggaagtggccgggggcggcatggcagccgacgaatacaagctggacgccttcgccatcgcagcctccgcactgaccagtgctttcgggaaaccggaccgaccccggcccggcgaagaaccacagctgtggtggcaacaggacacgacgtggttcggtctgatcaccgaacacgacggcgtcagcctgcaactgacccccgccgaacggatggtgggtgagtggtcgtga

SEQ ID NO: 7580 - DNA, 369 bp, Actinoplanes utahensis
gtggtccgagacttactacctgcgcacgctggcttcgaaccggatcggcatgatcgccggacgggagttcgcctgcgacgcactccacatccacccaagcacctgacctgtgacgtccacgtcgacccgaagcctggcgaacttgacatctggggcctgggtcacgaccgtcggggactgcccacgctggtcgtggtcgaggccaagggtggcatcgccggcaccggcggccgcgaccgcctacagcagggcagcgcaccctacctggagctgaccatgcgactcgacccgaagttccagacgtttctccgggagaatccggtgatcgccgagcagatccgcaccggtgtcatcaaggtcgagtgctag

SEQ ID NO: 7581 - DNA, 462 bp, Actinoplanes utahensis
gtgaccgacctggactggccggcgtttcgcgatgctctggcgcgtagcatcgcgaccctgcccaacggtgctgcgttgatagtcagcgacgcagaacggacggtgtgctacgtccagttcctgctcgaccggaacaccgtcaccgccgaggtggccagtggcctggatcggtgggaccgtcctttcctcaccgaggaggagacggcgacagtggaacagattggctggctgcccccggacaatactgtggtcaaccatggagtgaagctggcctggccgacccgttcagccgagtgccgccgggtggccgacatgtcggtggccgccctccgcgacgtcttcgagatcccgtcgcccgccaaccttcggtacaaggccttcaaggtcgcgggcggcgccggcgtgccgatgccgaagctcggcatccccgcccgcaaagaccaaccgccagggacacaatga

SEQ ID NO: 7582 - DNA, 429 bp, Actinoplanes utahensis
ttgtctgccgagccgtggctgatgacaacctccctcacggacatggcggccaggttcggctggacggtgtcgagtttcaatccggatcgtccgaccctaggcgcgttcatcgacgacagccggggattgggcccgagaagcggcttcgtcgatcttgacaaacagagccgggtgcagcacatcttgctcaacctcaccgagcgggtggccgaggatcgctgggaggttgatgcgttcttgcaggatgtcttcgccgacgcggcggcagccctgacgggcgagttcgggcgtccgacccgcaccatatacggcgagcagccgcatctgtggtggcagcgcccccccacgatgttcgggctactcaccaggaccgatacagtcagcctgcagttgtcgccgaacgagctgatggacggtgagtgggagtga

SEQ ID NO: 7583 - DNA, 1044 bp, Actinoplanes utahensis
gtggctgcgacaggccgacgtcgaggacggcgcgaagccgggtgtgacccgcagcgagtcgtcggagctgcgggaactgcgacgccggaacaagttgctggagcaggagaacgaggtgctgcgccgggctgcggcgtacttgtcgcaggcgaatctgccgggaaaaggctctacccgctcgtgagcgagctggccgccgacgggatccccgtggcggtgacgtgccgggtgctgaacatcgctcgacagccctactaccggtggctggcccgtccagtcacgccgaccgtgctcacgcaggcgtaccgggcgaacgcgctcatcgacgcccaccgcgacgacccagagttcggctaccgattcctggccgacgaggcccgcgccgccgggcaaccgatggccgatcggacggcgtggcggatctgctctggtaacggctggtggagcgcgttcggcaagaaacgccgccgtggcaaaagccgcaaggtgggtccgccggtgcatgacgacctcgtgagacgcgacttcaccgcggacggcccgaaccggttgtggctggccgacatcaccgaacaccgcaccggtgaaggcaagctctacctgtgcgcgatcaaagacgtgtggtccaaccggatcgtcggctactcgatcgacgcgcggatgaagtcgcgcctggccgtggccgcgctggacaacgccgccgctcgacgcggtgacctggccggctgtgtattgcacaccgaccgcgggtcgcaatttcgctcccggaagctgcaacgcgcgctggcccggcatcagatggtcggctcgatgggccgcgtcggcgccgccggcgacaacgccgccatggaatcgttcttcggcctgctgcagaacaacgtcctcaaccggcggacctgggccacccgcgagcagctgcggatcgcgatcgtgacctggatcgaacggacctaccaccgccggcgacgccaacgatccctgtcccggttgacccctatcgagtacgagaccatcatgaccccaccggccagtcaggccgcgtga

SEQ ID NO: 7584 - DNA, 654 bp, Actinoplanes utahensis
gtgctggaagcgaaacggccagtggagcatgtttctatattggtcggtatgcgtgcctcgttcgacgatcgatggatttggagcaacaggtactcgtcgctgggtttgagcctgacttttgtggaaggcggtgacgagggtggggtgctgcgggcgttcggcgctgacccaggtgaggccgaggttctttccctggatgaatgcggtgaagagttcgggtatgagttgccagtgatccgcgtcggtgaggtgggcggctggcgctttgctttcgagttgttcggcagaagcggtagccaggaggacgtcgttgtagcgctgtcgcgtggctcgcgggttgttcaggtgcttcgcacgggcagtgccgtgtcggtctttcggtatgccgtgggtggccagatggtgtgctcgctcgatccgttgatgccgcaatcgcgcagtggtagtgatcctgaccggctcctggacgccatgcgaacagtcggccttgatcccgatcggccagacgatgagctggatgctctgaccgcgatgttgaggttggtcagtgaggtgttcggcatcgtgctggaagccgggattgtggagggtccgctgctgagtgccgagcagtctgtcgatatgagctggctcgacgccgacaacgaggtttga

SEQ ID NO: 7585 - DNA, 462 bp, Actinoplanes utahensis
atgaccgcccttgattgggagacctttcgggacgacctggcgcgcagcatcgcgtctctgcccaacagtggtgcgctgatcgtcggcgacgaggagcgtacggagtgcttcgtgcagttcatgctcgactacgaccatgtcgtcgccgaggtggccagcggcatggacccgtgggaccggccgaacctcaccgagcaggaggcggccgcgttggagaagctcggctggttgccgcccccggagctgcaggagcattgcaaccacggggtgaagatcgcctggccggcgccttcggcggagtaccggcggatcgctgacatgtccgtgaccgccctgcgcgtcgtcttcgggatcccttcaccggactcgctggtctacaaagcgttcgttgtcagcgcaacaggcgagcccttgcaaatgccccgcctcggagtcccgtaccggcccgactggcgttcctga

SEQ ID NO: 7586 - DNA, 486 bp, Actinoplanes utahensis
atggtccagtggcaagaagtcgacgaagcgacggtgttgcggttgacgcaaacgctgctgtcactagagccattgctgttgaccgcttcgatccagcaggtggcggccaaagcgggctgggtggtgacccgtttcgaccccgagtggccgagtggaggcgcatcccttgacaccgggtgtggtctgggctccagcagcgccttcttcaacaccgacgccgacgccaaggtcacatcgatctcagcgaacgttaccgaagatgtgacgggcggcggctcggcggccgacgagtacaagctggacgcgttcgcgctcgcggcgtctgcactgaccagtgccctcggccagccggaccgcccccagccgggtgagcgaccgcggctgtggtggcagcgggacacgacgtggctcggcttggtcaccaaacgcgacgccgtaggcttgcaactgactcctgccgaacgaatggtgggtaagtgggaatga

SEQ ID NO: 7587 - DNA, 3456 bp, Actinoplanes utahensis
atgcgcggcggaatccgagacgccggcgccgacctgcggctacgcctcggcgagaacaacgcgttcggcgaaatcggcacgccgggcgccgagccgggcgtggggtcggccggcgacaccggcgtccaggccggaacacggcccgcagccgatcacggcgccggaggcagcgagcagacgtcggccggtaccgggttagaacgctccaccagcagtccgggcgccgaccagcagtcgcgcggcgaatcaggcgatcgtgcgggcaccgagccgggccagcgcagcgagtcgaccggcggcgggaagcaggcggaggcgggcggcggtccgcagcgggccgaagcaggcaccggtgagcagcggtccggctccggtgacacggcgcgggacgagtctccgcaggcgagtggcaagccagagcagacttctggcggccagagcggcacggcggatcgcggcgaccagcgcgtggtcgaacccgatgggggaggccgccaggagaccggccacccggaccggttccccgaggcggccaacgacagcgacaccggccgcggcgacatgtctgcaggttcggatcgggccgtaccggagcgcgcagcggatggctctgacggcggagctgacccgggccgggaggtgcagcggccgggtgatgcggccaacggtcacacccgagaggtgcacggcgacagccttgaaggaacggcgggggccggacgtgacgcgccggccgtccatggagcgcggtccgagggcaccggtgacggcaggccagccgatgccggggtgccggcgtatgggcggcacgccgagatcggcggcccccgcattcccgaaccagccgcggcccgatccgcagtcccagagaccgcattctccagtggcgagccggcactgccgggcgcaccggaaatggcggtgccgcgtaccggggaactcggccgaaccgacctgcccgctcatcggcccgctgacatctcacccggcgatacgacgaccagtccccggtcagaaagcccgacacggtcatcgactggaccggaacggcaagggggcgagccggcctcgtcgtctcgggcccaggatccgcgcggggacatcaccggcacgaacacggaaggcggccgtccggaacggccgacgcgtgacgatgatccgggccgcaccccgcctcgcaacgaggcccgtgatcagggaaaccggtcgtcgcggcgagactacggccacgatgatccccgtcggcgggcgtcggagccggacggcaggcgctggcaggactacgcgcagcgaattcagcgctggtcggagaaccgggccgctgaccaagcggcgatggaccgtgcgctgttccgccggttcaagccggagcaggacggcaccgcgcggctacggccggagacggtgcaacgggtcctgggcaccccagccgaccggctggacggcaccggccagcggttcaagcagatggtggaacagcatttcaccgaccccgcgttcaaggacggccagccggtccggcgcccggcctcgcccgacgacatcgccgcccggctcggcgaactgcgcacctcccgtccgcccagcctgaccggccggctgctgcacatcgacaaactgcgtggcatgctgcccgagctgccacgccggctcccgcagctggatcccatccactccgagcacgtcatcggcggcgagtatcacggcttcggccgaccggcggacaccgtgtcggtgagccgggaaatgcgcgaagcggtaccggaggtcctcgaccggctgttcaagaacgtccagttcagccgccccgaggacggtgcccccgacgtcatccgtactggtgagggccacgaaatcaagctcaacttcggggctgagtcgatggatcgcaaggacgtcggcacctccacgcgcggtggagacaacatctggcaggtgcgggccaactctggagccagacccgagcacatctccaccgtgaccagccatgaactcgccgaaatcctgcaagcggagcgcctgcagatggctggcgagacgatgtcgcccaagaagatgctcattcccaaggacaccggcgcgcgcaaattgagcccggatgaccacggccggatcgccgaaatgctcgactggcacgaacgctcgctaaacggagaagcaggcgcgcgcgaccggctcggcgaactcgtcgaccacctcgggttacgtggcgacgaactgggtgccgttgcgcgccggggagctgtcaccgagatgcttgacaacccgtcggcacaccacttcaacgacgctgcggccggacggcttagtgacctgctccaaggcgcaccggaggatctcccggcagcaccagagaggcgaagattcgccgaggatgatctgcgggccatccctgacgaccttgcgcagcgacttggcatcgagatccggccgaggactttgcaggacggaaagattctgcagatggaggctcaccagcagacgctgcagaagattcggctgcacgtcgagggcgacccggtggacaccttccgcgccgagaacggaaagctgcagaactacggacacgacggacggcccgggtttgcttccaacgacccgttccgcaagccgcaaggatgggacgtcgtcaacagcaaacaacggctgccggaccacccccacgacgcggcaaatgccgacctgatcgtcaaggacagcgccgtctatcgggagctgaccgttgaactcaacaccgccagtgcggaccgcacgatgaaactagactcggtgaacgcgatcctcgacgcggttcggtcacattcccgggtgcctgcggagttgctggagccggtcaccacaaaagacgttaacgccgacaatcttgaggaaaccatccagtatctgaaggaaaaggtggcccccgagcatccggagttgcggccgcacatcgacgcactggagcagtcagccacgacgtggtccaagacctactacaggcgcacgctggcttcgaaccggattggcatgatcgccggacgggagttcgcctgcgacaccttccgcatccgccccgagcacctgaccggcgacgtccaggccgacccgaaggccggcgaactcgacatctggggcctgggtcgggatgaacacggacggccgacgctggtcgtggtcgaggctaaaggcggcggcgccggtaccggcggtcgcctccgtctgcagcaaggcagcggaccctacctggaactgatcatgcgactagacccgaagttccaggcgttcctccgggacaacccggcgatcgccggccagcttcgcaccggtgtcatcaaggtggagtactacctggtcagccaaggtcatgaggaggcaaacggtgtcgtacccgacgccaaagtatcccggttcatgttcgacggcgtcgaccctggcaacatcttcgaccctggcaacatcgaagctccccgccgctga

SEQ ID NO: 7588 - DNA, 243 bp, Actinoplanes utahensis
atgagttcgtatctggagttgccggagggcacggaagcggtcgcgcagatcggtgcccggttgcgggcgcaggcgcaggatttcaaggagcaggcgcggcagatcctcggtgacatccaaggcctcgaccagggtcagccgtggggcaatgatcaggcgggtaaggcgttcgctgagcagtaccacaagccggtggaaggcgccggctcgctcgcgctggccatgcaggatcggctgctctag

SEQ ID NO: 7589 - DNA, 1146 bp, Actinoplanes utahensis
gtgggcggggcagcgtgggcagcggcgaacagtgctgagcggcggctggcgcgagcgtgggcggatgacgacgcggacagtttcgccgacgtactgctgcatgctgacctgtttttgccgggcttccccgatgacggtgcgagcgggcagcggctgctgacccgtgagcggggtggccggacgtttctgctggtctacacctcggtggaagccttgcaggaggcgattccggcggtgggcgtcggctggcggcgcacgacgttcgccgagctggtcgggtcgtggccgaacccggcgtggggactcgccgtcagcccgcacaccccgatcggcgcctacctggacgcggagcaggtgcgtctgctgggcgaggaggtggctgccgagcctccgttcgcgccgggtggtgagcgggagcgggcgatgcgtgccgcgcagcgcgccggtgatgccgaggtctatctcgatctgctggtcaccgcggacgtgttgctgccgctggccggtccggccggtgcggatgatctcgggaagccgggctttccgtggctggtggagcgggttgacggtgcggccaccatcgcggtgttcacctcacggcagcggttaccggatccggcggacaggcccgcggttgtcgaggtgccgctgctgtcggtggtgcgtgcctggcccggcgccgcctatcggatggtggtcaacccggggtcgccgatggtcgcggagttcaccggggcccaggtaccggatctgtggcgctgggcgcaggagctggtgctgcgccggaccgtacccacgcacaagggtgccgtggatgtcccggtggctgggccgcggatgcgccgggtccaggctctggttgattcgagtcgggcgttggaatggctggccgcgggtggcggcctggtgaccgggtcggtggcaccggcgggtgccgccgggatccttgacggctatctggtgcgttggcacgaggacgacgccggtggtgctgccacgcgtcaggtcgtcgggctggtgctgccgtatggggcgcagttggtgcggctggtggcggggcatgagctggtggtggcgacctatgacgcggagttgtcgtggtggcggccgtcgatcatgagtgtgttgcggggtgagacgttgtga

SEQ ID NO: 7590 - DNA, 1020 bp, Actinoplanes utahensis
atgacggtggtgcatccgggtccggctgggcttcgggtgcgctatcggcagggtgtgctgatcgatgccgccgggtttccggattgggtgttgtatgcgcgtgcggtggtcgagttgccggcgccgatagccgagttgaccggtgatgagcagctggtcttcgacgtgttggcggcgaatcgggtgatgcggggtgccgacccgttttggccggatgcgcagtcagattcccccggggcgacgccgacacctgccggctggtgctgggccaggatgccgacgttcgatgatcaggcgcgtcgggtcgcgttggtgccggtcgagttgcacggcgcgttccggcatggtggtggcgcccgcaccctgcctgtgggccggccggggttcggcgtgcggaccggcatggcgccggtggggcgcgtggtggtcgagccggttcctgaaccgatcgtggccgaggtggaggcgttgctcgggtacggcctgccgccggcgtatcggcgttttctggcggcgggtaatggtgtgggcccggccgagccggcagtgtcggcggtcgcggggatggtggtcgatcagccgctgttcggtttgggccgcgacgacatgctgcaggatctggggtatgcgccgcggtggctgggggaccggttcacgggcgaagtcctgccggtcgggtttgtgcagggcgggatcctcgcgatacgggtggctggtccggatgcgggcagtgtgtggttcttagacgacgacgatccgcgtgatgacgacagtctggggccagcggagatctgcgggcggttgttgcggcgctgcgccggggacttcgacgagttctgggcggggttgcggcggccggctgcggtgctgctggaggtggtcgaggatctggtggtcggcgggctggtccgtgaggtgcggccggagcttgccggtgcggcgcttcctgaacggatgcgtgccgagtggcaggccgtcccgcagcagcgttcgatatctgtcgatgatctgatgttgtag

SEQ ID NO: 7591 - DNA, 414 bp, Actinoplanes utahensis
atgggtgcgacggatccgtcggcttttctgagcttggctcaggagttgcggcgttcgttaggggatgcggcggagacgcagcggcgggtgttgagcgtcaccgggtctgcgacgtcgccggatgggctggtgacggtggtggtgggtccgcggggccagttggtggatttgcggattgatccgcgggtgtatcggcggccgaatgcgggtgcgttggcggcgacgattctggcgacggcgcgggccgcggtggagcaggcggtggagcagacgcgggagttggtggatgcgcggctgccgaaggccgacgaccttttggggccgcgcgggcagcgtccacccggggtgcgggagttgatgcgggcgcatgacggcgacctgaagcggatcatggatgccgaccgggaatcgtga

SEQ ID NO: 7592 - DNA, 2115 bp, Actinoplanes utahensis
gtggccctggttggccggtgtcagcaccgaggtgaccgagcggatggagcatcagcacgaggcggcggccggctggctggccgaggtcgaccggctggcgccgcgctggggggccggcgcggatgtcgtgctgcgggaggagctcgcccaggctctggaagccctgcacgccgtgctggtcgagcatctggacgacgaggaggcgaacctgctgcccctggtcgcggagcacatcaccgtggcgcagtggcggcagttgagcaaccgggggcggcgcagcatgccgatgcgtcagggcttcgtcttcctcggcctgatgctgcaggacgccacaccagcggaacgggccggcattctggcgcagatgcccgctccggtgcgcttcgtcttctcccgtttcggcctgccggcctatcggcgttacgtgacgcggattcacggagccgtgcccagcggccggtgatatcgccggcggggcgctgccacgccgcggatcaaccggcgatgtgcccgcgacgagcgtgccgcatcgctccacctcgctgcgatggccgtcatcctacgaccttggtggtatccgggcgggtgacaggccggctcgagtcgtttgggaccctcgcccggtggtacatgtgcggcatgaaggaccggatcttggatcacgcctgtgccccgctgctggaggcgctggtcgactatcaccgcgaggacaggtacggattcaccccgcccggacatcgtcaggggcgcggcgccgacccgcgagcccggcagatcctgggggcatcgacttatcaggcagatgtgctcgcgtccgctggtctcgacgaccgttcctcgtcgcaccagtacctcgccgaggcggagaagctgatggccgacgcggtcggcgccgaccagtcgttcttctccaccgcgggaagctccctgtccgtcaaagcggcgatgctggctgtcgccgggggccgggggcagctgctgatcggccgggatgctcacaagtccgtcgtggccggtttgatcttctccggggtcgagccgcgctgggtcgatgtgcggtacgacgagaatctgcacctggcgcatccgccgtcgccgcaacagttggaagaggcctggaatcggcatccgaccgccgccggcgcgctgatcgtcagccccaccccgtacggaacctgtgcggacatcgccggcctggccgaggtctgccatcgccgcggtaagccgctgatcgtcgacgaggcgtggggcgcgcatcttcccttccatgacgacctgcccacctgggctctgggtgccggcgccgacatctgcgtggtcagcgtgcacaagatgggtgccggcttcgagcaggggtcggtgctgcacagccggggcgacctggtcgacgccaagcacctctcggcatgcgccgacctgctgatgacgacgagcccgaacgccatcgtctatgccggtctcgacggctggcgccgccagatggtcgagcacggccatgacctgctgtccgccgccatcagggtcgccgaaagtgtccgggaccgcatcggacgaatcgccggcctgcacgtcgtacgcgaagaactgatcagtgtcgaggccagccatgaccttgacccgctgcaggtggtaatcgatctgaccgacctcgggatcagcggttaccaggcagccgactggctccgcgagaactgccggatcgacatgggcctgtccgaccatcggcgcattctggccaccctctcgatggccgatgacgagaccaccgctgaccggctcatcgaagccctgcggcgtttggtcgccgccgccccggccctgccggcagccaagccggtgcacctgccgccgcccgccgcgttcgaggtggacccggtgatgctgccccgggacgctttcttcggccccgccgagacggtcccggtcgcgcaggcgaccggccgggtctgcgccgagcagatcaccccatacccgcccggcattcccgcgctgctacccggtgaacggatcaatgccgagatcctggactatctgcggtccggcctggcagccggcatggtcctgcccgactctgcagacccgaacctggacaccatccgggtcgccatcacgtga

SEQ ID NO: 7593 - DNA, 2796 bp, Actinoplanes utahensis
gtgaccgcttctcgccccgcttcgaccggccggcccgcacccggccccacgacggcgagcagactgcgccactggacgatcgcgcggatgctgaccgccagttacctgtgcgcggtcgcgacaatggtgatcgtgggcggcagtgcgttcgtgcggatcggcacgctgctcggcgaccgggtgccggtcgagcaggcgcactgcgtcctcggtcagttggcgatgctgcagaagcaggtcgatgacgcggaacgcggccaacgcggcttcgtgatcaccggcaacgagcagtatctggatccgtattccgcggcggtcgccgccatccccggcaccgtgcggaccctcgggcagctcaccgcgggcgacgcgatccaggcgcggttgctgagctcggtgtcggccccgctgcgcgacaagctcgacgagctggccgacaccatcgagctgcgccgcacccgggggttcgctgcggcgcagacagtggtggagaccaaccgcggcgctgacgacatgatcagtattgacgccgccatcgaggcgatgcgggagcacgaacagcagctgctcgaccaccagttgcaggtcagcggcaccgccggcgcgcagacccgccatgtgatcctgtgggggtcgctgaccgccgccttgctggtcgggctcggcaccgggtgggcgacccgccgggtcaaccggagcatcgccgaggtgacggccgcggcccgttcggtcatcgccggaaagcagggcccgcagcgtcagatcaaggggacggcggagctggccgagatggcccaggcggtcaccatcgccaccgagaccgtgctggctgcccgcgacgaggcggtgcaggcggccaagtcgaagtcggcgttcctggccacaatgagtcatgagatccggaccccgatgaacgccgtcatcggcatgaccggcctgctgctggacaccaggctcaccaccgagcagcgcgagtacgtcagcaccgtgcgcgacagcggtgaggcgctgttggtcatcatcaacgacatcctggacttctccaagatcgaatcggggcagctggagctcgaggacgccgtcttcgagctgcgcgactgcatcgacagcgccctggccctggtcacccttccggccgcggccaagggcctggagctggtcgcccaggtggatccggcctgcccgcggctactgcgcggcgacgtcacccggctccggcagatcctggtcaacctgctgtccaatgccgtcaagttcactgccgccggcgaggtcgtcgtcaccgtcggcgcgcaggacgagcccggcccggacggtgcggtgcggctgtgtctcgcggtgcgcgacaccggcatcggcattcccgccgaccgtctgcaccggctgttccgctcgttcagccaggtggacgactcgaccacccggctgtacggcgggaccgggctgggcctggcgatcagcaggcggctcgcccaggcgatgggtggcgacatcaccgtcgccagcacccccggcgtcggttcgaccttcaccacgaccgcggtggtgcgcgcctgcccggacccggccgccacgacggtctcctcgacggtcggccgcagtgtgctggtggtcgacgacaacgcgacgaaccgcgccgtgctgcaggctcaactcgccggctgggggatgacgtgtgccgccgtcgacggcgcggacgcggcgcttgccgccctggacgccggcgcacgattcgacgtcgccttgttggacatgcacatgccggacgtcgacggtctggagctggccggcctgctgcactcgcacgccgccggccgcggtatgccgcttgtgctgctcagcagcgtcacgtggcgaccggagccgggccagcgcgacgtgttcgccgcggtcatgtccaagcccgtgcggcccgcgacgctgcagaccacgctgatgcagctgctcagtccgcagcccgacggcgccatcccgccggcgcccacgccgcagccggccgtcaagccggtgagcgcgctgcggatcctgctggccgaggacaaccagatcaaccagaaggttgcgcagaccatgctcgccaagctcgggcatcgggtcgacgcggtcgccgacggcctggaagcggtgcaggcgatgcagcgcgccgactacgacgtcgtgctgatggacatgcagatgccggtgctcgacggcttggacgccacccggcgcatccggtccgagatccccgccacgaggcaaccgcggatcatcgcgatgaccgccaacgcgctgcaggaggaccgggcggcgtgccaggccgccgggatggacgacttcctggccaaaccggtccggctggccgacctggccgccgcgctcggctgcgccgaacccacccagggcgcagccgagcaggctgccgcgggcgacgcccgggaacgggaggtccgcgcccggctgctcgccattaccggcggtgaccccggcccggacgagagtcggctgctcagccggttgatgacgtcgtatctcaccaagacgcccgaggggatcagcacgctgcgcgacctgctggccgccggccagccgggaccggtgcgcgaccaggcgcacgccatgaagggctccgccgccaatctcggcgccaccaccctggccggcctgctcgccgacgtggaacacgccgcccgcagcggcgacgagctccccgagccgacggcgaccgcggacgcgctgcgcgccgagttcgctctgctgcagccgatcgtgcggggcatcgccgacgagctcgacggcgttcccgcgaccgtctga

SEQ ID NO: 7594 - DNA, 2244 bp, Actinoplanes utahensis
gtgacggaccgcaacgacgcagtgctgaagtctccatcgcgattgcaggcggttgccggcgcccaccgggccctgccgatgatgccggtcccgctcgatgcgctggcccgcatggcagcacgcttgctcagggcacccatggccgtcctcagcctggtcggcgccgagcaggaggagttcctcggcatgttcggtctaccggcatccccggcagcgcgacgacgcaccggcgaacacctggtatgcgcgaacgtggtcgctgcggacgggccgctggcggtacccgacatgaccgccgacccgcagttcgccgagcatccggccttcaccggtcacggcatccgcgcgttcgcgggtgtcccgctacgcgacggccaggaccggcaggtcggcgccctctccgtcctggacgacggtccgcacgactggagcgagaccgacctgtccacgctggtggagatcaccgcgatgctcgggcccgtcccggtcggcgcggatccggtcatcgcgatggccgccctcaccgatcttgatcagagcggctcagccgccgacgcccccgctgctgcggtcagtgccacggtccacgccgaggtgcaagccggcttcatcaccgcgttgctggacagcctgcaggtcggggtgttcgccgtcgacaccgaccgccgcccggtgctgttcaatcgcactctgcgccagttctacggcctgccggaagacctgacccccgccgaagccatggccggcgcctacacccagttgcgccacctcgacggcacaccgtacgcgaccgacgaactcgccacggtccgcgcactgcgcgagggcagtgtccgcgacgtccgggcggtgatgcaggcgccggacatgcccgaccggcacattctcaccaacgccgaagccatccacgacgccgccggtcacctgctcggggcggtggccaccgtccaggacgtgaccgatcgccgtcgccgggaacgcttccgtgactgcgaattgcgcgtcgccgggatcctcaaccgctgcgacaccatcgccgaggccgcaccaccgatcctgcgagccgtcggcgaggcgctgcactggcagtacctcgcgttgctgctgatcgacgaggtggccgacgtgctgcgcgtggccgcctgctggagtgcccccggtgtcgaggtgggcggtctgctgcccgacatgatcggtcgcggcgacgccgagacccgccggctgggccgcaccgaccagccactgccgctgtccgacctggtcgactcccacctcatcgcccgccatgccgcgcagaccatcgcccgcgccgccgccgaccagggcctgcgcgccagcctcgccgtcccgatccgcgacgccgacaccatcctcggcgtcctggtgtcgctgagctccaccgccgagtgcgacagagtgctcttggctggcctgctcaccagcgtcaccgcacagctgggtcaattcctcatccaccgccgcaatgccgagctgcaggcgcagctggtccacgccaaggacgatttcctcaccctggtgggtcacgagatgcgcacaccgctcacctcgatcatcagctacagcaccctgctcgccgacgagctcatcgaaccggagctgggcgccgtggtcgccgccatcacccgcaacaccagcactctgcagtcgatcatcgacgaactgctggacctcgccggtctggaagccgggaacacctctttgcaactgcgtcccacccacctgaccgagatcgtcaacgccgcggtcaccgccgtgcccgtcgacgcccaacgacgcatccacaccgacatgccccccacgctgctcgtcgaagccgacccgcaccgcctccggcagatcatcgatcacctgctgtccaacgccatcaaatacagccccgacggcggtgacatccggatcagcgcccacgagcacgacaccggcgtcgtcgaactcgccgtcgtcgaccccggcatcggcatccccgccgaagaccatcaacagctgttcacccgcttccaccgtgccggcaacacccgccacagctacatccccggcaccggcctgggtctcgctctggtacgcgccctggtccacgcccacggcggcaccatcacctacgaccctcaccaccgccccggcacccgcatcaccctccgactgccccagcaccacagcggcgccgggaagcccggaaacgccgtgcccggtagcggaaccctcaacggataccggacgacgtag

SEQ ID NO: 7595 - DNA, 444 bp, Actinoplanes utahensis
gtgacgatctttttctatggcgccgaagaggtgccctatgggtgcttctccaacttctccggtcacggtttcgaccttgacgggtcgtggtggccgacctcggagcactacttccaggcgcagaagttcaaggggagccggcacgcggagctcgtccggcgcgcccgcaccccgatgcgggcggcggagctgggccgggaccgggcgaaaccgctgcgcagggactgggagcgggtcaaggacgacgtgatgcgccgcgcggtggcggccaagttccgcgtgcacgccgatatccgggacattctgctggcgaccggcgacgaggagatcgtcgaggacaccaccaccgatcactactggggtcggggcacgaccgggaacggccggaacatgctcgggctgattctgatgcgcacccggagccggttgcgcgccgaggcatga

SEQ ID NO: 7596 - DNA, 510 bp, Actinoplanes utahensis
atgggcatggcaccgatcgatctgaccatggacgagctgcgcgaggtggcacggtacgccgtgcggcacgccgaagtcgtactgccaatttttgagcgaaccgtgcccggggatcaccgtccgcgggcggcggtcgatgcggcgtgggtgttcgtcaacggcgagcggcgtacgagactgcagcgtgtcgctgccctggacgcccatcgggcggcgaggcaggcacccaccgagcccgcgcggctggcggcgcgggcggccggggacgcggcggcggccgcctatctgcatccgatcgcccaggcgtcgcaggtgggtcacatactgcaggctgccgcgctggccgcccggctcggcgagattgaatccggggccgatccgcgcgacctgctggaacggtcgcggcagtgggcgacgccggtcgtcgtcgacgtgctgaaccggtatccgcggatcgagggcgccggattgatgggtgacctcgacgcgttgttgcggtacgacgcatga

SEQ ID NO: 7597 - DNA, 492 bp, Actinoplanes utahensis
atgattctgccgaaggttcgcgatccgcggttcgtgaccatccgccggggcggcacgctgaccgatgcggaccatcatctgctcgcgctgtgggcggccacctgcgccgagcatgtgctgcccctgttcgaggcggagcggccggacgatccgcggccgcggcaggcgatcgagcatgcccgggcctggacgcgcggtgaggtgaggatgatgcgggcgcgagaggcgggcgggcatgcgatgggcgcggcgcgggatctgcgcggggcggcccggttcgccgcgtacgccgcgggtcaggccgccgtggtcgcgcatgtcgccgcgcacgagctgggcgccgccgcgtatgcgatcaaggcggcccgggcggccggggatctcggtgagtgccgatggcagcgggcccgactgccggcggcgatccgcgagctggtcctggatgatcagcggttgcgcaacgacatctgctggtcggtgttcaccgagtga

SEQ ID NO: 7598 - DNA, 1785 bp, Actinoplanes utahensis
atgctcagcatgatcttccgcccggctgcggtgctcctgtcccgactgcgctacgcgcagaagatactgctggtcgccgtcgtcctgctgctcccgctgggtttcgtgacgtgggggtacgtggacatccagcgcgggcaggtccgtttcagcagcaccgagcgcgacggcgtcgcctacctgcgtccgctgctcgacctcaccgtgcacgccggggacgcgacgcccgagcgcatcgcggcggtcgacgcggtggatgcccgctatggtgcggctttcgagagcacccagctgtggacgacggcgaaggcggcgctcggctcgggtcaggcgaccgacgcgttgctggccttgatcaaccgggtgtccgacaaatcgaacctgacgctcgaccccgacctcgactcgtactacgtgatggatgcgctggtcttccggctgccgctgctgttgagcagcgtgcaccaggcgggcatcgcgtcagccgcgggtgacaagatcgccctggccgtcgcgaacggtgcgctcgacaccacgaaggcggcgttcgcgaacgacatgaccacggcgtatgcgaacaccggctccgcagggctgcgcgcggccagggacgtgacggacgccgtcctggccgatcccggtacggacagcatcgccgccgccgacgcgcggctgattccggcgctcgaccagctactggtcgcgcggatcggcgggttccaggcgaaggccttcaaggtcgaggccgcggcggcgctggcggtgctgctcgtcgcgtatctgctcgccgggttctaccggtccgcgacagtgccgatgcgacgcatggtcaccgcgttgggtgccctggccgacggcgacctgaccgcccgggtgcaggtcgacacccgcgacgaggtcgggcacatggcccaggcctacaacgaggcgctggaccgggtccggccggcgatcgaggcgctgcgcgacgaggccgccgacctctccggttcggccaccgaactgacccgggtgagcgaccggctgcgggacaccgccgcgcagaccgcggcccacgccgggcgggtcagcgatgcagcgggccaggtcaccggcaatgtcggcgacctggccacgggtaccgacgagatgaccgccgcgatccgggagatcgccgtcggtgccaccgaggccgccggggtcgccggggacgcggtgcgggcggcccagggcggcaacgaggccgtggcccggctgggccgcagctcggccgagatcggtgaggttctccaggtgatcaccgccatcgccgaacagatcaacctgctggcgctgaacgcgaccatcgaagccgccagggcgggagaggccggtcgcggattcgccgtcgtcgccggcgaagtgaaggagctgtcccaggagacggcccgggccaccggcgacatcgccgcgcgggtcgaggcgatccagagcgacacggcgcaggcggtcgccgcgatcagcgacatcggcgaggtcatcgggcggatcagcgagatccaggcgaccatcgccgccgccgtcgaggagcagacggcgacgaccgcggagatgggccgcggcgtcggtcaggccgcagcgggtgcggacgggatcgctgacggtctgacggcggtggccaccagcgccgaagagaccacagcgaacgccaccgtcaccgccgaaacggccaaccggctgtcggcgacggcggccaacctgcgcgacatcgtcgaccgcttcaccaccagcgaggcactgaccgccggccgccgcgatgccggatga

SEQ ID NO: 7599 - DNA, 462 bp, Actinoplanes utahensis
atgtcgtatgtcgccacccgcgacggccgccgcgatcgcagtgccgtccgccgggctcccgccgtccccgaccggatcgacgacctccacggccacagcgtcggcgtcctcgaagtcccgcatcacatggcctgcggtcacgccagccgtcgccggtacgatctggaggatccggcccagctgcggcacgcctacgagcaggtgctgtgcgaggccgccggctgcggcgaggtcgaagacctgatcaacccggccatgctccgtcgggtgtggcgtgacctgcacctgccgtcccgggtccgggacgcctgggagacccggcatcccagcctgcgccgcacgatcaaccgcagcccgtccgccgccaccgcggagccccggcccgccggcggcggcttcgcccgccgcggccgcacccagcccgtccggaccaggacggcgcgttccgtgccgggctcgtga

SEQ ID NO: 7600 - DNA, 1341 bp, Actinoplanes utahensis
atgacgcctgagagcggtgatctcctccggatcggcgtgcgggtctggtggctgcggcagtggcgcgatgatggtcgactcgtggtcacccgctcggtggaactcgacagcgaaaaagaggcgagtcctgtccttgagtggttcatgtcggagccggccaacggtttgcaggtggccatcgagctgctccggtatgccgacgtccctgctccggactggcgccgactactgctcggattgcagatcggtgcgcttgcagagccggtacggctgccgctgctgggtccggaagcggttgctgatctgcggttgaaagtgtcctgcggggcccttcggccagagcttctcttgactgtcgacctgtcaccgaaggctgggcagaacaactcaggccgggtgcatttcatgaccgccacactggggcaggtcgctcaagatccgttggctcgggcatgtcgcgaactggcaggcggccagctccaggtacctcgatcgcccgggggaccgcgggttcggcggtcgacgtggatggatgaagtcaggtggggtcaggatggtccgacgcccccggcgagcgctctttcgggccccactggcgtgaccctgcacggcgcccgaggtgtccaggtaggcgaccacaatcttcaggtcaacaatttccgtactgaagtcaagatcctggtcagcatgttccacatcgatcgcggcgtcgggcccggcgatctgaacggaatcttcggggtcgaggcggtccaggacggtatcgggcaactgcagcagtctcccaacgacgaagtcgcccgtgcgaaggtggcgtcgttgctcgctgatgccgcgcaggcgccggtaagggtgtcaccggtcttcttgccggcgccggtcgaggacgtggcgctgcaccggctgctggcggcgctactcgccttctcggcaggcgctccgggggccggagacgacgaagacacctatctcgcaccggccacgcgcgaggtgtcggctctgctgaccgactttcctcgagtgacacgtacgctggcggatctgatcgtcgggggcgaccgcgaccttgccgtgctccgccgcggaactcgcgcggtgcgggacctcatgccgcaggaggcccttccggagcccgcgatcctctacgggcctggcggtggagaactcctgcgggtggagcgaatcaaccagatggttgctgacgcagacggcggcatttcatccgtccgtgacgcccgtgtgacggccctggacttccccactctgcggaaagacagagtcgagcgaactgcccaggctgaaggcgagatagtgccgcttcgacgggcgtcgagacaatag

SEQ ID NO: 7601 - DNA, 849 bp, Actinoplanes utahensis
gtggcggaggtccgggtggggcagacgctgcgccggtggtcatggccacttccgtcgctcgtggtcctgctcgtggtaacgccgttgaccgcttgctccctctccaccccgctgtgcacggctgccgccggcctggtcacggacggccgactcaccgcggcggagtacgtctatggggaagcgcggaagtcggacgagggcgactgcgccggtgacgggatcgagcgggtggctggccggcggaagcaggccgccggatccgatgccacagggcgcgccgctgtccgacgccatgacaggacacgagcggcggcggccttccgcgccgcgctgaagatcgaccgaaacgacgccgatgcggtggccggcttgctgaagctgggcacggcgccctcggccccggtggctggaccggtcacgatcgtgaccacgcccgtcaccggaggcccgtcgatcggcgcgctcagatcaggttgcgcactggccctgatcacatcgctcgcattggcgatcggcatgtggtggacacggcgtcgggcaggaaacctcagagctgagtcgacccggatccggaaggccggggagaccagccctcggacgacgtcctcgtcgctgatttccatcgagcggcaggtgcgggcacggctggcgcaggtaagtgcggcggcggaatccgcggacctacgggtagcggatctcgaagccgacatggccaagctgcgggagcgggtggaccgagcggagcagggccatcgcgatgccctcttgctggcacaccagttgttcgaggcgctgcgggcgtcgcgtccggctgaggtcgtggtgatcgaggagagttatgacgcctga

SEQ ID NO: 7602 - DNA, 567 bp, Actinoplanes utahensis
atgaccaccggcgcagcgtctgccccacccggacctccgccacgatgcgaccggaacctggtcccagtatgtccgtccgcgccggtcacgcaacgaccttcgtggggcccggcgcgtcggcggagaaagtacagtcgccgcatgcgctacgaggaaacgtcgctgatcgatgcgccggtcgaggtggtgtggcggctgaccgtggagatcgacgggtggccggagttcctgccgaccgtgcagcgtgtcgaacgcctcgacgccggtgaggtgcgggtcggcacccgggcccgggtgaagcagcccgggcagctcagtgcgatctggacggtgacccggctggaggcgggccgggagttcacctgggagacccgccgaacggggctgcgcctgaccggccggcacctgctggagccggccggcgcgggcacccggatgacgctggtcctggaggtcgacggcgccgcggcgcgggcggcgacagcggtgctcgggggcatgatgcggacgacgctgcggcgggagtcggccggtttcgcccgccgggcgaccgcgccccgcgactga

SEQ ID NO: 7603 - DNA, 720 bp, Actinoplanes utahensis
atgctggacaccgaatgtgaaactgagcgcgagaccgaattgcgcaccctgatggtcaccgcctcgcatgacctgcggagcccgctgaccagcgtcgcggcgcacgtcgacacgatccggacggattacgcgtcggcgctgggcgaggacttcgcccgggatctggccgccatcgagcgcggtctgcaccggatgacccggctgacccaggatctgctcgactacgcccgggccgaatacgccctcgacgcgaccccggtacccctgggcgcggtgctcgccgacgtcgtcgccgaccaccccaccgccgcggtcaccgtggccacgacgctgccggaggtgctggccgacgccggcctgctccggcacgtgttcgacaacctggtgggcaacgccgtcaaatacgcccgggccgggcagtcgccgcggatcgtggtcagcgccaccccgatggcggacggcaccgtgctcatcgaggtcgccgaccacggcatcggcatcccggccgccgagcggtcctgcgtcttcgacgccttccaccgctgcgccaaccgcggcgaccgccccggcaccggcctgggcctggccatctgcaagcggatcgtcgaacgccacggcgggcggatcggcgtcaccaccggcccgggcgggggcagtcgcttctggttcaccctgcccgcggccgcagccgagcgcccggaccgtctaccccaggcgtag

SEQ ID NO: 7604 - DNA, 1413 bp, Actinoplanes utahensis
gtgagtctctacgtcaccaccgccatcccgtacgtcaacgccgcaccccatctgggccacgctctcgaactggtgcaggccgacgtgctcgcccgtcaccggcgcctgcgcggtgcgccggtgcggttcctgaccggcaccgacgagaacgcgctgaagaacgtgtccgcggccgccgcggccggtgtgccggtgaccgatttcgtggcgggcaacgcggcccggttcgcgaacctcgccgaggtcctcgacctgtccgtcgacgacttcatccggaccggcagcgacccgcggcacgcacccggcgtcgaacggttgtggcggcagtccgccgcccggggtgacttctatcagcgggcgtacgagggtctctactgcccgggctgcgagcagttcctgagccaggactcgtgcccggagcaccgtgccgcgcccgaagtcgttcgcgagacgaactggttcttccgcctgtcccgttatgccggcgcggtgctggacgcgctggagtccggccgggtgcggatcgagccggcgacccggcgcgccgaggtgctgtcgttcgtgcgcgcggggctggccgacatcagcgtctcccggccggcggcccgggccgccggctgggggattccggtgcccggcgatcccacccaggtcgtctacgtgtggtgggacgcgctggccggctacctcaccgcgctggacggcagcgcctaccgggaatggtgggtcgcatcatcggagcgggtgcatgtgatcggcaagggcatcgtccgcttcctcgccgtctactggctggcgttgctgttgtcggccgggcggccgctgccgaccgcgatcttcgtgcacgactacctgaccgtcgacggggcgaagatctcgaagagcaccgggaccgccgtcagccccgacgatctggtcgcccgctacggggtcgacgcggtgcggtggtggctgctgcgggacgtggcgagggtcggcgacaccgacttcaccgagccgcgactggtcacccgttatcaccaggatctcgccaacggtctgggcaacctggtcaaccggacgctgaccctcgtccaccggctccgtgccggcatcgttgcttgcgggacccagccgccgcgcgatctgccggacgccgtcgaccgcgcgctggcggccttcgacttccgggccgccaccgacgcgatcgcggccggcgtcgcggacgccaaccggctcatcgaagccgaacgcccctgggaactcgacggcgaccggctcgacgaggtgctcgccgccctggtggcgacctgccggaccctggcccgcgagttgtcaccgttcgttcccggcggcgccgcccggctcagcgcccagctgggcgccggcccgcgggtgggcgctccccgcccggccttcctacgcctggggtag

SEQ ID NO: 7605 - DNA, 192 bp, Actinoplanes utahensis
atggcagcgactggtgacgacacttcccccaccgagccgcgcgcgacggccgacgtgcccggccggcggctcatcgacctgatcgacgccggcgacgccgacctggccgcctcgatcagcgagctggtcgccctcctggaccggccgaccggggtccggcagggctggcagagcgcgatcaccgaggagtga

SEQ ID NO: 7606 - DNA, 1092 bp, Actinoplanes utahensis
atgccggtcagtctgcgcgcggtggtggtcgcggtggaggagtacgacgccggtgacccgtgggcgctggacgggccggcgatggacgcggtgcgggtggtgacctggctgcggcgcagcggggtgccggacgaggggatcacgctgctggtgtcggccctgccgcacaaccgggccgcggtcgaggcgctgggcctgccggtgcggcggccgacgcgggcggtcctgtacgacctgttcacccgggagatcgcgggtgacggcgcggcggagctgttcgtccactggggtgggcacggggcgcttgacgacgtacaccatcatcgtcttttctgcgctgacgcgacgaccgcggacaagcggaatgtcgatttcgacgcgctgcgccgttttctggccggggtggacgtccgcgggttgcgacggcaggtgttcctggtcgacgcgtgtcaggtgctggcgtcggagcgcgggtatgtgaaccggttgccggtcgacggctggccggagagtccgcggcggtccgaccgggagcagttctcgctgttcgcggccggggtcggtgaggtcgccgacagtctgaccgtgccgcgggccgggttgttcaccgccgaggtgctcgccgatctgaccggtgcgggactgcccgcgaccgggttggacgtggcggcgctcgccgagcggatcgaccggcggttcaccgagttgcggctggccgggcgggcccgccagaccccggtgtacgtctggttgaagacgccggtccgggagggcaacgtgtacgccacgccgcgcaccgatcgccggatgccgatcgccgcgctgcgcgacatcgtcgcggtcatgctggcggccgaggaggtggcgagcacaccgcggcgggaacgcatgatcatgaccatgccggacgagatccggtcggcggtggcgtactcctcgacgccgcgcgaacacgtgatcgactgggtgcgcacgtgcgagcggttccggaccggacgggcggccctggagggagtcctcgatctgtcgatgagcgatcgggcggcgttccagcggatcgtcgacgccttcgaccggcactggagcccctga

SEQ ID NO: 7607 - DNA, 3294 bp, Actinoplanes utahensis
ttggggcagtcgttgcaccctgagcacaatggagcactggacaaccgcaccggcgtccgccagccgacggtggccgatcgccgccggctgaagaaggccctgctcaagatcgaccggatcaccgacccgggggtgcgcgccagcatcctgcgcgagctgcgcaccgacctggtggatgtcgacccggcccggtccagcaccgccggcatggacatctgggagatcttcagcgagtgcgcccggcgcggcgccgccgagaccttcgccgacgcggtcgcgctcgtcgtcgacgactcccccgagtgggacaccttcgtcggcgtgatgcgggagatctacgcgccgccctcgctgagtgagacggagcggcaggcgatcgcccgggtgatggtggagttgccgcacgacgtgctggccgccgcggtacgccgcgccgagctcaccgacctggtcgacctgggcggccccggcgaggtcgaggccgccgaggtgctggccgtgctgcacgcgtacgagcagggttccggcgccctgatggagcggacctggcgcctgctggagaccgtcgcgcacgcctccgatccggaccgcgaccgggatctgcaccggctgatcacccatgccgcgacccggctcggcatgacggaacgactgctggcgatctgtacgagcgtctcgtccgtatcacctgccgaggccggcgatcccccggacctatcgggcgaaacggacgataatctaccgctgttgtaccaagacgacaccggagccgaggacatgctgagccagatcaccgcgccgccggttgcggttcccgccgtgatgcggggtctgccgccccgcaacgcgtatttctccggccggaccgacctgctccaccggatccgcgacacgctgcagagcaccagcgaggcggccgttctgccgcacgcgctgcaggggctcggcggggtcggcaagacccaggtcgcgctggagtacgcgtaccgcttcagcagtctctacaagctggtgttctggatcccggccgacgacgagcaggcgatccgccggtcgatggtgtcgctcggcaaggcgctcgacatgccggagaccgccgacgtccagtacatgatcgacaatacgctcgacgcgatccgggtgggtgcccagtattcgtcgtggctgctggtgttcgacaacgcgaccgacgtcaagacggtgcgcaagtacatccccagcggcgacaaagggcacgtgctgatcacctcccgcaacgccgagtggcgcggcgtctcgaacttcatcgaggtggacgtcttcacccccgaggagagcctggccttcctccggcagcgctgggagcacctcgaccccgagcaggcccgactgctcaccgagcgcctcgggcacctgccgctggcgctgaaccaggccgccgcgttccacgccgagaccggcatccacctcgcggagtacctggcaaactatgacgatctggtggaaaccgtcaccggcacggtccccgccgactatcctcgccccgtggctgccacctggcagatgaacttcgaccagctgcggaaggagaacccggccgccgcgcagctgctgcagctgtgctgtttcctgagctccgagccgatctccatcccgatgctgcgctccggccgcggcgccgccctgcgcccggaactcaagaaggcgctgcagaacgagctgtccttccgccgcgcggtccaggcgctcggcaagtacgcgctggcccagatcgacccgtcccgcgacttcatgaccgtgcacagcctggtccgggcggtgctgcgcgactccctcggcgacgacgaccgcgccgccgtgcagaaggccgcgcacgaggtgctcgccttcgccaaccccggggacccggacaacggcgagacctggagccggcaccggcagatcaccccgcatgtggtgccgtccggcctggtattctccgacgacccgcacgtgcggcaggtcctggtcgaccagatccggttctacttcagcaccggcgactacgcccagagccggcgcatcgccgagcacgccctggagaactggcgcagccggctcggccccgacgacgtgatgaccctgcgcgtccgcttccacctcggcaacgctctgcggctgctcggcgactaccggcacgcccgcgaggagaccctggaggcgcacagcattctggagcggacgctgggcgccgggcacgaatacaccctggccgtcgccaacagcctcggcgtcgacctgcgcttcctcggcgagtaccagaacgcgctggccagcgacctgaaaacgctggccgaccaccgggcggcgcccgacgtcgacgagttcagcgcgctgcgggccgccaacaacgtggcgatcaactaccggctgctcggccgcttcaccgaggccctggagatcgacgaggccaacgtccggcagcgccggcaggtcgacgtcaccagctcggacccggaaaccctggactcgatcaacgagctcacccgtgacctgatcgcgctgggccgctacaccgaggccaaggagcgcctcaccgagcgtctcccccagttcgagaacaacctcggcgtcaaccaccgcgtcgtcttgaacgcgcggcgccacctggcgatcctgcaccgcaaaaccggtcacctcgccgaggcctacgcccacgcggtcgtcgccgaggaggcgctgcggggtctgctcggcccccggcacgacgccaccctggcggccgcggtcaccctggtcaacaccatgcgggtgcagggcgacgtgatggcggcgcggcgccggggcgaggagacgctgaccgcgtaccaggagacgttcgtcccgcacaatccgcagacgctgctgtgcgcggtggacctggcgatcgtctaccgggcgctgggcatgcgcgccgaggcgtacgagtccgacgccgcgaacctggttcggctgcgcgaccggctcggtgagaaccatccgcacacgctgatctgcgcggccaaccacaccaacaacctggccgccgccggggagaagctggccgccctcgaactgtcccgcgagacgtacgaccggtcgctggccgtgcgggccgccgaccacccgaacacgctggccgtcgccgcgaacctggccgtcgacctggacagcgacggccggcacgacgaggccgccgcgctgcgcggcgccaccatcgagcggatgcgcgaggtgctcggcccggagcacccggagaccatcaacgtcgaacggggccgccggaccgagaccgacatcgaggtcttcacgctctga

SEQ ID NO: 7608 - DNA, 3117 bp, Actinoplanes utahensis
gtgctcgacgaacagaagcggtggccggtccgtcacgaggccgatggtgtcgatgcggatcttcaagcggtcgcggtgctggcggctcaactctgtcagatgccgatggccgcggtcagcctgatgggcgagcgtgaccagcggttcgtcggttcggtgggtttcgacggcgtcagcgtcgaccgcggttcgtcgttctgcgccgaggtggtgcagagatcggccgcgctgctggtccccgacacgcatgccgatgttcggttcgccgaccacccgtgggtgaccggaaaaccgcatatccgtgcctatgccggggtgccgatcctgtccgccgatcacgtcccggtgggcacggtgtgtgtgctggacacgcagccgcgcacaccgtcggcgtcgcagatggcagcgttggagtcgctggcgatggtcacccgacggctgctgcaggcgcaacgggccggcatcgagctggtcgccgtacaacaggcacagcaagccgcgaacagccagttccagaccgccttcgaccacctgaccaccggtatgaccctcgtcgacgacggcggcaggttcctgcgggtcaaccgcgccttcgccgacctgctcggctactccgtcgacgacctcgtcggacgcagcttccgcgaattcaccgacgacaccgacatcgacaccgatgtgcaggcgatcaccgagctggtggccggtctgcgccgcgcggcgctccgggagaagcgctaccggcaccgtgacggctcgctgatctcggcgctggtgtccagctcgctgatccagccggatcgcgacggcccatggcagctgctcaacagtgtcgaatcgctgaccgagcgccgtgccgccgaagcccggctgctggaactgcactcggcggtcgacggcatcatcaccatcgacggacacggccgggtgctggcctggaacctcggcgcgcagaacctgctcggtcactcggccgccgacatgctcggccagccgctggaccgcatcatccccgcccacgcccgcgcggcgcacaacgccggcgtggcccgggccgccagcggccaaccgacgcgactggtcggtaccaccgtcgaagtgcccgtcgtgcacgccgccggccacgaactgctcaccgaactgtccctgtcgagctggacgcaggacggccggccgcgtttcaccgccgtcctgcgcgacatcaccgcccagcgccgtaccgaagtagccaccgcgctgacccggcacgctgccgtgaccgccaacagcaccgacgtgttcgccgacgccgcggccgccatcgtgcgggaggtgtgcacccggctgggctggcgtgccggtcacgcatggaccgccgacgacagccgcgccatctggcatgtcggcgagcacctgggtgccggtggcgagccgcacccggcgaccagcgcaccgcagccgggaccggcagggcggtgcccgctgcacgtcctggccgcccagcacgcggcacccacccgcgaagacctgccgttctcctcgacggtgcaggtggcgaccgccccgcgcgagttgcagccgatgggcccggcggtgcacgcgtgcgggatcggcgctgccgtcgccgtccccgtgctcgccggtggcgaggtcaccggcaccctggccttctacctgccgcacagcagccctgcgccggataccgagatcatcaccgcgctcgaacaggtggggatggctgtcggccgcgtggtggagcgccagcgcacccgtgctcacctggcctggcaggcctcccacgatccgcttaccgacctggccagcagacggctcctgctggagcgcatcggtgcggcgcagcgcgaaaccgcgaccacggccggcacccggtatgcggtactgctgctcaatctcgaccggttccgcaccatcaacgactccctcgggtacgccgtcggcgacgaattgctgcggcaggtcgccgaccggctccggaccgccgtccgcaccggcgacctggtggcccggctcagcgcggacgaattcgtgatcctcacccgtcacctcaccgatgacccgggcggtccggccgacatgttcgccgccgtcgcccagcgcctcctcacccggctggcggaaccggtacagatcgccgggcaccgcctgcagctacgcgccagcatcggcctgtgcccgatcagcaccgcgcatgccggcggcagccacaacccggcacggctgctccgcgatgccgatgcggctctgcggcacgcgaagcggcggggcaagaaccagatccaggtgttcgacgccggcatggccgaccgcgcggaacaacgcctcggtgacgaaaccgcccttgccgaggcgattctcggcgaccagttgcggctgcactaccagccgatcgtcgacctgcccacgggctgcgtcgtcggtgccgaagctctcgtccgctggcagcggcccggtcacggcatggtcccaccggatcgcttcatcgccctggccgaagacaccgggctgatcatcggactgggccgatgggttctgcgccgcgcctgccacgacgcggcggcgtggccggaactcgtcccggcgatggcgaatgcatccataagcgtcaacgtttccgctcgccagctggtccatccggaattccttgccgacctcgacgccgccctggccgacagtggcctggacgcacgccgcctgactctggagatcaccgagacggcgctgatcggagagaccgaggccgtgctggaggtcctgcacgccgtccgccgccgggacgtgcaactggccctggacgacttcggcaccggctacagctcgctgagctacgtgcagcagctacccgccaccatcctgaagatcgacaagagcttcgtcgaccccatcaacggaccgggcgacggcatcgccctcagcgaagtcgtcatcaagctcgccgccgcaaccggattgcgcaccgtggccgaaggcgtcgagacccgcgaacaggccgaggctctgcgcctgctcggctgccagcgaggccagggctacacctggtcgcggccggtacctcaagatcagttggggcaggctgtcgccggcatgacgcccgcaccggtcgagggggcgaggatctga

SEQ ID NO: 7609 - DNA, 840 bp, Actinoplanes utahensis
atgcggctggcgggaatcatcgacacaccggagaaggcgggtgtgcacgaccatgtcggctgggtcttcgacaagccggccgactttcaggtacgtgccggccggttcctgtccgccggactcgcccgccggcagcgggtcgtctacgtcgcgggaaccgacggcgacggcccggccgagatgcccggctgggacgaggccctcgccagtggtcaggccgagctgacctcggtgaggaccgtgtacagcgccggcgaaccggtcgatccggagcggcaggtggccgcattcgtcggagccgccgaacgagccctgcaggacgggtggagcgggctccgggtcgcggccgacgtgacgtcactggtgctgaccgagcaacagcgggcggcgtggacccgttacgagctgctcatcgacgcgcacatggcccaccacccgatgaccggcatgtgcggcttccaccgcaccgcgctggaaccctccggcctggccgcggcgacctgcatccatcccgcgctgagcgaggacaccagcgcattccgcctctacgccggcggccaccccgacgcgcacatcgtggtggccggtgagatcgatcccgagaaccgacttctgttcgccacgacgctgcggcacgcccggccggagccgctcgacggtcgcctgctggtggacgcctcgccgctgactttcgtggattaccgcggcctcgtcgagctcgcgaactatgtcgccgaccggggtgccaccgccgtactgtatgccgacgaggcctcgatcgccgccatgatcactcgggtggtcccgctgaaagggttgcaagtgctggtgcgcccatga

SEQ ID NO: 7610 - DNA, 957 bp, Actinoplanes utahensis
atgagaaccggtgccgccgccggccaccgcggctacttccacgaaactgctttctacgacagcgacgaagcgttcctgtcgacgatcgtgcccttcttcaccgcaggactcgaagcaggcgaacccgtcgtcgccgcattcgccgccaccaaccagaacctgattcacgacgtgttcggcgatgacagcggcatccgatacctcggcggtgaggcccagtaccttcgaccggccagcgccatccgtacctaccgcgagctgttcggccgatacgccgcagccggagtgcagcagatccgcgtcgccggcgacgtgccccacccgggcgtgggtgtcccttgggactcgtggcgacgctacgaggctgctgtcaaccacgcctacgacgagttcccggtctggggcgtctgcccgtacgacacccgtacggcgcctgaccacgtcatcgccgaggtccgccgcacccacccgcacatcgcccacgccggtggccacgccgccaaccccgcgttcgaagacccggtgggacttcttctcgcccaccggagcgaccactggtgcgacccgttggagcagcaaccgccgcacctggagctgctcgatccggggagcgggccggcccgcggctcggtggccgcgctcgccggcgacctgctcaccgccgaggatcacgccggcctgctggttgccgtgagcgaagctgtcaccaacgccgaaaaacacggccgggcccctgtcgtgcttcgggcctgggcgggaccacgccgggtcgtcgtcaccgtcaccgacagcggcgacgggccgactgaccccttcgcgggtctgctggccaagcgtgatgcgccgagcggcggcctcgggctctggatcagccaccaggtgtgcggctacgtcggattgcagtcggcacccggtgccttcaccatccggctcctggccggggatctgcccgcatag

SEQ ID NO: 7611 - DNA, 1041 bp, Actinoplanes utahensis
atgagctggtcgtggtggccggccggggtgaccgcggtgctggcggtgatgcccagcgcggggccggaggcgaccaccgggaaggaggccgacggcgaggtgagggtggtcgcggaggccgcgccggggctgcggccggcgaccgtgacggtggtggcgaccggtgcgttcgtgtcgacgtcggcggtggtgacggtgtacggggtggtgctcaggcaggtcatcgacgcgttcggcgccaggctggtggccgggcaggtcgcggccccggaccgcgggtcggtgacggacaggtcgctgatcgtctggttgccgctgttggtgagcacggtgcggaacgtgacggtgtcgccggtgtcggcggcggtcacgtggccggccgggctgatcacggcggtgacggcggcggtgagcgcggtggtggccggggccacgttgatggtggcgatggccgggccgaaggagtacggtgccgggaatccgacctgccggccgtggatgtgggcgtcggagacgatcggcagcccggcgtcgaggtcggactgggtgaccgggcgggtggcggtggagcagaccacggtggcggtcaccgccagtggcgcgccggggcaggtgaccgtgccgaacagggtgtcggtgacggccagggtgtccatcgtgacgttgccggtgttggtgacggtgtacgcgtacgtgatgctgtcgccggccgcggcggcgctctggtgggccgcattggagacggtggcggtgctggcgatggtcagcgtcggcgcggcggcggccaccggtgcggtgacggccggcgccgcgaaggtcaggtcggtgggagtgccgccgcgccgggcgatggcgccgccggtgtccgagatcggcgctccggtgtcgacgtcggtctgggtgatggtgtacgtgccaccggtgcacgtggtgccggcgccgacggagagcgtcgtgaccaggcaggacgccgccccaccggtggagccgctgacgcgcagcgtgtccatcgtgacgttgccgatgttgcggaccgcgtag

SEQ ID NO: 7612 - DNA, 348 bp, Actinoplanes utahensis
atggtgtcgttcttcgccgcggcgctctgccgggccggcggggtcacggccgcggtcaccaccgcggacagcgcgggtgcggccgggacgaccgccacgctggtggagaacggcccgaaggtccgatcgctcgccgcgttggcgagccggccggtcagggtcgcggcgtcggccaccggtccgccggcgtcgatgtccgcctgggtgaccgtgtacggcgtgccaccggtgcaggtcatcgaggcgttcacggcgagggtggcgctcgggcaggtgaccgccccgcccagggtgtcggtcgcggccacccgggtcagcgccgcgttgccgtcgttggtgagcagatag

SEQ ID NO: 7613 - DNA, 312 bp, Actinoplanes utahensis
atgtcggcctgctgggccccggcgccggtcacggtgacgatgttgttgctgatgtccgggtcgggcgtgctcgagttgagcgagacggcgttgttcaccgtcgtgccgctcagcgtcatcgtgatggtgaccgtgacactggcgccggacgccaggctggccagcgtgcactcgatggtgccggtcgacgtcgacgcgcaggagccgccgggcaccaccgccgaggcgttggtcgagccgctcgggatcgggtcggacagcacgatgctccgggccgtcgacgggccctggttggtgatcaccgccgagtag

SEQ ID NO: 7614 - DNA, 861 bp, Actinoplanes utahensis
atgaacccgtacgacgagatccgcaccgcgtacatcacgctcggctggctcttcgaacccggcaacccgccgctgacccgccgggtcatcgccgacggccccgacgaggtcgtcgccgccctcctcgacgagccgctgatccctgccatgctgcgccgtgaactgcgcggccagcccgaccaccagctctgggcccaggcccggcacaccgcccaggacagccacatcatcacgcccagtgattccacctggccctgcggattcgaccccgacggcccgctgtgcctatggagccacggcaccggagaaccgccgtacgccgccgaagccatcaccatcgtcgggtcccgcgcctgcaccgcctacggcagccacgtcgccaccgacctggccggcggcctcgccgaacgcgactggaccatcgtcaccgacggcggatacggcatcgccaccagcgccatgctcggggccctgcgcaccagccgtccgcccatcgccgtcctgcccggcggcctcgaccaccttcaccccaccggcaaccggcagctgctcgaactcgtcggcgacaccgggctgctcctgagcccgtacccgccgggcgccgagcccgtccgcgaccgcgtgctctacgtcaaacgcctactggccgacctgagcactgcgaccgtgctcgtcgaagccccaccacggagcgcagccctgcacgccgtccggcgcgcactgcatctgggccgtcacggcctcatcgttcccgggccggtcacctccgtccactccggcggcggcctcgacgtgctgcgcaccgacagccgggcccggccggtcggcagcgttgccgacatcctcaccgatctgacctga

SEQ ID NO: 7615 - DNA, 513 bp, Actinoplanes utahensis
atgggctacctccactactggtccctgctcctcaacgatcccgcctaccaggccgcctggccgcagctggtcaacgacaccgtgcggatcgtcgatgccgtccgccgcgccggcatcgacctggccgggcctctcggtgacaaccggccgatcctcgacgcgaccggcgacctcaccttcaacggcgaccgcgtcgccggtcacgccgccgacaccttcaccctgcgccggccgcagaacggcggggaccggccgcagtggatcgccggctactgcgacaccaaacgcttcccctatgacctggccgtcgccgccacgctgctgcgctgccacctgctcgtgcccaccgccctgaccctcagcagcgacggcagctgggaacggcagtggaagtacggcaagaaactccccggccggcgccgccgcgcacccgccgcccgcaccctgctcaccgacctgttcggccccatcccggacaccgacccgctcaccccgctgagcgcgcggcactga

SEQ ID NO: 7616 - DNA, 951 bp, Actinoplanes utahensis
atgcaacgaccggaaatccggatcaccagctcggccgatgccgcgacgatcgtcgcctacctgctcggctatcagccggtcaactgcctcaccgtgctcgccgtcgccgacggcacggtcgccttcgccggcgcacaagcactggacggcatgcccgacccccgggcggccgccggccgcctggccaccgtggtgtacaacaacggcttcacccaggtcgtcctcgtcggttacggcacccaccagtcgatgcgcgacccgctgcaacaggccatcgacctgttcaccagcatcggcgtgacggtgctcgacgcgatgcgcgtcgacgacggccggctctggcatgtcggctgcggcgacccggactgcgagcgcaacggcgtcgcgttcgacccgcagaccacgatcatcgccgccgaagccaccttcgccggtgtcgaactcgctccggaccgggaaaccctcgaagcccgcctcgacccgatcaccggagaaccacgacagcggatgcgcgccgccgtcgcccgcatcctgcagagcacggtcctgccgatcgaccaccgacgggcgatgcggctgatcgaccagctcacgcaacaggcgctcgccggcccgctcagcgacgacgatgccgctcaactgctggtgctgctcgccttcgctgagctgcgcaactacgccgtccatctggtgcacggcagcgacgaggacgtgcacgcctggcgcgatctgacccgtcgggccggcaccggcacgctcgcctgcaccccggccaccttcctcgccctggccgccctgcagggcggcgacggcaccaccgccgccatcgccgccgggcgcgcccgcgcagccgaccccgacgacgacttcgcccacctgctcgaacgggccctccaggccggcatcagcccacaggcgctgcgcgaagttctgcacaaaccccagcactga

SEQ ID NO: 7617 - DNA, 687 bp, Actinoplanes utahensis
atgcctgaacctgctgggccgccgggacgtcctggtcgccgcggtcacggagccccgggagcgcggatgaacgccgtgcggaccgtctgtctggtcgtgctggccgacctgctgttgatcctcagcgggccgctgctgccggtgatcatgccgctgcacgcggccgtgctcggtgtgctgctgatccggctgtgcagcgaggtggcgcaggccctgcgggacccggtcactgggatctcggtgcggcgggtcgccgaacggcacctcgaccgggcccgcggcgaggtgaccgtggcgctgatcgacggcgatgacctgcacggggtcaaccgccggtttggtcacgccggtggtgacgccctgctggccgccctcgccgtccggctgcagcaggccgccgagcgaggcgatgtggtcgctcggctcggcggcgacgagttcgtcctgatcagccgccgaccggtcgacaccgtgcggcggcagctgacggccgtgttggccaccccggtcgtactgtccggtcaccccgtcccggtccggttctcggccggcatctgccgggttcccggcggggatcaccggcgcgccctgactcacgccgaccggctgatgtacgccgccaaacaccagggcggcggaatcgtcaccgaccgctgcccggacaacaccgaccaccaccagtactga

SEQ ID NO: 7618 - DNA, 672 bp, Actinoplanes utahensis
atgccctggaccaccctcgtctgcctaccggcagacaccccaccctccgactacgccgtacaggcagaactccgcctggcccgcgccgggctgaccgccgccggtctgctccggcacttcccggccgtcacccgctggcggcgcggctcgctgctgctcccgctgcgcggcgccgccgccggaggaccggtcgcccggctccagctcgacgcgatgcgtgaaggcgtgcaccgactgcactggttccgttggcaggcctggcggcagacggtcgccggcacaccgaccgcgaaaccgtactggatgttcctggaccggcaccgggccgctccgcaccggtacgagttcgcccgggccaggaccgactatctgtcccagccccggatcgcggcgatgcgcgtctacaacgcgatgccgtaccggccgttcgatctgccgaccagccatctggaggcgctgcaactgggcgccgaaacctacacccacctgggctggctgtccgcggtgcccggccgggcactgctcgacccggacggcctactgctggcccaacccgacgaccggctcgatgcccggctgacctacctggagcaggccaaccgatgcctgaacctgctgggccgccgggacgtcctggtcgccgcggtcacggagccccgggagcgcggatga

SEQ ID NO: 7619 - DNA, 162 bp, Actinoplanes utahensis
gtgcgcacgacggcgcgatccggcactgccggatggggtgcggttcgcggcgccgacgtgcggtgcgagccgaccgacctgctgagcaggtggtgggcggtggctaccgcggtcgtgggcggcgaagcccgcgaagtggtgctgaagggatcacagaagtga

SEQ ID NO: 7620 - DNA, 1695 bp, Actinoplanes utahensis
ttggtgggcgcagcggctctgggcgctgctgcggtgatccgcgccgtacgtggcctcggcgtcctgctggtcgcgctcgcggtggtcgccggaccacccgcgctggtcgcactgtggttcgtagaccatccgcagcagctgccgagcctggctgacctgaccaccgacggcccgccggggacccggttcgtgctggccgtcggcgccattccggccctgctggtgtggctgctggtgagcaccgcggtgctgcgccgcggtatccggcgggcccgcatgcacctgcggatgccgactccgtcgcagctgaccgccgggtcgatggccggtgcggtggtcctgggcgggcccgcgatcgtcgcggtgaccgcaccggccaccccggcagcggccgcgaccaccgttggagacacgaccgttgcccgcggtgtggagctgccggacggggccgggtgggtcccgatcgcggtcggtcaggcagtggcgagcaccgcggcggccctctggctgcggcggcgccgcgactaccggccgggcgcgtccggcagcgaggagctgcggccgctgccggccaccgtgaacgcgttggccgcactgtccggcgagtccacggcggccgctgcgctggttgatcggctgccagccggtgggatcgccctgaccgggcctggggcccgcgacgcgctgcgcgggctgctgatcagtctgctgctcagcgggcgcaaggtgagcatcacctgggcggacctcggggaactactggacgacccgtaccgggcggggccggtcccggccgggctgcgcgtcgtcgacgacccggacacgactgacagcgacgaggtgacactgaccctgcacccgctcacctcgaccggcacctgggtgagcgccggccggggtgcggcggcgacgcggtgggaggtcgacctcgacgggacggttaccggaacgcggcggctgtgcgtgctcaacgcccgcgccgccaccgacctactcgacctgctcgccgcagcccacccgcagcaaccgccgacagccggcgcaccgcagcaggcggtcgccgcactgcggctgttgggtggctgcgcgctgagtgtcggcgggcgtccggtgccggtgcggcgcaccgccggcctgcaggttctcgcctatctcgggctgcacccggacggtgcgaccggtcacgagctgatcgccgcgatctggcccgggctgcgcccggcgagcattaccaaccggctgtacatcacgatcagcgaacttcgcaaagaccttcgccacggtacggaggtcgaactgatccggcacgagcgcagccgataccgactgaccgccgcggtcgaggtcgacctgcacgtcgtgcgggatgcggcgggccgggtggatcgtgcggtcaccgcggccgagcggcggcaggcgcagcgggcgctcatcgacgcgtatgcgggggagctggcggccggctgcgactggccgtggctggtcccggcccgcgaaaccctgcgccggcggatcctgaccggctacgtcgacctggccgaggcggcggcaccggccgaagcgctgcagctgctgcgggccgcgatcacggtcgacccgtgcaacgacgacatccgggcgcgggccgcgcagctggccgacgaacccgacaccgcgctgcggcgtaagccgcgaccgcatcagcgaccggcgtga

SEQ ID NO: 7621 - DNA, 1821 bp, Actinoplanes utahensis
atgcagttcggagcgccgcgtctggcgatcgattacggcaccgcctgcactcgtgcggtgatcgccggtccggatcagccttggcagcccgtgacgatcgacgggggtccggagccgagcagcgtcgcgcacgtcgatgcgagcgggcagatcagcacgggcaacaccgcgtggcgcctcgccgtcaccgacccggacggattcgtcggtgcgccgctggccgaggggaccggcaccgtgcaacggcacggccacgacatcgaggtggcagatctggtggcggcgacgctgcgactggtcgcggacgaggctgcccgactgtgcggaaccgtcccggtggacgtgcggatgtgtgtgccggccgggtggggaccgcggcggcggacctggctgcggcaggccgcccggcgggccggcctgggaatgccgacgctggtcgaaacgccgatcgcggtcgccaaccaccaactgttggccggcgtccagctgcctgttggcacgtttgtgctggtctgtgacgtcggggcgacgatggaggccagcgtgctgcggcgcgggccgggcggcttcgaggtgctgtccacgctgtacgacgccgatgccggcggacaggccgtcgacaaggtgttggccgacacgctgctcgtgccggccaccggcgccaccaacgggacgccatcgtgggcggtgctggccagtatgcgtaccggcaaggaggccgtttcgttccagccggccgtgaccgtgccgctgcccccgcccgacccggcggtcatcgtgaacgccgccaccgtggaggcggccgcacagcccgtcctcagtcgggccgcggacctggccgcggccgccgtcggcgcggccgagatcagcccggccgacctggcagccgtctacgccgtcggcgccgtcgcggccatgcccgccctgcgcccggcggtcgagcaacggctcggggtgcccgtgcaggtggtgccgatgccgggtgcgacggcggtgctcggcgcggccgaagcgaccggcgccgcgttcgaggagacggccggtgaggtgccgccgccgacgctgcgcagcacgctgggactgctcgtaccaggaatcctgtcgttgatcctgtttgcgcatttcgtgttctcggccgatttcagcggctctcgggtgctgcggaccccgccgtggtgggtgtgggcgaactggggtgagctcgccatcgcctgcgtgctgaccctggtcgtgtgtgtggccgccagcccgtggatcggcctggcgctgagccgggatcagcggctcaagggccggtgggacgcgcccgggcagcgggcggcggggcagatcaccgcggtggcgatcgccgccgcggtcgccgcgctgtacgcggtggccggcggcctctacttcatcctgccgttcaccctgccgctgcgctgggcgctgctgccgatcctgccgatcgggctgatcgtggtcgccatcgccctgcgcaaccggaaacggccgggcccgccggccggggacttcccgatgctgccggtgctgctgatgggcggtggagacctgctgttctcctacacggtcaccagccgacacctgccgtggctgcacctgtggttcctgatcggtacccgggtgggagtcgcgctgatcggcgtgggcatcgccatgttgctgctgcagatcgcggtgctgcgcacgatcgccgcggtgacgctcggcgtgttcgggttcttcatcgccgacttccggctcaacaacgtcctcggggtcgcggtctcgctggccgtcaccggttggtgggcgcagcggctctgggcgctgctgcggtga

SEQ ID NO: 7622 - DNA, 2355 bp, Actinoplanes utahensis
gtgcgcatcggcctgattctgtccgtcgtgctggccggattcccggtcgggctcgtcgccctggccggctcacccctgcccagccggctgccgaccggcgtggatctgcaagcgtgggccgccaacccgttcgccgcaccattcctacccggactgctggccgccatcgcctggttcagctgggcattcgctgcggtgctgtcactcaaaatcgcggcacggtcagcgcaccggctcagccggcttgcccagtacctgcccgggccgctgcagggcctggccgccaccctgctcggggccgccgccgtcacggcgacctacgcaccggcggcggccgctcccccggcgaccgcgacggccaccgggccgaccctgctcaccggaaccatcaccgaccgggcgcccaccgccggtcacgcggacccgacgtgcaccgtgcaccgcggcgacacgctctccaaaatcgccaaacagcggctgggtgacccggaccgctggccgaccatcttcaaactcaaccgcggcaaacgcttcccgaccgtcggcggccgtctgaccaatccggacgtcatcttccccggctggaaactgaaaatgccggccaatgccaccccgccggcctccgacacctgcaccggtcccgcggcggcaccgacacacagaccatccccgaaacccagccggccggctgactccggcaacaccgtcaccacaccggtaccggcaactgcagcgccacaagcggcgccgcagacgaacaaccagaccgggcccgcggtcacgctcggcatcgccggtctcacgatcgcggccggttgcgcgtacgccgcaggcctactgtggcggcgcaaacgtcgcgccgcgcatccaggcgacccgacccgaccggccagcgtcaccctgctgccgaccaccacgcccgccggccggcccccgaccgccgcggcgtccggcgcagctaccccagcggccagccaccagccgatcaccgtgcggccgccggacaacccggccaccgccctgatcgggccgggcgcccacgacgcggcccgcgccgccctggtcgccgtcatcaccggcagcatcgccgacaccaccgcactgaccaccgcggccacccgcgacgccctgctgcccgacacaccgcttcggggcggcgtcaccgtcgtcgaggacttcgcggccgcgctcgccgccctggacgaggagatcatccgccgtagccggctcgccgatgatctcgatgacggcgccccgccgaaacccaccatgctggtactcaccgacgtcccggacaacgcctggcacggccggctcgccaccgcggcacgtgaaggagaacggctcggcatcgacatcaccctgctcggcgagtggccgtccggcaccaccctgaccgtcaccgcggacggcgccaccgaagccggtgaactcgccgtcctcaacgccggtgccgccgccacgctgctgaccgcagccgagaagaccacccccaaaccggccaccgttgttccgatgaccgtcgaaccggccaccgtggaacccgtcgccgcgccagcggagcatccgaccaccggccgggtggccatccgcatcctgggccgaccggccatcctcggacccgacggcaacccggtccgcggcctgcgctccaaaagcctggaactctgcgtctacctggtcctcaaccgcgacggcgccgccatcgacgacatcatggaagggatctggccggacgtcaccgtcgcccgtgccaccgaccgcctctccacctgcgtcgccaacctgcgcaacatcatccgctccggcgtccgcggcggcctcccgccccatgacggcaaccgcctggagccggtcatcaacaccggcggccgctaccacctcaaccccgacctggtcgacgtcgactggtggcagatcctggacgcccacacggccgcggccaccgcaaccgacgacagcacccggctggatcacctgcgggaagcggtcacggtggccggcgggcgtgccccggcggcggacaccgcctacgaatggatcgacaccgaccgggagcaggcccggcggctgctgatccgactgcacctgcagaccgcacgtctggtcgccgacgacaacccgcaggccgcgcgcaccctctacgaaaccgcctgcgactacgacccgatgtccgaagaactcgcccgccacgccatgcaggccgcggcccggctacatgacgccgacggcatccggcatcgccgagagcagctccaccaggcgctcgccgaagccgggatcgacgccgacaccgcaaccgaccgccacgccgccgagctgctgaacggcctcaccttctcccaccagcggtag

SEQ ID NO: 7623 - DNA, 819 bp, Actinoplanes utahensis
atggaccgacttcagccgcgacaccagatcgcaatcgatgcggccgttggcggagcactggctgcgatcggcgccgctgccggtggcccccttggagcaggcctggcccaagcggcaacaccagcggtatcagccgtaatgagccaaataattaccaccctcgccgatagcagcgcaagccgcacaaaccggaccatgaccagcgccgcacgaaccgccggagtcgacgagcacaccctcgccgagcagatgcttctatacagatctaaagcggtccttttgggcagagcccttgatggtgcggcgcgtagcatcgccgaagagaagatcgagtggttcgccaactgcatcgcaaacggatacctggctgcagacgatgccgccgtagaccgtgaatccttctacgtcagtgccttcgccgagctggaggccccacatatccgagttttgctcttcatcgccgagtgggagcgagtcggcgaccacgccgctcccccgactactgatgagctgtcagatgccttctcgcggcagctgtgtccggtgatcagacccgttctcaccacgctggagcgggcagggctggtggtgaagcgacgcgcccattcgagcgacgagaagatggcgtcgcagcgcgagaccggcgttccccacatctgggagataaccaccttcgctactcacctcctgcggcggataggacatacgccaccggaccgagtccggccctcccaggatgatcttctagaggcagccaatgcaggccagccagtgccgacgacgtcagcgaccgatgtcagcggtgccacgaatctctaa

SEQ ID NO: 7624 - DNA, 1020 bp, Actinoplanes utahensis
atgacggagccggacgagtgttacgaggatgccatcgtcccgttctggatcgagagcaaccagcccgagccgcccgtcgtgttcgcccggctctacctggaccgcgtggccgggcgtgaccgggtggagccggcctggcgccgctggcgtgcgatcgccgatcaaagcctcaccccgctcctcgggccggtgcctccggagccttacgtcgatgcggacccgacgccggtgatgccggtcggtcggctcgaacgcatcgagccgacgggcgtcggcgtgctatcggcgctgcgcgtcaccgtggagtggttcgacggtgacgggcaggcagtgctgcacgtctcggcgacgctgggcgcggacaccagccggctcaacgaggtggtcgaggcggcgtacgatgtcctgcgggatgtcgcagtgtcggctgagccggcttacggcgaggtaacagtcggacgtacgggacatctacatcgcaccgcgttagacatcgcactgagtcgttccgtgcaggagtcggcccgcgccgcccgcagcgtgctgcgcggctacgaatgggccacggtctgcccggccgagcttgccccgcacgttgccgttgccgccttcgaccgggttgtgccgctggccaggggcggcgtgctgctgcgggcaacgagctcctacgacgagtggtccgctggggccgttcagcgcgtgtttgaggcgctcgccccgatcctgcccgccggaatgccgcagcggtcgcactacggggacctccgccgggtcgtgttcgccgacgcggcggacgtccgcggcggcaagtcgatcattgcgcccgcctctgccccgcctgccgaccttactgagttcatccacgaggcggtattgcaagggtggatcaccaccgagccagtggacgagtcagctccgtcggccgtacgcgaactgttgccgcccgagttgggcgtcgggctcactgaggaaggccagcgaaggcttatcgagcttttcggcctcgacctgcgcggttga

SEQ ID NO: 7625 - DNA, 126 bp, Actinoplanes utahensis
ttgcatctagcacgaccggagttccagcgctcgcttctcacgttcgtcaagtcggtggccgaccaggcgaacccggcgttcgggcagtgcgactacgacgatctgctcggaggaaactgcgcttga

SEQ ID NO: 7626 - DNA, 474 bp, Actinoplanes utahensis
atgcgcgcaagccgcctcgcccggatcctcgccgccgcgctgaccgtggcggccctgaccgtcggatgtgattcctccgtgccatcccaatccaacgtcacccaacacgaagccgagcagcgggtcgccgaccgggcgcaggaagccctgcagcagctgccgtccggtgcgagtttgaaggtgacgctcaacgagcccaagctgcgatgcgaggacaacggcgaccgcaccttcgtcgaaaaccagtacgccatcgagtatccaaagggctggccggtacagcaggccgtccccaccctggccggctactggaccggcaaggggtacaagatcctgcgcgacgagcgcgacgatccgaaactcgcccggttcggcgtcgagtaccccgacgagttccgcatcagcatcgaagtcatccaccgcgacaacggccgggtagacgcctatctgatcagtagctcaccttgcatctag

SEQ ID NO: 7627 - DNA, 228 bp, Actinoplanes utahensis
gtgtgggcggcaaccgccggcaacgacgtcatctgcctgaccggcatcgaggacaacatgcgttttggggagaaccctgctaatcccggcttcggcggccgcgtcttcactagctcggatggatcgctgaacccggtcgcggcgcactcgcagtatggggacaacctcaacccggcccgcagctcgatcactttcatcgtgacgggccaaccagacagagtgcactga

SEQ ID NO: 7628 - DNA, 984 bp, Actinoplanes utahensis
atgaaggtcatcattccgggcgggaccggtcaggtcggcggcgtactacggcgggcattggcggcccgcggcgaccaggtcaccgttctgagccgtcggccgcagacgcttgagaagggggtccggcacgtagtctgggacggccgaaccctgggcgagtgggcgcgcgaggtggaaggggccgacgcggtcgtcaacctggcgggccggacggtgagctgccgctacaacgacgccaacctgcgccagatgatgaattctcggatcgagtccacccgggtcgtcggtgaggccatcgcccgggcggctcaggctccgagggtctggctacaggccagcaccgccaccatctacgccgacgcccgcagccgacccgacgacctgccccacgatgaggccaacggcatcatcggcggagaagaacccgacgtgcccctgtactgggaatacagtgtccggatcgcgcgccggtgggagcgggagcaagcggcggccgacactgtttccacccggcgggtggcgctgcgcacggcgatggtcatgactcccgaccgcggcgggattttcgactacttgtcccggctgacccggctggggctgggcggtcccgtcgatggcggcgggcagtatgtgtcgtggatccacggcgacgacttcattcgtgccgtactgttcctcatcgaccaccaggagttggacggcccggtcaacctggccagtcctcacccggtcacgcagcgggacctcatgcgatcgctccgccgcgcctgggggcgccgattcggtctgccggccacccggcagatggcggaaatcggtgcgttcgcgttgcgcacggacactgagctgctgcttaaaagccgacgcgtagtacccggtcgcctactcgacaacggattcacattcacccatcccacctgggattccgccgccgtcgatctcgtcagccaggccaaagaactccgaaacgccaccttgccctaa

SEQ ID NO: 7629 - DNA, 285 bp, Actinoplanes utahensis
atgcgagccggtcaaccccgcgagatcgtcaccaaagactcacaggtcaaagacttcagcgtcgtcaaacgacgctgggccgtcgagcgcagcctcggctggctcaggcgccactgcggcctcgcccgcgtctacgagaccctgcccggcagctccgaacccctgatcaccttcgccatgatcgacaatctcgcctgccggctcacggacgaacacacctcaatctggcgacccccaatcgcagaacacgcaaaatgcgttaatcagacatttcctcggtgttga

SEQ ID NO: 7630 - DNA, 930 bp, Actinoplanes utahensis
atgaacgccgccatgccgccccgacagtttcctgaaggggaaactcccgaacggggaagcagcctactttccatctcccaccgcctacgcgtgcgcgactacaccatcgcgaacctgctcgacgagcacagcaccctgaccaccgaccagctcgccaccatcctgttcgaccaccccaccacctgccggcaccggctgcacgccctgcgccggctccgcttcgtcgaccgcttcatccgcaaccgacccggcgcacccaaccccgcctgctgggtacccggaccgctgtccgcgcggtatgtggcgctcgcccgcggcgacaacccgccaaccgcccgggcgctgcgcgaccggcaggaccgggcgtatgccagcccgtatctggatcatttgctcgaagccaaccagttcttcgtcgacctgctcgccgaggcccgccgccggcccggcgaagccgacctggtccgctggtggtccgaacggacgacggcggccgcgttcggccggcgggtgcaccccgacgggcacggcgtgtggcgggacccggcaggggagaccggcttcttcctcgaactcgaccgcggcaccgaatccctgacccggctcgtcgacaaactgggcgcctaccggcgcctgcaggccgacgggggacccgggtatccggtgctgttcgccctcccgagccgcgcccgcgaagaacacctgcacgccaaactcatggtcaccggagtcaccgtggccacctgcgtgctcggggccggacagaacccggccgagccggtgtggtggctggccggatcggtagggcgccgggtagcgctgacggaaatccccggaggccacggacccctcgggccgctgagccctggtcccgccgccccggatcaccatccgctggccctgctgaccggcgtgccgctgctgccttga

SEQ ID NO: 7631 - DNA, 2283 bp, Actinoplanes utahensis
gtgcaccggcgacctcgacctcgaagaaggccaaccgtgatcgccattgttgttgggctgtccgccctgctcaccgtcgtgtcgggtgctgtcctgctggtgtggggtgaacaccgcggccgccgcaccgcgaccggcggccggcaggtgctgatcagcccaccaccccaggtcgatgcggccggtgcggtggtcttctgggccaccctcgccgctgtcctgcagaccggctggcggcaacggctgcgtcttggccggctgtggacggcctacgaataccggtgggacggccgccggctacgcatcgccgtatggctgccgcgcgcggtcgccgtcgaaccggtactggccgccgtccgcggcgcctggccgggtgccgcctgccgggtcggcgacgccgaaccgcccctgccgccgcagccggcggcggccgccggagcttcgctggcaccggtgctgcccggctggtatccgctgcgcaccgaccaccgcgacgacccactgcgcaccctgatcagcgcggccgccgggctgcgcaccggcgagcaagcctgcgtgcaggtcctggctcggcccgccgccgggcggtcccggcgcaggctgattgccggcgtacgggcactgcggggcgccccggccgcgcgcagcctgctggacccggccggctgggcgctcgcggccctcgatctcgtcgccggtgggcagccccgtccggtcgggcggcctgccgtgtccgctgatccccaacgggagcgtgacgcccgcgccgcccttgaccaactggccggcccgcactgggaagtggcggtacgctacgcggtcacctcgacccgtgacgacccggcccgcatgcgggtcctcgcccgagccgtcgcgaccgcgttcggaccgttcaccggccgcaaccggatgcgtgcccgccggctacgccaagccgtcaccctggtcaccgggcgccggctccggcacgggttcgtgctcacccccgtcgagctggccatgctggccggactgccccgcgacatcgccgtacccggactcgatcgcgcccgagccaaagcgatgccggcaccggtcggcatcgccaccggcgggcgcgccaccaaaagcctcggccgcgccgaagtcggcgggcacgccgtcgcgctacgcgccgctgacgccaggcatcatctgcacgtgctcgggtcgaccggctccggcaagagcaccctgctgctcaacctgatcctcgacgacattcacgccggccgcggcaccgtcgtcatcgaccccaagggcgacctggtcaccgatctgctcgaccggatcccgctgacctgcgcgcgccgcctggtgctcctcgaccccgaccagcccggcggaccgacgctgaacccgctcgaaggcgatgaccacgacctggtcgtcgacaacgtggtcagcatcttcggtcggatcttcgccaaacactgggggccgcgcatcgacgacaccctgcgcgtggcctgcctgaccctgctccgcaaacccggcgccaccctcacccaggtccccgaactactcaacgaacgcgaattccgccgcaaattcacccaggatctcaacgatccggccgggctcggcggctactggagctggtacgagaccagccccgcccagctgcgctccaccgtcatcgcccccgtcctggcccggctgcggtccctgctgctgcgcgacttcgtgcgcaccaccttcggatcgccgcgctccagcttcgacatgcgccgcatcctcgacggcggcatcctgctcgcccgcctcccgaaaggtcagatcggtgaggaaaccgcgcgtgtcatgggctccttcgttctggccagcgcctggcaggcggcaaccgcccgcgccaaaatcccccaagaaaagcgccgcgacgccgccgtctacatcgacgaagcccacaattttctcaacctgcccggctcgatcggcgacatgctcgccgaagcccggggctacggactcggcctgaccctcgcccaccagaacctggcgcagatgccccgcgaaacccagctggcgatctccgccaacgcccgcaacaaagtgttcttctcctgcgcccccgaagacgccgcccaactggccaaacacaccctgcccgaactcgacgagcacgacctggcccacctcgacgcctacaccgccgcctgccggctcgtcgtcgacggccgggaaaccccggccttcaccctgcgcagccccgccccgcgaccgccgctgggcaccgcccagaagctgcgggaggcgctggcctga

SEQ ID NO: 7632 - DNA, 1962 bp, Actinoplanes utahensis
gtggcgcacggtcacggtcgcgcacccggccgcccaaccggggcaggcgctgcggcacgccgaacacaccgccagtgtgctggccaccctcggggcgagcaccgcggtcctcgacggtggcgccgcgctggcggtgctgacctgcgcggcggacccgtacacgccggccgacaccggctggtcgcgggccctgccgcagcagccgatcacccgcggcggtgcggcatgaaccgcgacatgcaggtgcccgggccggccgtcacgcacgcccatcccgaccacgtgcaggtcgccgacggatacacggcgacgctgatcgtcaccggctacccggccgaggtcggcccggcctggctcgacccgctgctgtcctggcccggccgcctcgacgtggttctgtacgtcgatccactgtcggcgccggcggccgcatcccggctgcgccggcagcgggcccggctggaatcgagccggctgcacgacgccggccgcggccgggtcagtgacccgctgaccgacgcggccgccgacgacgccgccgacctggccgagcgggtcgcccgtggcgagtccaaactgttccgggtcggcctgtacctgtgcgtgaccgcacccagcccgcaggaactacgggaagcggtcgcgcacgtgcgggccaccgccgcctccgtgctgctggacacccaaccggcgacgtggcggcagctggaaggctggcagagcggactgccgctggccaccgacaccctgcacgcccggcggattatggacaccggggcgctggccgccgctttccccctcgcgggcgcggacctgccggccccactgccgggccggccgggacccgccggcggcatcctgtacgggcttaaccgggcctcgcacggcgtcgtctggtgggaccgctggtcagaacagaacgccaacggggtggtgctggcccgcagcggcagcggcaagtcgtacttcgtcaaactcgaggtgctgcggtcgctggccgacggcgtgcacgtcgccgtcatcgacccggagaacgaatacctgcgcctgaccgaagccgtcggcggcgccccgatcgtcctcggcaccggcggcgtgcgcctcaacccgctcgacatccccgccgatgatcgacgcgaccaggcccgcacccggcgcgccctgttcctgcacaccctgatcgccgtactgctcggcgaacaaccaccgccggccgagcgggccgccctggaccgggccgtcgtcgacgcctacgacaaagccggcatcaccagcgacccgaccacctggcggcggccggcgccgctgctgcgcgacgtggccggggcgctgctcaaccagaacaccacggccggggagaacctggcggcccggctcatgccgtggactcacggctccttccgggacctgttcgacggaccgaccaccaccgtgcccaccggccagctggtgtgctggtcgacccgggccctggccgacgaactgcgccccgccgggatgctcctcgcgctggacgcgatctggcgcgacgtcgacaacccggttaccgacccgacccgggcgccgcgacgccttgtcgtggtcgacgaggcgtggacgctgatgcgcgagggcgaaggcgcccgcttcctggcccggctggccaaacaggcccgcaaacgtcgcgccggactgctcgtctgctcccaggacgtcctcgacgtgctgggcagcgacctcgggcagatcgtcatcgccaacgccgccacccaggtactgctgcgccaggccccacaagccatcgacctggtcaccgacgcgttcgcactcagtgccggcgaggcccgcaccctgctgaccgcccgccgcggtgaagcgctgctgctgtccggcacccaccgtgtcggcttccacgtcgtcgcctcacccgccgaacaccggctgtgcaccggcgacctcgacctcgaagaaggccaaccgtga

SEQ ID NO: 7633 - DNA, 963 bp, Actinoplanes utahensis
atgtcggtcgggtgggcgctctccggtgttctcgggccgctgctgggcgcgctgtcggccctggtgctggccggcctggccctgacatggcggctgctgtcgacgaccgtgctggtggtgccggacgtcaccgcccttccgcaggtggacacgctgatgaccacgtcgctcggcgtcgtcgacacctgctacgtgctggccttcgtctgggtcggcgtgctggtgatgaaccgggagtggctgcagcagcagtccggcctcggggagatgattccgcggctggtcgtcgggctggtcgcggccaacagcgcgcggccgatctgtacggcggtggtggacacggcgaacgcgctgaccacggcgctggccggcgggcggggcgcgtccccggttccgcagctgcaggccgcggttttcgaggcgaccaacggcatgaccggcagcagcccggaggacttcctgatcctgatcatcggcgcgggcgtggcggtgctggcgctgatgctggtggtgcagtgggtcagccgggcagggctgctgatcctgctggccggcaccgcgccgatcgccctggcgatgcacgcgacggtgcagaccgaaccggtcgcgaagctgtggtggcgggcgatgctcgccgctccggcgaccgtggtcctgcaggcggtcgccctgcacaccaccctgcaggtgatgctggcgccgcagacggtcatcccggcactgggcctgaccggtaagccgggcgcggcgatgaacctgctggtcgtggtgtgtctgctgtggggcacgctgcggattcccgggctgatcggcaaattcgtgctgcggtccgcgccgagccggattcccggcgtgctgcggttcgcggtgctgcagcagatcaccggcctggcccgggtgcggatggggaagacccggacgatgccgccgttcggcggcggccacggccgggggcggcgatga

SEQ ID NO: 7634 - DNA, 249 bp, Actinoplanes utahensis
atggttctcgcggtgtacgagctgccgcagatcatcgccaacatccggatctgggtgatcgggatcgcggcggcggtcgccactctgtttctgactctcgccgggatccggtacatgctggccaacggggacaccggcgaggtggagcgggccaagacggcgttccggtgtgcactgatcggatacgcggtcgcggtactggcgccggtgttcctgaccgtgctcaagggcctgatcggggcgtcctga

SEQ ID NO: 7635 - DNA, 777 bp, Actinoplanes utahensis
atgggtggtcgaagctggagcgggtcgccgctggcggtggcgcagcgggcgtttgtactgctggtggcgccgccgaccccgctggtgctggatagcggcacggtggccggggtggtgccgctggatcggctgcgaggcctgctgctgagttcccggaccgggccgctgcagcgcgatgccgtgtggcgggagctggtcctgcgggccagggcggacgggccgggctgggtggtcggcgcggtgggtgtggccatgccggggctgcgccgcgcggcgggcgcactgtgcgccggccgatccggcgacagtgaggacctggacgcggagctgctggccggcttcgtggcggcgctccgccgggtggacgtggaagcgccgcggatctgtggtcgtctgatcgacgccggggtccgggcggcgcggcgggcgcgtcatgtgccgggggaacggtcgttcgggatggctggtgtgccgggcccggcggttccggcgcggccggcggatcacccggacttcgtcctggcgcgggccgtggccgcgggggtggtcgacgcggacgaggcgcatctgatcgcggcgacccggctggagggggagacgctcagtgtcgcgggggagcggctggggcttcccgcgcggctggcgtcggcgtggcgggcgcaggcggagcagcggctgcgggaggcgatccgggacggagagctggcccatatcgcgctgcgcccccggcgatcaggcgacgggcggccgaccctgacgaccaaggccgcggcctga

SEQ ID NO: 7636 - DNA, 429 bp, Actinoplanes utahensis
atgcagcgcgcagtggtgcatcaagcttcggctcgcgaactcagcgattcgttgcgcctggtcggcgcccgggagatcgcgatccggctcggtctctcccgacagcggatccaacagttggccgaccgcgatgacttcccggccccttttcaggaactcaagatgggacgggtctggtgggcgcaccaggtggaggagtggatccgggaatggcatgccggcaaactgccggagccgcccatgaaagaggagactgtcgaagatttcgcccggctgttggcggagcggacagcggaccagttggccgaacgcgctgaggtgttcctcgacgatgacctgatcgccgtgttggcgcagtggatgcgggtgtttctcgacgcgaacggcatcaccccgacacatcggcttctgaaccaacaccaccgttga

SEQ ID NO: 7637 - DNA, 687 bp, Actinoplanes utahensis
atgtccgcgagccgggcgagtttggcgcgcttctggcgcggacgggaggcgagcaatgaccgggaagaccacgtactacgcggttgcggcgcggaggcagctgcgtcaggcgcaggcgattctggacgagcatgtgacctcgagtgcgacgggccgctgcgtggcttgcggctgcctcggcccgtgtcggctgcgcgagaacgcggtggtgatcttctcgcgcaccctgcgactaccggtccgccggcccggtgcgactcgccccgaactggtcggcgccgtacgggtcggcgggccgcgcctcctcccctcccggagcgcagagccgagccggtcaagcgctgcccggccgtgtccaccgacggggttcaccttgccggtcaatctgtccgtccccacgaaaggacactcatgattacgcagagcgggctgatcgcggcgttgaccgcgattggcttggacaccgaggtgcagatcaagctcgacgggatcccgctggacatctgcgggctgagtctggacgagcgtcgcggcatcatcttcctgcgcccacatccagaggagattccggtggcgctgcgccggttcgtcgccgcggtgctcggtgcgtcgggaccgggccggcaggaggtcgcggtgcgccacaacgcgcatggccactacgagctgatcaggcacgagggatag

SEQ ID NO: 7638 - DNA, 396 bp, Actinoplanes utahensis
atgacgatcgcccgggaagccggcgagcgcggctggtcggagtcctgggccaacaagatgggaagccggcaggctctctacgccaatctggaagccggcgccgccacgatccgcgagtaccagatgactttcctgccaagcctgctgcaaaccccggcgttcagcgagcagcgcgcccagctcgacaccgccgactggtcgtcacggttcagcccggcccgcgcggtcgaagcacgcgagcgacgccagcgcatgctgcgccgtctcgatggaccgcggtacgaggtcgtcatcgaccagctggccatccggcggccggccgccaccaccgacgttcttcaggccaagtcgtgcacatcgcggacctggcgacccgggacgagaagatcaccgtga

SEQ ID NO: 7639 - DNA, 1344 bp, Actinoplanes utahensis
gtgccgagtgccgaccccgagcccaacctgctcctcatccaggctcgcgaacggcgagagtcgcccacccagcccggcgagcccatgtcccgggccgagctggccaccgaagtcagcagaatcttgttccccgacccgcgccagcggatcgccagccccttcaacgccaactacgtcggcaaacttgaaagcggtaccatcggccggccgaaccgccccgactaccgggcggcacttcgcagagtgcttcgagcctcatcggacgaagaactcggcttcgccaaccgcaaaacgtggatacctgcccggcaagccagcgtcgaggacccggttcccgcctctgcaatcgcagcggaaagcagcatgttcggagccttcgaatcgatcgaaaatccgtcagggatcatcattggtaaatcgggagactggaacagcttctccttggtcaccagcatgctggcacaacaacggcaaagcgtcgagccgattgccctattgagactggtagaggctcatcgcgagtgcctttcaacacttttccgcaatgccgggacagaccctgtacggaagactatcggccacatgctcggcgaagcatcgatagttgctagccgcctctggagcgctcacggaaaccgcaacatggcattggctcattgcgcttacgccaaacaactcgcggagcggatagacgatgtcgcgctcggggccacggcacggatatttggcagcaatcttcattctgaggcctccaccctaattggccccgacggcgatgtcatggtgggcctgcggctacttgaggaggccgccaccgtttccgaacggttgacgccggccgcacgcgctcggatcgctgcggagcaggcccagacgtatgcatcactcaggctgcaccgaccagccgaggaagccctcgatcgcgcccacgaagccgccggagacatcaccagtgaagaccgcgtcgggttgtacagtgactggaaccgcagtcgagtagaggtctacgacggcacctgccgcctactgctcggtgacccggagaaagcggttgccattctcgagcccgccatccatgaactggcgacagattcgcagaataccaacgtagtcatggcagcacaggtcgacctagccagttcctatgccgaactcggcgagcccgaaatgagctgcaaacttctcggcgaaacctatggacggctccgcgaagtcggtaaccttcgcggcataatgcgtgcacgacggtcgcgagaccgactggcccactgggaaggcaagcaagttgtccaagaactcgacgtccgcatgaagtcatgcctagctggccgagccgccggatag

SEQ ID NO: 7640 - DNA, 726 bp, Actinoplanes utahensis
gtggctcctaaagaacctgggctagtggtttgggacatcgacggaactctcattccggcggacctccgctggcttcggcgagcgatcgctcgagcctacggcctcgcggaggcagaggtccggttcccggcgaagaaggttcacgggtatacggacgagtcgatcgccatcgacactgctatcgcgtcgggcgtcactcctgcgctagctgaagcagggatcgcggacttttcaaccagcctgatgtcggtgatgaacgaaggtcgcgatgagcttcgatcggatcagccaccgtacccgggtgccgtcggcagcatcggtgaattgaacagagccggatttactcagacggtgttgaccggcaacattcggccggctaccgaggtgaagctcggtgaattgggcctagatgcctacttggacctcgatatcggcgccttcggctcggatagtagagatcgcttcaatttgcctgccgtggtggctcggcgattcgcaaacgccttcggaaggcaactcgtgccggctcggacggttatcatcggcgatgctcccaacgatatcgcctgtgcgcggcacgccggtttcaaagtgattgtcgttgcgcatcgttcgactcgtgaggaacttgcagagtatgggccggatgcaatagtggaggatcttgaaccttccactattgtcgccaccgtggaatctgtcctatccggcggctcggccagctag

SEQ ID NO: 7641 - DNA, 1005 bp, Actinoplanes utahensis
gtgcaccgacgtaactttctcgccggcgcagccgccgtcggcgccgccgcgctgccagtgctgccaccttcggcgtcggcagcagccggcgacaccattcaggacatgctgttcggacgattggccgccgaaccgctccccgcccagcaattagctgcacaaattgcggcagcccgcgctgactttcgtgccgcccgatacacccggctcgcccgccgcttgccgaggctgctcgcacaggcagccgccagccgttccgcagccggcaccggcgcagaggccgcagccgcgcaacggcttgccgaggcctacggcatcgccacccagctattgatcaagctgcatgacgacagcatggcctgcgccaccgccgatcgggccgtccaagccgccgccggaaactgcccactgatcatggctgatagtcagcgactggccgccaccgtcctgcgccgggccgggcaccgcgacagcgcccagcaactggttctctcggccgcacgccaactgtacgacgtcggggaatcagggcctgccgcccaagcgatgtacggacagctgctcgcggtcgccgcctacaccgcggccatgcgcgatgaccgtgacgcggcttgggcgctgctagaacaggcccaagagccagcaaacgcggccggggccacagctcgcttcaacggcaacgaaatcgcggtctaccggatcagcatcgctcggaccctcggcgactacggtgccgccgtcgactacgcccgcaaagtcaatctcaaggccattgtcgcccccgagcgccgggcaaggtactgggaagacaccgcgctcgcctcgcaaggccgaaggcggcccggtgccgcattcgaagcgctgctggccgccgaacacgacgtacccgaagaggtgcgataccggccgtgggcgcaaaacctcacccgggaactgctgtcatctccggcagcctacggtctgaccggggtgcgggaatacgccgccagaatcggcgtcgtttga

SEQ ID NO: 7642 - DNA, 633 bp, Actinoplanes utahensis
atgaagttcgcagtgctcggcgccggcaacgtcggatccgccctcgccgcccgcctcaccgcgctgggccaccacgtcacgctcgccgccagcgatcccggatcgtcgcggctggccgccgccgcggcggcctccggcgcggacaccgccaccgccgccgacgccgccgcggcggccgatctggccgtgatcgccgtgccgtactccgcggtcggcgacctgttcaccgacgaggtccgcgccgcgctcgccggcaaggtcgtgatcgacgcgacgaacccgctcgccgccgacttcatgtccctcaccgtcggccacaccacctccgccggtgagcagatcgccgcccggctgcctcagtcccgcgtcgtcaaggccttcaacaccgtcttcgccgcgaccctgggcaccccgaccctgggcggctcggcgcagctgctgcccgtcgccggtgacgacgcggacgccaagaacaccgtgatcggcctcggcaatcagctcggcttcgacgcgatcgacgccggcccgctgaccaacgcccgctatctggagccgaccgtcgaactgctcatccagctcgcctacggccaggggctgggcgcgaacatcggcctgcacctggcccgcggctga

SEQ ID NO: 7643 - DNA, 489 bp, Actinoplanes utahensis
atgacgcagcgatggctcgacgagatcgagatgcaggcctgggtggccttcctggacaccagcaacctgctgcaacgacgtatcgaccagcagctgcgtgaggacggcgggctcacccagccgcagtacgagctgctcacccgtctcgccgaggcaccgcagcaacgcatgcggatggcggaactcgccctcgccctggtcacctcccgcagtgggctcacctaccaggtcagccagctacagaaggccggactggtccgccgcgaagcctgcgccggggatgaccgcggcgtctacgcggtcctcaccgagcagggcagccaggcattgcatcgggccgcccccggccacctgcgcgtggtccgcgagaatctgatcgacctgctcgaccgcgaccaactggtcaccctcgccgacaccctcagccgcgcacgcgcccatctccgcatgaccgaggacgacgaaccccgccgcaacggctcgagctga

SEQ ID NO: 7644 - DNA, 999 bp, Actinoplanes utahensis
atggttcaccgcgtctccggcgagaccttccaacgggtcgtcgactctgcactcgacgacgaacacggggtgttcgtccacggcctgtccgacaaggtccccacctccctcgtgctttttgctcatggcctcaacggacatcgctacaagacctgggagaacttcccggaatttctactgcaggcgcgcaccgatctggacgtcggattgtacgggtacaccagtgggatcaaacgctatgcacgacgcgacatggttgatctgggtgcacaggcacagcatttcgccagtcagctgagaatgctcgaatatcaccgcatcgtcctggtcggccacagcatgggtggcctgttgtgcatgggcgcggtgcgggagctgctcgaggaccgcctcaccggtgacgacccgcagccggccatcgaccgcatcagcggcctcttcctgctggccacgccgctggccggatcgctgcgggtgcgatggccgttgagctggaccgtcgacggaaaggtgctgcgcgcgcactccgactatgtgggcggcctgcaccgaacattcgccgaccgggtcgaaatgaacggccgcccgccaagcgaccaccacaagatctggttaccgacgttcagcgcttccgccaccctggaccgattggtcgacaaaatgagctcccgcctcggtgtgcctgcatcacagtgcacatacgtgcgaggcagccacacgtcgattgtcaagccgcgatcaccggggagtgacatcttcacgtggttctgcagcaaacttgaccgctgccttgtggatccggagggtggtcccccaccattgggacttagggtacccacacaacgtgagggtggtcaggttcccggcggcaccgctcccaaaatccatatcaacatcaccccggatcagatgcccgaggtcgtccgcaccatcgcagccttgcgcctcgaagaggagacgtccatcgacatcaacatcctgccccgtgaaggtgattga

SEQ ID NO: 7645 - DNA, 2955 bp, Actinoplanes utahensis
atgatggtgcccccactgccgcccccgccatcctcctggatcgatccacgacgccggatggtcgatttccgaaaacgacgagaattcctggacctggtgacctggtgcaccgaggagccgggcatcgagccgcgggtgcgacttctcgccggcccagcgggaaccggcaagacccgcacagcactggagctccagcaggagctgcagccccatggctggatcgtgcatctgctggaggaaccgtacgaggcgatcgaggtcgtcggccagtccatcggccagtgcaccaagccttgcctgatcatcgtcgacaatgcggaccgctcacccagcagcatccgccgggtgatggaggcgctctccgagcagggggacacgcctctgcggatactgctgatcgcacgcagcgcagccgtctggtgggaacacctgaccgtgcgcggacccggggcggaactgctggatccccacccgatctggttcaggcacctgaccgccgagtatgcgacggaaatggcccgggccgctttcagcgccgtcactgccggattgggccgggaggtcgccgtcgagcgggcaccgacgcccgtcgcgctcgaccggtcgacatcgatgcttcacgcccagaccagcggagtggtagcagccctggggcccactcgcacgcccggccccgcagaactcctgcgcctagcggatccgatcgatgcgctcctcacgctggaacggcggcatctgaccaagagcgctgctgtacgtcatgtcaccttgcccgacgatcctgcagccgtcgacctgctccttctcgtcgcctggctcacaccgcgccgcgacaccgatctggccgtcacgctgccgtaccgcatcgagaacagccttctccacgtagacggtctcgcccggctactcgccgagctgtaccccgacgcggggccgagatcgcacgacttcgagccctccctgctgcgggaacgtcttctcgaagacctgctgctcacctccccccacccgcacaccctgcagtggatcatgcaaactctcgcgcgtgaccgccggcacgcctcggcacgggcggtcaccctgctgagcagtctgctgctgcaccaggagacggcgccgccagcccggttcatcgccgacatgggcgaactgatccgcgccgatcccgaccgggtggtagcagccgccgtggaggtcgccgtcgcgaaccccaagacctcgcggatacgcgagcacatcacgctgctgctgcgttcctgcccggtgcacagcttgctagcgttggacagcaccatcgacagcttggcccgcacccacccgccggccgcgatgaccgtcgtacagcagctcacgaacgcctgggagaccacgggcatcggaagcgaaccctccgatcggccgagagccgtgcggctgttgaaccgcatcggcatcgggctctctgaggcgggacaggtcgcggacgccctggcctcagcacgcatggccgcaacgctggtgaccgacatgcagatgaccaacgaacaagatcatctcctggtcgccgacaccttcaagttgctcagctatcgcctgtcggagatgctgctcggcaaggaagccttggccgccagcgagcgcgccttggcgacgttcgacccgctacaggacgaggcgctggaatacgcccatctcgtgaagcgggtggagatcgagcgctcacacggcatgcgtctgctcaacctcggccgtcacgaagacgccctgcaatggtgccaagccgccgtgcgccgggccgagggcatcaccggtcggcatccgatcgatcgatcgcggcacgagctggcagcagcgatgacagatctgtccgtggccctgtcggagaacggagcgtacgccgatggctatctgatggcgctacaggcggtatcgattcgccggacgctgaccacccggaatcccaacgccttcctccccgaccatgcgatcgcgttgagcaacctggggctgagactgtcggagatgggcaacctgaggcaggcgctggccaccacggaggaagccgtgtcggcgtggcgacgcctggcgaccctgcaaccggaaacgttcgagccggaactagccgccgccctcaacagtttgagtctgcggctggcggaaaacggtgacgagaccggtgccgaggacgccgcccgtgaggccgaacgcatctggcgccgggtggcgcacaacgctccgacctaccgtccctacctggcggtgtcgctgtccacgctggccgcccgccaacgcgctcaaggggattccggtggggcgtacaccacgctggaagaagcgatccagatctggcgctccgccggtgacaagcaagccccacgtttcactcgccgactcgcagccgcgctgcagaacgccagcatctacctttccgaatcgggcgatccggagaaggcgttcgcatccgcacgcgaatcggtgcgcatctgggagagcgcggcgaaccagtcccgcgtccaccgagcgggcctggcgtcagccatggtgacgtacagcatgcgcgccgccgaactcgggcaccaggaggaagcggtcgacacgatcacccgtgcagtgcgcatctggtcggtgctcgccgatcgcatccccgcgcatcgcggtgactacgccaccgcgctgcacaacttggccattcagatggcccaggtgggacgtaccgacgacgccatttccgcggccgaggaggcagtcgagatcttccagcaattggccgggcagtatgcagaggtgtacaacctcaaactgtcctcggcgcgggtgctctgcggtgcactgctggccaccgtggaccctgatcgcgcggaacaggagatctccgaagcccatcacctggtggagggcatcagtgccagacgggcccggcagaatccgcgcaagctgcaatcgatcaggcaggtggtacagcagttggccgggtag

SEQ ID NO: 7646 - DNA, 411 bp, Actinoplanes utahensis
atgctggccatcgtctgggagtcgtcgtttctggacaggctgcgccggcaacagcgactgacccggcgcgaggatccgcacaccggtgtacggttctggaccaaacctcgcgtccgtctctggaccatcaccgtcgtatcgaccgcagtgctcgaactcggactcatcgccctggtgctggcgaatgtggtaccggacgccctggccgcccgcgtcgtggtgttggtgggcctggccgtcgtgctggcgacgatcctgacccgtgccgttgtcgacatcatgggggcaacccgacacgctgcaccggctctctccgtgcagcgcgataccgctggacacggccagggcatgacgtccgcgaaagacgaatcaagccgtcgccgagatcgcgctgagaggacgtctgattaa

SEQ ID NO: 7647 - DNA, 144 bp, Actinoplanes utahensis
ttgcgcgtcgggcacgtggctcgatgccggtcgcgactacgaagccgcccggagaactccgccagcatgatcaccctcgcggtgatcgccaacgtcgccgaacgcctcaccgccgaaatctccccaacctggcgatacggctaa

SEQ ID NO: 7648 - DNA, 1170 bp, Actinoplanes utahensis
atgccgggtaagcagctctccaggaggatagttctgtcagcgatccactctctccgcaccgcgatccaccggcgaagccgctcggcaacgaagcggctcaggcaagcagcggtgccggcgggcgaggcggtcctggccgccacgctggcctggttcgtcgccgggcatctcgtcggccatcccacgccggtcttcgcgccgtcggccgcactggtcgtgctcgccgaggcccgcgggcgccggctgcgccaaagcatcgagatcgtgctcggcgtcgccgccggagtgctggtcgccgatctgagtgtccaggtcctcgggccgggaacggccacgatcgccgtcgttctcctgctgacggtcggtccgatgatcgccctgggggccagcaccaccctgatcatgcaggcggccatctcggcgatctacctggtcgcggtggccgaaccccgcatcgacgtgatgcagtggcgctgcctcgacgcgctgatcggtggcacgctcgccctggcggtcagccaactggccgtcgctcgcaatcccctcgctccgttggtgcgcgaggcccagcagaccttcaccggcctggccgatctcctcgaaaccgtcgatgcggcgctgcgcgagggcgaccgtgccgccgcggacgacgccttgcgtcgggcccgggcggcccgcaccagagtggagcggttggggatcgaggtgctggccgcggcggaggcggtgaagctgcgggtgggccggcgccggtatgtgcaccaggtaggacaggtggaggcgaccgccgcggaactggaccgcgtcgtggacaacatctgggttctggcgcgcaacgccgtcacgctgatccggctggacgtcccggcgccaaccgagctcagccgggcgttcggggcactggccgccgccatccgggccgcgggggaggccctggccaccgacctgaccggcaccgacgatccgcagcagcacgccagccgtgcggatcacaccgcgctggaggcggtacggatcgccgccaaactcctggagtccgagccggccctgccgctgaccatgatcatcggccagatccgggccaccgcgatcgacctgctgcgcggggtcggccacgacgacgagatcctcgatcgcgtcgacgaggccgtcggactcaccgcgccctga

SEQ ID NO: 7649 - DNA, 420 bp, Actinoplanes utahensis
gtggccgcagcctctcgtcattcccgtcgcactcgactggcccttgtcccccttgccgcattggcagccgcgacagcagcggcgacgctggcccctacccccgcggccgcggccgtcaagaactcctgcacgatcagcggctgcacggccgccgaaaacgcctacgagggctggtcggagcttggctggccgatcagtcggggctggtactcatggtcaagcggaaagtgcagctacgccggcggggagtactacaacaacaacgggcagttgccgtacggtgacaccttctgggaatacgacgtctacccgcgcaactgcggggcgcaccgcgacgcgtaccggatcgtggtcgacggcgacaccgggcaggcctggtactcccccgaccactacagcgacttccacgaattccggtag

SEQ ID NO: 7650 - DNA, 1065 bp, Actinoplanes utahensis
gtgaactcactcaactcctggctgctcctgctgatcttcgtggcctgcgccgcggcgatctgggtctccgggatcaaactgtccaacgccaccgacgtactgtccgaacgcctgcacctgggcaccgcactcggcggagtcatcctcctcgcgatcgcgaccaacctgccggaactcgcgatcaccgccagcgccgccctctcgcaccaactcgacgtcgccgtcggcaacatcctcggcggcatcgccctgcagaccgtcgtgctggtcatcctggacgccgccggcgtccggccccgcaaaccgctgacctacctcgccgcctccctgaccctgctgctggaaggcgccctggtggtggcgctgctgctggtcgtggtcatgtccacccagttgccgccctcgttgatcgcgttccggctcacccccggtgccgtcctcatcgccgtcctgtggggattcggactgctgttgctgcgccgcgcaggcaaggggctgccctggcacgagggcggcgacgcacccgacacccaggaaggccctcaaggccactccaaaaccaccaaggagaaccaggccagcgccaagggcgtcagtaccggccgcgccgcgacggttttcggcatcgcggcggcgatcaccctggttgccggtgtgttcatcgaacgcagcggcgaagaactgttcggccgcctcggcatgtccggcgtcctgttcggcgccaccgtcctggccgccgccaccgctctgcccgaggtgtccaccgggctcacctcgacccggatgggcgactaccagctcgccatcagtgacatcttcggcggcaacgcgttcctgcccgtgctgttcctgctcgccaccgtgctgtccggccaggccgtactgccgcgcgcccatcacagcgacatctacctgaccgccctcggcggcctgctcaccgtcgtgtacatggtcggcctggtcttccggccccagcgccaacgactgcgcatgggcgccgactccctcaccgtcctgatcctgtacgccctcggcatcgccgggctggcgttcatcaccggctga

SEQ ID NO: 7651 - DNA, 549 bp, Actinoplanes utahensis
gtggagggacgctcgcgatcggatgaggtggacgccgacctggtcgaggcgttcctgaccgccagccgagccctggtcggggtggcggtgcggtccttgaacgccggtgacggggaggtcacgctgccgcagcaccgcgccctggtgttgctcgccgcgcacggcccgcagcgcatggccgacctggccgccctgctgggggtgaacagttccaccgcgacccggcaatgcgaccggctgcaacgccacggtctgatccggcgcaagccctcaccgcaagaccgccgcgccgtgtgcgtgtcgctgaccgaggccggccaggaactggtccggcaggtcaccgcggcccgccgcgcccagatcagcgccatcctgcagaacatgcccctgcgaaaccgcaaagacctggtcgcagcgctgctcgggttcgccgcagcggccggcgaagtcccggaccagaactggtcactgggctggggcaccgacaccgcccccgaccgaccgagccccgcagcccctgtcccacccacccgaggaaccgtgaagtga

SEQ ID NO: 7652 - DNA, 360 bp, Actinoplanes utahensis
atgggtaaggtcctcgtggtcgacgacgagccggatctacggtttctgcatcgacggatcctgagccgggccggccacgaggtgaccgaggcgggtgacggtgcgtccgcgctggaggccgttcggacatccccacccgatctggtggtcaccgacatgatgatgccggtgatgggcggggtcgagttcattcgtcgcttgcgggctgatccggcgacggcgacgatccccgtcctggcagtcagcggcgactggcagctggcaaccgaagccgacgccgcactggccaaaccatgccacagccaggacctgctcgcagcagccgaggacctgctacggaaaggatgtggtgggaggtga

SEQ ID NO: 7653 - DNA, 1521 bp, Actinoplanes utahensis
atgccacagccaggacctgctcgcagcagccgaggacctgctacggaaaggatgtggtgggaggtgacgcgcctgtcgaccggacaagcggacctggacctggtgctcggtggcggcttcgaacgcggatcgatggtcgtcctgtccgggccaccgggagcgggcaagaccatcctggcgcagcagatctgcttcgccgccgccaacgccgatcacaaggccgtctactacacgacgtggtcggaaccgcactccaaactcgtcgagcatctgcgcgagttcacgttcttcgccccggaacggctgggtccgcaggtggagtacgtgcatctggggaacctgctgcgcgacagcgccggcaacgacctcagccccatgatcgacgaggtgatccgcaaagccttcgacgaccggcccgcggtggtggccatcgacagcaccaagatgctgcgcgacttcgtctccgaacacgacatgcggatgtcgctctacgacctgggcagcaaggtcgcacacagcggagcagtgctattgctgctgggcgagtacacctccgaggaggaacagaccggcgccgagttcaccctggccgacgcgatcatgcaactgtcctatcgcccccgcgaaccggtcgaccggcgcgggctacgggtggtcaagatgcgcggcaccggccatctgcaaggcacccacaccgtgcacatcacccgtgacggactgcgggtgtatccgaggatcgagtcgatgctgcccgaggaggtcgcaccgcagcaggaacggatatcgaccgggatcagcggcctcgacgcactcctgggcggcggagtaccgcgtggtgacgccactctggtgttcggaccttcgggtgtcggcaagacgatcggctcgttgcacttcgtcgccgacggactggcccgcgacgaacggtgcctctacatcagcttccaggacactgctgaagaattgatcggcatcgccgaccggctcgggtgggacttcaccgctgcgcgtgaggcaggaaagctgacgatctcgcacgtaccggtcggcaacctcgacctggacggactctcctcggtcgcccgtcaccagctggccgaggccggcaccacccggatcgtgatcgacagcctggccgagatggccttcaccgcgcgcgaggccgaacggttccccgcgtaccttcgcagcctcctcggcctcatccgcaccgccggagcctcgctctgggtcaccagtgaaacccgaaccatcggccccatggaggaacccctggccggcctcatgttcctgttccacaacgtgatccagatccgctacatcgagctctgctccgagatcggccgcgcggtcaacatcctcaagatgcgcaacagcggccatgacagcgctctccacacctaccacgtcaccgacaccggggccgccgtcggcgacaagatcgaaaacgtcaccggtctgctcggctggagcgccctgcgccactgcccgcccacgtcgcccagggacgacgggaactga

SEQ ID NO: 7654 - DNA, 678 bp, Actinoplanes utahensis
atgacggacaccggaaccccgaagccggccgggaaccgctgggggcgctacgcactctcagcggctgtcctggtcctcagcctcaccggcgttacggctctggtcaaaggcggtcaggaccaaccgcgccggattcccctcgccgccgccgcgtcagctcccgagaccgcgctcccggctgccggcaatggtgagctgaccagcggtccgctgatgagcacgtcgaaaccgacccgggtggtcatccccgccctcgacgtcgacgtgccgctgaccggcctcggtcggcaggccgacggcaccatgcaggtgcccaccgacgccagaaccgtcggctggtacaccggggcgcccaccccgggctcactcggcccggccgtgctcgccggtcacgtcgactaccggaaacagcccggcactttccaccggcttaccgacctcaagcccggcgactccatcgacgtcgaccgcgaagacggcagcgtggcgatgttcgccgttgtcaaggtcgagcgttacgccaaagccgaatttcctaccgatgcggtgtacggcgcgatcaaccgcgccggcctgcgcctgatcacctgcggcggcgacttcgacagcaccgccgggcactacgaggacaacatcgtcgtctacgccgacctcaccatggctcatccggccggatag

SEQ ID NO: 7655 - DNA, 780 bp, Actinoplanes utahensis
gtgaaacttccccgcgccctgctcgctgtgcccgcagcggcagtggtcctcctcgccgtcccgagcgccgctttcgccgatgagagcgtccacgtcaagctcgatcccctgaaccactccggcgcctccggcaccgccatcctgaccgccatggccgacggcgacctgaagatcagcatccggtcgatcggtctggtcccgaactcgccgcacgcgcagcacctgcacggctccaccgagggcatggacttccactgcccggacatgtccgccgactccgacggcaacggctatgtcagcaccgaggagggcatgccggactacggcaacatcttcatctcgctgaccaccaagggggacaccagccccaagagcggcctggccgtcgatcggatgccggtcgccgacgccaagggcaacctgtcctacgaccgcacgatcccggccgctgacctgcctgcgggcacgatcgaacacctcaaagacctccacgtcgtcgagcacgggatcgacgcgaacaggaacggcaagtacgacatggacggcctcggtgaatccacgctcgccaagtcggccggtctcagcggcatcccggaagaggcgaccgaccccgccgtgtgcggcatggtctccggcgcggcggtcggctcggttccggtcggcggcgtcgccaccggtgacggcagcacccgccatgactccatcccgctgtacgcgctcggcggcatcgccctgttcggcgccgccggcgccctcgtcgcccgccgccgcctgagctga

SEQ ID NO: 7656 - DNA, 1629 bp, Actinoplanes utahensis
gtgggaccggaagaggacggcgctgccgggcagcaggccggcgacctggtggtggccgaccggtaccgccttctcgccctggccgggtcggggggaatgggacgggtgtggcgggcccacgacgacctgctggaccgagaggttgcggtcaaggaggtcttggcgccggccgccctgccgtacatggatcggaccgagatcctgcgcaacaccgtccgcgaggcacgggccgctgcccgtctcgatcatcccaacgtcattcgggtcttcgacgtggtccgcgcggccggccggtcctggatcgtcatggaatacgtgccgtcccgctcactgcacgacatcgtgacccgcgacggcccgctgacccaccggcacgcggcgcggatcggggcgaccctgttggacgcgctggacgccgcgcaccgcgccggcgtgctgcatctcgacgtcaaaccgcacaacgtgctgatcgccgaggacggccgcgtcgtgctcaccgacttcggcctggccaccatcgtcgccgtcccggccggtcgggccgagccgctgctgggctcgccgcactacatcgccccggaacggctacgcgacggtgtctccagccgggaggcggacctgtggtcgctgggcgccaccctgtacatggcggtggagggccgagcgccgtacgcccggccgcaggtcgccgagtcgctggcggccctgctccaccaacctcctgatccgccgcagcacccggggcccctgcacaccgtcatcgccggcctgctcaccgccgatccgaagcgacggctgaccgcaggcgacgcccgcccggctttgcgggacctgacccgccgggccgtcggtgtccacgccgtgccggcaccgcgccgcccggccgacagcgacgtccgattccgcgcggccgccgcgccggcagtcgccgccctgatcgcggaacctgtggcgaagccggcgccggcccgctggcggggtctgctcgtcgccggcatcgccacggccgccgtgattctggtggccgccgtggcggtccggatctacggcggtggcaccgggaccccgcccgcggcagccgccgtcgccagcccgatggacgcctgctccacagcgcagtcgtctccggtgacgggttccggcgaggacgcgccggtctcgctgccggacggttggctctggcacgtcgacgccgatggcttcgctctcgcggtgccgcgcggctggcatcgcggtgccgccggcggtgacgtgtgcttcagggatgccgatggtgaccggtcgttcaccgtgcagtccgccggcccgctcaacggccgaccgctgcaacgatggcaagacgcggagcgcaaagccccgcccgggtatcgcagagtcagcatgggaccgcttctgatcactgggggaggcgccgactgggagtattcctggcagccggcgaccggtccgcgcctgcacacctatcggatgctgctggccgccggcgacgaccgttcgtacgcgctgacctggaccacccgggacgccgactgggatcttgaccgatccatcctgcgcaccctcactgacggcttccgcgactcggcgcgaccggcagtcacctggacgatccccggcccacgccactga

SEQ ID NO: 7657 - DNA, 693 bp, Actinoplanes utahensis
atgttcgacatcaatcgtcgccgatccgggcgggctggacgggcacggcgctgggctgttcccgtcgccgctgccgcggtgatcctggctgccggaggcggtctcgtcgccaaggccgccagcgccgccgaggccggcgggcgcgggccggacgagttcggcatgaccatgggcagccacgccggccactcgtcgggcttcacctaccaccacggcttctactgcgacacccacatcgccgcggcctcgaccaccggctgcgaggccggcgtcgcggccgaggtggcgccggccaggcacttcgatccgctgttcatcacggtgccgctgggcttcaccgtcaaggggctggactgcccggacaagctcacctgtgtcgatcacccgatgagcctggacatgacccggctggcgccggcgctcgatccggtctacaaggcgactccggagaagctgatgccggcgttgagagacttcaccacgccgggccatgaccacttcatcggcaccaggaacggcggcaaggccgagtggtgggacgtccgcgtggtcggcgtgaccgaccccgccacctaccgcgccatccggaagcaccagagctggacctacctcgacggccagatcaaggcgaagaacaagcacttggtcggcccgatcccgaccaacatgttcctgttcttcgccgcccactga

SEQ ID NO: 7658 - DNA, 1503 bp, Actinoplanes utahensis
atgcggcgcaccctgctcggcgcgatcagcgggatcgtcgcggcgggctccggggtcgcggtcgcggaacttctggcggccgcgacccggcccggggccgggccgttggtcgcggtcggtggagcggtcatcgacgcgacgcccacgccatggaaagaattcgccgtacgggaactgggcaccaacgacaagccggtgctgcttgccgtgatcggcgtcgtcctggccggcctggcgctggccaccggcatcgcggcgacgaggtggcgggccgcgatcccggtcggcaccgctctgctcggcgcggtcggggcggccgcggcactgtcccggccgacagcgaccctgccggacgcggtcccggcggtcgtcggggcggcggtggccggcgtgctgctgtggtggctcctgcgcaagccacggccggtggacaccggcgtacgggaaaatggtgtcgatcgtcggttggttcttcgcctgtcgctgcttgcggcgggtgccagcgtcgtggagggctccgctctggccgtttccggtcagcggcagaatgcggccgggcagtcccgggaggcccttcggcttcccgccgcggccgacccggcgaagccgctgccgggtgggatcggccgcgacttcacgacggggaacaccgcgttctaccgcgtcgacaccgcactgaccgtgccgcgcatcgacccgtcgacgtggtcgctgcggatccacgggatggtcgaccgggagatcgagatgtccttcgccgagttgctgcgacggccgctgatcgagcgcgacatcaccctcaactgcgtgtccaacgaggtcggcgggccctacatcgggaccgcccggtggctcggcgtgccgcttgcggccctgctgcgcgaagccggcgtgcagagcggcgcggaccagatcgtggcccgctccgacgaggggatgacgatcggcacaccggtggccacggccctggacgggcgcgacaccatgctcgccgtcggcatgaacggggaaccgctgccgctcgaacacggcttcccggtacggatgcttacccccgggctgtacggctacgcgggcgcctgcaagtgggtgaccgagatcgagctgaccactttcgatcggttcgacgcgtactgggtcaaacgcggctggggcgtgcagggcaccgtgaagacggcgtcgcggatcgacaagccgaagccgttcgcgcggatgacggccgggccggtcaccgtggccggcgtcgcctgggcgcagcgccgcggtatcgccgccgtcgaggtcagcgtcgacggaggcccctggcagcccgccgaactgctcccgaccgcctcgatcgacacgtgggtgcagtggcggttcacctggaaggcgaccccgggaccgcactcgctcgcggtgcgcgccaccgacagcaagggcgcggtgcaaccgcaggatcgggctacgccgtttccggacggcgcgaccggctggcacaccatcagcgtcaccgtgagctga

SEQ ID NO: 7659 - DNA, 645 bp, Actinoplanes utahensis
atgcgcgcaacgaagttcactgccctggccgccacgacggtcttcgcgatctccctggccgcgtgcggcagtaactccgatgacagcagcggagacaccgcagcggcggcgccgatggcgaccaccgcgccgaccagcgtggccccgagcatggggaccagcatggttaacttcggtccgggctgcgcggcggtgccgaccgacccggcgaacgcgggcagcttcgaggcgatgggcaaggtgccggtggccaccgcggcctccggcaacccgctgctgtcgaccctggtcgccgcggtgaagaaagccggcctggtggactcgctgaactcggccgacggcatcaccgtcttcgcgccgaccaacgacgccttcgccaagattccgaaggcgaccctggacaaggtcctcgccgacaagaagacgctgaccagcatcctcacctaccacgtcgtgagcggcaagctcaccccggccgacctcgccggcccccacaagacgctgcagggacaggacctgaccgtcgcgggcagcggcgagagcttcaccgtcggcaccggtaaggcgtcggtgatctgcggcaacgtgcagacggccaacgccaacgtctacatcgtcgactccgtcctgatgccgaagagctga

SEQ ID NO: 7660 - DNA, 459 bp, Actinoplanes utahensis
atgaagaaatctcttcgcgtagctaccacgctgggcgccatggcgctcggtctgggcgtcaccgcttctcccgcgttggctggtaagccgggcacgcccgaccacgccccttgccgccaaagcgccatgaacggctacggcaccaagcatcaccacaagcacccgaccaccaacggtggcgcagccgccgcgaacaacaacaccggctacggcgcgggcagcaagcaccaccacaagcacccgaccaccaacggcggcgcagccgccgcgaacaacaacaccggctacggcaccggcagcaagcaccacacgacgggcagtggcgcagccgccgcgaacaacaacaccggctacggcaccggcagcaagcaccaccacaagcacccggccaccaacggcggcgcagccgccgcgaacaacagcaccggcggttacaccggcgggcacgcggccggctag

SEQ ID NO: 7661 - DNA, 2094 bp, Actinoplanes utahensis
gtggctgagccggtgaacgaagtgagctgggaggcgctgttccgggccgtacccacaccgttgctggtgctggacaccgacttgatgatcgtcgaggcgaatcaggcgtacctgacggccaccatgcgcagccgtaccgagctggtcggccggccggtgttcgaggcgtttcccgacaatcccgaggacgcggcggcaagcggcgtgacgatgtggggcgcgtcgttgcagcgggtcctgagtcagtgcaccaccgacgtcatggcgatccagaggtacgacatccctcgcccgtggggtggtttcgacacccgctactgggcgcccgccaacgcgccggtgttcggtccggacggcgaactgcgctggatcattcaccgtaccgaggacgtcaccgcgttcatgcaggctcgtcacaacgatccggccgcgctggcggagctcaccgagcaactgcggatccgtaccgagcagatggccacggaagtcttcgcccggcgggaactggaggaacagaacgaaagcctgcacgccctgctcgacagcttggacaccgccgtggtcggctgcgacgctgaaggccgaactgtgctacgcaacgaagcggcccgccagcttttcggcgccctgctggatcaggtgccggtccagcggtgggccgagtaccaacacgtgtttcaccccgacggacatcggatgagcggtgatgacattccgctgatgcgcgccctgcgcggggaacgggtacgtgacgcggagatcgtagtgcgagtccccgaagcgccacgccggtacttccgggccaacggccgcccggtcgccggtcatccgcggctagcggcggtagtggcgttgcacgagattacgctgcaccgccgcgccgcccgcttcaaggagtgcgagctggagctctcccggctgacctccaagcccgccccgccggatgaaatcttcgccgagatggtgcagctcatcagccggatggccgggtgggcggcggtggaattctggaccgtcgacgatgtcgcccgggtgctgtaccgcaccacctgttgggccgaacccggctacgacctgccctgccgattgccggacccattgtcatacggccagggtgtaccgggccgcgcgtggcagacgtcggacccgatctgggcggcgaacctgcccaccgaccccgacgccgcccagcaggccactgactgggggccgttgcgcgccgccctggccatccccatccccagcggatccgtcatcctcggcgtgttggtctgctacagcgacgtccccgagaccccggacgatacccgtaccgccatgatgaccggtatcggggcgcacatcggagaattcctctcccgacgccgcgccgaacgcctgaccgaggagctggatcgcagccgcgacgagtacatcgccctggtcggccatgaactacgcaccccgttgacgagcctgcaggcatataccgacgtgatgatcgacgaaccggacctgtccgtcgacgagcggcagtccatgctgaaggtcatgcagcgcaataccgcgagcctgcgcgccatcgtgacgaaactgctcgacgtggccggtatgcgttccgggcatgtcgacctgcaccggcaacccatggacctggccaccatcgtgcacgaagcggccgacgatgcccgcaccggcgctcagatcacgatcgaggtcaacaccccgccgcaggcgccgctgcacggtgatcccgcccggctgcgtcaagtggttgacgagttgttgtccaacgcgctgacctgggcaccccggggcagcgccataggcatcaacctgcgtgctgacccgcgcgccatcgcggtatcggtgtcgaacaccggcaggccgctgaccgtcgaggaacgtggccggctgttcgatacgttctttcgcggcgagagcgcccgcaacggtggtgtgcccggcaccggcctcggcctcaccatcgcccgcaccatcgttgaagaacacggtggcaccatcgccgtcagcgaacccgacgaagccgccaccaccttcaccatccggctacctacccaccaaccggcaccgaacgactctcttaccgcctga

SEQ ID NO: 7662 - DNA, 1224 bp, Actinoplanes utahensis
atgattccggtacgggcgatagccgaccaagcacagaccgcggcgttggcgcgttaccacctcttcgacggtccgccggagcccgacttacagacggttgtggagttggctgcccagctgtgccaggtcccgatctcggtgctgttcgtcatcgacgccgacagtcagcaccaggtcgccgccgtcggcatcgacacggaagtgtgccggcgcgaagactccatgtgctcggtcgcgatggccgctcctgacccgatgttcatcgaagatgcacgcaccgacccgcgcttcgtagccaaccccttcgtaactggcagatttcagcggtttcgcttctacggctccacccagctccgccccccggaggggtttgtgctgggcaccctctgcgtgttcgatgaagtcccccgcgtgctcgatgaacagcaacgacaaggcctggaccggctcgctcggatggccatcgatgtgctcgaactacgcagacacgggtttctcgtcgcggacctgctccgccggcaacaacaaatccaagccgcgctggagggcaccaacgaaacgctgcggcacttcgctgcccaacttgcacatgacctgcgcaacccgttgaccggtatcagtgcctacgccgccgaactgcacctcatgcctaccgtcaacgccgacgccgacgcctccttgtgcaccgaccgcatctccgccgccgcgctgcggatgggcactctcatcgacgacgtgctcgcccacgccacgaccgaccacgcccgccacgccgtcgaggtgaacctcaccgagatcaccaacgaggtgctcgatgaccttgccgtacagatcagcgaagcgaacgccgacgtaaccgtgaacgaccttcccaccgtgatcggcgaccgcacccaatggcacatcctgctgcagaacctcgtcagcaacgccgtcaaataccgccacgccgagcgggcctgccacatcgccatcaccgccgccgacgaccctgccgggtatcgcgtctgcgtcactgacaacggcatcggtatccccgccagtcaacgtgaacaggccgctcaacccttcacccgtctcagccccggccacagcaccggtcacgggatcggtttgtcgacctgcgcccgtatcgtgcacacccacggcggcaggctcgacatcagcgacacccccggcggcggcaccaccgtctgtatcaccatgcccacagacaaccgttga

SEQ ID NO: 7663 - DNA, 1380 bp, Actinoplanes utahensis
gtgagcacgaatgtgcggggttttctggcgcagcatcgggacgccgtggttgccgaactggcggagtgggtgcggattccgtcggtcgccggggttccggagcatgcggtggatttgcagcggtcggcgaattggctggcggcggcgttgcgtgagacgggttttccgtcggtggaggtgtgggacaccgagggcggtccggcggtgtacgcgcagtggtgcgcggagccgggcgctcccacggttctgatctacagccaccatgacgtacgtgccgcgaaggacgaggagtgggacgagaccgcgccgttcgacccgaaggtccgtgacgggtacctctacgggcgtggcgcgtcggacgccaagggccaggctcttgcgcacctgtggggtgtccgtgcccacctggccgcgaccggccgcgaccatcccgccgtgaatctgaagctgttggtggagggtgaggaggagaccgggtcagcgcatctgaggcagcttctgcaggataacggcgaccgggtcggcgccgatctgatcgtcttctccgacacgctgctgtggcggtcggatcatccggccgtgtgcgtgagcatgcgcggcacgatgctggcgaagctcgagatcatggggccgttgcaggacgtgcatagcggagcggtgtccgggccggcgcccaacccggtcctggagatgagccggctgctcgcccaactgcacgacgacaagggccggatcacggtgcccggcttctacgacagtgtggtggagccgtcgcagcggtttcgcgacgagctggccgcgttgccgtacagcgacgccgactggctgaagcggtccctgacgcgcagcgtgggtggtgaggccgggtacacggtgctggaacgtctgtggacgcggccggcgatcgaggtgaccagcatgatcagtggtgatccgatcgggccgtcgcgggcggcggtgccgtcgctggccaccgctgatctgagcatccggtacgtctgtgaccagaccggtgccgagatcgccgagcagttgcgacggtgggtcgccgatactgtgagcgagcggttcgaccatcggctgaccgtgtccccggagaccgcacaggatccctaccgcacaccggacgatctgccggcggtggccgcgctggcggaggccatgcaggagggattcgggcgtccggcgggccggatgggcaacgccggtggcggtccggcggtatggctcacgcagagcgtcggtgcgccggtggtgtacttcggcaccgggctaccggaggatcgctggcacgacagcaacgagcgcgtctcgatcgatgtgctgctctccggcgcggctaccctggcagcgttctgggaccgactgccatcagcttga

SEQ ID NO: 7664 - DNA, 252 bp, Actinoplanes utahensis
gtgccggctcatgatcgagcgctgaatggcgacggcgaccagcccggctgcggcgctggcccagatggccggtgtgtttgggcaatggcgttcaagctgatcgaggccgcacagcaacgctggcgggcggtcgacgcaccgcacctggtcgcccgcatccgcgccggcacgctggctgggcgggcgtacgggcgggtagccggcgatgcgtacgaggaggcgccgatgcgggtgacctccactgcgtcgtaa

SEQ ID NO: 7665 - DNA, 342 bp, Actinoplanes utahensis
atgaaggtattcaagctggccgtcggattcgccgccgggtacgtcctcggcacccgcgcgggccgcgagaagttcgaacagatcgccgcggcgacccgcaaggcgagcaaccacccagcggtgattcaggcgcaggacaaggcgaaggcgatgctggccaccggccgagattccatcatggcgaagctcccgcacgacgacacggccacggcgagcacgccgtcgacgacctacccgacgcagacgaccgcgaccaccgctgctgtcggcacgccgagccggccacgcccctcgaaggcggcccacaccccgtcgcccgtcggcggtgacccgctgccgtag

SEQ ID NO: 7666 - DNA, 765 bp, Actinoplanes utahensis
atgctgaaacgcgactaccgtcctctcatcgtgctcccgcacgccggagccttcggtctgcggcagttgcccgccgcgttgatgatggaggcggcgttcaccgaatctccggatgccgccacgacatcgccgtcgccgtcttcggaccccggacgcgtcgatgacacgagtaccgtccccggcgaggcgacccggtcgccgagccccaggccggacgaccgcgcaagcactttccccggcccgacgcggacgtccccggcgcaaccgaccgtgccgcccggaggcgtggaatgggtacccgcgcggccgggggagaagggtcctgaacggctgtcagcgcgggaggcataccggcgacaactcgacgcggttgaacccctgcatcgttcaggccaaacgcgcgtgaggaaacagaaacccgcccgcaccccgaaccggtccgccacacaagaagacgagatcggcgtggaggtccgcgcgaccatcagcctctacagcctacgcggcgtcatcgtgcgcctgtattggtccatgtccagccggaacccacaggaaaagctgtccgtcggctggagcaacagattgctcgagccggcactcaaggccaccagcgaccatgacaccgcgagcttcaccttctggctgcctatgccgggaacggcgaaggggccgttcgtcgtcacatcgagtctcgtggtcagcgacgatgagccgcccctcgccaccgccgataccgagccattcagctggcggcaatcgggttga

SEQ ID NO: 7667 - DNA, 1854 bp, Actinoplanes utahensis
atggtcacggaccaccttctggttctcgtgttcacggtgatgatcttggtggctgccacatcgatggcacttcatccggacgccggccggttgaaccgcctcatcgaatctgtggctctgggggccaggacgctggccgtgatctggcttgtcgcgacccgaggccgggcacggcatccgtggaccatagcgacgctgctgctcgtggacatcactctgctcgcggccgtgttcgcgacgatcccgattccgtacgcccgggagccgttcgtcctgcactctgtgatgcggttgccgctggtctgtgccgctctgcgacggcggcagatgatggtggtgctgcccgctctgctggccgggccaagcgtcattctgggctggcagatgttcacgctgggccggaacggcatcaccatgccgctgctgtggctggtgacggtcggggtgaccggctactgcatgcggcggctggctcagcacctcgccaccgcgcgagccgaggcgctggagctggccgcacgccggcagcacgatgccctgcatgactcgctgacaggtctgcccaatcgcttcctctacgctgaccagctggccgaagcagtcactgccgcggctccggacggcccggacgtggcggtggtgctcatcgacctggaccgcttcaagatggtcaatgacagtcatggtcaccagttcggtgacgaagtgctcgtcgccgtcagccggcggctgcgtcacagcctgcgctccggggacaccctggcccgcctgggcggggacgagttcgccgtaatcctccgggacatccacgagccggccgatgccttggccgccgccgcccacctgggtgccgcgctccgggacccgctgcaccccggcggcgccggcgcgtcccccgggaccgggccggggatgtacgtcacggccagcatgggcatcgctttcgcccgccggcacagagacgacctcggagcggtgctgcgcgaggccgacatcgccatgtaccaggccaaggcgcggggtcaagcgtcggtggaaatcttcgacgagacgatgggccgggtcgctcatcgtcgcctggacctggagaaccagctgcgccacgacgtcgaaaccggctcggacaccctgtcggtggcgtttcagccgatcgtggaaccagccggcgggcgcatcgtgggtatggaggctttggcgagatggagttctccccggtacggggcggtacccccggacgagttcatcgccatcgcggaagagtgtgacatcatccacgacctggggcgccgggtactgcgcaccgccctcgaccacaccctttggtggtgcacactgcagcccactctggagatctcggtcaacgtctcgcccgtacagctgcaccgccccgagttcgcggacgaggtgcgggcgctgctgcgacagacccgcgtaccggcggagcaagtgtgcctggagatcaccgaaggggtgctgctcgacccctacggagcgagcgacgcgaacctgcgtgccctgcacgaagccggtctcaaactggctgtcgacgacttcggcagcggctactcgtcgctggcccagttacgccgattcccggtcgacaagctgaaggcggacaggtccttcatcgacgacgccccgctcctgcaagccgtcgccgacctggccctcgccttgaacgcccaggccctcgccgaaggtgttgaaacgcccgagcagcgccggcgcctcgtcgaactcggttatgcgcaggctcaaggctacttcttcgcccgtccacaaccgccggccgccgtcaccgaactgctgcgctcccagcagaaccagcagcaaggttcgtctggccgtacctga

SEQ ID NO: 7668 - DNA, 537 bp, Actinoplanes utahensis
atgaacaacaccgatccagaggcgctgaccgacgtcgagttgcggcagcgtgctgccaccgccggcgtcaccgcacccaccggcatgccgcgcgctgacttgatcgccgcgctgcagaacaccgacgacgccatgacccggtccgaggaacggctcgtccccagcacccaggtctacgagaccggacgggcgcggctccgcaaatacgtggtcaccgaagacgtgcagatcaccgtgcagatccgccgcgaagaactccgcctggaacaggaagccatcgccgcgcccgatcagcgggtagtggcggaccccgacgtgttcggacccgacgaggtcttcaccggccccgacggcggactgatcttcgaagtcaccctgcacgaggaacgccccgtgatcaccaccgagatcgtgccggtgcaacgcgtacgcctgacgaagatcgtccacaccgacgaacacatcgtctccggacaggtccgcaaggagaaaatcgacgtcgatctgcccggcgagccgcccaccaccctgcaatga

SEQ ID NO: 7669 - DNA, 774 bp, Actinoplanes utahensis
gtgatcacccagaacgacatcgctcgactcgacgacaccgacgtgtacgacaccaccggcgacaagatcggctccgtcggccaggtctacctcgacggccgcagcggcgacccggagtgggtcaccgtcaagaccggcctgttcggcaccaagcagaccttcgtcccgctgcgcgacgccaccttcgccgacgaccgggtcgtcgtcgcctacaccaaggcccaggtcaaggacgctccccgcatcgacgccgacgggcccatctcgcacgccgaggagaacgagctgtactccttctacggcctgccgagcaccggcggctacggcgacggataccagaacgacgacacctaccagagcggcgcccggcgccgtgccaccaccgaccatgccggcgacgacgcgatgacgcgctccgaggagcggctggtcaccgacacccgcaccgagcaggccggcaaggcccggctgcgcaagtacgtggtcaccgagcagcagcaggtcaccgtccccgtcacccacgaggaggcccgcctcgagcgcgagccgatcaccgacgcgaacatcggtgacgcctacgacgggccggccatcaccgaagccgagcacgaggtcaccctgcacgcggagcgacccgtcaccaataccgagacggtgccggtcgagcgggtacgcctgagcaaggaaaccgtccgcgacgaagaaaccgtctccggcgaggttcgcaaggagcagatcgagtacgacggtcccgacggcaccaaccgcctctga

SEQ ID NO: 7670 - DNA, 762 bp, Actinoplanes utahensis
atgacacgggatccggacacgccgccgaccgctggcgaccctgccatcgccgcaggccatcccgtaaccggacgcagcgggttggaccagcaccgcatcctgagcgcggcagtgcagttcatcgacgagaacggcctgcgcaggctgaccatgcaacgcctcggcgcctacctcggtgtggaagccatggccctgtaccggtacgtgcccgggcgtgaggcgctgctggacggggtggtcgaaaccgtcgtcgacgagttgtacggcgaccccgacgtgcacctgcaggcccagggcggctgggtcgactacctgcaacgcctggcccacgggctgcggcgcatcgcgctcgcccaccccgaggtcttccctctggtcgccacccggccggccgccgcaccatgggtccggcctccgctgcgcagtctgcggtggatcgagtcgctgctcgaggtgatgaccgaggccggcttctccgacgagaacgccgccgcggtctaccgggcgttcagcagcttcctcctcggctacctgctgctcgaggtgtcggccaggggcgtggagaccggaccggtcgaggaacccgacgtgtcaccgatcgaggacctgagcgagtaccccatggtgcagcgcctgcagccgcacctgtccgtcgacgccgccgcggaagacttcgaagaggccctcgaagccctcctcgaccgtgtggcgctgctgttgccgcgtcgccgccggccaccacgactgaccgagaacatgtga

SEQ ID NO: 7671 - DNA, 1050 bp, Actinoplanes utahensis
atgagcgctgaccaccatcgcgaccgtcgcgacgcggtcgcgaccacccggaccggcgacgacaagccgtacgacttgtccgcgcccccaccggacgccggcccggacagccctgtcgagttgcggggcaaggggctggtcggcgcgctcaagcgcaccggcaagcagttctcgcaggacaacctgtcggactgggccgccgccctgacgtactacggcgtgctgtcgatctttcctggcctgctggtgatcgtgtcgctgttgggcatgctcaacagcaacggccagaagacggtccaggacgcggtgcaccagctggcgccgaacccgcaactgcaggacatggtcaacacggtcctgacccaggtgcaggatcccggcaaggccggcctcgccgcgatcatcggcgtcctggtggcattctggtcggcctccggctacacggcggcgttcatgcgcgcgtccaacgccgtctacgacgtcccggagggccggccgatctggaagaccctgccgatccgggtcggtgtcaccgccgtggtcgggatcatgctcgtcgtctccgcggccatcgtcatcttcaccggcgacctcgcccggatcgtcggcgacaagatcggcctcgggtccgccgcggtggcgacgtggaacatcgcgaagtggccggtcctgctggtcctgatcagcctgatgttcgcgatcctgtactgggcgtcgccgaacgccaagaccggctcattccggtgggtcagtcccggcggcctgttcgccgtactgctgtggatcctcgcctccgtcgcgttcgccctctacctggcgaacttcgcgaactacaacaagacctacggcaccctcggcggggtgatcgcgttcttggtctggatgtggatcagcaacatcgcgatcctgctgggcgcggaactcgacgccgagctgcagcgcggtcgggccatcgccgccggccacgacccggccgacgagccgttcctggagctgcgcgacgaccggaagatcaaaccgggcagtgagcagggcctgagcaccaactga

SEQ ID NO: 7672 - DNA, 420 bp, Actinoplanes utahensis
gtgtccgaacgaatagcacagggatcagcagcgtcgaccggtgatctggtcagtcaggcagctgcgcagatctcgacgctcgtccgcgacgagctcgcgctggcaaagctggaactgaccgagaagggcaagcgggccgggatcggcggcggcctgttcggcggtgccgcggtgctcggactgtacgggctcggtctgctggtggctctcgcggtggtgctgctcgacctggtgtggccgctgtggctggctctgctggtggtgctggtcgttgtgctggccgccgccggtatcgctgccctgctgggcagaaacaagctgaaggacgccgtgccgccggtgccgagcgacgcggtggccagcgctcaagccgatgtgcgcgcggtgaagaacgccgtacaggaaggaaaatctcgatga

SEQ ID NO: 7673 - DNA, 360 bp, Actinoplanes utahensis
atgagccagtcccccacaccgaccgacccgcaggagctacgcgcggaaatcgaacggacccgcgccgagctcgggcagacggtggagcagctcgcggccaaggcggatgtgaagacccgcgccaagcaggcggtcgcggacgcggctgggcaagcgcaacacaagctcgccggcgccaaggaccaggccgtacaggcggccggcctggtgaagggcaaggcgttgaccgccaagcagcagctggccgattccgacctgcccgcaccgatgcgccgaccggtgccgctggccgccatcgtggcagccgcggccgccctgatcatcacggtagtcgtcgtcgtccgccggaggagctcatga

SEQ ID NO: 7674 - DNA, 273 bp, Actinoplanes utahensis
atgagcagcaagacactgaagatcgcgtacaagccggtcggattgctgctcggcgccggtgccggggctgtctccgggctgatcttcaagcaggtgtggaagctcatcgcgcatgacgatgacgcacctgacgccaccgaccaggaccgcggctggaccgaggtcctggtcgccgccgcgatccagggagccatcttcgccgtcgtcaaggccgccgtcgaccgcgccggcgccaccggcgtacagaaggccaccggacagtggccggactga

SEQ ID NO: 7675 - DNA, 1545 bp, Actinoplanes utahensis
atgccttggttcggtcgtcgtcgacagcagacaccggaggcacgcccggtcccccgcgatgtcgaagcgctggaacgggtcatcgaggcgctcgcgggcggcgcggcgtccgtgcaagacggccgggccaagatcactagcaccctcgttcaggtactcggtctggattatggggcgctctggagctgtaacgagcgcggcgactacacgctcaccttcgaaaccgggtccctcggcccggccctgcgcggggccatcggcgggacagacaccctcacctcggcggacggcctgatcggcgcagccgtcaccggccggcaagcgatcaccctgagcgagacgccacaggccggcagctcctgcctgcgctggcaggccgcccaccgggccggcatggtcgaagctgccagcatcccgatcgtgcacgacggcacggtcgccggggtcctcgagttctacggccggcagccgctgcccgcgttcgccagcgacaaatgggccgcgatcacccgcatcgccgtactcaccggcctgcacgccgcggcggcttccgagctcaaagagaccctcagcgaccgggccgcggtcacgaacgtcgtcgccgaagtcggcgaagcactcgaccagcagtccgccatccggatcgcgctcgaccgggtccgcaccgcattcggatgggcatacggctcctactgggcgctcgacgaagccgaccaggtactgcgcttcacctgcgagtccggttcggcgggcgatgagttccgcaaggtcaccctggcggcgtcgttcgccgaaggtgtcggtctgtcgggacgggcatggcgggccaaggatctggtattcgttcacgacttggccgagatgaccgactgtgtccgggcgcccgcggcgcagcgggcgggtgtgcgctcgggagtgtgtttcccgatcatggatggtcggaccgtcatcggaacgatggacttcttcaccaccgagagcatcgaactcagcgactcccgggccgccgcgctgcgcaatgtgcaacagttggtgtcccagcggatgtcggcgctgcgccgggtggaaaacgacgccgcgaaggcacgccaactgctcgatacggtctccgagctgcgcgccgcctccgaggacgccagccgcgtcgccgctctggccgcgagcggatcccaggcgatgacgacagaagtgcaggcactctcccacgcttccgcggcggtcggtgacgtcatcaaaatcatctcctcgatcgccgagcagacgaacctcctcgcgctcaacgcgacaatcgaggccgcacgcgccggcgaagtcggcaagggcttcgccgtcgtcgccagcgaggtcaaagacctcgcccgggagacagccgaagccacacagaaagtcaccgagcagatcgccggcatccagaactccagccgcgcagtcgccgagggcatccatacctccagcgacaccatcgggcagctcgacatcgtgcaagcccggatgaaccaggtgctgcaacggcaggccgacatggcgtccgccttccggtcgtga

SEQ ID NO: 7676 - DNA, 339 bp, Actinoplanes utahensis
atgagcagcatgccgccgcgccacccagtgacgatcaccatgggtggcatcgacgatgggaccgtgcacctcaccgtggccggtgagatcgatctggccaccgccgatgttgtctacgacgcgatcgccgcggctgcggacactccggcagcacagcacgtggaaatcaatcttcgacacgttgaattctgcgactcgactggtatcggagccctcatgagggccagacacttcgcgctcgagcacgccgtcaccctgcacgtagtggaacccagcggcttcgttcgccgcgtactggaactagccggggtcctggagatactcaccgaaccgaaatag

SEQ ID NO: 7677 - DNA, 549 bp, Actinoplanes utahensis
atgaacgttctggtcgccgaactcaagatccgcgcgcgcctctgcctcaacgccgcccgccggggagacttcggccttctcggccacttgccggccgacgggggacggggcccgtcaccggcgcccggctggcgtttacggcactgtctgactctggtcgccaagaacgtcggcttcgccggctgggaccacgcccggcgggtactcggcggcgacgcgcagatcggcgatgacctgggcacgttctggcatgcgccgcggtgcaccggactgctcagccactggtttcccagctattcacaggcgcaggtgttcctcgcggataccgacaagctggtgctgttgccgtaccgccgccaatttgtcgtggtggaccatgactacctggccgctatcggcataccccacgccgtcgaaccagggcgacccggccgacgggaccttgtcgccgcctacggcacgccggactggctcgccctcgcgcagcaacgcctgcacgcgacccgtacgccgggcccgtcatcgaggaaaggagggcgcgaccgataa

SEQ ID NO: 7678 - DNA, 789 bp, Actinoplanes utahensis
atgtcttctctgtcgcccctcgccgtggtcaccggcgccggttccggcatcggctacgccctcacgcaggccctgctcgcccgtggcctcgaggtagtggccatcgaccgcgacaccagccgcctcgacgagcgcgtccaggcgtacgagttcgacgtccgcgacggggccgctatgcagaggctggcagagtcgctgtcgacgcgaccggtgcactacctgttcgcgaacgcgggcgtcggcgtctccggcgatgtgctgtcctcaccggagcaggcgtggcaatgggcctgggacgtcaacgtgctcagcgtcatccgttcccttcgcctgtggtggccacagctggtcgccggccgcggcaaggcggtagtcaccgtgtcagcggcggccttgcagagctacccgggcgcgggtccgtaccgtgcgaccaaggctgccttgctcagcgcgctggaaggcctctactacgaggcactcagcgatggtgtcggtgttcacgcactgtgccccggtctcgtacgtaccggcatcaccgacgtgaaccgctacgccgaggttgcccatgccgcacctaccgagcccaacgcgttcgagagcttcatgagaaccgcgatgcgcgatgctgagccggccgacgcgtttgcccgccgagttctccacggcctcgacagcggtgcaccgttctactggttcacccatccggagaccatgggctggaccgaggcgcgccaccgtgctgtggtcagcgccggcacgccgttcgccgacttcgggacaccggcatga

SEQ ID NO: 7679 - DNA, 1614 bp, Actinoplanes utahensis
gtgggactacggtgggagccgaaccgtgggaccagcacggcagtagcccctggtaccggcgcggcggccgcgttggaactgacccgcgggcagatgacacagaccgccgccgaccggatggccgcggtcaccgctcgcgccgcccaagcacggtgcgcgatgatccacatcaccgatgggcagaatctacgcctcatcggcggacaggcgattccggccggcttcgacaaccggaagcccgtgccggtgacctccacccttgccggcctcgtcctgcacaccggcttcccggtcacgatcaacgacatccacaccgacatccgtgttccgctggacgcgccggtgcgctccacgcgccttcgctgctacgccggattcccggtacgcgacccggacggacatatcgtcggggtgtgcgctgtagccgacgaacttgcgcgagactggctccccgagcagctggccggagctgacgagggcgcgcaggcgtgcaccgcgctggtggcagagcacctcgcccgcgaaagtgaactgcgccagagagtcttcctggacaccctgctcgacagccttgacaccggtgtggccgcctgcgacgcggacggtcgcctcgtgctggtcaaccggtccctgcgggagcgcctcgagctgaccgatgtcgacggcacagccgaagaatgggttgcccgcctgccggctaccgacaccaccggcacaccgctgagcccggaccgcacgtcgctgctgcgtgccttgcgtggtgaaacggtgcgtggcgccgagaacttcctccaggttcaggggcaacgccacctgttccgggtcaacggtcatcccatcacctacggcgatcagcagctcggggcggtcgcggtgttccacgacatcaccgccgcccgccacgctgaacggctgcaacaaatgctcagccgcaccaaggacgactacctcaacctcgtcggccatgaactgcgcacccctgtggcgatcatcgactcgtatctggatctgctgcacgacagcgtccacgacacagcaccagcggacctggtaccgatgatcgaggcagcccggcgtgggagcgaacgtctccggcggctgatcaccgcactgctggacctctccgcgctcgacgccggccgcagcccactacagatgagcgacatcgacctcagcaccgtcgtcaccgccgccgtcgaccacgtcaccgagcgcgccgcgaaaaggaacatcacgatcacctgccacgtgccaccacacaccccgcagcacgccgactaccaccggatgcgccagctgatcctcgccctactcgacaacgcgatcgcctacacccctgccggcggcaccgtcaccgtcacgctgaccagcaccagccaggctgacgagctcaccgtctccgacaccggattcggtatacccgcctatgaacagccccacgtattcgagcgcttctttcgaggagctctagccaccgaactcgcgatacccggcgccggactcggcctgaccatcgcacgactgatcaccgaacgccacgacggcaccatcaccgtcaccaccaacgccccccaggccaggggtacgagcgtgcacgtccgcctccctcactga

SEQ ID NO: 7680 - DNA, 429 bp, Actinoplanes utahensis
gtgatcgtcgtcgacgacggctccagcgacgacaccgccgccatcgtcgagcggctcgggcttgcgcgcgtccgggtcatccggcagcccaacgcggtaaagcccgccgcgctcaacaccggcatccggcactcccggggacagatcctggtgctggtcgacggcgacacggtgttcgcgccggacgcggtaggccggctcatccagccgctcaccgttcctggcgtcggcgcggtgtccggcaacaccaaggtggcgaaccggaccgggctgctcggccgctggcagcacctggagtacgtgatcggtttcaatctcgatcgccggatgttcgatggctatgacggttgtatttggctccaccagggcggcttgaactggccccacccgcgggggactttcccgcacggatgggcgacgacggcttga

SEQ ID NO: 7681 - DNA, 1641 bp, Actinoplanes utahensis
atgccgttgaccaaggacgaactgttccgccggatccgttccgatgcggtgctcgaggagctgtcgattcgggcgcttgcgcgtaagcacggtgtgcatcgccgtctggtccgcgaagcgctgacttctgcggagccgacgccgcgccggcaaccggttcgccgttcgccgcggcttgacccggtgaagaagacgatcgacgagtggctgcgggcggatctggaagcaccgcgaaagcagcggcacacggctcgccggatcaaggaccggctcgcggaagaggcggacactgacgtcccgtattcgacggtgcgtgactatgtgtcgatgcgccgccggcagatcgcggcggaggcgggtgctccgatggacgggttcatcatccggcacaaccggcccggcgccgacgcggaagtcgacttcggtgaggtcgtggtctgcctggccgggacaatgactcgctgtcacctgttcgcgttccggttggcctactccggtctggcagtgcaccgcgtgacggtgtcctgcggacaagaagcgttcctggaaggtcacgaatacgccttcgagttgatcggcgggatcccggtcggtcagatccgttacgacaacctgagttcggcagtacgccgcgtggtcttccgcagccgatcgagggtcgaaaatccgaggtgggaggctttccgggagcactacggatttacggccttctactgcattcccgggctggagggcgcccatgagaagggcggggtcgagggccaggttggctactaccgccgcaaccggctgaccccggttcccgtcgttgccacgttggaggatctgaaccagcggctggcggctgctgatctgaccgaccgggaacgcaagatccgactccggtcgagaactgtcggtgaggacttcgccgccgaggctgcgctgctgggccgactaccgaccgagaagttcggggcgtcactcacgctgcggcctcgagtcgatcgcgaggcgacggtgacggtccggatgaacgactattcggtcccggcccgcttcatcggccgcaagctgcaagtcttgctcggcaccaccgaggtcgtcgtctccgacggccggaccgaggtcgcccggcatccccgcctgcccggacgcggcggacagcacctgctgctggatcactatctggagattttgctgcgcaaacccggagccttggcccggtcggaagctctcgatcaagcccgccgggaaggcaccttcaccgccgagcacgaagcgttctggacagcggcgaaggccgcgaccggcgaggacgccgccggcacccgcgagctgatccaggtcctgttgctgcaccggcacatgcgtggtcaggacgtggccgccggcatccgggctgcgttgtcggtcggcaccgcgaccgctgatgtcgtggcggtcgaggcccgcaaggccgcccagaacgccggacgatcacccacgatcacagccggcccgccgccggcaccaccaccccccttgccgccaccggcgccgccgccggtcacggaacggaccttgcagcgggtcgctcgattgcccgccgaccaccggccgccgccggacctgaatcgctgggaccagctgttacaccaccggagaaaggaatcatcgtga

SEQ ID NO: 7682 - DNA, 792 bp, Actinoplanes utahensis
gtgagccgtattccgcgagctatcaccgagaacgccgctgacgcggcgatcgagacctcctgccgggtcctgcacctgccgaccgtccgcagccagttctccgagctgatcacccgcgccgaacgcgaccagctcagctaccgcggcatgctcgccgagctgctgatggccgagtgcgaagaacgcgaccggcgtcgttcccagcgcaggttgcaggccgcggggttcccccgccagaagtggctcagcgacttcgattacaccgcgaacccgaacatcaacgccgctttgatcaacaacctcgccaactgcgactgggtccgcgccggccagccactctgcttgatcggcgactccggcaccggcaaatcacacctgctcatcggcctgggatcagccgcggcgatggccggcttccgcgtccgctacaccctggccgcgaagctggtcaacgaactggtcgaggccgccgacgaccggcaactcaccaagaccatcgcccgttacggccgcgtcgacctgctctgcatcgacgaactgggctatctcgaacttgatcgccgaggcgcggaaatgctgttccaggtcctgaccgaacgcgaagagaagaacagcgtcgcgatcgcgtcgaacgagtccttctccggctggacccgcaccttcaccgacccgcggctctgcgccgcgatcgtcgaccggctgaccttcaacggcacgatcgtcgagaccggcaccgactcctacaggctctcccgaaccgccgcgaaacagcccgccaccagcggatcctga

SEQ ID NO: 7683 - DNA, 789 bp, Actinoplanes utahensis
gtggggccacttcaagccgccctggtggagccacttcaaaccgtcacgctcgccgcgggtggggccagttcaagccgccctggtggagccagatacaaccgtcatagccagttcgagatcgcccggtgtatgccgaccgtgcccggagcgatcggcgcgttccgtcgcgccgcgatccaggacgccggcggcgtctccgcgcaaaccttggccgaggacaccgatttcaccatgtcaatcctgcgggcagggtgggacgtcgtctacgagcccgccgcaatcgcctggaccgaggcgccggccaacttccggcagctgtggcggcagcgttaccgctggtgttacggcaccatgcaggcgatgtggaagcaccgggacacggtgcggcagcgcggcccggccggccggctcggccggcgcggcatcgggtacctgttgccgttccaggtgctgctgccgatcaccgcacccatgatcgacgtgtacggggtgtacggcctgatcttcctgtcaccgctcacggtggccgcggtgtggtcggcgttcatggccgcccagatggctacggcggcgatcgcactacgcatggacggcgaatcgtaccgcccgttgtggaccctgccgttgcaacagatcgtctaccgccagctgatgtatctggtggtcatccagtcgacggtgatggcgctgatcggcagccgattgcggtggcatcggatggtccggatcggcgccgcccagcagcatgccaccggagtgcgcgccagcgccgcggcgaagagttcttga

SEQ ID NO: 7684 - DNA, 1797 bp, Actinoplanes utahensis
atggaggccgccggcgatgccgtgctctaccgccgggtgctcagcccaggtgcgcatcggaccttgatgggcgtcgcggccttgcacatcgtgctggctgtcgccctggttgtctatctggtgctgcctggcaacctgccccggttcgcttcggtgacggcggttggtcaggtggtgatggcggcggggctggggctgatgattgtgcttcagctgatcgtggccctgcgcacctgggttctcgcctacttcgcggcgcgggcggtcgatccggtgccggtcaaggcgaaacctgggctgcgcgtggcggtgctgaccacgatcgtgccagggaaggagccggtcgacctggtcatggccacgctgcgggcgatgctgcggatccggcacgacgggccgctggacgtgtggctgctcgacgagggcgacgaccccgaagtcgcacggctgtgcgccgagatcggcgtgcggcacttcagccgcaagggccacccggaatggaaccaggacagtgggccgttccggcgcaagaccaagcatggcaaccacaacgcgtggcggtcgatgcacgaggcggactacgacgtcgtcgcgcagatggacccggaccacgtgccgtacccgaacttcctggaacgtaccctcggctacttccgcgaccccgacaccgcgtttgtggttgccccgcaggtgtatgcgaacctcggcgattcgtttgtggcccgcggtgccgccgagctggcctacgtctttcacggcatcatgcagcgcggcggcaacgggcacggtgcgccgctgctgattggcaccaaccatctgtaccggccggccgcgttcgcgcagatcggcggctaccaggactgcatcatcgaggaccacctgacctcgatggtggtgtactcggcggtcaaccagggcaccggcaaccactggcgcggcgtctacaccccggacattctggccgtcggcgaaggcccggcaacctactcggacttcttcagccagcagaaacgctgggcgtacggcatctgggagatcgctcgccggcactccccggcgctgctgcgccgactgccgcgccgggcccagcggctggcgttcttcgccctgcagtcgcattacccgaccactgccgcgtcctgggtgatcggcctggcgctcagcgcgatctacctggtcggcggcgtgtcggtgacccggctgcccgctctggtctggggcgtgctgttcgtcgcgaacctcgccgtcggcctgggcttcttccggatcacccagcgctacaacctggttgagcacgaacgccgctcctggggtttgaccggcatggctctggagctgatgaccgcaccggtgtacgtggccgcggccgccgcccaactcgccggccggcctctggcgtatgtggtgaccgcgaagggcaaggccgccaccggcgacacctggcgcaccttccggccgcacctgggctgggccgcggtcgccgccgcatgcatgagcgccgggctgctgctgcaccacgactggtggtcgctctacctgtgggccgggatcagcctgctcacctgtctggctccgcttactctggtcgccctcaacggtgttggtcgtcgcttccgcggcgctgccgccacgattaccggccgccgccgtatcggcgagcagctggttcggcaggggctcctgagccgccaggaactggaagagcttctcgcactacaggccggcgccggccgcggaacgcgcctcggcgacctcgccgtccagcacggctacgtgccggccgaccggctgatctga

SEQ ID NO: 7685 - DNA, 387 bp, Actinoplanes utahensis
ttggtcacggcccgactatcggctcagcgcagcagaactgaagcaaaacgcctccgtccatcatacgccgcatcggccaatcgccgtatggacgagcaccgcggccaggcggtgctggcccaccggtgggcgccgatcaccggcgagctgccggtgacggtcagcatcggggtcaccgccgcggtgcccagcggcaccgtccaaggcgctgcatgccggtcacgagccgtgccagcaggcgatcgtgtgcacgccaagctgagccagccgtccggccaccaggcagcctttcgcggtggggaaacagcagcggcgaaaaccttcaccttgccagggtcattgccgatcacctacgcccacatgaggaatcggatgggcgatgcgtaa

SEQ ID NO: 7686 - DNA, 1554 bp, Actinoplanes utahensis
atgcgtaaatttcacaccggtccgggcatcgtggccgggcgttggcgtggtgtcgcgggtatgaccgcgatctgggtggccttcctgggtgcgaccctcgccagctcgccgggagacctggtgaggtacgtcctcgacgacggggtctacccgctgggcgtcgtcgttgccgcggtgatgtcactgttcgccctacgccgggggccgcgcgaacgccgccaatggtgggcgttgacgctcgccggcaacgtcgcgtgggcgacggcggacggatactggtgctggaacgacgcctggcagcacccggtcgacggggtgtcgatcggggacgcgttgctgatcctgtcgtacctgctgcagctgatcgcgatcggaggggcgttcgccggcagcggcggcttgcgtcagtggcgtggccagctcgacggcgcgctggtggcgaccgcggtcggactcgccggttggcagctgatggtgagcccgcggctgcacaccgggctgaccgccaactcggtcgtgctggccgtctacccgttgctggacgtggcgttcttcatggtgttcgtctcggtcggcctgtccggccggcgccggctcccgctgcccgtgctgctcgtcgtgatcggcaacctctggtcggtgctgggcgacctcgccgtcgcggtggcgggcctgcgcaacctgactctcgacgacggcctggtcaaagccgtgtacctcccgatgatcctgctgatgatcctcggtgcgaccatcgacgcccgccggtccaccgccgagcaggcagtggagcgctcgctcgcctacgacccgggcaacgtgcccgtgctggtcgccgtggccggcgtcctgctgtgggcgggccgggatgcgctcgccggtcggatcggggcggccgcgctgatcgcctccgccaccatgatcatcggcttgacggtccgcagccatctgaccctgcgcgaccaccggcgggtcgctcgcgaactcgacgccgccctcgccgaacagcggcgactggccatcaccgacggcctgaccggaatctacaaccgccggttcggcgaggagctgctgcaactggagtccgaacgggccgttcgcgaggccggatccgtgtccatcgtgctggtggacctcgaccatttcaagtcggtgaacgacacctacggccacgaagccggcgacgcggtgctcatccagagcacggtccggttcaacgccgtcctgcgctcgacggacgtgctgatcaggtggggcggtgaggagttcctcgccgtcctcccggggatggacgggcacgaggcggccgaggtcggcgagcgactccgcagggtgctcagcgaccgtccgctgcagttgccctccggacagcggatcggcgccaccgcctccttcggcatcgcctccgtcaccacggccaccttcccgccggaggccgtgctgcaagccgccgacgaagccctgtacgcggccaagaccgccggtcgcaaccgggtcgtccgggccggcgccgcggccggacagcccgacctcagcgcatgtccggccgcttga

SEQ ID NO: 7687 - DNA, 1311 bp, Actinoplanes utahensis
atgaagtcgttcctgatgcgcaccaccctgacgaaggcgcaccagatcagcttggcgatcatcgttggcctgctggtggtgccgactgtcgtgtccggctggcaactgtggtcggccacgaagaagatcgactatgtggcgcaggtcggcgtccccggagcgcacctcatcggcagtatcgacgggctgatgaacaaataccgcaaggagcagtggcaatacctggcgcttcaccccggcgatccgcagctggcggagtgcacggactcgatgaccgacgagaaagctgagatgctggggctgttcgccgcctaccgccagctgcctctgcaacagcgaggtcgtgaggaactggccaccttccaagcggactggcgcgactacgtggatgtcaccgccaacgaattgacactggcggacagcggtcaataccaggcggccatcgacaccttcaataccggtcacggtcaagcaaaatgggacagcttgaagaaggacctcgcggcatggcgcgccaacgatgttgccgtggcctccgcctaccgcgccacggccagacaatgggcgcggtggagtgtggcggcgatcgtggttctgctgacggcggcgctgttactcaccataaaggtgagccgtctgttgaagacgcggctcacgcggggtctgcgccggctcagcgcggccgcgggcggtatcgcggccggcgaggtcgaccagcagatcgaggtcgacgcggacgatgagatcgccgaggtggcccgggccttcgccgacatggtcacctacctacgcggggtggtgaacacgatgcaggaccaggcgcagcagctggcgaccatggcgcatcacgatgccctgaccggcctgccgaaccggcgcgcatgggatcttgccatcgccgacggcctgaaggcggcacatcgctcgggcgcgcaactctgtgtagcggtgatagacatcgaccacttcaagtcgtacaacgacacccacggtcatcctgccggcgacgcgctactgagaacagcggcgaaggcgtggcgggccgtgctgcacccatcgcacctgctcgcccgctatggcggcgaagagttcacgatcatgaccagcaatgccacggtcgaccaggtcgttgcgatcgtcgcgaggctgcgtacggcgacaccgtccggtcagacgttctcggcggggatcgcggtgtgggacggctcagaaaccggggaacagttggtacgtcgtgccgacgatgccctgtatcgcgccaagcacgccggccgggaccaggcgcaggttgccgagctggcgacgcggtga

SEQ ID NO: 7688 - DNA, 1731 bp, Actinoplanes utahensis
gtgtcgctggcagtgatcagcacgctggcagcggccttgtcgccgtttctggtgcgttcgatggcggtggtcaaggagcagcgtgagcgcgaggtcgcggtgcaactcgctgatgacgccatggaacgggtgtcggcgctgaccggcgccgccgcgctcaccggccgtggatacgccgccgccagaacgcagtgggacgcggcgacctcgtccagcacccctgcctcgtacgccgcagccgtcggtccctacctgcagtcgatgagcctgggcaatcccttggacgtgagcgaccccgccaaggcgccttggctggcctgggatctggacctgccggtctcggcgaccgcgggggcgtcggcggggctgcccaccgccgtgatcaacgctccagtgaacggcttgagcttccaggagaactactacctgggcatgtgccgtcaacagttcggcaccggaggaagctgcgacaatcccgatacgcctgacccggacatcacccgcgccgacgtgcccctgctgcgcgtggtcatcgcggtgacctggacgaaccactcgtgtgccggcggcatctgcacctacgtcacatccggactggtgagtgacgtccaggatcccacgtacaacctcaaccggccggcgccgacagcgaacgaccccggcccgcaggtcagttacgccaagctggcgataaccgggctgcagctcagcgccacgggtggtcagctgccgctggcctggtcgttcaccggcctgccacccggcctgaccggctccgccaccggcctggtcaccggtacgcccaccgacccgggaaccggcaagacgtacccggtgaccgcgaccgtgaccgaccagttgggccggtccagcagcgtgacgttctcctggacgatcgtgccggcaccggtggtggccaaccccggcaaccagtcgacgcagacgggcaccgcgacgtcactgaccatggcggcgaccggcggggcgaacccgatcacctggtcggccaccggcctgcccgccgggctcagcatcaatgccggcaccgggatcatctcggggacgccgacggcgaccagccgcctcgacgccacggtcaccgtgacagcgaccgacaaaatgggccggtcgacctcggtgagcttcacgtggaccgtgaccgcgctggctctggcgcccatcgcgacacgcaccgacagcatccgtgactcggtcaacttcaccgtaccgcgaccgacgggcggaaccggcccgtacacgtaccggatggtcaactaccccggcgactactccggcgagatctcgatcaacccgtccaccggcgtgatctccggcaaggtgtggtacgccaaccgcttcttcaccaccgtctacgtcaaggacgccaccggcaccgaggtgtccaccaccttcctgtggaatgtgctgccgagccagcccaacgacctgtacatcaccgtcccgaatcccagcaaccccgatcagacgagcaaggtggggcagccgctggaactcgatgcgtacgcgccgagcggcagcaacagcggctacgactgggtcacctacaccaccgggctgccgccgggactctcgatcgccacgaagaactactactacggtgccatcaccggcacgccgaccacgccgggcgtctaccgggtgaccctggtctgccaggacgcgaactacaagagggccgtcgtgatgttcgactggacggtgacgccatga

SEQ ID NO: 7689 - DNA, 657 bp, Actinoplanes utahensis
atgatccgccgccagatctgcagccggatgggcgacgacagcggcacctcgctgattgaggtgatggtcgccatgggtgtgatgagcgtcgtcatggcgatcttcaccggcggcgtgatccagttctaccgctcggcggacgcggcggaagagaccgggatcacccagacacagctacggctcgcgttccaaaccctcgatcgtgaagtgcgctacgccaacgggatcagcttgcccgccaccgccgcgatcaatggcgcctggtacgtggagttctccggcatcgacccggccggcgcccaggtctgccggcaactccgactggacgccggcggggtactgcaggagctgacctggacgccgggctcgccgccggccgccggaacccgcggccggaccctcgcctccggcctgatgtcgcccggcggcagcgtgccggcgccgttcgaccggcaggcggccggctcgacaccgtacgcgtcggcgtccacctcagcgacgggcactgccttctcccccgacttgcagcgcctgcgggtgcggctgaccacccgggccgggtcgaccacctccgtcaccgacgtgacgttcacggccctcaacacctcgcgtgacaccgcagatcccaacatctgtctcgaaggacgcccctcatga

SEQ ID NO: 7690 - DNA, 1491 bp, Actinoplanes utahensis
atgatccagctccgaggcgacgaccgcgggtcgatgccgctggccatgctgctcagcatcgtcggtgtcacactcagcacgctggtcggcacggtggcggtcagccagatcaccgaggcccgcaccagctcggatcgcgctcaggcgctcatcgccgcccaggccggcatcaccgtggcgacgggccagttccgggcggccaccgacagcacgggaaccggggatccggcccgtctgcccgccggaccgctggccggcaacgtcggaccgaacggcggcgggcgctaccaggtgaccatcgcctaccgcgacctggacggcaacccgctcaccgtgccgctcaacgcccagcccgcgacggcagtggtcgtctccaccggcatccaggccgccaccggggccttccagcagggcaccaacggaacccggacgctgcaggccacatacgctttccgactctcgaaccagaacatcccgggcggccagatccacgtccggagttccgccgccgatctgtgcctggacgccggctccgcgcagcccgtggccggcaccccggtacagatgcgaagctgctccggcgtcccggccccgcagatctgggcgtacaacagcgacctcacgatctcgctggtctcctcccgcaccggcatcaacccgctcggcatgtgtctggacgcaggatcaccgcataccgccggtgcacaggtgaagatgcagaagtgcaccgctaccagcccaccgccacctcaacagcagtggagcacgaacgactcggccaacatcatgggcaccagcaacggatcaacgttggacaactactgcttcaacgtgcagagtccggatttcgccggcagcttcgtcgtgctgtccaacaccaagtgcaacggcaactacgacaacgtacagacattccagcccgatcccgccgtcggcgccggcgcggccggaccggccaccaggcagctggtcaactatcggcaattcgggcgctgcctggacgtgaccaatcagaacgtcgcctcgacctatctgatcgcgtggccatgcaaacaggcgccgaaccccgcgaacatcagctggaaccagaaatggaccctgccgcccgccgtcaacggcgcacacacggccaccggtcgcatctacaccaccctcaacggcaccgaatactgcctccgcagccccggcgtcaccagcggcgcatatcccaccatgacgacgtgtacgagcacgtcctccaccgccgatcagacctggaccgtctacggcaacaccggcagctacacggcgagctatcagatcgtcgacaacgccggcctctgtctggccccggcagaccctacggcgtacccgaccgaggtgttgccgtacaccgggccaacagtgagccgcatcgtccttcgcacctgcgacggctccgcctggcagaagtggaacgccccaccagacgtgtccaaaccctcaccactcaaacaaatcaccgagcgttag

SEQ ID NO: 7691 - DNA, 699 bp, Actinoplanes utahensis
atgaaggccataactatgcagctgaaccacattgttcgcggcgcggcaagcatcgccctcggtgtctctgtcgcgctggctctgaccgcgcccgcgtgggccggccgctcgaaggacccggccggcgccaacggcacagtgaagatcgacgcagttccgttcgatcctaagatcagtaataatccgcacgtaacgtgcgagttccgcgtgaagttcttcaacttcgacaccaacgagcatggcaacatcgtcttcaccgcgcagccgccgagcggcaagggtaccgagctgctgcgtcagaacaatgtgttgctcagcgacgacgcggcaaagggcggcgcgccggatcccgacgagatctacacgtactccgccggcgacctgaaactggacgggttgaagctgcagcccaagcagggctaccacatcaagctcacggttgagcggatcggcgcaccgggcgccggcaagcacaaggtgttctggctccagccgtgcgccagccagaatggcggtggatcgagctcgacgccggcctcggcaccgtcctcttcgtcgtcgaatccggtacctgccggcaacgagagcgcgctgcccatcaccggctccgcggccagcacggtcgcggctgtcggcctggtcctgatcggcagcggcgcggcgctcaccatacggcgccggcgcaagttcaccgcctga

SEQ ID NO: 7692 - DNA, 723 bp, Actinoplanes utahensis
atgcgcagcaccgggcctcgccggcggccaacacgaacgctcttgctgtctgtccgcgcttcgctgggaaggttgttccacaacaccatgacgtccacttcagtgccgccctcgaaccgctggcgccgagccctgctcgccggcgccgccgcctgcgccgctgccctgctgtccgcatgcagcgacaccaccaccgccggcccggccggcgccccggaaagcagcccggccacgaccggggcgtcgaccgcggcgttcaacgccgccgacatcaccttcgtgcagcagatgatcccgcaccaccggtcggccatcaccatggccgccctggccgccggccacgccggtgatccccgcgtcacgcagctcgccacggcgatcaaagccgctcagcaacccgagatcgacaccatgaaccggtggctgcgcgcctggggcaagcccatgcccagcgccggcagcgacgcgggggagggcatggagcacggtgacatggccggcatcgacgaactcgacatgacggcactgatgaacgccaaaggcgccccgtgggacaagcagttcctcggggtcatggtcaaacaccatcagggtgccgtcacgatggccgagcaggaactcgcgcaaggcgtcaacaccgacgccaggaccctggcccagaagatcattaccgaccagcaggcgcagatcaccgcgatgaagcagatccgcgccagcctgtag

SEQ ID NO: 7693 - DNA, 672 bp, Actinoplanes utahensis
atgttgcgtacctccatgctgtcttcccccacctggcgccggggcctgctggccggcgccgccgtgaccgccacgctcgtgctctcggcctgcggcgggaacgacacctcgtcggattccggcatgaatcacggcggcatgccgacgaccacgaccgcttccgcggcggcgacggcgacgttcaacgacgccgacgtcatgttcgcgagcatgatgatcccgcaccaccagcaggcggtggagatggccgcactggccgacggccgtgccgccagcagcgaggtcaaagatctagccgcaaagatcaaagccgctcagcagcccgagatcgacaccatgacgcagtggctgagcgcgtggggccacccgatgccgatgagctcgtccggcatgccggggatggacgcttcggccatgcccggcatggaccacggcgcgatgcccggcgctatgtcgccggccgatatgggcgcgctgggcaaggccaagggtgccgcgtttgacaagcagttcctcaccatgatgatcagccaccacgaaggtgccgtcagcatggccgagcaggaagtcgcgcagggttccaacgctggcgccaaagccctcgccgagaagatcatcgccgcgcagcaggcggagatcaccactatgaagggcctgctcagcaaaggctga

SEQ ID NO: 7694 - DNA, 450 bp, Actinoplanes utahensis
gtgggcgccgtgatcggcgcaaccgcggcagggatcgggcgtggagcccggacggtgctgttgttgtgcaccgtgttcggcttggcggtgatgcacaccctgggccatgccggcgtccgtgtccaggatcgtggcccggtgtcgatgaccgcgatgtctgcggtggtgagcgtgccggtggtggcgttcgtggccgccgccatgtccggggaatgcccggatgatcattgccccggcgaccacgatcacggccacggcgcgtggagtgtgtgcctggccgtgctgggcggtctcgccgtggtcatcctgctggcgatgatgctgctggccgtcgcccgccccggcctctttccgggaggcctcggcgcgtcgcagcggcgtgccagccgggcgccgccacccaccggtaccggattgaccctcgcttcggcagcggtgctgcgcatttag

SEQ ID NO: 7695 - DNA, 552 bp, Actinoplanes utahensis
gtgaggttcggtgcgcaggatgcagtgcgcgccgatgatctggctgcggacggtgaggggcgcggtggcaggccgatgaccctcacccgccggttcaccgatgcactcggagccgcccggccccgtgtcggccaccgccgtatggcagctggcgtgctgctcgcaaccgccatcctgcaggcggtcagtcctttgttcgtgggtttcgaccagggcgaggccaacgatcctgtccttgtgccacccggcccgttcttcgggatctggggagtcgtcatcgcaggatctgtcgcccacgcggtgtggggactggccgaccggcggtccgccgtggatccgtaccgttcggtgcagctgccgctgtccctggtgcacgtactggtcgccgcctggctcctggcggccgagcacgcgccttgggcgactctgccgatcttcgccatcatggtggccgtcctcgtcgcctgtctgcgcgccgtgctagcgagttccgagataccgcgggccacccgctggctgctcggcgggaccgtgggaatctacgccgggtaa

SEQ ID NO: 7696 - DNA, 231 bp, Actinoplanes utahensis
ttgcaggccagcgccatcgccgcggcagccgcaatgagttgcatcatcatcggattcatcggcggatggccgccgtacgttgctgccgcggcctgggccctcaccggagtgaccctcagcggagtccggttccacacaccggccatctgggccacggccgcagtcgggctgcttgccgtcgccctcaccacccagcgctcgatcaagagcgggcaccgtcccggtacctga

SEQ ID NO: 7697 - DNA, 159 bp, Actinoplanes utahensis
gtggccgggcggaagctgatcgactcgcggccggccggcgcggagcccagactgctcaccggcgatcacgcgctgctcggcgccctggacggagtcgccaaccagctaccgccggttgtcgccgacctacgtccaggtctcatgggacggccagcctga

SEQ ID NO: 7698 - DNA, 450 bp, Actinoplanes utahensis
atggatcagcccttggtcgtcgtcgccgaagacgaccgcgacgttcgtgacttactcaccttcttcttggagaaagccggataccgcaccatcggcgcccatgacggcgctaccgccgcgcggctgctgacgactacgcgacctgcagcgcttatcaccgacgttcacatgccggacatgaacgggatggatctgtgccggctggcccggcgcaccttcgccacgcaggacatccccatcatcatgttctcggccaacactcaccagcacgacatgcaggccggcataaccgccggagccgacagctacctacccaagccgctgtctccgagcgcagtcgtttctcggctggacgagctgctgtcggccgggggtttacgccggcgtgacgacgtcccggcgcacacccgcgccgccgtcggaggcgttttcactctggccggaagctag

SEQ ID NO: 7699 - DNA, 780 bp, Actinoplanes utahensis
atgcgtctggccgtcaaagctcaagctggcggccgcgacttcggtaggacctattcctcctcggcgcagggcgacagcaatcaggcccatgacgcggatgccgggattacgcttgagcaccgtaaacgttcgtcgcagcctttgaccggactatcagaatcggctcaacccgtgggcaaaacgcttcgccgtcgcagggccaagaccgcgcctgcatcgcgcctggtcgtgctgctggtggaagacgaccccgacaatcgggagatcaccgcggcgcagctcacgtcacacggcatgcaggtgatatgcgccgcgaacgcagccgaagccgtggccgcctgcggagcccacaccggcccgatccacgtcctcctgaccgacgttcaccttcccggcgcgtctggcggcgagctgaccaacttgatcaccgtcctacggccgcgcatacggacggtttacctctcgggcatacctgcagacctggcgacccgcagctaccgactcgacacccgtgctccgttcctgaccaagccgtacagctccgatctgctcgtgaacaccatccgccacgtggcagccggcattgccgaagtggtcaacgaagattgtcaatgcgccacgtcgaagccgaccggtagtcagaacgaaaaatgccacccgcatggcgcatccgcacaggaccgcgcgccggaccagggtatgcggtggcctcgacgcaaaattgctacgcctcggcgcagagcaccacagcctcggcgcaaagcacacggctctcgttga

SEQ ID NO: 7700 - DNA, 1587 bp, Actinoplanes utahensis
atggccccgaccccggcgttgccggttcccatcacgcacatcgggccgctgcggcacctggcagtacatccccaccggctctactcacttggccggttcgacgaggcgctcacggtcgtcgaaaagaacaggtggatcgccgaggcgctgggtgactcggatacggcacgcagcgtcctgcagacccggctgtacgtgttgactgaactgggccgtctcgccgaggcggaaacccttggctggcacctactggatcacgccgcctcccgggtggctcaggcaaaggccagcgccgatctcgccgacgtgctcgtacgaatgggccgcctcgaggagggattgcacctgctcgccgcggccctgaacatcctggaggggtgtccgcgggactggcgctattttgccgcgatgtcctccgtcgtggaagcggctcgctgggcggatctgtacgaactgtccgacgcggcagccgtcgcggacccacggtggctttccgccgatcccatcctggacggccagcgcgccgagatgcttctggaatgggctctgcggctggagcacgtaggttgccaggatgaggcgaccgcccgctatcagtcggtgatcgcgttgacccggccgtgggtcgaccccgggaccacgaccggccctgatgcggatcgcgccttggtctccgctgtgctggcatgtgcgctggccaagaccggcgcgatcgctgaagccatcgagttggcggaagcggtgatccctgttctgcgttctgagggacgcttgttcgatgctcgactggcgcatctggcctacggcgttgcccttcgcaaccgcggtgagtacgaggccgccacccgagagctgatcgccgctgagcagtcgtgtgctggttctggtaccagtgctggtgcgccgcggcatcgactgattttccaattcgagttggccctggtcgacttggaggccgagcccggctcggcgagcggacgcctgctctccgccctgcgggggcatgccgagcaactctggcggctgcggatggaccgggtcgcgatgctgcgccaggcccgccatcggctgcggcttgaggccgctcacgcctcggcggacgccgccgcgcagaccgatccgctgaccggcctggcgaatcggcgcgggttcgaccgacgactcgcgacggtggacaccgatccacaggcggcaactgaccccctgtgcctgctactggtcgacctggacaacttcaagcagatcaatgacggcttctcgcacgcgatcggcgacgctgtcctacaggagatcgggcatgttctgcgaagccagagccgggcgtgtgatctgcctgcccgattcggtggggacgagttcggggtgatcttcgcagccgacccggagacgagtgtccggatcggggcgcggatgtgcacggcgatcaggaaccacgactggcagcggatagccccgggtctccgggtgaccgtgagcatgggtctggcaccgttgcagcccggcatgagcagcaaggagctgttcgctgccgccgacgatcgcctttatcaggctaaacgaggtggccgggaccggcttgcatcctag

SEQ ID NO: 7701 - DNA, 2148 bp, Actinoplanes utahensis
gtggttcccacgggtggcgcggtcccgaccggggtggcggaccctcgccggttggcggtcctgcgggctaccggtctgatcggtgatcggtcgttttcggggctggatcgacttactgcgatggccagccggatgctggaggcgccgatgtcgctggtcacgctggtggaccaggatcggcagtggttcgccagcgccgtgggtctgccggagccgtgggccaccgagcggcagacgccgctgacatattcgttctgccggtacgtggtcgccaccgaggccccgctcgtggtgatggatgcccgcgctgacgtgggtctgtgtgacagtaaggcgatcactgagctggggatggtcgcctatgccggttatccgttacgggctccgggcggtgcggtactgggcgcgttctgcgtcgccgacagccggccacgccgttgggagtaccgggaactgaccctggtgggcgatctcgccgcgattgctgccagtgaggtggcggccctgctgggcgccggggagctggcggtggcgcatcaggacgctgaacagcagcgagcattcttggaggccctgctggacagcctggacaccggggtggtggcatgtgatccggctggccggctgattcggttcaaccaggcgctgcggtacgcattggacgatgacgcggatccggcactgtcgccgaggcagtgggcgcgccggttgcgggtgctgcaccccgacgggcgtcgcttcaccgccgaggagatgccgctgttacgggctctggccggtgaacatgtccgcgacgtcgagcatctggtggtcggtcgcgatgatcaacggctggtgttccgcaccaacgctcagcgcattgccgggcctgatggcagcgtgctgggtgcggtcgcggtctcccaggacatctccgctcagtaccgcaccggccggttccgcgacgcggaactcgcggtgcatcgcgcgttcatcgcctccaccgatcccgccgacgcggccgcagcggtagtgcaggccgtcggtaccgcgctcgactgggcgcacgcggagctgtggctcgccgacgagttgagcgacatgttgcatccgatcgccacctggaccgatccgcagcgtccggccgtgcacgtgccggccagcctcggccgcggttccggcctggccggaaccgcatggcatgagcagcagccggtctgggtgcccgacctcgccgccggcgcagccccgatgactgccgacatcgtcaccggctcccggctacgggcagcgctggcggtgccggtacgcggggcggatcaggccctcggcgccctgacggtgttcgcccccaccgccgagaccaaggacagcacctgcgtcaccctggtcgccgggatcgccgcccaggtcggcgcttttctgcaacggtgccgcgccgacgagcttcgccgggagctgatccagtcgaaggacgaatacatcgccctggtcggccacgaattacgcacaccgctgacttcgatcagcgcgaacaccgaactgctgcgcgacaccgacgacaccaccgcattcggagaggtgcgggatctggtcgaggtcatcgatcgcaacaacagtcacctgcttgcccttgtcggggagcttctcgacctggccggcctggattccggccatacgcaactgcatatcgcacccgtcgacctcgccgcgctggtcggcgaacgtgtcagcgccgcccggcccggggcacaggcggccggcgccgacatccgggcccgcatcccgccgcgactcaccgttgccggcgacgaggcacggctgcggcaaatggtgggcaaactgatcgacaacgcggtcaaatacagcgtgcacggcggccccgtcgacgtcgtcctggtcgacaatgacggcgtcgccgaactggacgtcaccgacaccggcatcggcatccccgacgacgaacgggaactggtctttcaccgtttccaccgctccagccgcgcccgtacccacggcatcgccggcacgggtctgggtctcgccctgtgccggacgatcatcgagcgccaccatggcacgatcgcggtttcccctcctgccgaccgttccggcagcggtacccggatcagcgtccgcatccccgttgcggcaggcagcgcacgatga

SEQ ID NO: 7702 - DNA, 465 bp, Actinoplanes utahensis
gtggtggtgccggttgcagccggcagccacgatgatgccgtgctcgacgtcaaccggctgggaccggtcctgccccgggtccgcatctctcaggacgggctcctgctgcgcccgtggtttcgacgcgcgctgctggtgccctgggcgaggatcaaaggcgtacggatcacgcccgcggatcgatggtcgggcaagaatgctgttcccggaggccacggctactacatggttcagatcaagctggccggcgactggcggcgggtcggtcaggctcttcgggtacgacactccctcctgccgctggtggtccgcgagcggctcttcggcgagagaggctcgtggtcctcgcaagaggtgatcttgttcagcggctacgagacgatccggatattgtgggagaatgcgggcggtgagtccggggacgaggatgacaactggccgcggatcaagcctgctgaagggtag

SEQ ID NO: 7703 - DNA, 468 bp, Actinoplanes utahensis
atggcaacgatcctgatcgccgacgatgagcccgatatccgcgacgtcctgaccctggtcttgaaccgggcgggacatcgggtgctcgccgtcggggacggactcacggcgctgcgggtcgccgagcgcgagcttcccgatctcatcctggcggacatgagcatgccaggactcaacggcgccgagctgtgtcacgcgatacgccggcaccgcctgctgagcacggtcccgatggccatcctcagcagcacgctgcacttcgacgacccgcggctcgccggcatcgacgcctgctcagtcctgttcgagcccatgaccaacaaggatctcgtcaaagcggtcgagcatctgctggcggatggaccgcatcgccacagctccgaagcggggtccctcgaggagcgtcctccgcaataccgggtaccccgcctaggcagatccgatccctctcatgtccgccagacgtga

SEQ ID NO: 7704 - DNA, 531 bp, Actinoplanes utahensis
atgacccggtcatctgctggattgctgcggttggttttgcggggcatctcttggcgtgcttgcgtaatcttgaccgtagggggcaatagctgtggcatgaacgggtggatcacggggcgtcctcctgctgtcgatgaggtaatcgcccgttgggatgtcgagcgtccgccgcagctgcaggatctgcgccgcgagttgcaacagttggtgagggccggccggatcgcgacgccggcggacgcggatgacgtggctgagcggttggtcatcgtggtgacggagttgacgagcaacgcgctgcggcacggtcagcctccgacgatcgtgatgctgttccgctccgatggccaggtcatcgtcgacgtggtcgatcacgacgagaacagtgtcccggccgtcgaccggcatcgggcgccggcgcgcggaggcttggggctgcaggtcgtccagcgtctggccgtggcagtcggctggtacgccgcagaccgtgtcaaacacgtctgggcatccttgacgctgcggacgcattga

SEQ ID NO: 7705 - DNA, 4518 bp, Actinoplanes utahensis
gtgacccggtcgtacacggatccgcggctgcggctgaccgaccggatctgccggatgggtctgcaggactggatgttcgggggcagcggaaaacgtctcgcccgggcgctcgccgcggtggaagccgggttcgacagcccgcccctgggacggccggtgatccgtcgctaccgccgtgcgctccgactggcgctgcgggccaacccgcgggaggccgtgggcctggtcagacggtacaacgccaggattcccgcggaccgctatcacgaggcatttcgtaccggggacgcatgctggttggccgctcatgtagccgacggcgaccagtacgcgttcgccgcggtgctggaactggcgaccacgctgggcctgcccggcctgcagcatcacgcccgggaccggatgtccgccgtgctcggccggtcggccgacgtgaacgaggtcatcgggcagctgcggcgctggtcgcagctgcagctgctggaccgggacacggcgacccgggtgcttcgcgcgtggctcgaccgcacgccgctggagcgcgacgaccgggtgtggcaggcgttcttcggtgagctgccggagtcgcagatgccggacctcttcgaggtgcgctgcttcgtcggccggggcgccgatgccgtgcgtctggccgacggcagcgtgtcccggctgcgcgccgcggtggacgtgtgtgcccgctcctcgtcggtgatcgacgtggacgccggtctggccgcggcgcgccaccagcgctggagcgtcgaggtccgcaacctgctggtgcgtcgaggcgatctgctggtggcggaccggctcttcaacgaggccctgctgtcctatcaggaagccggccggaccgatcgggtgagcgagtgccacgagtggcggggccgctacggcatcgcgttcgacacctgcccgttgcatctgaccgaccggctgatccggctggcggcgcggtgccagaacgatgtccacgacctcgccgaccggggtgacttcgtcggtgccatgaaccgggtccgggccgtgctggaccggctggatctggcggctcactccgcggatgtgctcgaacgcgcgggcgcgaccgacgtcgtggcacggtgccaggcggcggtggcggaacagcgcgacgagatccttcacgccggccggttccacttcggcgccacgaccccggtcgcccacgccgcgtggagccgattcgaggaagccgccggtgatctcgtgatggcggcccaacaggccgaagcggctcaggagtcgcttcgggcggcccggctctatcgcgcctgcgggcagttcggccgcgcggaacggatacaccagaatgacacgagcgtcgaggcgctgcgggacagggccgagacccgccgagccgcgggcgacgctctgggagcggcccagatcctccaggagacggctgatctcgacgccgcgatcgatctctacatgcaggcccgggagttcggtgccgcgatggcctgcctgcacctgctgcacaccgacggggtcatcgaggacccccgtaccgtcgcctgcctgcgcggcgccggcgactatccggaactggtcgcgctctgcctgcggtcgctggcggccggcagccgaccggcgcgggaggaattgcggttgctgcgcgccgatccgatggtgccggccgccttgcagcaggacatcgacgccgcactcgacgatctggaggcaggcaagcgcgaggcgttcgaacggctcgcccccggctgggtcgcgaaggccagggaggagatcgaccgtcgtttcgccggcatctggggactcgaccttggcaccagcacttgcgcggtggccgtgtttgacaccgcgaccggccgcgccgtgctctgcccgacggaaaccggtgagcatctgttcgcctcgaccctgagcctggacgtgcacggtgacgaactggtcgggctcgccggcgagcgcctgctcaccacccgactggtcggtcacatcgccgcggccaagcgcgcgatgggcaccagccggagattttccatcgccgaccgggagtaccggccggaggaggtggcggcccggctgatcgcacacggtcgtacggtggtcgaacgcttcctggccgatcgggtcgccgacctggtcgccgccagcgcccgggcggagttcggggtcgtacccgatgagctgctcgcccgggcagcacgggaacacgacatgcggctgtcgcgaccgcgagtgctggtcaccgtgccggcctatttcaccaacaaccagaccgcggcgacccgggcggcctgctcgatcgccgatgtcgagccggttctcctgctccgtgagcccaccgcggcctgcgtcgtggcctccttgcagcaccatctgaacggcgccgtggtcgtgatcgacctcggcgccgggacgctggacgcgagttatgtcgaggtctccgacggggtgcaccgggtgcggcaggtccaaggggacacccggttcggcagcatcgacttcgaccacgccatcgtcgaggaactcgtcgcccggctcggccgtcaaggtatccaggcaccggcgagcgggccggcccggcaacgactcgaggtcgcggccgagcatttgaagatcacgctgtcctctgtctcggaggccgaatacgtgctggtcggcttcgccgacgagcggaacgtcacgctgaccctgtcgcgaaccgacctggcctctgtgctgaccgccccgctgggcagactgcatcgcctctgcacccgattccgggacgagttgccgaggtcgccgcaccatctggtgctggttggcggtccgatgcgttcgccactggtgcgcgaactggtcgagaaggtgttcgggctgagcgcgaccgggatccaggacccccgcaccgctgtcgcgtgcggggcggccctgcagtccgctgtcatcgacggcaagctccgacaacgattgatccacgacgtgacctcgttgtcgctggggattcaggccgccgacgagaacggcgtggtggggtactcccgcatcatcgaaggcaactgcccgattccggtgacccggtccgcgatgtacacgactcaccgcgaccgggcgacgggcgtccggatccaggttttcaacggcgcggtcgacagcggctccctgatcggtacgttctgcctcgaaggcctgccgccggcaccccggggggtgccgaagatcgaggtcaccttcagcatcgatgagagcggtgtcctgaaggtgacggcccgggagatccagaccggcatcgtcgcgagcatcaagatcattgacagcaccctgctggcgcccagcgaggtcgacgcgctgtcccgccgccaccacgagctcgccgttcaacaggagctccgtcatgccggggaccggcttcgccgggagctgcggacgcttgtggcgaccgtcgtggcgcgcgacgtcgacgcggcctggcaacggttctgcgaacgcaaggcggcacaccggccctcggctcgtgccgacgccggtacgcagcagatcctcatcgaggtgttccgggacgcgaaccagaccagcatcgacctcgacctggtccgggtgccgctgcgcgatctgctgaccaacgcccagcagtacctggaccgtccggctgccgccgaggaccccgccggcgacctggccaccggacagcacctgctgcacgccgtccagcggcatctggcgcggctggatccgctactggctcgcatagcccggtggaacgccacgctggcccagctgaccatggccgaccccgatccgctgcgacgcttccgcgatctgcacgacacccgggaattcgtccgggcactcgactcgctgcgcacccacggtgtgccgctgaccgacgccgcggacatcacccgccacctgaggtgcctggccgagaccggagatgcggaggcgtaccgccgggtcctggtcgcgaacgccgccggtctcggtctcgtgctgcccgacccggaccggccggaacgattcctggacccgctgcgggacacgctcgtgcgggtcgacgtcgcccggcatccggaccgcaccggttgctgcggcgtactcgtccgcaacgacctcgtcctcgtccccggagggctcaccgagcacacgacaccggccgacgtcgagatcgtgggcggtgcgggaccgggtccgctcgtaccggccgggctcctgacctccaccggcggcggtccggcggcgatccggctcaaggccgcggccccgatcggcccgatccggctgggccacccgaagttgcttcgcgtcggcgaccgggtgtgggccgtcggcggtcccggttccgctccgttcaccgccgttcccggcttcgtcaaccggttcgggccgacctgcgggagcggcccccggacgctcgcgatcgagatcccggggccggtcacggacggcccgctattcaacgacctcggcgagcttgtcggcctccgctccggcacctcggcggtgcaggtggagagcctggagtcgttccccggtccggcctga

SEQ ID NO: 7706 - DNA, 585 bp, Actinoplanes utahensis
gtgggctcttctcgagcccacctcggctcagtggcgagaggggtggtccggtgggcgctcggatcgggcgaccctggccgttcatacgaccctgtccggggctgtccgatccgaccccggtctggtcatagttgtccggaggtttcgagcgtcctgatccaggacctgtcgaagggccaccgggtggagcttgacattctggccatggcgggagctgccgcattggtgcaagcggcgaccaccgaagcgtggggcacggtgagcagacaggtcgccggggtgctgagccggggcaaccagagccggcgggcggtgatcgagcatcagctcgtgcggacccacgaggtcctcggttcgtcaccgggcgaggagtcagccgccgccgaggaaaagacctgggcgatgcggttggcggacctcctcgcggagcgaccggagagccggccggaactccaggaactcgtcgacaccctgcggcccccgcagtcgggcgtgacgatcggtgatcatgcattcgtcgtcatgcagaatcacggcgaggcgcaccagaccaacaacttcggaccctcctctccgtcccggtga

SEQ ID NO: 7707 - DNA, 1881 bp, Actinoplanes utahensis
atgagctggctgtcgaagcgtcggtatgaaaggcgcttactggttacggcgatcaccatcgtggtgctggtggccgtcgttgtattgggctactccgtatcctaccggcaggaagccatggccggtcaggcacagcgggcgcagcggctggctcaatccgcacagcaggtgaaattccgggcggccgatttcaacggctggcagacggcatacgcattggacatcatccgcggcgagccggaagccacggccgatacctcacccagccgtgcgaaattcctcgacgcggcccagaagttcgacaaagatctgggagccctggaactgttgtccacgtcgtctccggcggcaccgaccgtcgatgccgtcaggagggcgttcgagcaattcatgaccgtggaccggaaggtcgtggagctgtaccgcaccggcaagccggcggaccgcagggccgcctccgaactcgtcctcggccaagagatcaaactctacgggcagatcgccggcggttgtgatgccaccgccgcgctgtcggtctcggcggaggaaaccagtctcggccggctcgacgcggtgggagccgccacccggcgctacatcctcatcctgagcatcgtcgccgccgccctgacggtgctcggtgccatcctcgccgaagcgcgacaacgagcaatcgagcagcgagccaaagaggctcagcggatggcgagcctggggcacctggctggtggcatcacccacgacttcaacaacgtcctggccatcatcctcaattacacggacttcgtcgccgagaacgcttcgcccgagacgctgcatgacctcggccagattcgcaaggctgcaaaacgggcggccgggctcaccgcgcaactgctcggcttcatccggcacgaggccatccagccgcagattctcgacatcaacgccgcgatcgacgaagcgcaggccatgctcgcccgcactctcggcgaacacatcgagctggtggtgatgcgctcccccgagcccgtcaagatctgtgcggacgccggccagatccaacagattctggtcaacctcgccgtcaacgcccgtgacgcgatgcccgacggtggcaccttggtgatcgcggccggcgccgtggacctcgaggagaaccaggcgaacgtccacccaccggtggcggccggacgttacctccagctttccgtcaccgataccggcaccgggatgcctccggaaaccatagcccgcatcttcgaaccgttcttcaccaccaaaccgaaagggcacggcaccggactcggcctggccaccgtcctggacatcgtcaccaccgccggcggcagcatcgacgtctgctccaagttcggcctcggcacgaccttcaggctgtacttccccagcgtcgacgtgccgtacggcctcgcttcggcacgtcgcaccgatgcggcaccgccacgtggacacggcgagagcatcctggtcgtcgaggatgaaccggcgctcgccgcgagcgttgctcgtattctcacccacggcggatatcaggtccggtccgccgtcagtggccccgatgccctggctgcctacgcttgcggcggctgcgacctgctgatcgccgacgtggtcatgcccgacatgtcaggctcgcgcctggccgagatcctgcgtcgcaccgacccccgcctgcccgtgctctacatctccgggtacatcgacggcaacctcggccccaaccgtctgtgcaaaaccgacgctacggtgatcgagaagcccttcactgcggaccacctcctcaccgcggtcggcgacgcgctttcacgggcaccggaaagcagcggcatggcaggcgaatctccacagccggccgacaactacccgcatacgtcggcttga

SEQ ID NO: 7708 - DNA, 483 bp, Actinoplanes utahensis
atgaagagcattactcgtgtgctcgctgtgggcggcctggggctgggtgccgctctggtgatcggtgcggggcccgcacaggccgtcgacgccacggcccagccggccgtgcacggcgggtcggtccaggccgtcggccactgggacgacagcgacgtcgtgggatatttccggacccggttcgggtgtgagcgggtcggccggctcggcgagtaccacggtcgctgggatgactacgactgctcgcgggtgtggtccgggttcaaccgcggcgcctgggtcctggaggtcgccaccgacgactggaacggcgactgggacgacgacaactggtaccacggctggtacgacagctggcacggcggtgactgggaccgtggtggctggcaccgcgatcacggcggctgggacggccaccaccgggacggctccgcgaaggtggcggtgttcccggtgaattccggcgcccgatcggtcagctga

SEQ ID NO: 7709 - DNA, 639 bp, Actinoplanes utahensis
atgctgaaggtcttggccaccggagccaccctgctcgcctcactggccggcaccggcacggccgcgcacgccgcgccgtccacgatcgtcccgggcgaggacatggccatcaccgtggccgccgccaacggcagcggctgcccggagcgcagcgcgaaggtcaccgtgtcgccggacaacaaggcattcaccgtcacctacagcaagttcacggcccagaccggccccgacgcggggcccaccgactttcgtaggaactgtcaactcgccttgaacgtgcacgtcccacagggttacaccttcgccatcgccggtgccgactaccgcggttatgcccacctcgagcgcggcgccaccggctcggaaagcgcgaactactacttccagggtgagccgcagtccacccgcatccggcacgacttctccggtccggccgacaccgactggcagcgcaccgacaccgtgggcatcgggtcgctgtcgttcctgccctgcggcgaggaccgctacctcaacgtcaacaccgagctgcgggtcaaccgcggctggtccagccgtaccgccaccagcttcctgaccatggactccaccgacgggcgcatcgacaccgtctaccacgtcgcctggaagaagtgctga

SEQ ID NO: 7710 - DNA, 1926 bp, Actinoplanes utahensis
gtgcagccggcgggcgggctggcgcagtggatgctcaagcatcgcgtgcagccggtgggcccggccgcgggtgaggcgcacgctgagcagcacgcctggtggaaggtgatgtgcctgaccggcgtcgactacttctccagcctcgcctacgtgccgggcatcgccgcggtggcggccggcgcaacctcgccattggcgaccctgctgatcgtcgcgctgaccctgttcgggatgctgccgatgtaccggcgggtcgccaaggagagcccacacggcgccgggtcggtgcacatgctggaggaactgctgccgttctggcgcggcaagctgttcgttctggtcctgctcggcttcgtcgccacgagttggctcatcacgatcaccctgtccgcggccgacgccagtctgcacctgctggagaacccgcactcccccgccgtactgcacgggcacggcgtcgcggtgactgtcgtgctgctgctgattctgggcggggtgttcctgctcggcttcagcgaggcggtcagcgtcgccatccccctggtcgcggtattcctcggcctcaacgccgtcatcatcggcgccggcctgatcgacatcgtcaccaacgcgtcggcctggtcggcgtggacgtcggcgctcacctccggcggcggcggattcaccgccctggccggcccggctctgctggccttcccgttgctggtgctcgggctgtccggtttcgagacgggggtgagcatgatgccactgatcgccgccgacggcgccgatcccgaacagcggctaacctcgcggatcggtaacagccgcaagctgctcaccgccgccgcgctgatcatgagcgtctacctgatggccagcagcttcgtcaccaccgtgctcatcccggccagcgaattcggcgacgggggaaacgccaagggccgcgctctggcgtggctggcccacgaacgcctgggcgaggcgttcggcaccgtctacgacatcagcaccgtgctgatcctgtggttcgccggcgcctccgcgatggccgggctggtcaacatcgtgccccgctacctgcccggctatggcatggctccggaatggggccgtgccgtgcggcccgtggtcatcgtctacaccgtgatcagcatcgcgatcaccatcgcgttcaaagccgacgtcgacgctcaggccggcgcctacgccaccggcatcctggccatgatggtgtccggcgcgttcgccgtcaccgtctcgaccatccgccaccgcaagcgtccggcagcggtcggcttcgcgctgctcaccggtgtgctgacctacgcgttggtcgcgaacatcatcgacaaacccgacggtatcgccatctccgcgatgttcatcgccggcatcatcaccatctcgttgatctcccgggtcgcccggaccaccgagctgcgcgccgaccgcatcgagttcgacgacaccgcccgccgattcatcaccgacaccatcgaccacgacgggcagatcaacctgatcgccaaccgccggcaggccgggaacgccgccgagtaccgggccaaggaacgcgaacaacgcggcaacaaccccgtgcccggcagcgccgacgtcatcttcctggagatcgacgtcatcgacccgtcggacttcagcgagaccctcgccgtgcacggcgtgcaggtcggcccgcaccgggtgctccgggcgcaggctccggccgggccgaacgccatcgcggcgatcctgctcgccctgcgcgacgtcaccggggtacgcccgcactgctacttcgcctgggccgagggcagcccgctggtgcacatgatccgctacttcctgctcggccgcggcgataccgccccggtcgtccgcgagatcatccgggagaacgaacccgacccggcccgccgacccggcatccacgtcggcgcatga

SEQ ID NO: 7711 - DNA, 1443 bp, Actinoplanes utahensis
gtgagtaaagacgcaggtgtcgccgttgacgggcacgggttcgtagtggtcgccaaccggctgccggtcgacgaggtgaccgacaccgacgggcagcgccgatgggaacgcagtcccggagggctggtcagcgccctgcagccggtggtgcgccagcagggtggtgcctgggtgggctggaccggcagcgccgggaccgagaccgaacccttcgacgtcgacggcatgtacctgcggccggtgtcgctgagcgccgacgacgtcgaccgctactacgagggccagtccaacgccaccatctggccgctgttccacgatctggtcgaacaaccgactcaccgccgggaatggcgacaggcgtacgaggcggtgaaccgtcgcttcgcccaggccgccgcggacgtggccgcaccgaacgcgaccgtgtgggttcacgactaccagctgctcctggtgccggcgatgctgcgcgaactgcgccccgatgtgcggatcggcttcttcctgcacatcccctttcccccggtcgaactgttcatgcagctgccacgccgtcgtgagctgctgcgtgggctgctcggcgccgatctggtcggcttccagggcgccctcgcggcgcagaacttcctgcggctgactcggcagctgctgggactggatcccgaggacgaccgcgtcgaggtcgacggacgtaccgtcgtcgcccgggctttcccgatctccatcgacgtcgccgaggtcgaccaactcgctgccgaccccgcggtgcagcagcgggctcaggagctccgagcggaactcggcggtcaacggcgactgctgctcggcgttgaccgtctcgactacaccaaaggcatcgaacagcgcctcgaggcgtaccacgatctgctcgacgacggcgagatctccaacgacgacgtggtactggtgcaggtcgccacccccagcaggcaacgcatcacccaataccagcagctgcgcgaaagggtggagcgcgaggtcgggcgcaccaacggcgaatacggccacatcggccgcgtgccggtgcactatctgttccagtcctatgaccgcgctgaactcgtcgccctgtacctcgccgccgacgtcatgctggtcaccccgttacgcgatggcatgaacctcgtcgccaaggaatacgtcgccgcccgccgggacgagcagggagcactcgttctcagcgagttcaccggagcggccgaggaactcggcgacgcgttcctgaccaacgcccacgacaccgacgacgtcaaacgcgccatcctcgccgctctccacgctgaccccgaggacttgcgcacccggatgcgccggatgcgcgagcaggtgcgcgcctacgacatcgactactgggcccgggacttccttggtaccctcgcaccgtctgaggctcctcagctcgcaacagcgccatcggtgtag

SEQ ID NO: 7712 - DNA, 732 bp, Actinoplanes utahensis
gtgacgaccgacgtctcaatagacgtcaacaccgatcaacagatgggcaaaaacagcatgcgtgagaacgacaaccggcagcagtcatccggactgaacgagatcagaactccggaatcgtccgcggtcggggagctctcccgtacgccgaagcggcgtcgtcgcgctgtgcagatggccggcggcgtcgccgtcggggccggtctgctcgtcggtctggtgggcatgccggcggccttcgcgtccgcgggatccaagccgccgcacgtcaacccgaccagcgatcccggcgatccggtcgccccgaactgtacgagcgccaagctgaagatcactatggatccggccgagggcgccaccggtcacagcatggcacgggtgcacttccgtaacaacggaaccacctgctggttcaggggctaccccagcgtcgtcgcgtacaccgcgtccggcgccaaggtgcccgtcgcgcagaccccgcggggcttcgccggcggccaggcaccgggttccgacgagatctcgccgctcctgctggagaagggcgacgtcgtgtcggccgtggtggaggcgctcaacgccggcaaggacggccgggcctgcacaccggtgaccaagctgaaggtcagcccgccgcaccagagccggtcggccaccgtcgcctggagcggcgggtgcgccgacttccaggtgcacccggccttccggggcaccaccggccaggagagctga

SEQ ID NO: 7713 - DNA, 2184 bp, Actinoplanes utahensis
atgacgaccggcgccgtgttctgcgtcgcccttgccgttcttcctgccgactcggcgccgagccggctcatctattacatcatcggcgccgccacggtgacggcgatcctgaccgcggtccgccggtaccgtccggccgacgcccgctcgtggtacgtcctgacagccggcatcggtgccttcgtcgccggcgacgtgctgttcgaggcgatggtcgcggtgaccgggaaacatctgcacctctggtacaacgacggcctctacctgctgggctatcccgtcctctgggccggtctgctgctcgtcgcacgccatcgcgggcctcgtgatcgcgccggcgtgatcgacgccgcgatcatcgcgaccgcggtcggtctggtgtactgggtcttcctggtcgaaccgacgctaggcgaccgtagcaccccgctcgtggaacgtctggtgagcggcgcctatccgacgtgcgacgtgctcatgctcgccgtggtggtccgcatgctgagccggccgggtgggcgcaccccgagcgtggtcctcctcgccacgggcagcatgatcatgttcctcggtgaggtcttctggacgttctcgttgagcaccaacgcccacatcggcaccgtggtcaacgccggattcgttttcagctatgtgtgctgggccggcgcggccctacaccccacgatgccggcggtcgcgaccggcgggctcggcccggtccggttcgggtggggccgtctggccaccatcaccgccgcgacgctgctggtgccggcggtgctgttcgcccagggcctccggcaggaaccggtcgactggatcgccatcggagtggactcggtggtgctcttcctgcttgtcctgacccgcctgtccggcttcgtgcagcaggtacagcgacagtccgcccgcctcgaaaaactcgccttgcacgacgacctgaccggcctgatcaaccgccgaggtttcgagcaacggctcgtcacggcggttgccgccggctccgtccaggtctgcctgctcgacctggacgggttcaagagcatcaacgaccggctcggtcacgtggtgggcgaccgcctgctgagcctggtcgccgagcggctggcaaccgcgctgcccgacgctgacgcggtcgcccggatgggcggcgacgagttcgcggtccttgtacccggcgcgggtaccaccgaaggcgacgcgatcgtcgcacggctgaccggggcgttgcgcgaaccggtgcacgtcgacggccacgaactgctggtcagcggaagcatcggcatcgccgacgcgcaggacaccaccgatccggtggaggtgctgcgccgcgccgacctggcgatgtacgcggcgaaggcagccggggttcgcgcccggcgatacacgccggacctcgaccggcgggcgggcgaggaagcccggatcggcgccgagctgcgggtcgccctggacgagggccagttccacctgctttaccagccgatcgtcgatctgccggacggcgaactacgctacgtcgaggcgctgatccgctgggatcatccggagcggggaacggtgagcccggccgtcttcattccggtcgccgagcgcaacggtctgatcgtggaattgggcgagtggatcctccgcacctcctgccgacagttcatgctgtggcggcgcgagcaggctgcgggcgcgccggagaagatcagcgtcaacgtgtccgcccgtcaactggccgagccgaacttcgccggattggtcgccgacatcctcctgcaggccggaatgccggcgcatcacctgctcgtcgaggtcaccgagaccgcggtgttcgaaggcggggtcgccgtgaccaccctcgaggagctgcacgatctcggcgtccacatcgcgctggacgacttcggcaccgggcattcctccctgaccctgctgcacaccgtcccggtcgacgtactgaaggtcgacaagtcgttcgtcgaccacgtgaccatggccggtaggcacgcggtgatcgccaccgcgctcatccaggtggccaacggtttgggactgatcgccgtggcggagggcgtcgagaccgcggagcaggcggccgaactgcatcggctgggctatcgactggcccagggataccatttcggccgtccgtccgtggagccgctccgcggcgcggcagcagccgcccggtaa

SEQ ID NO: 7714 - DNA, 564 bp, Actinoplanes utahensis
atgcggcgacgtaccctgctggcgtcggcgggagcgggagccatgctgaccgttcccgggctgcccccggccgcggccgaggccgctgccaaacccactctgcgtacgtacgccgtgcagggcaccgacctcgcggtggcgttgctgcccggtccggccgcgacgatcctgctctacgctgctcgccgcttccactacgagatcgacgcgctgcgctcgggtgatctcgtcaccgacgcttcgggcaccgtcctcgacatccggccggggtggtatccggcgggcgcacgggacggcttcctgccgtaccagctgatcgttgttcatgacatcgtcgcgcagtgcgacggtctgctccgctggggcggcgacgagcgtacgccgcgcgaaggacgcttcgcgatcgccgtggcgcccaccgaccaccgcctgcgggtgctggcgaagcgcctggacaccgatgccgcatcaccgagccgccgggtgggggcgggcaccgccctgccgttcaccacggaccgggtgcggcgggcgcagtcgctgcgtcgcagcatgatccggtaa

SEQ ID NO: 7715 - DNA, 2508 bp, Actinoplanes utahensis
atgaatagttgccgaagagccggtccagcacccaggcgacgcccggcagcaagatcaggggaagcttcgccagcttaccgctcccggccatgccgctatcatctccggtcatgcgtccgtcggtgtgggttacgccgccggcaggcttgcgccccggccgtgagcaggcgtaatggcccgctttgcagcggcctgtatcgtgtcgtccggccatgcagtgacgacgacgaatcagaggtgctgatggacgccgccgtactggcagtgcagcagtgggtcaacgccacgtacgccggggtctccggatatgtggtggtcaccgaggacggcagcgccggacgccagacgatggccgcgctcacccggggactgcagcacgagctggggatcacggccctctcggacaacttcggcccggcgacgctggcggcgctgaccgcgcacggcccgatcggacccgccgagacgaatcgcaacctggtcaagatcgtccagggtggcctggtctgcaagggctatgccgccttccgcctcgacggcatctacggcacggccgtgaccgccgccgtcacggccctgatgaccgacgccggcctcacggcgcgggccgacggggcggtcgccccgaaggtgtgcaaggccctgctgttcaccgacagctacgtgctggagtccggcgcctccgcgccactgcgcgccgcccagcagtggctgaacgggcgctacctgaaccggtcggcgttcaccgtgctggcctgcgacggccgccgctcccgcgagttcctgaccgcgctgatcttcgccgtgcagtacgagggcggcctgaccgacgcgcaggccaacggcaacttcggcccgctgacccaggccggggtcaagaagaacggcctgatcaaggcgggttcctccggcccgtgggtgcggttgttctcggccgcgctcacgcactacccggccaccccggtgttcaccggcgacttcgacgagtcgctggccgctgccgcccgcgcggtgcagcagttctgcgggctccccgtgagcggcgagggtgacttcgcgacctgggcgtcgttgctgatcagcatcggtgatcaggcccgcccgggcacggcggcggacaccgtcgacgaggtgaccccggcccgcgcccaggccctggcggcggccgggtaccgcacgatcggccgctatctgaccaacgtcgagggcagcggcttcgacaagaagatcaagcccggtgagctggccaccctggccgccaacaacctgcgcctgttcccgatcttccagacgtacgcggactcggcctcctacttcggctgggggcagggttacgcggacgcgctcaccgcgcacgacgtggcggtcgggcacggcatcgccgcgggggcggtcgtctacttcgccgtcgactacgacgcgaccgacaccgaggtcacgcagcgggtgatcccgtacttcctcggggtcgacgccgggttgcggcagcgcggtggccggtactcgcacggcgtctacggcgcccggaacgtgtgcagccggctcgcggccgaggcgttcccgcgctggagcttcgtcagcgggatcacctcgggctggaccgggaacgtgacctacccactgcccgccaactgggccttcgaccagatctccacgatggacgtcggcaccctggagatcgacaagtgcgtgcagcgggccggcgccgacccgggggagggcgctttcggctccgccgcgaccgacctgtccgcctacctcgactggatcgaccggctgcacgagctcgcggtcgcgttcggcaccggcgatccgggcgagcgggtcctggaatacctgcgcgccggccgctacgacaactggcagacccggaagctggccggcggcacgaacgccgcattcgtcagctacgtcgacagcaccgggctggcgcgcgtgcgcacctaccgcgacccggtcgccggggtggacgtggacgtcagccggtggggtgcggcggcgctcgccgatctgcgcggacggggcgacgccggaggttggggcggtgacctgatcgccttctacggcggatggcggttcacggctccggccaccgcggcccgcgactactgcgcggcgtaccttgccaccagcgagaagccggcggcgctcgacctcgccgggctggtcgcggacgtggacgcgtacctggccgccgcggccctgcgcgcgggcaccacgctcggcgcccacctgcgcggagccgatcgcggtatccggttcagccggttctaccgcggccggttcggcagcgacccgaacgccgccgcgaccgcggcacagagcctgctcaccggcaccggcgacgacgtggtgacggcataccgcacggcgctgctgcgcggcctgagcaccaccccggtgaccgtggacgaccagctgcggcagttctgcaggggcttcgccgaccggctggtcgcgctggccgagaaggagcagatccacatccgtcgaggaaaggtgtcctga

SEQ ID NO: 7716 - DNA, 1041 bp, Actinoplanes utahensis
atgatcgagaaggtgcgtacggcggtactggccgttgtcgcgttcggtggtgccgggctctgggcgtacggcatggcggtgttgcagccgttgtgtgaacctggctcgccgtggtgggacgacaagacagacctgtcgtatggggcgcgggatgtgcgctggggagccgccctcgcttgctgcctggcgcttgtcgtgctcgctcgtggtgctcggtcggcggttgcggtcgccggggtcggcgtcgtcgtctgggccggtgtcgaccttgtgctcgatcgggccgacgtgggcggctcggcgctgctgcccctgctgtcggttgccggagctgtggttgcagcggcggctgtgggctgccggcgggccggtcgggccatggtgtcgccggatcggcacgttttcggagtggtcgcggcgatcgccatcccggtcgggctggcggtcagtttcgtgacgtctggccgcaatgccgagccggagctggtgtgggccgtgctccccgtggtcgccttgcacgctggtgtgggattggtggtcgcgctggagacggcgacaccattcacccgagcgcgcgccatggcggtcaccgtggccgcagtgatctgggtcgtggcgctggccattcgtgcggtgacgacggagaacatgttggcgtggctgtgggtggaagcggcggtgtcaggcctgctgctcaccgggatctggtggctgggcaggtcgcaggcaaccccgtgggaaaggacgggcatgactttcgccggtggactcatgacgccggccctcttctttggtctgctcttcgcgacctcggtgttcgacctgctgtcgccgctgaccaggtgggccggaagtgtgccaggtattgatggggacgtgtcctggacgactgccggactgttgacggggctctcgctggctttcggggcgctcacgaccaggtcggacggttcccggcgaacggcaccgccggcttcgacagcaaccgggccgcaccacgcccgggccggcactcgggccaccgcgccgaccagaacctga

SEQ ID NO: 7717 - DNA, 5190 bp, Actinoplanes utahensis
atgagcgcggcagtcgacgccggcccgcagacccatcgcccgtcggtggccgggctggagatgctcgaggagctgggtcgtggcacccacgcctcggtctaccgggtgcagcgtgacggccgtgagtacgcgctcaagatggtgcacgccgacgtcctggaccgcgctggtgccaccgcggctttccggcgcgaggccgcgctgctggcctgcgtcgatcatccctcggtgggccgggtgtacgacgtcggcgagaccgacgggacgcccttcctgatcatggaactcgtgcaggggatgtcactggcggcgctgcgggaccagcgcccggtctccgtggtcgaggcggtggccatcaccgctgagctggcggccgcgctcgccgccgcccatcgggtcggtatcgtgcaccgcgacgtcacgccgcggaacatcatcgtgctccccgacgggcggccgaaactcgtcgacttcgggctggccgcccggcaggaccacagtgtcggccactccgccgccggtacgttcgcctacgccgcaccggaacagaccgggatgctggcccgcccggtcgacggccgcgccgacctctacgccctcggtgtcgtgcttttcgaatgtctcaccgggcgcgcaccgttcgcctcgaccgacgtcgccgagctggtgcggatgcacgccgtggaacccgcacccgcggtgcgtgatctgaatcccgaggtgccggtcgccctggccgccgtggtggcccggctgctcgccaaggaccccgacgaccggtatgccgacggcgacgacgtcgcggccgtgctgcgcggcctggtcgacaactcggcggaggaacggcgagtcgagggcaccgggggccggctggtgggccgcgagaccgaactcgccgaactgacgcgccactgggccggggccggtacgggccgcgcgggagcggtgcgactggccggtgtgcccggcgcgggcaagacccggctcgccggcgaactggcgcggcgtgcccgagccgccggccaccccgtgctgaccctgctctgcgcgcccggcgcaccggcgatggcgccgctgcgggccgcgctcgaacgctacctggaccaggtcgacaggcttccggcggccgcggccgaggaagcgcggcagcgccttcgcaccatggccggggacggcgccgccgtacttcaattgctgtcgcccgcgctgcggcacatcctgcgggcgccgcaactggccgacgaggaccgtcaggaccagttggtcacggcgaccgtggcgtttctgaaccggatcggtcacgccgcgaagggcctgctcgtacacgtcgacgatgtccagtgggcggacgacgccaccagccgggtgctcaccgctctgagcgcttcgtcggcgccggtgctgatcgtgagcaccgaacgcaccggtgaggccgcctgggcgcccgaggtgccgatcatcgaggtgccgccgatggacgaggccgagatggccgccctcatggcgcaccatctcggcaacgccgccgtgccgtcgtcgctggttgagcagatcctggcgcgcagtgagggaaacccgttcgccgcgctgcagtacctcaacgccatgctggacgccggggtgctgctcccgcagtggggctcgtggcggctcgaccagtacggcctggaccggctggacctgcccaccgacgtcctcgatctcgtggtggcccgtaccagggcgctgcccgagacgaaccggcggctgctcgtggcggcggccgcggtgggcgctccgttcaccgccgcgctgctggccgaagtctgtgacaccggcctgccggcggcgctggaggcggtgcaggacggggtggcccgcggcatcctcgagccggcgggcggggggcggcacgccttcctgcaccagcggttgcgtgaggcgctgctcagcgacgtcgacgccgccgggcgacgagtcctgcacaggctcatcgccgagcacctcgacgccgctgacaccggggattcgcgggaccggtaccggatcgcccgccactacaccgcggcaggcccggaggcggatccgctgcgtacgctggctgcctgccgggccgccgcggatgccgcactgaccaaccacgccgcggctcaggcactggagttcctcgatctggccgagcaggccgccacggacgccggcgtgccgctcgacgggctgttccaccgccagcgcggcgtggccagcctccgcgccgggcacctggccgccgccgagcgtgaactcgccgccgctctggagcatgaatccgacccgttgcgccgggccgatctactcgccaagatcgcgcacgcccagcacagtgacttcgccgccaccgaggcgctgcggacggtccgggccggtttgcgcgaactcgggcagcccgtgccgtccagcgtgctgctccaggtgatcaccggtctggcctacctgctggtgggatggtccactggccggcgacggcaccggtactccgggcgtgacgaagcagcccggcagcgggatcgcgtcgtgtcggatctgtgcgacgcgggggcgatggcggctgcggtcggcatgcacatgatgctgatccccctcttccacttccgcgccctgccggccgtccaccgtctcggcccgggccccgaatacgcccgcgtgcaggccgccctcgccatgatcgcggatgccgtgcgcctgtcccggctcgccgagcgctgctacgcgcgcgccgaccgggcggcccgcgccgtcggtgacccccggctgaccacccgggtgccgtggagccgcgccaccggaacggacgcggtggccggtttcgggccggccaccggctcggcgatccgcgagatgctgcgcgaacacggcacgtggctgccgcccggcgaatatctgtccggtgtcggcgcgctggccggcacgctgctgctgcgcggttacacccgcgaggcgcaggcctggtacgaccggggccgggaccgcctcgccaaggacctcgtgctgccgggcaacccgatcgccgcggtgggtgtgcaggtcgccgcgatgtccggcaaccgggccgaggcccaggcacgcctgggcgggatgctggccgccgccgggggtcgcggggacgaccagggccggcgaatgaacatcatgatggcgcgggcctgcatggccgccgagttcccggacacgcaggacatcgacgcgctcaccgcggaggtgcgccggtggcgcatcacgccccggcgggtctggccgcagcagcgcaacttctggctctacctggcctgggccgaactggcccggtgccgcagcgccgaaccgcaggagcgggcggcccggctccggctcgcccgtgacgccgtagccgcgttcgggcgcgccgccgacaacgacgtgctgcgcgccttccaccacgccgtgctcgccgactacctcgagctgaccggcgcggcggaaaaggcgctgacccagctgagtcacgccgaccggctgggctgcgggatggatctgccgctgctggctcacctcgtcgcggtgggccggtgccgggcgctgcgggcactcgaccgccgagcggacgcggaccggcaagccgaactggccgtcgcgatcgccgtcgaccacgggtgggagcaccgcgccagggccgggcacgcgctcctggagcggtcaggctcccatcgcaccacggtcagccgccggcagccggccgacgtcaccggtgagctgttgcgccgccggctgcacgcggtgcaggaactcagcgccgcggcggccaccgtgctggatcccggcgagctcgcccgcgtcgcgctcgacgagacgatgcgaaccttcgccgcggagcgggcgatcctgttcctcgccggcgacgccggcggaccgctgacgccgtatctggggcgcggggccggcggtaccgatctcgtcgaggtcaccggttacgcggccagcctggtgtgccaggtccatcacaccggctccgccgtcgtcctgaccggcaccgatgacggcaccgccgtgcgttcgcagagtgtggtggccaacggcctgcgcagcgtgatgatcgcgccgttggtgtcacgcggtgacgtcatgggtgctgtgtacctggacacccggctggcccaaggcgcgttcagcgaggacgacgccgacctgctcaacgtgatcacccagcagatctccgcctcgctggtaaccgcccgtgccgcgcagttggaggtgaacgtgcgcacggccgaacgccagcgggccgtcgccgacatgatgcgggcggcggtcagcgatctggccggcaccctggtgcccgacgaggcgctcgcccggctgctgaccaccttcgtccgggtcaccggcgcggacgcggggatcctgatcccgctgaccgggtcggccgcggccgtggcaggtgcggtcgatgccacgctgctgcccggcttcgccgcgctcgacgcggtacgccgcggcgccgcggacggcctgtgggcagaaatcgacgcggtgacaccgggtgcccaggcctgggtggcggcgcccctggccggccgggacggacggatcgcggtggccgtgctcaccgctcgtgagccgggccggttcgacgacagccacgtcagcgtcgtggcggcgctggccgagcaggggatggtggcgtacgagaacgcccagctgttcaccgaggtccgccggctggccaccacggacgcgctgaccgggatccacaaccgccggcacttcttcgaaggcgcctccgaacggtgcgcgcaagcccgtcgtaccggcactccgctgagcgcgttgatgatcgacatcgaccacttcaagcggatcaacgatgacagcggtcacggagcgggcgacgacgtcatccaagccgtcgcgggccgcctgcgtgacgtcctgggtggccaggggctgctgggtcgttacggcggcgaggagttcgcctgcgcgttgcccggccgttcactcgccgacaccgcgcacctcgccgaggcgatgcgcgccgccgtcgccggcgagcccgtggtcacgcgcagcgggccgatcccggtgacggtgagcatcggcctcgccgaactcggtgaggggacgccgaacctcgacgacgtgctgggctccgcggacgcggcgctgtacgaagccaagcgcggcgggcgcaaccgggtggcacaccacatgggctga

SEQ ID NO: 7718 - DNA, 1509 bp, Actinoplanes utahensis
atgacccagatcaagcgaccgcgcaccggggtcaccttcctggcggagtgtggttggtacctgtccaccggtacagcgctggtcgcgggatacttcctgctggccctcgtgccgggctccggtctcctgcggctggtggcatacgcgaccgtcgtgctgtccgtacccgtggccgtgaccatcggcgtgcgtcggcacggatgtcaccgaccgctgcgctggtatctggcggccgcgggacagggcacgtacggaatcggcgatgtgatcttctacctgcaccgtttcgtcgtcgatgtcgacacggacctggcttccagcctgtgttacctgctctcctacccgttgatggcggcgggtctgctggggttcatccgacgccgtgcggccgggcgggatgtcgcgagtctcatcgacacggcgatcgtggggttgggcgcggggctggtgatgtgggtgtacctgctcgcgccggggctcgccgatgccacccgttcgtcggccgtgaagaccaccgtcctggcctccgcggtgatggacctggtgctgggcatcctcgcgatccggttggccctcggcgacatccgcgtcgtacccgcgtaccggctgctgctgctctggatcggtggcctggtcaccgcggatctgacctacggctatctgcagctgaccggcggctaccgggccggggatgtcctggacctgctgtggttggcctcggccctggccctgggcgccgccgcactgcacccgagcatgcggtcgctggaccggtccccggccgcaccggaacagccgatcagcaccggccggttggctgcgctcgcgttgacatgtctcaccgcgccggccctgctgtatctggaatacctccagcgcgcgccgctgcacgtaccgctgatcgccgcggccagcgccgggctgttcctgctcgctctcgcccggatgaaggtcatcgccgacgggcagcgtcgcgcggccatcaccgaccccctgaccggcctgcgtacgcggcgcttcctgcgcgaggcgatgcaccgccacgccggccccgacacctggctgctcctgctcgatctggaccatttcaaagagatcaacgaccggtatgggcacaccgccggcgacgacgtgcttcgcgaggtgtcgcagcggctgctggcggcacggcgccgcggtgacgtcgtcgcccggtacggcggcgaggagttcgcgatcctgctgccgaagacgacggtcgtcgagatcgcagcgatggccgagcagatccggcagagcgtggccggcgccccgatcgcaacgaccgggcactcgctccgggtcaccgcctcgatcggcggggcgacgtgggatgacgggcacagcctcgacgagttgatcgccgaggccgaccacgcgctgtacgccgcgaagcgggccggtcgcaaccgggtcatgatcgccccgaatcccgcaccccggccaccgaccaccccggccgaagcactgaaggaccggccggcggcgtga

SEQ ID NO: 7719 - DNA, 1263 bp, Actinoplanes utahensis
gtgaccgatcctgcgggcaccgtcgagcaggtgtggcgacaggagtcgtcgcgcctgctcggcgcgctgctgcggatcacccgcgacgtcggccgcgcggaagacctggctcaggaggcgctcgcccaggcgctcgcgcagtggccgcggacgggcgtcccggacaatcccgccgcctggctgatgaccacggccaaacgacgcgcgatcgaccagttccgcgccggtgagcgccaggtccgggcgtacgcggaggtggccgtgggcgtggtcgaggggtacgaacagaagttcaccgtcgaccatcttgaggacgacgtactccggctgatgttcatctgctgccatccgtcgctcaccgctgacacccgcacggtgctgaccctccggatggtcgccgggctcaccacgcgagagatcgcccgcgcctacctcacctccgaggcgacggtcgccacccgcatctcccgggccaagcggaccctcgccgcggccggcgccgcgctcgaagagccggatgcgatggagcgagccggccggctcggctcggtgatgtcggcgatctacctgctcttcaacgaggggtacgccgtgaccgccggcgtggaatggacgcggcccgccctgtgccgcgaggccgtccgggtggccgccgtgctggcttccgtgttgccccgagagcccgaggtgcacggtctgctcgccctcgtcgagttgcagtcctcccgcctggcggcccggcagaacgcggcgggcgaggtcgtactgctcaacgatcaggaccgatccgcatgggaccgcgccgccatcgaacgcggcagtacggccctcgaagccgcgcgggccctgggcggtgacggcccctacttccttcaggccgcgatcgcggctgagcacgcccgcgcggcatcggtcccgtcgaccgactggccgagcatcgctgcgctgtacgagcggctggcccgcgtcacgggctcggcagtggtcgagctcaaccgggccgtcgcgctcggcatggcctacggccccgagatcggcctgcaactcgtcgaccaggtcgcggagattcccgcgatggccgactatcacctcctaccctcggtccgcggcgacctgctggagaagctcggccgccctgacgaagccgcggcggaattccgccgggcggcatcgctggcccgcaatgaccgtgagcgagccctgctcatccgtcgcgccgatgcagcctcagcgggcaccgggtccccgaaccggatcggttga

SEQ ID NO: 7720 - DNA, 354 bp, Actinoplanes utahensis
atgctgctcgtccatgagaccacccgcccgagcggccagccgcccgcggagctgttcgcggcgatcggcgcgctcggcgcccaggagtcggcggccggcaccctgatcgaggtgggcgggctgatgccgattcaggccggcgcggtcgtcaccctcgccgggtccgtgatcgccaccaccgacggcccgttcgtcgaggccaccgagctcgtcggcgggtactcggtctacgagctgcccgacgtggccgaggctgcccgcaaggctgaggcgttcctcgacgcccaccgcaccacctggcccggctgggaggggtgggtcgaggtccgcgccatcatggagatggctgggtga

SEQ ID NO: 7721 - DNA, 420 bp, Actinoplanes utahensis
atgacggcactcattgaccctgagacggcgaccatcgcgtcggaaatgaccagtcgtggcggctccacccgcatcgcgggctggatcgtcaccgggctcgtcaccctgttcctggccttcgactcgatcacccatctggtccgcgagaagcatgtcgtggacttcaacagcaggatcggcgcccccggttggttcccggtcgtctgcggcacggtgctggcggtgtgcctggtcgccttccacgtgccgcgcacccgcgtcctcggcgcgatcctgctgaccggctacctcggtggtgcgacggccgtgaacctcgtcatgggccagcccgccttcaacaccgcattcgcgatcgtcaccggggtgctcgtctgggccggcctgtggccctgtgacgagcgggctcggcgtctgttctga

SEQ ID NO: 7722 - DNA, 372 bp, Actinoplanes utahensis
gtgccgtcatgcccctacgtcgccgggcctgccgtcatctcgacatcacacctcaacttttttccgagggcgggtgagagcacgccctgtccggcacctgacctcgatcatcaacttttgttgacggcgatctcgctatcaactaaagttgatgacatggtcgagctcccttcacccgaggatccggacgccgcactggccgccgtcgtggcgctgcgacggctcgccaaccagttggagcgctccgcggtcgagcacgcgctgcgacaagggtggacgtgggcccacatcggccaggcactcggcatcagcgcccaggccgcccacaagaagctcgccccgaagatcgcacaggagagagacgccacgtga

SEQ ID NO: 7723 - DNA, 501 bp, Actinoplanes utahensis
gtgaagcttccccgccccatccaggacatgcgcacgatcaagaagctgctcaccgccgcggagtccgaggcgcggcgcgccggtgacgaactgcccggcccggagcacctcctgctggccgcgttcgacctgcccgacgacacggcccggcgagcgttcgagcgggccggcgccgacccggccgggttccgggcggcgatcgacgacacgcaccagcgggcgatgcacgacgtcggcgtgcaggtcgccggaccggaccggccgcttcccgaggccgccccggccaccgggccctatcggctgaccgcgcccggccaggaggtcttccaggccgcggtgcggctggcgaaggccggctcagggtcacctctgcgcggtgcgcatgtcgtcgccgcgatcggcggacagcaacgcggcaccgtggcccgggcgctgcgcacgctcggcgtcgaacgcgccgcgctgaccgccgccgccgaccaggtcctcaccgagcggtga

SEQ ID NO: 7724 - DNA, 450 bp, Actinoplanes utahensis
atggacgacgcccggaggcgaccgcatcgcctggtttcgggatccggatggcaacaccctgtccctgacgcagttcctccctcactgatcagtccggacgaggctcggcataccaaggtgccgcctcgctgccgggcagtcagcgcgagccggttgtgcgttcagacccgggtgctcttgctgcgggacggtgtgctctcattgagcctcatgagtgaggcacgcgcagtcgaggatctttgcgaggagttgcgccgacgggccggcacggccagccgcgtggatctctgggttcccgaggaactgacgatcggcaacgcgcctgagccgaagaacccgaccggtctcggcatggcgctcatcgtcgacaccgcgctgtcgctgggtctcatgccggacggattcactcagggtgccggcgggcgaacctaccactacaagtccgagtaa

SEQ ID NO: 7725 - DNA, 483 bp, Actinoplanes utahensis
gtggacgacagcctccttcgccggctgcgggccgaacaggctcgggcacttctctacgacaccgagccccatcacgcggtgatgctggcctgcgacctgctggcggccggcgtcgacggcgacgccgtggtggcgctcgcggcgcagtcagctcgaacgctgtcgacgcatgacgctaaccagcacctggcggcggtcaccgccgaactaggcctcgcagaaccggacctggcgaccgcggtggagctgatcgcagccgacacctgcgagcgcatcctcgaccgcagcatcgccgccggagtgggaacccaccgtctatacgtggtgggccatgagcgcagcccactgtccgacctgctcccggcggtcgccgcactggccgagcgcctggaggacgaactcggtggacgcgccgacaacgacctgcaagcccgactcgacgcgctggcccggaccgtcctgaaccgcctgttgcccgcgtga

SEQ ID NO: 7726 - DNA, 1335 bp, Actinoplanes utahensis
atggaacgtttggccgccgctgttcgggccggcgatatccagcggttgaccgtgctgctgcgggagctgtccgacattgacctgggtggcgagctcggcagcgccctgttccgggaggcggccgtcgccgggcgggccgaggtggtcgaggaactgctgttggccggcgtggacccgaaccgggcatggccgggcagggtcgagccggtgagctggttcgccgagcgtggggcctggaacatgctggtcacggtgttgatgcacaaccatgggcactcgtcgtggccgacagtccccgagtcctcgttgcgagcggcactcgctctggcccgcacctggcttacggtcgacccggaacaggagctgcgccggcgtctcggcgccctggacgaccccgcgaccgtggtggagcgcgagcgggtacccgcgtggcgcgacggcgacgacggcccgtcggcggtacggatccgcgtgcacaccgccgacggccgcgaggaccgggtgtgggtggcgcatcgcgcggtcgtcacgctgctggaggacgcattgggcatcgtcacgtcgaacgatgagatcgccgcgcgtgccgtgcacaccgcgcacccctactcgtgggacaacgcgcaggctcacaccacgatcagggagcgcgcggaacgcgatgccgcggtgttcgactggctcgccgcccgattgacccatcccaccgtcgaacaccggcggttcgcggccgaggtcgtgcaggggctgtgtcggcgcgagcggccgttcgacgacgcgcaggccgcggacatcatcgccgcccggatccgtgacgagcgggacccggtcgtgctcgacaacctgatcggcgccttcgccgagttcgccttccacgcccggcccggtaccgacctgcgtcagatcctgccgcacgctcggcaccgcgatccgctggtccgcacccgggtggccatggagctggtcctcgtcaccggttcgcggcgtgacgagacgctgcccgccccggcgagttctccacctgccgcgcacatcaggacgttgatcgaactcgcggcggacccggacccccacacccgtgcgacggcactgggcgtcctcgccggttcctacctcgacaccacacaggtccgcaccgtcttcatcgaccatttgagcgacccgcacgcacccgcccgcgtcccggctgccgccggcctctcactacgcgacgacgtacgcgggcaagatgccctgcatctcctgcgcaccgacccggtcaccgcggacgtagcgtgcgggtggctcgccgatctcgaccgcatcctggcccggcgtccggcgccgcagcactga

SEQ ID NO: 7727 - DNA, 696 bp, Actinoplanes utahensis
gtggcgcgtgcacacccatgcacatacggtgggttcgtggacactgtggatggtcaggacgaggacaagagtttctaccggaccgttctgaaatactcggcgggtttgtgtctcggcctgctgctactcgtcacctaccccgtctacgtacgggtcacatgccacgccgacttcgacgccgggcgcctggagacgcacgacgcgaccgtactgagcgcgcactactacgacgtcttcgacggcagcacgcacgggacaggtcagcagatcacgctgcgcctggacaacggcacggagcggacaacacccgaagctgcgaattggatcgaggtagacaaggtgcgcgagggtgcccgggtgacggtcggactgtcccagggccgcttagtgtcggtagcgggcacctacgtcggaccgggatacctctactccgggctcggtctgtggatcatgacaggcgcgctcgtgctgtcaggcatctatgccgtacagcttcgcagagcccccgctggccggtccaaaccgcacaccgcgggctacgtcacccaggccctgatgttgtaccttttgttcaccatcgtggtccagtacagccggtacgaagcatgggcacccgttatcgccccggtcctggcgacggccatcccgctggtgatcttctggacgcgtcaccgccggcccgcccacgccctctga

SEQ ID NO: 7728 - DNA, 2256 bp, Actinoplanes utahensis
atgtcgtggccgctgcctgacatgccgacgctcaccgaccgccggacccggctgacctggacgtggatgaccgcggggacgctgatctgcctgggcttcccgctgctgccggccgggggactgctcgcgtccgtgctgtacaacgggatcggcctggccgcgttcgtggccatcctcgccgcggtgcgccggtaccggccggcccggccgtacgcctggtacgtgttcgccgccggcgtcatcgcgttcgtggccggtgacgtggccttcgaggtcggtggcctgctccacggcgagcacccgtacccgtactggaacgacgcgtgctacctcgtcgcgtaccccctgctctggtccggtctgctcctcgccgccggcgtaccggcccggcgggacctgcccggcatgaccgacgccgcggtgatggccaccggtgtcgcgctggtctactgggtgttcctgatcgacccggcgctgggcggacacggcacgccgctgtccgagcgggtcctcacggtcgcctaccccggctgtgacgtgatcatgtgtgcggtggcgacccggctgctcacccgcaccggagcccgcaccaccagcgtggcgctgctcgcggccggctcggtgctgaacttcgccggtgacctcgcctggagtctcgcgccgacgctgaccggacgtccggcctcggtcatcaccgccgtgttcctgggcagctacgtctgctgggccggtgccgcgctgcacccgtcgatggcggacgccggcgccgcggcacgcccggccaccagcgtccgcttcgggtggggccgctccaccatgctgatcggctgcgccctgctcgtacccgccgtgctgatgatccagggcctgcgtcacgacgagatcagatgggcggccatcgggctcggcgccgtcctggtcctgctcctggtgaccgcccggatgaccggcttcgtccggcagatccagacccagtcttcgctcctcgaacggctggccatgcgcgacgacctcaccgggctggccaaccgccgccgattcggccgacgtctgggcgaggccctcgcggccggctccccgcaggtctgcctcctggacctcaaccgcttcaaggagatcaacgaccggctcgggcacgcggccggcgacgcgctgctgctcgccgtcgccgaccgcctgcgccacgggctgggcgaggtcgatctggtggcgaggatgggcggcgacgagttcgccgtcctgctcgccgacgcgacggccgagcaggccgacgccgaagccgaccggatctccgtcgcgctgcgcgagccgttcgcggtggccgggcagaagctgctggtggtcgcgagcgtcggcgtcgccgacggggccggtgccggcgacgcgatggaggtgctgcgccgggccgacgtcgcgatgtacgcggcgaagtccggtggcggccggtggcgccggtacgcggcgggactcgacgaacacgccgacgagaaggcccgcctcggcgccgaactgcgcgccgccctggacgccggccagttccgcctggtctaccagccgatcgtggcgctgccctccggcgacctgcgctacgtggaggcgctggtccgctggcagcacccggaccgcggcttcgtcagtcccgccgcgttcgtcccggtcaccgaggagaacgggctgatcgtcgagctcggcgaatggatcatgcggaccgcgtgcgccgacttcgcccggtggcacgccgagcagccggccaccgccccgcagcggatcagcgtgaacgtctccgcccggcagctcgccgagccggggctcgccgcgatggtcgcctccgtactggccgagacgggaatgcccgccggctgcctgatcgtcgaggtcaccgagaccgccgtgttcggcggcggtgtcgccgtccaggccatcgaggacctgcacacgctgggcgtgggaatcgcgctggacgacttcggcaccgggcactcgtcgctgggcctgctgcagaccgtcccggtggacgtcctcaaggtcgacaagtccttcgtcgacaacgtgaccatggcggggcggcacgcggtgatcgccgaggcgctgatcagggtcagcgacggcctggggctcagcgccgtggccgaaggcgtcgagaccgcggaacaggccgcggaactgtaccggctgggctaccggctggcgcagggctaccacttcggtaaaccggccgcggaactccccgcccgccggatagcggcggcggcctga

SEQ ID NO: 7729 - DNA, 1467 bp, Actinoplanes utahensis
atgatgaagcgtcctcgcgcgtggatgggtttcctgatcggcggcatgcttttcgtcgcgctgtatctgtggctgcccgacaacgtgtacggggtcctggggtgggacggcgtggcggtggccggtgccgtggccatcgtggtcggcatccggcgcaaccggcccgcgggagcggccgcctggtggctgctcatggccgggcagctggccaacgtcgtgggcgacatcatctacttcgtcgcctccggcagcggtggggtcttccacccgtacgacgtcccgtacctgctgggctacgcgctccaggtgaccggggtgctggtcctgctgcgccggcgaggcgccggccgggactgggccacgctcgtcgactcgatgatcatcacaagtgcgttcgcgctgctgagctgggttttcctgatgaagccggcggccgcggaggcgtcgctcggcctggccggccggctgatggcgatctcgtacccggctctcgatctgctgctggtcgccatggtcgcctggctgctgaccgccgacggggcgcgcaacatcgcgttcttcctggtcgcgacgaacatggtggtcttcctcgtcggcgactacttctgggcgttcgccaatcagacctcctacgacccgggcacgctcggcggccgactgatcgactgcacgtacctgaccggctacatcgccttcggcgccgccgcgttgcacccgggcatggtggagatcggccggccggccggcccacagcgggtccgaccgatgaccctgcaccgcctgatgctgctcaccgcggccacgctgatcgcgccggcgctgctggcctggcaggcgtaccgcggtgccggccgggtcctcgacgcgtacgcgatcgtgaccggttcggtggtcatgttcctgctcgtcatcgcccggatgacgatgctcgtccggcaggtccaggcacagtcggccatcctcgccgaacacgccgatctgctgcgcgaggcggcccagctggacccgctcaccaacctgcccaaccgccgcgcctggaacgccgcactgcccgcggcgctgcaacacgccgcccggcaccgcgccccgctcaccctcgccgtgctcgacctcgaccacttcaaggtcttcaacgacacgcacggccaccagacgggcgaccgactgctcaccgaggcgaccgcggcctggtcgacgaacctgcgttcgacggacgtgctggcccgctacggcggcgaggagttcgtggccctgctgcccggcaccaccgcagccgaggccctcgacctgctcgaccggctgcgcccggtcacgccgatgggctgcacgttctcggccggcgtggcgacctgggacggcgtggagagcggcgacgagctcctcggccgcgccgaccaggcgctgtaccgggccaaggccgccggccgtgaccgggtggtgagcgacgatgtcgtggccgctgcctga

SEQ ID NO: 7730 - DNA, 906 bp, Actinoplanes utahensis
atgccccgtgagccgcaccccgacgccgcgccgccggcaccgatgacccgacgtcggatcctcgccaccacagcggtcgtgtccgctgcgctgctgaccggctgcccgcaccccgagaagtccaccccccgcgacacgctggccaaactgcgccggacgcgagtggcgcgcctggccgtcgccggtgaggagccgttcggcttcgtggacgccggcggcgaactcaccggcgccatgccgcagatcgccagggaggttctcgccgcgatgggcgtcccccggatcgaaccgctggtgatggatttcaccagtctcatcgacgccgtactgtccggcaacgccgacatcgtcgccgccggcatgtccatcaccacagctcgctgcgcacgggtggcgttcgcccgtcccgacttccggctgccccaggcgctcgccgtccgcggtggaaacccgctgcacctggccgactacgccggcatcgccgcgcgccccggcaccaggctcggggttctggccggtgcggtcgagaccgaatacgccaccgcggccggcgtaccggaggaacggatcatcccgttcaccggctccgaccagctcaccaccgcggtgatcgccggcgacatcgacgccttcgccctgaccagcctgtccgtgcgccggctcgtggccaccaccgcacccggcgcgctcgacatcacgcccagcttcacgccgatcgtcgacggcacaccccgcctcgaactcggcgccatggcctttcatcccggcgcccccgacctgctcgacgcctacaccgccgcggccgcgaagctgcgcagctccggcaccatcgcccggatcctgcgcgcctggggattcgagaatcaggagatcgccgacggtaccgagccgggatgcgtgtcctga

SEQ ID NO: 7731 - DNA, 2340 bp, Actinoplanes utahensis
atggcacgtcgactggcagcgctacgccggggacagcgggcgctgccgtggatcggcgtcacggccgcattggccctgatggccggagcgtggctctggtcgggtgcggtcgcgcgccacgacgagaccatcgccacggctgccgccctggccacggatgttcgtgccgtcgagaacgagttggctcgctatgcggacgtgctggctgccgcggatgccgctctctcgacgggaaagggggacgattccgccctggccgccgtctccggcggcttcgacctgccgcaccggtatccgggtgcgctggcgatcctcgccatcgaccgggatgccggtggggcagctgtcgtccggacggcgcagccacagccggcccgcggctacccgatcggcaccgacctgagcacggtgccgcaggcagcggcgacgttcggcatcgcgacgcaggccaggcgcccggcgctgagcgccccgatacccgcctccggcgccatggccggcaccgtcctggcgatccgcgccgccggtgccgaccggtacgtgggcctgcacctggacgtccagcgcttcctcgacggcctgtacggccgcgcggagatcagcggcaacgtgcgcatcaccgatgtgtcccacactcccacgctgctggccgtgtcggtggacgacggccggccctcggcgcgcaccgacgaggtggccgcctacggccggcgctggcagatcggctacacccccacgggcacggtaaccgtcgcgggggagcggacctaccggctggtgctgcagtccgcggccgccctgttgtgcctggtgctgctggccaccgtgctcggccaggctcggtcgcggcgccgcgccgtgaatctggccgagcgcctgtccgagagcgaggagcgccgcaaccgcctgatcgacacgtcgccgataccgatcctggaggtcgacccccagggcaccgtcgagtacgagaacggcgctgccgcccgcctgctcggccaccgaccgggtgcggttctcggcagcccgctgcacctgaccgtgcaccgggccgacggcgagccggagtcgctgagcgtcaccgaggatctcgacggtgagccgatgaccatcgagaccggtgcgggaccgcgctgggtgatcgcctactgcaccgacaccttccgcggccgaggacggctgctgctgctctccgacgagaccccgcggcacgaactgcaggaacagttggcgcaggtgcaccgcatggaggcgctgggccggctcgccgcccgcatcgcgcacgacttcaacaacctgctcaccccgatcggcggctacctcgacctggtgctcaccggcggcaacgacctggccgcggaggaccgtgacgcgctcaccgaatgccggaaagcgaccggccgggccgctgccctggtggatcagatcctcgccatcagccgtcagcaacacgacggcaccagtaccgtcaccgacgtcgccgccggagtcgcgtcgatgaccggactgctgcggcgcatcatcggtccggaccgccatctcgaagtcgggctgccgcccgacgacgccgggcgcccgttcgccgcaatcgagcccaccgcgctcgagcagatactggtcaatctggtcaccaacgcccgcgatgccaccccggccggcggccggatcacggtcaccgtcgacgccggcgacaccgtacggatcagtgtcgccgacaccggcgccgggatggacgacgagaccctcgcccgggtcttcgacccgttcttctccaccaaacgcgaccacggcggcaccggtctcgggctggccaccgtgcacgccatcgtcgacggtgccggcggtcacctcgccgtcgagagccggcccgggcagggaacgaccttcacgatcgccctccatcgtcacgacgccccgccgtccgatcccgccgccgagccggcggccgccacagcgccaccggcagccgagaaccagaccgtcctgctggtcgaggacgacccgcaggtccggcaactggcccagcgcatcctgcagcgccacggctaccgcgtactggcgtgcggcaccgccgaggaggccgagaaacgctacaccgaacaacgggccacgatctccatcctgctcaccgatgtcatgctgcccggcatgagcggccccgaactggcccgcaccatcgccaaggtcgaccccgacctgcccaccgtcttcatgtcgggatactccgacggcgagctcaccgaccaggggcaggttcccgcccacaccaccctgctggccaaaccgttccccgccgccgacctgacccgcaccgtcgcggaggcactcgccgatgccccgtga

SEQ ID NO: 7732 - DNA, 1563 bp, Actinoplanes utahensis
atgcgtcgtctcgcgatcgtcctgtcgttgctcatgatgtccgtcctggtgatgtccgccccggccacggcccggccggcggcgaccaccgggttccgctggaacgacatcaccgccgccgacggtgtggtgctgaagtccaacgtgatcgccccgtccgcgccgggtgcccacccggcggtcgtgctggtgtccagctggggattcaacgacctggagtatctggcgcaggcccgcgggctcgccgaagccgggtacgtggtgctgtcgtacaccgctcgcgggttctggctctccggcgggacgatcgacgtggccgggccgcgggatgtcgcggacgcctcgagcgcggtcgactggctgctcgcgcacaccgcggccgacccgggccggatcggcatcgtcggcgtctcctacggcggtgggatcagcctgctcgccgcggcccacgatccgcggatccacgcggtggcctcgctcagcggctgggccgatctggccgcctcgatggccggcggcgacacccgccggccgcaggcggcatggttcctgcaggccgcggcacgcctggtcgggcacccgtcgccggagatgaaccagatcctcgacgactactgggccgaccggaacgccgacgcccgggagcgctgggcgcggggtcgatccgcccggtactcgatcgacgcgatcaaccggaaccatccggccgtgctcctcgcgcacagctacggcgacagcatcttcccggccgggcagatgctcgacttctacaccgcgctgagcacgccgaagcgtctggaactggcgccgggtgaccacgccacggtggagctgtccgggctggccggcatcccgaaccacgtgtggaccagcgtgcggcgctggctcgacgaatacctggccggcgtcgacaccggcatcggcgccgaacccggcgtggtgctgcgtccgcacgactcgacggcggtcgagtcgtaccgcgacgtggccgctgtgtccccgcacaccgatcgcctgctgctgggcgcgccgcacgggctgatccccaccggcgatctgggcaccgcggtgccgtcgtcgacctgggaccggcagatccaggccggcacggacaccgtcgccgacgggggagtggcgctgctgaccaacggcctggagggcctgaccggcatcctgccgaccacgtcactgccgttcgtgtcgcgccgcgatgccggagtctggctgtccggcgccgcgccggccggcggctggcgggtccgcggcgtgccgcacctgcacgtgtcgctgacctcgtcgcggccggccggcacggtcatcgcctacctgtacgacgtgaacgccctcggcgtcagccgactgttctcgcacgcgccggtcacctggcacgggtcacccacggtcctggatctgccgctgcaggtcaccgcgtacaacctgccggccggtcaccggctagccctggtcgtggacaccaaggacccgctctacttcgacgcgaacacggcggggtccaccatcaccttccacggcggctcatggctggacgtaccgtcggcctga

SEQ ID NO: 7733 - DNA, 525 bp, Actinoplanes utahensis
atgccgctgacaatccgctccgccggcgaggctgatgccgctgcctgcgcggccgtctaccgcccgtacgtactggacaccgccatcaccttcgagtccgacccgccgtcggacgccgagatggcccggcgcatcgcggccgccgtccggtcgcacgcctggctcgtcgccgaggacgacggcgagatcatcggctacgcgtacgccggtccgttcgccgcccgcccggcctaccgctggtcgtgcgaggtcagcgtctacctggccgtcggccgccgccgcacgggcgccggccgcgccctgtaccggtcactgctgccgcggttgatcgatcgcggctaccgggtggcggtggcgaagacgaccctgcccaacgaggcgagcatgggcctgcacgcggcgctcggcttccagctggtcggcgtacaccggaacatcggttggaagaacggcgactggcacgatgtcgccatcacccagctcgacctcgtcaccgacagtgagccaccggtcgaaccgtgctga

SEQ ID NO: 7734 - DNA, 351 bp, Actinoplanes utahensis
atgtcccaagacgctcgcctcgccggcgaaatggcggcatcgttggaaaggctgcgcacactcagcgatgagcgccaagccgacctgcgccgccagcaagaggccaccagccccaccaccgacgcccagaagcaccgcggccggatcctcgatcgacgggacgacgccctcgaccggcgtgacgacgcactcgaccggcgtgacggcgccctggaccggcgtgccaaagccgtttcccgccgcgatgaggcgctgacgcggcgggaaagaaccctcaacgaccggcaagcggagatcgagcagcgagcagaagtcctcgacaagcgagaaagaggcgaccagcgggcgtaa

SEQ ID NO: 7735 - DNA, 846 bp, Actinoplanes utahensis
atgcgcatccttgtcaccgggggaaccgggaatgtgggcaggctggtcgtcgaacaccttctccaggccggagcagaggtccgggtgctcagccgtggcggtcacgcgcccggtgcggccgcaacggtccggggggatctggcgcagccggacagcctgcgagcggcattgcaggacatcgatcgcctctatctgttcccgtacgccgggaccgcacccgccgtggtccggctcgccgaacaggccggcgtcgagcgggtggtcaccctgtcgtccggggcggtgaccaccggctacgacacgaatttccacctgcccgtcgagcaggcggtggaagcctccggcatgcggtggacccacgtccgcccggccgaattcatgctcaacaacctgtggctgtgggggccgtccatccgggcggagagaaccgtccgcgagcccttcccggatcgtgccgggtgcccggtccacgaacgggacatcgccgaggtggccgcggcggcactggtggaggacggtcatcacggccgggcgtacacactctatggtccggaaacgctgacccgccgggaccaggtggcggccatcggtcaggcgctcggcgaacctgtccggctgcaagccgtgacgccggcccatgcccgcgacatgtatctggcccagggcggtttcgcggccgcgtccgccgattttctcaccggcttccagagctattccggaggagagccggaggccgccccggtaccggtcgaaccgcaccccatgccgaccgcggcggacgtcaccggccgtcccgcccggaccttcgccacctgggctgtcgaccacgccgccgatttccggtga

SEQ ID NO: 7736 - DNA, 1248 bp, Actinoplanes utahensis
atgactgacctgatcggtggcgccgggcaggtgctcgacccggccgccgtccgcgcctccgtgctggcccggctggcggccgaggatctcggcggcaaacgggtgtgcctggtggtgccggacgcgacccgcagctgcccgctgccgctgctgctggacgcggtgcacgaggcgctgcacgggcgggccgccgcggtgaccgtgctgatcgccctgggcacgcacgcgccgatgaccgacgagcagctgcgccagcacctcggcgggccctacccgggcttcgaggtgcgcaatcacgagtggtggcggccggcggcgctggtgtcgctgggcctgatcggcgaggaacgggtggcgcagctgtccgagggccggatgcggcgcgccgtcgaggtcaccctgaaccgggcggtggccgagcacgacgtgtgcctggtgatcgggccggtcttcccgcacgaggtggtcggcttctccggcggcaacaagtacttcttcccgggcgtcgccgggcaggagatcatcgacttctcgcactggctcggcgcgctgatcaccagcgccgagatcatcggtacgcgcgggatcaccccggtgcgggcgctgatcgacgaggcggccgcgatgatcccgtcccgccggctggcgctgtgcctggtcgtgcagtcgggcaccggcgccctgcacgcggcggcgttcggcaccccggagcaggcgtgggcggcgtgcgcggacgtctccgcgcggacccacgtgcagtatcgggatgcgccggtgcgccgggtggtgtcggtcatcccgggcaagtacgacgacatgtggaccggggcgaagggcttctacaaggtggagccgatcgtcgcggacggcggcgaggtgatcatctacgcgccgcacatcacccggatctccgcgatgcatccggagatcgaggagatcggctaccactgccgggactacttcgtgagacagtgggaccggttctccgcgcagcactggggcgtgctggcccactcgacgcatctgcacggcgccgggacgtgggatccggtggacggggagcggccgcgggtgcgcgtcaccctggccaccggcatccccgagcaggtggtgcgcggggcgaacctcggctatcgggacccggcgacgatcgacctggaagccttggccgcggatccggacaccctggtcgtcccccaggccggcgaggtcctgttccgcctgaacgccgcggggaccgcacgatga

SEQ ID NO: 7737 - DNA, 831 bp, Actinoplanes utahensis
atgagccggcggggtgccgacgaggtggtgaccgagctcgccaagatgctgaccggcgtcggccggctcgcggtcgcgttctccggcggcgtcgactccgccctgctgctcgccctcgccgcccgggcgctcggccccggccgggtgctcgccgtgctcggcgtctcggcgagcctgcccgcggccgaacgcgccgccgcgcacgaggtggcccggcacatcggcgcgccggtcgtcgaggtgctcacccgcgagggcgagcggcccgcctaccgcgcgaacgggccggaccgctgctaccactgcaaggacgagctgttcacccggatcgacgacgaggtcctcgccgcgcaccgggtggacgccgtggcgtacggcgagaacgccgacgacgcccggcgcccggaccggcccgggtcccgggccgcgaccgagcatcgggtgctgcgaccgctcgccgacctcgggctgagcaaggcggacgtacgccgtctcgcccgcgagtgcgggctgccggtcgccgccaagccggccgcgccctgcctcgcctcgcgcatcccgcacttcgtcgaggtcaccccgcaccggctcgcgcaggtggaacgggccgaggcggcgctgcgtgacctcgggttcgccgacctgcgggtgcgtcaccacgatgacgtggcccggatcgaactgctcccggaggacctgccacgcgcggtcagctccccgatccgggaggcggtgcacgcggcggtcctggcggccgggttccggttcgccgccttcgacgcggccggcatccagtccggcgccttcaccctgcccctggtcgggcgctga

SEQ ID NO: 7738 - DNA, 288 bp, Actinoplanes utahensis
gtggagttcagtcaggtgttctggtacgtcttcatggtcctgctgttcttcggcggcagcatcggcggggtcgtccagcaccttcagtcccgccggcaccggttcaagctggagatggccagggagcacaccaacctggtgcaggcgcaggcgaagctggcggaggaacagaaccgcaagaccgcgctggaggtgcggcaggcggagctggagatcgaacgctacgaccggcgcgtccccggcagcccgccgatcccgtcgctgggtgtcaccggcgaggagcggtag

SEQ ID NO: 7739 - DNA, 783 bp, Actinoplanes utahensis
atgagcgacaccccgattccggccgatctcgacgaggcacttgccggcctgctcgacatgctcgccgctcccgacccgcgggtgcgagacgaccaggcgtactcgacgctggtccgctggatccgtggcggagcgctggacacccgtctcaccgcactcggcgacatgctggccggccgcctcgttcacccggagatccaggcccgcgccttcgcgccgctcgtcctggctgccatcgtcgatcgggaccgggaaacgggagtcctggaccgcgcggcagtgcatcgctggcgggcggcgttcggcgactggtggctgaccgaggatgaccttcgcggctgggacgagcggctcggctggctgcacgcgatcgcgcacggggccgacctcgccggagccttgggcacctcaccgcggctcgatgcggcggcgctggccgcactgctcgatctcatcggccggcggacggtgaccccgaccgcgtaccggtatgcccagatggaagaggacaggacggcgcgggcactggtgcggatactggggcggccggagttgaccgaggagggggcggtccgctggctgatccgggtggacgagctgttcgacggcggtggccccgggccgctgccgattccggtcgccaacaccctcgcggtcctgcgggcgctctacgtcatggcggaccggcatgcattgccgcaccggaccgcgatcaccgacgcgacagcggtccggctgcacgccgccttcgatgcctacccggtggacagatcgtcaccctag

SEQ ID NO: 7740 - DNA, 270 bp, Actinoplanes utahensis
gtgatcgacgacgtccgccgcacccgccccggtcccgcgcggcccgtcctcgccggctcggccgccgcgttcgtcctgctgacccccgccgtggccggcagactcgccccgctgctctccttcgacgccttcgtcagccaccgggcgcacaccctggcgctcgcccatcccgcctggcgttcggcgatggccgcggtgatgatctccccgacggttttcctgatcggctacgtcgtccctgcggcggtgatcggcatttgtacgccttag

SEQ ID NO: 7741 - DNA, 369 bp, Actinoplanes utahensis
gtgacgaaggacaggcggcgccccggtgcgctggaagcggccgtcatggcgtcgctgtgggcggccgacgcgccgatgacgccggcccaggtgcagcagcgggtcggcgacgatctggcgtacaacaccgtgcagaccatcctgatccggctgcacgagaaggatcaggtgcagcggcgccgcgccggccgcgggcacgtgtactggccggtgcgcgacgcggcggccgcggcggtggcccagatgcgcgccgcgctgccggacggcaccgaccggcacgccgtgctccggcagttcgccgcctccctcgacgcggccgacgcggcgatcctgcgtgacctgttcaccgacgccgagcgcccggcatga

SEQ ID NO: 7742 - DNA, 756 bp, Actinoplanes utahensis
atgaccgtcgccatctacctgccgctgctgctggccctgccactggcgtcgatcgcgccgcgggtcgccggccggggcacgcccggcccggccgcgcgcctcctcgccgccaccgccgcggtcgccgccgtctcgtccacctggtcgctgaccatgctggcgctcaccatgctcgacgacgtaccgccgctgtccgtccgggacgactcccccggcctggagcttcccgagccggtgcccgggccggtcgctctgctcgccggggtcctcctgctgggcgccggggtccggctgctcgtcgacgtccgccggcgctggacgacgcatcgccggttgcgggccgtcggcgaggtccaggacggcctggtcatcgccgactgggcgaaaccgatggcggtcgccgtgcccggcgccgccggccggcccgggcatctgctggtcaccaccgggatcctgcggctgctcgacgccgacgagcggcgggtgttgttcgcccacgagcaggcccacctcgagcatcgtcaccaccggctcgtcgccgtggccgccgcggccgccgcgctgaacccgctgctcatcccggtccgggacgcggtcgcctacctggtcgaacgctgggccgacgaggaggccgccgcgcacgtcggcgaccgccggctgaccgccaaggcggtggcccgggccgccctcgccggctccggcccggagccggggacggcgctgggcatcgacggcggggcggtggtccgccgctag

SEQ ID NO: 7743 - DNA, 873 bp, Actinoplanes utahensis
gtgtcgaggggacgatcaccctgtaacctacagcatgtaggagtggacatcacgcgaaagctcgggcaggcgacactggcggccgtgacggcggcgctgatcaacccggttccggccgtggccgcgacgccgaagccggaccatgtggtcatcgtcgtcctggagaacaagcggtacgacgccatcgtcggacccgcccagaccccgtggatcaccgccctggccgggcacgcggcgaacctgcgtgacttctacgccgagacacatcccagccagccgaactatctggcgctgttctccgggtcgacccagggcgtcaccgatgacaagtgcccgtacgacctgggagcccggcccaacctggcgcgtcagctgatcgacgccggcgacagcttcgccggatacgccgagggcctgccccgcacgggctggcgcggctgcgggtcggcccgctacttccggcggcacaccccgtgggcgaacttcagcaacgtgccgtcgtcggtcagccggccgtactccgccttcccgtcgcactaccggaagctgccgaccgtctcgttcgtgatccccgacgtgtgcgacgacatgcacgactgctcccgggcgaccggcgacgcgtggctgcgcgaacacctcgccaagtacgtgacctgggcccggacgcacaacagctggttcgtgctcaccttcgacgaggacgaccggaccgacgccgaccacattccggccatcgtcatcggggtgggggtgccggcgggccagtacaccgtccggctcgaccactacgacctgctgcacagcctggagaagatgtacggtctgccgtacctgggcgcggccgccgcgcgtaccggcctgccctgggtctag

SEQ ID NO: 7744 - DNA, 735 bp, Actinoplanes utahensis
atgaaccaggcaacgatctccgcccgccccgccctggccgtggtgctcaccgcgctgctgctcatcgccacgacggcggccgcggtcggccggctcggggtgtcccgggcggtggtgaccgcctcactgcgcgcggtcgcccagctggcgctggtgtccgtgctgatcaccgcggtgctgcgggcgtggtggtccaccgcggtgttcctgctgctgatggtgctggtcgcggcggccacctcggcgcggcggatcagcaccctgcggcgcggatggccggcgatcgtcccgatcgtggccggcgccgggctcgccgggatcgtggtcgtcgccgcgggcacggtgccgccgaccgagatcgcggtcctgccgatcgccgggatcctgatcggtggggcgatgaccgccacgtcgctgtccggccggcgcgcccgggacgaactgcgcgaccggcgcggcgagtacgaggcggccctggccctgggtttcctgccgcgcgacgccgccctggaggtgtgccggcccaccgccggccaggcgctggtgccggccctggaccagacccggacggtcgggctggtgacgttgccgggcgcgttcgtcggggtgctgctcggcgggggctcggcggtccaggccggcgccacccagctgctggtcctggtcgggctgttggcggccgaggcggtcgccgccgccctgaccgtcgagctggtggcgaacaacctggtctga

SEQ ID NO: 7745 - DNA, 1275 bp, Actinoplanes utahensis
atgagctactcctccagcggtctggccacgcgcaccgacagggcgtggctgaccaaggtcccggcgatcaccgccaccttctgggtgatcaagatcctgtcgaccacggtcggtgagacgttctccgactacctggccgtcaacgtcggactcggcccgctggtcaccgacgcgatcatgatgaccgtgctggcgatcgcactggtccggcaattccgtaccgccaagtacacgccctggatctactgggcctgcgtggtgctggtcagcatcgtcggcacccagatcaccgacttcttcaccgacaccctcggcgtcagcctgtacgtgagcacggcggtgttcgcggtgatcctggcgatcgtcttcatcacctggcaccggcaggaacacaccctggcgatcacctcgatcgacaccccgcgccgggaggcgttctactggggcgcgatcctgaccacgttcgcgctcggcaccgccgccggcgacctgtccaccgaggcgctcagcctcggcttccgcaacggcgtgctgatcttcggcgcgctgatcctgatcacctgggcggcctcccggttcggcgcgagcctggtggcgacgttctggatcgcgtatgtgctcacccgcccgctgggcgcgtcgctcggcgacctgctcacccagtcgaaggacttcggtggcctggatctcggcgccagcgccaccagcctgctgttcttcggcgtcatcctgatcctggtgatccgcgagcagttgctggccaaccggcacggggtcgccgagaagggcgacgggccgctcggtggccgccgcgccgactacgcctgggccggcgccgcagccgtggcgatcgcggtcgccggcgtcgggctgagcagcctgcacaccggcagcaccgacacgacggcgaccaccaccacgacggacgtcggcggcaccgccaccggcggcggccggccggcgcaggtgaaggtgatccacccgacgaccaagctcggcaacctcaccaggttcgcgacgatcaccgccgcggtcaaggccaaagtcgacaagaacgacctggccggcggcaaggccaaggtcaaggacctggaagtggcgtgggacgaggccgaggccggtctcaagccccgcgaccccggcaagtggagccggctcgacggcgagatcgacgacgtcctcaccgccctgcgcgccggcaaccccagccaggccgactgcaccgccgccctgaagaccctgatcaccaccctgaaccagttcgacggcgtctga

SEQ ID NO: 7746 - DNA, 1815 bp, Actinoplanes utahensis
gtgatcgaatcgttcgaggcgtcctggcagacggtgggcgacaccggcctccgggcgagcgccgagccggccttcgaccggatcgccggtctggcccgggttctgctcagcgtccccgtggcggtcgtggccctgttcgacgcccaggggcagttcttccccggcgccgcggggctggccgaaccctgggccactctgcggcaggcaccgctgagccacaccctgtacgagccggcagacctgcggcaaggacccgtcgtcgtcgccgacgcccgcaccgacccacgatgcgcccaccgcccggcgatcagctcgttacgggccggcagttacgtggcaatgccgctgaccgacaacgccggcaccgttctgggagcgttgtgcgtcatcggcgaccggcctcgcgcctggtccgcaacggacctgtcgcagctgtccgacctcgccctgacctgctcggacagcctgcaatcgcgaatcgctctcgggcgggccgaaagccgcagcgccgccgcgacggcgaccagccgccaggcccgggcggtctccgcacgcggcgaactcctgctcaaggccagcgtcctgctggcgcaggcgcgtaccgtcgccgacaccgtggacgcggtcgcccagctcacctcaccggtgttcgaccccgacctgatcggcatggtcctgctcgacgacgagcaccgcctgcgggtcttcggcgccgacgggctccccggcgacgtcgcctcccgctgggtcagcttccccacctcggcgccgctgccggccgccacggcgtttcgcaccggacagctgctgtccctgcccgacccggccgccatcaccgccgagttcccgcagctcgccgacgaattcttcggactgggctggaaagccatcgcctgtcagcccctccccggcgtgcacggcaccctcggcgtcctcaccctgtcctggacgcacccgcaacacctcgacgccgagcagcgcagcatcatcgtcaccgtggccggatacctcgggcaggccctgcaacgcatcgcccacctggacgcgcagtacaccgccgcccgaaccctgcagagggccctgctcacgcgactgccgcacaccgcgacgctgcggctggccgcccgctacctacccgcccaccacggtgatctggtcggcggagactggtacgacacggtcccgctcgccgacgaccggctcgccctggtcatcggcgacgtatccgggcacaacctgaccgccgccgcggccatgagcgaactgcgcagcatggcccgggccctgctcatcgaccggcccgacactccctcgggggtcctgcaccgcctcgatcacgccaatcaggccctcggcgccgacatcatcgccaccgcggtcatcgcctacctcgatccgcaaccggacggcagccaccgcctgcaatggtcgaacgccggacaccccgcgcccaccctgatcaccgccggcaaccgggtcaccgggctgcccggcgccgacccgctgctcggcgcccgccaccgtcgcccccggagcacccaccatcacgtgctcccgcccggcgccaccctcctgctgcacaccgacgggctgatcgagacgcgtgacgccagcctcgacgagggcatctcccagctgcatcgactactttcccaccatcgcgaccccgtgacgttcgccgatgtactcgccgcccacgccaacgcgcgcatccgtgaggacgacgtcgccttcctcctggccaccgccgtgccggtagccgcccgacacacgctcacggcacccgccgaaggcgactgcgccgacggcagctga

SEQ ID NO: 7747 - DNA, 381 bp, Actinoplanes utahensis
gtgagtcatattgtcgcggccgacgacgacgccggcatccgccgggtggtggagagggtgctgacccgtgccggccacacggtggacctgtgcagcaacggtcaggagcttgtcaccgaggttcgcgcccagcatccggacgcggtcgtgaccgacaacgagatgccggggatgaccggcctgcaggcacgcgcggaactactcaccaccccggataccgaggacatcccggtcgtgatggccagtggctcggtcactccggagcaggccgccgcaacgcttcgagagggcgaccgggtcgtgcacaaaccgttccagccggccgagttgcgcgacgctgtgcgagaggtcctgatccaccgtcgaccgcgaccggcctga

SEQ ID NO: 7748 - DNA, 1983 bp, Actinoplanes utahensis
ttgcccgaactgaggggcatgcaggaccagttctttctgatgggcaatctggtgatcatggtggcctatgcggcgatcatggtggcgatcgtgggtccggttgctcacgctgggcaactgcgcaccaaccggctggcgaccgccaccgcgttgatcttcttcagttgcgcggtgggccatggcctgcatgccgcgatggcgtatcgcactgtcatgcaggtcccggccgctcaccgcatgcagatggacgccgccgggtggtcctggacctcggccgtgtgggacctgctcaccgccggcgtgggcgtctactactggacgctgcgccgcaactatggcgttctgctcggtaagggtggcctgtacgtggatccgtggggtcagcgccgactggacgaggctgacgcgcgggaacgcgccgcccgcgatgtcgccgaggcgcagcgggccgccctggcgaccgtggtcgagcacaccgacgacgcggtcgtcgggctcaccccggaagggatcatcacggcgtggaacggcggcgcggaacgcctgttcggatacccggcggaggaagccctcggccagcccgtcgcggtgctggccgacgcgaccggcggcggcgagcaggtggacgtcctcgaccggatcaggcagggcgagcgcggcatggcgtacgagacccgacggctgcgcagggacgggaccgccgtcgacgtcgcgctgacgatcaccccgatccacgatcaggcgggcacggtcatcggcgcctccgccatcgcccgcgacatcaccgcggccaaggaggccgccgaacaccggcgtgcgatggaggagcgcagcaaccaggcgcagcgcatggagagcctcggcaagctggccggtggtgtcgctcatgacttcaacaacattctggcgatcatcgccaactacaccgagttcgtggcggcggatacgagcgaccggccgggtgtgcaagcggacctcacgcaggtacgcagggcggtggagcgggcgaccaatctgacccggcagttgctgaccttcacccgcgcgcaggccgtccagccggaggacgtggacctcaacatggcggtcaccgaagtccagatgatgttggagcgcaccatcggcgagcacatcgacctggtcgcggtgccctcgacgcggcccctgatggtgcacaccgatccgggtcagctgcagcaggtgctgttgaacctggcgatcaatgcccgggacgcgatgcccgagggcggcaccctggttctggaggccgacgccgtgacgctggacggcgaggaggtcgacatgcaaccgcccctgcccgccggcacgtacgcccgcctgttggtcagcgacacgggcgagggcatgtcgcccgaaacggccaagcgcatcttcgagccgttctacaccaccaagccgcagggccgcggcaccggattggggctggccaccgtctacggcatcgtgaccgaagccggaggcagcatcaacgtctactcggagctgaacctcggtacgaccttccggatctacctcccgttggtgacggcagagtccgccgccgctgctgccgcgccggtgcacagtacggcgccaccactcggcggcggcagcaccgttctcgtcgtcgaggacgagccggctctcgcccggatggtcgcccgcatcctcagtgaagccgaataccgcgtgctcgttgccgccgatgccggcgaagcactggacctgtacgaacaacacggctgcgacgccttgctgactgatgtgatcatgcccggtatctccgggcgccgtctggccgagtcgctgcacgagcgtcagccggacctccccgtcctctacatgtcggggtacagcaacggcctgctcggcaccacccacatcctcgacgaggacatcgcctttctcgagaagcccttcaccgccgctgacctgctccacaagctggcagcggtacggacgacgagctccagccagaggtga

SEQ ID NO: 7749 - DNA, 2391 bp, Actinoplanes utahensis
atgtttcccgggaccgctcagcttcggcgcggctgtgccgacccgggagacatgggtggtgtgaaccttccgcggccggatcccgcgcccctcgagccgctcgaggagcggacgggcgccggcgtggcgcgttggctggcccgaaccatcctgaccatggcgcggaccgggaacttctcggatctgatgcgggtcgtcgtggagggtgtggcccaggctgtgccggcggacgcggtggcggtcgtcgagcggggccgcgtcgtggcgatggtcggctcggacgagcccgaccgggttctgcgggtcgcatccggcggcggcaccgccgacgacggcgtggtggtaccggtggcaagggtcgcgccggatgccacagcgtggaccggcgagatgacgctggtgctgaccggccggggtctgggctccgacgagatcgcggtggccgaggcggtcgccgccgcgttgggcgtgtgcctgtccggccggcgccgccacgacaacgattccccaccggcgggtgcggccgatgccgaggggcaggcggcccggctgctggagcggctgtcggtggtgcagcgggccattgcccgccaggcacccttggacgaaatcttccgtacggtgaccgcgcagacgcaggccctgctgggtgacgacatcgtcgcgctggccctgcgtgacggcgacgacccggaacggcttcacctggtcgccgcgtacggattcccggacgacgtgctgcaccgtctctggtccaccccggtggcagccggcggcgtcacggggcaggcggtcctccgcggtgaactggtggtgttcgaccggtacgccgactccgcacacgcgctgcgcgaaggcgtggaggccggggtgcacaccgcgatggcagcgcccgtcatccatgacgcaagagtgttgggaagcctgttcgtggcctcccggaaaccggaacggagctacggccccgctgaccagaacatcctgaccgccttcgccgggcacatcggggtggcgatccagtcggcgcgcgccgtggacgggctccagcatgccttccgcgatccgttgaccggattggcgagccgggcgctgttgctcaaccggctggcgcacagccttgcccatgcccatcgcggcggtggccgcatcgcggtgctgctgatcgacctgcaccggttccgagccgtgaacgacgccgtgggccacgccatgggggacgcgatcctcatcggtgccgccgcgcgtctgcgtgatctcgtgcgggggaccgacaccgtcgcgcgctgtggtggcgacgagttcgcggtgctcctgcacggtgcggagcacgtcgcgcaggcgagcgcgttcgctcgtcgggtgatggcggccatggccaggccgttcaccgacggcagcgacggtgaggtcaccgtgggatgtcatgtcgggatcgcgttcagcggccccggtgccgattccgccgagaccctgttgcagggggccgacctggcgctgatcgccgccaagcagcgcagcatgggcacctacgagatcttccagccggcgatgcaggcggccctgcgcgtccgcaccaggatcgaggcggacctgcggtacgcggtggaacgcggcgagttggaggtgcacttccagccgatcgtcgacctgcgcgatgcgcggatcgccggatgtgaggcgctggtgcgctggcgtcatccgcagcgcggcatggtgtctccgctcgacttcatctcgcttgccgaacagaacggtgcgatcactgccatcggcaggtgggtgctgcgccaggcgtgccggcagaccgcgcagtggaaccggcgccgcccgcacgcgccgttgtacgtcgcggtgaacctgtccggacggcagctcgaacagtcgtcgctggccgacgacgtcgtccaggtgttgcgcgaaaccggcctggaaagcaatcggctcgtcctggaactgaccgagtccgtactggtggcggacgcacccgcgacgctggcgcagttgcgcaggttcaaggagctcggcgtacgcctggccgtggacgacttcggcaccggctactcctccctggcctacctgcgccggttccccatcgacattctcaagatcgataagtcgttcgtcgatgacatcgccaccgctcccgccagcgcggccctggccgaaggcatcgttcatctggcccacacgatgggcctcgcgacggtcgccgagggagtcgaggacgcccgtcagcgggaggtcctgctgaacagcggctgcgaattcgcgcagggttaccatttcgccaagccgctgaccgccaccgagtgcggtgagcacctgttcggtgagcagccgtccggctccgagcggccgcagcccggctcacgtgccgccgcacgtcggtga

SEQ ID NO: 7750 - DNA, 4257 bp, Actinoplanes utahensis
atggtgacgggtgagcaggcaacctccggtccgcgtccggctgtaccggcctggtcggtgtacgcattcgcgcaggcgaccgggtcggggatcttcttcggcctgccagacggtctgccgcgcgcgacgttactggtggtgctcaacgcggtgacggtgctggcggtggcgacgaccgcccgccgctgcgccgaaggccgccggggttggtcactgctggccacggctcagctgctcagcaccctgggatgggtgtgctggtacctgtacccgatggccgcggcggtgaccgtgccctcaccgtcgctgggtgacgtgttcttcatcggctcctacgccctgtccgcggtgggcgtcgggatgctggcgcgccggcatgccgaccgtcgcacggtgctggacgcggcgatcgtcaccacctcactgggggtgttgctgtgggtggtgttcatcgccggccacgcggtgactccggggctgagcctgccccaacgcctgaccgccgtcgcgtatccggtgctcgatctgctgctgctggcggccgccctgccgctggcgttgaacgtccgacggtcgccgcgcaccctgctgctgctcggttgggtggcgttgcagctgtgcggcgacatggtgttcaacgtgcaggtgctgcacggcacgttccgcttcggcggggcgacgttcggctggtggctgctgtcgtacgcggtgctcagcgccgcggcgcggtatcagtcgtcgcccgcgaccggggcggcgtcgaggtgggtgcgccccgtgctgctcaccatcgcggtgttgccgctgccggtactgctgctgatgcgggcgttgcaggcctccgggcaggacgtggtggtcatcgccggcgggtcgttggcggtgacgatgctcgtggtgctgcggctgctgaccaccggccggcagagcccgccctcggccgcggtgcgggcacacctgcgccgggcggtgacccggctgtgcgcgggattcgtggtgttggcgctgctgccgctcgccggcctggcatatctgtcggtacgcgaggccaccgacaccgtccggaccgaggtggaccggcggctgaccaccagcgccgatgccagcgtcgcctatgtcgagcagaagcttgccgggctacgggccctggtggcctcctacgccgaacggcgactgctcgcggccgcactcgccgacaacgccaccgccgaccccgccgcgctgcagcatcacctcaccgggctggagtcccgcgacccggcgttcgtcggggcctgggtgctcgacgccgccggcaggatgctggctttcgatccccccacgccgagcgtcatcggcctcaacttcgcccaccgcgactacttccagggcgcgctgcggacccgtgcgccctacgtctccgaggcgttcgcgaccgcgacacccggcaatccgcgagtcgtcgcggtcagcgcgccgatcctgcacgacggtcagcttgtcggcgtgatcaccctgggataccggctggcggcgctggccgcattcaccgaccagctcgccggcgcgcaacaggtgcggttgaaactcgccgaccgccgcggcaccctgctcgccggacccggcagcgagcagcccacgctcacgtcggccaccggcgacccgcagatccgcgccgcactcgccggcggcagcggcaccgcccggcacatgtcggacggggtggagaccctgtcggcctaccgcaccgtcgccagcgtcggctgggcggtgaaagcggagatccccgcggcgcaggcgttcgccggcgccacccggttcaccggccgggtcggggccgtgacgacgctgctcgcgcaggtgctgctgctcggcctcgtgctggcggtgcgcagcgaacgtgcccgccacgccgcccaggcccacgcgggccggcgcgaagctcaggtcaccgacatcctgcaggccgccggcgacgcgttcgtctccatcgacaccgcgggcaacgtgacgcgctggaacacccaggccgagatcattttcggctggcccgcggatcaggcagtcggtcgccccctcaccgagctgatcatgccggatgaccagcgacacgctcatctggccggcgtgcagcgcgtcgccgagggtgggcaaccgcacctgctcgggcaacgcgtcgaggtgcaggcccgccgccgcgacggcgaactgttcccggcggagttgcacgtctgggcatccggcgacgccgacgacacgacgttcagcgcgttcatccgcgacatcaccgaccgtaaactcgccgaggccgaggtcgccgccgcccgggacgaggcgcttgccgcctcccggatgaaatcggaattcgtggcgaacatgagccacgagatccgcaccccgatgaacggcgtcatcggcctcaccagcctgctgctggacaccgacctcgacgcccgccagcgcgactacctcaccacggtgcagaactccgccgacgcgctgctcaacgtcatcaacgacatcctcgacttctccaagatcgaggccggcaagctcgacatcgacccggtcgacttcgacccgcgcgccgtggtcgaggacgtggtcagtctgctcgccgcgaccgctcaggccaagggtctggagatcgccgcggtgatcaccccggccatcccgcccgcgctgaacggcgatgctcaccggatccggcagattctgacgaacctggtctccaacgcggtgaagttcaccgcgcacggcgaggtcgtcgtcaccgtcgagatcggcgaacccagggacggcgtccgcgaggtcaccttcgccgtcaccgacaccggtatcggcatccccgccgaccggcaggcgcacctcttcgaagcgttcacccaggccgatgcctccaccacccgccgatacggcggcaccgggctcggactgaccatcagccgtcagctcgtcgggctgatgggcggcagcatcggcctggacagcgaacccggccgcggcagccgcttccacttcaccctgcccctgcccggtgcgggcgcgccgctcccgggctcgcaccccgacccggaactcacggatgtccgcgtgctggtcgtcgacgacaactcgaccaaccgcaccgtcgtcaccggactgctcaccggctggagcatggacgcccacgccgtggcggacgccggtgcggcactcacggcgctccgggaagccgccgacgccggcaccccgtacgccgtcgcgctgctggacatgcacatgcccggcctcgacggcatcgacctggcccgcatcatccacggcgatcccctcctgcagggcaccagcctcgcgatgctcacgtccaccaaccaggccggcgaagcacaggccgcccgcgacgccggcgtgctggcctacctcaccaaaccggtgcgggcgatccagcttcgcaccaccctgctacaactcctgggccgcacgcccgcctcccccgcaccggagcagacgagcatcgcggagcgacccggttcgaccgcgcacgtcctgatcgccgaggacaacgaggtcaaccaggaggtcacccgggagatgctcgccgctctcggctacacctgcgacatcgccgccgacggcgagcaggccgtgcggatgctgcagacgcgccactacgacgccgtcctcatggactgtcagatgcccgtgctcgacggctatcaggccaccgaagtcatccgccggctccccgcgccccgcaacgccgtacccgtcatcgccttgaccgcctccgtcctcgcctccgaccagcagcgctgccgcagcgccggcatggacgatgtgctcaccaagccattgcgcaagcacgacctgcaggcctatctgacccgcttcctgccgaatcccgcctcgcccacgactgccaccaccaccatcgccgagcaaccgcacgacatcagcgacctgctcgaccccgccgccgtcgaagaactccgcgagatgggcccgggcttcatcgaccggatcctgcccaactatctgcgcaacgcccccgccgccgccgcacagatcgccgccgcggcggcccgtcaggacatgaccgaactcgcccgcctggcacacaaattgcgcggcagcagcggcaccctcgccggccaccgcctcgccgccacctgcaccgacctggagaacgccgccaccagcggcgacgtcgtcgccgccgccaccctcgccgcgctcgtccaccaacagacccacgccacctgcgacgccctgcacaccaccctgaccctccactga

SEQ ID NO: 7751 - DNA, 762 bp, Actinoplanes utahensis
gtggcgggccgccgtccgcgggggatttacccgggcggcccggttggcgatgatgcagggatgtcctcagcagccgtgccgcccggtacaccccagcccgcccccgtcgcgcccgcggaactcatcggccggttgcgcccgttcgtgctggcccgagcggtggtgcccgccggtgccgccgccgtcggcgagatgctgcccggtctcgtcgccacgctcggcgtcgacatgggtggccaggtcaacttcgtcccgaccgcaaccgtcgaggccctgggcggcctgcgggcagcatggaaggccgcggtcaccaatctgacccggctgccggcgatgagcgtgggcagcctcgaagccaccgccgggcacccggacagcgtgatctacgaactgcacagcaccgatcccttcggcgcttcgcgggtctgtcacctggacggcctgctggctaccgccaaggtcgccggcagccggcatggactgctggtcgccctgccgacgtggtacaccgtgctccttcacgtgctgaccggtcccggcgtactcgcggccttgaacgtgatgggtaaggcggcgtccgccgagcatgccgccgcctccggcccgaaggcggtgagcccggacgtgttcttcgtcaacagtgcgggcaaagccgagacggtggtctacagcgacagcatggacggcctggtggtcaacacgaacggcctcatcaaggagtcgttgttcggcccgggcggcctgctgccgcagggtcgatag

SEQ ID NO: 7752 - DNA, 1893 bp, Actinoplanes utahensis
atgagcgactcgatcggccgcctgccccgggagccgggaacggagacggcacgcgtgcggcgctggtggcgcgatccggtcatcgtcggtctgggcctgtgcggcctggccgcgacatgctggttcctgctcggcggtgccgacgaccgtacccgggtgctcgtcacctggatgtcgctgcccccactcgacctggcgatcctcctgctgtcgcgccgggtggcgcgaggcgtggacggagcaccgcgccgcttctggcggtcgatggccatcggtggcggcctgtgggcggcgggcgacctcagccaggccctggtcactctggtcggcggcccggcgcgaaccttggacgccgtgcccacgcaggccggggccgcactcgtcggcgctctgctcatcgtcgtggtgaccctgacctacccgatcggaaccaggtcgaggaccgtccggttgcgcttccacctggacgcggcgaccgtgctgagcgccgccaccgtggtgttctccgccctgctgatcgggtcaggcatcaccgcggccggcttctccgcgttcaccaccgccatgtccggcttcatcgtgctcatggtgggtgtcttcgtcaccctgcggctgggcctgtcaggccgcagcccggtccagggtgcggccgcggccgccatcgtcgccgccgcgacggtccagggtgtcgcgaacatgatcgtcccgttcggcgtccagggacagatgctgaccgtgcagggcctcacgctggtgctgccgtgcgttctcgcggcgctgtcggcgcgactccaggaacgccgacaggcgcacgggccacgcccggcggcggcgccggcgcgcccgcgacggcgattcagcattcttccgtacgccgcgaccatcctcgtcttcgcggttctgatcgtctcgctgctgaacgggacgaccgcacagacgtggggcgcggtggccgggctcctggtgaacttcgtgctggtcgtggcgcggcagacagtcgcgttcagcgagaacgcccggttgctggaccgcctcgacgacaccgtcaagcagctcgggcagcagcacaaccggctcgaggcgctgctgcggcactcctcggacatcacctcgatctgtgacgccgagggcaggatcacgtacgtgacgccggtggtcgcccaggtactcggctaccaaccggaggacctcatgggaatccggctcaccaccctcatccacgacgacgatcaggtgcagctcagcagccgcacggacgtcctgttcggcgcgcccggcgcgcagatcagctatcacgcccggttccggcacgccgacggctcgtaccggtggatcgaggtggtggccgtcaaccagctgcacgagagcggcatcggcggcgtggtcagcaacgcgcgcgatgtcaccgaggaacgggcggcccgcgagcaactgcggcaccaggccacccacgacgcgctcaccgggctcgccaaccggcggctgctcgccgaacggatgcgcgagctgcgccccgccgaggccgccgtgctgctcatcgatctcgacggattcaaacccatcaacgacacgtacggtcatgcggccggcgacgccgtgctgctgcatgtggccgacgtgctccgccgctgcgccggacccgacgccctgccggcccgtctcggcggcgacgagttcgcgatcctgctccccggcgccggcatcgaggcggccgaccggatcgcggaccggctgcaggaactgctcgcccagccggcgcaggtggacggccgggcgatccgggccagggcgagcgtgggatgcgccgccggcccgaccaccgacccggaggccctgctgcaccgcgccgacgcccggatgtacgagcgtaagcgcctcacccgggtcccctga

SEQ ID NO: 7753 - DNA, 111 bp, Actinoplanes utahensis
gtgctgcccgcaccgtacgactgggtgatcgtctggtcgaaggcgtccgaggtggtggtggcggacgcggatgatccgaccaccgacctcagggtgccgcgagcggtgtag

SEQ ID NO: 7754 - DNA, 255 bp, Actinoplanes utahensis
ttggcggttttgccggccagcttcaccatcgccgacaccgtgtacggcctggtggtgtcgaccggggcatcgtcgccggtgatcgtggaggtggtgccgtcgaacgacgccaccgcaccgcgcgtggtgtcgttcacccacgcgaccttggtggcggtcagacggttgttgccggagctgtcggcgatcgcggtaccgctggtctggttcagcctccagcgggccgccggggtcaggtcggggtcgccgttgtag

SEQ ID NO: 7755 - DNA, 159 bp, Actinoplanes utahensis
gtggtcgccgtggtcgcggaccgggtcagcgccgcgggcgagctcacctgcgaagcaccgagcgacaccttcagcgagttggccttcatcgaccaccgcgagcccgacggcaccagggtcgcgtcgatcggctgccaactgccgtcctcggcgcgatag

SEQ ID NO: 7756 - DNA, 525 bp, Actinoplanes utahensis
atgtgtcgcaccgtgaagcgtggatttcaacgtaccggcaggtgggcgtggaccccgcgccggatcgccatcgcgggcggcggtgctgcggccgcgctggccgcggccggggtcacctgggcgctactgcccggtgacccgcaggagccgcgtccccgggagtaccgcgacgcgaccgcttgcctgcttaccgatcagcagggggtggccggtaaggacgcggccccgatctgggcggcgatgcagtcggcgtcggcgcgcacgcacggtcaggtccgctacctcgccgtgaccggtgagcagtccgtggccaatgctgagtcattcgtgggcacgctcgttctcggccggtgttcggtgatcgtcgccgagcccgggatcccggaccaggccgtgcgtgcggccgcggcgcagcactccggtcagcgattcctggtgatcggcggggtgaaggcaggctcgaatgtcaccgtcgtggcagccgcgaagatcgatgaggtcgtgggtggcgttttgaaccgctag

SEQ ID NO: 7757 - DNA, 747 bp, Actinoplanes utahensis
gtggccgccggcacggtcgccatgacggtgctcgccggcgccgctcccgcccacgcgatcgcgaacggggaggaggtccccgacggtcagtacgggttctccgtcaagctgaccatgacgggcatcccgaccgccgacggtgggcgccgcaacagtgggtgttcgggagccctggtctcggctcggtggatcatcacggccgggcactgtttccgggacgcgaacggggtccgggtggagcacccggtggccgacctgaccacggcggccgtgggccgtaccgacaccaccgacaccagccgcgggcacctgctgaaggtggtcgccgtccggcagtcaccgaccgccgacgtgtcgctcgccatgctggaggagccggtccgcgacgtccgcccgatccggctcgccggcaagccgccggcggtcggcacgatcgtgcggctcaccgggtacggctcgctgaccagcagcaacccggtgccggtgaaccggctgcggaccgggcagctgcaggtggcgcagctcagcgacacggtgaccgggttccgcggttacgcaccgcaggccgacaccacgccgtgcccgtacgactcgggcgggccctacttcaccgagagcaaagggatcccgaaattggtggcggtggtcagcaacgggcccagctgcccgcacaccgcgatcgagaacggcgcccgcaccgacaacatcaccgcctggatcaggaaggtaatccactccggcagatag

SEQ ID NO: 7758 - DNA, 3579 bp, Actinoplanes utahensis
atgcaacaacccttcaaaatcgccagcgtgctggccctgctgatggccatgctggtggtccccacgccggcccgggccgatcaggccgcgatcaccgacggtctcgtgctctggtacaaactcgacgagacggccgggtcggtggccaccgactcctccggccacgcgcacaacgggacggtcgccggcacggcgtcctggaccggcggccagggcctgaccttcgacgggtccagcacctacgtgaaggtcccgaacgacatcatgtcggggctcaccgcaatctcggtgtcgttcgacgtcctggtcgacgcggaccagccgaccccgtacttcctctacggattcggcaacaccgacacctccaccgggtacggcaacggatacctgttcacgaccggcaacaacctgcgtaccgcgatctccacggcgaactggaccaaggagcagagcacccaggcgcccgcgccgcagccgctcgcccgcggcacgtggaaacacctcgcgtacacccagaccggcaccaccgggacgctgttcgaggacggcacgccgatcgccacgaacacctccgtcaccatcaagccgggcgacatcggcgccggcacgaccagcgcgaactacctcggcaggtcgaactacaccggcgaccggctgctcaagggcaggatcaaggacttccgggtgtacgaccgggccctcggcgacccggagctgcagagcctcgccgagccggtggtctccgccgagctggcagccgaccgggccacgctcaccctcggcgacacctccgccctcaccgcggacctgagcctcccggcgaccgcaccccgggggacgaggctgacctgggccaccagcgacgcctcggtgatcaccgcggccggcgtggtgatccggccgccgtccgggcaggcggccggcagcgcgacgctcaccgccaccctcacccgcggttcgctgaccgccaccagatccttcccggtcaccgtgccaccgcagctcagcgccgaggacgcggtacgggaggccgccaccgccctcaccgtgcgcaacctcggtgacgtccggggcaacctgacgctgccggccaccggggcgtacggcaccacggtcacctggtcgtcggaccggcccggggtgatcgacgacaccggtgtcgtgcaccggccgcaggccggtcagggcgccaccaccgtggctctgaccgcgacggtccactccggcgcggcctcggccacccggacgctgaccgcgaccgtgcccgagctgcccgcggcccaggcccggaccgggtacctgttcagctacttcaccggcgagggcaccgcgaccggcgagcagctgcacttcgcggtgagtagggcgaacgacccgctgtcctaccgcgaggtcaacgacggcaagccggtgctgacctcgacgctgggcacgaagggtctgcgcgacccgttcatcatccgctcgcccgagggcgacaagttctaccagatcgccaccgacctgaagatctacggcaacggcgactgggacgcgtcgcagcgtaccggcagtagatcgatcatggtgtgggagtccaccgacctggtccactggaccgaccagcgcctggtcaaggtctcgccggacaccgccggcaacacctgggcgccggaggccttctacgacaagaccctgggggagtacgtcgtcttctgggcttcgaagctctacgacgccgcggacaccgcgcacgccggcaacacctacaaccggatgatgtacgcgacgacccgcgacttctacaccttcagcgaaccgaaggtctggaaggacccgggctactcggtgatcgactcgacgatgatcgagaacgacggcgagtactaccggttcaccaaggacgagcgcaacaacacctcgagcacgccgtgcgccaaattcctgatcgaggagaagtccgcctcgatcctgagcacgaactacgacttcgtcagcgagtgcatcggctccggcagcatcagcgcgggcgaggggccgctggtgttcaaatcgaacaccgagcagcggtggtacctgttcatcgacgagttcggcggccaggggtacgtgccgttcaccaccacggacctggcgtccggcaagtggacgaaggtcgcgtcgtactcgctgccggccagcccgcggcacggcaccgtcctgccggtcacccaggccgagtacgaccggctgctcaccgcctaccagccgaacctgctggtcaccgcggtggacccgattccgctcgtcacgccggccggcgtcgccccggctctcccggcccgggtcaccgcccggttcgcggacggttcctcgtccagcgtcgcggtcacctgggacgccgtgccgccggcggcgtacgcccagccgggcacgttcaccgtcgccggcaccgtcgccgagagccagaacgtcaaggccggcgtggtggtgaccgtccccgacgtgcaggcgccggtggtcagcgccaccgtcaccccggccgtaccggccagcggatggttcaccggcccggcgacggtcacggtgaccgccaccgacgcggtcgacggtgcggtggtcccgaaggtccgggtcacccgctccggcgacccggccggccagtggaccgaccaggcaccaccgctgaccctcggtgcggacggcagctacctggtcgaatacaccgccatcgacgccgctggcaacagctccggaaccggatcggtgaccgtgcgcatcgacacggcgcccccggtgtcgcaggccacggtcgacgcgcagagccggaccgtgacactgcgggcggccgacaacgactccggcgtcagcgggctggcgtattcggtggacggcggccgcacctggcagccgtacaccgtgccggtgcgcgccgggcagacccggttgacggtgctctaccgggccaccgacgtcgccgggaacgtcgaggtgatcaaccaggccgtggtgccggccgtacgcgtggtgctcgccccgagcacgacccgggcgaccctggacgcgacgaaggtgacctacggcagtgtgccggtggtgcgggtgacggtcaccggcaagctggcggagcgcccctcgggtaccgtccgggtgctgctcggcgggacctcggtcggctccggcaccctggccgggggtggagccaccgtccggctggcgaagaccatcgcggtcggcacccggtcgttgcgggtcgtctacgacggcgacgcccgctacgccggctcgtcggcgaacctgaccctgaaggtggtcgcggcggcctcgaagaccgcattgtccgccaagtccggcacggtccacaccggccgcaaggcgcagctcaccgtgacggtgaccggcgcggccggcgtcacaccgtccgggacggtgctggtgatcgcgaccaacggcacgtccaccctggtccgcacggtgcgcctcgaccgtgccggcagggcggtgctcgccctgggcccgctgggcgcgaagggcacctaccggatcaccgcgcagtacctcggctcagcgtcggtgaccggctcgaccagcgcggcgacccggatcacggtgatccgctga

SEQ ID NO: 7759 - DNA, 810 bp, Actinoplanes utahensis
atgtcacgcatcctgcgcagagttctgctcctggccgcggcacccgtcgccgccctcggattcctcgccgcaccggccgccgccagcccctcccccgccccggtgctgcacttcaacgccgacggcagcaccgcggtcgacggggtcatcgagtccggccacccggtcaccgtcgacttcgacccggcacgcctgccccggtgccgcggcaccgacgagtacggcgactcctggggcatctccgtccagtaccgcatcgacggcggcgacctgcgggtctacccggtcacccagcgggtgacggccgacggcaaggacaccacggtccgcagcctgggcaccctgcaactgcgcccggacacccaccagctgcagatgtggttcgtcgccgaggaccgcaccggctgccacgaggaggacaccgccggcggcgcgaactaccggttcgacatcaaccagccgccggtgctggcccgcgccgcctacaacgccgactggtcggagaccgtgaccgggccgctgcgccggggcggcgccctggtgctcaactacgatccggcccggctcccgcagtgccgggccacctaccgcggctaccccgcgtgggagatcgacgtctactaccgcttcgacggaggcccggtgcagtccaccccggtgaaccaggccgccgaggcgatcccggtccgcatcgacatcccggcgaacgcccggaagatcgagacgtggttcaagaactccgacccgtacacgcagtgctcggcgtacgactcggactacggcaggaactacaccttcccgatcggctga

SEQ ID NO: 7760 - DNA, 363 bp, Actinoplanes utahensis
atgaccgaggatccatcatcatcacgacgcgagcgactcggccgggtggccacgacggtcgctctgctgtcggtgccgctgatgtcgctgctgtgctgcgttccgggcttcgccgcgctcggcgggatggactccagctgcggcaccggcttcgatcacgactgcctgaatctctcccggccggtcttcaccgtctggccctgggtgaccggcggcatcgccgcggtcgccctcgtgacccggctcgcgatcccccgccgggccgagggacttcgcctggtggcgggagccttcatcgtggtgccacccctggtgaacgcggtggcggcgttcgccgcggtgcaccggcccggcgtgatctga

SEQ ID NO: 7761 - DNA, 1356 bp, Actinoplanes utahensis
atgaccccggcggcacagccgggcgcggagtattcgacggacccgtatctgcccggccacggcaacggcggataccgggtgctgcactacgacctcgacctggactaccgggtcacgtccaaccggatcgccgggaaggcggtgatcaccgcgcgggcggtccagccgctgtcccggttcaccctggacctcgggcatctccgggtgcaggacgtgcgggtcgacgggcggccggcgaagttcgcccaccggccggacaagctgcggatccggccggagcaggcggtcgggcacggcgccgtcttccggatcgagatccgttactccggcaagccggtgccgatcgccggccgctggggtgacatcggctgggacgagctgaccgacggggcgctggtggccagccagccgatcggcgcgccgtcctggttcccgtgcaacgaccgcccggacgacaaggccacgttcctggtcacgctgaccacggcgacgccgtacaccgtgctggtcaccggcgacctggtcgcccgccgccgcggcgcgggcaccaccacctgggtgtacgagcggaccgagccgaccgcgacgtacctgatgagcgtccaggtcgggcgttacgacgtggtcgacctcgccgacgcgcgggtgccgcagcgcgccgcgatcccgccccggctgcgcgaggcgttgcggcacgacttcggccggcacggcgagatcatggaagctctggaacggttgttcggaccgtaccccttccgggagtacgtcgtggtggtcgccgacgacgacctggacgacccgatcgaggcgcagggcatggccgtgttcggccgcaaccacctggacgggcagcgcacccatgagcgcctggtggtgcacgagctggcgcaccagtggttcggcaacagcctgaccgtcgccgactggcggcacatctggctcaacgagggcttcgcgacgtacgccgaatggttgtggtccggcgcttccggcgggccttcggcggcctcgcacgcggcacagtggcacgcctgggcggcggcgcagccggctgatctggcggtggccgacccgggcgtggcccggatgttcgacccgctggtctacaagcggggcgcgctggcggtgcacgcgctgcgggtgcggctgggggacacggcgttcttcgcgctgctgcgctcctgggtggcggagaaccagcaccggacggtgacgaccgaacagttccgccggcatgcggcgcggttcagcgcccggagtctggacgatctgttcaccgcctggctcgaccggccggagctgccgccgctgcctcgccaccccgacgggccggtggtccgcgccctctcctga

SEQ ID NO: 7762 - DNA, 3906 bp, Actinoplanes utahensis
gtgaccgtgaccagtgacctgcgactgatcgagcttcccgaggccgccgttcccgacgaggcgccggcgctgttccggtccgactcggcaccgctgcggcggacgctgctcgacatcctcgacgcgacggtgacagcgcacccgagggcggcggcgatcgacaccggggccggggtgctgacctaccgggagctggccgacgcggtcgaggcgttgcgggtgacgctgagcgggcacgggatcggggtcggtgaccgggtcggcatccggatctcgtccggcacggcggagctctacctggcgatcctcggggtgctcgcggtcggtgcggcctacgtcccggtggacgcggacgacccggaggagcgggccgagctggtcttcgccgaggcggatgtgagcgcggtgctcggggacgggctgagcgtgtccacccggcgtactcccggtggaagcgcgggacggccggggcccggcgatgacgcctggatcatcttcacctccggttcgaccggcaccccgaagggggtggcggtcacccacgggtccgcggccgccttcgtcgacgcggaggcgcagctgttcctcgccgacgagggtgccgagccgatgggccccggggaccgggtgctggccgggctgtcggtggcgttcgacgcgtcgtgtgaggagatgtggctggcctggcggcacggcgcctgcctggtgccggccgcgcggtcgctggtgcgcagcggtgtcgacctgggtccgtggctggccgagcagcggatcaccgtggtgtcgacggtgccgaccctggcggcgctgtggccggtggaggcgctcgaggacgtccggttgctgatcttcggtggtgaggcgtgcccgccggagctggccgaacggctcgcggtcgaggggcgcgaggtgtggaacacgtacggcccgaccgaggcgaccgtggtggcgtgtgccgcgcggatgaccggtgacgggccggtgcggatcgggctgccgctggccggctgggagctggccgtggtcgacccggcgggcgagccggtgaccatgggggagaccggcgagctggtgatcggcggtgtcggcctggcgcgctacctggacgccggcaaggacgcggagaagttcgcggcgctgccgtcgctgggctgggagcgggcctaccgcagcggtgacatcgtccgcgcggagccggccgggctgctgttcctgggccgcggtgacgagcaggtcaagctcggtggccggcggatcgagctgggtgaggtggacgcggcgctgcaggcgctgcccggggtggccggtgcggccgccgcggtgaagcggacggccgccggcaatcagctgctggtgggttatctggtggtccgggaggacggcggcttcgacctggccgcggccacgcagcgggttcgggagcagttgccggccgcgctcgtaccgctgctggccgtggtcgatgatcttccgacgcggacgtcgggcaaggtggaccgggcggcgctgccgtggcccctcgcgaccgccggtgacgtggacgccgagctgaccgaggccgagcagtggctggcggacggctgggagcagatcctcggggtgcgcccggcggatgccgcggccgacttcttcagcagtggcggcagcagtctgaacgcggcgcagttggtggcgtggatccggcagacccggccgcaggcgtcggtggccgacgtctaccagaatccgcggctgtcggagatggccgtgaagctgggcgcggccggtgggcaggtggcggtgcgccgggaggtgcgaccgacgccgcggcgggccgggctggcgcagttcctgctgatgctgccgatgctggcgctggtcgggctgcgctgggtgaccgtgctcgccgcgctgggaaaggtcgtggcggcgtcgtggacgccgcaggtgtcctggtcgtggatcgtggcgggctggctggtgctgttcagcccggccgggcggatcgcggtggcggcggccggcgcgcggatgctgctgcgcggtgtcggaccgggcaactatccgcggggcggcagcgtgcacgtgcggctgtgggccgccgagcggctggccgagctgaccggggcgaacggggtgaccggcgcgggctggatgatcacgtacgcccgggcgctcggggcgcggatcggccgggacgtcgacctgcactcggcgccgccggtgaccggcctgctgaaggtcggccggggcgcggcgatcgagccggaggcggacctgtccggctactgggtcgacggtgacgtcgtccgggtgggcatggtgcgggtcggcgccggggcgcgggtggggtcgcgcagcacgctgatgccgggtgcccgggtcggcaagaacgcgaggatcgcggcggggtcgacggtcctgggcgcggtgccgtcggggcagcgctgggccggttccccggccgcgccggccgccgccaaggatgcggagggctggccggagcagcggccggagcgttcgccgctgggctccaagttctgggtggtggcctacagcgtgaccgcgcagctgctgggtctggtgccggtgctggcgctgctgccggcattcgcgctgctcggctggggggtgtccggccgtcccgcgctggcgggtgcgctgctcgtgatcccggtggccgcggtcgcctatctgctgacgtacgcgatgatcgtgctcgccgcggtgcgcatcctcagcctcgggatgcgggagggcttccaccgcgtgcagggccgggtggcgtggcaggtgtggaccaccgagcggctgatggggatggcccgggtggcgctgttcccgatgtacgccagcctgttcaccccggtgtggctgcgcctgctcggcgccaaggtcggccgcaacgtcgaagtctccacggtcctcgccctgccggcgatgaccacggtgaacgacggggcgttcctggccgacgacaccatggtggccacctacgagctcagccacggctggctgcgggtggcgccggcccggatcggcaagcaggcgttcctgggcaactcggggatggcggcgcccggccggtcggtgcccaagcgcggcctggtcggggtgctgtcgtcggcgccgcacaaggcgaagaagggttcgtcgtggctgggcgccccgcccatgccgctgcgccggaccgtcgaggcggccgacgccagccgcaccttcgccccgccgctgcggctgaagctggcccgggccgcgatcgaactgtgccggatcgtcccggtgatgtgcgccggcgccctcgccgtgctggtgatcgccgcgctggcgctgatctggcgggccgggggcggctgggcggccgcgctggccgccgggccggtcatgttcggcgcggtgatcgtcgcggcgttgaccgcgaccgcggcgaagtggctgctggtcggccggctgcgggtgaccgagcgggcgctgtggacgtcgttcgtgtggcgcaacgagctggccgacacgttcgtcgaggtgctcgccgcgccgtggctgttccggttcgccaccggcaccccgctgctgaccgcgtggatgcgcacgctgggtgctcggatcggtcgcggtgtgtggctggagacgtactggctccccgagtacgacctggtacacctcggtgccggagcaaccgtcaaccgggggtgcgtggtgcagacccacctgttccatgatcggatcatggccatggacgaggtcactctgagcgcgggcgccacgctcggtcccaacgggatcgtgctgcccggcgcgagcatcggcgcccgcaccacggttggccccggatcgctggtcacccgcggcgacgcggtgcccgccgacagccgctggctcggcaacccgatcggcacctggccggcgccggcttcccgccggccatga

SEQ ID NO: 7763 - DNA, 345 bp, Actinoplanes utahensis
ttgtgggagctgatcgagccggtactgccgccgtggccggcgaaggctccgggaccgcggcctgccccggaccggatgtgtctgcatggcatttcgtttgtgctgcataccggcatcggctgggaggatttgccgcaggagctcggcttcggttccgggatgacctgttggcgccggctacagcgttggaccgaagccggcgtgttcgaccgggtgcatcagccactgctggccaagtcgaacgcggcgaaccggatcgactggtcgagagcagcgatggacggcagtcacatcgacgcgaaaaaggggcgccgggacaggcccgtcgccggtcaaccgcggtaa

SEQ ID NO: 7764 - DNA, 99 bp, Actinoplanes utahensis
atgcccggcgccgccatggcgaccaagggacacaagccgaaaccagccccgccggcggtgcgcgacagcgaccaccacggcatacccgacgaccggtag

SEQ ID NO: 7765 - DNA, 1017 bp, Actinoplanes utahensis
atgcgcgatgacatgaaagcggtcccggtcaactccggggcaccacctgtcgccgcggtcgaccagctctggccgaccgccgtgccgatcccgtacagctcgggccggcgggttgccggattcaggttgcgggccgtcctcgtcgcggcaatcgccgccgtgctcggcgggctcagcggtatcgccctcggctcctggctggcctggcgcaccgtcgacccgctggcgcccgacaaggccacggcggccgggatggcggtcacggtcctgccaggtgccttcggccacaaagtcgaatactacgagcggccgaccttctggaatccgtacagcaaccacagcctgcacggcggcacgggggtacgggtcggcacggcccaggtcgacggcatcatgcccccgaacgcaggctctgagcagatcgccgccgccgtcgaagaccagatgcgcgcacagggctggcacgacgtgcgcaccaccgtcgaccggcactggtcggacactccgtcgaagaccgaggtgtcgggcacccgtgcgggatacctcgccgcggtacagatcatcccggaccaggagccagccctgagtttcatcctgatgtgggccgaaccacctggtcaactgcgcgacaccatcgccggaggcgtggccggcatgctgctcggcgcgctgctcgggttttccacctcgcagcgcatgcgacgctacgaccggggtaggcagaccgcctactcgatactctgcttaaccacgctggtcatgctggccccggcctgcttagccaacatcccgacctcgaccggctccctgacggccgccacccatcgccagggcgccggcccgtcggtgtattggggaggcttcgtactcttcggagccgagccgctggccatcctgtcgctactaccgatcctggccatcctcaccctctgcgtatggccccgcacagcaaccaaccgccgacaccgtccgactgaaccgtggtcgcagcgcgcagccgaggatatctacggctga

SEQ ID NO: 7766 - DNA, 2019 bp, Actinoplanes utahensis
gtgatcgactaccggctgctgttccggcgcgccccgacgccgctgctggtcctcgatcccggcctggtgatcgtcgaggcgagcgacgcctatctcgcggccaccctcacccggcgcgaggacatcgtcggacggcacatcttcgcggctttccccgacaatcccgatgacccggaggccgacggcgtccaggcgatcaacgcctcgctgcagcgggtgctgcgcgaccgcgcccccgacgtgatgccgatccagaattacgacgtcccgcagccgggcggcggcttcgccacccggtactgggcgccgctgcacgccccgctggtcaacgcccacggtgagctgcagtacatcgtgcaacggccggaggacgtcaccgcgctgatggtttcccagaccgccggcggtgagctgggccggctcaccgaggagttgtcccggcgcatcgggcaggcggaggccgagatcctggcccggcggcagttgcagcaacagcagcaggagaccatgcaggtgctcgccgacagcctgaccaccgcggtgttcggctgcgacagcgtcggacggccggtgctgtgcaacgacgcggcgcgtgcgctcgccggcggccggctcgacgatgcccccgccgagcagtggccgcagcggctgcacctgcacgacccggccgggcgtccgctgacggaggcgggcaacccgctggtcagcgcgctgcgcggggaacacgtccgcgacgccgaggtcgtcatgcgcacgccggacgccccggcgcggaccttcctggtgcatgcccgcccgatcgagggccgtgccgacgtcctcgccgtggtggcgatgaacgacgtgacagcactgcggcgcgccgcccggttgaaggaatgcgagctgcggacctcgacggtcctcgcgagcgcggagcctgccgacgaggtgcttgccgacgcggtgcaggtcatcggttcgatgatcggctgggcggcgacggagctctggatcgtcgacgagatcgggcaggtccttcgccgcgccgcctgctgggcggccgacggtcacggctggtcctgcacggacggcgaaccgctgccgcccgacggcgggctcccggcccgggcctggcggagcaaccagccgctctgggcgaccgagctcggcgacgaccggacaccgctgcgcgccgcgctggccattccggtgtccagcggcgccgatgtgctgggtgtgctggtctgttccagcgacacgcccgaggtgcccgacgacacccgcaccgcgatcctcaccgggatcggcgcgcagctgggtggattcctcgaacgccgccgggccgccggcctcgccgccgaactggaccgcatcaggaacgagtatgcctcgctggtcggtcacgaggtgcgtacgccgctgaccaagatccaggcctacaccgagctgttgctcgacgagccggacctcgtcgaagaccatcgcgacatggtgcgggtggtgcaccgcaacgtcggcatcctcacggtcatcgtcgataagctgctggacgtggccggcctccggtccggccacctcgaggtccaccgccggacgatggacctggccgcggtcgtgcgccaggcggtggaggcggcgcgcgagcgcgcacaccgggacgtgaccatcgaggtcgacactcccgccacgacgctgatccagggcgatcgggaccggctgcgccaggtcgtcgacgaactgctgaacaacgcactgatctgggcggcggagcactctgcgatcgcggtgaccctgcgcgccgacgcacacgccgccgtgctcagtgtgtccaacaccggcgagccgattcccgcggacgagcgagaccgcgtgttcgacctgttcttccgcggcgacgccgtccggcacagcggcatacccggctccgggttgggcctcaccttggcgcgcgccgtggtggaacagcacggcggcagcatcgtcgtgagcgacccggcggaacccctgaccgtcttcgcggtgcgcctgcccgcctga

SEQ ID NO: 7767 - DNA, 837 bp, Actinoplanes utahensis
atggacggcaccgcggtgcgcaccgcgctgtggcgggcgctgcacgtggagctcgacgcgccgccgcacgttctggcggacacggtcgggcgggcactggccgctgcgggcgacgactggcgtgcccggccggacatggacccggaattcacccgcacgttccgggccgggatggtggcgcgggcgcggttcgtcgaggatctcgtcgtccagcaggccgatcgtggcgtcagccagtatgtgatcctcggggcggggctggacaccctggcccagcgtcgtccggagctgggcgggcggctgcggatcttcgagatcgaccggccggggcctcaggagtggaaacgacgccgtctgcaggaggcgggctacggcgtgcccgagtggctgcgcctcgtcccggtcgacttcgaggtgggtgcggactggctgaagccgctggtcgcggccggtttcgacgtcggcaggccggcggtggtggtctccaccggggtctcgatgtatctcacgagggaggctacggcgaccaccctgcggcaggtggccgggctggcggcggggtcggttttcgccatgacgttcctgctgccggtcgacctggtggacgaggctgaccggcccggcctgcgggcgagcacggcgggcgcacgggcctcgcgcacgcccttcgtcagtttctacacaccggctgagatgctcgacatcgcgagccgtatggggttcggcgaggttcggcacgtgtccgccgccgacctcgctgagcggtatttcgccggtcgtccggacggcctccggccctccagcggagaggacttcctggtggcccgctcagggtag

SEQ ID NO: 7768 - DNA, 351 bp, Actinoplanes utahensis
atggcgaccgaaggcatcgaggccgtgttcctggagacgcacaactggggccgggcggccaagttcttccagtctctgggctacgagctggaattctccaccgaccacaactccgggcaactgcgcaacggcgacggggcgtacgtgttcatcgccgaggtgccccaggaccgcgagccgaccacccggatcgtgctgcgcgtgccggacggggatgcgctcgccctcgatccggtcgtcgaggtggtcagcccgttcagcgacacccactacgggacccgggagatgatcgtccgcgatccggacgggcggctgtggaatctgcaggcacccgccagcgggaagccctga

SEQ ID NO: 7769 - DNA, 159 bp, Actinoplanes utahensis
gtgggtgagacggacgtcaaacagttcaacgtgtacctgccggtcgagctgatcaagcaggtcaaactccgggccgtcgagtccggctcgtcgctgtcggcgctggtcgccgacgccctgcgcgcctacctggacaagccgcacgaaaaggagatctga

SEQ ID NO: 7770 - DNA, 1161 bp, Actinoplanes utahensis
atggccgcgggtctgctggcgtcgctgtccgggacgttcgtggtcgccggcgtgattcccggggccgtggcggccggggtgctgccgatcgtctggcttccggtgatccagagcatcgagacgatcgaggacatgagcagcccggtcgtcgcccggctgctgcgcgaccgggacccggggcgggtgctggtggcgtgcgaggcgttcgatgtggtggcgtgcgccctcgcgctcgcactgatctggacgacaccgctccggccggcggtcgtcttcgtcgcgtacgtgctgatcgtctcggttgttccgttgttcgtcgacgtcgccgaggagctgttcaccggggagatcgcgcggatcagccacggagcggcggtgcgcttcaacatcacggtgtacgcgatgctcggagtctccgggtcgctgatggccaggccgctgggcagcctgctcgcggccgcggcgctgccggccgcgctcggcgtcaacctgtgctgctcgctggcgggacttctgctgcgccgccgttcggtgcgtaccctcgcggcgatcgcggtgaacccgcctgaggccgcaccggagagcaggtcggtgcgtgcatcgctgagcgacatcgtcagagcagtgggacccggcagcccggtggtctccgggctgctggcctgctcggccagcattgtcgccggctatctcgcgcagtgggcggcccaggcgatgccgcgtcccagtgcggcgctcaccgccctgctcgtcgccagcggtgtcggcgccacggtgggcccgtacctcgcccggggtgtaccgctgcgcgtactgctcgtcgcgcggatcgcggcactcggggccgtctgcgggctcgcgctgactggtggcctgggcggtggccttcggttcgcagggatgctggtgctcacggtgtgtttcgcggcggccgtccagggcgccgcggtgctccaggcgaccgcacgccaggcccggtatcggggccatcttctcgcgcagatggtgggctggagtcactctctcgcggcggcgggcacgttcgtcggggtgtggtgcgggctggcgttgggggtgcagcgcgcgccggttgccggtgttctcgccgcggtggccgtcacgctggccgccatgacacgactctcgccccggcgtcgctag

SEQ ID NO: 7771 - DNA, 762 bp, Actinoplanes utahensis
gtggaggatggcacccggctggtcgcgcggcggatcgggcgcggcgaaccggtcgtcctggtgcacggttcggcgggtgggctggattcgtgggatccggtccacccgctgctgagcgaccggttcgcggtgtgggtctacgcgcgtcgcgggtacgcgccgagtgaccgcgccggcggcccgaagacgtacgccgatgatgtcgccgatctgcgggccgtgatcgccgcggccggcgggtcggcgcacgtggtcggcgcgtcctacggcgcgacggtcgggctgcacgcggcggccggggacgcgatgggcgtccggtcgctggcgttgttcgagccgccgctgttcgcggccggggcggggctggccgccaccctggacctctatcgcaagctgctgcgcgacggcgaccccgcggccgcggcggtgctgttcgccgagcaggtgtcccgggtgcccgcgccgatcctcgccgcgctggccggggccgcgccgccggatccggccgagatggtcggctgcctgcacgacctggaggcgatggtcgacgacaccctcgacgtcgggcggtggggcgggaccggtgtgccggtgctgctgctgcagggcagcgacacctgggcgccgatgccggagacgatggaggcgctggcggccaccctgccggacgtcacccgggtgacgctggccggccagtcgcacttcgcgacgcacaccgcgccacggatggtcgccggcgccctgctcgacttcctgggttga

SEQ ID NO: 7772 - DNA, 564 bp, Actinoplanes utahensis
atgcggcgcagggccgcgaaggagaggacctcgatcggcaaggtctccgtcccggcgggcggatcgtacgcaacctgccagatgtcatgtccgatagtcacaagccggtgtcacctttcgccacaggcaccgagccgccgcaaccgtagcgttcgagccggaaggaagcgttccgagcgtacgaggagagacagcgacatgacccctttcgacatgtccggcacgttccagcagaaggtcaacgacggcgacctggagggcctgctcggcctgctgtcgccggaggcggtgagccggacggtgcagggcgaggtgctcaccgacccggcgaagatccgcgccgacctggccgggctgctgtccgcccgcccgcacctggtgaacaccgtgcggcacatcttcagcagcggcgacgtcgccctgatgctgatcgactggacgctggaggtggacaccccggacgggcgggcgcaggcggccggcacgacgacgaacgtggtgcgccgcggccacgacggtgagtggcggctcgccattctcaacccgatcggcaccgccgcctga

SEQ ID NO: 7773 - DNA, 840 bp, Actinoplanes utahensis
gtgactatcggacatgacatctggcaggttgcgtacgatccgcccgccgggacggagaccttgccgatcgaggtcctctccttcgcggccctgcgccgcatggaccgcgctcaccggcgcacccgggtgcagcggccggcattccacatcctggccatcgtcgagtcgggcgagggccggcaccgggccgacttcgtcgaccacccgctgcgtcccgggacgatcgtgtggatccggcccgggacggtccaccgctggacggacgtcgaagccgtcgacggtccgctgatcctcttcactgcgggcgcggtcccggaggacccggccaccgccgtctgctggcagacgaccggcgccgacggagacctcgcccgcctcgcagccgcccacctgaccgccgagcacaacgcccgaccagcctcggcggcgatcctgaagctgctgctcagcgccctgctggcccgggtcacccggaccgctcccccggcgccgggagagcccggagacgtcttccaccgcttccgggcggcggtcgaggcgcatttccccacccaccatcaggtcgcctggtacgcccgtcatctgggctactctccgcgcaccctgacccgggccacgagcgaggcgaccggggtcggcgcgaaacggttcctcgacgagcggatcaccctggaggcgaaacggctgctcgcccacaccgacctgaccgtcgtccggtgcgcccaccggctgggcttcgccgaccaggcgaacttcaccacgttcttccagcgtcagaccggtgtcgcccccaccttctggcgactgaccgaatcggccggtggggcgcccgccggttag

SEQ ID NO: 7774 - DNA, 150 bp, Actinoplanes utahensis
gtgtcgcacaccgacgtccacgccgcgctggccgcacgcgacgccgacctcgcggcgttcgacatcctcagcctgctgggaatctccgaccgtgaccgcgaactgccggaccggttgtggcgccggttccgcgccggcgatcgctcatag

SEQ ID NO: 7775 - DNA, 1272 bp, Actinoplanes utahensis
atgacggcggtttcaaacgagcagtcggccaccccgggtgtggacggggatctgcgggcgctgttcggccagtcgatcgccgtgttcgcctcgctgggcgggccggagcaccgggtggaggcggccgaccccgccttcttcgccgcgatcgggatggcgcccccgcgtaccggtgatccgctcgtcgaccttcttccggagctcgccgaccaggggttcatcgagctgctcgccgaggtctaccgcagcggtgaacggtacaccgggcgggatgtccgggtggtgctcggccgcggggcccaggagcgggaggccttcttcgacttcacgtacgagccgcgccgcgacgccgccggccgggtcgccggggtgcacgtgatcggcgtggagaccacccaggtcaagcaggcgcagcggctgaccgccgaacaccgggcgctgctggagcagatcgccctgcaggcgcccctggccgaggtgctcgacgggatggcccgcaccatcgaacgcctgaccccccaggaagtgctggtcagcgtgctgctcgctgacgcggacggacgtcatctgcggcacggggcggcgcccggcctgcccgccttctacaacgaggcgatcgacgggatcgcgaccggtgagggcgtcggctcctgcgggaccgccgcgcaccggcgggaaccggtgatcgtcacggacatcggcaccgacccgttctgggccgacttccgcgacctggccggtcgcgccggactcgccgcctgctggtcgacacccatcctggcccgcgacggcagcctgctgggcaccttcgcgatgtaccaccggacaccccgcgtaccgcaagagaccgatcttgccctgaaccgcatcttcgccggcacggcggcgctcgccatcgaacggcaccacatcgaacaggccaaggcggaggcggaggcgcgggccagggccgcgcacgacgcgcttgccaaggtggtacgcgccgagcgcgaactgcgcgccgaagccgaggagcgggccgcggcggcagccgacctcgccgcccggatgcgctccgccgcggcggcccagggggccgcaccgcacccggagaactgccagctcggcggcgcgtccggctgcaccgagccggccgaaatcaagatcgcggactcgtggggagactccgcctgggggtgtccggtccacgtcgaagaagcgatcatcaacgtccggtcggtgttcatcgccagcgaggaactcggcggcctcgcgacttacgtgaaccgctga

SEQ ID NO: 7776 - DNA, 426 bp, Actinoplanes utahensis
atgcttctgcgtacagacccgttccgtgacctcgaccgcgttttcgagcagctcaccggcaccagcagccggcccgcggtcatgcacgccgacgccgagcgcgacggcgacaccttctacgtgtacttcgatctacccggcgtcgaccccgactcgatcgacctcaccgtggaacgcaacgtgttgcaggtccaggcacggcggcagcggcagagccgggacggcgtcgagacggtgatcagtgagcggccgatgggggtgttcagccggcagctgttcctcggcgacaccctggacaccgagcatctcgacgcaacctacgacaacggggtgctgacgctgcgcatcccgatctccgcgaaggccaagcctcgcagaatcaccatcggcaccggtggcagcgggccccggcagatcgagggctga

SEQ ID NO: 7777 - DNA, 294 bp, Actinoplanes utahensis
atgtggtcgttgccgccgaccgtcgaccggtggatgctgcacgtcgccgccagcccgcacgaggtcgacgaggttctcgccgacctgtgcctgcaccagcgcagccgcgccgtcaccgaccccgacttcccggcctgcctgatcggtccgaagaacctgggcgaacccccggcctggatgcggttcgcccgcaccgaactcgaccggctcggctaccgcacccgctggtgcgacgtcggctgcgtccaccacccgctcccgcagcgcatcgcctccctggtcacgctcggctga

SEQ ID NO: 7778 - DNA, 1266 bp, Actinoplanes utahensis
gtggccgcgtcgttcgtgtcgcagaccggcaactggctgaccttcaccgggctcgcccagctggtccagtcgcactacggatcggccgcgaccgccgcggcgttcgccgcgcagagcctgccgagcctgctgttcgtgcgggcggtggtggaacgcatcccggcacggcggcggcgggccgtctacaacctgagccaggtggtgctcgcggcgctcagcctgtcgctcgccgtgggcacgccgttgacgtacaccctgatcttcttcgccctgtcggcgctgctgcgcggcatcgcgaatccgctgttcatggcgctggtcggggagtgggtgccggccggtgagcggacggcggccttcatcgcgatcggggcggccgggtcggtgaccctcgcgctgtcaccggccgtcggcggggtcgtcgccgtcaccctggggctacgctggctggtgatcatcgatgcgatcagcttcctgctcgggctggccatcctcgccaccggcccggccgcggccgctcggggcgccaccgctccggccgccgctgcttcgtccgccgccgctgcgtccgcggccgatggtgccgccaccgctccggtcgcggccgttccgtgtgccaccgttccgtccgccaccgttgcggccgccggcgggtcggccgttgccgcgccggctcagccggcgctgttcacgctgcgcagactgctggcccgtccgaccggactcggcggcgcgtccgcctggacctggctgagcctggccggcgccgccgtcaacgcggtcgaactgccggtgttcacgctcgtgcaccacttcgactcgcggatgttcgggtacgcgctgtcctgctacggcgccggggggttcgcgacgctggcgctgcgccgcctcgtcaccggacgggaacggctgctgccgtggctggccggcggctacctgctggcgatcgtggcgtgggtcttcggtggcaccccgggcgcgttcgccggattcttcggcgccggactgacgtacggcctgatcaacggtgtgttgcggggcatcctggagcgatcggccggggtcgatccggtgcccctctgggcgtgggcgaaccaggtggtcgtcgtcgccaacctggccgtgtacggctgtgccgtcgtcgcgttcgccgccggcctggccccggtcgcgggcgcgctcgtcctcatcgccatctgcgcgatcttcacgctgcaagcggcgcgcgtgaaggaatcgtgtgcggccccggcgaatccggtgtag

SEQ ID NO: 7779 - DNA, 543 bp, Actinoplanes utahensis
gtgtccggaatcgaccaactgctgctgcggccgtggcgcgacgacgacgcaccggcggtgctggccgcgttcgccacccccgacatggcgacccaggccggcgaaccgatcaccgacccggccgcggcccggcggtggatcacccactggcgcaacgccggcggggcccatccgttcgctgtcgcgtatgccggccggatcgtcgggcacgtcgcggtcagcgccgtggaccggcggcactcggtcggctgggtgtcctactggacgacccgcgccgaccgcgggcacgggttcggcacggcggccaccgcggcgctggccgaatgggccttcgccgagctcggcctgttccgcctggagctggggcaccgggtcgacaacccgggctcgtgcggcgtcgcccgcggcgccggatttctggtggaagggcgggaaagagccaaactggcgtacgacggtgagcggtacgacgtcgaactgcacgcccggctgcgcaccgacccggcgcccgcgccgcgatacacgtacgccgtccagcggtga

SEQ ID NO: 7780 - DNA, 699 bp, Actinoplanes utahensis
gtgtgctcggatggagggatgggggacagcgttgaggtcgcggccatcgtcgatgcgctgccggggcaggagtcggtgcggcgcctggtccggcaggaactggccgacaccggccgggagcatctgctcgacgacgccggcgacgaccaggggcggtcggcgctgatcgcggccctcgacgagtgcctgcggcagaacccggacttcggctgggcactgcggtcggcgctggcacccgaaccggtcgccgagccggtgccccgcggctacgagccgccggccggaccgccgcggcgctggatgcccgaggacgaggtgcgccgccgctggccgacgatccgggacaccgaagtgggccgggtcgccgccgcacacggcgtcgaccgctggttccgccagaccggcccggccaccgggctgtacggcaccggtgcgcccggcaccctgatgttcgacaccgacggcgtggaacgggtggccaccggcctggcctccggcgagctgcgggtccggcccgaacagcgcaccgacaccggacaggggcgggacgcccaccgtcgcgtcatggccaccgcgatcgtcgtcggcctcgtcgtgctggccctgtgcggtctgctcggttacctcgcggtccagtcgttccgccacccggcctccgggagcgggagctcgaactgcggcgactgcggctggcactga

SEQ ID NO: 7781 - DNA, 633 bp, Actinoplanes utahensis
atgatgcggttctcctgggacggcgaatccgccgacgagcggagcgcgatcgagcaacggctggccgaccggtgggtcggcgacctcgaccggctgatcgaacggcggctgagcgacgacaccgtcgaccggcgactggcccggatcaccggacgccggcgctgggattggcgccggttcctgaccatggtgatcgcctggtgcacccggtcgacggcggtcccgcaccggccgcaccggccggcccggtcccgtggcgggtcgccgctggcccggaaaccgggccggatcgccccaccgcgcggcggacatccgccgaagcggcgcctgcgggtcgtggaccgctccggcagcggcgcggtggccgccctgcccgccgttccgctcgaacaggtcgccttcgacctgcgccggctggaccggatgcgacgctccgaccacatccgccgatcggacgcggtgctggcggcggtgctgcgcgcctacgacgcccgcctcgaactggcctgccggtgcctcggcatcgaggagcacctgcagacgctgcagggcgtcgaccgggagctggagcggctccggctggagggcgccctcgacgacgtcggggtgccgatccgggcgatgaatccatga

SEQ ID NO: 7782 - DNA, 549 bp, Actinoplanes utahensis
gtgacgctctggcaacggctcaccgcgctgcgggggctgcccgcgtacggggagatcctggaattcgaactgttcttccggggccgtttcccggagctggtgcgctttctgatgatcaaggaggatgccacgctgcaggacgcggaggatgcggtcgaggacgccatgagctcggcctaccggtgctggtcgaagatcgacaaccccgatgcctgggtacgacaggccgcggtccacgcgctgatcggcatccggcggcgcgaccgtcgtcgccggctcgcgctgctggccatgcggggacaacgcaccgccgacagcgaccttgcggacagcgcgctgcacgaggaggccgagggggtgctcgcggtgctcaagaaactgccgccggcccagcgcgaagtgctggcataccggctggacggctacccccccggcggagatcgcgcggctgatcggcaaggacccgcagaccgtccgcagcaacctgcgggccgcacgccgggcggtcgccgtgatcctcgaatcgccggtgaccggccgaggaggtga

SEQ ID NO: 7783 - DNA, 321 bp, Actinoplanes utahensis
gtgtacgccgggccaccgcgcagtcgccgccatcacaccgcccggtcacccgtcggtggcgatcttgcacgccgcgcgcccacgctgaccctgtacggacgtcagcacacacccgcggttcgacgatccggaaggtggcagcccgtggaatcccgtcaacgtgcgagagaccgcaccgtcagtcctgccgtagccctgtgcagcatcgcgccgagcagcgtggcgggcgtctacgtgttcacccagtcggtgccggtcacggtgatcgcggcggtggtcaccctcggactggccgccgtccaggcctttccccgccggtga

SEQ ID NO: 7784 - DNA, 1308 bp, Actinoplanes utahensis
atggcggcgactgcgcggtggcccggcgtacaccagaatcgggtggtgaatcgacccgccgagagcctttcgccagggcagttgctgccgctggggcgccgtttccggatcgtgctcgtgctgggtttcctgaccgcgctcgggccgctgaccatcgacatgtaccttccgtcgctgccgacgatcaccgatgacctgcacgccaccgcggcggcggtgcagctgacgctgaccgggacgctggtcgggctggcgttcgggcagttgctgatcgggccgctggccgacgcggtggggcggcgggtgccgctgctcagtggcatcgccgtgcacgtgctggcgtcgatctgctgtgtcgtcgcgccgaacctcgcggtgctggggtcgctgcgggtgctgcagggtctgggcgccgcggcggcgaccgtggtggcgatggcgatggtgcgggacctgttcgacgggctggccgcggcccggctgttctcccggctgatgctggtggtcggggtggcgccgatcctcgcgccgaccgtgggcgggctggtgctgacctgggcctcgtggcgcggcgtgttcgtggtgctgaccgcgatcgggctggcgatcatggcggcggccgcggtggtgctgccggagacgctgccccggcagcggcggcgcaacggcgggttgctgggcacggcgcgcgactacgggcggttgttcaccgaccgggtgtatgtcgggctgatcctggtcgccggcctggcgatggccgcgctgttcgcctacgtcagcgggtcgtcgtacgttttccaggacgagtacgggatgagcgagcagcagttcgcgctgatcttcgccggcggcgcggtcgggttgatcggggcgacccaggcgaatgtgcggctactgcgccggtggacgccgcagcggatcctgagcgggtcgctgctggccgggctggggttcgcggtcgtgctgctgatcctggccggcaccggagccggcggcctggccgggattctggtcccgctgtggctggtgctggtcatggtgggtttggcgatgccgaacgcgccggcactggcgctgtcccggcacggtgaggcggccggcaccgcggcggcgctgctcggtgccgtccagttcggggtgggtgcgctggccgcgccgctggtcggggtgctcggggtgggcgcggtggcgatggccgtggtggtgttcgccggcatgctggccgcgaccctggtgtgcctgctggtggtccgcccgcaccggctgccggtggaggatgccgagccggcgatcgcggtcgtgcactga

SEQ ID NO: 7785 - DNA, 399 bp, Actinoplanes utahensis
atgccgagccggcgatcgcggtcgtgcactgagcgggccggttcggggtatggggcgggtgtgtcgacgacaacgtgggtgagggcggccgcggccgcgcgggtggcgtggggcgtggcgctggtggcggcgccgcaccggattccccggtacggcgccgcgccggccgtggcggtgctgcgggtgctgggtgcgcgtcagatcgtgcagggtgcggtgacgctggcccggcccacgccgctggtgaccgggtgcggggcgctggtcgacgcactgcacgccggcaccgatctggccgcggcggccgggtcggcccgctggcggccggtggcgctgcccgacgcggtggtcgccctgggcttcgccgcggcgggctggtggctccgcgacgcggcctga

SEQ ID NO: 7786 - DNA, 996 bp, Actinoplanes utahensis
gtggctccgtgcccgatgtcactgtgcgaggcggtgacggccatgactgaccgcaaaccatccgtgcgacagcgcccgatcgacccggcgctgtgccatctcctccgggccatagccgtgtcacatgcccgcgtccggcgcctggtcgccctgcgcatcgtgatctccgcggtgctcgccggggccggcctggtgaccgtcttcgccggcgcgtccaccgggaagccgctgagcgtcaccctctccgtcgtcggcgtgctgtgggccctggcgtactccctgggcctggcctcctgggcggaccgggaactgcaccgggccgcgctgctgcaggagtcgttcgaggtccgcttcttccagctgccgtggaactgcatgctggccggcgaggagatccccgccgaggacgtccggcacctgagcagccgctaccggggcgacccgccccgcgacacgtacgagatgccgaacctgccccgccccttcgacgtgctcgtccgccagcagcagaacctgtcctggggcagccgggtccggcaccgctacgcccaggtggtgatgttcgcgatgagcggctgggcggcgctcggcctgttcaccgccatcgcccgcaactcgaccatcaccgacctgttcgtccagtggtgcgtgccgtcgctcggcatgttcctgctcggctgggacaccttccgcgaacagcgccgggtcgccgaggaccgcaaacgggtgtgcggcaactcccgggggcgctgcctgcaactggccccggccggcctggacccggtggtcaaccaggacctgtgccggatggcccggcaggtccaggaccagctctacctgtcccgcagccgggcgccgcgggtgccgcgctggttcttccagcggtattacactcaggacagttccgacttcaccgccgggctggccgaggcccgcaactccctgctcacggccggcctgcacaaccgtccaccccggtcgccgcagcggccctga

SEQ ID NO: 7787 - DNA, 1230 bp, Actinoplanes utahensis
ttgccagtcgccgaggaccagccggacccgggctcgtcgcgggtgctgcgcgccctgctcaacggcacgttcgtgcccgcgatggcgccgaggctggcgaccgcgctggtcaccgtggtcgtcgccggcttcgtcattctctcgctggccggcatcgcggtgcgcgccgacggccccgggccgatcgtcgcggcgctggcctgcgcaaccccgatcatcgcgctgcaactgggctacttcggccggctccccgccaggcccaccggtcgggccggtcatctcgccctcgccgtgcaggccggtttcgtctgcctgccgttcctgcgcttcggcgtcgcctggctcagcttcgccgggctgctcgcggccggtgtgctgttcaccctcgcgccgaaggcggccgtgccgctgttcgtcctgatcgtggcgggcgcgggcgccgtcgaggtctggtgcgccgacgcgacgacggatctacccttcgccgtctcctacgccgtcgtctccaccaccctcaccggcctgatcgtctacgggctgacccggctggcccgcctgctggccgacctgcacgccgcacggcaggacctggtgcggatggcgacggccgaggagcggctgcgcctcgcccgggacgtgcacgacctgctcggcctcagcctgtcggcgatcaccctgaagagtgaactcacctaccggctgatggacgcgcatccggaccgggcacgccgggaactggccgaggtgctgacgctgtcccgcagggcgctgtccgaggtgcgcacgatcgtcgaccccgggcgggaaatttcgctggccgacgagtgccgcaccgcgcaccgcctgctcaccgcggccggcatccgggtgcgggtggtcgaacagggccggccgcccaccggccgggtcggcaccgtgctggccacggtgctgcgcgagggcgtcacgaacgtgctgcggcacactggtcatggaggcgaaggacgagccgacggcgctggagatcgccaaggccgttccggccaagggggtcggcggcgtggaggtccggccgatcttcacaccgccggcggcctgacgacggcgggccgcccggccggcgcggcccgggtcagccggcggccatccggatcagggcgttgccgccgagcagcagcacgtcggcggtggcgaccagggccatgctgcgccgcatccagcgggccgccgcctcgtgatcgtcgctggtga

SEQ ID NO: 7788 - DNA, 486 bp, Actinoplanes utahensis
gtgcccgcctcgcggattttgctggacgagccgttgaccggcgcgcggccgcgtccgggcctgcagcaggcattgcacatggttcaggccggggacaccctggtcactccgggtttggcgcggctggcccggtcgttgtcggatgcctggtcgatcatcgagcacctcgcgcagcgtcgtgcctgcctttccttggccgggcatctgcatgatccggcggatgggtcgttgctgcgcgatctggcgctgttcgtgcagttcgaggcggagttgaaggggttgcagacccgggagggcatggtgctggcccggcgggagggccgggtggccgggcgtgagccgaaactgtcgaccgagcagcgggccgagctgctgcggttgcatgcgtcgggcctgcatcaggttacgcagttggccaggatgttcggtgtctcgcgtcccacggtgtaccggttggtgcagcgtgctgctgagctgtccgcgtga

SEQ ID NO: 7789 - DNA, 1785 bp, Actinoplanes utahensis
gtgaccgcgcccccgggccggcgcgttgacgagccggggcggctgacgtcggtctggcgtaccggcttggacgcggcggccgatccgctgttcgactggttcgccgacatggtccgtagcgttgtcggtgtcccggtggcgctggtgtcactggtcggcgacgaccgtcagttcttccccggggcgcgggggctgggccagccgtggcaggaacggcggcagaccccgttgagtcattcgttctgtcagcacgtcgtggccacggccgagccgctgatcgtcaccgacgcccgcagcgacgcccgcgtgcgcggcaacctcgcggtggacgaactgggggtgatcgcgtacgccggcatgccgttgaccgacgaggacgggcatgtgctcggctcgttgtgcgccatcgaccatcagcctcgccgttggaccgctcaggaacttgcgcggctggccgagctggccgccggctgttcccgggcgttgcgggcgcgcatcgcctcggatcaggcgcaggtgcagcagcaggcgggcatggagcgggaacggcgtgcccaggcggcggtcgaacgcagccagctgctgctgcgcgccagtgccgcgctgggtgcggccaccacgttcgatgaggtggtcgacacggtgcggactctggtgatcggcaatctggacccggtgtacgtgggcgtctccacgctggccccggacgggttcgtgcatctggcgtccggtcggcagctaccggagcggttcgcccgccaatggaagctgtacggcgccgaccagaagacgccgtccgggttggcggcccgcaccggccggctggtgtcgtttcccgacctggccgcgatcgccgaacagaccccggactcgctggcgaccttccacgcgctgggctggcagtcggcggccagtgtgccgctacccggcgagcacggcccggcgggcgcgctgaccatcgtctggaaacagccgcacatgttgaccgacggcgagcaggtggtgttgaccgcgctggccgggttcgtcgcgcaggcgctgcaccgcgccgccgcctacgaagaccagcgcaccgccgccaccaccatgcaacaagccctgctcagcactctgcccgaggtcagccacgtccgtatggccgcccagtacgtgcccgcgcagcagaatgatctggtcggtggcgactggtacgacgtgatcgacatcgatgagcagcgcctggccctggtgatcggcgacgttgccggccacggcatcaccgcggccgccaccatgagccagtaccgcaccatgctgcgcactctgctcgtcgatcacaacgaccacgcttctgcgctgctgcaacgcctggaacgcaccaccagggccctcggtctcaccgccacggccaccgccatggtcgcctatctgacccacgaccaggccggcggccacaccctgacctggagcaacgccggtcacataccacccacgctggtcctgcccgacggccggatcagtctgctcgcccgcggtgggcctctgctcggcggcctgcgcaacatcacccggcgcacccacacccggcatctgccacccggatgcctgctgctgttgcacaccgacgggctgatcgagacccggactcgcccgatcgacgacggcatcgcccgcctgcaccaactgctcgccgttcacggtggcgccccgctgtgcgagctggccgacatcctgatgaacgacaccaaccccgtcgaccgcgaagacgacgcctcactactgctcatccgcaccgctccggcgtga

SEQ ID NO: 7790 - DNA, 861 bp, Actinoplanes utahensis
atgggcactgaggcgtcgcatccggacgacgacgaatcagtcccgttgactggccagcccaggtcttcgacctgcccctcgacgcggtcttcctgtaccagacgccactcgaccgacgcccggcaccgctacccctcaccgtcctggagcaccgtcatgaccactacgaaacgcatggcccggatcaccgggctggcctacctcggcctcgccctctccggcatgctcggattcctgctgatccgcgaccggctgtacattcccgacgacgcggccgcaaccgccgcaagcctcatcacacacgaacggctcgcccgcctcggcatcgtcgcggacctcgccatggtgctcgcccaggccgccacagcagtgtgcttctggaagctgttccgaccggtccagcccgtcgccgccggctcgatcgccggcttcgggctggtgaactgcgtgacgatcctggtcgccgtgatgttctcgaccaccgcactcgacgtggctctccacaacgacgcgacatcagcacaccaggcgctgctgctctaccacctcaacacggcagcgttcagcctgtcaggcctcttcttcggactgtggctgataccgatgggatggctggtgatccggtcgggctacatgccacgcccactcggatggctcctcatcggcggcggcctcggatacccgatcagcgtcatcacatcatcgctcgcccccgcccactccagcgtcgtctccgcgctcaccatgcccgccacggcgggcgagttgtggatggtgggctacctcctcatcaagggggtgtcggacgcggcaccgataaccgccgcgccaacagccggccctcaggcagcgctgccctga

SEQ ID NO: 7791 - DNA, 708 bp, Actinoplanes utahensis
gtgaagatggcggtctgcgggataggcaccgtggtgctcgccgcgacagtcgcgcttgcggcagcggtgccgggcgaatgggtgacctcgaccggagcccggcaccaatggaactacccgctggtgatgtggccactgttgctggcgctgatcgttgcgggcctggtgatgacagccagctggcgatgggctcgcccggcagccgtcgccgcggtcatcgtggcagctcaggtggctggctatggcctggtctcggtccgcagctggttcgacctcgccgcgacggcacgcgtggacggcctggatcaggagaacctgcccacggtcgtcacgctggccgccgtcgtcatggccgctgccgccgccgcggccgtcttggccgctgcagcggcgtggcaggaaccggcccgcggccgctcaggactggcaccgaagcgtcccggatacctggcggtcggggcggcggtggtgacgctgccatcgctggccgcgacaatcatgaccgttccagacttcgtctcagcgggctgggagacttcactgacgtgcttgctgccgtggggtgcgagcattgccgcgatcgcctggctgcgaggccgatcggcgactacggccggtgtaaccgtcgtagcgtccgccgtgctcgtcgtcgcgtccactatcgccatgcatcggacgggacacatgtacccgccgacgagtgactga

SEQ ID NO: 7792 - DNA, 1011 bp, Actinoplanes utahensis
gtgccagactgccgagccatgacgcttctcgacgtactgatcgagggcctgacggcggtcggcatcgacgagaagagcagcccgggcccttcgacgccggtcgccctgatcgccgcgcgcgggatcgtgctccgcgaactggaggaccgcctcccggcggacggcgacggaccgttcacggtcacgcgcagcctcggaccggtacggtcgtaccgcgccgaggtggacctgctccggcggcgcggcgggttctcgctggccgacgcggcctgcgcactgctcgcggtcggcgccctcaccgacgacgacgtcgcagcgcttctgccgcatctgccggcgtcctgcggcatcggccgccagcgggtgctcaatcggctcgccgacgacgacctcggtgcggcccgggcggctgccgaccggatccggggcgacaccggctggaagggccaccgggacatcgccgccgtgctggccgaccggggcgacgccgccgagtttctcgccgggtggaagagctaccgggcggcgacggaccggcacggcatgggtgagctcaaacgccgtctggtcgagggcgtcgcgcgcaccgcgggctgggcggcggcgctcgaactcgtcggcgacaagcggttcgggccggcgctcgcggtgcacgcgttcaccgcgttcggcgccgacgtcgacggcctgcgccgggtcctgggccgcaccggcgtgctggcggagctggaccagctcgcggtgctcagctcggcggtgctgcgggccagcggtaccgacccggtacgcaaccacccgtacctcgacgaactggtcgaccggatcatcgctgtcgacccgtccgccgaccgcgccaccatgcgcacccgcgaccggctgctgttctcgctgtggccggcgatgggtgagacggcgaccctcgaccgggtccgcagggcggtccggacaccgcaataccggcgggaactgacccggcttccccgcgacctgaccgcttcgctccggcactga

SEQ ID NO: 7793 - DNA, 801 bp, Actinoplanes utahensis
atggtcgatcgccatgcccgcggccaggccggccgcgtagtacagcgggggaggaacgaggatcacggcgtaccctctcttcttttgagtagagtcaagctctatcgaatagagcactacagtgaggcggtggctgtcaagcggcgatacgcgtcggatcaccgtcaggagcaggcccggcagacccgagcggcgatcctcgcggcggccgcccggctgttcgtcgaccccggatacgcggccaccccgctgaccgcggtcgccgccgaggccggcgtcgcggtgcagacgctgtacaagaccttccgcagcaaaccggcgctgctgtccgccctggtcgacgtcaccgtcgccggcgacgacgaaccggtggcgctgcccgaccggccgttcgtcgccgagatccgcgcactgcccggcgcccgggcgcgactggagcgctacgcccggcacctcaccgacgtccacgcccgccaggcccaggtgatgctcgccctggccgccgccgccaccgccgacccggacgccgccacgatctggcgcaaacacctcgccgaccggcgtgccggcatgctgatgttcgccaccgccctggccgccaccggcgaactgcggcccgggcacacccccgagaccgccgccgacgtgctgtggctcgcgatggacgtgcacaactacgactggctggtccgccggcggggctggccggtcgaggacttccggcgctggtacgtcgacacggtggccggggcgctgctcgacccgctggcgctgaaccgtcggcctgacgcgccggcctga

SEQ ID NO: 7794 - DNA, 2430 bp, Actinoplanes utahensis
atgtcgctgaccctgggggaggcccgcgcccgggccgccatgctcgccgatgtctcctacgacctggcgctggacctgacctcgccggacgacttcggcagccgggtgacggtgcggttccggaccaccggcggttcgaccttcctggagctgcacggggccgtggcgcccacggtgacgctggacggggcggcgctgctcaccgcgtacgacggcaatcggatccggcttgaagatctttccccggggacccacgaggtggtcgtggacgcccggctgcgctacgtcagcgacggcgcggggctgcacgcgttcaccgatccggccgacggcgagcggtatctcggcggctacctggggttggacgtgacgcagcggctgttcgcctgcttcgaccagctcgatctcaaggcgccgatcacggtggcggtgaccgccgacccggcgtggacggtgctgtcgaacgggctgccggtcgcctccgcgcaggggcggtggcggttcgcgaccaccccgccgatcccgtgcgaccagttcgtcgtggtggccgggccgttgcactcggtccgctgggagcatcgcggggtgccgatgggctggcacgtgcgccgctcgctcgccgcgcagctcgaccgggacgtcgccgagctgcgccggatcaccgaggcgtgcttcgaccacttcgccgagatcttcgtggagccgttcccgttcgactcctacgaccaggtgttcgtgcccgagctgaactggggcgcgatggagaatccgggctgcgtcacggtgaacgagtacctgctgccccgccagcgggtcaccgacgacgaccggcgccggcaggcgatggtgatcgcgcacgagatgtcccacatgtggttcgcgaacctggtctccccggtctggtgggaggacgcctggctcaacgagtcgttcgccgactacatgggtttcgaggtggccgagaacgtcgccgggcatccgggtgcgcgggtggccttcgagtcggcgttcaagccgggcgcctacctcgccgaccggcgccgctccacccacccggtggcgccgcgcgccgagcaggtgccggacgccgccaccggcgggaccatcttcgatcagatctcgtacggcaagggcaacgccgtcctccggcaactggtcacctggctcggccgggacgccttcctggccggcgtcaacgcgcacctgagcgcccaccggttcggcaacgccaccctcgacgacctgctgaccgccctcgacgccgcctctccacgcgacgtgcgcgcctgggccgacgggtggctgcggcgctccggccacgacacgatccgggtgacccgggacggcgacgtgccggtgctgacccgcgacggggtgcggccgcaccggttcacggtcaccgcgtacacgtcgtcgctgcagccggccggcgcccgcctcgtcgacctcgccgacaccccgctggcgctgcccgacttcgccggtctggccgtcgtgcccaacgctcacggcgagacctttgccaaggtcgacttcgacgagctgtcgtacgccgtgatcacccgaggcctcaccggcctgcccgacccgctcgcccgggcggtactgtgggccgccctgctcgacggcgccacccccgccgcccacctggacctgctggcccggcacctgccgcacgagccgtcggccaccctgatctccgccgctctggaccacacccggcagctcctgcgccgccgcgaccagccgggcgccctcgacgtgatcgccgccgcgtgcaccccggccggtgacctcgacccgcagcgggaggtggcgctgacccgcgggctggcctggtccgccgccgaccccggcatgctgcggcgctggctgaccacgggcagcaccgaccgcggtctggcactcgaccccgacctgcgctggacggtcgttacccggctggccgagctcggcgtgtgggacgcgacgcagatcgagcgggagcggcggcacgacggcaccgcggccggcgagctgggggcgctgaccgccctcgccgcccggccggacgccgcggcgaaagcggacgcctgggcggcgatgacccaggatccggacatttcggtacgtcgtttcctggcgctcgccgcgggcctgtggacgtcgccgcggcgggagctggtcacaccgtacgtcgcccgctacgtcgcggcggccccggcgctggccgggcgcgggccggcgttcgcgacggcggtcggccgggcgttcccggcgatcccgctgaccgatgcggagctgggactcatccgggaggccctgtccggcgacgtgccgacggtgctgcgccgggcctggaacgacgaactcgacgaccgcgcggcggtcacagccaacgacgtacccgggaccggtagtcgaggtacttctcgccgaacagtccggtga

SEQ ID NO: 7795 - DNA, 771 bp, Actinoplanes utahensis
atgagggcacgaatcgcaccacggcacctccccggtcgtcacgatcctcgcacacggctcgttgggccggttgatgcgacgccatatgctggaccgatgcggatcttgatcgccgaggacgacccggcgatggccgccatgctccaacgggcgttcgagcgggccggctacgccgtcgacgccgtcgccaccgggaccgacgcggtgtgggcgatcaccgagaccgacttcgacgcggcggtcctggacgtgatgatcccggagccggacgggatcgaggtgtgccggcagatccgggcccgggaccgctgggtgccggtgctgatgctgaccgcccgggacggcaccggggacaaggtccggggtctcgacgcgggcgccgacgactatctgaccaagccgttcgcgctggacgagctgatggcccgggtccgcgccctgctgcgccgcgagccggcccagcgtccggccgtgctgcgcgtcggcgacctggagctggatccggccgggcggacggtgcgccgcggcgagaaccggatcccgctgtcggcgaaggagttcgccctgctgcacgagctgatgcggcgggcgggggagacgctgagccgcacccatctcatcgagcacgtctgggatttcgcgtacgacggtggctccaacgtggtcgacgtctacgtccgctatctgcgcgacaaggtcgaccgcccgttcggtcgggacagcatccgtaccatccgcggtgccggctacctgctcgatccggaggcgtga

SEQ ID NO: 7796 - DNA, 1347 bp, Actinoplanes utahensis
gtgcgattcgtgccctcatcgctgcgcacccgcctcgccctggtgttcggcatcggcacgtccctggtgctgctgatcgccctctccctgctctacgtcgtcctggaccgtcagctcgacggcgccgtcgacgccgacctggccggccggggcgacgacctgatcgccggcatccgctccggtgacctgaccacggtcagcggcgacccgatggcccagctgtacgccccggacggcaccctgatcgcctccggcgccgccctgtccggccaggtgctgctgctccccgaccaggtccgcagcgcccgcaaccacaccgtgaagagcgtcgccctgctcgacctgcgccccgacgagccggccctgcgggtccggctgatggcccgccccaccggccgcgacggcgacatcctcgccgtcgcccagcccctggccaccgtcgagagcgccggcaaccggcagctgatcgtcctggccgtcgccaccccggtgctgatcggcgcgctcgccgtcctcggctggctgctcgtccgcgccgccctgcgcccggtcgacctgctcacccgggaagccgccgcgatctccaccttcgacaccgaccgccggctgccggtgatcaccggcgacgacgagatcggccggctcgccgccaccctgggcggcatgctgtcccggctgtccgtcgccttcacccgcgagcgcgccttcgtcgacgacgccagccacgagctgcgcaccccgatcgcggtgctgcgcggcgaactcgacctggccctggccgccgtcgacgacccggccgaggtccgccgctccctgctcgccgcccagaaccaggtcgcccgcctcacccgcctggccgaggacatgctgctgctcgcccgcgaacgcgccggcgccctcgccgtgcaccgcgaaccggtcgacctgaccgacctggcccacaccgagcagcgcgccctggccacggtgtccggcctgcgcatcgaggtccgcggcgacccggtcatcgtcgacgccgacccgggccgcgtccgccagatcctcgccaacctggccgccaacagcggcgccgcgggcgccacgacggcccaggtcaccatcgtggccgaggaggccggcgcccggatccaatgggccgacgacggcccgggcttcccccacgagttgctcgaccgcgccttcgaacgcttcgtccgcggcgaccgctcccgcacctcggcgaccggcgccggcctggggttgtcgatcgtgcgggcggtgacgatcgcgcacggcggcaccgccgaggtccgcaacggccccccgctgggcggtgcggtggtcaccgtccacctcccgacgaagtga

SEQ ID NO: 7797 - DNA, 867 bp, Actinoplanes utahensis
gtgatgcggggccgcgacgttgtagtgatcggcgcctccgcaggcggcgtcgaggcgctgggtgagcttgtgcggggcctgcccgccggattgccggtcggcgtgctcatcgtggtgcacaccccggccgactcggcgcgcaggctgcccgacgtcctgtcccggtacgggccgctgcccgccgcctacgccgtctgcgggcagcggctgacccccggcctgctgaccgtcgcaccgcccgggcagcacctcgtcctgaccgccggacaggtcctgcgtctgcaccgcggcccgctggtgcaccgcacccgccctgcgatcgacacgctgctgcacagcgcggcccgcgtctgtggtggccggacgatcgccgtcatcctgtccgggctgctccgcgacggcgccgacggtgcggccgcggtcgccgccgccggcggatccgtcctcgtgcaggacccgctggacgcccgccgccccggcatgcccaccgccgcgctccaccgggttccggacgcggcggtctggccggccgcgaagctgggccgggccatcaccgatctgctcgatgcagcccgcccgacaccgaccggtgccgtgctcgcaccgccggcgccgccggagcacggtgatccgagcggcatcgatgcggccctgtggaccgccgtgtcgcagctgcaagcgcacgccgccgcgcagcaggggttcctgcggcagctcgaccggaccggcccgctcgccctcgtggtgcgcaaacgcgccgcccgcacactgcacgccgcgcaggtgatcaccgaccacgtcatcccggtcttcgagccggaagccgggaggtgtgaagcccccggcagtgcgccgacctccccctga

SEQ ID NO: 7798 - DNA, 954 bp, Actinoplanes utahensis
atgaagcgggtcctgtccgccaccggacatgaagacatcgagcagctgctccgcgcccagtacctgaccgtccggctgcggacccgcggcgacaacaagcatttcatggtcgaacagaacaccgccggcccggtcacgctggggcacgccgcgtacggcatgagtgtggacatggccggtgagcccatcggggcactggtcatcgggcatgtccgcagtgggtcggccacctatgtcagccgcgggcggcgacgcacgtgggggccgggcgacgtcttcctcggggtggaggccgacgagccgttcaccgccaccctcgaccatctcgacagcgatttcgtgatcttcgatcccgcgaccctgtccgacgtggcctgcaccgcgcccggggttgccgggccggtccggctcgaaggccatggcgccgtgagtccacgggcagccgcccggttcatgcgtacggtcgcgttcctccaccacctgaccgacgacgatccgaccggaacccccgggccggatgcgtcgcccctggtcgcgctgcaggcggcgcggttgctggcgtcggtgaccctcgacacgttcgcgtcgaacgcgatgctcgagccgaccatcgaggaccgccacgacgtgcaccccgccacggtccgccgggcggtcgcgttcatcgagtcccaccccgacctcgacctcagcgtggtcgacatcgcccgggccgcgttcgtcaccacccgagccctgcaactggctttccggcgccatctgggcaccacacccctgcggtacctgcggcgggtgcggctggatcgcgcccacgccgacctgctcgccgccgatccggccgtcgacaccgtcaccgccatcgccgcccgctgggggtgggcgcggcccagccgtttcgccgccgactaccgcgccgcccacggccggcacccccaccagaccctgcggtcctga

SEQ ID NO: 7799 - DNA, 717 bp, Actinoplanes utahensis
atgacgatcgaccatctgtgcctcaccgagtactcaccgcgcgatctcgtggccttccgtgccgcaccggcggctgacgcggtcagcggcaaagagctcgccttcgccgacagccgacgttggcagaccgggcaggaactggttgtccggttcatggacggcgacgcgcggaccagggcgcgggtcgaagagatcgcgcgcgcctggcttgagcacgccaatctgcgcttcaccttcgccgaccgggccggcgccgagttgcgcgtgacgttcaccggatcgggctactggtcattcgtcggtaccgaggctctcgccgtgccgtccgcaaagcccaccattcagttgggcggcctcagcgccgacgatgatccgcaggagttgcgagctgtggtgctgcatgagttcggccatgccatcggctgcgttcacgagcaggcgagcccggcggcggacattccgtgggacgttccggccgtctacaagtactacctcggcgtgcacggctggagtgcggccaagacggaggcgaacgtgctgcaccggtacgcgaacgacgggacgatttccttcaccgaccatgatcctgaatcgatcatgcaatacgcggtgccccggtcgctgaccctcggcggctatgagatcggctggaacaccgacctgtcggacggcgacaagcaattcatcgccgccatgtacccccctgccgaccggtag

SEQ ID NO: 7800 - DNA, 1470 bp, Actinoplanes utahensis
gtggtgagcgcgagctgggacgggcagagacggcagcggctcctcgagcttctcctgggcggttatgaaaccaagagaccgttgcggcacctcgccaagcaggccgggctgaagaacggactctttccggacggcggcgatctccggtccgtctgtcatgacctgatcgagcgactcgcgaacgcgaagatcctggacgacttcgtacgctgtgcggcaaatgacgtccggctcagcggctcgcgggaagccctgctcgatctgctcttccctgaggtgcccgagcagaagccacccgatcgggtgctcaccgacaacgaacgcgcccgcttgaccgatctgatcgatcagtgggacaaggcgtcccgcctgcccgacgagtccgacgtggcggttctggtctggaccgcgctggggcacatcggccgggtcgagctgcgcgcgtgtcgcagcgtaccgatgatgatctcgctgctggatcagcgcatgcacgccctgggagccatgccggcgatcctgctgttcctggagcatctgctcgcccatcccgacatcgccgttagtgaggaacgccccatcctgcggcgactgatcgacgacgtggcacagcggacgcgggtggcgccggagaaccgggggccgacagctgcggccggtgagatcctcggccaggtcatggtctatctcgaactgctcgacgaggatggtcacctccggccggaggcactggtctaccggcagaccggcaaatcgtatttcgtctatcagtgtgtcgatgctttcccggattggcaggaggccgccgaacaggcgatcaccgagatcgcgccgctgctgcgccggttcgacccgggccagatccggttcgagatcgtcgtgccgtggcggctgctcggggagccgatggacgaatgcctgttcgccggcgcggaactcggttcccagttcgaggtgaccatcaggctgggcgagcgccggatcttcgcgctgtacgagcgtaggtgggagcgtcgtagccggctcctgcacgaccgcggggacaccccggctgaacatcttgtgcgggtggtgacgccggacgcccggccgggcacggtgctgcggcccggacggcccaccgacgaatcggtcgcggtcatgatcttctcggctgtccaccatccgcctcgcacgctgcccacgcgacacgtcctgctggatgcgttccgggaaggtgttcccgtgttcctgtggtttcgcggcgaccaagatcccagccagctccacgatctcgtcaagtccatgttgagcggcgcggaactgaatgggataccggcggcggtgcgcgcaaggcggcatccgtcggaaccggacgacagcgacggggctgccgcaggacagcccatctccgtgatctacgacgacttcggaacccgcccccgacggggcggatcgctgcaacccgcccgagcacgcggaggcacgcaatga

SEQ ID NO: 7801 - DNA, 1002 bp, Actinoplanes utahensis
atgaccaccacacccctctggatctatcggggcgacggcaacccacacgcctgggatgtccccccatcgccgccttggcgcgagttcgcgggccagccgatggatcgacccccgtcgccggacgcacccggttcccggcgacgtcggcacctggcttccacctatcgtgctgaaccgggcgaggcactcatggtgaacaccgccattcacctgcgccgtccgctgctggtcaccgggacacccgggtgcggcaaatccacgctcgccctgagcgtcgcctacgagctgggactcggcgagctgctctactggccgatcaccagccggaccacggtccaggacggtttgtatcgctatgacgcggtaggccggctgcacgccgccggcctgcgagaacgcacccgaggtcggggtggtgccgggacgcagatcggcaaatatctgagtctcggcccgctgggaaccgccctgctccccgccgaccggccgcgggtcctgctgatcgacgagttcgacaagggtgacatcgatctggccaacgatctgctgacggtgttcgaggagggccgcttcaccgtccccgaactgcagcgcctcccgaaccggaccgtcacggtccaggacgacgacggcttgccggtggagatcgaacgcggtgcggtggagtgcgcacagttccccatcgtcgtgatcaccagtaacggggaacgcgaattcccgccggccttcctacgccggtgcattcccctgcggatcgcgccgccgtcgcccgacaagctgcggcgcatcgtgcaggcgcacctcggccgtgaggtgctcgccgacccgctggtgcgggaactggtcaccgacttcgccgagatcctggagaagcaggacggaacgtacgccaccgatcaactgcttaacctgttgagcctgcgcaccggcgtcagcaagaccgacgacgactggtccgccctcacccggaatctgctcggccgactcgacgaccagccgtga

SEQ ID NO: 7802 - DNA, 2748 bp, Actinoplanes utahensis
atgtctgtccatgacgagctcgacgtccaccatctgctggacgtcctctggatggcacggctggtacgtgccgacgagaccggcatcgccggcccggtgggtgagacggccgacgcaagcgcacacacggcgacggacgcccgcccgaagggccccggctcgcccgtcgaggcgctctccggcgtggccgccgcggacgccctgcatcaaccggtcaccgcggccaggctggggtccggctcggctgccggcggtcgggccaccgcggaacatgctcatcgagcgggaagagccgggcaacacggtgacgcgacgccagtgaccagccgagcactacgtccgctgcgccggcgggtcccccgccgggaccgcatcgccctggacgaggaacggactctgcgcgtctctgcagacctcggtcgcccggtcgtgatcacccgaccgcacaccgaacggtggctggacctcgctctggtcatcgacgcctcgccgaccatgggcatctggcaggagaaggtggccgggctccggaccgcggttcgccgctccggcgtgttccgcgacgtgcgggtgctacgcctggtcaccgacgacgtgggagacctggccctgctcaccaccggcgggcaacgtcaccagcccagtgaactgctggaccgcaccgggcgtcgattgatcgccctggtcaccgacggggtcgatgatcgctggcacaccatcgaggcggctgcgatgctggcacggtggtcggcgcacaatccggtcctgacccttcaggttcttccgccggcgctctggcaccgcacggcgctcccgccgctacctctgcgcccccggcaggtacgtcccggcatctggcagtccacgtcgccatatccggcggaatacgagacctcgaactggataccggtagccgccgtcgacgactcgtcgatacatcggtgggcatcgacggtagtctcgtcccggccgcccacactcgagctgcccgcgataccggtcggcttcctgccgctggccgatcccgccggccccgcgatggccgacgatccggtcgaactcgtggcgctcttccacagcgactcttcgccgaccgccttcgcgctcgcggggtacctggcatcggcgccgatcacactgcccgtcgcccgggccattcaggaagacttgctgccggcctccgataccggccatctggccgaggtcctcttctccggcctcgtcgagcggatctcaccgcccaggcccgaagaggatcccgacgccgtggtttacgacttcctcccgggcgtccggcatgagctcttgcgcacccgccggcgcgacgagaccttccgtgtcctgcgtctactcggccgtcgctccgcatcggtcgccggccggctcggcaccgtggacctgttctcactcgccgagaacccaagcggctatctccgcgaccacccggacagccggctggcagcgaccgtcgcggtcaccgtgctcggcggcttcggtggcgtgtacgcggacaacgccacacggctccagctcatgctcgaagagaccgccgcgccggcgccggctctgacgaacccgcccgcgcttctcctcaaacccgcacccgacgcgacagcgggcacacaatgggccgctcccctggaattgttcggcagcggccccgtcgtcgccacggccagccaatgggcggaggtgcaccggttggccctcgccggccgcaaggcaacgatcgcccgcgacgtcggccatcgattggcgacggtatggttgcgtgtttcccggctcgcggacgtcgcggccctctcccgggccaccctgacgttggggcccgacgcgaacgcgctctacgacctgggccgggccgaatccggcatgggccggtaccgagacgccctggcgagctatgagctggcccttcacctgtaccgggatgccggcgcccgcggcgacgaggcggccgccctgaacaacatcgccttcctgtacaacaatctgggtgatgcggcacaagccctcgcctacagtgaacgggcactgtccatccagcgcgaggtcggcaaccgcgccggcgaggcggccgcgctgaacaacatcggctctgtcctctacaccctcggcgaccgacgacaggcgctcgaccgcttccagcaagccctggtcatccgcctcgaggtcggcgaccgtgggggcgaggccaccacccgcagcaacatcggcaacgttcttctcgccctcggtgaccggcaacaggccctcgcccatcaccaacaagccctccccatccagcgggagatcggcgaccgtgccggcgaagccaccacgcttcacaacctgggctccctttatgacgacctgggcgaccgcggccaggccctcacctactaccggcaggccctgagcctctgtcaggagatcggggaccgcgccggcgaagccggcaccctcagcaacctcggcaacctctactacgccctcgacgaccggcaacaagccctcgcctgccatcaacgagcgctggccatccgacaggaactcggcgaccgggatgccgaggcgacgtcgcgattcaacctggccgttctgttgtcgcaaacggaacagatcgacgatgcagccgctcacctacgggaatccatcagactggccgaggagacgggtcatccgtcgctggagcggatccgctcgttcctcgacgaattgcagccatccggcgggaaacgtccgaagggcggtgggcagagccggtga

SEQ ID NO: 7803 - DNA, 2232 bp, Actinoplanes utahensis
atgacctcataccagttggagatcttcgaacagattccgggttcgtacgagctcagactggtcgcccctgacggagcggtgaaaacccgcagcgtccctcgggcggttgtcgacgacctcgtcgaaacagtggaccgctactacaccgagcatgcgatcgccccccgcgtattcggatcgacacagctgcaggacatcggcacaagattggcggggttcatcgacggtgacaacggttggctgacgccgttactgagcccccctggcaccaccgtacgcatcgtcgccgggcaacgcctccggcatctgccctgggagctgcttttcgacaacggctcgttccctgccgtcgatgaccgtgccgcactgctgacggtccggacacgcggcacccgccaggtccatacggattctcccctgcccagcaaccgtccgctacgcgtgctgttcatggccacttcgcccgagggggtggaaccggtcctgaattacgaggcggaagaggctgccatcctggccgcaaccgcgcgcacaggcaccgcactggtcgtcgaagaaagcggcactctggagggtctgcgctttctcttccgggattacggcgccggatacttcgatgtcctgcatctcagcggacatgcgacggtcggcgccgacggcgagccggtcctcctactggaaaacgagttcggcgggctgcatctggccaccgcggaccagctggtccaggccatggccgggcattggccgcgtctggtcttcgtcagcgcctgcctctccgccagcgcctccacggacgacgcaccgctctccctcggggagcggctcgtcgacgctggcgctcccgcagtactgggttgggcgctgccggtcggggacagtgctgcgatcgagttcgcggccgaactgtaccggaacctggctgacgggcagcccatcgacgcggcggtcgtggcggcccggcggcacctgcaccggcagaagagtcccgcctggcacctcctgcgggtctatgccgacgacacaccgctcgacgcgatggtgacaccgttgcacaccacgggccgtgcacagcttcgtatccgacatgctgatcagcagtttctcgatccgcgcaccatggtgtccagggttgccgctcgcaaccggttcgtcggccgtcgtcgagtcattcaacggtgcctacgaaccctcagacggcccgacagccaggctctcgtcctgcacgggatgggcgggctcggtaagagcagcctcgcctcccgcctgctggaacggatgccgacacaccagcacgcggtctggtacggccgagtcgacatgagcaagttccgggagctcaccgacaaggtcgctttcccgacgctgacgaaacacatcgaggcgatgacgttgctgagccaggatgtcgttcccctgtccgttcgcctgcgctacctgctggatgcgaacggccccctcggagacctgccatgcctcttcgtcttcgacgacttcgaggacggcaatctcgagcaacaggacaacggtccggtgctgtccgcggcgatggcggaaatcctgcctgccctgctcggcgccatccgtgacaccggcagcaccagccgggtcatcatcaccagccgctaccgattccccgcaccgaccggaagcggattgacggtggagtcactcgagagtctcaccgacgtcgagcaggtgaaaaagctcgccaacctgcccaacttacgccccggctcacctctcgaccagcgcattcgcgtccgcgcgattcaagccgcagccggcaacccccgcctgctggattggctcgacctgatcgtggccgacgccactaccgagccggacgagctcctcaccgcgatcgaggcgacggcggaccgattccgcgaggagatcctcgccgagaagctcctcggctctcagccacccgagctgcggagaatgctcgccaaggtcaacgtcgtcgaactgccggtaccagcgtcgacggtgacagcgatgcacgaccacccgtccgctgaccgtcacatcgaacgggccgtccaactcgggttgctggaagaaggcgtcgaccacgacacccgccgcccccggtaccacgtctccaacgtgctgcgcccactgatccgcccgctgctcaccgacgacgaatacgtcgaagcctgcgctgcggcggctcagtcgctctaccacctctgggtcgtcgagccgaccaaccgcgagtactga

SEQ ID NO: 7804 - DNA, 1191 bp, Actinoplanes utahensis
atgacgaccgccactctcgaccgaacggccgtgcgaggtgactccgcccccgggccgaaaggccggcctcggctgtacgtgctggacgcgatgcggctggtgtgcgcgctggccgtggccggctaccacttcggggactcctggtgggcggacggcacgcatcgacccgcgtacttcctgccgcacgcggcgccggtactgatctacggcttcctgggcgtcgaggtgttcttcctgatcagcgggttcgtcatcctgatgagcggctggggacgcacggtccgggcgttcgcggcctcccgcgccgcccggctctacccggcgctctgggcgggcgtactgatcaccgccctggtcagcacgctcctgccgatcgagggcgggctgccactcgggccgctgccggccggccgggacgtgctggtcaacctgacgatgctggcggagccgttgaaccggccgctggtcgacaccgtgtactggacgctctggtgcgagttccggttctacctgatcgtcgcctgcatgctcgccgccgggctcaccgcgaagcgggtgcggctgctcggcgccgggtggctgaccgccgcgatgctcatgccggccttccccggggcggtgctcaaccaggtcgtgatggccgacttcgcgccctacttcgtcgccggaatgaccatgttcctgctgcgccgcgaccgtcgcgactggtgggcctggctgctgctggccgtctgctggctggtcagcctgcaccacgtgcagctgcgggtggcggacctgcgtcccggcttcgacgtcgcggcctggccggcgccggtgctgctcaccatggcgtacggtgtcctgctcgtcatcgccctcggcggcacggaccggatcacctggcgatggctgggcacggccggcgcgctcacctacccgttctacctggtgcatcagcgcgtcggctacagcctcatccgtaccgcccgcaccgcgaccgggctgcccgtaccgacactgatcgtgggagccgtcctggtcctgctcaccacggcatggctcatccaccgcctgaccgagcggccgctcgcaccgtacgtccgcgctctcctggcgggtccgcgcagcctgccgggcccggggagagtggggcacgacactgatccgcgggatgacacacgccggaaatccgggcttaccacaatgtga

SEQ ID NO: 7805 - DNA, 564 bp, Actinoplanes utahensis
atgaagtcgccgccgcagctagccgtcaccgtcgccatcacccgacggatcgacccgtcccgggatgcggagatggccgcgtgggtgcgggccggcgcctcgctggccgagaccttcccggggttcctcggcaccggttgggtccgccccgagccgcgctccccggagtggcacatgctctaccgcttcgccgacgccggctcgctcagcgactgggaggagtcgccgcagcggcagtggtggctctcctcggccgagggtttcgtcgagcacacccgggtggagaagcgcaccgggatcgaaggctggttcgacccgccccgggagtccccgatcgacccaccggcgccggccgctccggcccggtggaagcaggcgaccaccatctggctgggcttcttcccggtcagcctgctctccggctggttgctggccccgcacctgatcaccctgaacctggtgctgcgcacgctgatcagcacgctggtgctgaccccgatcatgacctacctcgtgctcccccggatcaccagaatcctgcagccctggctgcgtcgcggctag

SEQ ID NO: 7806 - DNA, 861 bp, Actinoplanes utahensis
gtggagacgacctcagctgagctgctgcgtagggcgcacgcgaccgccgatgtcgacgatctgctcgacatcgggtgcgacctcgcggacagcggcgatgccgccggcgccgagtactgcttccgccgagcgtcggagctcggcgaacccgccggcgcgttcaacctcggcaacaccctgagagatcaggggcgccttcatgaggcggtcgacgcctacgagctcgccctctctggtggtgagaccgatgcgtggctgaacctcggcgtggtgctggacggtctcggcgacctggccggcgcgatgcgcgcgtacgaacaggccgagcgggccggcgacagcggcggcgcggttgcgctggccttttccctgcgggagcagggtgagcgtgccgcggccttcgtcgcgatggaacgcgccgaggcagccgggaacacattcgccgcggcggtactggcctgctggcggtgggaccagagcctcgacccctccctcgagccggccctgcgcgccgcggccgagctttacccctcggcccgcgccgacctcggcgccctgctggtgaacaccggccgggtggaggaggggcgcctcgtgcttctgcggggcatggagctgggcgaaaccgagagcatggtcccgctgggcaacgtctacgccgatgtcctcggcgacgacgacgccgccgaagcggcctaccgtgccggcgcggagctcggtgatacgcacgcccaccacaacctcgcgaacctgctcgaacgccggggcgacctggtcggtgccgaatggcacttccgtcaggccgcggagggcggagatacgctggccgcggcggcgttgcgagacctgctcgagggctga

SEQ ID NO: 7807 - DNA, 1263 bp, Actinoplanes utahensis
atgttgcacggtgcgcgttcgcccggcggtaggcggcttctctatgccgttgtgacgcttgcggtggcaggtgctgtcgctggagtttcgtcggtcgccgacgccgcagtggtgacgggtctccactatgtggccatcggcagttccttcgcggcggggccgggcatctcgccggtgcagtccagcaccggggccgcagcctgcgctcggtcgagcaacaactatgccagcgtggtggcccgcgacctgggagctgacctcaccgacgtctcctgtagtggcgcaaccacggcgaacgtgctgaccacaagccagaacggcctgccgccgcagattcaagcggtgacgagcgccaccgacgtcgtcacgatcaccgtcggcgggaacgacgtcgactacctcggcagcatgggggcgtacacctgccagaacgatggcggctccacctgcgcgagcgtggaccgtgcggcgatcgacaaggcgttcgctgatgagcccgcacgcctgcagaacgtcgtgaacgcggtacacagcgccgcgccccaggcacaggtttacctggtcaactacttcacgatcctgccggactccggcacctgctccggcgtgccgctcaccgccgaccaggtggcgtacgaacgcagtatcgccacccgcctcgcggcagccaccgccaccgccgcgtcagccgcgggagcgacgctcgtcgacgtggccgcagccagccacgggcacgacgcctgcgcagccgatccctgggtcgagaacggccacccgccgaccggacgcacccagtaccacccgaatgccaccggaatgaggaacgccgcccaggtcatcgaagcggcgttggccgcccgcggtcaggttcgcgccgccgagttccgctccggtatcgcgggtaaatgcgtggacgtcgcgggcgcgggaactgccgacggcaccccggttcagctgtacacatgcaacgggaccgtggcacagcggtggacgttcaccccgggcgccggcggcagcctgcgcgtcctgggcaagtgcctggacatcagcaacggcggcaccgccaactccaccagagttcagttgtggacgtgcaacggaaccggcgcccagcgctggaccctcggtgccggctcgtcattggtgaacccgcagtcgggccgctgtctcgatgatcccggcggctcgacatccgacggaaaccagctgcagatctttgattgcaatgccaccgtcgcgcaacagtggactccgacgacctga

SEQ ID NO: 7808 - DNA, 408 bp, Actinoplanes utahensis
atgttccgcatcatcgccgcatcagctgcaaccaccgccgctgtcgccctgtgggccgctcccgctcaggccgacgcccctctgatcgagaccggcgtgaccgccgtctgcaatgctgcgaccggcaactgggacctcacctggacgctgacgaacaacctcaacagcccggcgctgaccatcacgcagatctccaccccggccccgggcgtcggaaccctgccgtccgtgccggggaacggcacggcgcaggcgcatcagaccgttgacggggcagcgtcgagtgcccaactggactacgtcgccgtctggacccaggtgtggccctcggtcagccggtacagctccacgacctggaccgctcctaccgcgaacggcgacgtcacgatttgcaccaagacggcctga

SEQ ID NO: 7809 - DNA, 735 bp, Actinoplanes utahensis
atgctggaagcgctgggccttgtcgtcgatttcctgacgcgggccatccctgcggcggccggacggcggcggaagaagaaattggacgatgtcggctctgaacttttcctcatctattttcgactgaacgaagtcattgtcacggcggaacgcattctcggcgtgttggagaactacgttcgccggatgagtcagaatgacggccgcagtcacctgctcgaggatctcaccggaaagagctggcagaccggtctcctcatgcgacaacgcacaaacctgcaagaggtggccgagctgattttccgagacaggagcggtctcatgcttatcgatgctccgtcgtacaatgcactgacaccactgctggaccgaaaaatgggattgatccgggtcctcatccgcgcaatggacggaaacaggctgccggtggcgccgtccgcggaggacatccattgtgtagtatccctttatgctctcggaggacagcaccttgatcttgactcggaagagatgagaagggtccaggacagaatattcgccgaagcgctttccttcgacgatgtcatggatgagagcacctaccgggcggttcagcgctacctcgacgccgagaatccgcgagagcaactcaaacggatcaagggatccgtcagtaacatgagacggtctctccttaaacattttaccgttgaagacatgttgctacgcgccggagacgagcgtttctcaaattga

SEQ ID NO: 7810 - DNA, 843 bp, Actinoplanes utahensis
gtgccgctctgcacggcagaacctgccgccgcctgggaccgcccgtatgacatctaccaggtcgtcgcgccggacaagcccggcacctacgctcacaccgagccgcgtttcgccagcccgacgacgaccttcctggccaacggcactcagctggacatcaactgccggggcgccggcgaagccggaacgacccgcgtcctgtcgggcgccacgtctgacaaccccgatccgcactggatcgagagcaccacagcccgatgggtgcggctgagcgacggcacctgggtgttcgacggacacaccgataccgacccgggcactccagccatcagctcgtgcgccgccacgccgctgctgagcacgccgacctgtgtcgagcaggaccagggatgcgcaaccgacgacccggaggtgtctcgctgcgtcaccgcgggcctggtcaagctggcctccgcgccgatcggcgaccccgaccagggcatggccgaactctggtactcccgcggctgcagagcgggctggatcagggcgcgctggacgcaaccaccgtcccacttcgcagggcgcactgatcgggtcgtcctgacggtgggacgtcaggatgacttcccggtatccgcggcgggccggcccgccgcgttgctgtggggccggatggctgtcgcgcaacgtggcgagtgcatctcaggccacgcctcatatccattacgactcaacggcgggaccatcggcttctccaacatgctttcggtcactgacgcctgcgtccgagcggaggcgcaatccgccgacggccagaagcggggcgaactcaccaccacccgatgcgcggatatgccatga

SEQ ID NO: 7811 - DNA, 630 bp, Actinoplanes utahensis
atgagcaacactgaccccggtacccgcggtctgccccgccggcccgcgccgggctgggtggcaccggtcttcgccctgctgggggcggccaccatcccgtggaccatctatctgtcggtcaccctgccgcagcggatggacaccggctactaccggaccgcctgggtcggcttcgacgtgatgctcgtgctcggcctgctcaccaccgcgtacacggcgtggcgcggccagcagcgggtcggcctggtcgcgatggccacggcgaccttgctggtggtcgacgcgtggttcgacctgaccctgtccagccgcgccgaaatgctgtccgcggtgctgtcggcggccctggtggagttgccgctcgccgtggtgtgcggctggatcgcgctgcacgtcgaccggctcgtggcccgccgcctgcaccggctggcccgccgcgcggcccggctgcaggccgagaccgtagcgctgaaactcgacgaaccgggccggcgcggcatgtcccgcctgcagtatctgctgcgggagcaggcccacctgcggcgcgaccgcgggcaggccgcggccgtcaaggacttcccgccggacagccgatcgtcgcggggtcggggtgcagatccgcgaccctga

SEQ ID NO: 7812 - DNA, 1737 bp, Actinoplanes utahensis
atgtccgcaagcccctggaaatcccggccgcccctgtcccgtgccgccgtcgcccgactggtccaggtcgccggcgggttcaacgtcgcggcggccctgctgccggccggccacgggcggatcatggccctcgccgaattcgtgccggtcgccggaatactgtcggcgcgcgccgccaccgcggccgccggcgccctgctcatctatctgggcgccgggctgcggcggggcaaacgccgcgcctggcagctcgccgtggtcgtggcgtgcgccgggatcgcgctgcacatcctcaaggggctcgacttcgacgctgccgcggtgtcggctgccctgctggtgctgctgatcgccgtacgcggcaatttcaagaccgtgcccgggccgcgcagccggtggcgcgcgctgaccgcgctcgccggattcgccggcgccggtttcgtgctcggcctgatcgagatcgcgatccgcgccgaccacctggtcggcacgcccggcgtgcaggcgtgggcccagcagtccgcactcgggctgatcggggtgtccgggccggtgcacttcgtgcggccctgggcggccgagacggtgtgcctgaccaccggcacgttcgggctgctcgcggtgctcgccgcggtcgtgctgttcctgcagcccggcgagcggcgaccggtccgcaccggcgacgacgacgcccggctgcgggacctgctggcccggtacggcggcaacgactcgctgggatacttcgcgctgcgcgccgacaaggcgctgatctgggcgccgtccgggaaagcaagcgtcgcctaccgggtggtccgcggcgtcagcctggcctccggcgacccgatcggggtggccgccgcctggccggaagcgatcagcgcctggctggccgactgcgaggtgcacggctggacgccggcggtcctcgggtgcgggcgggccggcggcacggcgtaccgcaaagccggtctggacgtgatcgaactgggcgatgaggcgatcgtcgaggtcgacgcgttctcgctggacggacgcccgatgcgggcggtgcgccaggcggtcaaccggatgagccgcgccgggtacacgtgcaccgcggtccgccagcgggacctggcgcccgacgacctcgacgcggtgatccgggccgccgaatggttccgcgacggcaacgtggaacgcggcttctcgatggcgctgtcccggctcggcgacccggccgacggcgactgcctgctcgtgctggcccgcgacggggacggccggctgcgcggcgtgctgcagttcgtgccctggggcgccgacgggctgtccctcgacctgatgcgcggcgaccggaccgcgccgaacggactcaccgaactgatggtggtcaccgccatcgaagccggccccggcctcggcgtccgccgggtgtcgctgaacttcgccgtgctgcgcagcgtcttcgcccgcgccgaacagctcggcgccggcccggtcctgcggatgtggcaccggctgctgcgcgcggtgtcccgggtctggcagatcgaatcgctgtaccgggccaacgccaagtacctgcccacctggcagccccgctacctgtgcttcccggtcgcccgggacctgccccggatcgcggtggccgcgctgaccgccgaggcgttcctgccgacgttcgagaccactgtcgccacgcccgctccccgcgagcgcatcaccgtcggtggtggcatgctcgaccgatga

SEQ ID NO: 7813 - DNA, 990 bp, Actinoplanes utahensis
atgtccctgaccggtgtgccactgctctgcctggtggccttcggtgcggtcgcggcgatggccggcagcgtcgtggtctggcggcgcggctggcggccgcgggtgccgctgcgcgccctcagcgtgctgctcaccgaaaccctggcgctgttgacggtaggtctggcggtcaaccgttcggaggaattctatccgtcctgggcagctcttttccccgctgccgagcaggagccggccacggtcgcggcccggcccggcgacctggacgcgtggttgcgcgcgcagggctcggccgattccgggcaggagatcagcgtcccgtggaagccgcgcggctggaccggctggcatctgtccgccgccccgaccgtggtcgtcccggccggctacctgcaacatccgacgaaccactattcggcggtcgtggtgaccggcacggggtggaccgtcacgcccggcgtcgcggagcagaccgtcgtggtgttcgtgccgaccaccgcggcgaccgggcccggtgtgctgaccgcgtcgctgcccgcgctgttgagccacgacctgcgggtgaccgcgcgccggtgggcgctggtcgccccggccgccggcgccgccctcgtcgagcaggcggccggcaccgccccggaccgctacccggcgatcgcgctggtgcgggcgaaggtcgcgccggtgctcaaggcgttcacccggctgctggtcgccgggcacggcgtggccgcgcccgtgcatccgtccaccccgccggtgccgcccggcatccggctgaccacggtcgacggtttcccggccgggatcgcctgggcgatccggcagaccccgccgccgctggacaccgccatcccggcgcccacctgggtgccgagccagccgccggtcccgcgccggtccccgggggcggcgccgaagccgaaaaccccggccggaccgccgcaggtctcgcccggcccgacgacaggagtgaacagtggctcctga

SEQ ID NO: 7814 - DNA, 1104 bp, Actinoplanes utahensis
gtggctcctgacagcctcggcgctgaactcgtcgccctcgccgccgcggtgctcaccgccgtactgctgagcccgctctggaatgtggccggcggtcgctggcggttaccggtccggggtgccgcgctgaccgcctgcctgctgaccgcgaccgcggccggcctgatctgggtcaatcacgaggtcgacgtgtacccgacctggggcagcctggtcagttcggacccggcggaggcggccgcggccaccgggccgcatcccgcttccacgaagacgggcgccaccaccggccagatgctcaccaccacggtcgccggcaaggccagcggcctcaccatgccggtgtacgtctatctgccgcccgggtacggtcagcagcccgatgtccactatccggtgatcgaggcgctgcacggctatccgggttcgccggtgcagtgggtgcaccggatgaacgtgggcaagatcctggaccgggagatcacggccgggcggatgtcgcccacggtcgtgctgttcccgtaccagacgccgtcgccgaccatcgacaccgaatgcgccaacctggacggcggaccgcaggccgagacgttcctgacggtcgacctgccggccgaggtccgcgccgactaccacgtgcgcgccgaccccgccgggtggggcctgatcggctattcggccggcggctactgcgcgaccaacctgctgctgcgccacccggaccggtacgccgccggggccagcctgtccggtgacgccacccccggcatccacatcggcaagggcgccgagaacaccgtgtacaacgacctgtggcggctcacgcacctgcccatcccggccgtcgccctgtacctggcctgcgccaccaccgacaggatcccggtccgcgacatgcacgacctggcccgcgccgcccacgccccgctgtcggtcaccaccgcctacgtcggcgggggtggcggccacaacgtcggcacctgggaggccatggaagctccggcgttcgactggttgtcgacctcactgggccgtccggtcgtacccccgccgtcgggcgaaccgcaaccctccccggtcggcagcccggcgggcggacggtga

SEQ ID NO: 7815 - DNA, 1581 bp, Actinoplanes utahensis
atgggtagactcccggggcgcgaaagcggagggggagagatccggatgagcatgccgctgcgcccgggagatccggtccggctcggtcggtacgagctggtcgggcggctcggtgagggcggcatgggcacggtctacctgggccgcgacagcgacggtgggcgtcctgtcgcgatcaagatggtgcggtcggagttcgcgcacgacacggagttccgcggacgcttccgcagtgaggtgaaccgggcccggcaggtgccgtcgttctcgaccgccgaggtgctggacgccgatcccgatcatgagccgccgtacctggtggtggagtacgtcgacgggccgagcctggcggtcgaggtgcgcgagcgggggccgctgtccggggccgcgctgcagggtgtcgccgtcgggatcgccacggcgctgaccgcgatccacggggccgaggtgatccaccgggatctgaagccgggcaacgtgctgttggcccgcggcggcatcaaggtgatcgacttcgggatcgcgcgggcgttcgaggccaccagccggcacacccgcaccgatcagatgctcggcacggtgtcgtacatggcgccggaacgcttcgatccggccgatgcacggccggtcaccccggccgccgacatcttcgcctggggcaccgtggtggcgttcgcggcgaccggccggagcccgttcgccgccgattcggccgccgggacggcgatgcgcatcctcaccagcgagccggatctgaccggggtgccggagtcgctgcgcgccgcggtggaatggacgctggcgaaggacccgcaggctcggccgaccgcccgggaactgctggatctgctgctgggcggcgaggcgccccgtccggtgccggagatcgcgccggtcccggtcaaggcccggcgcgggcgtacggtcgccggggtcgccaccgtgctcgccgtgctcgccgcggccggcgccgggctgacgatccgcaaccggctgcaggacggctcggcgggcaccggcgcctcgtccgccggcagttccagctcccccgccaccgccgccgcgtcgaaccgcccggcgccgaaaccgtcggcccggtcgctgtcaccgctggagaaactgcaggccatccggaacggcagacacaagacgctgatccactccgtccagctcgaccgggatctggcgatggagtcgcacgacaccgagatccaggccggcgacggcaccgggcacaagtcggagttcgcgctgatcccggccggcgtcgacgtcctgatccagtcactggccgcgtcgacgcccgggcgtccggtgtgtctcggggtccggatcaccgcggagtcggcgaagctgaccccgtccgagtgcttcaccgggccgggcacccagttcgagctgatccccgccgagaagaaggaggaccagggccggccggcgtactacatctacaacgactccagcggttacctgctgtgggacggcaaggccttctacgtgcaggaggtcggcgacggcgacccgatctacacgttcagcttcgtcgaccgcggcccgctgcccagcccgtcggccacctga

SEQ ID NO: 7816 - DNA, 684 bp, Actinoplanes utahensis
atgaccccgcgaaccgacctcgtcattccggccgacctggtggcgggcctggacatcccgtcgctggccgtcaccgacgccacgcccgacccggtctgggcgccggtgccgatcggccagaacaccttccggcgcgatccgtcccagcgcctgcccctcgatccgcgcaccgccgcgaccacgatgcggcaccgccggctcgcgccgtggggtccgccggccctgttcggtaccctgatcatctactggatctcgctccaccggcacgacctgccgctcgccgtctcgctggccggcctcgcggtgtacctgggcacgatcgtcggatggcagcgggtgaccgcggggctgccggcgcagcggccccgccggctgccctccggtgatctgcgcattccgaaggtcccggccgaggtcgcggcgcagtggaccgtgcgcaaccccggcgtgaccgtcaccgacgagccgatgccccgcccgcactcccgccggttctacgccggctgggcgatcggcctgctgtccgcgacggttctgctcgtcgtggtgctggccgaggacggccgggaagacgacatccggctctggatgctcgtcccgatgttgttcgtcagcggcatcgtcatggcgttccggatgcggccaccggcgcgcggcaaaccggaatacaccctgctcggctga

SEQ ID NO: 7817 - DNA, 474 bp, Actinoplanes utahensis
atgggcatttctccatatctggcccggctgcgggcgatgatcggccacgaactcatccagttgccgtcggtgtcggtcctggtcgtcgacgatcgggaccggatcctgctggtgcgccatgccggggacgccgacggctgggcggttcccggcggcgcggtcgacatcggcgagtcgccggccgccgcggcggtgcgggagatccgcgaggagaccggcatcgtgatcggcccaccgcgactgctcgaggtgctcggcggtgacgacttcgaggtgcgctatcccaacggggaccgggtcgcctacgtcaccgcggtctaccgggccgaggtcgccgccgggacgccggtcccggatcgggaggagatcagcgaggtgggctggttcgccgtgcgggagctcgatggcgtggacctcaaccggttcgcccgggcgctgttgctggccaccggccatctccggcggcggccctga

SEQ ID NO: 7818 - DNA, 2322 bp, Actinoplanes utahensis
gtgtgccggggatcaaccgatggtgcgactgtgggtatggtgccggcgcgcgggcggatctggctgagggccgggttcgcggtgggtgctgtcttcctgctcgcgcagttcgccgcgatcgtaccggccgcccgggactggatgaatcggttcacttggctgtacgagctccggcaggacgcattctacctggtggcggtggcgctggtggcggcccgggcgatgctggtgcgtcgcgatcgcggtgcctggtcgctgatggccgccgggctcggctgctacgccgtgggtacggtctgctgggtggcggtgttcgtctggcaggacccgccgccgttcccgtcgttctccgacgcgatgtggctggcctactatccgttcgcctacgcggccgtcctacggctgctgtgggtgcagcggtcccggatcagcatgtccaccctgctggacgggctgatcgccgcggcctgcgcggcggcgttcgcctcggtgctgttcctaaccgggttcaccggtctcaccgggccggccacctcggtcatggtcagcctcgcctacccgatcgccgacatcgcactctccggcctgctgctcggcgtgtgggcgctcagcggctggcgcaccgaacgggtgtggctgctgctgctcgccggaatgggcacgaacaccgccgcgaacgggctgcacgcgttcgacaccacgcacggctcgttcgtcccgggcagctgggaggacgccctgtgggcggtcgcgctggccggggtggcgctggccgcctggcagtacccggagcgaccggagcgccgggcgccggcccgggcgaccgtgggcgtggtgctgccggcggtgctggcctgtgcctcgatgggactcctgctgtacggcagctggcacgagtacgtgttgccgcacgccagcagcgcgttcgccgccatcgcgatcatggcggcggtggcgcggatggtgctgaccgtgcacgccgtggcatcgctggccgacgcccgccggcaggcccgcaccgacgacctgaccgagttgcccaaccggcggctgttccaggagaccctggaccgcgacctgcaccagcgggacccgcagcggccgatggcggtcgcgatcatcgacctggaccggttcaaggagatcaacgacagcttcgggcaccacctcggcgatcagctgctgctgctggtcgccgcccggctcggcgaggcgttcggcggggacggcatgctcgcccgcctcggcggcgacgagttcggcctgctgctgccggccgccgacatggatcgggcgctgcaggtcgcgaccggactgctcaccgcgctgcgccacccgttcgagctggaacaggtcacgctgcacatcgacgccagcatcgggctcgccgtcttccccgaccacggcaccgaccgcaccaccctgctgcggcacgccgacaccgccatgtacaccgccaagagcgaccacagcggcctggcgatcgccagcggcgcggccgacgacgacaccggccggcgccggctgaccaccctcgaagagctgcgcaccggcctggacaacggcgaactcgtgctgcactaccagccgcagctggacctggtgtccggcgcggtgtccggggtcgaggcgctcgtgcgctgggaccacccgacccgcggcctggtctaccccgacggcttcctggccctcgccgagaacgccgggctgatcggccggctcaccacccaggtcctcgagatggcgctgcagcagtgccgggactggcgggccgccggcctcgacctgaccgtggcggtcaacctgtccgcctccaacctgcacgaccccggcctgcccgggcacgtcgccgcggcgctggcccgatacggcgtaccgccggccgccctgcatctggaagtgaccgaagaggtcctgatgcgcgacgccgcccgtgccaccgagacgctcgaccagctgcgcgcgatgggcatccggctggccgtcgacgactacggcaccggctactccagcctggcctacctgcacgcgctgccggtcgacgacctgaagctcgaccgtgcgttcgtcgggcactgcgacaccgacccgcgcagcgcggcgatcgtgaagagcaccgtcgagctcgcccacaacctcggcatgcgcctggtcgccgagggcgtcgagaacgaggcggtcctcgagcggctgcggcgctgggactgcgacctggtgcagggctaccacctgagccggccgcaggccccggaccggctcaccccgtggctgctggagcggcaggccgtcctgctcgcggtgtcgcagggaggtcgcgggtga

SEQ ID NO: 7819 - DNA, 1245 bp, Actinoplanes utahensis
atgggcacactgtcccggcgcctgctcggtgccgccgcgacggccaccctggccgccagcaccatcatcccctcctccgccgccgccaccgccgccgagccgctgcgggaggtgatgttcgtcggcaacaactgggagggcaccgcggacgtcatcaaacccagcggcgacttcgcccggatcgggcggatcaacgtcgtaccggacaagacgcaacgccttgccgagatctatctgaacccgatcaggctggccttctacctgggcatccagcaggggccgggcgagggccacgaccagttggtcgacgacatgtactcgacgccggacggcaccgcgctggtcgcctcccggcccagcttcgccgacgtcgtctcgatcgacctgaccaccgggaagatcagatggcggttcccggtctccgggttccgcgccgaccacatggccgtctcccccgacggcaccaaggtggcggtgtccgcgtcgaccgccaacaccgtgcacgtgctggacatcaacaccggcgcgcagctcggctcgttcagcaccggcgacaaaccgcacgagaacgtgttcaccaacggcggccgctacctctggaacatgtccatcggcaacgtcgacaccagcctggacgcgccgggctgggactggaccaagggcgaccggcacatcaccgtcgtcgacaccggcacgtggcagatcgtcaagaccatcgacatgcgctcccggctgaacgccttcggtcgcagcgacctgtccaacgcgatccgtccggcggtcttcagcccggacttcgccaagctctacttccaggtctcgttcttcaacggcttcatcgagtacgacgtggccaccgacaagatcacccgggtgaagacactgccgaagaatccggccaccagcgacgaccgcaccacgttcgtcaacgactcgcggcaccacggcctctcgatgagtccggacggcagcaaactgtgcgtggccgggacgatggacgactacgccaccgtggtcgaccgcgccaccctgcatgagggcaccctggtgccggcggccaagccgtactgggcgacggtcagcggcgacggccgggactgcgtcatctcggagagcggggcggacgcggtcaccgcgatcgacttcgccaccggtcagaaggtggtctcggtgccggtcggcgaccacccgcagcgggtccgcctcgcccacatcccggcctcctggaccggcgtcaccggctga

SEQ ID NO: 7820 - DNA, 1968 bp, Actinoplanes utahensis
gtgcaggacagcgcggcggtgctgcccaccgccgggccggatgccgcccggaccgccgacgggcacgaggccgccgcgctctgcccggcgccgacgatcctcgtgacgaatggacgcgcgaccgataacgtcaaggcttccagagacactggtcaatttcctggaggtttgatgagcatccgcagacgggcgacagccgccgccggtgcgctgatcacggtggcggctctcgccgtcggcggcccggcgacggccgccgccgcggcgccgggcggcatcacccacgagcagaatccgcgcgtaccggagggtgccgtgtggaccgaggtgtacttcccgtccgccgaccacagtggcgtcgaactgcacgccgatgtgctgcgcccggcgaacctgccggccggggcgaggaccccggtgatcgtcgccgtcgggccgtacttctcgcacaccggccagaccgggcccgaagggtggacgcagagcgggccgtccagccggttcgccgacttcaccagcggcaccgacctgttcgcccgcggctacagctacgtgatggtcgacctgcgcggcttcggcggcagcaccggctgcctcgactgggtgggcccgggggagcaggccgacgtcaaggcggcgatccgctgggcggccggccagccgtggtcgaccggccgggtcgggatgtacggcaagtcgtacgacgcggtcaccggcctggtcggcaacgatctgcggctgccggccctgaaggcggtggtcgcccaggagccggtctggaacatgtacaactacctgttcagcaacggcgtgccccggcccaacgtgaccggtaccccggcggcgtacaacggcatcgccacgctcgcgccgctgcccgacgacagcgaccactacagggcgaacgccgcgtacgagtccagccacccggaatgcctcagcgacaacctgaagaacaacgacaacccggacccggactcgtcctactggcgggcgcgcaacctggcggcgcgcgcgaagggcaccggcaccccgctgttcgtcactcagggcttcatcgagaacaacaccaagccggaggacatccaggagtacctcggcaaccaccacggcgtggaacgcgggtggctcgggcagtgggaacacgtacgcggcaatcagaccgacgaccagggtcagcttctgcagggccgggccggattcttcgacgaggtcatgcggttctacgaccgctacctcaagggcgtcctcccggccgtgcacgacccggcgttcgcgatcgaggacagcaccggcgtgtggcgtgcccagccggcctggcccatccccacctcggtgacctcggcgaagctgaccgacgggcagtacgtcgacgacggcctgccctccgccctggccgcgaccggtgttcccggcgcccggcagtgggacatggagcacgccgccgaccccgcaccggccaccgcgcgggggctcgcgccgctgccggcggccggtgacacgcacagctacctcacctggtcgacgccggtcaccacccggctgcggatcaccggcaccccgcggatcgccctcaccgccagcgcgcccggcaacgtccaggtgcggctctgggacgtcgctcccggcggatccgcggtgatgttcgacgagaacgtggcactgatcgcgaaggccggccgggtcggcgtcgacctcaaggcgaccgactggaccctggaatccggccaccagctcggcgtgcaggtcggcacgatcggcagcggcacctggctggacaccccgagcggcaacaccatccaggtcagccgggcgcggctcagcctggcgctgcaggacccggcgcgggacgtgcccacccagggcgaccggtcgccgttcctcgacacctacctgcggcagtacacccggacgctgaccggggtcggcgcgggcagcttcccgctcgcgctccgcggccggcactga

SEQ ID NO: 7821 - DNA, 375 bp, Actinoplanes utahensis
atgcgtaacctgatgcgcggaatcgtgctgtccggtctggccgcgacggccgggctcgccatcggcgccggcccggccctggccaccgccggcacgcccgtgacctgccagaagacagccacgcaccactgcacgacacacaccaccggcatgcccggcaagacccacgccaagggccaccacggccacgtgaccggcatgcacggcaagacccaccacggccacgcggcgagcatgcacggcaagacccaccacggtcacgccgcgagcatgcacggcaagacccaccacagcaccgcggtcaagccggccgccccggtgaccaagccggtcgccccgccggccaagccggccggcaacgcgcccaagaagtag

SEQ ID NO: 7822 - DNA, 930 bp, Actinoplanes utahensis
atgcgggttcgcaactatgcctacgccggggtggccgccgcgctcagcgtcgcgctggcggtcaccggtacggcccacgccgatgccacgccggccgccgcggtcgccgtcgcgccgccggtgatcagcgccgacgccacgatggtgcatctgcagaagctgatgagcttcgcgcaggccagcaacaacacccgggtgatcggcagcaccggcttcacgtcgacggtcacctacatcaagcagcagctggacgcgttgggctggcagaccacggtgcagaacttcaccaccggcgggagggccgcggccaacgtggtggccgagtggccgtacggcgacgccacccacgtggtgatggcgggcgcgcactccgactcggtgtcggcgggtcccgggatcaacgacgacggctcgggcgtcgcggcactgctggccaacgcggccgcgatatcgcaggccaagctgaagccgcagaagcggatccggttcggtttctggggcgccgaggagcagggcgacgtcggttccggctactacgtgtcgcacctggccggcggcgaggcgaagaagatcgacgcgtacctcaacttcgacatggtcggcaacaagccggagaacggccgggcggtcggctggagcctgtacgtcgagggtcagtcgaacggactgaacgcgccgttccagacctatttcagcgcgcaggggatcaccgtcaacccgtcgctgaacaccgacgaccgctccgatcacgccgccttcaagcgggccggggtgaaggtcaccggggtgagctcggtgcgcagcctcaatgcgctgggcgcgtgttaccaccggtcctgcgacaacctgaccgatgtgagccagaccagcatggggctggccgccaacgcgatcgcgtccgcggtctggtcgctcgccggcaccgcctga

SEQ ID NO: 7823 - DNA, 552 bp, Actinoplanes utahensis
atgtccgggtggcggtccggcttcatgccggcgcccgagcaactgtgccgtcagcggtcccgcctgctggcgctgcggggacagcgtctgcgggccggcgcggtcacctgggatccggccatggaccggtggcagccggccggtccggtggtcctccggttcgatcggggcgaccggctggaaatcgcctggcagggctgggacgacctgtcgatcacgtggaacaccgtcgacctgacgaccccgcccgtcatcaccggccggccgcacgagtggcgttcctccgtaccgcccgcgctggctgccgtcgagggtcggatcctgaccggctgggcggtgaccgaagacccgtactttcccggcgggaccgacctcaccggcgagctgccgatggatgcggtggcgggctgggtcatgcagggcctgttgatccggttcggtggttccgacctgcatgtccacgccggcgcggacacgactctcgtgtcggcgggctgcacggaatccactactcgggtggcccatcacggccttgtgccggacgccgcgtag

SEQ ID NO: 7824 - DNA, 366 bp, Actinoplanes utahensis
gtgtcggccggaaacgctgatcgacccgacggcacctgctgccccgcgtacttcctcggcggcgggcggttcgcggcagacatcccacggtcgccggaccggttgaccgacgagcctggagtgcacacaggatcggcgcatacggtcgtcggcatgtggttctcggtgacgcgccgggtccggcacgccgccggccatcatccgctggcggccgacacggtcttcgggctgatgctggcgttgccggcgctggccgcggtggtccgccacggtgaccgcccactgctgccggcggccggggccgcggtgctcggcaaggtgcgcccgcaggtccactccggcgcggagctaccgcgatcgcggtag

SEQ ID NO: 7825 - DNA, 807 bp, Actinoplanes utahensis
atggcggactactcttcgcctatgaccgatcccctcgacgtcgggcgcccgcaccccgctcgcgtctacgacttcctgctgggcggcaaggacaacttcgcggccgatcgcgcggccgcggccgagggactcaaagtcaaccccaacgtggccaccgcgcccctgcagaaccgggcgttcgtgcaacgcacggtgcgcttcctggccggcgaagccggcatccggcagttcctcgacatcggcaccggactacccacctcgcccaacgttcacgaggtggcccaggcgatcgaccccaccgcgcggatcgtctacgtcgacaacgaccccctcgtgctcacccacgcccgagccctgctgaccagcgggccgcagggacacacggcgtacgtcgacgccgacttcgccgacacggaccggatcctgtccgcggcgcgtgaccatctcgacctcggcgagccggtcgccctgctgctctacgccgtcctgcacttcttcgacgacgagcaggacccttacacgacggtcgcccagctcatggacgcgctgcccaccggcagccacctggtgatctcccacatgaccggcgaccacgatcccgaagcctgggcccggttcgccgaggtgatgcgccgccagggcgtgcacagccggcaacgttcactcgacgaactggcccgcttcttcgccaagctcgagaccgtcccgcccggcgtggtcccgatcctccgctggcggcctgacgagcagaccacactcaccgacgcccaggtcgccctctacggcggtgtcggccggaaacgctga

SEQ ID NO: 7826 - DNA, 1068 bp, Actinoplanes utahensis
atggcagtgctgcgggtccggggtttcgggcttcctgacggggagccgatcgatctctatgccgacggggaccggtggaccacggatccggtgcggggtgccgagtcggtggccgaggggtgggtgctgcccggactggtcgatgcgcacacccatcccggcgccgaggagcccgggcggccgctcgacgacgacatcctgcggcgggatctgcgggcccacctggacgccggggtcacgctgatccgggcgcccgggctggccggggatccgccggactggttcggggcggcggacgacagcccgcgcgcccagcatgccggaccgtggatcgcccagcagggccagttcatggacggctggggccgccgccccgatcatgccgacctgccggccgtcgcggccgcgcaggccgcccgcaccggctgggccaagctggtgatcgactggaagccggccgacccggtcctgccggtcggcgtgctgcgcgaggcggtggcccgggtgcacgcggtgggtgggcggctcgcggtgcacacccagcaggcggcgggcggggtggtcgcggtcgaggccggggtggattcgatcgagcacggcatgggcctcgacccggacctgctgccgctgatggccgagcggggcatcgcgctcaccccgacgctggccgcgatcaccgggtcgctgacccagattctcgccgaccccgagcgcgcggcccgcagctggtacgtgccgggggccggcgcccacgccgggctcaccgccgcggcggtcgaagccggggtcaccgtgctggccggcaccgacacgcgaccgcacggcgggatcgtccgggagatccgtgcgctggtcgcggccggggtgtcgccgcaccgggcgatcgccgccgcctcctggacggcccgctcgttcctgggtctgcccggtctggtggacggggcgccggcggatgccgtggtgttcgacggggatccgcgggccgatctgggccggctcgacaagccgctcgcggtgatcgtccgcggcaagcgggtccccacgcgaccctgggtgcctgtcccgtag

SEQ ID NO: 7827 - DNA, 1074 bp, Actinoplanes utahensis
atgacaaccaccgattctgtacgcgaccagccgccccggacggcccccgcgaaccgccgtggcggctggtggaaactccccgtcctggccctggccggctgcctcgccgtccacgagctgcaggggcacctgcccggggtggccgccacctggaccgcgctgcgacagaccagggcgggctggctgaccgccgccgtgctgctgcaggtgatctccaccgtcgcgttcgccgaggaggagcggcggctgctgggcgccttcggcgtgccgatcgcggcccgcacctcggtggcggtcaccctggtgcgctcggcgatggcgacctcgctgcccggtgggtccgcggtcgccgcggcctacggtttccggcagttccgggcgcgcggcgccagccgcccgatcgcggccacggtcaccgcgctctgcggcgcggcctcggtcaccgggctggccgtgctctacgccggtgatgcgctggtgcaggccggcgacccccgggtgatcgcgatcatggtggcggcggtgaccgggctggcgctcggcgtgcgcacgctgcgacgccacccgccgccggccggcgagccggccacggctctggcgcgggtgcggcgcggcgtgcacgagacgctggtggcgagcgccgctgtccgcgtaccgcaatggctggcgatcctggccctcgcggtgctgaactggctcgcggacctggtgtgcctgatcgcgtgcctgcacgcgctgaacctgcgggtgccgatcgcggtgctcgggaccgcctatctgggggcgcagctggcccggcagatcccggcgacacccggcggcatcggggtgatcgaggcggcgctgatcctggccgtcaccaccgcgggcggcgcggcggccgcgccggccaccgccgcggtgctgctttaccgcctgctctcctgctggctgcagttgccgctgggcgcggcctgctgggcggtcctgcgcacgccgccgtcaccggcggtcgagccaccgacgcctgccgacctgcacgggggagcgattcttcatgccaccgggactgctcgtcccggtgagcgccggtga

SEQ ID NO: 7828 - DNA, 639 bp, Actinoplanes utahensis
atgaccgcagcgctgggcccttcgtttctcgcgccggaatggctgatctcgacattcggactggtcgggatcctcgccatcgtgttcgccgagtcaggactgctgatcggcttcttcctgcccggtgactcgctgctgttcaccgcgggtctgctgatcgccggcggcacctatctgcaccagccgctgtggctgatgtgcctgctggtgtcggtcgcggcggtcgccggcgaccagttcggctatctgttcgggcggcgtttcgggccggccctgttccgccggcccgattcacggctgttcaagcaggagaatctcggccgggcgcgggacttcttcgccaagtacggcgcccggtcgatcattctggcccggttcgtgccgatcgtccggaccttcaccccgatcgtggccggcgccagccacatgccttaccgcacgttcctgagctacaacgtgatcggcggcaccgcgtggggctgcggtgtcacgattctcggctatttcctcggccagatcgccttcgtgaagtcgaacatcgaattcatcctggtcggcatcgtggccctgtcggtcgtcccgatcggcatcgaactgctgcgcggccggcgccgcgcccgggctcagcgcacccgctga

SEQ ID NO: 7829 - DNA, 2223 bp, Actinoplanes utahensis
atggggagggatcgtgggtatttcgcggcgagggctgctcggggcgacgctggcggcagggatcagcgtgccgttcgggggtgtggcgaacgcggcggtgagttccgggccgccgcggctgcggttgccgcggccgaccgggccgctgccggtggggacgacgcggctgcatctcgtggaccggtcgcggacccatcaggggcggccgcgcgagctgatggccaacatctggtatccggccgagggcagccggcccgggccggtggagacgtggctggacgccgagccgatgcggctgctgctcgcgtcggccgatttcgaccgggacgcggtgctcgcgccgttcacgtcgggacgactgggtgctccggtacggcgtacaccgcagggttttccggtcgtggtgtattcgcatggcgcccacgatcaccgctcggagacgacgatcatcgcgcaggagctggtgagccacggtttcgtggtggcgaccgtcgatcacaccttcgacgcgtacaccgagttcccggatggccgcgtcctggaaccggtggaggatccgctgatgctgccgctggacttcgcccgggacgccgggttcgtcatcgatcagctcgaggtggtcgcgcgcggcgggaatccggatgtggacggccgcccgctgccggacgggctgggccgggcgatcgacgtgcggcggatcggcatgtacgggcactccaagggtggcaccgcgaccgcgctgctgatggccgccgaccggcgggtgcgggccgggctgatcctggacgggccgatggagtccgatccgatgccgtcgaccgatctggatcggccggtgctgctgatgagcgccttcttcaaccgggcggaccatccggcggtggccgcgttctggtcgcatctgcgcgggtggcggctcaccatccgggcggacggggcggcgcatccgtcgtacaccgattatcagaccctgtacgcccaggtggccccgatcgtggggttgagcgacgagatgctgcagggggagatcggcaccctggatccgggccgggcggtgcggatccagcaggcgtatccgctggccttcttcgaccagcatctgcgcgggcggcacagccggctgctggacgggccgagccgggcgttccccgaggtcaggttcctgccttagggccggggcatgccgcgcggcaccacctcactcggctgggggccgcagggtctcggcctcggctacccggccggggccgcgatcctcacctcgctgctgatcaccgtggtgctggcggtgctggccggattcatggcctgggcggcggtccgcaaccgcccgcgagccgtcgccgtctgacggactttaggctggcggtcatgaaagttctgtccatccagtcggtggtcgcgcacggtcacgtcggcaactccgcggccgtgttcccgctgcagcgcatcggtgtcgaggtcgttccgatcccgaccgtcaacttctccaaccacaccgggtacggggcgtggcgcgggccgctgctgccgcccgccgacgtcgccgagatcattctcggggtcgcggagcgcggggtgttcccgcagatcgacgcggtgctgtccgggtatcagggcggcgccgggatcgccgacgtgatcatcgacgcggtgcgccgggtcaaggcggcgaacccgaacgcggtgtacgcgtgtgacccggtgatgggcaacgccaagtccggctgcttcgtcgcgccggagatcccggtgctgctgcgcgaccgggtggtgccggtcgccgacatcatcacgccgaaccagttcgagctgggcttcctgaccggcaccgagccggccgacatcgactcgaccctggcctcggccgacctggcccgggccatgggtccgtcgaccgtgctggtcaccagcgtggagcggccggaccgggagccggggacgatcgagatgctggtcgtcgccgacgccggagcatggctggtgagcacgccgcacctgccgttcaaggcgaacggctccggggacgtgacggccgccctgttcaccgcgcactacgtggccacgggcgaggcggcgacggctctcgaacgtaccgtgtccagcgtcttcgatcttttgaagacgacgttcgagtcgggggagcgcgaactgcagctgatccaggcgcaggagttctatgccgcgccgcgcctgcagttccgcgctcagcgggtgcgctga

SEQ ID NO: 7830 - DNA, 1071 bp, Actinoplanes utahensis
atggagtcgtccgctgtaccggtccgggtgctgctccaccttgaggtcggtgaagaccgccgactcgccggagccccggacgcggacctgcgcctcatagacctggaagccggtccacgaccgccacatccgcaccgtgtccgcgtcgtcgagatgcgccatccagcggatttccatgtcaaagtagccgagcccgtcgcggagcaatccgatggtgtccgcgtccaggatgaggcccggccgatgaccggtcaggtggagagccagcgcgggacgaaccctggccgcactcggcgcggtgaacaacggacggatgtcctcaggcggcatgaccgcattctcacctacgcttgcggcgagcaccaaccgtgccaggattcacctgtgccggctgccgtgctgttcgacctcgacgacacgttgatcgacgagacgaccgcgtcccgcgatgccgtgctcgcttgggccgcggagctggagctcaccgggccgggagccgaccagcggtgggcgcggatctcggcccggcactactcccgctaccagcgacgggagctctccttcgcgcagcagcggcgagaacgggtccgtgacttcctcggcaccgccctcaccgacaccgcagcggatcggctcttcgccacctacctgcggcactacgaagccgcctggaccgttttcgacgacgcggtgcccacgctccgccgagcacgggagtccggcctgcgggtcgccgtgctgaccaacggtgaacatagccagcagcaccacaagctcgaacgcctttccctgctgtccgagatcgacctgctggtggcctcctccaccctgcccgccggcaagccggaccccggcgcattccgccatacggtcaaccacttgggggtcgagcccgtcgacgtcgtgatggtcggcgactccctggagaaggacgtcttcggagcccgagcggcgggcctgtccgcgatcctgctggaccgggacgggacccgggccgggtccggggtcccccgcgtacggtccctcaacgacctcgtcttcacccctgacaggaagatgacgcccacgtga

SEQ ID NO: 7831 - DNA, 1281 bp, Actinoplanes utahensis
gtggccgtacagcggtcgaatgcgatgccggcacggcgactgggcacggggtcgctgatcgagcggatcgtggcggagcgcgccatctatccggtcttccagccgatcgtcgatctcggctcgcacgcggtcgtcggggtcgaggcgttggcgcgtggtccggcgggctctgccctggagactcccgacgcgctgttcgccgccgcgatcgaggccggtttgctgaccgagttggaccagttgtgctacgcccgcgcgctggagacggtccgggacgccgggccaccggtgccgccactggtgttcgtcaatgccgagcccgccggattgagccagccgatgtctccggacctcgccgctgtggtccggagcagcctgccttttcggatcgtgctggagttcaccgaacgcgcgctgacgagccgaccggctgcggtcctgcgcctcgccgacctcgtccattccctcggtaatgccgtcgcgttggacgacgtgggtgccgaccctgcctcgctggcgtttctgccgctcgtcgagccggatgtcgtcaagctcgacatgcatctgatccgcgatccgtattcaccgaaaacccaggcgacggccgccgctgtcgtgggatacgccgaccgcagcggagcgacggtactggctgagggcatcgagacaccggacgacgaggtgaacgccgcggctctgggcgcgcgatgggggcaggggtggttgttcggtcggcccgggccgttggagatgatgctgggccgcgagtacgcgcagtcgccggccgtgtcccgattcgtgccaggcgttgaaccggtgcacggggagacgccgttcgccatagccgctcaccgacagccggtgcgcgtggccgggccggacatggccgacgccctgatcgaccacgtcctggcatccatcggggatcgcggtcggcagagcatcgtgatgtgcgccatcaatgggccgggacagccgtcgcgatggcttccgagactcgtcgccgcggccgatcacttcacctacctgggtctgctcagcggctcagcgttgccctccgtcgctgatgtgcaggtccaacggatcgaagagagtgacccgcttcgcgaagagaccgtgatatcggtactcacggaggacgtttcgatggcgctgtgcctgaaatcgatcggatcagaatcggccggcgatcgcgattccgttcaattcgtctacccgcagagcaggcacatcgtgcatcccatcctgcgtaacatgatgcgccgcttcggcacctggtga

SEQ ID NO: 7832 - DNA, 171 bp, Actinoplanes utahensis
atgctgatccaccccgccatctcactcaccctcgccgacgaccaccgccgcaccctgatcgccgaagccgaccgcgagcgcctggccaccgcggcccgggtccgacgcggccggcgcggctccggcaccccgccgtccccccaggcgacacgcctgatcccggcccgctga

SEQ ID NO: 7833 - DNA, 990 bp, Actinoplanes utahensis
atgatggatccggcacaatgcctggtcatggctgtcgcgtcacttacctacgccgaggctgtggtcatcggactgctgcagggcgtcaccgagctcttcccggtctccagtctcgggcacagcgtgctgatcccggcgctgatcggcgggcggtgggcgcaggacctgagtctcggcgccgaccagtcgccctacctggcgttcctggtggcggtgcacgtggcgacggccgcggcgctggtgtggttcttccgggccgactgggtgcggatcgtgcgcgggctgttcacctcggtgcgcgaccggcggatcgagaacccggatcagcggctggcctggctgctgatcgcggcgaccattccggtggggctggccgggctggtcctggagcacaccgtgcggaccgcgctgggcaagccgctgccggcctcgatcttcctgctcgtcaacgggctgctgctggccggggtggagcggatccggcggcggacgccggagccccgcgtgccactcgccgtcggcagcgacggggtctatgtggggtcgaccgcccagcagcacggcggggtctcggcgcacggcggcgacgtcgagtccgatcaccggctcgccgggctgggctggaagcaggcgatcctgatcggggcggcgcagatcctggcgctgctgccggggatcagccggtccggcgtgacgatcggggccggcctgctgcgcgggctgtcccacgaggacgcggcacgcttcgcgttcctgctggcaacgccggtgatcgcggcggccggggtgctgaagctgccggaactggccgggccggccgggcacgggatcgccgggccggtcctggccggcagcctggtggcgggggtcgcggcgtacgtctcgcttcggttcttgaccaggtatttcgagacccggacgctgaacccgttcgccatctactgcgtggtcgccggcctgggcggcctgatctggttcggcgtgcagtag

SEQ ID NO: 7834 - DNA, 540 bp, Actinoplanes utahensis
ttgttctcacgggcgaccgcgccgtacgcgttcggtctgctggtcggcttctgcgtggtcccgttcgtcctgccgatcttcctcgccctctggatactgggcgccggccagccggagaccgacgaggagatgtcggcggatccccttctggtgtggcgccgggaccgccactatgcccgcgtggtcagtgtggtcgtcggtgcctacgtggcggccctcggtgggctggtcctgtacgaccactacttcaccggctcgagcatgaccgcgcccgccggcgcggcgctgctcggcacgtcgctcgccttcggcggcctggccggtggcgccgcctgcctgatctccggggcgacctggccgacccggctgacgttcctgcagttgcaccggtccgtcggcaccccggtcgcgctgctggccttcctggaggatgcgggttcccgcgggatcctgcgggcggtcggtcggggctacgaattccggcacgccctgctgcgcgactacctcctcgcgcacgaaccccacccgccggggccgtga

SEQ ID NO: 7835 - DNA, 1062 bp, Actinoplanes utahensis
gtggttcgtggaagcccgggactcacagatcttggtgatgagcgcgctgctcgacggcccgctgcacggctatgcgatcaacgtcgcgatcgaggagctgatcggcgaccggctcggtcccggcagcctctacggcgcgctgaccaggctcgaagccaaagggttgatcgagtcgctgcccggccgggggcgccggcagccggtccggctcaccgcgcagggccgcgcggcgatcgagcgggagctgcgcgcgatggcccgggtcgccgactccggcctgcgccggctcggcatccggccggcatgatcggggcccgcggtctggtccgctgctatccgcgcccgatgcgcgaccgctgggggagcggcctggaggacgaggtccgcgccggcggctggcgcaccgtgccgaacctgctggccggcgccgccgccatgtggctgcacccggtgctgtggccggccggttccccgctgcagcgccgcagccgggccacggtcaccgtgttcctgctggccggggtcgcctggctgctcggccacctcctcgccgaggaggactcgctgctgcccaggtcgctggcgcacgcccggccgctgctgctcagcgacctgctgatcagcgcggcgctgctgctggccgcgccgttcccgcggcgcacggccgcggccctgcggcaattgctggcgtacgtcgtgcggcgcctcgccgtgcccaccctcgccggtctggccatcgtctgcgtggccaacacggccggcctcgccgtgcccccggccgtccgccacctggcgctcggcgtctggtgggccaccctgctggccggggtggtgcagacctgccgcctgatcgccgacctgggcgaggccaccaccaccgcgccccgcctcagctacggcctgtggaccctcaccgcggccctggccgccgggtccgccaccgtcctggccgccgccccgcactcggcgcgcccgctcaccacggccgtcctcggggtgacgatgctcctgctgaccgtccccgctctgctcaccctgcgcgacctgtgcgacgtcgcctga

SEQ ID NO: 7836 - DNA, 876 bp, Actinoplanes utahensis
gtgaccgacattcccttccgtgccgagaacgtcacgaaacggttccgccgcaccaccgccgtcgacgcggtgacctgggcgccgcgcgccggccgggtcaccgcgctggtcgggctgaacggggccggcaagtccaccctgctgcggatgctggccgggctgatccggcccacctcgggcacggtgacccggcaccggccgctgtccgcgatgatcgaggcgccggccctgcacgccggcctgagcgcccgccgcaacctggagatgcaccggatcctcaccggggccggccgcgcccggctggccgaggtcgccgagctcgcccaggtcaccgaggtgctcgaccggcgggccggggcgctgtcccaggggtatcggcagcggctggcgatcgccgtggccctgctgggcgcgccggccgcgctgctgctcgacgagccggccaacgcgctcgacccggaggccgtcgtccacctgcgacacctggtgcggacggtggccgcgcagggcaccgcggtcgtcgtctccagccaccagctgcgcgaactcgacggggtcgcggacgcgctcaccctgctgcatcgggggcggatccgctacgacgggccgttcggcgacttcgtcggtccggcccggctgcgggtccgggccagcgaccgcgaccggctgacccgcgcgctgcacgacgacggtctcaccgcgcagcccggtggcgaccacctgtggatcacccccggccggcccgggcccgaccggaccgcttcgcgggtcttcgcggccgccgcgcgggccggcgtcacgctcgtcgagctgagccatgtcgccccgacgctcgaggaggccttccaccagacgattgcggaggtacgtcgatga

SEQ ID NO: 7837 - DNA, 696 bp, Actinoplanes utahensis
atgatcagctcctaccgcgccgaaacgctgcgggcgctcagccggtccagcgccgcgttcctggcgctgtgcacggcactgacctggttctcgatggtgaacgccggcccgcaacaccagaccccgctgtggggcttccgccaggtcgccatcttcacggcgaccctggtgctgggccgcgccgccgtggtcgccgccggcgatttcggctccggcacgatccgcccgtggctgatctcggcacggacccggcccggcacgttcctcggcaaactcgccgcgtcggccaccttcgggctggtcaccgccctggtcaccggcctcgccggggaagccgtgagcggcctgctcggcccggtgccggccccggccgcgatggcactcgcggtggcccagctcgggttcgcgtgcgtggcgctcgccgtcttcgggcacgccgccggcatgctgacccggtcggtgccggtggcgctgaccgtggcgatcggctggatcctgccggccgaggcggtgctgcagggacactcggcgaccgtcgaccggtggctgcccggcaacgtgctgcaggacttcacgctcggcggggtcgcggccggcagcacctgggccggcgcggccgtgcacgcgacgctgccgttcctggccctggacgcgatcgcgctcgcgctgttcctgcggcgggacgtgaacgactga

SEQ ID NO: 7838 - DNA, 900 bp, Actinoplanes utahensis
atgcggcgggcgccgatcgtggccgcgctcggggcggccgccgggagcgagacgctgagcgtgctgtcgacgcagattcgcgacgtacgggcgagcagcccctggcagagcgacccgtacaacacggtgctgtcggtgacggtgttcgccgtgccggtcctggccgtgctgatcgccggacggctggccgcgtggcaggcggcgggcggcggaaggcgcggacgggaacaccatcgggcgccgggcgacgacgaccgcgaacggcagctgcggcgggcggccgccgccctgctcgggctggccggcgccaccgcggtcatcgaatggatcgcggtcgctctccggccacacccctggcgcggctggaccggcccgctgatcggcggcctcaccgtcgcgacgctcgcgctcgcgctcgccaccggtctgctgctgcgccgccgcctgccccggcgcgcgccgggaatctgggcctcggactggctgtcggatctggccggaccgccgatcccgcggccgctgaccggatggatccggcggcacgccaccgcggtgttcgccgggctgagcgtgctggccgcggccggggtggtcgggtcgctggccgtcggcgaggcatggaccgacccgctgctgatcggctgggcattcgtgctggaggcaagcgcgtggttcgccctggccgtactcggcaatcggatctgtgtcttcgtcctgcgcccgccgcaccggacggacgccgcggcgatcggcttcagcctggggatgctggtggcgaccgcgttccacggtccgatcagcacggtcccggcgctggtcgcggtcaccgccggcgcgggactggtgggtgccgtgctggcttcggtccaccggccgcggatcgcccgcgtcccgggatga

SEQ ID NO: 7839 - DNA, 474 bp, Actinoplanes utahensis
atggcgaccggacggcccggggcgccggtgtcgagggtcgggatcacggtcgcggcgggcggctggcacgtaccgcccatcgggatcctgaatcgatattctctcgtcgtgacgaacgacaggcggcggcccggcgccctggaagcggccgtgatggccacgctgtgggcggccgacgcgccgatgaccgccgcccaggtgcagctgctcgtcggcgacgacctggcgtacaacaccgtccagacgatcctgatccggctgcacggcaaagggcggctgcggcgccggcgggccggtcgcggacacgaatactggccggtggaggacgccgcgacagcggcggccgggcggatgcgggccgcgctgccgcccggatcgggacgccacgccgtgctgcggcagttcgccgccaccctcgacccggcggacgccgccctgctgcgcgcgctgctggccgacagtgacggcgactga

SEQ ID NO: 7840 - DNA, 402 bp, Actinoplanes utahensis
atgatcaccctgcctgaggggctgctcgccctcctgcgccgcccgagcccgtgcttcatcgccaccgtcgacccggacgggtcgccccagctcaccgagacatgggtcgacaccgacggtgagcacatcctgatcaatacggtggagggcttccggaaggtacgcaacatcgagcgggacccgcgcgtctcggtcatcgtgacggatccggacgacgtgaccgactactactcggtgaagggacacgtcatcgacgtgaccacgaaaaacggcgccgagcacatcgacgagctggcgcaccggtatctgggccggccgtacccgtggttcggaggccgcgaccaggtgcgcctcatcctgaccatcgccgccgaccggatcgtccacgcgccgcgcggctga

SEQ ID NO: 7841 - DNA, 516 bp, Actinoplanes utahensis
atgaccgaagtcatgggtgccgcgcccgagcccaccggcctttccagcctcgcggcgcgcctcgaccacctgttcgacacgatccgcccgaccgctgccgagctcggggagcatgaccagccgggccggcgatacaccaaccgggagatcgcggacagggtcaacgcagtggcggggacgatgcccggcgcggtcaccatcagcgccgcgtacatcggggagcttcggcgcggtgtggccaccgacccccgaacctcgcacgtgcaggcgctcgcccgggcgttcggtgtcgatccggggtacttcgtggacgacgaggcggccagacgggtccaggagcagatcggcctgctcaacgagcttcgtcggatggacgtccggcaggtggccttgcgccgcgtcctgcaggacagtggcctgtccacggcgagcgcgctcctggtcgaacagatggtggcccgtctgcacgaggtcgagtccgatgccaccgatcggtcacgtcaccaccgcgactga

SEQ ID NO: 7842 - DNA, 555 bp, Actinoplanes utahensis
atgagcagcagtcaggacgatgaccgggaattgcgtcgccgctgtcaagctgtcgtcgacgccctcgagatcccctacccgttcgacatggccctgctctgtcagcgcatcggtggccaccgcggacgcccgatccatctgatcgcgatgccgatgccgcccggcgggccgtccggcgtgtggatctccgcgcgcgactacgacgccatcttctacgaggcggacaccggccgaccccaccaggatcacatcatcggccatgagctcggacatctgctctgcggccacgagcgtggcgtcggggacgacctcgcgcggatgctgctgcccgacctcgatccggcgctcgtgcggcgggtgttgcagcgcaccggctacagcgcgatcgatgagcgtgaggcggagatggtggcgtcgctgctgttgcgagcggcgcaacgcctcggcacgccgccgcccgcggtcgccccggatgccgccccaggcggcgcggccgaggtggtggcccggctgcagcggtcgctgggccgtcccgtcggcgacctcgacggctga

SEQ ID NO: 7843 - DNA, 1164 bp, Actinoplanes utahensis
atgacggctcagagcctcaaagctgtgctgtttcccctgtcggccgccatctgcctgctggcgttgacctacaaggcagtggacgccaggcgacgtccgcgcgacccggcactgatcgccctgctgatcgcgttcaccggcaagggagtctcgttcacgctgtccacgccggcggtgtcggcgacggtggacgcggcaacgggcgtaccgaacctgggcgcgctcggcatccatctctgcggcggcgtgctctccagcgccgccttcctcgccgccctggtccactgggtgtatccgcgagagcgggtggctcgtgcggtccgggcccgggtggtggtggcggcggtcatcgggatcgtcatggtggcgctgtggtggagcgcctcacgcggcgggcggcggtcggcgcacttcctcctggacaatgccggcgagcccgcggtcatcgcctacctgcttctgtacgtgaccgctttcggtaccgcgatgaccgagatcgtccggttgtgccggcggtacggtccaccgtccggctcgagctggcttcgccggggtctcgccctgaccgccctcggcgcctcggcatgcatcgtgtactgcctcaaccgcgcgttcgtcatcgtggcggtgcagctcgggtggcacccgttgaactgggagatactcaccccgatcgccaacacggtgggtatcgccgggatcgccggcggcctgaccatgccgtcctggggccctcggctggccgcggccgtgcgctggtgccggcattaccgcgatcaatggcagctgtatccgctctggcgggacgtgtgtgcggccgtccccgccgtcgccctcctgccgcccacctccccgctgcgcgaccggctgcatccggtcgacgtcgagttccggctctatcgacgcgtggtggagatccgcgacggtctcctcgccctgcgcgcggatcccggcctggggaccggcgaccgggaagctctccggatcctggacacgtccctgaacgacagcgagaactacgctgacgagctggcgtggttgcggcgccgggccgcggagtaccggcggcgcacgggcccgtcaccggaccgcgccgacaccgactgtcgcaccgaccccccggcgaccgccggcggtgcaccgaagaccaccacctggaggtaa

SEQ ID NO: 7844 - DNA, 990 bp, Actinoplanes utahensis
atgaagtaccgaaccgtgggtgccgcaggccccaccgtgtccgccatcgggctcgggtgcatgggcatgtcgatctcctacggcccgccggacgaggcggagtcgatccggaccctggaccgcgccgccgagctcggcgtcaccctgtacgacaccgccgacgtctacggcctcggggtgaacgaggaactgctcggccggtggctggcccggcggcggcccgaggtgctggtgtcgaccaagttcggcctgcgccgcggggcagacggacgcgtttccgaggtggacaccagccccgcgtacgtgcccgtggcgtgcgacgcgtcgctgcgacggttgggcaggcagcacatcgatctgtactacgcgcaccgtcgcagtcccgaggttcccatcgaggacacggtcggggccatggccggcctggtggccgccggcaaggttcgctacctggggctgtccgaggtgaacccgaccacgctgcgccgcgcccacgccgtacacccgatcgccgccgtccagctggaatactcgctgttcacccgggacgtggtggccggcgagatggccgccacctgccgtgaactcggtatcgccgtggtggcctactgcccgctgggccggggcatgctgaccggacggatcacctcgcgcgatcagctttcggaagccgacgcccgactccggtggccgcgcttcgacgccgacaacctggtccgcaacctcacgctggtgaccgcggtggctgaggtcgcgcaggagatcggctgcacgcccgcccaggcggcactggcatggctgctcggtcagggcgagaacgtcatcccgatcccgggcaccaagcgggtccgctacctcgaggagaacgttgcggcggtgacggtcgacctcacgcccacccagctcgatcgtctccgctctgcggtcccggccgacgcggtggccggcaccagatatcccgcacaagccctggcccggctcggccactga

SEQ ID NO: 7845 - DNA, 1410 bp, Actinoplanes utahensis
atgctgtcctcgctacggcgccggcgggggccgtcctcgctgcggcgccggttgatgccgtcctggctgcggcggcggctcggcgtgcggatgcgctccgcgctggccgccgggatcgtcgtcgcgttcgcctcggtgctggccggcggcatcctgctggtcgtcgcccgcggcatcctgctcgacaatgtcgactcggcggcctccgaccggaccgccgaggtcaccgcggccctgaccccgcgggacgcggccgccctgcaggtgacgctgcactcgtcccgcgccggccgaggcctggtccaggtgctcaccgccggcggcacggtcgtcgacgcctccgccgccatcgccgaactgccgcccatgtccgagctgcgcccaccggccgggcagcacgcgcgggaaaccacctacctgccgatcggcgaaggcgaaccctggctgatcgaggccaccggcgtcgccaccgccgacgggcagcacaccgtactggtcgccgagtcgttggacgtcgtctcggacagcaccgccgcgatcgtcaccgcgctgctgctcggcctgcccatgctggccgtcgtggtcggcgtcgccaccttccacttcgtcggccgcaccctgcaaccggtcgaagcgatgcgccggcaggccgccacgatcaccgccaccaatctgcatgcccggctgccgctgcccgccgccgacgacgagatcgcggcactggccaccacgatgaacaccatgctggaccggatcgaggcgtccgcggccgcgcagcgccgattcgtcgccgacgccagccacgaactgcgcagcccgctcaccaccatccgcgccaacgccgacctgctggccgccgacgcctccaccgcgccccacgtgcagcggatccgggccgagagcgcccgcatgtcccgcctggtcgacgacctgctgctgctggcccgggtcgacgaccagcgctctccacgccgccaggacgtcgacctggacgacctgatcttcgccgaacgcgaccgggtcgccgtcgaacacccccacctgcgcatcgagggcgccgtcagcccggtccgggtcaccggcgaccccgatcagctcacccgggtcgtccgcaacctggtcgacaacaccgtccggcacgcccgcgaacgcgtcaccatcagcctcaccgcgaccggcggccagggcgagatcgtggtcggcaacgacggccccccgatcccgcccgccgaccgcgagcgcatcttccaccgcttcgtccgcctggacgacagccgctcccgcggcggcggcggctccggcctcggcctggccatcgcccgcgacatcatcaccacacaccagggcaccctgaccgtcgacgacctcccggaaggcgccgccatgcgcatccgcctccccaccgcgtag

SEQ ID NO: 7846 - DNA, 684 bp, Actinoplanes utahensis
atgcgggttctggtggtggaggacgaggtcacgatggcggagacgatccgcgacgggatcacccgggagggtttcacggtcgacctggtgcacgacgggaccgagggcttgtggacggccaccgagcagccgtacggggcgtacgacgtgatcgtcctggacatcatgctgcccgggctcagcggctacgaggtgtgccgccggctgcgggcggccggggtgtggacgccgatcctgatgctgaccgccaaggacggagagtacgaccacgccgacgcgctcgacctcggggccgacgactacctggtcaaaccgttctccttcgtggtgctgatcgcgcatctgcgggcgctggtccggcgcggcgccccggaacgcccggccgtgctgcgcgccggtgatctgaccctggatccggcggagcggcgggtgctgcgcggcgacaccccgatcccggtcaccccgcgggagttcgcgctgctggagttcctgatgcggcaccgcggtcaggcgatgaccaagaccgcgatcatcgagaacgtgtgggacgcccacttcgacggcgacccgaacatcgtcgaggtgtacatcggatatctgcggaagaagatcgaccacccgttcggccgggccgccatcgagacggtccggggcgccgggtatcggctcgccgacgagggttga

SEQ ID NO: 7847 - DNA, 420 bp, Actinoplanes utahensis
atgtggcgtcctcccgccgccgacgaggagatcgcccgctgggcggtgaaccacccgccgcagctgcgtgacctgcgcggcgacctgcgccggctggtcacggcgggccggctcccgacggtcgcggacgccgacgacctcgccgaccggctggtcatcgtcgccaccgaactggccggcaacgcgctgcggcacggccgcccgccgaccgccgtggtgctgttccgttccgacgggcgcctgatcatcgaggtgtccgaccatgatgcggacgccgtgccggcggtcgacccgcagcggcccccggcggccggcgggatgggcctgcggatggtggagcggctcgccgagcgggtcggctggtatccgtcagcgcccggcaaacacgtctgggccgcggtccggctcagcggcgcctga

SEQ ID NO: 7848 - DNA, 3930 bp, Actinoplanes utahensis
atgagcagccaggtgtcgccggtcttgcggccggccaccagcagcagggccagcccgacacctttgagccgcaggacgcggtcccggccggtgtgccgcgtcagggcgatgaccgcgtgggccgcgatcacccacagcgcgccgttgccgaaggcgggtttcgcgccggcgatccagcggaccagcaggaagacggcgtcgatgccgacggccgcggcgaccgagacgagtctctcccggcgggtgagcacgaccagggtcagggccagactggcgtacagcaggaagcccgacttgggggcgaacaggaactctttcacctggttggtgaccggccccggcaggccgcaacggcgggcggcgatttccagcgcggccagaaaccccaggcccacgatgcccgtgacggcccacagcaccacgcggggccggcgccacgcggggaacgcttcccgatcacctgtccgggaaatgtcccgcactgccatagttttcacggtttaccggctgccattttcccgttgttgggtaccttgtcgtcgagatttccccgggagccgcctgcggtcccgggccatcgccacgaggtcggtcatcctagcggagtccggcacgggcgacgggcccactgagcggcgaccggcccgactgactaacgtcaacgccgtggtgagcgtcgagggcctgagcgcccggcaggaaaagttcgcgatctggcccggccggatcgtcaccctggccggcatctgggtgctgctcagcttcccgctgcggatgttctcctggacctggaccgtcgactacgcgttcagcctgctcaacgtcccggccgagccgaacctgttcatcgccgccgcgctgctgctgctgggcagcgcgctgcgccgccggctgcgggccgcgttcatcctgctgctgatctaccagatctgcgccaccgtgctggacacgatcaccgcgctggtcggcctcgcctactgggatcagcccgagcaggccgacctggacctgtcccgcaccgagatcgtgctgaccgccgtggccgtgccgatcggcctggtggtgacggtgctggtctggcgggcccggcgcgccttcccggcccggctggcgcacgcctcccggcgcaccgcgctgatcctgctggtcgccggcctcgccgccgcctggagtctggccttcagcctgacctggttgttccccgactcgctgcacggcatgggcgagcgggtgatctgggccaaccgctcggcgctcggcctcagcgccgccggcgacaacgccggcctgcacgggcatcacgggcaccactgggtgtcggtggccgcgtcgacggtgtccgcgctggtgctgctcggcacggtcgccgtcttcctgcgctcggcccgctcccagcagtatctgaccgcggaagccgagctccagctgcgccggctgatcctggagagcggggatcgggactcgctgggctacttcgccacccgccgggacaaatcagtgatcttctccccggacgggcgggccgcggtcacctaccgggtggtcgccgcggtcagcctggccagcgccgacccgatcgggcacgtcggctcgtggccggccgcgatcggggcgtggcgggccgaggcgcaccggcacggctggttcacggcggcgctctcggcgagcgaggcgggggccaacgcgtacgtcgagtcgggtttgaaggcgttgagcatcggcgacgaggcgatcctcgaggtgagcggcttcgacctgcagagccgggcgatgcgcccggtgcggcgggcggtcacccgggtgcgcgccgccggctacaccgggcaggtccgccgccaggcggcgatcggcgccgacgagctcgccgagctggaccggctggccgcggcgtggcgcggcgacggctccgagcgcggcttctcgatggcgctcggccggttcggcgacccggcggacggccgctgcgtggtggtcaccgcccacgacccacagggccgggtccgcggggtgctcacgttcgcgccgtggggggtgcgcggcctgtcgctcgacctgatgcgcgccgaccggcaggccgagaacgggctcaccgagttcatggtggcggtcctcgtcgaagcgtgcccggacctgggcgtacgccggatctcgctgaacttcgccatgttccgctcggtgttcagctcggccgacatggtcggcgccggtccggtcacccggctgtcggacgcggtgctgtcggtcgcttcccggttctggcagctggagtcgctgtaccgggccaacgccaaatacctgccgaactggctgccccggttcctctgcttcgactcgtcgctcaccctgagccgggcggtgctcgccgccggcattgccgaggggttcctgccctcgctctcccccgccgccacggccctggacgccgacccggccttcctgcagcagatccgcgaccaggaggaccagttgctgcgcccggccgtcccgctgcgccggctcagccagcagcagcgcgcccgcctggacaagcgggcccgcctggccgaggcgtacccggtcacggtcccgcgcaccgtgacgctcgccgaggcccgcacgctgccggccggcaccggggtgtcggtgaccggccgggtccgcgccctgcgtgacctcggcggcgtgctcttcgccgtgctgcaggagggtgacgccacgctgcaggcgatgctcaccgccgaccgcaccccggaccaggagcgcctgcggtggcggcggaccgtcgacctcggcgaccacgtcagcgtcaccggcgcgatcggcagctcccgcagcggcgaactctccgtcctggccgacacgtgggtgatggccgcgaaatgcctgcgcccgctgcccgacgtgcacgccggcttcaccgacccggaggcccggctcggccagcgatacctcgacctgctggtcaacccggacgcgatgcaggtgctgcggcaccgcagcgccgcggtccgggcgttgcgccaggctttcgccgtacgcggtttcaccgaggtggagacgccgatgctgcaggccgtgcacggcggcgcgtcggcccgtccgttccggacccacatcaacgcgtacgacatggaactctatctgcggatcgcccccgagctgtacctcaaacgcctgtgcgtggccggcatggagaaggtcttcgagctcaaccgcaacttccgcaacgagggcgcggacgccacgcacaacccggagttcacgtcgttggaggcctatcaggcgtatgcggactaccacacgatgcggcacctgacccgcgagctgatcctcgaagtcgccaccgccgtgcacggccggccggtggccctgcgcccggagggcccggtcgacctgggtgagccgtggccggtgctgaccgtccacgaggcggtcagcaaggcggccggcgccagcctgaccgccgacacgccggtcgacgaggtacgccaggtgtgcgcccggcacggcgtccacgcgaaagccgacgcgacggcgggtgagctggtcgtcgagctctacgatgcgctcgtcgagaagcagacgacgtacccgaccttctacaccgacttcccgctggagacctcaccgctgacccgcacccaccgcggggatccgcggctggccgaacgctgggatctggtggccttcggcatggagctgggcacggcgtactccgagctggtcgacccgatcgaccagcgggaccggctcaccgcccagtccctgaaggcggcggccggcgacccggaggcgatgcagatcgacgagtcgttcctgaccgccctggagtacgcgatgcccccgaccggcggcctcgggctgggcgtcgaccggctggtcatgctcctcaccggcaccgccatccgggccaccctcgccttcccgttccatcgccaggcccggccgtga

SEQ ID NO: 7849 - DNA, 1200 bp, Actinoplanes utahensis
atgagcggcgccagagtgctggtgacgggggcgagcatcgcggggccggccctggcccactggctgcaccggcggggagccgaggtgaccgtcgtggagcgggcccccgggctgcggcccggcgggcaggcggtggacgcgcgcggggtggcccgggacgtcatcgcgcggatggggctggccgcggcggtgcgcgcggcgtgcaccgacaccgccggcgcgcacaccgtggacgcggacgggcaggtgctggcgaccttccgcgccgacgacgacggcggcgacgggttcatcgcggacatcgagatcctgcgcggagacctgtcccgggtgctctacgacgacacccgcgacggcgtcgactacgtcttcggtgaccggatcgccgagctcacccaggacgccgacggcgtcgacgtggtcttcgcgggcggtgaccggcggcgtttcgacctggtcgtcggcgccgacgggctgcactcgtcgctgcgcgcgacggttttcgggccgcaccagcggttcctgcgccacctcgggcacgtgctggccttctacagtgtgcccaacgagttcggcctggaccgctggctgctggagtatcaggaccgggagtccgggcgctcggccctgctgcgccccatccaggacgccacccgggcgatggcgctgttctccttcccggccgccgacttcgcggtcgaccaccgggacgtcgccgcccagaagagcctgctgcgcgagcggatgaccggcctgggctggcacaccccggcaatgctcgcgcatctggacgacactccggacttctacctcgaccaggtcgcccaggtggtgatggacagctggtcccacggccgggtcgggctgctcggcgacgcggcgttcagctcctcgccgatgtccgggcagggcaccgggctggccctggtcggcgcctacgtgctggccggtgagctggccgcggccggctgggacccggccaccgggttcgcccgctacgagacccggatgcggccgttcgtcgaggccaaccaggagatcggccggctgaatgcgcgcagccgcgaccttcccggcccggacaccaccgcactcccggacttcaccggcgactggttcgccgacctggccgcccgcgccatcaacggcatcgacctgcccgactacgcggagacgccggacgtcgcgcggcgctcctga

SEQ ID NO: 7850 - DNA, 324 bp, Actinoplanes utahensis
atgcagccatctgaacagtacgcaaccgtgccgcccaccgagaccgcgccgatcgcccgggccgccaccggcatgctggtggtcgacgccgccggggacgaggtcggcaaggtgagcgcggtgcagccgccgggcacgccggtccggccggacacggtggccggggtcgccgaggcgctgatgggctccgggtatctgcggatcgacgggaccggggcactgtccaacgacacgtacgcgggcggcgaccagatcgtcgccctcgaggacggggtggtgcggctgcgggtggggcgcgacgggctgcaccgggccgcgagctga

SEQ ID NO: 7851 - DNA, 1077 bp, Actinoplanes utahensis
atgacgggacgcgtactcagcaaatcggaccttgtggtgctgggcgccggcgtggtcgccgtcgccgccgccggggttctgcactacagcggtgccacggcggtactggcgttcgtggtcgccggcgtcgccgtggcgctgctcgcctcgctggtcgggcgcagtgtggagcagctcggcgaccggttcgggccgggcgcgaccggggtgctgcaaagcgcgctgggcaacctgccggagctgttcatcggcttcttcgccctgcaggccgggctgctcgcggtggtccaggcggcgatcatcgggtcgatcctgtcgaacatcctgctggtgctcggcctggcgttcgtggtcggcggggtcaagcacgggacgcagcggttcgactcggaccgggcccgcacctcgaccgtgctgatggtgctggccaccgccgccctggtgatgcccagcctggcgcagtacgtgcacgcgccggccgccgggcacgagaaggcactgtcgctggtcgtctcggtcgtgctgctgggcgtgttcctgctctcgctgccgtcggcgctcaagcgcagcccggtggccgagccgtccgcgccgcaaccggccgagcacgcgggcccgcactggccgctgtggctggcgctgaccatgctcaccgggtcgagcgtcgccgccgcgctggtctccgactggttcgtcgccgcgctggaaccggcgatcacctcgctgggtgtctcgcaggcgttcgccggcctggtcatcgtggcgatcgccggcaacgcgatcgagaacgtgatcggcatccagctggcctaccgcaaccaggccgacttcgcgatggccgtgatcatccagagcccgctgcaggtggcgttggtgctggccccggcactggtgctgctgagcctgttcaccgcgacgacgctgaccctggtcttcgccccgctgctggtgatggcggtcgcggtggccgtgctcgcgaccgccttcatcgtcttcgacggggagtcgaactggctggaaggcgccaccctgatcgccctctacgcgatcatcgcgaccaccttctggtggggctag

SEQ ID NO: 7852 - DNA, 501 bp, Actinoplanes utahensis
atgaccgagacacactctgccgccgacgggcagtacacgacgaacggcactccgcacggcgcgaccggcctgaccccgttcctggtcatcccggacgcccgcggcgcgatcgacttctacgtcaagatcttcggagcgcgggtggtcgacgtgaccgagttcggcgggacggtggcgcacgccgtgctcgacttcggtgacggcctgctgcaactcggcgagccgtcaccggactacggcctgatcccgccgcccgagggggaccgggactgttactcgatcgggcggtactgcccggacgtggacgccgtggtcgcccgggccgaggcggccggggcgaccatccgggaggcgccggccacgttcgtctccggcgaccggttcgccagcattcgcgacccgtacggcgtccgctggtcgatcatgacgagggtcgaggacctgtccgagcaggagagcgcccgccgggtcgccgagtgggcggccaagcagggctcctag

SEQ ID NO: 7853 - DNA, 813 bp, Actinoplanes utahensis
atgaccggcggcgacccgcttgaagattcgcgacaggatccgcacccgcggggtgtcctctacccggcgcggctgccgaccttcacccggctgcccgcgcccggaccggtggcgcacctggtgcgctggttctggatcccggagtggcggatccagccgggacgctcgtcccgccagcagctgatcgccttcccggcctgcaacctggtggtcgagaaggaccgggtcggcctgtccgggccgaccacgcgcgcctcacaccgggatctgatcggcaccggctgggcggtcggggcactgctgcggccggccgcggtgccgcacctggtcgccgacccggcggcgctgcgggacacgtaccggatgatcgatcttcccgatctgcacgagggggtgtcccgcgcgatggccggcgacgggccggagcggcaccgggacgcggtcgacgccttcaccgcctggctggccgcccgcatcccaccgccggacgcggaggcgctgctggccaacacgatggccggcctcatcgacgccgacccggcgatccgcacggtccaggacgcgacggcccggctgaacatctcggcccgctcactgcagcgactcgcggcccggtacgtcgggctgcccccgctcgcgatgatccgccggcgacggctgcaggaggcggccgagcggctgcgggccgagccgggcacgaacctggcggcggtcgccgccgacctgggctacagcgaccacgcacatctggccaacgagttccggtcggtgctcggcctgaccctcagcgactaccgccaggacttctcgtga

SEQ ID NO: 7854 - DNA, 1446 bp, Actinoplanes utahensis
atggtgttgcggttcggccgtcaggcatggtcggtatatctcgcgttctgcgtagtggtgatggcggcgtgcttcctggtgccgtgggagtcggtcaaaacggtcctgaccgggctactgggtgtctcggcggtggtcgccaccgcggtcggcgtggcacgtcaccggccggcgacgcgctggccgtggtacgtgatggcggccggttggctcttcttcgccgccggtgacgtcatctactgggtgcagagttcggtcctgggccgcgacgtcttcccgtccgtcgcggatgtcttctacctgggctcctacccgatgctcacggtgggcctgctcggtctcgtccgggcccgccgaccgggtcgggaccggcccggcctgctggatgcgctggtgctgtcgaccggtgcggccatgctgtcgtgggtgttcctgatggaaccctacgttcacgccaccgatctcgacgtcctgggccgggtcgtctcgctcgcctatccgtccgctgatctgctgcttctggccgtgttgctgcggctgaccaccggccgcggggaccggcagccggcgttccggctcttcgtggcggccggcgccgccatgctcgtcggcgacgtcgtctacgggctgatggagctcaccatcggctaccacgccggggacccgatcgacggggcgtggatgctgatgtacgccttcgccggcgcggccgccctgcacccgacgatggccgacatgtcacggctgtcgccgcccacggcggagggcaccatcggggtgggacggctgatcgcgctggccctggccagcctcatggcgccggcggcactgatcatcgagtggttccgcggcggcgagatcgacatcccggtcatcgtgtccggctgtgtggtcctgttcctgctggtcatcgcgcgtctgcacggcctggtggtcctgctggccgaaagcctgcgatcgaccgaggtgcaggccaccaccgaccagctgaccggcctggccaaccgccggcgtttccacacctgctggcagcagtcgctgaccggcgaggtcggccccaccgcgctgctctacatcgacctcgacgggttcaaaccggtcaacgacaagctgggccacgacgccggcgacagcatcctgctcggggtcgccgaccgcctccgcggcgtggtccgcgccgccgacgtggtcgcccgcctcggcggcgacgagttcgcgatcatcctgccctggaccgacgacgccaccgccgggaccatcgcgcagcgcatcgtcgaggacctggcgcagccgttcgagatctccggacgcgcggtgtacatcggcgccagcatcggcgtcatcaccgccgcccggggtgacaacccgaacgcgcagctgcgtcgtgccgacaccgcgatgtacgccgccaagaacgcggggcgaggccgggtacaccacggctga

SEQ ID NO: 7855 - DNA, 1200 bp, Actinoplanes utahensis
atgtccctacgtgcacgcctgctgcgggcttccgcggcactgacactcaccgtttccgcggccctggtcgccgggagtccggcgctggccgccgcggcacccaccaccctgccggccggccagttcaccctgaccgccgactacagccggttcgatgcgctggacgccgcgctggtctcgaagctcggcaccgcctcggtctcggccgtgatggccgacgcgaaccacgaccggcgggggatcaccgatgcgctgaacctggccgggtacagcaccggcttccagttcgacgacaccgacgtcaacgactgcgcgaacttcccgcagggcatcaccagcagccgggacgccatcggcaccgcgaacagcggcaactatgacggacaccagctgatcctggtcagctggtacaccgaggacggttgcggcggcagcaccgcacgcagccggatcaccctggtcgactgggatgcgacgtacccgaacagatatcgcaagatcctcttggtggagccgaccggcacggcggccgcgcccagcttcaaggacgtgctggtgcacgccggcggcgtcgcctggtacggcgactacctctacgtcgccgacaccgggcacggcatgcgggtgttcaacatgaagaagatcctgaagaccgacaccgggggcaccgccgaccagatcggacggcaggacgacaccacctattacgcccacaattacgcgtacgcgctgccccagctcggcacgatcaccgcggccaccacctccggcacggcactggcctggtcgacgatctcgctggaccgcgccgacccgtcgatcgtgatgaccgagtacacctgctcgtcgggctgcaccgcgtacccgaaccgggcggcccgcgcgatccgcttcccgttcgccccgggcgccaccaccttcgcggccagcaccaccgcgaccgaggcgctgaagctgccctggttcaagctgaacggcgtcgcctcgcacaacgaccgctggtggttcaactcctccggcgacaagaagttgtactactggacgccggccgccggcccgtccgcgtacgcctgggtcagcggcggcgagagcatcagctactgggaggacaccaccaaagccgacctgctgtggtcgctgcaggagccggtcgggcaccgcaacgtcttcgcggtcgaacagggcagctacgacggctga

SEQ ID NO: 7856 - DNA, 204 bp, Actinoplanes utahensis
atgggactttcagggcgggaatgcccggactgcgggcgcagtgtgcgcgagccgttcgagcagaccgtgaccggtcgcgaggtctgcccggactgcgcgaaggcgctgtttctgggttcggccgcaggcgcggtcaccggcgacgtcggtgccggctacggggtgtgggcgatgctgatgcgcaaggtccgccgctcggagtag

SEQ ID NO: 7857 - DNA, 1215 bp, Actinoplanes utahensis
atgaccgcgatcgacgaggtgatcacccgggtgcaccgggccgagtgggcccgggtggtcgcgaccctggcgcggcggatcggtgatctcgacgtggccgaggagatggccgccgaggcgttcgcgatcgcggtgcaacggtggccggccgacggcgtaccgccgaatccgggtgcctggctgaccacgaccgcgcagcgcaaggcgatcgaccggctgcggcgtgaggtgcggcgcgacgagatccatcgggaggcgctgatgacgtacgacccgcccggcccgctcggcgccgtcgacgacgaccggctgcgactggtgttcacctgctgccatccggcgctcgccatggacgcgcgggtggcgctgacgctgcggatggtcggcgggctgaccgtgcccgagatcgcccgcgccttcctggtcgaggaggcggccatgagccgccggatcacccgggccaaagccaagatcaaggacgcccggatcccgtacggcgtaccgttccgcgaagatctcccgatccgggtcggcggggtcctggccgtcctgttcctgatcttcaacgaggggtatctggcgtcggatcccgcccgcgagccggtccgcgccgacgtgaccgcggaggcgatccggctgacccggctggtccgcgccctgctcccggacgacggtgaggtggtcgggctgctcgcgctgatgctgctcaccgaggcccggcgccccgcccgggtgtccgcgaccggcgacctggtcaccctcaccgaccaggaccgcgccctctgggaccgggagctgatcgccgaggggcacgcgctggtccgggcccggctcgccggcgggcaggcgcccggccgctaccagatcctggccgcgatcaacgcggtgcacaccgatgcccggcacgccggggacaccgcctgggggcaggtggtcgccctctacgaccagctcctgcggctcgacccgtcgccggtcgtgcggctcaaccgggcgatcgcggtcgccgagcgggacgggccgcgggtggcgctggcactgatcgacgacctgccgctggacggctaccacgcgttccacgcgacccgggccgagctgctgcgccggtcggggcagcacgatcaggccagaacggcgtacgaccgggccatcgtcctgtcgaccaaccgtgccgagaccgcccacctgcagcggcgccgggccggcttgtcctga

SEQ ID NO: 7858 - DNA, 333 bp, Actinoplanes utahensis
atgacgcagtatctgatgtccgtgctgaacgacgccgacacgcgggcgaccgaggcggaggcggcggcgatcgacgtcttcaacgcgaagatgcgggccgacgggcactgggtgttcgccgggggactggcggcgccgggcagtgcgaccgtcgtcgacgcgcgggacgggcagccggtgttcaccgacgggccgtacctggagtcgaaggagcacatcgtgggcttctggatcgtcgaggcggcgcacctcgacgaggcgttgcggctggccgcggccgggtcgaaggcctgcaaccggagggtcgagctgcgcccgttcctgggcgcatga

SEQ ID NO: 7859 - DNA, 579 bp, Actinoplanes utahensis
atgccccagctcatgatcatcatcggttcgacccgtcccggccgggccgggctgccgatcggccggtggttcgccgaggcggccgccaagcacggcggcttcgacgtgcagatcgccgacctggccgagatcgacctgccgctgctggccgacccgcaccacccgcgcctgcggcagtacgtgcaccagcacacctgggactggagcgcccgggtcgcggccgccgacgcggtcgtggtcgtcaccccggagtacaactacggctacccggccggggtgaagaacgcgctcgaccacctgtcccaggagtgggcgtacgcgccggtcggcttcgtctcctacggcgggatcgcggccggcacccgcgccgtgcagcagctcaagcaggtggtcaccacgctgcggatgatcccggtggtcgagagcgtgaacatcccgttccacgcccagcacctcaccgacggcgtcttcaccccggccccggccgccgagcaggccgccaccgcgatgctcgacgagctggtcaaggtcgaggccggcgtccaccggctgcgcgccgacgtccgcgccaccttctga

SEQ ID NO: 7860 - DNA, 522 bp, Actinoplanes utahensis
atgacggcgacactcggcgacatcctgctcgtcttcctggccgaccggcccggctcggcctacgacctgaagcagcgccacgagcagaccttcggggccgaccgcgccgtcgacgtgctgcgggttgcgcagaccctgagccggcaggagaaatcggggtacgtgcggcccagcacccgcgccctgccaccgcgttcgccgcgggtgttcacgctgaccgacgcgggtctgcgccggcagttcggctggctgctcgacgtgccgccggacgcggccgggccggacgtgctcgaccgggtgctgctggcgatggccgccaccgagcgggccaccttcgacgcggtcgtcgcccgctgcctggcggtgctggaggcgcagcgaccccggcccggcctgccccgccaggacgcgctgtcggtccggcacgcccgggccgagctggcggtggtgatggccacctcggcgatcgagtgggtccggcacctggcgcagcgcccgcgcgagcgggacgccgccgcctga

SEQ ID NO: 7861 - DNA, 732 bp, Actinoplanes utahensis
gtgaccatcccgcacctgccgtccctcgcggcggcctcggcggccgccttcctgctcgcctggctgtccgcggtggccggcttcggcggcggggtgctgctgctgccggtgttcaccgcgctgttcggcctgcgggtggcggtgccgatgctgaccctcacccaggtgtccagcaacgccttccgggtcctgctcaaccgtcgcgacctgcactggcggctggtcgcctggttcaccgcgggtgccgccccgtgcgcggtcgtcggcggcctgctgctggcccacgccccgctgggcgcgctgaaacgggtgctcggcgtcttcctgatcggcgtggtcgtctggcgccggctgcgcccacaccccggccggccggccgacccggcgttcgccgcggtcggcgccgcctccgggctgggttcggcgctgctcggctcggtcggcccgctgaccgcgccgttcttcctcgcctacggcctggcccgggccgcctacatcggcaccgaggcagccagcgccctcgccatgcacctgtccaagatcgccggctacggcgccggcgacctgctgaccggacaggttctgtggtacggggtggcgctgaccccggccaccctggccggggcatgggccgggcgccgggtggtcggccggatcagcgaccgggtcttcgtcaccctggtcgagctcggcctgatcgccgcggggctgctgttcatcctcggctggtga

SEQ ID NO: 7862 - DNA, 456 bp, Actinoplanes utahensis
atgacgatcccgccgaggcgcgccggcgacctcctcaccgcgtgggtggaccggctgccaccccggctgcgccgccacctcccccgcgagctggccggtttcgccatcctcggctggttcaccttcaccgtcgacctgaccctgctcaccgtgctgcgccggcacacgtcgctgccgctgccggtcgccgtgtccatcgcgtacctgaccgctctcaccctgaacttcacgctgaaccgcacgatcaccttccggtcgcacgcgccggccggcccgcaggtcctgcggtacatcgtggtcatggtcggcgactacctgctcaccgtcggcgtctcgaccggcctgacgatgctgggcgcgccgttcgcggtcgcccgcgtcgcggcgtccttcctggtcgcgatcctcacctacgccgcttctcgctggtgggtgttccgcgatcgccgcacctag

SEQ ID NO: 7863 - DNA, 495 bp, Actinoplanes utahensis
atgaaaagaattgctcgtgtgctcgctatgagtggtccgggcctgggtgccgctctggtgatcgctgcggggcctgcgcaggctgccaccgtcacggcccagccggccgtgcacagcgcgtcggtccaggccgcgggccattgggacgacagtgatgtcgtcgggtacttccggacccggttcgggtgtgagcgggtcggccggctcggcgagtaccacggccgttgggatgactacgactgctcgcgggtgtggtccgggttcaaccgcggcgcctgggtcctggaggtcgccgccgacgactggaacggcgactgggacgacgacaactggtaccacggctggtacgacagctatcacggtggggacttcgacggcggctgggatcacggtggctggcaccatgatgacggcggttgggacggccaccacccggacggttccggtagcgtagccgtgttcccgctccactcccgggcccgatcagtgaactga

SEQ ID NO: 7864 - DNA, 1962 bp, Actinoplanes utahensis
gtgccctcaacccctgagccgcctgccgtcgatgcgtcctgggcgcggctggaagctttcagccgtctcgccggtccgctcaccgtcgtcccggacgaccgtccgtaccgggtggcctatcgcaaccagcgagcggtcgacggccggcgccacatgattaacgctgcggtgatcgcgctctgcaacgtgtgcttcgaagtgttctttttcgcctggctgctacggccggaccacatcgggccgactcacatcggccctgcggcccaggccgcccgggtcgcgaacctcgtcgtgatcgcggcgatcgccgtcgtcgagctgcttcgcctgatcaacgtactgtcgctgtcgctggcctcggtcgtggcccgcgacccggtccccgtcgtacccgacgacgacctccgggtggcctttctgaccaccatcgtgccgagcaaggagcccatcgcggtcgtcacggacacgttgcgtgcggctacccggatccggcaccgcgggaccttcgacgtctggctgctcgacgagggcgatgacccggccgtcaaagcggtctgcgccgagctgggcgtgcggcacttcacccggaagggcaataccggttacaaccagccggccggggcgttcaaggccaggaccaaacacggcaactacaacgcttggctcgacgcccacggcgaccggtacgacgtgctgctgtcggtcgacccggatcacgtgcccttggccaacttcgccgaacgaatcctgggctacttccgggaccccgacgtggcctatgcggtcgggccgcagtgctacaagaacggcgaggagttcgtcacccgcgccgccgagtcgcagcagttcccgttccacagcgtcatccagcgtgccgccaaccgttacggcacgccgatgctggtcggcacgaacaacgccatccggatcgccgcgatccgaggcatcggaggtctggccgactcgatcaccgaggacatggccaccggtctggcgttccacaccagtcgcaaccgggccaccggcaaccgctggaaatcggtgtacaccccggacgtgctgtcggccggtgagggcccgtcaagctggagcgactatttcagccagcaacgccgctggtcgcgcggcaccttcgagatcctctccggcaccttctggcggcgcttcctgcgactgtcgcccggtgcgatgctgcactacatgctgatcaccacgttctacccgtcgatggcgatcggctggttgctgggcatcctgaactcggtgctgttcctcggcctcggtgtcaccggcatgaccatcgtcgcccgcacctggctcgccctctacaccgacgccaccgtgttctcactgtggctgtacatccacaaccggcgctacaacgtcagcccctacgagccacccaactcgtggggcttgaccggcatgctcatgtccgtcatcgccgcacccctgtacgccgggcagctgtgcagcaccctgctgcggcgaccggccaaattcgtggtcaccccgaaaggaaccagcaccagtaacgacggcctgcgcaccttccgcaaccaccttggctggctcgccgtcctgaccgccgctgtagccgtttcctatgtacgcggctacgcgagcccggcgtcgctgctatggccgtgcacctccctggctgtatgcctacttcccctcaccctgtggcaagccgggccgcgactgacccggaaggcagcgaccacccccgtcggtcggcaaccgctgccggcccctggaccgcaccatgccggggacatcaccaaggaaatcccgaaagcagccatcaaggaattgctgtccgcgggctcaaaatccggacaacggcacgaagaccgcctgccggcgcctgccccagctgcggtagacgtgccgtcgcaacgcaccgactcggccgatcagactccgcagcccgcaacagcacctcgttcacacggatga

SEQ ID NO: 7865 - DNA, 1059 bp, Actinoplanes utahensis
gtgttgattcccacccgacgccggcgattcacgctcgccttgatcgctatcagcgcgatcgcgatggccttgtgttgtgtcaaggaattcgccaccgacggacaccggcgcgcaccgaagccgagcacagcgcggcctggcgctgcaacttcgatgcttcgggagaacagtgcgctggcacagcagcatttctatgtggatccgcacgggcgcgcagcgactcaagccgcccagtggcaggccgacggacactcgcagcaggccgccctgctacgcaagatcgcggatcggccggtagcagactgggttaccgacggaccgatacccgtggccgaacgggtgggcgcactcgtgggtcgggccgaggccgccgggcagctgcccgtgctggtggcctacaacatccccgaccgtgactgcggcggtcacagctccggcggcgccgcctccgccgcccgttacggcgagtggattcgcggattcgcccggggcatcggcaaccgacccgcggtggtgatcctcgagccggacgcgatcgcgcactcgctgcagggttgcgccgaatccggcgagcgactcgccgtgctgcacgacgcggtcaccgtcctcaagggcaacagctccaccagcgtctacctcgacgccggcaacccgggctggatcaccgacacgcgtcagctggcactggcgctgcggcgggcgggaatcgccgaggcggacggtttcgcgctcaacgtggcgaacttctacaccacctccgacaacatcaccttcggcaacggcctgtccgacgcgctgggcggccacatccacttcgtcgtcgacaccagccgcaacggagacgggccggcgccgagcgacgatacctcccgctggtgcaacccgccgggccgcgcgctgggtgcggcaccgaccacagagaccggtcaacccctggtcgacgcctttctgtgggtcaaacgtcccggtgaatccgacggctcctgccgttccggcgagccgcctgccgggcagtggtggccggagtacgccctcggcctcgcggctcgcgcttcctga

SEQ ID NO: 7866 - DNA, 1872 bp, Actinoplanes utahensis
gtgccgccggtgtggtcggcggtgtcgcggtggcagcacgaaaagttgatcaatagcgcggcgtacaagagctcgcatggtttctggcaggtggtgaaactaccggcgggcagccgggtgaacgccatccactcggcgatgctgccgtccggcaagctgctgttgatcgcgggttcgggcaacgaccgcacccaattcaaggcgggcacgttcaagacactggtgttcgatccggtcagcggaaacacgaagctggtacctaccccgaccgatttgttttgtgcgggtcatgcgtttctgccaaatggcaagcttctggtcgccggcggcacgctgcgctacgaggtgctgcagccggacgtgacccatgcgggcggaacgatgacggtgaagaacgagtcacctgacggcgcccgttcctttccgaagggcaccgtgttcgtggcggcgaacgggctgcgctacacctccggtgatgccttcacggttcccgccgccaccaagacggtgacgccggcggcggccggcggtaagacgaaggtcgccgttgcggcgagctccgtcgacgtgtgggtcgacggagccggtgacggcgtccagtatgccaccggcatccgcggtcaataccgcatcgacgggctcaccggagccgatgcgcgcaacgtgtacggcatgaccgaccggatcagcatggataagcaggactatcagggccgcaaggaggcttacgagttcaacccggtgaccgagcggtacgagcgggtcgccgatatgcacgagaagcgctggtatccgacgctcacgggcttgtcggacggctcagtcttggcgttgtccggcctggacggcagcggcaaggtcgtcgatgggacccggaacgaggtcttcgacccgaagacgcagacgtggacggtccgcaaggacctcaatcattacttcccgacctacccgacattgctgcagacggcaaagcccggcgtgctgttctacacgggctccaattcggggtacgggccggccgaccgcggccgtgacccgggcctgtggaacctgagtgacaacagcttccgcaacgtctccggcctacgcgatcctgaccagctggaaaccagcatgtcggcgtgggtggggccggtgcagaaccagacggtgatggtggtcggtggcggaggcgtcggcgaatctcgccactcgacccggcgtatcgacatcatcaacctcaacgatccgacgccgcacttccggcccgggccggatctgccggagcctactcgctatccgagcctggtgaacctgccggacgacaccacgttgatcaccaacggttcgcgcgactatcgcggccgcggggcgagcgacaaccatgtcgcgcggatctaccatccggacaccaataccttgtcgatggcggcggacccgcacatcgggcgtaactatcacagctcggcggtgttgctgcccgacgggcgggtgctgacggccggttccgatccgttgtacgccgacaagaagaacaccatttccggaacgttcgagcagcggctggagatctacacgccgccgtacctgttccacgggccgcggccccagatcactgctgggccgcccgtcgtcggctacgggcagaaagccgacttcgccacaagctcgccggcggagatcgccagtgtccggctgatccggcccagcgccgcgacgcacatgctgaatccggaccagcggtccttggcggtgcccttcacgacgacagccgccggcgtgcgcgtcacggtgccggagcaggccgcgctcatgcctccgggaccttacatggcgttcgtggtcaaccgagccggcgttccgtcggtagctcggtggatcaccgtgcattga

SEQ ID NO: 7867 - DNA, 324 bp, Actinoplanes utahensis
atgaaccccacctggcagcacagcgtccaacgcgacaccgccaccagcaccatcgccctcagtggagaactcgacctcgccgcgaccgccaccctgaacgacctgttcgccggtcaactcgccgttgatggcatcatcacggtgcgtgtcgacctgtccgcggtgaccttcctcgattccacggtgatcaccaccctgatcgtcgctcgtaataccgcgaccgccggcaaccgccagttcactgtcactcacgccgccggccacgttcggcgcgtcctgaccgtcgcaggtgttctcgacacactgaccaccgaccccggctga

SEQ ID NO: 7868 - DNA, 558 bp, Actinoplanes utahensis
atgcgcacgccggcccctgccctcgccaggccggtcgacagaccggcgccgacgctggactcccgcttcgccgcggcggctctgaccgacctgcgccacacggttcgaaccgcggcagccggcgccgggctgcacggggaacggttggacgacttcatcgtggctgtgcaggagctgattaccaacgccgtgcggcacggcggcggtcggggtcggctgctgctgcgtcggtacgacaacaccgtgacctgtgagatcagcgaccacggcagcggattccccggcggcgtccccccgatcgtcagcccgccaccggccggcgtgcccggtggccgcgggctctggctggccacccagctcagcgacaccctgctcatcaccgatcgacccgatggcgtgaccgtcacgatcaccatctgcctgactactcctggtatgccggccggtgtgacaccggccgcagactccggtacggtgcccgcacgacagcagtcggagctggccgtcatgcctggtccgccgcttcttggcagcgacggcgggagcacaccggcatga

SEQ ID NO: 7869 - DNA, 456 bp, Actinoplanes utahensis
atgcgaatctattaccaggacgccgacatcacggtggccggcgcgggcgtcgaggtcaacggccatctctatccgttgggcgagatcgagaacgcctggcgccgcggccgccgctcggtcggccgccgcggccggatcgccctcgtcgtgctcctcgccgtcatcgtcttcgaagtcgtggtctgggcgctgacctggtggctgtgggcgttccgcggcctgctggtgatcgccgccctgctgctgatccgggtcgtcgcccacctggcggccggctccaccggcctgcaggccctggaggacctgcgccggtacggccgccgccaccagttgtggatcagcgtcgcccgcaccccgatctgcgtcctgtccaccaacgacgcgatccgctacggccaggtctgccgggccctgacccgggccctcaacgactacgacatcacgcccagccgctga

SEQ ID NO: 7870 - DNA, 648 bp, Actinoplanes utahensis
gtggggccgcgcgggtacgccggtaggtgcgggatctgcccacatgatctactgcccggtgtgaaacgagcggcgatcctggtcacagccctgatcgtggccgtggccgcggtcgtcggctggcgctggtggcatcaccgtccgccgttcgggccgaaggcgatgaacgcccgggccaccctgcacccggccgacgccgcggcggtcaccgccgcgttcgggccgggccgggcgatcgtcgccggggacggtgaccgcacgttcctcggtgaggtcacctggacccgtccggcgcacccgcgggcgggcaacagtttctggatcgtcgtgctggacaagagggcgcacgtcaaaccggacatggtcgcggcgacgtcggcccggcccggtgacctgttcctcggcgaggatccggtcctcgaccgggcccaggcccgctatccgtggctgcgcggtgccggcaccgtcgcgaccggcggcggttacgtgagccggggcaatgccgtccacgtcgcctcggtggacgccgctccggtcaccgtcgaggtggtcctgcccgcgtcccgcaatccgacggacgtgctgatcgccctggtcagcgccggcccggacggccagctctactgggcgcagcgcctgctgaactga

SEQ ID NO: 7871 - DNA, 1917 bp, Actinoplanes utahensis
ttgcgacgcctggccgtcgctgtgctggcgaccgcggccgttctcgtggtgccggtcggagccgcgcgggccaccgacctcaccacggccgccccgatcagcgccgccggctgggcgccgacctggcgtgacgacttcaccggcgacgtcgtcgatccgacgcgatgggggtacgacgtcggccccggcccgcagttcggcgacgcggccgagcgggagacctacaccgactcccgggcgaacgcctacctggacggcgccgggcacctgaccatcgacgcccgcgccgactgtgccgccggctcctgcgcgtacacgtcggcgcggctgcgcaccggcaccctgttcagccagcggtacggccggttcaccgcgcggatccaggtgccggccggcgccggggtgtggccggcgttctgggcgcagggcgacaccggacagtggccggccaacggcgagatcgacgtgatggacgacggcgcgccgggggagaacggcacggtcgcccacggcgggccgatcgggccgcgcggcaccaccggcacctgcacgatccgcaacggcgacggcagcaccaccgccgactggtacggcgtcggcggcgaatcccggctgccctccggcgcgtccctgaccggcggttaccacgtgttctccaccgactggtaccccgaccacatctccacctgggtggacgggttgctctactcgatcgcgttccgggccgacgtcgtcgcggccggctgcacctggccgttcgaccagccgttctggctgctgctcaacgtggccgtcggcggcggctggcccggcccgccggtcgacccgccggcctccggggtgtacgcccggatgaaggtcgactacgtcgaggtgtccgcaccacgggacaccccggcgaccgccgcgaccgggccgatccgcggccggcaggccaccgccgactgcctggacgtgtggcactccggcaccgccgacggcacggcggtcgactcgtacccgtgcaacggctccaccgcgcaacagtggaccacggcgaccgacggcaccctgcgcgccttcggtaggtgcctcgtcgtgaccgcggccggccaggcgcagctggccacctgcaccggcgccgcggcccagcgctggatcgccgaatccgacggcgggctgcgcaacgcgtccaccggcacctgcctgaccaccggcaccgggatcccggccccgctgacgctggccgcctgcacccgctcccgataccccacccaggcgtggtcgccgccgcccaccccggccctggccgcccgctggcgcctcgccgacggcgccggcgacaccgcacccgacaccggcggcgccggcctgcagactctcacctgcaccaacggcgtcacctgggcggacggcggggccaccctggacggcgcggacgcatcctgcgagaccgcctccgccgtcgtcgacacccggggcagctacacgatctcggcgtgggcgcgcctgaccgccgtcccggccggcaaccggaccgtggtcagccaggacggtgcctccctgagcgccttctacctgcagtacgacggcaccgggaaacgctgggcgatcaccgtgccggccaccgacgacgcggccgcaccggtcttcgcgggcaccggcggcggcccggtcagagcgggcacctggcagctgctgaccggggtgatcgaccgggccaccggtacggcgaccctctacgtcgacggcaaacccgccggcaccccggcggcggtcaccggcgcctggcgcgccgaccactccctggcggtcggccgcggcctctgggccggcgcccacggcgactacttccccggatcgatcagcgacgtgcgggtctacccgtacgcgctggacgcggccgccgtgtcggccctgtacgccacgggccgctga

SEQ ID NO: 7872 - DNA, 633 bp, Actinoplanes utahensis
gtgacgggctggagccgcgagcagatggccgcacgggcggccgccgagctcaccgacgggtcgtacgtcaatctcgggatcgggctgccgaccctggtgcccaactacgtaccggatgatgtcgaacttgttctgcactccgagaacgggatcctcggagtcggcgcctatccggccgacgacgacgtcgacccggatctgatcaacgccggcaaggagaccgtcaccgtgcgcgcgggcgcgtcgtacttcgactcggccacctcgttcggcatgatccgcggcggcaagatcgacgccgcgatcctcggcgccatgcaggtgtccgcggccggcgacctggccaactggatgatccccggcaaaatggtcaagggcatgggcggcgcgatggacctggtccacggcgcccgccgggtgatcgtgctgatggagcacgtcgccaaggacggctcctacaagatcgtcaaggagtgctcgctgccgtacaccggccgcggcgtcgtccagcggatcatcaccgacctcgccgtcctggacgtcacccccgagggactgcggctggtcgaactcgcccccggcgtcaccgaggacgaggtccggagcaagaccgagccggagctgctggcatag

SEQ ID NO: 7873 - DNA, 768 bp, Actinoplanes utahensis
atgcacaaagtgatgagctcggccgccgaggcggtggccgacatcccggccggagccacgctgtcggtgggcggcttcggactctgcggtatcccgtcagtgctgatcaacgcgctggtggcgaccggcaccggtgacttcgaggtggtctccaacaacgccggcgtggacgacttcggtctcggactgctgctcgcgcggggccggatccgccggatcatcgcctcctacgtgggggagaacaaggagttcgcccggcagtacctgtccggcgagctggaggtcgaactcaccccacagggcacgctcgccgagcggatgcgggccggcggctcgggcatcccggcgttctacaccgcgaccggcgccggcacccaggtcgccgacggcggactgccctggcgctacgactcgaccggcgccgtcgccgtggcctccccggccaaggagacccgcgtgttcggcggccgcgagcacgtgctcgaggaggcgatcgtggccgacttcggcctggtccgcgcgtggaagggcgaccggcacggcaacctggtgttccgccgggcggcccgcaacttcaacccgctcgccgcgatgtgcgggaagatcaccatcgccgaggtcgagcacctcgtcgagccgggcgagctgaacccggacgaggttcacacgccgggcatctatgtgcaccgggtggtcgcgctcaccgccgagcaggccgccgacaagcggatcgagaagcgcaccgtgcgggccggaggagcgaagtga

SEQ ID NO: 7874 - DNA, 756 bp, Actinoplanes utahensis
gtgaacgctcccccggatgtgctcggccgcgccggggtcctgctgcgcgccatctccagccacgagccggagggcgccaccacggccgagctggcccgcctgaccgcgatcgcccgtcccaccgcgcaccggctgctcaccgcgctgatgacggagggtttcaccgaccgtgacccgggcggccgctggcggctgggtccggagctgtatctgctgggcaccgccgccgcggcccgctacgacgtcaccgcggtggcccagcccagtgtccgccggctggcggtggccaccggcgaaagcgcgttcttctcggtccgccgcggcgccgagacggtctgcctgctccgcgaggacggcagcttcccgatccgctcgcacgtgctgcacgagggcatccgattccccctcggcgtcgcctcggccggcctggccgtcctggcctacctgccggccgccgaggtcgaccgctacctgtccgacaacgatctggtcccgggttacggcccggcccacactccggaccgcgtccgggagcggatctccaccacccggcgcgaggggtacgcggtgaatcccggcctgatcgtcgagggcagctggggcatggccgccgcggtgttcgaccgccgcgcccgcccgatcggcgccctcagcctgaccggcgtcgaacaccgcttcgccgcgcagcgccgccctcaactgggccgcctgctgctggaggaggcccaccgcctgtccgccagcgaccggctctga

SEQ ID NO: 7875 - DNA, 129 bp, Actinoplanes utahensis
atgacgaatcccgaggagcggccgcccgagccggtcgagcgcccgatcgacctgcaggacgtgcccgaatccgagcggcccgaaccaccgcgcgatccggagccggaggtgccggagccaccggactga

SEQ ID NO: 7876 - DNA, 780 bp, Actinoplanes utahensis
gtgcgaaaaatcggggtcgtcctgctgctggcgctggtaccggcgctgctcgccgggtgtggcgccggccggcaggcgcgggccgccggcccggtcggtccgcgggtgctcagcgaggtgttgagcttcgcccggggcgaggaccggccgctgccgaccacggtctggtatctcagcggcccgcgcggcaccggcacggcggccgggcggcatccgatcgtgctgttcagccacggtctcggcggcctgccggagcagttcacgccgctcgccacccagtgggcgcaggcggggtacgtggtggccgcgccggcgtacccgcacaccaacggccgggtgcgggtcgacgccggtgacatcgggcaccagtccgcggacgccgcgtacgtgctggcgaagctgaccaccgggaagctggccgcgcacctcgaccccggcgcggtggccgcggtcgggttctccgccggggcgacgaccacgctgggcctgttcgtcgaggggcatccggcatcgctgcgggccgcggtgtccgtggccggccggcgcccggccaccgcgttcggcggcccggccgcgccgatcctgttcctgcacggcgatcaggatccggtggtgccgatcggggccggccgggcggcctaccgggcggtaccgtggccgaagcagttcgtcgtggtcaggggcgagggccacggacagtatctgaacccgggcgaccccggctacccgtccgccgccgccgggatcctcgccttcctccgggagcacgtgccggtgtag

SEQ ID NO: 7877 - DNA, 1203 bp, Actinoplanes utahensis
atggtccggttcatgcaggtggccccgacagatgacgcaacggctcggcacgatgcccggccggaggtggaccggctgctcgacaaggtccgtgcccagctgggtgtcgaggccgcctgggtctccgcgttcggcgccggcgagctgaccattctggccgcggccggcgccgccggggagatgcggctgccggtcggcgaggacgccggactgctcggctcactctgcctgcgggtgctggccggaacgctgccggagatcgtccacgacgtgcgccgtcacccgctcacccgggacctggacagcgccaccgacctggcgatcggctcgtacgccggggtgccgtggcggtccccggacggcgccgtggccggcatgctgtgctgcggcagccggcacccggatccgtcgctcgaccagcgggccgtccggtacctgtcgctgatcgccgagctgatcagcgaccatctgagcggtccgctggccgagcagcggcacagtgtggcgtccgcccgccgggccgtgcagggggtactggacagccgggcggtccggatggtcttccagccgatcgtccgcctgcacgacggccgggccgtcgggttcgaggcgctcgcccggttcgacccgggcaccttcgccgggccggaccgggcgttcgcggccgcctccctgtgcggtctcggcgtaccgctggaactcctggccctgcgccaggcgctgcggcggctccccgagctgccgggggacgcctggctggcggtgaacctgtcggccgacgcgctgctcgacgccgacgtgctggacaccctgctggcgcacggcggcgaccggctcaacgtggaggtcaccgagcacgcgcaggtcagcgactacgacctgctgggcggcgcgctggactcgctgcgccggaccgggatccggctcagcgtggacgacgccggcgccggctacgccagcctgcagcacatcctgcggctgcggccggacctgatcaaactggacatcagcctggtccgcgacatcgacaccgatccggtgaagacggcgctcggccggtgcctcaacgacttcgccaccggcatcggcgcgcggctgatcgccgagggcatcgagaccgcggccgagctggcccgcctgcgtgagctgggcgtcgcgtacgggcaggggtatcacctggcgcggccgggcgccctgctctag

SEQ ID NO: 7878 - DNA, 582 bp, Actinoplanes utahensis
atgtcctaccctgaaccgtccccgtccgacccgacgcagccgtcgacgccgccgccgtatcacccggcgcagccgccgtcgctgtacgcgccgcccgcgtcgtcgccgcccgcggcctacgacccgtacgcgtcgccgccgccgccgtcgtatgacccgtacgcaccgccgcagcagccgatctacgacccgacgcaggcatatccgggtgccggtcagccgagcgcgccgccgttcgacccgggctacccgccgcagcagcccagcccgccctacggctaccaggcgtacgccccggtcgtgatggccgtcggcatgcccacctcgggcgcggccgtcgcctcgatggtgctcgggatcatcggcatcctgggtttctgcctgttcggcatcccctgcatcctggcgatcatcctcggtcacgtcggcctgaacgagacccgcaacggcgccaagtcgggccgcggcatggcggtcgccggcctggtcatgggctacctgttcgtcatcccgacggtcatcttcatcgccatgggcggcatcggcggcctcagcgcgatcatgaaccacacctcgccgtga

SEQ ID NO: 7879 - DNA, 366 bp, Actinoplanes utahensis
atgtcggagaacgtcaaggtgatctcggaggccctcggcctcggtgccacggccgggccgtcatccgatgcggtgctggaggcgtaccggcaattcaagaaggatctttttccctgggtccgcggcgacgcccgggaggccctggcggccgacgagaccgaccccggtttctgggaggtcaccctcgggtcggagctgaccgattccggcgcggccgaggacgccgtgatcctggccgccgcgcggcggctggcggagctggtgaaggcgccgcccgcggcgaaatacacggtgacggtcagcggcagcgagggtgtgcagatcggcgaccacaacactcagaccaacaccttcggtgcccgctga

SEQ ID NO: 7880 - DNA, 2361 bp, Actinoplanes utahensis
gtgacgcacagcgcgaccaggtcgctcgcccacggcccggacggcacggtgaaccgggccaggccgagagccaccacggcgccgatcgcgagcaggttcacgccggcggtggccagcagcgcgaacggccagacgctcaggcccaggtggcccaggccgaggcgccgccagccggtccggctccagccttccctcgtgacgaccaccagcatcagcagggtgaccagcagcggtgagacggccaggagcaggccgtcgaacacccttgcggtcgtcgccgagatcgagagcaccagaacgatgtacgtcaacgccgcagcgcgatcagtgagtccccgtatcactcgtgcagtcttcggcagtcgccgtcgccggccatccgtccaaagtgggatcccggaaggggaacggtcggccgtagggcggagatcggcacttgccgagcggtggccgttccggaacgctggaccggtgggcacaccgttctatccggacatcccggtgatcgtgcggctggagattccgtcccggaccggcacggcgttcgcggtggacgtgcgactcgcctgctcggtggtcgatctgggtacgcacgtccgccacggggtgacggacccacgggaggcgctgcgccggcacctggaacgcatccggttcgacccggtggccggcgaaccggacatggtggcggtgttcacccggatccgggagcatctcgccgccgttccgccggtgctgcccggcctgtcggtgaccctcctcgcggtcgaacgatcggatccggtccggtggcagccgggcgtggtcctcaccgggcccccgccggtcgggccgcgaagctcccccgccgaggcggagatcgcccggcgggaacgggtggagcggctgcgacgggaggccgccgcacgcgccgagccgccgtcccgggccctcgtcggcgaggcgccggcccaggtccgggccggcgccgaggtcagcctgatcgtgcacgtggcgcgcgccgcgccggccggcccacgggtgcgcagcgcggccatgcggtcgtggccgatcccgccggccggctcggaggtcaccctggtcacgcacccttcggccgggctgacgccgctcggaccgatccagcaggcggtgcgggtgccgccggacgcggattcggacccggtgcggttcgcgttccgggccggggtcaccgacgtacaccggatcgaggtgacggcctgggccggtggcaccttcctggcccggctggtcttcgagatcgcggtcagcgaccgcgccgtccacccggagacggcgacgaagagcgccaccacggccggcgacgtcgacggtgtgcccggggccgtgaccatgcaggtccaccagtccgggaaccgatacacctttcagctgcacaacagcgagtacgtcttcgatccggtcaccgtgaccgtcgacaccgccgtggacggggtgctcggccgcatcctggagacgctgcgccggttcgcccgcagcgacgacccgccgccgatcgcccgggaatggctgcgcaacgccggcgtctcgctgtgggacagcctggtgccggaggcggtccgcgagcagtatctgcggctgcacggccggatcggcagtttcgcgatcgccaccggcaacgacgtgatcccctgggagctgctctatccgatgacccggacgcatgacgccgggttcctggtccggcagttcccggtgacccgcaccctgttcaacaccggtcgctcgcgccggatcaacatcggtcaggcgcgtttcgtccgggacgtcaaaggcccggcgaacgcggaagccgaattccaggcgatcggccggatcctgtcccccggccgggacccggcccggatcagcgacctggacgacctgctcgccctgctgtccggcggcgaggccgggctgacccatttcgcctgccacgccggttaccgcgacgacggcccggcgatcgcgatgaccggcggcgatttctcgccgatgatgctggccacggtccgggccaaggagatgctcgcgcccacccggccgctggttttcatcaacgcgtgccgctcggccggcgccgtcccgtacttcacccggatgatgggctgggcccagcagttcctgggcgccggcgcgggcgcgttcgtcggcacgctgtgggatgtccgcagccggaccgcgcagaccttcgccgaggcgttctacagcggcttgagcgaaggtaagcccctcggccaggccgccctgctcgcccgccgcaccgtcgaagacgactacgaccccacctggctcgcctacacgatctacggcgacgcggacgcgctcgccttccccgtcagtgaaggacgacagcattga

SEQ ID NO: 7881 - DNA, 513 bp, Actinoplanes utahensis
ttgaaaaccacagacgacggtgtacgcgtcgaagacctgatcgccgcggtgaagaacgccatcgacgaggccaacatctccaccaccgacccgtcccgtgacctgcgggtcagcaaggtcgatctgaccctgtcggtggtcgcctcccgccacggcggcgccggcctggagctgaaggtcccggtcatcggcacgaaactcggcgcccgctaccaacatggcacctccggcacccagaccgtccaggtcacgctgatccccccgcccccgtccggcttcgaagtccgcggcggcgacctggaggaatccctggtcgaagccatcaccaccatccgcgccgcgatcatcgcggcccgcaccggcgacgacccgttcgtgctggagtccagcgtcgtcaccctggtcttcgcggtcaccgacaccggctccatcaccctcctcggcgagggcgacctcaccgacgagcagacgagcacgctcgccctcaccctggtccccgccgaccacccctga

SEQ ID NO: 7882 - DNA, 2661 bp, Actinoplanes utahensis
atgattcaccccatgacggcgaccgaccttccgcgctccggcccgcacgacgtcgactgggcgaagctggaccggggcaccgtcgtccgcacactgctcaccgacctgaccaccgacgatcccgccacccgggcagcggcccgccgcgccctgtgccgcaacgccccggacggcgaggatgtccgcccctgggtcaccgccgccctgccaacgctgctggccctggtcgccgatccggcccagcccgaacgcggccccctcctccacctgatcgccgacctcgcgggcgccgaccgtacgtggcagatgtccggcgagacgctgcgcgccaagcggctcctggcagcccatgccgcccagtccatccccacctcctccgccgccgcccccgccactcaagccggccccagcgcgcccaccaccctcgccgctgacgccgaccgagccgcttccagcaccgcggtgatcccagcgacccagctcgcactcccccgtcagaccgagcatgtcggatcttccggaaatgtccggagggtccgaccgtcgggagctgcactcccttcatctgactctcaccgtcgccctcggacgaactcggcgaatccgattccgggagcacgtcagcccgagtccgcgacagcggccgaagctgtttctccgaccggagcaccgccggcgtccgcacttgcggccacgcccgaagcgacccggggacctgccgcccgggccgcgaccgaggcgaccccggaagctgccgcccgagccgcaacacaggcgccgccgggagccgccgcccgagccacgacccaggcgccgccgggagccgccgcccgagccacgaccaaagcgcccctgggatccgcggccggcacctcggccgagacgccggccgagcctgcgcccggcttcctcgccgcgctgatggctgacgaggatccgctggtgcgggacgcggccgcctacctcgtgcgggccgtcgcgcgcctgcttcccggcctgatcgagctgatctggggccggtatgtcgaggagcccgacccggcggtccgggtcaccctggtgcgcagcggtgtggtcgccggcgcggtcggcagcggggtcgagccgaccaaggtgtggctggcgtgggccgccgacagcgacgcggatctgcgggtccggatcaccgcgctgaccgagctgatggcgctgctgaacccaccaccgttcgacgtggagaccgcccgggagacggtgctggccgcctacaaggcgggcctgaaccgggagccggcaccgctggacgatgcggtcgccccgctgctggccggccggcggatggcggcgcggcagtggacgccgggttatccgcaggtggtcagtgtggtgcggacgtcgtatcgcaacgacgtacgcccgcaattggatcttttgacccgcatgctggagttggatgccgcggacgcccgccaggacgcgctgcacgaggcgcgggccctggtgcggagattgcgcgccccgtatcggccgttggtggtgcgtgccgccgagctgctcggcgacgacgatccgcaggtgcgcgcggccgcgctgcggatgctgcacggggtcggcgagctggcgcgaccggccgccgatgacatctgggcgacgctgccgccgacccggcagcggatccgtcccggccagagcccgtgggtccaggccgacctgactctggggccggccgtgcgcaccctggccggtctgcgggacgaacgtgtcctgccgatgctggagcgtctgctcgacgagctgcccgggacggtcgacctgcaccggttcatcgccggttacggtgcccgtgcccggggtttgagtcgcaccctgcgccgcctgctgcgtgcggtcgagcccagcgcgtccgcccagcggctgagttttctgcatccggagacggtcgagttgccccggatcgcccagcgtgcacgcccgtcgtcgatcgcccagcgcgcggccggcctgttcggtgatgacgcgctgcgggccgccctgctgcgcgcgctgatcgcggtcgccccgcacgaggccgccgatcacctgacctacgacccgatcgacctgaccaccctggacctgctggcccgggccgggcgttccgccgccgcccggatccccgagatccgacttgcgctgacctgcggcgatccggcgctggagctggcggcagcgcaggcgatctggcgggtcgccggtgacgccgaggcggccgcctccgtttacgaccgctatttcgacgacccggccacgctccccgagcacgcggtcacggcgctggacggtctgcgtgatctgcggttgcgcgtcaagtcgcgcacccggcgcctggtgagcctggccaagacccgccgcaacggcgccgtcgtggtcgccgccgccgacgccctgtggtggatcgccggcaatcaggatgccgcccggactctcggcccggtctgggagtccctgccccgggcccggccgcgcatcgcccgcatctggacagacaccggcgacgcccgttacgccgcccgttacgtcaaggccgagctcgccaccacgttgcgccacaacgccacccttttcgggcggcccaccaccgacatcaacgaggacgagcacctgctggcgctctgccgcgacctgctcgcgaaagcctcctga

SEQ ID NO: 7883 - DNA, 858 bp, Actinoplanes utahensis
gtgatcgtctgctatgcgcagggcggcgggctcggacatctcacccggatccgggcttacctccacaccgtgcacgacgacgagccggcgacggtggtgacctcctccccgttcggcggtgatccgcgggtgctcgggccgcaccggctggcctgtgcgccgatcgccgacgtgctgcgcgagctgcggccggagacgctggtggtggacgctttcccgggcgggatccgcggcgaactggatgcttcggtcattccgcctaagatccggacggttcatcttgcgcggctgctgcggtgggcggcgtaccgggacatgctgccggtggatgtgacctattttgatcagacgtgggtgctggaggaactgaccgacgggcatgccgccttcctggccgggcactcgggcgcgatcggctcgctgacgctcaccgacccgccctccgttccggcccgcgagatcgctgccgatcgatggttgatcgcgcatgcgggtccgctggaggagacgacacaattgctggcgtacgcccgtgaatgcgccgccctggaaaacgttcagccgcggctgctgctggccgccccgtcgcgtcccgcgccattgccggccgacgtggaccacatcgacgactatccggtgtggccgttgttcgcctccgccgcgcgcgtcttcaccgcggccggtttcaacgcggtccgccagatggcgccgtggcgccatcgacaccgcatcctgccgttcgcgcgccgctgggacgaccagttcgcgcgggccgcgcgcgtccgcccgcccgccgcgcacctactttcggaccgaaccgtagaccaaagttcatggcggcggcgtgacgcccggtga

SEQ ID NO: 7884 - DNA, 1086 bp, Actinoplanes utahensis
atgcggttgctctgggtgaccgagaactatccgcccagcccgggcgggatggcgaactcgtgcgaccggatcgtgcgcggcctgcgccgagccggggtggtcgtcgacgtggtccacctcagccgtcgggccggcgccggccggatcacccctgagcagggcggccgcttgatcacggtgccgctcggggaggatgccgagcacgcgctgcgaatgttgtggacctcgctcgaagcggcggcctacacgcacgtcgtggcgttcggtggcacctaccccctgctggccgcgccggtctacgccgcgtggagcgggaaaccgctgatcacgctgctgcgcggcaacgacttcgacaccggaatgttctccctgcgccgtcagccggtcgttcgggaagcactccgatcgtccgcgcacgtctgcgtcgtcgccagttccaccgcgccgctggtctccgctctagcgcccggcgtcccggtcacctgggtcgccaatggcattgacgccgacgaatggcaggtgctgccgtccgagagtcggaaagccgccgcgtggcgcgccgagcacgtcactgacgggcgccgcacgatcggcctgatcggccagttgaagaacaagaagggtgtccgtctgctgctcgatgccctggcgcccggacggcacgacttccacctgatcctggccggcgacctggagcccggaatgcccctcgacgggcacccgcacacgatccttcccttccaggaccgataccagctgctgaccgtttatgcctcctgcgacgtgatcgctctgccgtccttctacgacggcctgccgaacgtcgccctcgaggccgccgcgctcggcatcccgctgctcgcctccgatgccggcgggctcgccgacctggtcgacgagacgatcggcttccggttccgggccggtgatccgcacggctgccggtcggcgctgcaccgcgcggccgaagcgacggatgagcagctcggagcgctgggggaggcggcggcgcggcgggtgcgcgagcgcttcgggatcgcgcgggagaccgacggctacctgaaggtgctggcagcgacccggtga

SEQ ID NO: 7885 - DNA, 285 bp, Actinoplanes utahensis
atggcggtcgcggcctgcccgtcgtgcgggcgtccgatctgcgccgaccacatcgccgagggcggcatgtgcccggaatgtgcggcggcgcgcggccaggtgtcgcatcccgcggcggcggccgcttaccggcggcgggcacaccgataccgtacgtcgcaggaatattcggacgttgtctggtattccggcttcgatacgtatgaccgtgctgccttcgatcccggcgccggtgcgacccaggatttcctcgacgacggggacgacgcgctggtggacagctga

SEQ ID NO: 7886 - DNA, 723 bp, Actinoplanes utahensis
atgttctggcgggagcagaaggcggccatcgcggggttccacccgctgcaccaggccctcatcgcgcagcgcggggtcgccgcgaccctgccggcggccggctgggcggcgttcgtcaccagcctccagcagcatgccgggctgatccggcgccgcaagtgggcgctgccggcgcggaccctcgacgtggtggtgccgttgatcctggagctctgctcggatctcgggccggagggaacactgtcggtcaccgccgatctgcgcgggttggacgcgcccggcaagtgcggccccgaggcgccgctcgccgtgcggccgccgatccggaaggcgaccgaggcctgggtgatcgatccgtggctgcggctgcgcggtgacctgcgggacggcagcgtgctggagatcctggtcgtcgaccgggaacgccgccggcggatcaccaaacgcaacccgcgcggcaagtacaagacgaagcagaagcgcaaactggtgcaaaccatccgggtgcgccggcgcctgccgaagggtgccgacagccgggtgccggtgacgccgccgccgggctggatcggcgtgctggtccgggagggcgagcggcgcagtgtgctggccgccgcgaagctcgacccggtgccgcgcagcgcgcaggagcagatcgaccggattctgagcgtggccaccgaaccgttccgctggacgtcgccgatgggggagatccgatga

SEQ ID NO: 7887 - DNA, 1221 bp, Actinoplanes utahensis
atgcctgacgaccgccgaggcccggcccgggagggcgggacgccggacgatccgcgagcgggtgcgccgcgaagtggcggccaccgggctgcctacatcgcgttcgaccggtttccctcgaccaaggggtcggcggtgcacatccggcacatggccggcgagttgttcgaacggtacggcggcggcctgctctgtgtgctcggcggtggcggcctgccggcctaccagttcgagaacggtgtggagatcgtccggttcaccgaggtgatccccaatctgctggaccgggccgaggcgttctccgcctgggtgtccgatcggctcgcgccgcatcggggcacgctgcggctggtgcacgtgcgggatccgtggggcgcactgcccgcgctcgatgccggcggacggctggtctacgaggccaacgggctgccgtcgatcgagctgccgtacgcctggccgctggccgctcccacgaccctcgccaaggtccgcgcactggaggagaggtgcctgcggcgggccgcggcggtcgtcgtaccgtcgtacgtcatcgaagcggccgtgatcgagcgcggcgtggcgccggaaaacgtccacctggtgcccaatggcgcggatccggtgccgccggatgtgccacgaccggcggcggccccgggccggtatctgatctatgtgggtgccctgcagccctggcagggcgtcgacgtgttgctgcgggcgttcgcccggctcgccgacctgaccgacctggagctggtgatctgttcgtcggtgtcgccggcccgggcgcggccgctggtccggctcgccgagcggctcggggtgagcgcgcgggtccggtggcagtacacgttgccgcatgcggaggtggcggcctggctcacgcatgccgagttgtcggtggcgccgctgaccgccggcccgcggaacctggagcagggatgcagtccgatcaaggtgtgggagtcgatggcggccgggacggcggtggtcgcctccgatctgccggtgatccgggaggtgctcggcgggtacgggcggctggtgccaccggaccggccggccgagctggcgcgggcgatccgggtgctgctggagtatccggcggtggcccgcgatctcgggcagcgcgcccggcggcacgtcgaggacggcttcacctggaagcatgcgcgggcccggctggccgccgtgtatgaccgggtagaccagcactga

SEQ ID NO: 7888 - DNA, 924 bp, Actinoplanes utahensis
gtggtcacgggagcggcggggttcatcggaagccggctcgtgcgagcgctgctgggcgacgggcacgacgtcgtggcggtggacgcgatcgagcgggccggggcgcccgcagcggccgccgagaacgcggcggcactgggggttccgttgacccactgtgatcttgcgacggctgatctcaccgggctggtcgacgcggatgtggtctttcacctcgcggggcggccgggggtgcggtcctcgtggggttccggggcagccgacgctcaccgggacaatgtcgtggcgaccgagcggctgctggcggcatgccggaggacacggccacggttcgtgctcgcgtccagttcgtcggtctacgggagtgcggagcatccctgcacggaggacgacccgatctcgccgcggagtccctacgcacgatcgaaggcggcggcggagcggctggcgcggcaggcggcagaggacgggctgccggcggtggttctccgatacttctccgtgtacgggccggggcagcgaccggacatggccttccaccggttcatcgaggcgggcctcgacggggagccggcaccgctgtacggcaacgggcagagccggtccttcaccttcgtcgatgatgtcgtcgcggcgaccatccgggccgcgcaggttccgctgccgcccgggacggtgctgaatgtgggacatccggtgaccgtcggggtccgggaggcgctcggccggatcggggtgctgctcggcgcgacacccccgaccgtgccggcgggggtggcgcgcggcgacgtgacccggacgtgggccgcgaccggacgggcggaaaggttgctcggctggcgggcccgcaccgccctggacgaggggctcgccgagcagatcgcctggcaccgaagccggcgacgggagcacagccatgcctga

SEQ ID NO: 7889 - DNA, 1338 bp, Actinoplanes utahensis
atgccgatgcccgacgatcgatcggcggacagtgagccgctgtcggatggcggccaggcatggagcggcgagccgacggtgggcggtcagccgtcggacggcggccggtcatggagcggcgagccgacggtgggcggtcagtcgtcggacggcggccggatgtggaacgaggagccgctgtcggatgggcggccgtcggagggtcggttgtcggcggatgcccggccgctcgccggactggtggtggcggacttcagccgggttcttgccgggccgttggcgacgatgaccctcgcggatctgggcgctaccgtgatcaaggtcgagcggcccgggagtggtgacgacacccgcagttgggggccgccgtgggggacgcattcatcggcgtatttcgaggggctcaatcgcagcaagtacagcatcgcgctggacctgtccgaccccggcgaccgagcgaccgcgctcgccctggcggcccgggccgacgtcatggtgcagaatttgcggctgaccggtttcgggctggactacgcgtcggtcgcggcgatcaacccgggcgtcgtctactgctcgatcaccggcttcggcccggatgctgacctgcccggatacgacttcgtcgtgcaggcggtcggcgggctgatgagcatcaccggtgagtccaccggcgagccgctgaaggtcggcgtcgcgctggtcgacgtgctgaccgcgaaggatgccacgatcgggatcctggccgccctgcaccggcggcgcgagaccggcgcgggcgatcacgtgcaggtcgacctgctgtccagcctgctcgggggtctggtcaaccaggcgtccggctacctggcgaccgggcgggcgcccggccggatgggtaaccggcacccgtcgatcgcgccgtacgagactctgcgctgcgccgatgtgccgatcgcggtggcctgcgggaacgaccgccagttcgcccgactgagcgccgttctgggggtaccgggactggccgaggattaccggttcgtcgataacccgtcccgggtggcgcaccgggaggtactggtcgacgccctcgaagcggcgctcgccgccgagaccgcggcggtctgggagcggcgtctcacggcggccggcatcgccgccggcgtggtgcgcgacatcggccaggccatcgaccgggccaccgatctgggcctggacccggtcgtcgacgggcagatccggcaccccgtccggtatgccaacgccgcaacacgacctccggcagcaccgccgcggctgggggagcacagcgatctcgttcgcgcctggctcagcggcgaccctgcgaccgggctcggctga

SEQ ID NO: 7890 - DNA, 1134 bp, Actinoplanes utahensis
atgaagacgaccgcactccaaacgatctgtgcaggcacgatggcgaccggattgttggctttcggtggcgccgcgcatgccgcgatgccacccgcctctccgcccgccgccctgcgggaggcgatcgatgaggcggtcagcgcgggcaatcccgcagtcctttcctatgtacgacgtgagggtcgctcctggcagctcgccgccgggaccgccgacctggcatccggccgggccgcccagcccggcgaccgatggcggatcttcagcaacaccaaatcattcgtcgccaccgttctcctgcagttggagggcgagggacgcctgagtctggacgacagcatcgagcggtggctgccgggtgtcgtccggggcaacggcaatgacggccgacggatcaccgtgcgccaacttctgaaccacaccagtggcatctacgacccgggcaacgatccggtcttcggcaccgacaagggcgggcacaccccagagcaggtggtggacgccgccatggcccatccgccgctgttcccggccgggcagcagtgggactactcgaacaccaactacctgctcgccggcatgatcgtcgaggcggtctccggccatgccgtggacaaggaaatcgagcggcggatcctccgcccgctaggcctcaagcacacgtccttcccgctcaccgacccccggattcccggcccgcacctgcacgggtacgacatgggttatcgcgacgtgacgcacttcaacccgtcgggggagtggacagccggggcgatgctttccaccaccgctgacctggcgcgcttcgacgccgcgctgttcagcggccggctgttgaagcccgtccagcagcgtgagctgcagacgacggtgttcgaacagaattatgggctcggggtccagcaagggacgatcccttgcggcgacgcccaggtgacggtctggcagaccgacggcggtggaccggggttcaccagtctgtcgatgacgactcccggcgccgcgcggcaactcgtgctcgtcgccaacgtcttcgacctgggccgtgaccagcgggacattccgggcgaggacccgaccccggacgcccgtcccgcctacttcaaggccatcaccagcgtgttctgcccctga

SEQ ID NO: 7891 - DNA, 1449 bp, Actinoplanes utahensis
atgcgcggcgccaccgaaagccaacaatccggtcgccatcgtgcctgcacagatcgtttggagtgcggtcgtcttcatgttcgctccttcgtcgaggtccggcttcgactcttccggttcgacggcgtcgattcgaccaggcagtccccccaatcgacccccgggatatcccggtatccacaacgggggctcaccgggtgttccgtccccgcccggtcggccattctggacgccatgaagcggttctcgtacgccatgctcggcttgccgttgggcctgttcggcctgttctacgtggcgttcgccatcgttgccgggtcggccttgtcgttcacggtggtcgggctgccggtgttggccgccgggctgcgcggcgcccggctcctgggcacgctgcaccaccgtctagcccgacggctgctcggattcgcgggtgccggaccgaccactccgccgacgggcgcgggcttcttcgactggctcaagaccggcctgaccgatcgcgccggctggcaggctgcggtctacctgctgatcaaagcgccgctggccgtgctcaccgccggagttgccatcttcttctacggctacgggatcgcggggatgacctatccgctctggtggaaactcgtgccgatacaggacggccacgccggggtgccgctgcccggcaatatctatctcgacaactggggccgagccgcgctgatctcatcgctcggcgcggggctggtcttggccgctccccgcatgctgcgtgccgtattgctcttcgaccgcctggccatcggcgccctgctcggccccggcaagctccgggaacgggttcgcgagctggaggagagccgcgcgttcgcggtccaggacaccgccacgatgctccggcgcatcgagcgcgatctgcacgacggcgcccaggcccggctggtggccgtggccatgggcctcggcgatgccaaggaacggctggaacagaccaacgccgacccagcctcgcggagactgatcagcaaggcgcatcaggacgcgaaggcggccatcgtcgaactgcgcaatctggcccggggcttccatccgcccagtctggacagcgggctcgacgtcgccttgaccacactggccgcgcgcaatgccatcccggtggagctgagtgtcatccttccccggcggccgccgctggcggtggagacgatcgcctacttctgcgtggccgagcttctcaccaatgtggccaagcacagtcgggcccggcacgctacagtcgccgtccgcggtgaacgggacaggttgcgattggtggtcagcgacgacggccagggcggggcccgccccagcggaggcctcgtcggcctcgccgatcgcgcacgcactgtcgacggcacgctcaaggtcgacagtccgcccggcggaccgaccatcgtgaccgtggagctgccgtgcggatcgtga

SEQ ID NO: 7892 - DNA, 672 bp, Actinoplanes utahensis
gtgcggatcgtgatcgccgaggacgccgccatgctgcgggccggtctgaccgacactctggtcaaccgtgggcatgaggttccggcggcagtcgccgacggtgacggcctgctggccgcggtggcgaagcaccgaccggacgtggcgatcatcgacatccggatgccgcccacccacaccgatgagggcctgcgcgccgcgatccagatccggcgtgatcacccggatgtcggggtcatgctgttctcgcagtatgtcgagagcaggcacaccaacgccctgctccgcggtggggcgcagcgactcggttacctgctcaaggatcgcgtcgcggacgtcagcgagttcatcgatgcactggcccgggtcgctgccggcggcaccgtcctggatccggaggtggtcacacaattattcaattcgggggcgagccgtgggcggctgtccggtctcaccggccgagagcgtgaggtactggccctgatggccgagggccgatcgaacacggcgatcgccgagcagttggtgctcgcctatgcgtccgtcgagaagcacatcaccagcatcttcaccaaactaggtctgccagcctcggccagcgatcaccgtcgtgtcctcgccgtcctgcagtacctgcgcgtcgaaaccctcaccgaccccgccgccacctga

SEQ ID NO: 7893 - DNA, 609 bp, Actinoplanes utahensis
gtgattgggtgggcggggtcagcgctactggtgtggtcgctgatgcagacccggctgctgcgcctgcgggctttgaaccttgtgggatgtttggtactgatcgggttcaatgcggccctcggggtttggccgatggtggggctcaatgtggtgctgtcggtgatcaacgtttggtatctggtgcggatgctggctactcggcacgacgagaaggcttatcaggtggtggaggttcggcctgatgacggggttctgacgcatacgctgcagcggcatcatgacgacattgtccggttcaatccggattttgtgcctcaggagctgggcgggcgcgaggcggcagccttcctggtactcaacgctgacgaggtcgctggcgtggtggtgttccacgtggcggacagcggggttgcccaggtggagcttgactatgtcaccgagcggtatcgggacttcacaccaggggagttcgtctttcggcggagccggttcttcgcagatcggggctgccacacggtgatcactccgccgggcatgcaggcgccttactacgggcggctgggcttcaagcgggacggcgaatcgtacgtgctggagctggctggctga

SEQ ID NO: 7894 - DNA, 1065 bp, Actinoplanes utahensis
atgtccttcagctggccgtatgccctgaccgcgctcctcctcgtcccgctgctgccggctgcgcgctggtggttcaaccgtcgtcggaagcgggccagtctcgtggtctccgatctggggcttgttcgggcggctgtgcccgggcgcggtgcctggcggcggcggataccggcggcgctgttgctgtgcgggatgctggcgctggcgctcggtgtggcccggccgcaggcgaccgttgccgtgccacgggcgaacgcgtcgatcctgctggcgatcgacgtgtccgggtcgatgtgttcgaccgatgtggcgcccaaccggctggccgcggcgatcgacgcggctcggacgttcatcgaacgcagcgatcgggggacgcggatcgggctggtggcgttctccgggaccgccgggctggtggtggcaccgaccaccgaccgcaaggaactgatccgggcggtggggcggttccggacagcgttggggaccgccatcggggaggccattctcaccgccatcgatgcgatcgccgagtacaacccggcggtggccgcgagtggggtggatctgatcagtgacaacagcggcgggtttcagccggacacgatcgtggtgctgaccgacgggtcgaacaccaccggggtggatccgctgatcgccgccggtcaagccgcggcgcggcatcttcgggtgttcaccatcgggttcgggacgacgacgcccgggccgatggtgtgtgatccggggcaggtcaccagtgggtccttccggggcgggccggatccgggcggggcaggcggcgggagcgcgtccgggcagtcgctggaaatcgatgagaagtcgctggtggcggtggccgagacgaccggcgggcggtatttccgggcggccgacgccggacagctcaacagcgtcctcaccgacctgcccgccgagatcgggctgcaccggcagaagaccgagatcaccatgtggtacgtcctgggcggcaccctgctcaccttcaccgggctgacgctgtcgctgtggtggagccgtcccagcctgaaacccacccgaaagtga

SEQ ID NO: 7895 - DNA, 654 bp, Actinoplanes utahensis
atggggcgacttccggccgggcacgcagccgcccggcttcgggcaccgaagcggaccgaggcggggcggcaccagctgatcgacgcggtctgtgcggtggtggccgagcgcgggcatgagaacacccggttcaccgatgtggcgcagcgggccggcacgtcgatcggcagcctgcagtatgcgttcggcacccgggagaacatggtcgccaccgcgctggacgagcggaccaaccgctacctgaccgagattcaggcggccggttccggaatcgccgatccgctggcccggctccgctggctgggcacccatctcgcggccggcctgggtggtgacgacgcggcccggctggaatggctggtctggaccgaatgctggcgggcctcgctgcgcgacgaccggctgaaggcggcttcgacggcgcagtaccggaactggatcgcgatgatcaccgaggcgatcgaggactgcgtgacggccggcgtgatcgccgaaccggacgacactcatgcgatcgccgcggcggcgctcggtatggctgacggtctgggtgtccaggtgtcgttgagcgaccgtgacttcggctgggaggacgccagccggatggtccgttcctggctcgccctgtccctgaactgccccgacctgcgctaa

SEQ ID NO: 7896 - DNA, 1362 bp, Actinoplanes utahensis
atgtacgagcaagcggatgtagtcgtcgtcggcgccggggtcaccggcctcaccgccgccacccggctggcggcggccggcttgacggtcaccgtcctggaggcccgtgaccgggtcggcggccgcctgctcggtgccgaggtcgacggtgtccccctggagctcggcggccagtggatctccccggaccagaccgccgccctggcgatggccgaggagctgggcctggacacgttcccgcgctaccgcgacggcgccaacgtctaccgcgatcgggccggggtccggcacacctacaccggcgccgcgctgcccgtgtcggcggcgaccgcccgcgcgatcgaggcgatcagcgacgaggtggagcgcctggccgccgagaccgacccggaccgcccgtgggcgcacccggacgccgagcgcctggacagcatctcgttcgccgactggctcgggatgcgcaccgacgaccaggaggcccgggacaacgtcgcgatgttcctggcctcggcgatgctgaccaaggcggccgacgagttctccaccctctcggccctgcacatggcggccagcgccggcggtttcagccacctcaccgacgagaatttcgtcctggaccgccgggtcgcgggcggcctgagccaggtcccgcgcctgctcgccgagcgcctgggcgacatcgtccgcttgaactcgccggtcgagcggatcacctgggacgcggacggcgccacggtcgccacggcggacggcagcgtgcgcggccgccgcgtgatcctcgcgctgccgcccaccctgatgggccggatcaccttcgagccggcgctgcccgaggcgcagcggcaggcgcaggcacaccagtcgttcggcacggtgctcaagatccaggtggcgtacccgacgccgttctggcgcgcggccggcctgtcgggcaccgggttcagcccgtaccagatcgtgcacgaggtgtacgacaacaccaacgacgaccgccccgaggaccgccgtggcgtgctcgtcggcttcgtctcggaccggcacgcgcgggcgctgctcgacctctcccccgcggaccggcgagccgccgtgctgaactcgctggcctcctacttcggcgacgaggcccggcagccggtggcctactcggagagcccgtggctggacgagaagtggaccggcggggcgtacggcacgagcttcgcgatcggcgccttccacgagtacggccggcacctgcgcgaggagaccggcccgctgtcgttcggctcggcggacgtcgccggcctcggctatctgcacgtcgacggcgccatccgggtcggcgaggaactcgccaacgcctccatcaaagccctgaaatag

SEQ ID NO: 7897 - DNA, 981 bp, Actinoplanes utahensis
gtgatccacgtcgttctcctgctcgcctgtgccgtcgtcatctacctcgcctgcgagtggttcgtcaacgcggtcgagtggctcggcgtccgcctccgggtcggcccgctggccgtcggcacgatcctggcggcggccggcaccgccctgccggagagcgtggtcaccctgatcgcggtcctcttcggcggtggccatgccggtgacgacatcggcgtaggcgcggcgctcggtggcccactagtggtcggcaccatcgcgtacgcaataaccggcttgatgcttttgattgtcaaaatgccggacctgggaggcaccgatctgacccggctggcccgcgaccagacctggttcctggccatcttcgtgttcaagatcggtctcggcctggtcgccttcgccctcaaaccctggctcggcctgctgttcttcgtcgcctatgcgatctatttccgcaaggagacggccgacaccggcgacgccggcatcgtggacgatctggagccgctgaagctgcagccgcggcgggagagcccggccaccctcgcggtgatcgtccagagcctggcgacgctggtcgtgatcttcctggcctcgcagctgttcgtccggcaactcgcctgggccggtccggcgatgggcctgtccccggtggtcgtcgcactgctgctgtcgccgatcgccaccgagctgcccgaggtgatgaacgcggtgatctgggtgcggcagggaaagacgccgctcgcgctggcgaacatctccggcgccatgatgatccaggcgacggtgccgtccggcatcggcctgctcggcaccgcctggcgcttcgacaccccgctgatcctggccggcaccgccaccatgctgtcggtcgtctatctgctgatcctgttccgcaccggccgggtcaccccgcgcctgctctgcgtcgccgtcgtcttctacctgctgttcgcggcgggcctgatcgccgccggttag

SEQ ID NO: 7898 - DNA, 924 bp, Actinoplanes utahensis
atgccgtttcgtatccacgccgggcatctcgcggcgctgcgggcccggctcgggcggatcgccgccggtgtcggcgagttcgagcaggaccaggccgcgttcggtgcctggtgcggctggatcctcaccgggctcggcgaccgggtggtccggcacggcgagctggtcgcctacatcgaggagaccctgctgctgttcgtccaggggttccaccgggtcgcggacggctcggagaccttcggcgcgatgatcggcatgccggtcgacgaggacatcacggtctacgactcggccaccgagatcatcgacggggtgctcgacacggtcgccgcccgggagtgggtggagccgctgctcgccgaggccgccccggtcgccgaattcgccgccccggtcggcgacctggtcggcgcgctgcgcgtgggcgggctccactgggcggtcacccacgtgcccgagctgcggcagatgctcgacgacctggccggcgcccccgacgtggtggcccggcaggccgaccggtgggggcggatggccaccgagctggaacggatcgccgacgacctgcaacgctgcctcgaccacgacttccgcggccggagcagccccgaggtccgcggctacctggccatcatgtcgaacaatgtggtcggcctgcgcggcctggtcgccacctccaccgcgatgaccgccctcaccaaggccgccggtgacctgatcctgctcacccgcgacatcgtccgcggcctgatcggcgacctgatcgcccgggtcgccggctggtccctggaatccgaggtcgtgccgctgccgctgctcaccgcccggctggcggtcgtggccaccaccgtgcgccgcgtcgacgcctacctgaacgccctggtcgtcagcatcgccaacctgtcccgctcgatcggcggctga

SEQ ID NO: 7899 - DNA, 789 bp, Actinoplanes utahensis
atgggaatgctgcggctctaccgccggctgctcggcgcccacctgcggtccatgctcgaatacgagaccgacttctggttgctcgccggtgccaccgtgctcacccaggtggtcaacgtcgtcttcctgtccgcgctgttcgcccgggtgccgcggctcaacggctggagcttctgggcggtggtgatgatgttcggcgcggtcgccgtcgccgagggcgtcggctcgctgttcttcgagggcatgtggcgcatggcgtggcaggtcaaccagggcgaactggactacttcctggtccggccctacccggtggtgctgcaggtgagcagcgccgagatcggcgtcaacggggccagcaacatcgtcaccggcggtctgatgctcggcgtcggcgccgcgcacgccggcgtcgactggacctggtggcgggtcgccctggcagtgctcctgctggccggcgcgtgcgtgatcaaagtgtcgatcaacctggccaccaacgccgcggtcttctggctgagcagccccaccccgttgttcgggttcgccgtccaccagatcggcgacctcgcccggttcccgctgtcgatctatccggcggcgctcaaaatggtgctcggagtggcgttgccgttcgcgttcgtcagcttcttcccggtcgcctacctggtcgacgccggcgcggcgccgtgggtcggggtgctcaccccgctggtcgccgcctactgcctgggcgccgcactgctgatcttccgccgcgggctgcgccgttacgagagcgccggcaactga

SEQ ID NO: 7900 - DNA, 789 bp, Actinoplanes utahensis
gtgagggcctaccgggcgctcgcgcgggccacggcgcggtccgccctggcgtacaagaacaatctgttcctgggtctcggtgccgtcttcgtgcagttcatcgcgatgctcgcggtgtggcgggtggtgctcgccgacgggtccgcggtgcagggcttcggctggccgcagatgcgcgcctacctgctggtcgcgttcgccgccggcaccctggtctcggtgttcggggacttccgcaccgccgcccggatccagagcgggctggtcgcgctggacatcatcaaacccgtcgacttccagcgggcccggctggccgagacgctcggcgggacgtggctggaagcgctggtcgtcgtggtggtggggggcgtgacgctggccctcaccggcggggtgccgaccccgcccggcgcggcgctggcgctgttcgcggctagcatgctgatgctcgtaccgctgaaattcctgatcgtctatgtgagcacgctggcctgtttctggacgcagaacttcatcggcgtgcagtgggcccggatcgcgctggtcaacctgctgtccggggcgctgatcccgctcgccttcctgcccggctggctggccgcggtcgcccagtggtcgccgttcgccgggctggtgtccacccccgcgttgatcttcgtcggtcaggtcggcgtcggccgcggcctcgccctggtcgccgcccaactcggctgggtggtggcgctctggttcggcgcccggctgatctggcgggccgccctgcgccagctcaccgtccacggaggctga

SEQ ID NO: 7901 - DNA, 1020 bp, Actinoplanes utahensis
atgtcgatcgtggaagctcgtgggctcaccaaggtgttccgccggcccgacaagggtcccggcctgaccggctcggtgcggcacctgttcacccgccgctaccaggacaaggtcgcggtcgaccgggtcgacctgtcgatcgaggccggtgaggcggtcgcctacgtcgggccgaacggggccggcaagtcgaccaccgtgaaactgctcagcggcatcctggtgccgaccgccggcgaggtccggatcgacgggctgcacccgcaacgcgaccgcaccgcggtggcgcaccggatcggggtcctcttcggccagcggacccagctgtggtgggatctgccggtcgccgagtcgctggccgtgctgcgcgacatctacggggtgcccgacgcggcgtaccgggcccgcctggcccgcttcgaggaggtgctcgacctcggtgggatcctgccgatcgtcggccgcaaactctccctcggccagcggatgcgcgccgacctggccgccgccctgatccacgggccacaggtggtctacctcgacgagccgaccatcgggctcgacctggccgtcaaggaccgggtccgggagttcttccgcaccctgcgcgacgagggcaccacggtgatgctgaccagccacgacctggccgacatcgagggcttctgccgccggctggtgatcatcgacgagggtcggatcatcttcgacggcgacctgcagagcgtcaaggaccggttcgcccgcgagcggatcctgcacgtggagaccgagcagccggtgccgctggacacgctcgccgcggcgctgcccggcgcggcggtcaccgcggaggagaccccgacccggttcgccgtacgattcgatcggttcgccatgaccgccgggcaggcggtgaccgcggtcgccgggctgaccagcctggtcgacttccggatggacgagcccgggatcgaggacgtgatccgccgggtctactccggagagctggtcctcgacgagaaccgggcggcccggtga

SEQ ID NO: 7902 - DNA, 849 bp, Actinoplanes utahensis
atgccacgtatcgcggtgaccggcggcggcggcaagctcggccgcgccgtcgtccaggacctgctcgaccacgacttcgaggtggtcaacctcgaccgggagccgccccgggacccggtgtgcccgcacacccgggtcgacctgaccgattacggccaggtggccgaggcgctcaccgcgatcgacagccgctacaccgggatcgacgcggtcgtgcacctggccgccatcccggggccgggcgtggcgaccaacgcggtgaccttcgccaacaacatcaccgccagctacaacgtcttcgccgcggcccgggcggccgggatcaagcgggtggtgtgggcgtccagcgagaccgtgctgggcctgccgttcgacaccccaccgccgtacctgccggtcgacgaggagtacgcggcccggccggagacgtcgtactcgctggccaagcacctcgacgagcagatggccgcccagttctgccggtgggaccccgagctcacgatgatcgggctgcggttctccaacgtgatggagccggacgactacgccgccttcccgtccttcgaggcggacccgcgccggcggatctggaacctgtggggatacatcgacgcccgtgacggggcgcaggcggtgcggcgggccctgtcgtacgaccgctccggtctggagatcttcatcatcgccaacgcggacacggtgatgagccggcccaccgcggaactggccgccgagtacttcccggagctgccgctgacccgcgagatcggcgagcaccagacgctgctctccatcgacaaggcgcgccgcctgctcggctacgacccgcggcacggctggcgccgatga

SEQ ID NO: 7903 - DNA, 159 bp, Actinoplanes utahensis
atgaaccccgcgcggcggaaatatcggcggatcaccttcatgatgtccgatgccgcggccgacctcggatcgtcgctccggtggcggccgggtcacgatgatccggccgccggcgcggcccgggcgatcatcgcgaccactcctcgcggttcctgctga

SEQ ID NO: 7904 - DNA, 846 bp, Actinoplanes utahensis
atgtctccgaacaggttccggaagcggatcgcgctgaccgccgccgtcgccgtcgtgaccggtggcgccctgctcatcgtgcagaacagcttcgccgcgacgatcccgggcgccggcgggagcaccgccggccggcccgccacctccgcggcggccggcaccgccgcacggccgggtgccgccacccgcgccctgcccggcgccggcacccgggtcgcctcgaccggcgatcaggccgggaagtgtccggatgtgcacatcatcgtgacgcgggcctcgaccgaagcgcccggcaccgggatcatcggatcgctggcgaccgcggtgacccgggccagccggcagaccgtgaccgtggaggccaccgactatccggcggcactgaacccgtacccgccgagcgtcgccgccggcaccagggccctcaccgcccaggtcaccgccgaggccgggaactgccccggcaccaggatcgtcctgatgggctactcgcagggcgcgcatgtgatcggtgacgtgctggccggcaccggccgggtcgccggcttcaccccgaacgccgcgctgtcgaagaagaccaccgaccacgtcgccgcggtgatcctgatgggtgatccgcggtacgtgccgggcaagtcgttcaacgccgggacctcgaagacccgcggcctgttcccgcgcggcggcgacgcgccgctcgacgccttcgcggcacggacccagtcctactgcgacaccggcgacacgttctgcgccggcggccggagcgtcgcggtgcacctgagctacacccgcaggtacaacaccgccgcccgggacttcgtcctgaaccggatcggcggctga

SEQ ID NO: 7905 - DNA, 945 bp, Actinoplanes utahensis
atgggtcgtggcgccgaagctgggcgcatgggtccgttgctggttcttctctcggccgcgtgtttcggcgcgatggcgatcttcggaaaatgggcgtacgacgtgggcgtcacccccggcaccctgctgctggtccgcttcacgctggccgcgctgctgctggccatggtgctggcggccggtcccgcgctgcgccggatgccgccgggcgggggtcgcggccgggccgtgctgaccgcgctggggctgggggcggtgggctacgccgcgcaggcctcgctgtatttcgccgcgttggagcggatggacgcctcgctgctggcgctgatcctctacacctatccggttctggtgaccatcggcgcggtgctgctcggccgggaccggctgacccggggccgtgcggtggcgctggccgcggcgtccggcgggacgctgctggtgctgggcggggccggcggaaccggcttccggccggtgggtgcggtgctggccttcggcgcggcggtcacctacaccggctacatcctggtcgccgacaccgtggtccgccggctgccgccggtcgtgctgtccgccctggtgatggccggcgcggcggtgaccctcggggtacgcgcgctgctcaccggcggggtgcacttcggcttcccggcggccggctggctgtggctgggctgcatcgcggtggtgtccacggtggtggcgatgctcgccttcttcgccgggctgcgccgtaccgggccgtcggccgccgccatcctgtcgaccttcgaaccggtggtgaccggtgcgctggccgccctgacgctgggcgagcgcctcaccccggtgcaggtggcaggcggcgtcctggtgctggcctcggtggtgatcctgcagaccggcccgggaacgggccggtccgcggaccgggtccggcgcgacggccgggtggccgcctga

SEQ ID NO: 7906 - DNA, 270 bp, Actinoplanes utahensis
atggtcgccctggatctgcgccggctgcggttcctgcgcgagttcgaggagcgcggcacgctcggcgccgtcgcggcagctctcggctacagcccgtcgaccgtgtcccagcagctggcgctgctggagaaggaggtcggcgccaccctgttcgcccgcgccgggcggggactgcggctcaccgacgccgggcggctgctggccgggcacgcgcgggtgttgctcgccgcggccgaggccgccgaggccgacctggcggcgcctagctag

SEQ ID NO: 7907 - DNA, 543 bp, Actinoplanes utahensis
gtggagatctccgaactggagctggagcaggccctgccgagcctgcgcctgggcgcggtcgacctggtgatcggtgacgagtacgacggacatccccgcccccgcccggccggactgcgcttcaccgtggtgctcgccgagccgctgcggctcgtgctgccggccgcgcacccgctggcccgcgccggtgggccggtcgccttcgccgacctgcactccgcggtgtggacgagttccgccgagggcaccgggcaccacgccatggtggtcggcacctgccgggcgctgggcggctacgagccggatctgcggcaccgctcaaacgatgcggacgtgcagctggagctggtccgggccggagccgcggtcgcgctgatgccaccgctggcgctgccggtcgccgacccggcactggccgtgcgggaggtcgccggggccgcgctgggccgccgcctgatggccgtcacacggcagtccgctgcggcacccgccctgcatgccttcctcgacgcggtccgggcgcaggcgcggtccatcgcctga

SEQ ID NO: 7908 - DNA, 876 bp, Actinoplanes utahensis
gtgctgaagctactcgcgatcgtcatgctgatcgtcctgggcgcggcccggcccgcctacgccatcgcgtacggcgagaccgccgaagacggccggtacgcgttctccacccggctcaccatgaccggcatcccgaccgaggagaacgggacccgggacagctggtgctcgggtgcgctgatcgccccgcgctgggtgatcaccgcggggcactgcttccgggacgcggccggccggcacgtgtcccggacggtggccgaccgcaccaccgcgacggtcggcggtcaggagatcgaggtggtcgccgtcgtgcaggccggtggcgccgacgtggccctggcccggctggccgccgaggtcaccggggtgacgccgctgcgggtcggcgacaccgcgcccgccgagggggagcaggtgcggctgaccgggttcggcttcgccgacgaccaggggacggtgccggcccggatgcagaccggtcagttcgtcatcgaccaggtcggcgagcagctgctgcagatctccgggcgggcgccgcgccgagcgaccagcgcctgcctgcacgactccggcggcccgtacttccgggagcgccgagggggcgcgccggaactggtggcggtggtcagcgggggaccggcgtgcccgcacgagggcccggacagcagcgcgcgcaccgacaccctggccggctggatcaccgcgacggtcacggcggcgcccggaccggacgtaccgctgatcgtcgtcgtcgccgctctcggtcttctgatcgtcgcgggggtggtgaccggggtcaggcgatggaccgcgcctgcgcccggaccgcgtcgaggaaggcatgcagggcgggtgccgcagcggactgccgtgtga

SEQ ID NO: 7909 - DNA, 798 bp, Actinoplanes utahensis
atgacgatcgcgagtagcttcagcacagccgtcgatgcttccgggcgggtggtacgggcgtcgtcagcgacgtacttatgcgatctttatcagtgttttggtgtggtgggcaaaagcggggcaacgggaggacgcggcgtgcgggtgttggtcgccgaggacgagcggattctggccgacacgatcgccgaggggctgcggcggttcgcgatggccgtcgacgtggtctacgacggcgacagcgccgtcgaacggctctcggtgaaccggtacgacgtcgccgtcctcgaccgggacctgcccggccgcagcggcgacgacgtgtgccggcacctgaccgcctccgacgccggcacccgggtgctgatgctgaccgccgcggtcggcatccgcgatcgggtcgagggcctggggttgggcgccgacgactatctgaccaagccgttcgccttcgccgaactggtcgcccggctgcaggcgctgtcccggcgcccgtcgaccgcgctgccgccggtgctcgagcaggacggcgtcgtcctcgacatcacccggcacaccgccacccgcgacgggctgctgctgtcgctgaccccgaaggagttcgccgttctgcacgtgctgctgcgcgccggcggccgcctggtcagcgccgaggacctgctcgaacaggcctgggacgagaacgccgacccgttcaccaacacggtccgggtgacgatcatgacgttgcgccgcaagcttggcgacccgccgctgatccacaccgtgccgcgcgccggttaccggctcggcgcgtga

SEQ ID NO: 7910 - DNA, 720 bp, Actinoplanes utahensis
atgaccgagattcttctggacgaccggggcaccggtaagccgtatctgctgctgcacggcggtggcggggtggccaccatggcggggctcgccggccggctggccgcgcgacccgggacgcgggtgctgctgcccacccaccccggcttcgccggcacggtccagcccgacgggttgcgctcggtgggcgacctggcccgggcctacgtcgcgctgctcgacgagcgggacctcaccgacgtgaccgtggtgggcaactcgttcggcggctggctggccgccgagatcgcgctgctgcgcagtccccgggtcagcggcgcggtcctgatcaacgcgatcgggatcgaggtcgccgggcacccggtcgccgacgtcggcgcgatgaccccggccgagctggccgcgcacgcctggcacgacccgtcccgcgcccccaagccgccggccgccgggggcaccggccccagcccggacatcctggcgctggtcgcctacaccggcccggtgatgaacgaccccaccctgctcgaccggctgcggaccctcgacctgccggtccacgtcatctggggcgccagcgaccgggtcgtcgacgtggcgcacgccgaggcgttcgccgccgcgctcccgcagtccaccctgaccgtgctgcccggctccggtcacctgccgcagctggagacgccggaggagctggtcgcggcactgctcggcgactga

SEQ ID NO: 7911 - DNA, 447 bp, Actinoplanes utahensis
gtggagcagggtgcccaggtcgtcgagctgggtgggggtgagggcggcgaaggacgtcgcgacgacctcgtcggcgagctgctggccggcggcccgcaggcgttcgccctccggggtgaggcggtgtctgacggcccggcccggcccgggcacgcgttcgatcaggccgcggtcgaccatgcgggtggccagggagccgaaggactggtcggtctggaaggtgcggacggccaggtcgtgcagcgaggcgtccgggtgccggtgcaggtggcgcagggtgtcccactggggcagggacaggcccagtggagccagtgccgcggtcagggcgcggtggtggcggtgctggaggcgtttgacggccagggcgacgtcggcggggcggtagggcaccggtggatggtaactcgggaaactcaggttgcgtatataagcttccttatctaa

SEQ ID NO: 7912 - DNA, 831 bp, Actinoplanes utahensis
atgtcgcagcccggatcacccgccaaccgagccacctcagacccgctgacggcgaacccgctggataaccagacggaggacggactgcgcgatctcatcgccaaagtcccggccgtcactgtcggcttctgggttgtcaaggtactggccaccactctcggcgagacaggcggcgactcgctgtccatgtccatgcgcctgggctacctggtcagcaccatgatcttcgcggtggtgttcgtggccgccgtcatcctgcaggtccgggcgacacggttccatcaatgggtgtactggttcaccatcgtcgcaaccacgaccctgggcaccacgatcgccgactacgtcgaccggtccctcggactcggctaccctggcggcaccaccatcctggtcatctgtctggcgtgctcctttgccctctggtacaaagccaccggcaccatcgccgtgaccagcattcagaccccgcgcaccgaagcgttctactggctcaccatcctgttctcacaaaccctcggcaccgccctgggcgactggaccgccgacacgatcggcctcgaatacaccggcggcgccctgctgttcaccgctctgctggccatcctcgccgccgcctaccggtggacccggctgtcgcgcaccctgctgttctgggccgccttcgtcctcacccgcccgctcggcgccgtcgtcggtgactttctcgacaaacccatcgccaaaggcggcctcaacctcgaccgctacgccgcctccgccgcgctgctcatcgcgatcgtggcaatcctgttcgcccgacgccaacacccggccacacgcccacactga

SEQ ID NO: 7913 - DNA, 399 bp, Actinoplanes utahensis
ttggcactcgacgggcaggtgtcggacccctatcctgacacctcggagaacaccggggtaacggaaggtcacgcgatgacgaccaccacggtcgacgtcaacaccagcaccgacggcactctcatcattcatccgcacggcgctctcgacgccaccgacgccgtcggactcagccgcaccctcgtgcaggccatccgccgcacccgcccactgcgtctcattctggacctggctgacgtccacgatctcgacccgatcaacctcggcacgctcgctgccgcgtgccaccttggtgatgatcaccaggttgccgtgttcctcgaccacagctcagcacgaatcgccgaagaactgaccgaagcgggtgttccccgacaccgcctgcgcaacatcatttga

SEQ ID NO: 7914 - DNA, 129 bp, Actinoplanes utahensis
gtgtcttactcgcggacgccggtctccaccgcccggataccgaaccgccggctgaccggcatcggcctcgcgttgcgcggttacgtcgctatcctcgccgtcaccgctacgcaaatgacctggccgtga

SEQ ID NO: 7915 - DNA, 834 bp, Actinoplanes utahensis
gtgagcgcgcgccggccgatcctgtcgcacctgttcctgatctgctgggcggtgctgaccacgctgccgctgctgtgggcggtgctcagttcgttcaagagcgacaccgagatcctcaccgacccgtggcgcccgccgtcccggctgcgctgggagaactggacccgcgcctggacctcggcccacctcggccgctacttcgtgaacagcgcggtggtggtgaccggcgcgctgaccatcaccatgctgttcggcgcgatggcggcgtacgtgctggcccgctaccggttccgcggccatcggatcgcctactacgcgttcgccggcggcatgatgttcccggtcttcctcgccctggtgccgctcttcttcgtggtccgcgacctgggcctgctcggcacgctgcccgggctcaccctggtctacgccgcctattcgctgccgttcacggtgttcttcctgaccgcgttcttccgcaccctgccgggcgccgtcgccgaggccgcgatggtcgacggctgcggccacctcggcctgttcttccggatcatgctgccgatggcccgccccggcctgctcagcgtcggcatcttcaacttcctcttccaatggaaccagtacgtgctgccgatcgtgctgatgcagggcgagggcgccgagagccggtgggtgctggcccagggcctgaccgcgctcgccgtcagcgagggttaccgcggcgacttcagcggcctgttcgccggcatgaccatcgccatgctcccggtcctggccgcctacctgatcttccaccgtcaggtccagagcggcctgtccgcgggccagctccgctga

SEQ ID NO: 7916 - DNA, 906 bp, Actinoplanes utahensis
atgcgcggcagacgaccgttcatcgcggccttcctgatcccgtccctgctgctgtacggcgtcttcgtggtgtcgccgtacgcgcaggcgttcccgatcgccggcaccgactgggcggggctgtcaccgtcgtacgacttcgtcggcctggacaatttccggcggctgctcggcgacgcgtacttctggaccgcgctgcggcacaacgggctgctgctcgtgctgctgccggtggtgacgatcacgctcggactgttcttcgcctcgatgatcagcgtggggggacggggcgaccgggccgggatccacggcgtacgcggctcgggtttctatcgggtggtctacttctttccgcaggtgctgtccgtggccatcgtcggcgtgctgtggaaacagatgtacgggccgaacaccgggctggtcaacggaacactgcgcgcgatcggcctggaacggttcaccacgccctggctcggcgacccgcggttcgcgttctggtgcgtgttcgccgttctcgtctggatgaacgtcggcttctacgtggtgctgttcagcgccgccatgcaggccgtgccgcgggacctgtacgaggcggcgctgctggacggcgcgaaccggctcaccaccctggtccggctgaccgtgccgctgctctgggacaccatccaggtggcctgggtgtatctggcgatcatcgcgatggacggattcgccatcgtgcagctcgtcaccgacggcggccccggatcggcgtccgacgtggtcggcctgcggctctaccggacggcgttcggcgacggccgcttcggctacgcgtcggcgatcggggtggcgatgttcttcctgaccctcaccgtggccgcgatgttcctgcgggtcacccgccgggagacggtggagctgtga

SEQ ID NO: 7917 - DNA, 1407 bp, Actinoplanes utahensis
atggagtacgacgtgagcaggcgcgacctgctccggtgcgccgccggggtggccgccgtgggcgccctcggcggatgcgccctgggcggcggcgacgtgcccggcgaccccaccgtgacccggccggtcagcgcggccaacccgctcggcgtgccggcggacgcccccctcgaagtggtgatcttcaacggcgggttcggcgaggactacgcccgggagcacgaggcgcgctaccggcagcggtacccgcgggcgcggatccggcactcggcgacccagcagatcgccgagacgctgcaaccccggttcgtcgccggcgacccgcccgacgtggtcgacaactccggcggcagccagatcgacttcaacgcgctggtcggccagggcgcgctggccgacctgaccgacctgctcgacgcgcccagcctggacgacccgaccgtgcgggtgcgcgacaccctgctgccggggatcgtcgaggtggggtcgtacggcggcaggttcctgaccctcaactacgcctattcggcgtacgggatctggtattcgcgcaagctcttcgaggcgcgcggctggagctatccgcgcacctgggacgagatgatcgccctgtgccggcggatcaaggcggccggcatcgccccgtggacctacccgggggtgcatgcccgatacatgagctggccgatcctggcggccgccgccaaactcggcggcctcggcgtgctcaaggcgatcgacaacctggagccgggcgcctggcgccacgaggcggtgcggaccgccgccgaggcgtaccgccagctggccgtcgacggattcctgcagccgggcgccgccggcatggaccacatccaggcgcagaccgaatggtgccgggggcgggccgccttcgtctcctgcggatcctggctggagaacgagatgaggtcggtgacaccgcccgatttcgcgatgaccgtggcacccacccccagcttcaccgctaccgacagcatgccgttcacggcgttccgcggcaccggcagcgaaccgttcatcgtcccggcgaaggcgaagaacgtccgtggcggcctggaatacctgcgcatcatgctgtccaggacggccgccgccgccttcaccacccgggtcggcagcctgaccgcggtggccggcgccaccggggggcagccgctcagcgccgggctgaccgcggtcaccgcgatggtcgacgcgtcccggggctcggcgttcacctggctctacgccacctactaccgcaagctggaacgggaacgggtgaacgcggccaccctcgacctgctgaccgggcgctgcaccggcgcccaatggtgcgaccggatccagcggtccgccgacgaatgcgccgcggatccgggtgtcaagaagtaccagcgggtctga

SEQ ID NO: 7918 - DNA, 1233 bp, Actinoplanes utahensis
atggtcaggctcgtgctcagcgtggcggtcgggctcgtcaccggcctgcccgcggtcaccccggccgacgtggcgttccggcacgacgtgctgcgcccgggcaccgccgcacaggccggtctgcgacccgctccgatcggcgaactgcgcgatgtcgcggcggcccacctgcggccgacacccgaccaccccgggcacccgtcgtacgccggtgccaccgtgctcgccgcgcaccacggcatcgtggtggcccgcttcgcggtgggtgacgcggtccgctacaccgcgaccgccgccgggatcgccgagctgccgcccgcccggcgcgtcccggcccgggtggacaccatctgggacctggcgtcgctcaccaaactgttcaccacgatcgtggtgctgcagcaggtgcaggccgggcgggtgggcctggacgcgccggtcgccgcgtacgtgccggagttcgcggccggtggcaaggccgcggtcaccgtccggcagctgctcacccacacctccgggctgcccgcgttccggccgctctacgccaccgagccgacccccgcggcccggctcgccgcggcgctgcgcacgccggtcaccccggggaccacgcccggccggcagtacgtctactccgacctcggcatgatcgcgctcggcgtgctggtcgaacgggtcacaggcaggcgcctggaccgggtggtgcacgacggggtgaccgggccgctcggcatgcgcgacaccggctaccggccggggcgcgcggcgcgtcaccggatcgcggcgacggaatatcagccgcacgtccatcgtggtctggtccggggggtcgtgcacgacgagaacgcctgggcgctgggcggcgtggccgggcacgccgggatcttcgccaccgtggacgacctcgccgtgctctgccagacgctgctcgacggcggcgagtaccacgggcaccggatcctgtccgcggcgatggtccgcgcggcgctcaccgcgaaccccggcggccgcgggctcggcttcgagctggccgcccgcacctacatgggcggcctgacgtcacccgtcactttcggacacaccgggttcaccggcacgtccgtggtgatcgacccggtgcgtcagtccttcctcatcctgctcagcaaccgggtgcatccggaccgggcgtggggcaccgacaccgcggcccgccgggcgctggccgacgcgttcgccgccgcccatccgtga

SEQ ID NO: 7919 - DNA, 1251 bp, Actinoplanes utahensis
ttgctgaaccgacgcgggttcctggccggcacggtcgccctgtccaccggcgccggcgcgtccgccccgccgtcccgcgtcccggtggtgaccggatcggatcggctggcggcggacggctgggcccccctgaaaggccagcggatcggcgtggtggccaacccgaccgccgtcgaccggcggtaccggcacgtggtcgacctgatgcacgcggccgggatcgagatcggcggggtgttcggcccggagcacgggttccgcggctcggcgcaggccggcggcggcgagggcaccggcaccgacgcgcgcaccggactgaccgtgtacgacgcctacgccgccgacccgcagcggtggctggcgatgttccgcgcggccggcgtgcggaccgtcgtcttcgacctgcaggacgtcggggcgcggttctacacctacatctacacgctgtacgactcgatggtcgccgcggcccggctcggtttgcgctacgtcgtgctggaccgtccgaatccgatcggcggacacgcggccggcccgatgatgaccgacggctacacctccggggtcggccggctccggatcgcccagcagcacgggatgaccgtgggcgagctggcccggttctacgacggcgagttcgtccccgccgcggccgggcggccggcccggccggaagtgatcagctgccgcgggtggaccggcgggctccgggccggcgacaccgacctgccgtgggtgctgcccagcccgaacatgcccaccccggacaccgcgctcgtctatcccggcaccggcatggtcgagggcgtcgccgcgctctccgaggggcgcggcaccacccggccgttcgagctgatcggcggccccggcttcggcttccgctggcacgaccgggtggccgcgctggggttgcccggcgtcgcgttccgcgaggcctacttcacgcccacggtcgacaagttcgccggccggctgtgcgcgggggtcgagatcaaggtcatcgacccgcgggcgtacgacccgatccgcaccgccgtgggcatgctgaccgaggcgcgccgggaggccgccttcgcctggcgggtcgacagtggcgcgacgtattggatcgatctgctcaccgggtcgtcccggctgcgcacgatgatcgacgcgggcgcgggcgtcgacgaggtgaccggggcgtgggccggtgagctggccgccttcgaccagcgccggcagccctacctgctctatgcgcgccggtga

SEQ ID NO: 7920 - DNA, 897 bp, Actinoplanes utahensis
atgaccggacgacagggcggcgacaccatcgtggtacgggcccgcggcctgctccccgcgctctcccccgccgagcagcgcgtcgcccgggtgatcgtcgaggaggccgacaccgcggcccggctcaccatcaccggcctggccgagcgggccggcgccagcgagaccacggtcatccggttctgccgggcgatgggcttcaacggatactcccagctgcggctcaccctggccgccgaggccggccgcgcgtccggggcggccggcgacgacgagccggtcggcagcgacatcagccagagcgacgacctcggccaggtggtcaagaagatcgccttcgccgacgcgcgggccgtcgaggagaccgccacccagctcgacctcgccgtcctggagcaggtcgtcgacctgatcgccggggcccgccgggtcgacatctacggggtcggcgcgagcgccttcgtcgccttggacctccagctcaaactgcaccggatcggccgggtggcctacgcgtggagcgacacccacctggccctgaccagtgccgccctgctcgacgagcgggacgtcgcggtcggcatctcgcacaccggcgccaccatcgacaccatcgacgcgttcgccgaggccggccggcacggcgctcgcaccgtcgcgctgaccaacttcccgaaatcgccgatcacccgggtcgccgacctcgtgctgaccaccgcggcccgcgagacgacgttccgctccggcgcgatggccagccggctggcccagctcaccgtcatcgactgcgtgttcgtcggggtcgcccagcgcacctaccagcagaccagggcagctctggacgccacctacaccgccgtccagccgcgccggctgggcgctgaccggaggcactga

SEQ ID NO: 7921 - DNA, 906 bp, Actinoplanes utahensis
atgaggcacgtcgaggaagcgtcgctgtcgcgcaccgaggagcgcaacccgcgcagcaccaccatggaccggatgtccacgctcgacctgctgtgcctgatcaacgcggaggaccgcctggtcgcgccggccgtcaccgcggtgctgcccgagctggccgccgcggtcgagctcgcggtcagtgcgctcaccgacggcaaccgggtgcactacttcggcgccggcacctccggacgcatcgccgtgctcgacgccgccgagctcatcccgaccttcggcctggcccccgaccgggtcgtcgcccacctggccggcggcctgccggcactgacccgcccggccgaggacgccgaggacgacgagttcgccggcgccgcggcggccaccgcggtcgtcgccggagacgtcggcgtcggggtcaccgccagcgggagtacgccgtacgtccgcgccgccctggcccaggcgcgcgccgcgggcgcgaagaccgtcctgatctcggcgaacccggcgtcgccgatggccgccgaggtggacgtgcacatcgccccggacaccggtccggaagtgctcaccgggtcgacccggatgaaggccgggaccgcgcagaagatggtgctcaacgccttctccacggccaccatggtgcggctcggccggacctggtccaacctgatgaccgacatgctggccagcaacgccaaactccgcgaccggcagatccggatcctggccgaggcgaccggggtctccccggcctcctgcgagaccgccctgcaggaggccgacggggacgccaaggtcgccctggtcgccctgctcgccgacgtcggcatcgacagcgcggcccgcgccctgaccaccgtggaccgcaacgtccaccgcgccctacgcctgctcctctga

SEQ ID NO: 7922 - DNA, 1110 bp, Actinoplanes utahensis
atgtccgcagaccttcgccccgccacctggctggacgcgccgatcggcctcgcgccccaggtcagcctggtcgacggagccgacggcaacccgctgctcttcgacgccgagaccggcacctacgtgcgtctgagccggaccggcgcccgcctcgtcccgctgctcgacggcagccgcaccggcgtcgcgctgctcgacgcggccacccgctcccgtggcccggacggcgtccgcgaccgctccccggccctgctgtcgttcctcaccgacctgcgggccgccggcgtgctcaccgtcgcccccgaaccgcgccgcggccgccgccgctggtttccctggctgatccggctcaccccgcgcgtccggatcccggcccggcacctcaacctgctgctgcgcccgccggcccggctgctcacccgcttcccgcgcggcgcgctcagcaccgccctgctgctcgccgcggcggccaccgcggccatcgccctcgcgctgctcgcccccgggccgccgtccttcgtcggcccgccgtggctgctgatcgtcggtgcgctggtggtccaggccgccgtccacgagatgggccacgccaccgtctgccaggcgctcggcgttccggtccgggaggccgggatcaagctgttcttctggctcctcccgatgacctacgtcgaccgcaccgacgcctaccgggtgcgctcccgcaccggccgcgccgcggtcgccctgatcggccccctggtcgatctgctcgccgccggtctcaccggtctgctcgtgctgaccgcgccggaccgcttcgccgacctgcgctggctgctgggcatgcagctgttcgtcgtcctgaacaacctcaacccgctgctgcccctcaccgacggccaccacgccatggaagccgccatgggcgagctgaacctgcgcgaccgcgccttccgctacctgggccacgtcctgttccggatgccgctctccgccgcccaccaggccgtctccgccacccgccgcggcatctacctgctgtacggcctggtcagcgccgcctatctggccctgctcctcaccatgatcggcaccaactactaccgcctgctcgccgccgccttctag

SEQ ID NO: 7923 - DNA, 291 bp, Actinoplanes utahensis
atgcacaccgaaatgaccgggccggagatctccgaggatctcgacctgtggctggaggacgacctcaccgccgagcaactgcccaccgtgatcagcgcgtccctgctgggctgcggcggctgtggcggctgcgggccgtgcggcccctgcggaccgtgcggtccctgcggtccctgcggtccctgcggtggctgccacggctgtcacggctgccacggctgtcacggatgccgtggctgccacggctgcggtggctgcggtggctgtggtggttgcggcggatgtcgctga

SEQ ID NO: 7924 - DNA, 726 bp, Actinoplanes utahensis
atgaccacggccacccagcacgaccgccagcggctgctcgaacacctgctggccgacacccgcctggacgccgcggcggccgtccgcccgctgcccgaggtcccggcgcagacggccgcggcgccggctgacgggccgctgatcacgctgccgccgccggctgcgccgcgtgccaccctcaccgcgacgctggcggaccgctcggcggcacgggatttcggtcgtacgccgatggccgccgccgatctgtgcgccctgctcgccgcggccgacacgatggacgccggctcgtggcccggtgagcgggcggccggcgtcgacctggagatccactgcgcggtctggcgggtcgacggcgtgcccgccgggctgtaccgctatccgcccgccggcgactccctgatccgggtcgccgacctgcccgagggcccggccgccgaggaactcgtcatgcagcgcgagttcgccggggcggccgccgtggtggtgctcaccggcaacctggccgccgcgctcgcccggcacggcagccacgggcaccggctgttgctcacccgggccggcgccgccgggcacgccgcgtggctggccgcgatccgtctcggactggtcgggtcggtcttcgccggactgctgccgcacgtactgaaggaactcgccggagccgacggctaccgccgcgccgcgctgttcgccttcgccgccggacaccccggcggatcttga

SEQ ID NO: 7925 - DNA, 1587 bp, Actinoplanes utahensis
atgatcgggaccgaagaggcgacccggaacgacgggcggttgtcggccgcgtacatggcgtacgccgtcgccagtgacccgcagttcaccgtgccccggcgcccctgcctgatccccggcctggtcgtcgtccggctcgaggacggcttggcgttcgccggcagcggcaaccggcagaccgtgctgcgcggccggaccgcgatgacgctgatcccgcgcctgctgcgcctgctcgacggcacccgcacggtggacgaactgccggagaagcacgccgcggcgtgcgtgtcgatgctctacgtgagcggcctgctgcaggacggcccagcgggcggggaggccgagctgatccccgccgaggtggtcgactacctgggccgcaacctggacaccacccgggtgaaccggagccgcggcgaggcggcggcccggctggcccggacccgggcgctgatcgccgggccggagcggctcaccggcccgctgcgtgcggaactcgccgcggccggcgtcgacgcgcacccgttccacccggccgacagtctgggcgacggcgatttcgtggtcgcggtcgacgacgggaacctcgccgggatcgacgaggcgtgccggcgggccggggtcggctggctgcgtaccgcggccggcgcgtccaccgccgagatcggaccgatgttcgatgccggccacacgagctgtctccggtgtttcgccgagggacggaccgcgccggccggggagccgtcgccggcccgggccgcgatctgggccgcactgaccgcgaccgaggtcgtccacctgctgtcccgggtcgggctggctccgtcgaccgccggctgcaccgcgtacgacctggacgactggtcgcagaccagcaccggcgcgtaccgccggcccggctgcccccgctgcctgccgggcaccgagccggccgagccggcgctggcccacgtctacgagcaggcggtggcgttcccgccgcgcgagtggctcaacccgaaggaccaccaggcacacttccggccggccaacgcggcgctgcagcgctacaacaaggaatatcggtccgcgccgcggatcccgctcgcggacgcgccgttcgcggacctggccgggctgctgctgcgcaccgccggtctcaaggacgcgggggagcgggtcacccggtgggcgccgaccggcgggaacctcggctcggtgcaggcctacctgcgggccgacgacgtgcccgggctcgaccccggctggtacttctaccagcgcggcgaccacagcctggcgcggatcgccgggccgtcggccgggatcgccccggcgctggaggcggaccgtcccgcggcgctgatcgtgctcaccggcgccctcccggtcgtcgcggcaaaatatcacgatttttcatatcgacttgtctgtctggacgccggggcggcgctcgcccagctgtccgcggtggccgccgagaccgggctggccacccggatcgccgatcgctgggacgaccaggcgatcagcgcggcgctgcggatcgacgccgtgaccgagccggtgaccgcggtggtcgccgtgagccggaaggacccgtcatga

SEQ ID NO: 7926 - DNA, 630 bp, Actinoplanes utahensis
atgtaccacctgcgcgtttcccccgtaggcccgttcggatacgcggtcgccgaacgcctgcgcgacctgtgcccggacgtctcgatcaccgacccggtggaccgggcggcgcccgccgcacccaaggggccgaccctgcacctgctcgccgcctggcgccgggtgccggacaccgagcgggcgttcgacgagcgggcgcaccgcaccggcgacccgtggctgccggtcatcctcgaccacccggtgctggagatcggcccggccgtgctgcccggcgtcggcgcctgccacggctgttaccggctgcggctcgcccagcacgatccggcccgcaccgtccgcgcggccgtcgaccggcactacgagctggacccggacgccggtccggccggctacctgccgtcgaccgcgctgttcgccgcggccgccgcggccgaggtggtgcagcggctacggaccgacccggagggcgaggccggccgggtccgccagatcgaggtgccgacccagcagctgcgcaccggccgggtggtcggcgtgcacggctgcccgcggtgcggtctgggacgtgacgagcagacccggtcgtacgaccggctgccggagatgatgcggggagtgctggcatga

SEQ ID NO: 7927 - DNA, 1320 bp, Actinoplanes utahensis
atgagtgcggtagctgccgaaaaggcgcagcggcgaatggacctcaaggatctggtgtcacccctgggcggcctgatcacccacgtcatgccactgccggtggaaccctcggagccgccgctgcgggtgcactcggcggacctcggcgacgtctccaccgtgatctccagcgcgtgcgggccggactgcctgggcagcctggacggcaccggcaccggggtcgacccggagcgggccaccgtggtggcgatcgccgaagcactcgaacgatacgccaacatcctttacgacgagcggcagatccgctgggccacggccgacgagctgggtgccgaggcgcttgccctggacaccctgccgcgctgctcggccaccgagctggccgccccggactgcccggtggtcagcccggacccttccgcaccgatccgctgggtgcgcggcatgaacacgcgcaccggacggctgtgctgggtgccggccgccctggtgtacatgcacttctcggcgcacggtgcggaacggatcaccaacccgatctccaccggcgcggccgcgcaccccgacccggcccgggcgatcagcggcgcgctctgcgaggtggtcgaacgcgacgcgatcagcctgacctggctgcagcggctggagctgccccggctggtcctcgacacggtcggcccggaactgcagcgctacctcgacctgtgcgccgggcggaacgcgacgatccacctgttcgacgcgaccaccgacgtggggattcccaccgtgtacggcgtctcggtggccccggagcacccgtcgtgccggatcgtggtctcctgcgcgaccagcctcgacccgcaggtcgcggcggccaaggcgatctgcgagacggtgtcggtgcggatcgccctgcacgacgccaggccgccgagcgacgacgtgcgcaccttcaccggggtggcggacggcgccgcgtacatgtgcgctccggagcgcgccgaggccttcgacttcctgctggacagcccggcccggcgccggctctccgagatgcccgacctgtcgaccggcgacgcgcgcggcgacctgcgcgtggtgctggaccggttggccgagcgcggtctcgacgcgtacctggtcgacctgacgccggacgaggcggtacgggccgggatgacggtggtccgcgcggtggtgcccgggctgctgccactgtccttcaactatcgtgcgcgcttcctcggcacgccccggctgtacgaggcgccggcccggatgggtcacccgacccgctccgaggctgagctcaacgcctggccgcagccgttcgcctga

SEQ ID NO: 7928 - DNA, 1755 bp, Actinoplanes utahensis
gtgacctcggacgtcgatgatgtttccaccccggaggatgtcaccgccgcggcagcacccgtcgcggtcacccgcgggccggccgacctgtggtcccgccaccggtcctggctggtcccgctcgcggtcgtcgccttcctggcccagatggccgtcggcatggtgaccgccgcccggcaggagtccaccacggtcgacgaggtggcctatctcggcgccgcggtgacgtatgcgcacgatcacgacctggccgacaactacgagcatccgccgctgacgaagctgctggaggccaccggtctggccttcgtcgacgtgaagcgcaccacgcacttcgacggcgaccagtgggcgctgggcgagcacctgctgtacgacagcggcaacgacgcgcaggagctgctcttcgcggcccggcttccgatgatcatcctgaccctgctgttcgggctggtggtcttcgccttcgcccgggacctgaccggcccggccggcggcctgctggcgctgctgctgtacgcgttctcaccggacgtcatcggttacggctcgctggccggggtggacctgccgaccgccggcttcctgctgaccgccctgtggctgttgtggcgggcccggtcccggccgtatcttcaccttccgctcgccggtgtcgccctgggcgccgcgaccgccagcaaggccaccgccctgccgggtctgctcgtcggcgccgggctggcggtcgtctcggtgtggtttgccggccgcgcccatcacctgggccgcccaccggtgctccggctgctgctgatcggcgtcgccgcggccgccggggtcgtcgccgtcgcgatcgccaccgtgtgggttacctacctgatcgtcgacccgcacctgcactgggtgaccccccggtcggtgggcccggtgcacgggctcaagggcgagctgtttaacctcctgccgttgccgcggccgttcctcgacgggatgcgcctgcagctgggcctggagaagggcacctactccagcgtgctgttcggtgacttccagaacggcgcgcgatggtactacctgccgggcgcgctgctgatcaaggaaccgctgggcatgctggcgctctggctgatcggctcggtcgcgatgctgcgctcggcgaagctgcggccggccgccctctacctgctgctgccgaccgcggtgctgaccgcgacggcgatggccggcaaccggaactggggcgtgcggtacgccattttcgtcccggtgattttggcggtcgtggcggccgccgtgctggtctaccggaatcggtggccgcgggtcgtcgtgggtctgctggcggcgttcgtcgcgatcagttcgctggccgcctttccgtattatctgacatattccaacgaggccttcggcggcccgtccaagacatatcttcagcttaccgactcgaatgtcgactggggccaggacatgtcccggctcggtgaccggctggcccgcagatatccgggggagcaggcctggctgatctacaagggccggggccgggccgcctattacggcgtgcccgggcagaacccgctggtcctgcccccggctcaggtgcacgggctgatcgcgatctcggtgcggtgcctgacgctgaagagcgcctgcctgcccgacgcctccgtgatcagtgcgaaaaaggctcgggcgaacttcaatgaactgctcgcgacgagcacccggatcgacaacgtcggcaattcaatcttcatctaccggcggtga

SEQ ID NO: 7929 - DNA, 195 bp, Actinoplanes utahensis
atgatcagggacctggtgcgccgctccctgatcctgctgctggccgcgctgggcgcatgccgccgcgtgccgccctcccctgtggaccttccggtcgtcgccaccgtcccggtggccgaccgcacccgggtgctgaacgcgcagaccaccgtgtccgccggcgcctcccgcgcgcccccggctttcgctgtctga

SEQ ID NO: 7930 - DNA, 717 bp, Actinoplanes utahensis
atgctgctcgccgactccatcgcctccgtcgcgatctggctggttctgctgctgttcgccctgcccgccctgctcctgctggccaacccgcaggcggtgcgccacccccgcgagttcgccctggaggcgctcggcctggcccgctcacggcgggaggccgccgaactcgcccggtacgccgaggagatccaggtcgccgccgaccgcgccgaccacgccgcacagcgctggcaggagcaccggcagcgggccgagacgcacgccgccgacacctggcacgcctggcaggccgccgagcagcgtctcacccgggcccgcgccgcggccgccttcgccccgccggacagtccgcgcaccgccgccgaatacgccgaccgggaacgcttcctgcaccgctcggtgcgcgccgccgtcgaccgcggagacctgccgtccgccgcgctgcccgccgcgatcgccggacgcgacggctggaacccgcgcctgcacccggccgaccaggaactgatcctgctcaccgcggtcaccgcccaccgccgcacgatccaccggcaggccaccgtcgccgaacggaccgcggcgcacgacgcccggctcgccgccgccacccggcacagcctgcgtcgcgaggcggccaccctgcgccgcttcctgccggccccggagcggcgcaccgccccgtccctcgcccgcgcctgggttcagcgcaccgcctga

SEQ ID NO: 7931 - DNA, 663 bp, Actinoplanes utahensis
atggccggcatgacgcggccggtgcgggtgatcgtggtggatgatgatgcgctggtgcgggccgggctgacgatgatgctcgatggcgcgccggggatcgcggtggtgggggaggccgcggacggcgacgaggtggcggcggtggtggacgcgcacgcgccggatgtggtgctgatggatctgcggatgccgcgggtggacgggatcacggcgacccggcgggtgcgcggccggccgcgggcgcccgaggtgatcgtgctgacgaccttcgacaccgacgacgacatcctgcacgcgctgcgcgccggggccagcgggttcctgctcaaggacacgccgccggcgcggatcgccgaggcggtgcggcaggtggcggccggggagccgatcctgtcgccggggatcacccggcggttgatggatcgggtggcggtgcaggccggagcgtatgcgcgggcccggaacacgctggcggcgctgagcccgcgggaacgggacgtggtggtggcgatcggccggggtcggtccaacacggagatcgccgccgcgctggacatgaccctggccaccgtgaaaacccacgtctcgcacatcctgaccaagctcgatctggacaaccgcacccagatcgcgctgctggcccacgacgccggcctcgcctga

SEQ ID NO: 7932 - DNA, 1647 bp, Actinoplanes utahensis
atgccgatcagggtgagcgtgccggtggcgccgaccgcgctgccgagcgggccggccagcgacagcagcaacaccacgaaggcgatgatccggtacgtccgggtggcgtgccgggtccggcgctccaggacggtgagcagcgcccaggcggccaggccggccagcagcgcggtgatcacgacggcggccgggccgatgtgggtcgtgcccccgcttgagcggacggtgaggtcggtgccgccccacgggtcggtgaccgtccacaggagcagggctccggccgcgccggcggcgacggtgatcgcccggccggcgcggcgccgggcgggacgggggcagtcggcgtcggtggcggtggcgggacggtgcgtctggttcgtcatgccgatgagcctggccgacccggccggtcgcccacatcggaccgaagtcggcggcgccgctctcctaagttgcagcctctcctactttggtcggtgtcggcgccggcagcgccgccgatacggtgaccgcgtgaaaaccaacggtgccgtcggcatggtcctcggggtgtccggcgccctggtcaccgcgaccgtcaccggttggtgggccgggcgcccgatggtcgccccgctgctcaccctggacgtggtggccggcgtgctcgcctgtctgatcaccccgctcatgctgtggcggccggtgccggtcgccggcgtgctcgccgtgctggccgcgctctccccggcggccagcccaccggccacgatcgtcgcgctgcacgtggcccggcggcaccggttcccggtcgggctcgcgggcgcggcggccggcgtcgtggcgcacgcggtgcagggctggtggcggcccaacgacgggatgtcgtacggctggtggctggccctggtcaccgtcggctacggcgcgctgctcggctggggcgcctggtggcgggcccgcgacgaactcgtccggtccctgcgcgagcgggcccggcgcgccgaggccgaacagggccgccgggtcgccgaggcgcggatgctggaacgccgcaagatcgcccgggagatgcacgacgtgctggcgcaccggctgtcgctgatcgccaccttcgccggggcgatggagttccggcccgacgcaccgccggagcgcgtcgcggcggccgccggggtggtccgcgacggcgtccaccaggcgttggaggagctgcgcgaggtgatctcgctgctgcgcgacgacaccccggcggacgacgacggcagccggccgcagccggtcctggccgacgtgccgcgactggtcgaggagagccgggcggccggcaccgaggtgcggctgcgcgacacggtcgccgagccgggtcaggcgccgcccgcggtggcccgcacggcgtaccgggtgatccaggaagctctgaccaacgcccgcaaacacgccgcgggccgcgcggtccgcgtcgagctgcgcggcggtcccggcgcgggcctgctcatcgacgtccgcaacgagctggcccccgaccaccccaccccacccggctggagcggcggcgccggcctggtcggcctcaccgaacgcgtccacctggccggcggccacctcgaccacgagtccaccgccggcgaattccacctgtacgctaccctgccctggccccggtga

SEQ ID NO: 7933 - DNA, 843 bp, Actinoplanes utahensis
gtgggcgacggtggcgacgcgggcgcatacgatccggcgatgcgacttctggtgatcggtggcagcgggttgctcggccgggaggtcgtccggcaggcccggctggccgggcaccgggtgacggcgaccgcgttccgccggccgaccggtccgcggctggacatccgggaccggtccgcggtcgccgctctggtcgcggccgataatccggaggtggtcgtcaacgccgcctatctgcagtcggattgggcgaccaccgctgacggcggcatgcacgtggcggcggccgccgccggctgcggcgcccggctcgtgcatgtctccagcgacgccgtcttctccggccgcgcgccgtcctatgccgagaccgcggcgcccgacccggtcaccccgtacggcgcggccaaggccgctgccgaggtcgcggtccgcggcctggtgccggccgctgccgtggtgcgtacgtcgttgatcatcggcgccggtgattcggtgaccgagcggcacgtccgcgatctggccaccggccggcggtccggggtcctgttcaccgatgacgtccgctgcccgatccacgtcaccgacctggcggccgccctgctggagttcgccgcccgtccgtcgcccggcgtgcatcacgtggcgggcgccgaggcggtcagccggcaccggctgggggtgctgatcgcccgccgtgacggtctcgacgagtcggcgctgcggaccgcccggcgggtcggcagcggcctgcccggtgccgtcgacgtacggttagattgtcgtgcgacgcagcgccggctggtgacccgcctgcgcggggccggtgagtttctgtcgctctga

SEQ ID NO: 7934 - DNA, 501 bp, Actinoplanes utahensis
gtggtgcggcgtggcggctgtggatgcacgaagtcggacttccctgaggatgacggcggccggaacccgcacttttcggtcgcggatgggataaagcggcgggtctacggatgtaacgagcgccggggggccaccggttacgctgccgcggtgaccgcggcgacatccttccgactcaccccgatgcgaccccgcgatccgggcgaaccaggacgcaccgcgacacccctggaactcttcttcgacctggtgttcgtggtcgcggtcagcatcgcggcgggagagctgcaccacgcgctgagcgacgacctcgccgtcccgctcggcgcgctgctcgtcctgctcgacccgatcaccggggtcccggtcctgctcaccgcagtgatcatggtggcggtcgtcgcggtgctggtgctgcggcccccgctgtcagagcgacagaaactcaccggccccgcgcaggcgggtcaccagccggcgctgcgtcgcacgacaatctaa

SEQ ID NO: 7935 - DNA, 579 bp, Actinoplanes utahensis
gtgcatccacagccgccacgccgcaccactcacgcccacggaacaccgcacaaccggctcgtctacgaccgctgggggcggttcggccgcccggtggtcctgctgcacgggctgttctacgaccggacgatgtggtggccggtcgccgccgaactggacgcgggctgcgccgcggtcgcggtcgacctgcccggacacggcgagtccgcgccgcgcgccgacctcagccggctcaccgaggacctggccgcgctgatccgcgggctggacctgcaccgcgccccgatcctggtggcgcacgccggggcggcgcggctggcccgggccttcgcggagaagtacgcggtgcagcacgtgctgacggtggacgacgggacggacaccgacctgtcggtggtgccggccgcgtaccggcagttcgccgttccccggcgaccggatcgggcggtgaccgccgcctaccgcgagtgggcggcggtgccggtcggcgccggtcacccggcgagccgggccgagggcacgttcccgcacctgcgggatccggcggctttcgccgccctgctgcacaacctcgtttag

SEQ ID NO: 7936 - DNA, 1113 bp, Actinoplanes utahensis
gtgaggcgccggaggcggacctgctgcgcgccgagcaggccgccacggtccgccgcgccctggcccgcctgccggagcgccagcgccgcctgctgtggcagatggcgaccgacccggacgcgcggtacaccgagatcagcgcccggctggacatcccggtcggcgcgatcgggccgacccgggcacgtgctctgggccggctacgccgcctgctgctcgacgaggatcgggccgctcactactctcaccagcgtggatcttgattgggggcgcacgacgcacgcgtacggcccggcggtcgccaccccgggacacctgcgcgacctgaccgccgtcgagccggcggcgcgggcccgggcgctgcggcacctgtaccacgaggtctgccaccgccagaccatccatccggcgaccggcccgatggtggaggcggtcgccgggatcctggccgacgaccggctgggcgtaccggacccggatgccggccggtcgatgcgggcgtcgctgctggcgctgctcggcgaggtcggcgcgtggtgcggcggatatgcgtccgagtcggagagcacgatgctggcgatccggcgcgacgatccggaggccgccgccttccccgaggtgtgggacgacttcgagggcgacccggccatcctgatcgccggcccggtccaggcggcctgcgtgcgtcgggcgccggcggtgctggccgcgctcacgccgtggctggacgccgacgatccgcacgaacgcggccgggcccggtacgcggcggcctgctgggcggcgctcggcccgcccgtgccggagccggtcatcgcccgcctgcgcgagatcgccaccggcgacggctgtcgcgacgtgcgggtcgacagtgtcctcgggctggccggggcgggcgtcgacaccggggtgctgctcgacgacccggaccggctgatccgcacgtgcgcggcgctgtccccggcgatggccggcgatccgcgcgcggtcgcgctcgtggaggccgcactgatcgatgcgccggacggcatccggtgggaaccgccgccgccctacatcgcgttcgggctggagaaccggctcgcggcgctggctcccgggtggcccggctaa

SEQ ID NO: 7937 - DNA, 1008 bp, Actinoplanes utahensis
atgtcgtcacggggtagaggaatcgtcgtctatctggccatcgccttcggcggggtgtggccgtacctgttcgtggtccggctcggcttcggctggtcgctggtcgatccgctggtccagctgccggtggcgttcgtgccggcgatcggcgcggccgtggtgcgccgctgggtcacccgggagggtttcgccaccgccgggttgcgcctgcgcgcgccgtggcggttgtgggcggccggctggttggccccgctcgccgccaccgcggtcatgctgggctgcgcgtactcggccggctggtggcggtccggcgtggggccggccggcgggcccggcggggtgccgatgctgctcgccgtccaggtggtgctcatcccggcctatttcggcgaagagttcggctggaccagcttcctctggccgcgcctggtgcccggccggccccggctgtcgctgctggccaccggcctgatctgggcgttctggcactatccgctggcctttctcggctacgccgacttcaccgaccgggcggtcagcattccactgtggaccgtcatgttcctgctcttcgaggtgctgctcggctggctgtacgcgggtagcggctcggtgtgggtgaccagcctcgcccattccggcaacaacgtggtgatgagcatggtgtccgagcagctgctcggtgggctgaccagcgtgcagacgctgatctgcaccgacctggggctggcgctgctctgcctgcccctactcgggtcgccggtgttcgggaccggcccgggcggccggatgaatgaatgccccccggtggagcgccggaactcacccgatcgcatgacaccggggatttccccggcgcgaaacagccgcgaccgtcggcaggcttcaggagtcggcgaccggcggtcgtgcccggccggcgaccggcgcgaggtggggggagacggctatgcgacaggcggtggcggaggatcttgccacggtggtccgcgaggctcgggccggtga

SEQ ID NO: 7938 - DNA, 2175 bp, Actinoplanes utahensis
atgcccctgtcccgcagaagctggctcgccgccggcacgatgaccgtggtggtcgccggcctcggcgtcgccggcatcaccgaggcgctggccgccagcagcggcaccctcgtcagctcggccaacggcagatgcctcgacgtcaccgacggcagtaccgcgaacggcaaccagccgcagatgtggcgttgttccggcggcccgaaccagaactggacgctggccgacaacggtcaggtgcgggcgctcggcaaatgtctcgacgtggcgaacaacgccaccgccaacggcgcggtggtgcacctgtgggactgctatgactcggtggccacccagaaatggacgctgaccgcctcgaaggacctggtcaacctcgcggcgaacaggtgcctcgacatcaaggacggcaatctcgccgacggcgccaagctgcagctctgggactgctccggcggcgcccaccagaagtggacgttctccggcagcggcaccacgcccccgaccaccgtgccgaccgacccggcgaacccggacctcggtcccaacgtcacgatcttcgacccgtcgatgcccgcctcgaccatccagagcaagctgaacgcggtcttcaacggccaggtcagtaatcagttcggcaacgctcgccatgcgctgctgttcaagccgggcgtctacccggtcgacgcgaacgtcgggttcttcacccaggtggccgggctcggcctgaccccggaccaggtgaccatcaacggccacgtgcacgccgaggcggactggtggccggacggctcacagaacgccacgcagaacttctggcggtccgccgagggcttgtcggtcagcccggcggacgggctggaccgctgggcggtgtcgcaggccgcgccgtaccggagaatgcacgtacgcggcaatcttgcgctctccgacgggggctggtcgtcaggtgggttcatcgccgactcgaagatcgacggtcagatccagtcgggcacccagcagcagttcctgacccgcaactcggcgatgggcagctggtccggctcgaactggaaccaggtgttcgtcggctcgccgggcgcacccgcgcagagcttcccgtccccgccgttcaccaccgtcggctcggcgccggccatcgccgagaagccgtacctgtacgtcgacagcgccggcgcctaccaggtcttcgttcccgccgtgcggaccaacgcgtccggccccacctgggcgaacggcacgcccgccggcacctcgctgccgatcggcggcttctacgtggtgaagtccggtgacaccgcggcgaccatcaacgcggccctggccgcgggcaggaacctgctggtcacgccgggcgtctaccacctcaaccagacgctgaacgtgacccgggccggcaccgtggtcctcggcctggggctggccaccttcgtgccggacggcggcgtcgacgcgatgcacgtcgccgacgtcgacgcggtgcgggtcgccgggctgctcttcgacgccggcaccaccaactcggccatcctgctgcaggtcggcccgaccggctcgaccgccacgcacgcggcgaacccgaccgtgctctccgacgtgttcgtccggatcggcggcgcgatcgccggcaaggccaccgtcagcgtccagatcaacagcaacgacgtgatcggcgaccacgcctggatctggcgcgccgaccacggcaacagcggcacggtcggctggaccaccaacaccgcccgcaacggcctggtggtcaacgggaacaacgtcaccttctacggcctgttcgtcgagcactaccagcagtaccagacgatctggaacggcaacggcggccggacgtacttctaccagaacgagatgccgtacgacccgccgaaccaggccgcctacctgaacggcgccacccggggctgggccgcctacaaggtggccgacacggtgaccagccacgaggcgtgggggctgggcagctactgctacttcgccgtgaacccgtcggtggtcaacgcccgcgccttcgaggcccccgcggtcagcggcgtcaagttccacgacatggtcaccgtctcgctcggcggcaccggcacgatcagccacgtcatcaacaacaccggcgcggccgcgaacagcggccaccaggtcaccgacctgaccagcggcccgtag

SEQ ID NO: 7939 - DNA, 495 bp, Actinoplanes utahensis
ttgcgctctctcctccgcagcttcgccctggccgccctcgtcgtcccggccgcggccggcgtcatgatgaccgcgtccccggcccaggccgcgccggcgaaggccaaggcggccgagcaggccctgcaggccgacatcaaccggctgatcaacgagcagcgggtgcagcacgggtgcggcgagctgaccgagaacgccgcgctcacccaggcggcccgcgcgcacagcgcgtggatggggcagaccggcgagttctcgcacaccggccggggcggctccaacttcgtggcccgcgaccgggccgccgggtacgcccgcccgtcggcggagaacatcgcctggggctaccggaccgccgacgacgtggtcaccgcgtggatgcacagcccgggccaccgcgccaacatcctgaactgccggtcgaagacggtcggcctgggcgcggtgtacgccgcggacggcaccccgtactacaccgaggacttcggttactga

SEQ ID NO: 7940 - DNA, 867 bp, Actinoplanes utahensis
gtgccggacgatccgggacagccggcgcgccattcgcgacccgccggaccggatcgccgtcgacttcggcgtcagggtcaccgtcgacgccggcgtggtgagcgcccgcgcgaccagcgaggcgaacttcaccgtccacctggagtggatcagcgaccggctggtcggccgcctgggactcgactgacccttatagttgccgccgtgcatgatcactcacgacggctcgtcgccggaagcctgctgctggccggggttctcgcggcggccggctgctcggcccacgcgtccgcccagtccgtgcccgctcccaccccgtccggtgccgcgcccaccctggcgcaggcggccacccggctgggcaccgagacggcccgcttcaccgtcaccctgggcgccgccgagcgggccaccggggtgatcgacccggccaccggcaactgggagatgaccggggacggctatgtcgtacgccggatcgggccggccgtctacgtccggctgaccgccgagccggcgcacagcatgtatcccggccagtatgccgacgacctgggccggtgggtgcacaccacggtcccgacggatgccgccccggccttcgccgagggcttcccgtgggccgcggcccggacgctggccggtcaaccgggcgccgccccgggcgcctccggccgcttccggctgggtgggggcaccgccgagctggacgtggccggccggttcagccggatcaccctgaccgacccggcgatgaccgtgagctacgccgactacggcctgccggtccgggtcaccgcgccgccggccgaccaggtcgccgaggaccacctgttcacggtcgccaacctggggccgatcttctga

SEQ ID NO: 7941 - DNA, 1380 bp, Actinoplanes utahensis
gtgcggaaccggtcgaacgctcccctggtcgtctacctctgcgccgccttcaccacgctgctcgaccaggccagcctgaccaccgcgctgccggcgctgcggggcacgctcggcgccgggccggccaccctgcagtggatcatcgcggggtactcgctgaccttcggcctcgctctggtcccggccgggcgcctgggcgacgcgcacggccgccgccggttgttcgccggcggggtcgccctgttcaccatggcggcgatcgtcggcggcacggccaccgcgccgtgggtggtcgcgatcgcccgcctggcgcagggcgccggcgcgggcaccgtcaatccgcaggtgtacggcatcatccaggacctgtacacgggccgggcgcgcacccgggcactcggcgcctacgccaccgtcggcgggatcgccggggtgatcgggccaccactgggcgggctggtgctcaacgcggccggggagcacctcgggtggcggctcatcctgctcttcaccgtgccgttcgggctgacgaccgtaccgctggcaatcctcctgctgccccgcggccgcgcgccgcaagcggcccggaccaccctcgacctgcccggtctcggcctgctcgcggtgaccactctcggtctgctgctgccgttcaccctgcccgccggaagcggtccgccgcgcgcggtgtgggcgctcgccgccggcgcggcgctgctcgcgctgatcgcctgggagcgccggtacgcgcgtcgcggtcgcaccccggtgctcatccccgatctgctgcgccggcccggcttcagtctgggcacgctgaccgcgatgttccagttcggtgcgtcgctggcgaccaccctggtactcgtcctccacctgcaggacggtctcggctggtcgccgctgcgcgccgcgctgaccacgctgcccagcgcgctgggtttcgcggtggcctcggcgcagagctggcgcctggtcacccggtacggccggcccagcgtgaccgccgccctgaccggggccggccctgtcgatcgcggccaccatcctggtgctgcacaccctgtccggcgccgcgctgggcgtcgcactggccggcacccaactggccatgggcgtcaccggcgggctggtcgtctcgccgaaccaggcgctcaccctggccggcgcgcccgccgcggtggccgggctggccggggcgttcctgcaggtctcgcagcggatctcggccacgttcgcgaccgccgcggtgaccggcgtgctgagcggccgcaccgggctcctgctgtgcctggccatgatggccgccggggccgggatgtccgccctcgacagtcgcccgcctgtgacgcaggcaaccaccgccaaatctctatctaa

SEQ ID NO: 7942 - DNA, 876 bp, Actinoplanes utahensis
atggctcaccgacaaccgcatctggcgctggagctcggcgcgaccgccggcccggagcacgtggccgccgccgaggccgccggattcgccctcgtcaccatcgacgacacgcccggcgccgcacagcccgaagccggggtgcgggccgcctacctggcccggcgcacccggcggatcgcgctcgcgcccaccctgcacgccaccgtcaccgagccgttccacctggccacccagctggcctcactggaccacgcgtcgctcgggcgcggcgcctgggtggtcggcgcggcggccgggcccgcggcgtacgcgacggtcggcctccccctcctcgacggcgccgccctgcgccgggagatcgccgacgtgatcgacgtggcccgccggctgtgggactcctgggaggacgacgcgatcatccgcgacgtgcccagcggacgcttcctcgacgccgaccgggtgcaccacgtgaacttcaccggcgaacgcttctccgtggtcgggccgctgatcacgccgcggccgccgcagggccagctggtcgtgctcggcgccgacacgctcggcgtcaccgaccggctcgacatcgcgctgatcccgttcgacaccgtcgacgcgctctccgcccgggccgggcaggcccggacggacggcgcgccgctggtcttcgccgacctcgacctcgccgtcgccggcgacgacccggccgggctgatcgaccggctgggccgggtcgtcgacggggtccggctgcacctcggcgacatcgacgccgacctgccccggatcgccgcgacgctgtcccggcccccggtcaccgggccgaccctgcgcgacaccctcggcctgccccggcccgtcaaccagttcgcctag

SEQ ID NO: 7943 - DNA, 1254 bp, Actinoplanes utahensis
gtgctgcacctgggagtcttcttcaccggtgtcgggccgcaactgctgtggaccgatccggcgttcagctcgcacacccacatcgactcgttcatcgccacggcgcggaccctggagcgcgggctgttcgacgccttcttcctcggtgagggcctgcgcgtccgggagaaccgcggacgcgtccacgacctggacgtcgccgggcggccggacgccatcacccagctcgccgccctggccgccgaaaccacccggatcggcctggtcgccacccagaacaccacctacaacttcccggccgacctggcccgccggctcgcctcgctggacgcgatctccggcggccgggccggctggaacatcgtcaccaccgacaacgcgtggaccggggagaatttccggtacggcggatggctgccgcacgagcgccgctacgagcgggccgccgcgttcgtcgagaccgccaaggcgctgtggcgcggcgagaccgtcgaccggcacgacgacctgatcgacgtgaccgccggcccgaccgtcccggcgtccccggtgctgttccaggccggcgactccgcgggcggccgggacctggccgcccggcacgccgaggtggtcttctccgccaacaccgacttcgacaaggccgtcgattacgccaccgacctgcgccggcggctcgccggtcacggccgcccggcggacgccgtccggatcctgccgggcgcctcggtggtgctcggcgacaccccggccgaggccgaggagaaggcccgctggatcgcccgtgagcaggtcaccggcccgcgcgcgctggccttcctggaacagtactggggcaaggacctcagcggctacgacccggagggcccgctgcccgacatcgaacccgccgagggcgaactcgacccgtcccgcggcaccatctccatcgagcaccgcaccggcaaggccgaacgcatcgcgggctggcggcggctggccgaggaccgcggctactccatccgcgacctggtgatcgaggtgaccccgcggcacagcaccttcgtcggcacgcccggccagatcgccgaccggtgggcgcgatacgacgaggcccgggcggtggacggcttcaacatcctgccgcagctgctgcccggcacgatcgaggacatcgtcgaccggctggtgccggagctgcagagccggggcatctaccgcaccgagtacaccggcacgaccctgcgcgaacacctggagctgccgccggcctga

SEQ ID NO: 7944 - DNA, 1311 bp, Actinoplanes utahensis
atggggagctgctcgcggggggagagggaggcatccttgctcaagcggaagaagatggtcacgttcggcaccgtagtgtccactttattactatcggccctcgccgtgtcgccggccgaagcccatggtcacctcgctcccgcgggggcaaaggacatccttgactcgtccatcgatcccaaccaggaccggctcatggacttcaaaagctggcttatcggcctgccggagctcgccgacagcggctacatcgagtcgataaacgactcttcgaatctttctacgaccctgctctggagtggagacgagaccgccctccagaagtcgatagctgccgaggggaagcgtcgggggattaccgtcacgttcgagcgccgcaaattcagtagagcccagctcgaccaggcggccgccaaggtgatggcccaaggtagggatgggatgggcggcttccagtggtcagcgatttcgacggtcaatccgaagttcgacggtatcgtagtgaagggcgcgaccggagcaaacataaaaggcaagagcatccccaacgctctcgactcggatgccgcatctgcactttctcggcgcattgctgccttgaccgacgttcccgcaatggttgaagccggcgcatctgtcaacctggacggccagcggtggagtgactattcgcccttcaatgcgggcgggctcatggttcaaggcaacgacacctgctcgacgggcttctcggtgaacgtcaacggatctccgtacgtcacgacggcccggcattgcgtggaccaccattatcagaccctttccggaagccgttcctacggggatggagtacggaactccggtgacggtgccgctcgtcaaatgagcgccaaggggtccgggcgtgtgtttgacggcgcttgggacaactcggctggctacgacaagaaggtcatcggatacggtgacgtgagcatcggggacaggatttgtagcagcggagccgagtcgggggtgcactgcggcctccgggtcgaggagagcgacatgatcagcgacaactatccgggcggcgccaacttcagcgcaatctatgtgttcggtgacgtcttcgcctgcaagggtgacagcggtggaccgatgctcacccctcggaacacctcggatgtgctcgctgtcggtatggttcagaagggcgacggccggtacgagcttcccgcgttttccatttcggagaggtacatggtgcttccttgcttccgaggcggatggatcaccagcatgaggactatcgtcaacactcttccgaatgcgtccctggtgctcggctaa

SEQ ID NO: 7945 - DNA, 831 bp, Actinoplanes utahensis
atggtcgccgccgtgctctgcgccctctgttacggcgtggcgaccgcgctgcaggcccgcgccgccgccaccggatccatgctcggcatgctccggcgcgccccgttcctgctcggcatcctgctcgacctggccggcttcggcgcccagttgctggccctgcgctaccggccgctgttcgtggtgcaggcggcgcaggccggcaacctggccgtcaccgccgtcgcgtgcgtgccgctgctgggcatccgcctgaacgcccggcagtggtcggcggtgttcgccgtctgcgccggactggcgctgctcggggcgtccagcggcgcggagggctccaccgtggtcggcacccgcacccgcctcgtgctgctcgccgccgccctgctgctggccgcgatcacaccgctggccacccgcctgcgcgcgccggccggcccggtggtgcagggtgcggtcgccggcctcggcttcgggctgaccgcgctggccgtgcgcgcggtgccgtcgctgcagccggcggcactgctgcacgacccggccgcctacgccgcggcgatctgcggcgtctgcgcgttcgcctccttcgcggccggcctgcaacgcggctcggtcaccgcggtcgccgcgctcgccgtgatcggggagaccgcgttgcccgccgcgatcggcatcctgctgtggcacgaccgcacccgcccgggctgggcggtccccgccgtcctcggtttcgtcctggccgtggccggcgcgctgagcctgtccagcttcgccgagccggcgcggcaaccggccgcgccaccggccggtccgccggtcgagcatcccgtctga

SEQ ID NO: 7946 - DNA, 684 bp, Actinoplanes utahensis
gtgcgacggacgtgtcgatcctgtcccccacgatatgtccccttccacaccggccaggcgattcacgaagatcttaatgcctttcgcccggaatggggatgccgcagactggccggcatgatctccgacgtcccgtccctgctcaccgccctggccgccggccggcacccgaagtacctgtatttctggggacacacaccggcacgggacgggtcggtgagcgccacctgcctcagccagtggtcgcccgagggctgcaccgtcgacgggatccggtatgcgaccgccgagcactacatgatgtggagcaaggcggtcctgttcggggacaccgccgcggccgagcggatcctcgccgccggccacccgcgcgacgcgaaactgctgggcggccgggtcaccccgttcgacgagccgacctggcgggcccgccgcaccgacatcgtcacccgcggcaacctcgccaagttcggccagcatcccgacctggccgcgttcctgctcggcaccggtgaccgcgtgctggtcgaggccagcccgacggaccggatctggggcatcggcctgacccgcgacgacccgcgcgccgccgacccggcccggtggcgcggcctgaacctgctcggcttcgccctgatgacggtccgcgagcggctgcgcgcggcggccccggccggcgggtag

SEQ ID NO: 7947 - DNA, 795 bp, Actinoplanes utahensis
gtgggggacaggatcgacacgtccgtcgcacatccggcccggcgctacgatttcctgctcggcggcaaggacaacttcgaggccgaccggcagtccgccctggagatcgagcgccggcatccgaccgcgcggctcagcgccctggagaaccggtatttcctgcaccgcgcggtccgattcatggccgggcaggggatccggcagttcctcgacatcggcaccggcattccgacctcgccgaacacgcacgagatcgcgcagggcgtcgacccgcaggcgcgggtcgtctatgtggacaacgacccgctggtgctggtgcacgcccgggccctgctgaccggcaccccgcagggccgcaccacctacatcgaggcggatctgcgggagccggcgcggatcctggccgccccggacgtgctggccaccctggacctgcgccacccggtcgggctgctgctgatcgcggtgctgcacttcatccgggacgacgacgatccgcgcgcgatcctcgacacgctgatcgacgcgttgccgcccggcagtgtcgtcgcggtctcccacgccaccccggagtacatgccggccgagcaggtggcggcactgcgcgcggtgatggagaagcagtggcaggaccggaccggcgacgagctgcgggcgctgttcgaccgcccggacctggagttcaccggtccgggcgtgcagtcggtggcggcctggtggccgcaggacgcgccgcagccgcgcccggcggtcgaggacatcgcgtccaacggcctggtggcccgcaagcgctga

SEQ ID NO: 7948 - DNA, 228 bp, Actinoplanes utahensis
gtgaccgtcacgctcaagccgggccaggcggccaacgcggtcctgcagtccaccaacgtcggcttcttcgacaaggacaagtgcaagccggtcgacgtgcgcggcatccgggtctacccgccggacgagaccacctcgatcttcgtcagcctgcccggccaggcctgctcggtgaagggtcagggcgtcggcacgatctgggcgatcgcggccggttcgaaggtctga

SEQ ID NO: 7949 - DNA, 165 bp, Actinoplanes utahensis
ttgatgaggtccgccggccggcccggcgactacaaagtagtcatgaagcgcaccatgatcgttctgctggccgccccgctcctgctcgcgacgggctgctccagcaccgggagttcgaccaccaccgccggcgccgctccggcgaccaccaccgccgctagctag

SEQ ID NO: 7950 - DNA, 1116 bp, Actinoplanes utahensis
gtgggggcttcggcggccgggatcacggccgccgaaaccctgcgccgctccgggttcaccggcacggtcacggtcatcggcgaggagaaccatctgccgtacgatcgtccgccgctgtccaaacagatcctggccgccgagtgggaaccgtcccggatccttctacggacggccgagcagctggcggctctcgatctggatctgcgtcggggtgtgcgtgcggtcgggctggccgatcgcacggtgctgctcgacgacggggacacggccggcttcgacgctctgatcatcgccaccggggtccggccgcgcaccctcccgggcgccggggcccatgcgatccgcaccctcgacgatgctctggcgctgcgcgggagactgcatcacggcgtacacctgatcgtcgtcggagccggcttcctcggcgccgaatgcgccgccgtggcccgcggcctggggtgtgcggtgaccctgctggaaccggcgccggtgccgctcgcgcacgccgtcggcaccgagatcggccgggtgctcgccgcggtgcacaccgaccggggtgtcgatctgcgcaccggcgtcgcggtcagcgcggtgaccgggcgcggcgtgctgctggccgacggcacccacctggaaggcgacgaggtgctggtcgcgatcggctccctgccgaacaccgagtggctggccggcagcggcctgacgatcggcgacggcgtggtctgcgacgcgttctgcgcggccggcccgggcgtctacgccgccggggacgtggcgcgctggcatcacccgctgttcggcgtggacctgcggatcgagcaccggaccaacgcgggggagcaggccatggccgccgcccgcaacctgctcggcgccggccggccgttcgccccggtgccgtacttctggtccgagcagtacgacctgaagatccacgcgtacgggcatccgcggctgcacgaccgggtcgaggtgaccgaggggtccctggcgcaacgccggttcgtcgcggtgtaccaccggggtgaccggatggtcggcgcgctcgccgtcgacatgccgccgaaggcgatccggccgtaccggcagcggctgctggcggctggcacgatttga

SEQ ID NO: 7951 - DNA, 1206 bp, Actinoplanes utahensis
atgaccgatacggttcccgcctacccgttcgctcaccccgccgccctcgacccgtctcccgaatgggagcagctgcgcaacgagtgtcccgtcgcccggatccgcctcgtcagtggcgacgaggcgctgctggtcacgcggtacgacgacgtcaaggggctgctcgccgacccgcggttcacgcacagcctcgcccggccggacgccgcgaagatctccgcctcggacgacggcggcgtgttcaaccgggaggagtccgcgatgatcgccagcccggaccacccgcgctggcgccggatgatgaacaggtcattcacggtcaagcgggtgaccgcgatgcgcccgcggatcgagcagatcgcccaccggctgatcgacgagatggtggccgccgggcagcccggcgacctgcagtcggcgctcggtttcccgttgcccgtgttcgtgatctgcgagctgctcggcgtcgacccgggctaccgcgacaccttctcgcactggtccgacgccatgctgaacctgaccaggttcgaccaggccgagctgaccaaggccgcggtggaattccaggagttcatggcccagcacgtgcgggacaagcgggctgagccgggtgacgacctgctcagcgagctggccgcgatcgtcgacagccaggacggccggatgaccgagaccgagctggtcctcaccgcccagggcctgctggtggccgggcacgagaccaccgccaacatgatcggcaagatggtcgcgatgctgctcgccgaccggccggcccgttgggagcggctggtcgccgaccgcggcctgatcaactcggcggtcgaggagtcgctgcggttcgacgcgaacccggggatcggcctgccccgctacatctccgaggacatcgagatcgccggttgcccggtcaaggccggcaccgtggtgatggccagcatggccgccggcaaccgcgacgagaccgcctacgagcaggccggcgagatgcgtctggaccgctcgcccaacccgcacctgagcttcggcgccggcccgcactcctgcctcggccaggcgctggcccgcaccgagctgcaggtcacccttgcggtgctgctggaccggctgcccaccctggagctggcggtcccgccggaggagctgcggcgccgcaccggcctgatcgtcggcggcctcgaggaggttccggtccggtggtga

SEQ ID NO: 7952 - DNA, 360 bp, Actinoplanes utahensis
gtgctgctcggcgtggtcgggctctacctgtggcagcggctcagcccgctggtggtcgagggggtcaccgtggcggtgccccagccggccggggaccgctgcgacgtcaccgtgccggtggtcgccaccgtgcgcaccaacggccgtggcggaaccatccgttaccagtggttccgctccgacgcggcatccggcgcgatgctgaccgagcgggtcggtcgcgggcagcgcaccgtcacgctgaccctcaagtgggcgttcagcggggtgggcaccgccgccgagaccgccaccgtcaacatcgtcgagccgaccccggtgcaggccggcacccgggtcgcctaccactgccggggctga

SEQ ID NO: 7953 - DNA, 1374 bp, Actinoplanes utahensis
atgcgcgtacgtcccggagaaaccgaggtagttcgccgcggtgtagggggcggcctcggcggcggacagcaccggccgggccggggtgcccggcgcggcgagcaggccggccagcatgagcagcaccgctttcatggagcctcctctgcaggaatgcgctttcctgctgcaccataccgtcgattgtggtcgatgtcccgcggatggtgtcggccatccgacgcgagagagcagccgttgcgtcgatgcccggttgaccgggggtggtcacaatgggcggcgcggcggggaccgatccccgcccttcgacgagactgtggagcatcccgcatgagcggctggcagccgaccggctacacacctgttcgtgcgctcggcgccggcgcctccggcagtgtcgtgctggccacccacgacgcgaccggcaccccggtggcgatcaaacacctgaccggccagatcagcgacgacgccgcgttccgggccgccttccggcaggaggcgcggctgctcggcgagatcgacgacccgcacgtctgccgcctctacgagtacgtggagtccgccgacggcgcggcgatcgtgatggagctggtcaacggggtgtcgctgcgtcagatgctgcgcgagcacggcccgggcaccccggaggcggcgctgtgcgtgctgaagggctcgctgtccgggctggccgcggcccacgcgcacggcgtcgtgcaccgcgactacaagccggagaacgtgctggtcaccggcgacgggcggagcaaactcgccgacttcggcatcgccgtgccggtcggccagggcgccgccaccgtcgtctccggcacgccccgctacatggcccccgagcagtggaccggcggcgcggtcaccccggcctgcgacatctacgccgccaccgccaccttcttcgagtgcctgaccggccacccgccgtacgacggggccaacctgttcgccctgcacgaccagcacgcgcacgccccgatcccgaccggggcgaccccggagccggtgcacgatttgctgcgccgcgggatggccaagcagcccgccgaccggccgccgcacgcgttggccttcctcgacctgctggagcgggtggccggcgccgcctacggcccggactgggaggaccacgggctgcgcgacctggcccgtcgcgcggcactgctcgccgcgctgtggccgttcccggacggctcctccggcgcgaccagcgtggccaccaccacgttcggcagcagcgcggtgagcccggcacgtcggctgcgccggggccggcggaccaccgcgctggccgccggagcgctcgtcgcggccgtgctgctcggcggggcgggctaccacttcgcggtcgctagctag

SEQ ID NO: 7954 - DNA, 1143 bp, Actinoplanes utahensis
gtgaccgcttttgtggagtccgaggaacgccgggagctgcgtggggcggtcgcccggctcggccgcaagtacggcgaggagtacttctacgccgccgcccgcgagggccgcaagaccaccgaactgtggcaggaggccgcggcgctgggctacctcggggtgtccattcccgagcagtacggcggtggcggcggcgacatcggcgacctggccgcggtcctggaggagctggccaccgcgggctgcccgctgctgctgatggtggtctccccggcgatcgtcggcacggtcatcgcccagttcggcacggccgagcagcagcggcgctggctgcccggcctggcgaccggcgcggccacctacgtcttcggcatcaccgagccggacgccggctcgaacacccaccagatcgccacccgggcccgccgcgacggcgacgactggatcctgagcgggaccaagacgtacatcagcggggtcgacgaagcctcgtacgtgctgatcgtcgcccgggtcggcaagcgcccctcgctgttcatggtgccggtcggcgcgcccggcttcacgtatcgccggatcgacatgggcctggtcgcgccggaggaccagttcaccctcttcctggacgaggtgcggctgcccgccgacgcgctgatcggcagcgaggaggccgggttcgatcagctcttcgccggcctcaacccggaacggatcatggccgcctcctcggccaccgggatggcccgctgggcgctgcgcaaagccgtcggctacgccggcgaccgtgccgtctggggcgtaccgatcggcacccaccaggcgatcagccaccccctggccaagctgcacatcgagatcgaggcggcccggctgctcacccagaaggccgccgcgctgcacgtcgccggtgagctcaaggccgccggcgaggccgccaacatggccaagtacgcggccggcgaagccgtctgcgccgccgtcgaccaggccatccagacgcacggcggcaacggcctggccaccgagtacggcctggtccaggccctggccacgtcccggctgacccggctggccccggtcagccgggagatggcgctcaacttcgtcgcccagttctcgctggggctgccccgctcctactga

SEQ ID NO: 7955 - DNA, 1875 bp, Actinoplanes utahensis
gtgatgatccgcaggctgctggtcgcgaaccggggcgagatcgcccgccggatattccggacgtgtcggaatctcggcatcgagactgtcgctgttcatcgggaggagccggacctgcatgtccgggaggcggacatcgccgtggccgccgacttcctcgacgccgaacagatcatcgacgccgcccgcagggccggggccgacgccatccaccccggctacggcttcctgtcggagaacgccgacttcgcccgcagaaccgaggccgccggcctgatctggatcggccccgacccggacgccatcgcggcgatgggcgacaagatccgcgccaagaagctggtcgccgcggccggcgtgccgatcctcggcggcgacgccgacacgtacccgctgctgatcaaggccgccgccggcggtggcggccggggcatgcggatcgtcaccgacccggggaccctgcggtccgaactggccgccgcggccgccgaggcgcagtccgcgttcggcgacggcacggtcttcaccgagccgtacctgccccgcgcccgacacgtcgaggtccaggtcctcggcgaccggcacggccggatctggatcgtcggtgaccgggactgttcagtccagcgccggcaccagaagatcatcgaggaggcgcccgcgccgctgctgcccgacgacgtgcgggccgcgttgcaccggcacgcacgggccgcggccgaggcggtcggctaccgcagcgccggcaccgtcgagttcctcgtcgacggcgaccggatcttcttcctggagatgaacacccggctgcaggtcgagcacccggtcaccgaggcggtgaccggtctcgatctggtcgcccagcagatcgcgatcgccgagggtcacgccctgccgccggcgccgccgccgatcaccggccacgccgtcgaggtccgcctgtatgccgaggacccggccgcgggcttcgccccgcagaccggtgagctgcgcgctttcgacttcgccgccgccggcgtccgggtcgattccggggtcgaggcgggcagtcgggtcggggtccgctacgacgcgatgctcgccaagatcattgcgtacggaccggaccgccccgccgcgcttcgcctgctcgccgacgcgttgcgccgcgggcgcctgcacggtctcaccacgaacctgcccctgctgcgcgcgatcctggccgacgacgacttcgccgccggccgcctcgacaccgccctgctcgaccgcaagctcgccgcgtggaccggcgtcgggcaggaccacgcggtccgcaaagcggcgctggcggccgccgtgggatcggcggtccggaccgccgggtccgcgaatgttcaggcacgcatcccggccgcctggcgcaacgtgcccagcgccgcccgcgtccggacctaccgctgcctcgatcgggagtacgcggtcacctacaccgcccgctgcggccggatcgagtcctcgtggctgcccggcgtcggcgtcgtgtcggtcgacggcgaccgggtggtcctcgacgaccacggggtccgcgagacgtaccgggtgacgccgcacgccggcggcgccgacgtgcacggcccggccggcccgtacgacctgctcaccgtgccggtgttcggggacccggccgcgaccctggccgccggctccctgctggcgtccatgccgggcctggtcgtcgcggtccacgtgggcgagggcgaccgggtcgcggccggtgccccggtggtcgtcctggaggccatgaagatgcagcagaccctgaccgcgcccgccgacggggtggtcaccgccctgtccgcggcggtcggccgccaggtcgccgccggcgacgtgctagcagtgatcgacgggagctga

SEQ ID NO: 7956 - DNA, 1575 bp, Actinoplanes utahensis
gtgaccctgccaccctcgtacgacctcaatcggaccgcgatgctggagcgtgtcgcggatctggagcggcagcacgccgtcgccgtggccggcggcggcccgaaggcggtcgagcggcaccaccgccgcggcaagctgaccgcccgggagcggatcgagctgctgctcgacgaggattcggcgttcctggagctgagcaccctggccggctggggcaccgatgtcaccgtcggcggttcggtggtgaccgggatcggcgtcgtcgagggcgtcgagtgcatgatcgtcgccaatgatccgacggtgcgcggcgggtcgagcaatccggtcacggtgaagaagagtttccgggccgcgcagatcgccgccgagaaccggctgccgacgatcaatctggtggagtcgggtggcgcggatctgccgacgcagaaggacatcttcattccgggtgggcggcatttccgcgggttgaccgaggcgagcgcggatcggcggccgacgatcgcgctggtgttcgggaatgcgacggcgggcggcgcgtacgtgccgggcatgagcgactacgtggtgatggtcgccggcggcgcgaaggtgtttctgggtggcccgccgctggtgaagatggccacgggggaggagtcggacgacgagtcgttgggtggcgcgcagatgcacgcccgcacgtcggggctggccgatttcctggcggtggacgagaccgacgcgatcaggatcggccggcagatcgtgcgacggctgaattggcgcaagctgggcccgccgccgcgggccgggtatgccgagccggtgctggacgccgaggaactgctcggtctgattccgtcggatttgaaggtgccgttcgatccgcgcgaggtggtgtggcggatcgtcgacggcagcgagttcgacgaattcaagccgttgtacgggacgagcctggtgaccggctgggcccggttgcacggccatccgatcgggatcctcgcgaacgcgcagggtgtgctgttcagtgcggaggcgcagaaggccgcccagttcatccagttggcgaatcaggcggacacgcctctgctgttcctgcacaacacgaccggttacatggtcggtaaggagtacgagcagggtggcatcatcaagcacggcgctcagatgatcaatgcggtgtcgaattcacgggtgccgcacctgtcggtggtgatgggcgcgtcgtacggggccggcaactacgggatgagcgggcgcgcctacgacccgcggttcatgttcagctgggtgggggccaagtcggcggtgatgggcccggcgcagctggccggcgtggtgtccatcgtgtcccggcaggctgccgcggcggccggtcggccgttcgacgaggaggcggacgcgcggacccgggcggcgatcgaggcgcagatcgagcgggagtccctggcgtacttcacgtcgggcatgctctacgacgacggggtgatcgatccgcgggacacccgtaccgtgctcgggatctgcctgtccgtcattcataacgcgcccgtgcagggcgctcgtggctacggagtgttccggctgtga

SEQ ID NO: 7957 - DNA, 1893 bp, Actinoplanes utahensis
atgcgcaccatccgcgtcggcaactgctccggcttctacggcgaccgcctgaccgcgatgcgcgagatgctcgagggcgggccgctcgactacctcaccggcgactacctggccgagctgaccatgctcatcctcggccgcgaccgccagaagaacccggacaccgggtacgccaagacgttcctccggcaggtcgccgactgcctgtcgctggcccgggcccgccacgtccgcatcgtggccaacgccgggggcgtcaacccgggcgcccttgccggggcgatccgggcactcgatccgacggtccgggtcgcccacgtggccggcgacgacctgctgaccggggcctttccgggcgcgctgaccgcgaatgcctatctgggtgccttcggcatcgcggaagccctgcgatccggcgccgacatcgtggtcaccggccgggtcaccgacgcgtcactgaccctcggccccgcgatcgccgcattcggctggcggcgcgacgaatacgacaaactggccgccggaatcgtcgccggtcacatcctggaatgcggcacccaggccaccggcggcaacttcagcggattcgccaccatcgacaccagccggccgctcggcttcccgatcgccgaaatcgacgacgacggtgccgtggtcatcaccaaacatccgggcaccggcggggccgtcaccgaggacacggtcaccgcccagctcgtctacgagatcgacagcccgagatatctcaacccggacgtcaccgcgcgcctcgacaccatccggctcgccgcgccggaaaaggaccgggtagcgatttgcggggtacggggtgaagctccacccgccacgaccaaaatcgggatcacccgcctgggtggatatcggaacacggtttcgttcgtcctcaccgggctcgacatcgaagccaaagcggcgtgggtccgggagcagttcgaatccggtctcggcaggaggccggagactctcgtctgggacctgatccgcaccgaccgtccggacccgggcactcaggccgagggcgcggcggttctgcactgccacggcaaggatgccgacccggatgtcgtggggcggcccttcagcggtgcggccatcgagctggcgctggcgtcgtacccgggattccacgtgacggggccaccgtcgggcgcgactccctacggggttttcgaagcggcctatctgcctcagggtgaggtgccgcacgtggtggtgctgccggacggcgtgcgcgtcgaggtggcggcgccggggtgggagcgtgccggggtttccgccgggtcggggcggccgggtcgcgtggtgtccgctgacggggttcacgctggtccgcccgcctcggagcgcggggacgttgtccacactggcggcttgtccacaggggatccgcatgatcgtggcgttggcgacgatactggctcagggatggtccccctgggagggcgggccgtggtggacggggggcagcgcagccacccgacgaccaccgaacccccgaaccacccggcacccgacggctaccgccaccacaccagagcccccctcggccacctcctgcacgcccgctccggcgacaaagccggcaccgccaacctgggcatctggatccccgccgcccacccccaccgcctggccgccttccgctggctgacccgttggctgaccgccgaccgcctccgcaccctcctccccgaatccaccccgttcccgatctccctgcaccccctcccgaatctctgcgccctcaacatcgtcatcgccggcctgctcggcgacggcgtggccgcctccacccgccccgacccgcaggcgaaggccctcggcgagtggcttcgttcccgtctcgccgacatccctacggagcttctgtga

SEQ ID NO: 7958 - DNA, 633 bp, Actinoplanes utahensis
atgggccgatcgagaaccaaccccgcccccaccgccccggtcaccgcgcgcggccggcgtacccgcgatgcgctgctggccgccgggcgtgagctgctggagacccggggctggccggctttcacgccggagcaggtcgcggcggccgccggggtctcgtacgggaccttctacacgtacttcgagtcgaaggacgacctgctgggcgcgatcgtgcgggcggtcgccgaggagatgttcaccgacagtctggtcgcgccggacaccgccgacgacccgtacgtccgcatcgtcgcctcgaaccgtggttatctgcgcgcgtggcggaacgcctcgcgggtgttgcgcctggtggagcagggtgcggcggccgacgacacgctgcggcagctgctgctggaggtgcgcgagcggtatgtgcatcgcggtgccgagggcttgcgccgcctgcaggaggccgggctggcccgcaccgatctggatccgcggctgaccgcgatcgtgctgggcgccatggtcgagcagatggcgcacgtcatctactcgctgcgcgagccgctcgacgaggaggtcgtggtcagccacatgtcgaagctgtgggccgcggcgatcgggctccgcgggcatccttga

SEQ ID NO: 7959 - DNA, 738 bp, Actinoplanes utahensis
gtggacgtcgaggagatcacgagcgagacggtgcggccggtggcccgcgccgtgctcgggcagcgctggaccgacctggccttcctgcactgggcggtcgacccggaccgggtggcgccgctgctgccggccggcaccgtgccggatgtcatcggtggcgtcacgtacgccggcgtgatcggtttccggatggaacggatcggtttcctgggcagccccggcgtgccgtacctgggcacgttctgcgagacgaacgtgcggctctacagcgtcgacgcgcagggccggcgggccgtggtgttccgctcgctggaggccgaacggctgattccggtgctggtcgcccgggccagcctgcagctgccgtacatgtgggcgcggatgcgcatcgtccgcgacggcgacgagctcgcctacgtctcccggcgtcgctggcccggcccgcggcccgcgaccaaccggatgcggatccgggtcggcgcaccgatcgccgaaccgtcgcccctggaggacttcctgaccgcccggtggggactgcacacccgggcgtggggacggacccggcacctggccaacgatcatccccggtggccgctgcaccgtgccgagctgctggacctggacgacagcctgctggcggcggccgggctgcccggcatcgacaccccgccggtcagtgtcctctactcgcccggtgtcccggtcgtcttcgggccgaccggccgcgtgtcccgctga

SEQ ID NO: 7960 - DNA, 108 bp, Actinoplanes utahensis
atgacgctgagcagccggggcgacgggctcagcctcgacgagctgacgaaggtggccgcgcaggtgcgggtagaccccgccgggctggaccggctgggtcatccttag

SEQ ID NO: 7961 - DNA, 141 bp, Actinoplanes utahensis
gtgtcaccattcgacgggcgtgggagcgttttcctgccgtcaccgagttcctgtcccggcggtgcgaccctgaccgtcgccggccacccggcccggcacccgcagcgcaccgacgcacccggcaagaaccggcccacctga

SEQ ID NO: 7962 - DNA, 972 bp, Actinoplanes utahensis
gtggagagcatcaccaagaaccgccagagcccggatgtgctgcgcgcgatggtcgagcgcgcctacggccgggcggaggtgcccgccggtgacgactggtacgtggagctgagccacggctggttcaacgtggcgtaccggatccgcctgcggtccggacaccggacggtcctgaagatcgcgccgccgcccggtgtcgaggtgatgacgtacgagcggggtgcgatggcgaccgagctggccgcgctgcgcctgatccgcgagcacaccgacgtgccggtgccggaggtggagttcgtcgaccgcagccacgagctgtgcgacgccgactacttcttcatggcgttcatcgacggcgacaacctcggcatgctgcgcgggcagcaatcgccgcgggagcgtgccgcgtacaacctatcgctgggcgagatcaatcgccggctcaacgccatccgcggcgagcggttcgggccgctcgacggctccggcgacccgagttggcgggtcgtgttcaccgcgatgatcgagggggtgctgcgcgacggggaacgccgcgacgtgccgctcggcttcggctacgacgaggtccgcgcggtgatcgccgcgcatgccggcagcctcgacgaggtgaccgagccgcggttcgtcgagtgggacatgtgggacaacaacgtgatggtccgcgacggccgggtcgtcgcgatcatcgaccacgagcgggcgttcttcggcgatccgctgatcgaggccgggttcaccggcagcgaggtgcccgcctacggcgactcgtcggcgttcatccaggggtacgggcggggcccggccaccgaggccgagcggatccgccggcgcctctactgcctgtacctggcgttgatcatgacgatcgagaccgcttaccggaattttcccggcaccggcaactacgactgggccagtgagcggctcaaggagacgatggcgctgttctga

SEQ ID NO: 7963 - DNA, 159 bp, Actinoplanes utahensis
atgatcgccggtgggtggaggacgtcatccggggcagcatccgggctgcggccgcgtgacctcggcgaggaggtttctgcgctacggcccggcgtcctgccggccttcgtccgccgacccgacggctggcaagccgttcatgatctccacgagggctaa

SEQ ID NO: 7964 - DNA, 195 bp, Actinoplanes utahensis
gtggcgctcagcggggacggacgcaccctcgccaccggcagccacgaccacaccgcgatgctgtgggacctgaccgatttcaacgatctccgcgatcgggcgagcgaacgggcctgcgcgatcaccggcggactcagccacgaagactgggccctctatgttcccgaactcgcctacgagcccacctgcccttag

SEQ ID NO: 7965 - DNA, 1422 bp, Actinoplanes utahensis
atgcgctacgacgcgttcatctcgtacagccatgccgctgatggggcgttggcgccggcggttcagcgtggcctgcagcggctcgcgcggcggtggcaccggccgcgggcattggaggtgttccgggatcagaccggcctggcggtgagtcacgccctgtggtcgtcgatcaaagtcgcactggatcagtcggagttcttcgtgctgctcgcctccccggaggcggccgcgtcaccatgggtgaaccaggagatcgagcattggctgtcgcggcattcggttgaccggttgctgccggtggtgacgtccggcgagtgggtgtgggacgccgacgccggcgacgtggacttggagcgttcgactgcggtaccgccggcgttgcggggcgtgttcggtgaggagccgcggcacctggacctacggtgggcccgggcggaacacgaactcgacttgcggcacggccggttccgggacgcgatcgccgagttggcggccggtatgcacgggatgagcaaggaggacctcgacggtgaggacgtcatccgtcaccggcagatgctgcggatgcgtcgaggcgcgcttgctgtggtgtgtgcgctgctgctgttggtggccggtacggccgtggcgtggcgcaacgcccggggtgaggtgaccgcgacgaatgtcgcgttgcagcggcagcgtgctgccacggcggccgagcaacaccgaactgaggaggctgccgaccaggctcgtagtcagcagcagattgtcgaggctgagcagcagcgggcgcagaaggccgccgaggaggcgcggggccaacaggctgtcgcggaggctgagcagcaacgggctctgcgggcggcgggggaggcccggcgccaggagggcatcgcggcggctgaacagcggcgggcgcagaaggccgccgcggaggcgcggcgccagcggggtgtcgctgatgcggagaaggcgaaggcgaaccgcgctgccgcggaggccgagcggcagcggaagatcgctgccgacgagcagcgcaaggcgcacgaggctgctgcggaggccgagcggcagcgggaggaagccgtcaagcagcagcgcatcgccatcggccggcgactcttggggcaggccggcgaagcccgcgaccgggatccgagaaccgcgattcagctggggatcgcggcccggcacatctacccggggccgcagtcgcaggccggactggtcgaaaccctcgtaaggactcactatgcgggcaccgttaccggtcacaccgccgtggtcagcgcggtggcgctcagcggggacggacgcaccctcgtcactgacggccttgacggcaccgtgatggtgtgggatccgaccgaccgcgccgccccacggcggctggcccagctcaccagcagcaccgctccggtgtacactagctag

SEQ ID NO: 7966 - DNA, 2193 bp, Actinoplanes utahensis
atgagcgacatccaggatcagaaggcgtcgggctgcccggtcgcccacgactcggccaccgggcacggcggcagcgagagtgagaacccggggattccctcgccgcaggcgcgcaccggcggccgcccgcggggcaaccgggactggtggcccaaccaactcgacctgtccgtgctgcatgcccactcatcgaagagcaacccgctcggcgaggcgttcagctacgccgccgagttcgccaagctggacgtggaggcgctcaagcgggacatcaccgaggtgctgaccacctcgcaggactggtggccggccgacttcgggcactacggcggcctgatgatccggctcagctggcacgccgccggcacctaccggatccaggacggccggggtggcgcgggcgacggcgggcagcggttcgcgccgctgaacagctggccggacaacgcgaacctggacaaggcgcgccgtctgctgtggccggtgaagcagaagtacggtcagcagatctcctgggccgacctgctggtgctggcgggcaacgtggcgttggagtcgatggggttccagacgttcggtttcggcttcggccgggtcgacacctgggagccggaggagatcttctggggtccggaggacgcctggctcggtgacgagcggtatgtctccgacaagacgatgtccgagggtgtcggcgccaccgagatgggcctgatctacgtcaacccggaggggccgcgcggcaacgccgacccggcgcaggcggcgcacttcatccgggagacgttcgcccggatggcgatgaacgacgaggagaccgtcgcgctgatcgccggtggtcacacgttcggcaagacgcacggcgccgcggtcgccgccgaccacgtcggtccggagccggagggtgcgccgctggaggcgcagggcctgggctggctgagcacgcacggcagcggccgggccggggacacgatcaccagcggtctcgaggtgacctggaccgacaagccgacacagtggagcaaccggttcttcgagatcctgttcggctacgagtgggagctgaccaccagcccgggcggggccaagcagtgggtcgccaaggacgccgaggcgatcatcccggacgcgcacgacccggcgaagaagcacaagccgacgatgctgaccaccgacctgtcgctgcgcgtcgatccggcgtacgagaagatctcccgccgtttcctggagcaccccgacgagttcgcgctggcgttcgcgaaggcctggtacaaactgctgcaccgggacatggggccggtgtcccggttcctcggcccgtgggtgccggaggcgcagctgtggcaggacccggtgccggccgtcgagcacccgctgcccggtgacgccgagatcgcccagctgaaggcgacgattctggagtccgggctgagcacggccgacctggtcggtgtcgcgtgggcgtcggccgcgacgttccggtcgaccgacaagcgtggcggggccaacggtgcccggctgcgcctggagccgcagcgttcctgggcggtcaaccagccggtgctgccggtgctggccaggctggaggagatccagcggtcgtcgaccgtgaagatctcgctggccgacctgatcgtgctggccggtgtggccggggtggagaaggcggcccgtgacgccggcgtcgaggtcagcgttccgttcaagccgggccgcaccgacgcgacgcaggagcagaccgacgtcgagtcgttcgccgtgctggagccgcgcgccgacggattccgcaactacctgcgcccgggggagaagctccagcccgaggtgctgctggtcgagcgggcctacatgttgaacctgaccgcgccggagatgaccgtcctgctgggcggcctgcgcgggatcggggtcggggccaccgggtcggggcggctcaccaacgacttcttcgtcgacctgctggcgccgggcacccggtggacggcgtcggagtccgaggagcacgtctacgaggttcgcgacgcgagcaccggggatctgctgcggacggccaccgccgtcgacctggtcttcgggtcgaactcgcagctgcgggctctcgccgaggtgtacgcgagcgccgacgcgcgggaccggctcgtgcgggacttcgtcgccgcgtggaccaaggtgatggagaacgacctgttctga

SEQ ID NO: 7967 - DNA, 1026 bp, Actinoplanes utahensis
atgctgagctgcatgacaccggcagcaattcctactggaacagatccgcggtacgtcgtgatcggggccggcgcggtgggcgcctcgatcgccgctgagctccaccgggccggggcggacaccctgctggtggcccgcggcgcccagctggcggcgctgcgcgcggacgggctccgctacgttcgaccggacggtgtccaccaggtgcggatcccggtcgtcgccggaccggaggaggtcgagctgggcgagcacgacgtgctcgtgctggcgaccaaatcgcaggacaccgcgaccgcggtacgggactgggcgtggcgtccggtgaaacgcgccgacggcgccaccggcctgtccgccaccgacctccccctggtcaccctgcagaacgggctggacaacgagcgggccgcactgcgctcgttcgcccgggtggtcggcggcgtgatcggcatcccggccaccttcgtggtccccggcgaggtggtcaaccacgccgccgacgcgcccgccgtcctgttcctcggcagctacccggcccccgcgagcgacccgctggccgagcggatcggggccgggctgcggcggggcggtttccgtgtgcacgtggtggcggacatcgtggcgtacaaggccgggaagctcctcggcaacatggccaacacgctggacgcgctctatccggagagtcccctgcgggacgccgcgctcaggacgctgcaggccgaggccaccgccgtcctcgccgccgccgggatcaccccggccgccctggatctccacgagttccggctcggcgagatcccctcccacccgcgggtcggcgcctccacccggcagagcctggcccgcgccaccccgccggagaccgactacctggacggcgagatcgtcctgcgcggccggctgcacggcatccccaccccggccgccgcggcgatccaggcccggctgcaccgcgccctcgccgacgggaccccgcccggctcactgaccgacgacgatctggcccgcaccctgccctga

SEQ ID NO: 7968 - DNA, 1128 bp, Actinoplanes utahensis
gtgccgtggtgcgcgggctggcccggggtttcgccgagcggcacgccaacccgctgggtctggcgatctcgtcgtaccgagggatggacacctattttgacgtctcgaacagtgccgacccggctcccgcgacgcagcggattctcctggtatcggacgatccggttgaacgccgccggacgcctgcttgatgacgccgccgagccggtgccggccgcccgggtccgcgagcacctggcgtcccggctgcggctgccccggtcggtgaccgacatcttcgtgttcgtgcacggctggcggacgccgcaccgtaccgcgcaatcgtcttttgcccggttcttcggtgcggtgtggaacggccgggagcgatgggcgtcgctgcccggcgcggccggaccgttcgtgccgtggttcatcggggtgcagtggccgtcgagcagtgcgccgaccccgggcggctatcagcggatccgggagcgggcgcacgcggtcagcaccggcgggcacgccgccttcgtgctcggccagctgctcggctacctcgatgagcagcgggaccggccgcggcgcggcgcggaccggctgaccaacgcggccgggcagtacgtgcactgcgtcgggcactcgttcggcggtcggttcctgggtgaggcgatccgccgggccgccgaccgtcccgccggcacgctgggctgggaccatcgcagccggcatccgttcggggtggacacgtatctggcgttccagatggcggcgccgccggacatcttcgacggccggctggccgggatcctgaccgacggcgtggtgcacggccggatcgtgctgacctacagccggctcgatcacgccaacgcgatctggcaccgggcgatggagcgcaggccgggcatcggggcggtcggcgcgaccgccccggccggtctggtctcgacgattccgctgcaccgtcccggcgacccgtaccaccgggcggacttcgccaccccgatcgtcaacgtggacgcctcgccggtcttcacccggccgcggctgagcgtgaccggcgcccactccgactactggcacgcccactcgatccacctgctgctgagcctggccgcgctggcccggcccaccggcggctga

SEQ ID NO: 7969 - DNA, 2673 bp, Actinoplanes utahensis
gtgccggcccagctgccgccgggcaacagcaccttccggggccgggccgtcgagctgagcacgctgcgggagcggcacgaccggtggcgggagcggcagcgcaccagccagaccgaggcgccggtgctgatcttcctgcacggcatggccgggatcggcaagacggcggtggcgcagtccctcgcgcacgccctgaaggaggattacccggacggccagttgtacgccaacctcggggtggccggcacctcccggtccccggcccaggtgctgcacagtttcctgcccgcgctgggctgggacgtcgagcggatcccgacctcgaccgccgagcgggcctggctgttccggacgctgacccgggacaagcggatgctgatcgtgctggacgccgcccgcgaccaggcccagctgcgcgacctgatgcccagtgagagccggtgcgcggtgatcgtcaccagccggcgggacatgagcccggcgttcggggcgcggtcgttgcagttgcggccgctgtccaccgacgacggcatcgacctgctggccgcggtgctcggctacggtgtcccgttcgatctgggcgcggccaccgcgatcgtgtacgcgtgcggcgggcatccgctggccctgcgggcggccgccgatctggccgcgcagcgccggatgtcgctgcccgcgctcgccgacgagctgcgcgagccgggcggtctgcgcgccgtgctccgggcgccgagccgggatctgcacgaccgcctcagcggccagtacaaggcgctcggcccggaccatcagaaggcgttccggttgctgtcgttcgtcggctcggacaccttcgtgccgtgggtgttgcggcccgcctcgggggtggcgctgcccgaggcggagagcctgatcgccgacctggcctcggcgcagctggtgctggccgccggccgggacgaggtgaccgcgatcgaccggtacgcgctgccgccgatcgcccggcagctggccgtgtcgctggccgagccgggcgacgacccggacggggcgcggcggcgcatcgacgaggcgtacctggaggccgccgagcgggtgatccgggagctggacgccgggttcgcggccgcccggccggcgtcgccggtccgctggctgccggccgacgcccggttcgcgcaccgggtcgccggccgggggcaggccaaggtgtgggtgcgggaggagtacggcaatctgctgcgggtgatccggctggccgccgagcgcggcgaccacgccctgatcacccggatcgcctcctggctgggtggctgcgcgccgcggggcgtgccggcggccgaggtgctggacgggttccggatcgcggtcgactcggcgcagcacctgggtgcggcggcccgggcggacgtgctgctggcgcggggcgcctaccggaccgcggtggagcggtacaccgcggcgttcgaggatttcgccgaggcgcagtcgctgtgccgcaccgggtcgctggcctcgcgccgggtgctgctggagcgccgctgcggggaggcgcatctgcgggccggcgagttcaccgcggcggccggccggttcgcccgggcgcaggagctggcggcgcggctgccggccggggcggccatgctgccgctgctgcggacgttgcgccggctggccgatccggatgcgggcccgccggagccggtggagccggtcgatccggccggaccggggcagcccgatgacgagctggcgtactggtcggcgctggccgggtgtgaccgggcggtggccggcgacggctgggacaccgccgagcggatcctggcggcggcggccgccgactaccacgacgacctgcgccgggcggcgaccatcgcgtactggcaggcgcggctgcacctggcccgccaccaccgtgccccgggatccggccacctgcggccggccctgcgcgcggcgcaccgcagcctgcacgaccacctgctgctcggtgacccggccggtcaggtccggacccggtgtgtgctggtcagcgcgtatctcgcggccggccggacggatctggccgatcggcagctgcaggaggcccggcgggcccgggccggggtcgacccgtggctcacccggcccgggaatccgctggacgcgctgctgcgccgggcccgggccgaggccgcccggcacgccggccgggacgaggaggcggtgcacgagttgcgccgggcggcgctggtgctggccgccaacggcgatcggcgggcggtcgccgagatcgccgggctgatcggcgacgatccggcggtgctgtggcgcgacgcggaggcggaggccgggtcggccggtgcggtgcgcgcctacctggaccacgggccgccgatcaccgtggggcaggcggtcaccctgcgggtcgagatctcggcggcccacctgcgccgctaccgggatgtcgtgagcggcacctcgctgaccgtcctggtctgcgccgacggcgccgacgtggtcccgatgggcgcggcggtggacctgcgcgacctgcgcgacgacgtgcggctggtgcacgagctgcgcccgcggatcgccgggccgttcagcgtcaaggtgcagttgtacgcgccgggcgacggcgtgctcctgcaggagttcgaggccggtctggcaccggtggcgcgggccgagcgggaggcggcttga

SEQ ID NO: 7970 - DNA, 2439 bp, Actinoplanes utahensis
atgccaacttcgcgtacggaaggtgaccgaccctcgattgcccggcccgactcgggcatcctgacatcaaggcagcggccgtcggcgcggagcggaggtgtggtgcaccgggaaccgggaaccgttcgcttgtggatccgccggctcggcgcggtcacgctcgtcgtgatgccggtggccttcgcccggatcgtctccgcctcggcgcacagcgacggcctgttcgcctggctcgccctgttcgccggctatctggtcggcgtgctcgggatcggcctggccgtcgtcgtcagccggcaggacgggccccgcccgccggtcccgctggtcccgcgggagctgccggccgtcccgccgctgctgctcggccgcgccgaccgggtcggcgaggcggtggcctacctgtccgccgcgaccggtccggcggtgcgcaccgtggtgatcgccggcgcgcccgggatcgggaagaccgccgtcgccctgttcaccgcgcaccgggtggccgcccgctacccggacggccagctgttcgccaccctggacgcccgtggccgggaccccgacgagatggtgcgtcgcacgctgatccggttcctgctggcgctcgggcacccggccgagcgggcggccgggctggacgtctgccgccaggagttccagcggatgtcggccggcaaacggctcctggtggtgctcgacgacgtgcacgggctggacccgcagccgctgatcccggccggcgcgggcagtgccgtgctgctcacctcgccgcaggtccggcccgggcgggcgccgcacctgctgctgccgctggagccgctggccgaccgggacgcggtcgcgctgctcgcccagatcgtcggggagcagcgggtccgcgacagtctgccggccgccaccgcactcgcccgggcctgcgccgggctgccgctcgccctgcagatcgccggccaggccctggtggcccgcccgtcggcggacatgtcggtggtcctgtcccgcgccgacgtcgcgtccggtgactcccggccgacggagcggggccgcgatccgcggtcggtggagccgggtcatgacccgcgccggtgggcgctgaacgtcagctacgagctgctcagccgcggcgaccgggacgccgtgctgagcctgggccggctgtcccgtcgcttcgagccgtggatgctggccgcggagaccaatctggacgaggatcaggcccggtcgctggccgatcgcctgtccgccacccagttcgtcgagcggtggaccgccgacgcggccggcgtgccggtctacgagacggtcgagcacgtgcaggatttcgcccggctgcgggccggcggcgaccgtccggcgccgccgcacccccggccgcgcacccgcgatccgctggacgagcagcggatccacacctatgacctgctggacaagggcagtctggtggcggccgacgtcaacgtccgcgaggtgctcgaccgggcccggcaggccggcgaccagccaggagtcggcaaggcgctggccgcgctggccgagctgcgcgccgagctgggcggcaccgacgaggtggtggacctggccgagcaggcctggcagcaccaggatccggggatccgggcccgggtgtaccgggtgatgggccacatccagcgccgggtccggcagctcgacgtcgccgagcgcaacctgtcccgggcgctgcgccacgccgggcaggccggtgacgagccggagcagatccgggtgctgaccgagctggccctggtgcaccggctcggcggccgggccgctcaggcgctggagcacaccggccgcgccatggcgctggccgagggccgccgcgacggcggcatccgctaccggtcgcggattctgctggccgagggcatgacactgatcaaattgagccggtacgccgaggccgagcagcggttcgccgacgcgcgcgccgcggccgaccgggccgggtaccggttgtggcggcagtgggtcgactaccgggacgcgcaactgcacgtccgctccggcgacgcggtccgcgcccaggatctggcgatcgcggcgctcgccgggttcaccgggatccggcaccgctacggcaccggccactgtcgcctgttgctgggccggatccacgccgacgccgggcagtacgcggcggcccgcacggtgatcgaggacgcgctggagaccttccgcaactgcggggaccggttcatcgaggggcacgccgcggccgagttggccagcgtgcatctccgggagggctcgctggccgcggcggcggacgcgctgcgccgggccaagcagctcaagaccgggcagcggtactggcagacctcgctgcgtctgaccggggcccgcctgcgtcggatggccggcggtggcgcgccacgccgggtggaaccgatcgcgccgtccagcccggtcgggtggtga

SEQ ID NO: 7971 - DNA, 3096 bp, Actinoplanes utahensis
gtgcacccggttcccgagctgcgggaagcggccgccggggcggaccggcgggtcggtagtgttcgagcgaccagcccgccgacagattgccctgacaccgtgacaaccgccgcactctccaccgacctcgtccggagcctgaaccaggccggcgtcaccgatgtgctgaccgacccggcccaccgctcggcgtacgccagcgacgcctcgctgtaccgggtggtcccgcgggcgatcgtccggccccgccacgacgaggacgtggcggcgaccctgcgggtgtgccgcgagcggggcgtcccgatcaccgcccggggcgccgggacgtcggtggccggcaacgcgatcggccccggggtgatcctcgacttcagccggcacctgaaccgggtgctcgaggtcgacggggacggccggtgggcccgggtgcaggccggcacggtgcaggccaccctgcaggccgcggcgaaaccgttcggcctgcggttcgggccggacccgtcgacccacacccgctgcacgatcggcggcatgatcggcaacaattcgtgcgggtcacggaccttgggctacggccgtacgtcggacaacgtcctggccctgaaggctctgacgatcgacggcgagcagctggtcaccggcccggtcaccaccggcgccgacaagacggtcgccgccctcaaggacctgatcggcgcccacctcgcggtcggccgcaccgagttcggcaccttcggacggcaggtctccggttacgcggtcgagcacctgctcccggagaacgggttcaacctcaccgagttcctggtcggcagcgagggcaccctcgcggtggtgaccgaggccaccgtgcggctggtcgccgacccggtgcaccgcaccctggtggtgctcggctaccccgacttcggcaccgccggtgacgtcatcccggccatcctggagttcaagcccaccgcgtgcgaggggctcgaccaccggatctgcgacgtggtccgcagccgccgcgggccggacgcggtgcccccgctgcccggcggcgccgcctggctgatggtggagatcgccggcgacgacctcgacgaggtccgcgagcgggtggccgggctggtcaaggccgcccaggcggtcgattcgctgatcgtcgaggacaccgcgcaggccgccccgctgtggaagatccgcgaggacggcgccggcctggccgggcgcgctcccggcgggctgccggcgcacgccgggtgggaggacgcggcggtcccgcccgcgagaatcggggcatatctgcgcgacttcgacgcgctgaccgcgcggcacggcctgcacgccatgccgtacggccacctcggcgacggctgcgtgcacgtccggctcgacttcccgctcgacaagccgggcggaccggggagattccgcgcgttcctggaggacgcggccgacctggtggtgagctacggcgggtcactctccggcgagcacggcgacggccgggcccgcagcgaactgctcagccggatgtactcgcccgccgcgctggacctgttccggcggatcaagcacaccttcgacccggacaacctgctgaacccgggcaacctggtcgaccccgacccggtcgacgcgaacatccgggtgtcgcaggcccggccggtcaccacgaaactggcgctggcgtaccacgccgacggcggcgacttcaaccaggccgtgcaccggtgcaccggggtcggcaagtgccgggtcgacaccacggtcctcggcggcgtgatgtgcccgtcgttcctggccaccagaaacgagaaggactccacccgcggccgcgcccgggtgctgcaggagatgctcgacggcgatctcgcccccgactggcgggccgaggccgtccacgacgccctcgacctctgcctgtcctgcaagggctgcgcgtcggactgccccaccggcatcgacatggcggcctacaagtcggaggttctgcaccagagctaccggggccgcgcccgcccgcgctcgcactactcgctgggctggctgccgcgctggtcccggctcgcctccagggtgccggccctggccaacctgatgaccaacctgcccggcatccggcgcctcgcgctgtacgtcgccggcgtcgacgcccggcgctccatccccaccttcgcggaccgcacgttccgctcctccttccgcggcgtccagaccggcaagccggtcatcctgttcgtcgacagcttcaccgaccacttcgccccggacatcgcccgggccgccgtcgacctgctcaccgacgccggctacgccccacgggtgaccagccgcacagcatgctgcggcctgacctggatcaccaccggccagctggacgccgcccgccgcatcctcggcgccaccgtccacgaactgcaccaggccgtcaaacagggcatcccgatcgtcggcctggagccctcctgcaccggcgtcctgcgtcaggacgccgtcgaactcgtcgacaccgaggccgcgaaggaggtcgccgctgccacccggacggtcgccgagctgctggccgccacccccggctggaccccgccctcgctggccggggtccgggtcatcgcccagccgcactgccaccaccacgccgtgatgggctgggaagccgacgccaaactcctgaagagggccggcgccacggtcaaacgcctgggcggatgctgcggcctggccggcaacttcggcgtcgaacgcggccactacgaggtctccgtcgccgtcgccgaacagcagctgctgcccgccctggccgcggccgaggagggcgacatcttcctggccgacggcttctcctgccgcacccaggcggacgacctggccaaggtctccggcctccacctggtccagttgctcgccgacgcgctccccgccaaccgctccgctgccaccaccggcgactccggcaccggccttgccggcgcgggtgactccgctccgggcgcccccgctccgggtgcctccgctccgggcgcctccgcctcgggtgcctccgctccgggcgcctccgcctcgggcgcctccgccccgggccacgaagctcgccttggggacgaggagtga

SEQ ID NO: 7972 - DNA, 405 bp, Actinoplanes utahensis
gtgaccggcgacatccgctcgttcgagggggccgactacgagccggtcgccgcggtgtgggcggcggccggggcgggcgtgctgtcccgcgacgagctgacgcggaaactgacccgcgacccggacctgttcctggtcgccaccgacggcccggaactgaccggcgccgtgctgggcacctgggacggccgccgcggctggatcttccgcctcgcggtccacccggaccaccgccgccggggaatcgccaccgccctggtccgcgaactggagtcccgcttccgcgccctggactgcccacggatcaacctgctggtcctgcccgacaacgaggccggtctgcgtttctggcaggacctcggctacctgcccgccccggacgtcctctgcaccaaaccgctctga

SEQ ID NO: 7973 - DNA, 1026 bp, Actinoplanes utahensis
atggtcgaatggggcatgctgctcgccccgttgcttgtggccgcggtgaatgcggcgccggtctgcaggatcgccgacaagcggatggacgagctgtcggggctggtcacgaccgccgacgggtatgtcgtggtgaacgacgggtcggatgaggcgtcgcaccgcaggattttctacctgcggaaggactgctcggtggcccgggcggtgtcctatccgtcccgtccgcgggacaccgaggatctgcaactgggccgggacggcatcctgtgggtcgcggacatcggcgacaacggccgttcccgggacacgatcgccctgtggcggctgacccccggctcgtcgaagccgcaactgctgcggatgtcctacccggacggcgcccacgacgcggaagctctgctgatcacggccgagggcagcccgatcgtggtgaccaaggagcccggagcggccgggatctacgtcccggacggcggtctgcgcgccaccggcaccacccggctgaagcgggccggtgacgtctcggtgccgttcacctcgaccagcaacccgttctccctggccggccgcctgctgatcaccggcgcggcgaccagcccggacggctcccgggtggtgctgcgcacctacgccgacgccttcgaatacgacgttcccggcggcgacgtcgtcaaagccctggtctccggcacaccccggcagattccgctcccggacgagccacagggcgaatcggtcgcctacaccaccgacggcaccgccctgctcaccgtctccgagggtgcgaaaccgcccatcctcagacacccgctgcccgacactcccgccacaccccgctcccccgcgtcgtcaacagccgaccaggcggccccgtccgccgccgtcccacccgccgccgccgaagcggtccgggcaacaccgaagagctcctcctcccgcctccccctggtcctcctcctcatcgccgccaccgccctctgcctcgccgccgccatcgccgccgcccgccgccgcaagcgctag

SEQ ID NO: 7974 - DNA, 2247 bp, Actinoplanes utahensis
atggaagcgcgtagtcccgccgaagtgatcaaggatgccgtcaccgcggtgaccagcgagaagaagccggatgtgccgggcgccccgggcagcggcacgcccacggtcgaggagccggccacgccgcgggagcccctcccgcccaaacccgagcagggccagccggacacccgcaccccgaccggcgcgcccaccggtgcgccgccgacggcgtacggccagcagggtccttatctgaccaccgcgcagggtgcccgcctgcgggacaccgaccactcgttgaaggccgggccccgcggacccattctgctgcaggaccaccacttccgcgagaagatcacgcatttcgaccacgagcggatcccggagcgggtggtgcacgcgcggggcgccggcgcgcacggcgtgttcaccagttacggcaccgcggcggcgctcacccaggccggcttcctgaaggagaagggcaagcagaccgacgtcttcgtgcggttctccacggtgctcggctcgcgcggctcggccgacacggtgcgcgacacccgcggattcgccaccaagttctacaccgacgagggcaccttcgacctggtcggcaacaacatgccggtgttcttcatccaggacgcgatcaagttcccggacatcgtgcacgccgccaagtggcacccggaccgggagatcccgcaggcgcagagcgcgcacgacacgttctgggacttcgtctcgctgcacaccgaggcacagcaccacaccatgtggaacatgtccgaccggggcattccgcggtcgtaccggacgatggagggtttcggcgtccacacgttccgcctggtgaacgacgccggcgagaccgtgctggtgaagttccactggaaacccaagctgggcgtgcactcgctggtctgggaggaggcgcagatcaccaacggcgtcgacccggacttccaccgccgcgacctgtacgactcgatcgaggccggcgcctacccggagtgggagctgggcctgcaggtcttcccggacaatccggaggagacgttcgccgggatcgatctgctcgacccgacgaagatcgtgccggaggagctggccccggtgcagccggtcggcaagctggtcctcaaccgcacgcccaccaacttccacgccgaggtcgagcaggtcgccttccacctgggcaacctggtgccgggcatcgacgtgaccaacgacccgctgctgcagggccggctcttctcctacctggacacgcagctgacccggctggccgggccgaacttccaccagatcccgatcaacgcgccgcacgccccggtcaacgacatgctgcgggacggcttccaccagcacgcggtgcacgcgggcgtggcaccctaccgccccaactcgctggacggcggcaacccgttcaccaccaccgagggcagcttcgtcgatgtgcccgtggtggtcaccgaggcgcccaagatccgcgacctgccggtgtcgttcaaggaccactacacccaggtgcggctgttctggcagagcatgacgccggtcgagcgtgagcacatcatccgggcctacaccttcgagctcggcaagtgctaccaccaggcgatcaaggaacggcagctgcagtgcctggccaacatcgacccggtgctctgcgagcaggtcgcgctcggcctggggctgcccgccccggcgccgtcgatcgacctgcccgaggtcacgccgagcgccgcgctgtcccagatcggtcagcagtggccggccgacgggcggatcgtcggcatcgtggtcgacgagaccggcggcgacgccgcggtggccgagatccgcgaggcgatcgccgccgccggcatggtcccgctgatcatcgctccgcacggcggcaaggtcggcggattgacggtgcagcggaccttcgccaccgcgcggtccatcgagtacgacgcggtgctggtggcggccgccccggtcccggcgccggacgcggtgccggcccgcgacgagaaggccggcgcgccgcgcaccgcggccgtcgacccgcgggtgaacatgctggtcgacgaggcgtggcggcacgccaaggcgatcggcggctggggcaccggcgccgacctgctgcgccgaaccggcctggccgacacgccgggcgtggtggtcggcgactcggccaccgaggtgctgaccgcgctgcagcagctgatggccaaccaccgtgtgtgggaacgcttcccggccacggtggcctga

SEQ ID NO: 7975 - DNA, 2319 bp, Actinoplanes utahensis
atggcggataccccgcatgaaccccggcaaacggtccggccgagcatcggcccggcccggacggcgtctcgcggacgcgtcacgacgaccatccggccctgttcgtggccgacgatcgggtcggtccggacgtcggtggcggtcccggttttgtcgtacccctccagtatcaaggtcactgtcacgagagcccgacgaaacgagtgcctgatgcctaccgagcccgagatcgcccccgtcgtcgacgcggcgcacgccgagccgttcgacaccgccgcggactaccgcgcggcgatcgagcggatccgggcggccgccgcggcctactacgcgggcaccgacctggccatggacgacgccacctacgacgcgctgctggcccgggtcaccgccaccgaggccgcgcgacccgggtggacggtcgccgagtcgcccagcgacacggtcggcgccggcggcggcgtcaccggcgacgtgcagcacagcaccccgatgctgagcctggccaacgtcttcgaccccgacgagctgctcgcctgggcggcccggctggaccgggtcctcggccggcccgccgccggctacaccgtggagccgaagatcgacggcatggcgatcgccgcccgctacaccgacggccggctggtccaggtcgccacccgcggcgacgggcgggccggggaggacgtcaccgcccaggcccggacggtcgccggcctgccggccgagctgacccggccggtcaccgtcgaggtgcgcggcgaggtgttcatgaccgatgaggacttcacccgggccaacgaactgcgtaccgggcacggcggcgcaccgttcgccaacccgcgcaacgcggcggccggcacgctgcgcgcgcaggaccgggcgtacgtcgcgccactctccttcctagcgtacgcggtgcacgacctgcccggcggcgagggcctcacgcacagcgcggcgatggcggcgatcgccgagctcggggtggccacgaccggtggctcggcggccggcatggcggtctgcgccaccgccgacgagctggtcgcggcgatcagccgcctcggcgcgctccgcgacaaactcggcttcgacatcgacggcgtggtcgtcaaggccgactcccccgccgaccgggacgccgccgggtcgtccagccgggcgccgcgctgggcgatcgcctacaagttcccggccgacacccgcaccagccggctcaccgcgatcgaggtgcaggtcggccggaccgggctgatcaccccggtcgcggtgatcgagccggtccaggtcggcggcgtggtggtcacctcggccaccctgcacaacttcggcgacctggtgcggcgcgacgtgcgggtcggcgacacggtcttcgtccggcgggccggcgaggtgatcccggagatcaccggggccaaactcgacgagcggcccgagggcgccgagccgttcgccgcgccggagcactgcccgcgctgcggcggcgacatcgaccggtcgcagaaacgctggcgatgcgtgcagggccgggcgtgcggcgccaccgagtccctggcgtacttcgcggcccgcgactcgatggacatcgagggtctcggcgacaaggtgatccgcgcgctggtcacggccggcctggtcaccgacccggccgatctgtacgacctggacgccgacacgctcgcccggctcgagcgcctcggccgcacctcggcggcgaaactggtcgccaacatccaggcctccaaacagcagccgctgtcccgggtgctgaccggcctcggcgtgcggatgaccgggcggtcgatgtcgcgccggctggcccggcacttcggcaccatggaggcgctctgcgcggcgaccgtcgaccagctgcaggaggtggcggcggtcgggccggaacgtgccgccaccatcgcggccgagctggccgacctggcgccggtcatcgccaagctcaccgagcgcgggatcacgatgagcgagccgggagtgacgccctaccacgagcgggtggtggcgacggcagagaccgggctgccgttgcagaaggaggacggcacgccgatgacggtggtggtgaccggatcggtgccgggcctgacccgcaacgagggcaacgaggcggtggaacgcctcggcggcaagtcgtccgggtcggtgtcgaaacggaccgacctggtggtggtcggtgacggcgccgggtcgaaagcggcgaaagctgaggagctgggggtccggatcatggcgtcggaccggttcgcggcgctgctcgccgcgcacgacgccggggaggcgccggcgctcgacgactactga

SEQ ID NO: 7976 - DNA, 873 bp, Actinoplanes utahensis
gtggggcccggagagccggccgacgtcgtggtgaccctggcggcggcgcccgcgtcaccctcacccacgccgtccccgtcggcctcgccgtcggccgtgccgtccgcatcgccgacctcgtcgccgtccgcgtctcctacggcgtcgccgtccgcgagtccgagcgtggcgccgccgccggccggcccgccgtccggggtcaccgcccaggcgggcatctcgtcgatcgtcgtgagctggaatccaccggccgacaccaccggcgtcacctcatatcgcgcgaccgccagcccgggcccgggtagctgcagctcgagcggcaccagctgtgtgatgggggccgcggcgggcacctcctacacggtgacggtgaccgcggtgggtccgggtggcgagtcggcggcgtccgggtcgtcgaacggggtgaccccgtccgcgccggaagtgccggccaccgtgcccaccaccgacaagacgctcaccacgccggccggcaccgacaacacggtggcgccgggcgggacggtgaccatcaccggtgagggatacgcgccgttctcgacggtgaccgtcatcatctattcctcgccgctgaacctgggcacggccaccgccgacgcccagggccggatcagcgtgacggtcaccatcccgtccgggttgccgatcggggaccactcgatcgtcgcctccggcgtcgacaagtccggtaacgccctggtccgccgcctcgacgtgaaggccgccgcgaagaccgccaccgagacaccgaccctgcccaccaccgggccggccgtcatctggctgctgatcaccggagccgccatgatcctgaccggcgtgacggcccgcatcatcgccgcccgccgttag

SEQ ID NO: 7977 - DNA, 615 bp, Actinoplanes utahensis
atgaccgagaccacgcggccctacattccggccatggggcggcacgggatgctgttcctctacgatccgttcacccgggtggccgggctccggcgggtgcacgccgaactcctcgaccgggccggggcgcggccggggcagcgggtgctggagatcggctgcgggccgggtgatctgctgctggcgttggcgcggcgtacgccgcaatccgatctgaccggaatcgatccggatccggcggcgctgcgcaaagcgcgacgcaaagcggcgcggcgtggtgtcgaggtgcgtttcgagcaggcgtacgcggattgcctaccgctgccggatgcgagcgtggaccgggtgctgtcctgctacatgctgcaccacctggaaccggaggcgcagtcggcggcgttccgggaggtgcggcgggtgttgcggccgggcggcgagctgcatctggtggatgccgacggtgcggcgcacggactgtcgctgcggctcgccgggcagactccggagcggattgtggaccttatgcggtcggccgggctgaccgatccggcccataccggcaggggcgcggggcgggtgatcgggcggtacgccttttaccgggccaacgcctga

SEQ ID NO: 7978 - DNA, 963 bp, Actinoplanes utahensis
atgcaggccagcgtcggggacatcgtcggatccgtggcagggataggacattcttcggttccgcatagccaggcggcccggatggcccggaccaccgccggtggggtgccggtcgccgtcttcgagcgcgcgccgggcgtcccggcggtggccgtgtcgcggctgcccgacgtgccgctgaccgcggccgtgctgcccgggcggcgcacccacacgcacgacttcctggtccttttctatgccgcccgcgcggccggcaccgtcgtcatcgatgaccggaactggtcagttgccgacggcgacctgttcgtcatcgcgcccggccaggtgctgtccttcccggagccggccgacgggatggtcgccgacggctgggtggtcttcttcccggccgacgtgatccgctccggcgcctgttcgtcgtggcgcgcccacccgctgctgttcccgttcgcccacggcgcgcggcgcgcccagcgcctgcacctgccacccgccgaccgcgacggctgggtcgccggcctgcgcgccctcgacgccgagctgcgggccagggcgagcggtttcgccgaggcggccctggcgcacctgaccctgctgctggtcgcggtcgcccgccgctgcaccggcgtcgccgaggaaccgttgatcgccgccgtgctcgacgtcgtcgagcggcgcttcgccgagccgatctcgctggccgacgtcgcggccgagctgtccctgaccccggggcatctgaccaccgtggtccgccgccgcaccggccgcaccgtgcagcagtggctgggcgagcgccgcatgcaggaggcccgcctgctgctgaccgacaccgatctgacggtggcggcgatcgcccaccgcgtcggctacccggacgtcagctatttcatccgccgcttccgcaccgcgcacggcctgaccccgtgccgctggcgcacctacccggacccaccctga

SEQ ID NO: 7979 - DNA, 1101 bp, Actinoplanes utahensis
atgctcggggaggaagaggcgcaggccgccgccgacgcggtccgctccggctgggtcgcccagggcccgcgggtcgcccggttcgagaaggagttcgcggccaccgtcggcgcggcgcacggggtcgcggtcagctcctgcaccaccggcctgcacctggccctggtcctgctcgacctgcgccccggcgacgaggtgatcgtcccgtcgctgtcgttcatcgccaccgccaacgccgtgcgctacgtcggcgccacgccgatcttcgccgacgtcgacctggccaccggcaacctgaccgtcgagacgatcgacgcggtccgcaccgaccgcacccgcgcggtcatcgcggtccaccagggcggggtgccgttcgacacggtcgcgctgcgcaaggccgccgaagcctggggggtggccctggtcgaggacgccgcgtgcgccgccggctccaccgcctacggggcaccggccggcaccggcgcggccgtcgccgcgtggtcgttccacccgcgcaaggtgctcaccaccggcgagggcggcatggtcaccgtcgacgacccggacgtcgccgcccggctgcgccggctccgcgaacacgggatgaacgtgtccgcggccgatcggcactccagcagccagccggtcctcgaggcgtacctggagaccgcgtacaactaccggatgaccgacatccaggccgcggtcggcctggtccagctcggccggctcgccggtctggtcgcgcagcggcgttccctcgccgcgcgctaccacgagctgttggccgacatcgacggcctggtgccggtgcgtgacccggcccacggccagaccaactaccagtcgttctgggtgctgctcgacccgccgtaccggaccggacgggacgaggtgctggccgaactcgcccggcgcggggtgtcggcgcggcgcggcatcatggcggcccacctggagccggcctacgccgacgtgacgccgggaccgctgccggtcaccgagcggatcacccgggactcgctgatcctgccgctgcatcaccgggtgaccgacgaggaccagcagcacatcgtgggggtgctgcgcgacctcgcctga

SEQ ID NO: 7980 - DNA, 966 bp, Actinoplanes utahensis
gtgacggcagtatcgatcgagggcgcgcgcgccctggtcaccggcggggccggcaccatcgggtcgcatgtggtcgacgaactcgtccgcggcggggccgccgagatcgtcgtcctggacaacttcgtccgcggccgccgggagaacctggcctgggccatcgagaacggcccggtgaccctggtcgagggtgacatccgcgacgtggacctggtccgctcggtcaccgccggcaaggacctggtcttccacctggccgcgatccggatcacccagtgcgccgaggagccgcggctggccaacgaggtgctcgtcgacggcaccttcaacgtggtcgaggcggccgccgaggccggggtcaagaaggtgatcgcgtcctcgtcggcctccgtgtacggcctggccgagcagttcccgaccaccgagcgccaccacccgtacaacaacgacacgttctacggcgcagccaaggccttcaacgaggccaccctgcgcagcttcaaggcgatgaaggacctcgactacgtcgcgctgcgctacttcaacgtgtacggcccgcggatggacatccacggcctgtacaccgaggtgctgatccgctggatggagcggatcgagtcgggcaccccgccgctgatcctcggcgacggcctgcagaccatggacttcgtgcacgtggccgacatcgcccgggccaacatcctggccgcccaggccgatgtcaccgacgacgtgttcaacgtggcctccggcgccgagaccagcctcaaggagctggccgccgcgctgagcgcggtgatgaaatccgacctgcagccggagcacggcccggcgcgcgcggtcaacggcgtcacccggcgcctggccgagacccagcgcgcctacgacgtgatcggcttccgcgccgagatcggcctgcacgagggcctgcagcagctcgtcgactggtggcggtcctcccagtga

SEQ ID NO: 7981 - DNA, 1059 bp, Actinoplanes utahensis
ttgaacgcgtccgagccgatcgggatcgccgtcatcggggccgggtactggggccccaacctcgtccgcaacttccaggccagcccccagttccggctgcactggttgtgcgacctcgacaccgaccgggcccgccgggtcctcggcggatactccacggtgcgggtcaccgcggatctggaagagatcctggccgacccggccgtgcaggcggtggcgatcgccaccccggccggcacccacctcaaggtggcgctgtccgcgctgcgcgccggcaagcacgtcctggtggagaagccgctcgcggccacctatgcggagggccgccagctcgtcgaggaggccgacgagcgcggcctgaccctgatgtgcgaccacacctactgctacacccccgcggtgctgcgcatccgtgagctgctgcacgccggggagctgggtgagctgcacttcctcgactcggtgcggatcaacctgggcctggtccagcgggacatcgacgtgctgtgggacctcgccccgcacgacctgtccatcctcgacttcgtgctgcccgagggcgtcaccccggtggccgtcgcggcgcacggcgcggacgggatcggcgccggccgggcctgcgtggcctatctcacgctgcagctgagcaacggcgcgatcgcgcacatccacgtcaactggctgtccccggtgaagatccgcaccgcgatcttcggcggctcgaagcggaccctggtgtgggacgacctcaaccccagccagcggctggccatctacgaccggggcgtcgacgtggcctccccggacgagctcggcgacgagcagcgccgcgacatcctcatctcgtaccgctccggcgacatggtcgcgccggcgctcaccgagcgggaggcgctgcgcaccatggtggacgagtacgcgcgggcgatcaccaccaagacccccgcgctcaccgacggccgctccgggctccgggtgctgcagctgctgcaggccgcctcccgtagcctcaccgagggcggcacgatgatcacgatcgacgaagggcacatggcgtga

SEQ ID NO: 7982 - DNA, 822 bp, Actinoplanes utahensis
gtgtcaggtcagcaggactcatcaaacccttggcaagctatcgatccccttaggagcgacgctagatcgctgtcggataaccgcgcgcccggagggcaagccgatccgttcggtcgttccgggtcgccccaacggtcacatcgccggcccgcgtcgccttcccgacatcgcttcgggaggccctccgctaccctgtccgcgaccttacgtgagaggcgtttcatgactgacgtgaccgtggccgcgacggccgatgtggacccgcgcgccgagatcggcgagggcacccggatctggcatctggcgcagatccgcgagcaggccaccctgggccgcaactgcaacatcggccgcggagcgtacgtcgggcccggcgtcagcatcggcgacaacgtgaagctgcagaaccacgcgctggtctacgagccggccgtgctcggcgacggcgtcttcgtcggcccggccgcggtgctgaccaacgacgagtacccgcgctcggtcaccccggacggccgcctcaaggacggacacgactggaccgcggtcggggtcacgatcggtacgggcgccgcgatcggcgcccgcgcagtctgcgtcgcgccggtcaccgtcggccgctgggcgctggtcgccgccggcgcggtggtcaccaaggacgtgcccgatttcgccctggtcgtcggagtcccggcgcgccggatcggctgggtcggccgggccggcaaaccgctcaccgcgaagggcgacggcatctgggtctgcccggccaccggcgcccagttcaccgagaccgacggcatcctgaccgaaaacgagatctga

SEQ ID NO: 7983 - DNA, 1842 bp, Actinoplanes utahensis
atgtcggttttcgccgaggcagcggcgcttttcgcagggccgatgtggacgatagggtggccgcatgacgggaaatcttcggtgagatcgttcctcgcggtttccggtgcgctcgcgccggtcgccccggccccggtcctggcctgcctcagcggtgacccggtggtcacccgcacgtccaccggctgggtcgccaccggcggcgccgaccacggtgaccgcatcgaccaggacagcggggcgttcaccgtccgcctcggcaaggccgcccgcacccgcaccggcgacgtctccaccgaggccctcggcgtgctgctgcgcgacggtgtcaaggccgacggcccgctgctggccgcgctggtcccgccgttcgccgcggcgcacagcgagggcgccgccgcgccggtgatcgcggccaccgactggctcggcttccgccagctgttctggtggcagggccggggcgtcgcggccgtctccaccagtgctctcgcgctgcgcgcgctcgccgaggccgatctcgaccggccggcgctcgccgtgcagagcctggtcggctggcaggtcggcctgcgcacggtcttcgccggcgtgcacaaggtcccggccggctgcctcgcggtcctgcacgacggtcggatcctgattcaccggtacgtcgaggagtccctcgccgtggacggcccgtccccctcgctcgaggaggcggccgtcgaacaggcggccatcatgaccgcattccaccaggcgtatctgcgcgaccacccgcgttcggtgctgcagctgaccgggggacaggacacccgggtgctgctcgccgcgatcccggccgggctgcgcgccgggctgcccgcgctcaccctggacgtgcacggcggcaccgactcccggttcgccggccggctcgccgcgatgaccggcatgaaactgcacgtgcactggatggacgagggcccggcggtcaccccggccgaggcgttcgccctggccgtgcgcgccgcccgggaactggactgcatggccagcccgctcgccctggccccgctgctgcgcgccgagacccagctggagcagggccaccggctgtccgggctgggcggcgagacgtgccgcggcttctactacttcgggcagcccggcggggcgacgaccgggccgcggctgatcgagaaactggccacctggcggctgtacgccaacgaggcggtgcagtccgaggccctggcgcccgacttcgcggcgtccgcccgggccgacgccctcgagctgatcaccgcgtcgttcgacgggtaccccaccgactggctggccgcgaccgaccacttctacctgtatcagcggatgcagcgctggtcgggcgcgcacgggtcggtggccgccgccaaccggcacttcgtcaacccgatgttcgaccgacggttcatccagctggcgcacgcggtcaggcccgaggagaaacgccacgggctgctcaccggccggctgatcagcctgctcgacccggcgctggccgcggtgcccctcgactccgggctgatcccgaaccggctcggcagaccgggactggcggcgcgcaccgcggcctaccgggtgaccgcgcagaaggcggcccgcaagatccggcagaaggtgcgtggccaggggcgcccgcagctgggtgccggcgagatggccgccctggtggtcgagcactggcgatccgaaccggacagtgttgcgccgctgcgcgacaccgggctggtccgcgacgcctggctcggcgaggtgctcgccggtcgggccaccccggcgccggccaccgtcgccttcctggtcaacctgctggcgatcggggagaaatag

SEQ ID NO: 7984 - DNA, 1254 bp, Actinoplanes utahensis
atgcgggctccaatctggacgcggcgatcggtcgacgaggcgttctccgctccgggcaacagtttcggtttccttcgtctgctgttcgccttcgcggtgctggtctcccattcgctgccgctgggttacgggcgggaggatccgggcggcgggctcacccacgggcagaccgtgctcggcgagatcggcatcctcggcttcttcaccatctccggtttcctgatcacccgcagcgccggccgggtcccgctcccccgctacctgtggcaccgcggcctgcggatcctgcccggcctgtgggtgtgcctgatcgtcacggcgctcgtggtcgccccggtggtcgcgctgatcgagcacggcagcgtggccggggtgttcgccgagcccggcggcccgttcggctacgtgttccacaacctggccgtcgcgatccggcagtacgggatctccggcctgctgcgcgacacgccgtacgggcggctcaccggtgagtcggtcttcgacggctcgctgtggagcctgatgtacgaggtgttctgctacttcatgatcgccgggctggccctgaccggcctgttgaagcgggcccgctgggtggtcgcggcactggccggcggcctgttcgcggtgatcgtgcacgacttcctgaccgcgccgcgcatccccggcccgcagggggtgcacggcccgttcctgggcatcggcgggatcgacacgtactcgctggtctatctgacctacgtgttcctgctgggcgcgctgttcgagctgtaccgctcctcgatcgtgctcaacgagctgggcgcgatcgtggccgcggtcattctgctcggcaccacacaatgcggcggattcgacgttctcggctacccggccttcgcctatctgacgctctggctcgccattgcgctacccgccccattccggcgcatcggggtgcgtcaggactactcgtacggtttctacatttacgccttcccggtccagcagctgctcgccctgctcggcgtcccggcctgggggctgctgccgtacatcctgctggccaccgccggcacgctggtcttcgcgatcccgtcctggcacctggtcgagcggccggcgatggcgttgaagcactggtcgccgcgtcagcggaccaccgcgggcgaccaggcatccgggacgaacaccgcgggcgcgccactgccgttggccggcacggtccagacgtcgctggccgacggaccggtgcccgagcgcggcaggccgtag

SEQ ID NO: 7985 - DNA, 1218 bp, Actinoplanes utahensis
gtgtatctctcgctccgcgaccggccggccgaggatccggcggccggtccgaaggtccgggtcgccaccacggtggtgctgctcggcgtggtcagcctgctcaccgacgtctcgtcggagatggtgaccgcggtcctgccgctctacatgaccgccgagctcggcctgagcctgctcgcgtacggcgtcgtcgacggcctgtaccagggcgtcagcgccctggtccggattttcggcggctacctgaacgaccgcaccaaccggcccaagtgggtcgcggtgttcggctacggcatctccgcgctgagccggatcgcgctggtcccggcgcacaccttcgccgcgatcaccggggtgatcaccgccgatcggctgggcaaggggttccgcaccgccccgcgggacgcgctgatcgccgactcgtccgatccggccgtgctgggccgcgccttcggcgtgcaccgcaccctggacacggtcggcgcggcgctcggcccgctggtcgccttcggactgctgttgctggtacccggcggctacagctcggtgttcgtcgcgtcgttcgcgttcggcctgctcggagtcacggtgctggtgcttttcgtgccggaccggcgcaccgggggtgccggcctgccggcccggcggctggtgaccgaactgctcagcccgcggctgcgccggccgctgctggccgccggcctgctcggcctgtgcaccgtcagcgacgggttcctctacctgtcgctgcagcacagcggtgagttcgcggcccgctggttcccgctgatgtacgtcgggaccaacgtcgtctacctcaccctggcgatcccgctgggccggctctccgacagggtgggccgggcccgggtgttcctcgccgggcacgccgtgctgctgctcacctacctggtggccgggcggtccggcggcggcctggtcgccacgctggtcgcgctgggcctgctcggcgcctactacgcggccaccgacggggtgctgcccgcgctgatcagcaagcgggttccggccgaggcccggggcagcggcatcgcggccgcgcagaccgtggtggtgctggcccggttcgccgtgtcgctggcgttcgccgccctgtgggagtcgatcggcccgcgcgacgcgctggtgatcgcggctggtttcctggtggtcggcatcggcgcggccggatggctgctgaagggcatcgacaggtga

SEQ ID NO: 7986 - DNA, 1110 bp, Actinoplanes utahensis
atgattccgctcgtcgatctgcaagccgcccacgccgaggtcgccgaggaggtcgacgccggtttcaagcgggtcctggccaccaccggtttcgtcggcggtcccgaggtcgcggcgttcgagcgcgagttcgccgacttctccggcgccgcacactgcgtcggggtggccaacggcaccgacgcggtcgagctcgccctgcgcgcggccggggtcggccccggcgacgaggtcgtcgtcccggccaacacgttcgtcggcaccgccgagccggtcgcccggatcggcgcccgggtggtgctggccgacatggacccggcgacctacctggtcgacgtggacgccatgctcgccgcgatcggcccgaagaccagggcggtcgtcccggtccacctgtacggccagctggccgacgccgcgcggttgcgcaccgaactggccggcagcggcgtcgcggtggtcgaggacgccgcgcagagccagggcgcgctgcggcacggccgcggcgccggcgccgacggcctggcggcgaccagcttctacccgggcaagaacctgggcgcctacggtgacgccggcgcggtgctgacccccgatcacgagcaggccgatctggtacgaacgttgggcagccacggtggcctgcagaagtacgtgcacgacgtggtcggcgtcaacagccgtctcgacgccctgcaggcggtggtcctgcgcgccaagctgacccgcctggccgcgtggagcgccgcccgccgcgccgccgcggcccgctaccacgagctgctggccggggtggacgtcgtgctcccgcagaccctggccggcaacgagcacgtctggcacctgtacgtggtgcgcatcccgggcggcccgcggcgccgtgacacggtgctgggccggctgcacgaggccgggatcggcgccggcatccactatccgtacccgctgcacctgaccccggcgttcgccgacccgcggtatccggccggcagcttcccgcacgccgagaaggcggccggcgagatcctctcgcttccgctctacccgcagatcaccaccgagcagcaggaggcgaccgtgcgggcgctcgccaccgcgctgaaggactga

SEQ ID NO: 7987 - DNA, 936 bp, Actinoplanes utahensis
atgtcgacggcgctcgcgccggcgcggaccgggggcgacgagcggctcaccggattcgccggcgaaccgctcgcccaccggaggtaccggcgcatgcggttcatccggcggttcgaggagacgctgctccagctgttcgaagagggtgcgctcaacgggaccacgcacgcttgcatcggacaggaggccgacgcggtcgccgtcaccgagcacctggccgccggtgaccacatcttcagcaaccaccggtgtcacgggcactatctggcccactccggggacgcgctggggttgctggcggaaatcatgggcaaggacgccggggtgtgccggggcatgggcggcagccagcacatctgcgcccccggcttcaagtccaacggcgtccagggcgggatcgtgccgaacgcggccgggatcgcgctggcccaccagctcgccggcagcgacgcggtcagtgtggtgttcatcggcgacgggacgctcggggagggcgtcgtctacgagacgctgaacatggccgcgctgtggaaactgccgctgctggtggtctgcgaggacaaccggtgggcgcagagcacgccgatcgcggcgaacctggccggtgacatggccgcccggttcgccgcgttcggggtaccggtccgcgaggtggacagcaccgacgtcgaggagctcagcgcgatcgccggcgaggaggtcggcgcggtccgctcgggcaccggcccgcgggtgctgctgatccacacctaccggctgtgccaccactccaagagcgacgacgagcgtccggccgacgagatcgccgagcactggctggtcgagccgctcgtcgtgcacggccgccggctcgacgacgcggaccgcgcacggatcgacgacgaggtggagaccgcgctcgacgaggtcgtggcgacggcgagggccctgccgtga

SEQ ID NO: 7988 - DNA, 1011 bp, Actinoplanes utahensis
gtgatcttcgcgaaggagctgggtgacacgctgcgcggcgcgctcggcgacgacgagcgggtggtgctgctcggcgaggacatcgccgacccgtacggcggcgccttcaaggtgacccggggcctgtccacggcgttcccgcaacgggtgcgcaccacgccgatcagcgagggcgcgatcgccgggatctccgccgggctggccctggccggataccgcccgatcgccgaggtgatgttcggcgacttcctcaccctgatgttcgaccaggtggtcaaccacatagccaagtaccaggcgatgtacgccggacaggccacctgcccggtcatcgtgcgcgccgcgaccggcgggcaccgtggctacggtcccacgcacagccagagcctggagaagcacttcctcggcgtgccgcacctgcgggtggtggcggcgtcgctctaccacgacccgcgggtggtcttcgccgacttcctcagccgggacgagccggtgctgtacgtggagcacaagctgctctacccccagcacctgacgctgccggcgggtggcatggtcggcgatctgatcgccaccgccgacgcctcccccggcatgctgccgacgatccggctgtccgcggtgccggtgcaggactgcacggtcagcgtcctggcgtacgggtatcaggcgatgctcgccgcccgggtgatcgaacgcctggccatcgaggaggagatcttcgccgagctggtcgtgccggcccagatcgccccgatggactgggcgccggtcgaacgctccgccgcggtcaccggcagtctggtcaccgtcgaggagggcgccgacggctggtcgtggggctcggaggcggccgcggtgatgtcccgccggttgttcggccggctgcgccgcccggtcgacgtggtggccagcgcgcccaccgtcatcccgtcgtccaaggtcaaagaggccgaggtgctggtcggcgccgcccggatcgaggcggccgtgcgcgccgccgcccgttaa

SEQ ID NO: 7989 - DNA, 1107 bp, Actinoplanes utahensis
gtgaatcccgtcctggtgcccaccaacgacgtcaacagcgaacacggcatcctggtgatgtggttcgccgaggacggcgccgaggtggagaaggatgagctgctcgccgaggtggagacgagcaaggcggtcctcgaggtgctcgcgccggtggcgggggtgctgctgcacaccgcggccaagggggccgaggtgccgctgtcgcagccgatcgcgcagctgttcggatccgccgccgagcgcgacgcgcatctcgccgcactcgccgcggcaccggccaccgccgcccccgccgggccgcgggccacggtgaaagccgtacagcgggcggccgagctgggcgtggacctggccgcgctgggcctggaccggttgatcacggtcaaggacgtggaggcgtgcgcggctccggccgttcccccggccctgctggagccgttggccggcgcgcccgggcggcagcggatcctgatcgtcggggcggcgctcggggcgacccaggtcctcgacatcctggccggcagccggacgcagcaggcggtggcgatcgtggacgacgacgcgtcccggtggggtgcgtcggtgcacggggtgccggtggtcggcggcagtgaccggctgggggcgctgttcgccgagggcgcctacgacgcggcgatcatcgcgatcggccggtcgccggccgtccgtgcacggctgcgtgccgcgtgcgcggcggccggggtgccgctggccaacgcgatcgatccgaccgcgaagatcgccaccgacgtgtcgctcgggcaggggaacatcatctgcgcgttctgccacatcgcgaccggggtgcgggtgggcgacaacaacttcttctcggcgtacaactcgttcgaccaccacagcgtgatcggggacgacaacgccagcgggccgtccgtggtcacctcgggcaaggtgaccatcggctcgcggatccgcttcggcaccggcatcttcatcgaaccggacgtgaccgtcggcgacgacgcggcgatcgcctccggtgcggtgatcgtcagctcggtccccgccgaacacgtggtgaagaccaagatcgtgacgaccaccgtcgtaccgctgcgtcgttag

SEQ ID NO: 7990 - DNA, 1338 bp, Actinoplanes utahensis
atgtccctgcgtacccgcatttccgcagctctattggctgcgacactcaccggagccggctgggccgggacgccgctgcccgccgatgccgccgccggcggcacgtcccgcggtgtaacaattcccgatttttacaccccgccggcgaccctgccggccgctgacggcgccctggtgcggaccgagccgctcccgctggcgctctcgctgcccggcatcaccggcccgctgcccggcaccgcgacgcgcatcatgtacaagtccaccgactccaccgggcacccggtcgcgatcaccggtgcctacgtcgagccgtccgccgcctggaacggccccgggccccgccccctggtggtcctcgccccgggcaccatggggcagggtgaccagtgctccacctcgctggccctgcagcgcggcctgatcatcggcacggaggacaaccagttcaccgtctcgatcggctacgaggtgctggccatgtaccggatgctcgccaagggcatcgcggtcgtccagaccgactacgcgggtctgggcaccaccgaccgcctgcacacctacgtcaaccgggtcgacgagggccatgcggtgctggacgccgcccgggcggcccgggccctgccggccacctcactgtcggcgaggtcgctgatcggcctctacggttacagccagggcggcggcgcggtcgcctcggccgccgagctgcagtccagctacgcgccggacgtgcagctcaccgccacctactccggcgccccgccggcgaacctggccgcggtcaccgccgccatcgacggcagtgagctggtcggcgcgctcggctggtcgatcaacgggttcgtccagtccgatccggagttgcggccgctgctggaccggtatctgagcgacagcggccgcgccgtgctgaagaacctgtccaccatgtgtgtcggcgacgccatcctcggctatgcgacgaagcgcagcacgtcgtggacgaccggcggccagtcgctcgccgacatcgtggccgccgagccggtgctcaaggccttccttgccgagcagctgatcggcacccgcaagccggccggcgcggtccggatcgccaccggcgtcagcgacaacctggtcccgcacggccaggcccgtacgatggcggcgaactggtgctcacgcgggggcaacgtcgcttacgccccggtggtcctggccccgacgatcagcccgctgatcaaccacttcggcccgctgctggtcgaccagggcccggccgtcgactggctggccctgcgtctggccggtgtcccgtcgatccccacctgcgcgatcctgccgatccaaccttag

SEQ ID NO: 7991 - DNA, 204 bp, Actinoplanes utahensis
atgaatccttttgaggatgagcacggcacctatctcgtactgatcaacgacgagggccagtattcgttgtggccggaattcgccgacattcccgccggctggacaatcgccaaggccgccgcttcccgtcaggactgcgtcgactacgtcaacgagcactggacggacatgcgtccgaagagtctgatcgaggcgatgggctga

SEQ ID NO: 7992 - DNA, 6267 bp, Actinoplanes utahensis
atgacgattcccctgaccgccgcccagcgcggcatctggtacgcccggcagctggcgtccgacagccggatgcacaccatcggcgagtacctggacatcaccggcccgatccggaccgacgtgttcgaagccgccctgcgccgcaccgtcgacgaggcggactgcctgaccgtccgcttcaccgcgacgcccgacggcgaggtgcaccagcagaccggcgcggcggcgccctggcggctcacggtggacgacctcagtgacgaggccgaccccttcgaggccgcgatgcggtggatgcgcaccgatctcgaccggcccttcgagccggaggcgggccgggtgttccggtacgcgctgctgcgcctgtcccccgggcgtcacctgtggtggtccagctaccaccacctggtcctggacggtttcgggatgggcctcatcacccgccgggtggccgaggtctacacggcactgcacgcgggcaccgcggtgcccgcgtgtccgttcgggcgactgtccgatctggtggcccgcgaccgggcctaccaggaatcgccgcggcgcacgcaggaccagcagttctgggccgactacctgcgggactgcccgcagccgcgcggcctggcccacgcgcagccggcaccggccggaccggtgctccgccgctccgggtggatcgacggggcgaccgcccgcctgctgaccgagagggccgaggcctgcgggactcgctggccgctggtggtcgtcgccgcctgggccgcctacctgcaccggatgaccggcgagcgggaggtcgtcgtggggctgcccgcggccgcgcgccgcgatccgcacgaccgggtcacccccgcgatggtgtcgaacctgctgccgctgcgggtgcgggtggattccggggtcggcgtcaccgccctcgtcgagcaggtcgccgcgcaggcccggatcgtgctcgcgcatcagaactaccgggtggaggacctccgccgggaccggtcaccgggcgccgagctgatcgcctcccgggccaacgtcatgagtttcgcgtacggggtgagcttcggcgacgcccgcgcccgcgcgtacaacctggccggtggttttcccgaggacctcgcgatgctggtctgggaccggcgggacggcgaggactaccgggtggacttcgatgccaaccctcggcggtactccgcgccggacgtggtgggccaccgggaccggttcctggccttcctgacccggttcgccaccgcggacccaccggtcgagccggcgcggctcgacctgctgaccgacgccgatcgggcggcgacggcgcgctgggccggcccgggccccgccatcgaggcggccacgctcgccgagctcttcgccgcccaggtcacccgtacgccgcaggcgcccgccctggtgggcgacgacaccacgctgacctacgcgcagttggacgcggtgaccgaccggctcgcccggtcgctgctggcccggggcgtgggtgccgaggacctggtggcgctggcgtttccgcgctcggtgcactgggtgaccgccatgctcgccgtcaccaagaccggcgccgcctacctgccgatcgacccggcgtatcccgccgaccgcatccgctacatgctgaccgacgcgcgccccgtactgctgctgtccagcgcggagaccgcggccaccgtgccgtgcgccggtgtcccggtgatgatcctcgactccgccgaccccgccgaccccgccgcacccccggcgaggccggcaccggcacggccggccggtgccgacaacaccgcatacgtgatctacacgtccggttcgaccggacggcccaagggcgtcgcggtcacccaccgaggtctggccggcctggccgccgcgcagggtgagcggctgtgcgtgcgacccggggaccggatgctgcagttcgcgtcgccgagcttcgacgccgcccagtccgacatctgggtgaccctgctcgccggcgccaccctggtgactccctcggcggaccgcctcaccgtcggacctccgctggcggcgaccgtcgccgagcggggcgtgacacacctgaagctgccaccggccgcgctcgccgtcctgcccggcgacgccctcgacgggatccgcgtgctggcggtcgccggcgaggccctgccggagagcctggtcgcccggtggcacaccggccgccgcatgatcaacgtttacggaccgacggagaacaccgtcaccgcgaccctgagcgggccgctgacccccggcggcccggtgccgatcggcacgccgatcaccggcacccgggcgtacgtcctggacacccggttgcggccggtgccgccgaacgccgtgggcgagctgtatctgaccggggccgggctggcccgcggctacctgcgacgccccgcgctgaccgccggacggttcgtggcctgccccttcggtgcgccgggaacccgcatgtaccgcaccggcgatctggcccgctggacgtcggacggccggctggtgttcgccggccgggccgacgaccaggtgaagctgcgcggcttccggatcgagctcggcgagatcgaggccgtgctgagcgagcacccgggggtccggcaggcggtcgccacggtccgggaggatcgcggtggtgaccggcggctggtcgcctacgtcgtcggcgatgccgcccccgccgacgtgcgcgcgcgggccgccgccacgctgccggcgcacatggtgcccgccgccgtcgtggtcgtcgaccggataccgctgacccccaacggcaagctcgaccggcagtcgctgcccgcaccggactggtccgccgccggcgagccggcccgcacgccgcgcgacgaccgggaggagctgctctgccgactcttcgcgcagctgctgggcgtgccctcggtcgggcccggcgacgacttcttcgcgctgggcggacactcgctgctggccacccggctgctgggccggatccggaccgtgctgcgcgccgaggtgtccctgcgggagctgttcgccgcccccaccccggcccggctcgccgagctggtggccggctcccgccgcggtccgcggccaccgttgcgcccggtgccccggccggaggcaccgccgctgtccgcggcccagcgacgactgtggtttctgcaccggttgcagggccccggtgcgacctacaacatgccgtacgcgctgcggctgaccggcccgctcgacgtcgcggctctacgggccgcgctgaccgacgtggtgggccgccacgagagtctgcgcaccgtgttcgccgcccccgacggcgtcccccaccaggtgatcctgcccgcggaccgggcaacgcccgagatcagccggccggccggtgatcctgggcagtggttgagccgggccgcgcacctcccgttcgacctgtcccgggacctgccgatccgggtccacctgggtgtgctcggccccgacgagcacctgctgctgatggtgctgaaccacgtcgcggccgacggctggtccctggcgccgctcatgcgggacctgtcgaccgcgtacgccgcccggctcggcggcaccggtcccgcgtggcctccgctgcccgtgcagtacaccgactatgcgctgtggcagtcgcgactgctgggcacgatcgacgacccggacagcctgctgagccggcagctcgccttctggcgtaccgccctcgccggtgcgccgcagcatctggagctgccgaccgaccggccctacccggtcgagcggtccggggtcggcggccaggtgccgttcaccgtcccggcgcagctgcaccgggacctgctgcgcctggcccacgaccacgacgcgaccctgttcatggtgctgcacgcggcgttcgccgttctgctgcaccgcgtcggcgccggggacgacatcgtgatcggcaccccggtcgccggccgggccgacgaggagctggacgacctggtcggcttcttcgtcaacaccctggccctgcggaccgacctgtccggcgaccccggcttcggtgcgctgctcgaccgggtccgtgaccacgacctggacgccttcgcccaccaggacctgccgttcgaccggctggtggaggcgctggtccccgaccggtccaccgcccggcagccgctggtgcaggtcatggtgacgctgcaacgtgcggccgacgtcgcgctcagcctgccgggcgtgcacgccgaggcacacccggtgcacctcgacgtcgccaagttcgacctgaccgcgaccatcgtcgagcacgtcggcgccgccggtcagccggccgggctggacggccggctggagtacgccaccgacgtgctcgaccggcggagcgggcaggcgctcgccgagcggctgctgcggttgctgcggcaggtcgccgccgaaccggagcagcggatcggccggctggacgtgctcgacccggccgagcggcagcgcatgctggtcgacgggaacgccaccgccaccgcggtgccggacggcaccctggccgcgctgttcgcggcgcaggtggctcgtaccccggacgcgacggcggtgatcggcgacgacgtcaccctcacgtacgccgcgctcgacgcccgggcgaaccggctggcccggtggctgatcgcggcggggatcgggcccgaggacatcgtggcactgtcgttcccccgcggcgtgcggtgggtgacggcgatcctcgcggtggccaaggccggtgcggcgttcctgccgatcgaccccacctacccggccgcgcggatccgctacatggtcgaggacgcccggccccggatggtgctgacggtgaccgccaccgaaggcggcctgccggctctcgcggcgcccgtcacggcactggacggcgaggagatcgccaccgcgctgccggcgttgccggacacgctgccgccctgcccggccacgccggccaacaccctgtacgtcatctacacctccggctccaccggccggcccaagggcgtggcggtcacccacaccggcatcgccagcctggcggtggccaaggccgcccgcttcggcctcgacggcaccagccgggtcctgcagttcgcgtcgcccagcttcgacgcggccgtctgggagatctgcccggcactgctgtccggtgcggcgctcgtggtgccgtcggccgaccggctcaccgtcggggcgccgttggcggcgacgatcgccgaggccggcgtgacgcacctgaccctgccgccggcggccctcgccgtcctgcccggcgacgcgctggccggggtccggacgctgggggtggcgggcgagtcgccggccgccgaggtcgtgcagcgctggtcccccggccggacgatggtcaacgcgtacgggccgacggagaccacggtatgcgcgacggtcagccgtccgctgacgccgcgggaccggcccgcgccgatcggcgggccgatcaccggcacccgggtgtacgtgctggacgcccggctcgtaccggtgccgcccggggtgcccggcgagctgtacgtggccggtgccgggctggcccgcggttacctgcgccgtcccgcgatgaccgccgagcggttcgtggcgtgcccgtggggcgccgccggtgaacggatgtaccggacgggcgatctggtgaaatggaccggggacggtcaactgctgttcctcggccggaccgacgaccaggtcaagatccgcgggttccgcatcgaactcggggagatcaccggggtggtcgccggccagtccggcgtgcggcaggcgatcgtggtggcccgcgaggaccgccccggcgagaagaccctggcggcctacgtgaccgaggccgccggccggaccctcgatccgcagaccctgcgggacaaactggccgcggagttgcccgggcacatggttccggcggtcgtcgtcctcgacgccatgccgctgaccgccaacggcaagatcgacaaagcggcactgcccgcgccgaacaccgtcgccgcccccggccgggcaccccgggacgcccgcgaggaagtgctgtgtgcgctcttcgccgagctgctgggcgtaccggaggtgggcatcgacgacgacttcttccagctgggcggacactcgctgctggccacccggctgatcagccggatccgcgccgcgctgcgcgccgacctgaccatccgtgatctgttcaccgcgcgcacccccgcccggatcggcgaacgactgaccaccgcccgtcccgcccggccggccctgcgccgcatggcgaagaaagaggacgcctcatga

SEQ ID NO: 7993 - DNA, 6207 bp, Actinoplanes utahensis
atgaccaccctctcctatgcccagcaacggctgtggttcctgaaccggctggagggcggcggcgccacctacaacatgccgttcgcgctgcggctgaccggggagctcgacgtcatcgctctcggcgccgcgctgcgcgacgtgatcacccggcacgagagcctgcgcaccgtcttcccggcccccgacggcgtgcccgtccaacgggtgctggacccgggcgcggtggcggtggacctgaccgcgcgggacacctcggacgcgaccctgccacagctgctggccgaggacggccgccgccccttcgacctggccgtcgacccgccgatccggatccgcctgttcgcgaccggcccggacgaacacgtgctgctgctcgtcctgcaccacatcgccggcgacggctggtcggccgggccgctgatgcgcgacctgtccgaggcgtacgcggcgcggcggaccgggcagtcgcccggctgggacgagctcccggtgcagtacaccgactacagcctgtggcagcgggaactgctcggcgaggagcacggcatcctggccgagcagatggactactggcggacgaccctggccgggctgcccgcggagatcacgctgccggtcgaccgccgccatccggcggtaccgtcccaccggggcggccgggtcgccctgaccgtgccggccgagcggcaccgcgacctgctgcggctggccgcgcagaccgacagcaccctgttcatggtggtgcaggccgcggtcgccgccctgttgcaccggctcggcgccggcaccgacatcccgctcggcaccgcggtggccggccgtaccgacgaggcgctggaggatctggtcggcttcttcgtcaacaccctggtgctgcgcaccgacgtcgccggcgacccgaccttccgggagctgctgacccgggtccgggagaccgccctgggtgccttcgcccaccaggacgtgccgttcgacatgctggtggaggatctggcgccggcccggatcccgggccgtaccccgctgttccaggtgatggtgctgctgcagaacaacgccgtcgcccagctcgacctgcccgccctgcgggtccgcaccgagccggtcggcctcggcgtcgccaagttcgacctcaccgtcaatgtcgaggaacagtccgacgcggccggccggcccgccggactgcgcgtgctgctggagtacgccgaggacgtgttcgaccgggcgacggtgcaggcgctggccggccggttggaccggatgacggccgcggtcgccgccggaccggaccggcggatcggccggatcgacctgctcaccgccgccgagcgtgacctggtgctggcgggcgggaacgtcaccggcacgccgctgccggcccgcaccctgcctgcgatgttcgccgtccaggtggcgcgcaccccggacgccaccgcggtgatcggggacgaggtcaccctgacgtacgccgaactcgacgcccgctccgacactctggcccgctggctggtcggccggggggtggggccggaggacatcgtggccctgtccttcccacgctcggtgcactgggtcgtcgcccagctggcggtaaccaaggcgggggcggcgttcctgccgatcgacccggcgtacccggccgaccggatccgctacatgatcgacgacgcccggccggtactgctgtggacggtcaccgagaccgccgccaccctgcccgacctcgacgtgccggtgatccccctcgactcctccggcttcgccgaccagctcacggcatcacccaccgacccgatcacccccgcggcgacaccggcgaacaccgcctacgtcatctacacctccggctccaccggccggcccaagggcgtagtggtaagccatgccggcatcgccggtctcgtgcacgccctgaccgaccggtacggcatcgacgccggcagccgggtcctgcagttcgcgtcgcccagtttcgacgcggcggtcgcggacgtctgcccggcgctgctgtccggcgccgccctggtggtgccgtcggcgcagcgactgaccgtcggcgccgcgctggcggcgacgatcgccgagaccggggtcacccacgtgacgatgccgccggccgcgctggcggtacttcccgaggatgcgctcgccggtgtccacaccctggtggtggcgggcgaggccccgtccgacgaggtggtggaccgctggtcggcccggctccggatgatcaactgttacgggccgacggagaacaccgtcgtggcgaccaacagccggccgctggccccgggccatggtccggcacccatcggcggaccgatcgccggcacccggacgtacgtgctggacgcccggctgcagccggtgccacccggcacggcgggcgaactctacctggcgggtaccgctctggcccgcggttacctgggccggccggacctgaccgcccaacgattcgtcgcctgcccctggggaccacccggcgaacgcatgtaccgcaccggcgacctcgcccaatggaacaccgacggacaactcacctacctcggccgcaccgacgaccaggtcaagatccgcggctaccgcatcgaactcggcgaaatcaccaaagtcgtcaccggacaccccggcgtacaacaggccatcgtcctggcccgcgaagaccgccccggcgacaaacgcctcgtcgcctacgtcacccccacccacggccaccacctacaacccacccagatccgcgcacacgccgccaccgcactacccgaattcatgatccccacagtggtcgtcctcgacacgatgccactcaccaccaaccgcaagatcgacaaggcggcgctgcccgcgcccgaccagctcaccacggacggcggccgcgggccgcgcaccccggccgaacacatcctgtgcggcctgttcgccgagctcctcggggtcgcggcggtcggcgcggacgacgacttcttcgccctcggcggccactcgctgctcgccacccggctcgtgtcccgtgcccgggccgcgctcggcgtggaactgccggtccgtgcggtgttcgccgcgcccacccccgcgcgtctcgcggcggccgccgaggccacggccggcaccgcccgccccgccctgcggccgatggcgctgcccgatccgctgccgctgtccgcggcgcagcggcggctgtggttcctcaaccagctggaggggccgaacgccacctacaacgtgccgtacgcgctgcgcctcaccggtgacgtcgacgccggcgcactgcgcgccgcgctgcacgacgtggtcgtccggcacgagagcctgcggaccgtcttcccggcgaccggcggcgaaccacgccaggtgatcctggacccggccgacgtcaccgtgcggctgaccgagaagcacatcaccgagaccggcctgcggcgggaactcgcgcacgcggcgggcgtgcgcttcgacctctcgcagcaaccgccgctgcgggcctggctctggcatctgggcccggcagagcaggttttcgccctggtcattcatcacatcgccggggacggctggtccaccgcgccgctgctgggcgaccttcgcaccgcgtacgcggcacgcctggccgggaccgaaccgggctgggcgccgctgccggtcagctatgccgactacacgatctggcagcgggacctgctgggcgccgacagcgaccccgacagcctgctcaaccggcagctgcactactggacacaggcgctcgacggcgtacccaccgaactggacctgccgttcgaccggccgcacccggccgtcgcgtcgcaccagggcggccacatccgcctgcacctcgacgcggaggtgcatcgggcactcctgcgcgtcgccaggcagagcgacagcaccctgcacatggtgttgcaggcggccttcgccatcctgctgcaccgcgccggcgccggcgacgacctgccgatcggcgtcgcggtcgccgggcgtaccgacgaggcactcgacgacctggtcggcttcttcgtcaacaccctcgtgctccgcgccgacctcaccgggacacccgatttcaccgaactgctggcccgggtacgggagacggcgctgaacgcctacgcccaccaggacgtgccgttcgaccgggtggtggagaagctggccccggcccggtcggccggccgttccccgctggtccaggtgctgctgacggtgcagcacaccgcgcacgccgacctcggctttcccggcctgagcgggcgagccgaaccggtcgccctcaacgtggccaagttcgacctgctcgccagcttcgtcgaacacggcaccggcaccgagccggaggggctgaccggcgcactggaatacgccgccgacgtcttcgaccggtccaccgcccaggctctcgccgaccggctgaccctgatcctgcggaccgtcgccgccgacccgcgcgcccggctggaccggatcggcgcactgcccgcggacgagcaccagcggatgctcgccgccggcgaccgcagctcgccgccgcccgccggcaccgtgccgcagctgttcgccgcccaggccgcccggacaccggacgccccggccctgtgggccggcggcaccaccatgacgtacgccgagctggacgcccgcgccaaccggctggcgcaccggctgatcgccgccggcaccgggcccgaggtgccggtcgccgtgctgatggaccgctcccccggcctggtggtggcgctgctggcaatcctcaaggccggtggcgcctacgtaccgctgctgcccggataccccgccgaccggctcagctggatcgtcgcccaggccggggcgaccgtcctgctggtcgaccccgacctggccgacacccggttcgagcacggcgccacggtgctcgtgcacgccgacgagcccggacccggccatgccccggacgtccgggtgcacccggacaacctgggctacgtcatgtacacctccggctccaccggccggcccaagggcgtggcggtgcggcaccgcgacatcgtggcactggccgccgatcaccgctgggcgggcggcgcccacgatcgggtgctgtgccggtccccgcatgccttcgacgcctcgacctacgagctgtgggtgccgctgctgcgcggggggaccgtcgtgctggccccgcccggcgaacccgatccgcgcctgctcgcccgcaccatcgccgacggccgggccaccgccgcgttcctcaccaccgccctgttcaacctgatggtggaggagggtgtcgagcacctggccgggctgcgcgaggtcctcaccggaggcgaggccgcgagtccccgggcgatgcgccgtttcctgaagaactgtcccggcaccgtgctgagccacgtgtacgggccgaccgaggcgaccaccttcgccaccgggtacccgatgaccgactccgtggcgctgcccgccgacgacgtgccgatcggcgagccgctggacggcatgcgggcgtacgtcttcgaccggcacctgcaaccggtgccggccggcgtcaccggtgagctctacctggccggagccggcctggcgcgcggctacgccggccgtcccgacctgaccgccgaacgtttcgtggccgacccgaccggacgtaccggcgaacggatgtaccggaccggtgatctggtgcggtggaacaccgacgggcagctggtgttcgtgggccgggccgacggccaggtcaagctgcgcgggttccgcatcgagctcggcgagatcgaggccgtgctcgccgcccaccacgatgtcggccagacggtcgtcgtggtgcgcgaggaccggcccggcgaccgtcggctggtcggctacgtcaccccgggacgcgccggccggccggtcagcgccaccgaggtccgcgcctacgccgtcgcccacctgccggagttcatggtgccggcggtcgtggtcccgctggacgcgctgccgctgaccaccaacggcaaggtggaccgcgccgctctgccggtgccggacccggccgcgtccggcaccggccgggctccgcgcgacgagaccgaggcgatcctctgcgggttgttcgccgatctgctgggcgtcccgacggccggcatcgacgacgacttcttcagcctcggcgggcactcgctgctggcggtgcggctgaccgcgcgggtccgcaccgcgctcggcgccgaactctag

SEQ ID NO: 7994 - DNA, 4323 bp, Actinoplanes utahensis
gtgcggcccgcacggccgccgctggcggccgcccaacgacggttgtggttcctgcaccaggtggaggggccgagcgccacctacaacatgccggtggtgctgcgcctggacggtgtgctggaccccgcggcactgcgggcggccctggacgatctgacggcgcggcacgagacgctgcgcaccgtgttcgccgacgacggcggcgtggcgtaccagcgggtcctcgatccggcgcagggcaggatgccgatgacgacgctgcgcgtcgcggcgtccggcctgccggcggcactggccgacgccaccggccaccgcttcgatctggccaccgaggttcccgcccgggcctggctgttcgaggtggggccccgcgagcacgtgctcgccgtggtgctgcaccacatcgccggtgacggctggtcgacggccccgctgctgcgcgatctcggccaggcctacaccgcccgcgcgctcgggcggacaccggaccgcggcgccctgccggtgcagtacgtcgactacacgctctggcaggaggcgctgctcggcacccgggacgacccgggcagcctgatcagcggccagaccgaatactggcgcacggctctcgccggtgcccccgacgagctggcgctgcccaccgaccggccgcgtccggcggtgccctcgcaccggggcgggcacgtgccgttcaccctggacgaccggctccatcgggcgatggccgagctggcccggcaccacgacgcgaccttgcacatggtgttgcacgccgccttcgccgtgttgctgcatcggctcggggcgggcgacgacctcccgatcggtgcaccggtcgccggccgcgccgacgaggcgctcgacgatctggtcgggttcttcgtcaacaccgtggtcctgcgcaccgacctgtccggcgaccccaccttcgccgacctgctgggccgggtccgggaaaccgccctggacgcctacaccaacgccgacgtgcccttcgaccacctggtggagcggctggccccgaaccggtcactggcccggcagccgctgttccaggtgatgtgcgtgctgcagaacaacgcgaccggcgaccccgatttcggcggcctgcgggtccgccgggaagcgggcggcccgccggtcgcgaaattcgacctgaccgccacgttcgccgagcggaccggcgagcagggcggacccgacggcatcaccggcgtgctggagtacgccgccgacctgttcgacccggggaccgccgcggcgctggccgaccggctggtcaccgtgatcgagacggtcgtcgccgaaccggagcgccggatcggccgggtgcaggtgctcaccggggccgagcgggaacgggtgctggtgacctggaacgaccgccaggcaccggtacgcccgggcaccatcggggagctgttcgccgcccaggtggcacgcaccccggacgccaccgcggtgatcggggacgaggtcaccctgacgtacgccgaactcgacgcccgctccgacaccctggcccgctggctggtcggccggggagtggggccggaggacatcgtggccctctccttcccacgctcggtgcactgggtcgtcgccatgctggccgtcaccaaatccggcgcggcgttcctgccgatcgacccggcgtacccggccgaccggatccgctacatgatcgacgacgcccggccggtactgctgtggacggtcaccgagaccgccgccaccctgcccgacctcgacgtgccggtgatccccctcgactcccccggcttcgccgaccagctcacggcatcacccaccgacccgatcacccccgcggcgacaccggcgaacaccgcctacgtcatctacacctccggctccaccggccggcccaagggcgtcgtcgtcagccatgccggcatcgccagcctggcggcgaccaccggcgatctctaccgcaccggcccggacagccgggtcctgcagttcgtctcgcccagcttcgacgcgttcatccacgacgtctgcccgaccctgttctgcggcgcggcgctggtgatgccgtccgccgaacggctcacggtgggcggcccgctggccaccacgatcgccgagaccggcgtcacccaggtgaccctgccaccggctgccatcgccacgctgccggccgaggcgctggacggggtcgaggcgctggtgaccgccggggagacggcgagcgccgaggtggtggaccgctggtcgaccgggcggcggctgtacaacgcgtacggcccgaccgagaccacggtgtgtgcggcgatcagcacgccgctccgcgccggggtgtggccgccgccgatcggcgcaccggtcctcaacagccgtgcgtacgtgctggacgcccggctgcagccggtggcacccggcgcgaccggcgagctgtacgtggccggaaccggggtggcccgcggttacctgggccggcccgacctgaccgcccaacgattcgtcgcctgcccctggggaccccccggcgaacgcatgtaccgcaccggcgacctcgcccgatggaacaccgacggacaactcacctacctcggccgcaccgacgaccaggtcaagatccgcggctaccgcatcgaactcggcgaaatcaccaaagtcgtcaccggacaccccggcgtacaacaggccatcgtcctggcccgcgaagaccgccccggcgacaaacgcctcgtcgcctacgtcacccccacccacggccaccacctacaacccacccagatccgagcacacgccgccaccgcactacccgaattcatgatccccacagtggtcgtcctggacacgatgccggtcaccagcaacggcaagatcgacaaggcggcgctgcccgcgccgaacctggacgtacgccccggccgggccgcccgcgacgcccgcgaggagaccctgtgccggctgttcgccgaggccctcggcgtccccgaggtcggcatcgacgacgacttcttcgccctgggcgggcactccctgctggcgacccgcctcaccgcacggatccgggacaccatcaccgagcacgtgtcggtccgcgacgtcttccagagccgcacggtcgcggcgctggccgagacactcgccggcgtcacccgctcggcgggggcggccctgaccgccgacgcccgcctcgatccggcgatcgtcgtcggcggcccgcaccgccgggcggaaccggggcggatcctgctcaccggcgccaccgggttcctgggcgcgttcctgctggccgagctgctccgggcccatccggacgcccggatcgactgcctcgtgcgggccggcgacgaggtcgcggccatgcaccggatcgagcacagcctgcgacgctacctgctgtgggacgacgcggaccggacccggatctgcgccgtccccggcgacctggaacaaccacggctcgggttgagccgggaccggttcgacgagctggccgcgtcggtggacgtcgtgtaccacaacggcgcccgcgtgcacctggccgacccgtaccagcggatgcgggccgccaacgtggacgcgaccaccgacgtcatccgcctggccgcccgccgtggcatcccgctgcactacgtgtccacgaccagcgtgctgtactccaccaccgacaccccgccgctgctcaccgaggaccggcacgtacccgccgaccaggtgccggccaacggctacatccagacgaagtgggtggccgaggagctcgtccgcgaggccggccggcgtggcctgcccgtggcgatctaccggcccagccggatcagcggtgcgaccgcgaccggggcgaccggcgacggcgacgccttctggaacatggttcgcgcctgcgtcgagatcggcgccgcacccgaccggggacggctcgccgacgtcgacctcgtgccggtggactacgtggcggccgccctggtgcggctctcgcacaccgtcgacctggacgggacggcgtatcacctggtcaacccggtgcacacccgaccggcggacgtgttcgcggcggtccgggccgccggctacccgatccgcggcctgtccggcgccgagtgggtcgccgctctgaccgacgcggcccgcacggcggctccgggcagctcgatcccgggtgtggcgctgttgcacggcggcacctccggcgagtcgctcggcaccgagccccgattcgacgacagcaacacccctcggggcctcaccggctccggcatccagtgccccatcgtcggccccgacacgctgcggcgctgcgtgcgcttcttcgcgtcgaccggcttcctgcccgaggagcgttcatga

SEQ ID NO: 7995 - DNA, 1218 bp, Actinoplanes utahensis
atgagtcagccgttggtcctgcgcaaccgggccttcgcccgggtgtgggcggcacagatctgcagccaggtcgccggccggatgttccaggcgggcatcgtctggtgggtggtgagcgaggtggccgcatcggtccgcggccgggccaccgggccgttcatgatgctggcgtcgctgcccgccgtgctgctcatcccggtggtggcccgggccctggcccgctacaccagccggagcgtgatgcgcacggccgagctcgccgccgcggccgtcacgctcgtgctgctcgggtgggcgctgctgaccgacctgccgatggcggcgccctacccggcggtgttcctgctggccgtcacccagtgcttcttcaacccctgcctgaccaagtcggtgcccgagctggtcgacgccggcgacatccagcacgccacgtccttcgagatgtccacccagtccatcgccggcctggtcggggcggtggccggaccgtacctgatccacctcggcggaccggcccccctggtggcggcctgctccggagcgttcctgctcgcggcgctgctgatccacgtcgccggtttccggaccggcacggcacctcggccatcggcaccgggcggccccgcacccgccccgcgcaagctgcgtgccgtgctggctgatctgccgttcgtccgtaccgtgctgatctgcttcgccgcggcgaacctgttcgccacggccggggcggtgatctatccgctgtacgtccgcggcgtgttcggcgacgaccccggcgtgctggtgctgttccaggtggccatcggcatcggcatgctggtcggctcgttctccggaccgcacgtccccggccggccgacgaccctcggcccgctgtgcctgctcgggatcgcggccggcctgaccgtgcccggcctcgtcgtcaaccggatgctgacctcggtggcgttgctgggggtcggctggtgtgccggggtgctcggcgtcaagttcgtcaccctgttccagcacaccgtgccggcggcggacaagccggtcttcttcgccgccatgcaggcgctgatgaccgcgacgttcccggtggcgtcgatcgccttcggattcctcggcgacctcctcgaaccgcgcacgctctgcctcgtccagggcatcgggctgctccccgcggctctcgccctgctgacgacgcgcgaccgggagccggtgccggtgagctga

SEQ ID NO: 7996 - DNA, 1035 bp, Actinoplanes utahensis
ttgagttcggtcagcgtcgtgatcccgtgctacaagtacggcgattacctgcgggcatgcgtcgacagcgtgctcgacaacccgggcctcgacatccgggtgctgatcatcgatgacgcgtccccggacgactcggcatcgaaggcccacgcgatcgccgcggccgacccgcgcgtccaggtccgggtacacaccgagaacaagcgacacatcgccacctacaacgagggcctgctcgactgggccgacggcgactacgtcacgctgctctcggccgacgacatgctcaccccgggcgccctgaaccgtgccgtcgcgctgctggacgcgaacccgaacgtcggcttcgcctacggccacccggtccacttccagcaccccggcccgcccccgccggccaaccggggcaccggcggcaccgtcgtctaccccggccactggtggctggaacgccgattccgcgaaggcaccggctgcatcacctcacccgaggtggtggtccgcaccgacctgcagcgcaaggtcggcggctacgacccccagctcccgcacgccgccgacatcgagatgtggatgcgcctcgcgtcgcacgccgacgtcggctacgtcaaggcggaccaggcctactaccgcctgcacgcgaagaacatgcacgccgacgcgggcgcgatcgacgacctgcgggagcgcaagatcgcttacgagtcggtccttcgcaaatgcggtgacctgctgccccagcgggacgagctggacgccatggtccacgcccggctggcccgcttcgccctgcgccgggccttccgcgcctacgaccggggccgcaccgcgcagaccccggaggacgaactggtcgccttcgccgccgaggtctggcccgactaccgcagacttcccgaataccgcgcgctggccctgcgccgccgggtcggcgccaagacgatgccgtacctgcagcccctggtgctctccgcggtgggcgccaaggcccaggagtggctctggtggcaatcctggcgccgccgcggaatctag

SEQ ID NO: 7997 - DNA, 3324 bp, Actinoplanes utahensis
atgcgacaagaactgctcggtgaccttcggcgagtggtcgaacaacgtggtgggaacgatcgacggggtgcccacgaagaaacaggttccacaacccaaatgatctccttaggccggaagaagctcgaagtgataaaaaggctcgtctcaggagcgttgtcggcgctggtcgccggtgccgtcgtcctgccaccggctgcggtgctcgcggccgacgacccgtgcggggtcaactccaacccgatcgtctgcgagaactccaagccgggcaccccgctcgaggactggtacggcgacgcctcctggggcgacatcggcggcttcaccaccaaggtgagcgtgcagcccggtgagaccctgcagatgaaggtgaactcgccggactcgacgttcacggtgaccatctaccggctgggctactacaagggcgacggcgcccgccggatgccgacctcgccgaccaccacgttcccgctgaagaatcagggcggctgcgacagcgacgcgaccggcctggtcgactgcgggaagtggacggtcaacgccacctgggcggtgccctccgacgcggtctccggcgtctacctggcggtcttcgaccagggtgacggcaacggctacatgccgtacccgttcgtcgtcgccaacgacaacagccactccgacatcgtggtgcagacctccgacgagacctggcaggcctacaacaagttcggcggccagaacctctacgagggcggcgggcccgccccggacggccgcgcctacaaggtcagctacaaccggccgatgcggatcgccggcgacaacggcgtgctggccagcgagtacccgatgatctcctggctggagcgcaacggctacgacgtcagctacgcctccaacctcgacgtctccaccaagccggcgctgctgcccaagcacaaggtctacctgtcgtccggccacgacgagtactgggaccagggcatctggaacaacgtcaaggcggcccgcgcggccggcgtgaacctggccttcttcagcggcaacgaggcgttctggcggacccgctgggagccgtcgatcagcgccggcggcggtgaccaccgcaccctggtcagctacaagacgaccaagacgaagcagaccccggtcaacggcgttcccgaccccagtgggcagtggaccggcacctggatggacccgtccggtgccggcaccggcggcaacgcgccgcagaaccagatcaccggcacgctgttctctgtcaacggctaccgcaacgacgcgatgacggtcacctccgacttcaagaagttgcgactctggcgggacaccaggatcccgaccctgaacgacggcgagaaggtgaccttcccggtcggcacgctcggctacgagtgggactccgacgtcgacaatgcggtccggccaccgggcgcgatccggttctcggccaccacgctgcagatcaccgacggcaccatgctgctcgacgagggcaacaactacggcaacggcgtcgccacgcacagtgtcgtgatgtaccgcgacgccacctccggcgcgctggtcttcggcgccggcacggtgcagtggtcgtggggcctgagcacccagcacaccggcccggccaccgtcgaggacatccggatgcagcaggccaccgcgaacgtgctggccgacatgaacgccttcccgaagtcgttccagacgaacctggtctacccgagcaagacctccgacacggtcggtccggcggtcaccgtcaccgccccggtgggcggcaccacggtgccgaagctgtcgccgatcaccatcaccggcaccgcggccgacaccggcggccagctcggccgggtcgaggtctccaccgacggcggcaccacctggaacgccaccgtcgggctggcgaactggacgtacacctggacgccggtcaccgagggtgccgccacgatcaaggtgcgcggcatcgacgacagcctgaacttcggcaccaccaggacggtcaacgtgaccgtcgggccgcagcagtgcccgtgcaccacctacacgccgagcaccgtcccggccaacgtcgactcgttcgacggctcggccaacgaactgggcgccaagttccaggtcgcggtgcccgcctcggtcaccggggtgaagttctacaaggcgagcaccaacaccggcacgcacgtcggcaagctgtacacgctggccggcaagctgctcgcgtccgggacgttcaccggggagaccgccagtggctggcagaccctgacgttcagcaagtcggtgtcgatcgcggcgaacaccacgtacgtggtgtcgtactacacgccgaccgggcactactcgtacaccagcggatacttcagcaccaagggcgccggtgacggcatcgtcaagcagctgcagtccggggtggccggggccaacggggtctacagatacggcaccgacggcggcttcccgaacctcagctggggcgacaccaactactgggtggacgccgtggtggagaccagcgcggcgaccaccaccccgccgaaggtgacggtcaagtcgccggccgacggtgacgtgggcgtggcccgcaacgccgtggtcaccgcgaccttcgaccacgacatcgacccggcgaccatcgcgttcacgctcaccgcgggcggggtgaacgtgccggccaaggtggcctacgacgacaccacccgcagggccaccctgcagccggacagcgcgctcgccgcgagcaccgcgttcaccgcgtcggtgaaggccaccgatctgtggggcaacgcgatgaccggggcgaccacctggtcgttcaccaccggcaccggggtgtcctgcccgtgcaccgtgttcagcccgtcgtccacgcccgacgtggagagcgccggcgaggccgcctcactggaactcggcatgcggttcacctcggcgatcgacggctacgtgaccggcgtcaagttctacaagggcgaccggaacaccggcacgcacaccgggacgctgtggagtgccaccgggcagcagctggccaccggcacgttcaccaccgagagcggcagcgggtggcagacgctgaagttcgccaccccggtcgcgatcgacgccgggacgccgtacgtggtctcgtaccacaccacggtcgggttctactcgtacagcagcgggttcttcagcgccgaccacacgtcgtacccgctgaccggggtcgccgacgcggccaccgggcacaacgggctgttcatccagagcgccggtacggcgttcccgacctcgacgtggaacgcgaacaactactgggtcgacgcgatcttcagcaccaccgcgcagtga

SEQ ID NO: 7998 - DNA, 801 bp, Actinoplanes utahensis
atgccctcgctgaagaagcggctgcgcgaccggtacggctggttgccgctcgaagagctgcgcaacaaggtcgtgctcgggcacaccgcggtcggcctggcccgcttcgagcgcgccgaggtccgtcgcctgctgccgaccctgcccggcggggtccggccgcgggcccgggtcgccgtcatcgtgctcacctaccagcgcgccgacggcctggcccgcgccgtcgagtcggtcctcgcccagaccatgaaggacctggtcctgatcgtggtcgacgacgccggcgggcaggtgccggatctcccgcccgacccgcggctgcacaccgtcgcgctgcggcacaacatcaacgtgcccggggtgggtcgcaacgtcggtatcgggctgaccgattccgaccacgtcgccttcctcgatgacgacaacacctgggacgagcaccacctggagacggccctcgcgcggctggacgggccggcggcgccgaaccgcccggacgcggtctacaccgccatgcggcggatcatgcccgacgggacggtgcgcgacgtgctgtccgtcccgttcgaccggcggctcgcctgggagcggtgctacctggacaacaacccgctcgtgctgcggcgcctgcccgccacccgcttcagccggctgcgccgcaccacctcggtcgcgccgaaggaggactgggagctggtctaccggttcagccgccggcaccgtgtcgagcacatcccggagccgaccgtgaactacaccatcaacccggacagctactggaccccgtgggagttgccgtga

SEQ ID NO: 7999 - DNA, 1494 bp, Actinoplanes utahensis
gtgacggatctgaacggccgggtggccaccgccgcccgctggagtctggtcaacaccatcgtccgccgggtcggcacgttcgcctccggtgtggtgctggcgcgcctctacttcggaccctacgagtggggtctgtacgcggtcggcctgctcgtgctggcgatgctgctgtcgctcaacgagatgggtgtgagcctggcgctcgtccggtgggagggcgacatccgccgcttcgctcccaccgtgctcacactgtccacattgtccagttccgccttctacgtggtgttgtggttcgccgcaccggccctggcccgcgcgctcggctcgccggacgccaccacgatgctccgcgtgctctgcgtcagcgtgatcatcgacggtatcgcgtgcgtcccgctgggtcagctcaaccgcgagttccgccagttcggccgcaccgtcgtcgacatcctcaacttcgtggtcaacacggtcgccacgatcgccttcgcggcggccggcgtcggcgcgatgagcttcgcctggggctcgctgatcggcaacctggtcgccctggccggcttcggcctctgcgccccgggcatgctccgcttcggctggaacaccgaacaggccaaacgactgctgcggtacgggttcccgctggccgccgcgagcctgctcaccctgggcatcgtcaacgtcgactcggtggtggtcggctcggtgctcggccccgccgcgctcggcatctacgcgatggcgttcaacatgtccagctggccggtccggatggtgtcggagaccgcccgccgggtgtcgttcgccggcttctcccgattggccgacagctcgccggacgagttcgcgaccggcttcgtccgcgccttcaccctggtgatcgcggccgcggtgccgatctgcgtggtcctcggcgtgctcgccgggccgatcatcacgttcgtctacggcgaccagtgggcggccgccgccctgcccctgcagttcctggtcgcgctcgggctgctgcgcaccgcggtcgagctggcctacgactgcctggccacccgggtgcgcaagaccctgatggtgatgcaggcctggtggctgttctcgctgatcccgctgctgctgatcggcgcgcacctgtggggcgtgcgcggcgtcgcggccggccacgtggtggtcgccggcctgctggtcagcccggtcttcgtggtggtgctcggccggctcggcatcccggccggccgggtcctgatcgcctgcgtgcggcccgccctgggcggcctggcgatgggggtggtggcctggctcgcgcaccgctggctgggcggcggcttcctcggcctggcggtggccggggtcgcctcgctcgccacgtacctcccgttcgtcctcccgctcatcaaccgcctgcgggccgagccgtcgtccccttccgcgccctcgtcgccggccgagcccgatcccgtcgtcccggccgccgatcccgtcgccgaccccgtctag

SEQ ID NO: 8000 - DNA, 1383 bp, Actinoplanes utahensis
atgccaaccgggtcaacggcagctgaggctcgccgcaccacgcgcgagccgcacgcggccaccgtcaccgaccgccgcccgggtcgcctgtaccgctcccagcagcgcctgcgcaccctcggcccggattccctgctcgccacctacatcgtcctgctgctggtcgtcccggcccggctggtggtggccagcatcggcgctaccggcacggtcgccaacctgttcctgctggtctcgctgctgtggtacgcgatcagctggttgatgcgccgggtcaccccggcgccgttcacccgggtgccccggctcgcactgctcttctacgtcgtcgcgatcctgctggcgtacgtggcggtcggccgccgcgacgccgacgccgccgagtacagcgccgccgaccgggccctgctgcagctgctgatctggctcccgctgatcctgctgaccacctcgctcaccgagtaccggcagatcgagcggctgctcaagctgttcgtccggctgtgcacctgggtcgcggtgctggcgatggccgagttcgtgctcaagcagagcctgaccgcctggatcgtgatccccggcctgtcctccaacgccgcctccgagttggtcgcccgcggtgacttcgtgcggcccacggccaccgcgtcgaacaccctggagctggccgccaccctgtgcatcgccctgccgttcgcgatccagcaggcgctgtacgacaccgacggccgcaagccgtggaaacgctgggcgccggtcttcgtgatcgcgctggcctcggtgatgaccgtgtcgcgcacctcggtgatcggcctggtgctggtcttcctggtgctggtggtcacctggccggccggccgggtcggcaaggcgctgctgctgatgatcccggccctgggcgccacccggatcctcgtcccgggtctggtcggcacgctgatcggcctgttcagcgcgatgttcaacggtggcgacaacagcaccaactcgcggaccgcgaccagcgccgacgtgggcgagttcatgaaggggcacacctggttcgggcgcggccccggcaccttcctgcccgacctgtaccgcttcaccgacaatcagtacctgctggccctgctggagatcggcgtggtcggcctgctggcgatcgtcgggctctacgtggcgaccatccattgtggcggcgccggtcgccgccgtttcaccgacccggcacgccgggagaccggtcaggcgtttgtggccgtcgggttcgtgatgctcgtcgtaacggtcactttcgacaccctgagcttcccgatcgtggccggatccactttcctgatgttgggcctgtccggtgcgtacctgagcgtggcccgccgcgaaggagactctccacagtga

SEQ ID NO: 8001 - DNA, 918 bp, Actinoplanes utahensis
gtggacctcggcgagatcttgcgcgtcctgcgcaaccgctggctcatcgtcgtgcccatgctggtgctggcggtgggtctgggcatcaccacgtacctcatggtgccgaccacctactccacctacaccatggtcagcctgctcagcgccccggcggcgaccaaggcggccaccgagggccaggacaacccgttcctgaacttcaacggctcgctcgtggccaccgccgacttcctcggccgccggctgcagtccaccgacacgcagctggagctcagggccgacggaatcaccgagaagtacgtggtggccctcgccgagaacgcccagggcccgttcctcaccatcaccctgaccggcgacgaccaggagcacctgctcgcctcggcgacccggctcgcccagtacgccgacaagacgctcaccgagatccagcagcagaacaacgtcgcggagaaggaccggatcaagctgacccaggtcatcccgccgcagaagcctcaggtggagacgaaggcgaagctcaagctggtgatcgtcgccggcggcggcaccgcggcactcgggttcgtcgcggccttcgcggtggagagcatcagccgggcccggcgccgcaaggccgcgctggccgcgagcgaggcggccgagcccccggtcagcaccgccaggccggccgccggttccgcggtcgcctccccggacatcgagggcaccgtggtgctgcagctcccgccgaagaacgagccccggatgggcgtcgccggctcctccgccgcggcctcggtggacgtggagaagacccagcgcatccaggtgccgccgccgcggcagggcggcgggctcgccacgacgtaccagtcgaacggcaacgccgtggaccgtaggggtaaagatgccaaccgggtcaacggcagctga

SEQ ID NO: 8002 - DNA, 675 bp, Actinoplanes utahensis
atgtttctgtccgacatggcgggtgtactgaaacgccgctggtatctgatcatcgtgggcgcggtgctcaccgccgccgtggccagtccggccgtgcacacccgggaccggttcctcgcctccgaggtgctgatgatccagccgccggtgtcgccgtacgcgccgaacccggtgaccggtctgtacccgtcgatcgcggtgaccgcggcggccatcgcgaaccggctgaacacccccgactcgcaggccatgttccgggccaagggggtcaccgggacgtaccggttcgagccgcgcaacaccggcacccggcaggagccgcggtatgtgatcggctcgatgtcgatcaccaacaccagctcggccgaggccgacgcgctcgcctcgctgcaggtcctgagcagcacgtacgagcaggagttgaaggctatgcaggacgagtggaacgtcaagcgcgacctgcggatcaccgtggccaccctggtcccgccgacctcgacgctgctcacccactcgccgctgcgctcgctggtcggcgtcgcgctgctcggcgcgctgctgaccgccgctgtcacattgtggacagatgagctgctgcgccgacgccggtcggcacggttgtccacggcagactccccgaattggactgatccactggtccgttcagcccattag

SEQ ID NO: 8003 - DNA, 1245 bp, Actinoplanes utahensis
gtggggaaaagaccgagcgtcgcgattctggtggcgaacctgccggccgagaaggatcgccgcgtgatccgggaatgcctgagtctcgaggcggccggatacgacgtgacggtgatcgcaccgcgcggtgaccgcagcctcacgatcctcccgggcagcgagcggacccgactccggccgtacccgatcgtcgtctacggcagcggggtgctctcgttcgccgtcgagttcttctggtcgttcctctggatcagcatccggctgctcggcgagatcctgcgcggccgggcccaggcggtccaggtgtgcaacccgccggacatctacttcccgctcgcgctgctggtccgggcgctcggccggccctgggtcttcgaccaccacgacctctcccccgaggtctacgtctcgcgcggcggcgagccgaacccgctcgtctcccggctgctggtcgccttcgagtgggcgacgctgcgcaccgccaccgcggtcttcgcgaccaacgagtcgttcaaggacaacgcggtgcgccgcggagtgagaccggagaaggtcaccgtggtccgcaacggcccggcgttcgccgagatcgcctcctcggacggccccgccgacggtccgcaccgcgtcgtctacctgggcgtcttcggcccgcaggacaacgtcgagggcgccgtgctggccgccgaggagctgatcgggctgcgcggccgcaccggctggaagatgatcctggccggggacggcgagaccgccgccggcctgcgcgagctcaccgcgcagcgcggcctgggcgacgtggtggagttcaccggctggctgggcggacccgaggtcgacgcgctgctgcgcgaggccaccgtggcgatccagcccgacctgccgacccggatgaaccagctgtcgaccatggccaagaccgtggaatatctggggcgcggcgtgccggtggtggccgccgacctgatcgagacgcacgcgaccgtcggcgacgccgggctctacgtgccgaacggcacgccggaagagttcgcggccgcgatcgacaccctgctcgacgaccctgacctgcgggccggcatgcgcaagctcggccgcgagcggttccgcgactccctgtcctgggagcaccaggcggtgcagtacatcgcggtgtgggaccggctgctgcgccgtggcggcacaccgcggatcccggcgcagcggcagccgtcctcggcgccgtcccgggtggacgcgccgtga

SEQ ID NO: 8004 - DNA, 663 bp, Actinoplanes utahensis
gtgcctgagcagttcaacatcctgttccacgggatcgggaccccgcggcgcgacctggagcccggcgaggaccagtactggatcaccgaagacgcgttccacgcgatcctcgacgaggtcgccgcgtggcccgcggtcagcctcagcttcgacgacagcaactcctcggatatcgagatcgccctgcccgccctgctcgaccggggcctgaccgccgagttcttcgttctcgccggccggctcgaccagcccggcagtctcggcgaggccgacctgcgtgacctgctcaaacaggggatggcggtcggcacgcacgggatgcaccaccacccgtggcggggcctgaccgcggacaccacgcggtccgagctcgccgacgcccgggaccggatctccgcggtgatcgggcggccggtcacccgcgccgcgtgcccgctcggccggtacgaccgcggcaccctcggcgcgctgcgccggctcggctacaccaccgtcttcaccagcgaccggcgcccggcgcggcccggccgctggttgcagccgcggttcagcgtctatcgggacgacaccccgtcgacggtacgtgcggccacccaagggtcgcgccggctcccggtgcggctgcgcaacgcggcggccggcgtggtcaaacgctggcgctga

SEQ ID NO: 8005 - DNA, 918 bp, Actinoplanes utahensis
atggtccagcgacaacaccgtggcatgctggcgctcggcgccgccgtcctgctctgggcgtcgttcgcgctcaccgtccggggcatcggcgggtccgggctgaccgcgatggacgccgcgttgctgcggttcggcaccccggtcgtcctgctgtcgccgtggctgccgcgcgccgtccgggcggtccgccgggagcggccgacgacgatcgccgccctcctgctggccgggctgccgcactatctgctctccgcgctgggcgggcggctggcctcggccgccgtggtgggcctgctgctgcccggcacggtgccgctgttcgtggcactgctcaagcgggaccgccgccggtggccggcgctggccgcgatcctgctcggggtggccgtgctgaccgtcgcgcacgccggcctggccgggatcgcggtgctgctggccgccgggctggcgtgggcggtctacacgatggcgctgagccgcaccggactggatctgatcagcctggtgctggtcgtctgcacaccgtcggccctgatcgcgctggccgggtcggcgcacctgaaagccgccccggccgggaccatcgtgctgttcgtggtgctgcagggggtgggcaccggaatcgtgtcgacgctcagctacgcgtacgccgtccgccggctgggcagttcgatcccggcggtgaccggcgcgctcagtccggtgctgaccaccctgctggccgtgccgatcttcggggagggcctgaccgccggtgccgccgtggcgctgctgctgatcgtcggtggggtggtcgcctacaacgcgcctcagcgccagcgtttgaccacgccggccgccgcgttgcgcagccgcaccgggagccggcgcgacccttgggtggccgcacgtaccgtcgacggggtgtcgtcccgatag

SEQ ID NO: 8006 - DNA, 555 bp, Actinoplanes utahensis
gtgttgtcgctggaccatgcggccagactaggaattcttcaggcgcagccgattgctagttctgccctcaaccggcctcccggtggcagaatctgctacgtggactcgatcgatcgccggattctgctggaactgcagaaggacggccgcctcaccaaccaggaactcgccgaccgggtcggcctgtccccctccccctgcctgcgccgggtccgccagttgcaggactccggcgtgatctccggctacaccgcggtgctgtccgcggaggcgctcggcctgacgatcaccgctttcgcccggctcaccctgctctcgcacacctcgacggtggtcgacgaggtggaggcgcggctgcgcgccatccccgaggtggtcgaggcctacctgctggccggcgacgacgactacatggtgaagatcgtggtggcctcgttcgccgcctacgaggatctgctgcgccgcgagctgcgcgccatcccgtcgctgggctcgatcacgaccagcttcgccttcgccgtgaccaagccgcagtccccgctcccgatgccctga

SEQ ID NO: 8007 - DNA, 183 bp, Actinoplanes utahensis
atgactctcgccgacctgctgtctccgggcaccatcgtccccacggcggcgctggccggcgcggcgttcctggctgttcgcgcgctgaaggcccgcatggtccgggtcgtccgggtcatcgaccgcaacggcaaggtccacgagatgcgcgaggacgacccccgcatctccggccacctctga

SEQ ID NO: 8008 - DNA, 924 bp, Actinoplanes utahensis
atgacgattctggtggcggtcgtctcctacaacagcgcccggctgctcccggacctgatcgccgggctgcgcaccggcctggacgggatgaaatggcacctcacggtcgccgacaacgcgtcgcgggacgacagcgtcgcggtgctccgcgagctggcccccgaggcgaccgtcgtcgagatggggcgcaacgccggatacgcggccgggatcaacgcggcggtcgccgcctcgccggcgtacgacgcgatcctggtcctcaaccccgacgtccggctcacccccggctgcgtgccgcgcctgctcgcagcgctgcgcgtgcccggtaccgggatcgccgtgccgcaccttgtcgacggctccggcgcgctgatccacaccctgcgccgggagcccagcgtgctgcgcacgctcggggacgccgtcctcggggcacggcgggcgggccgcttccggttgctgggtgaggtgatcaccgacgagcgggcgtacgtgtcgcagggcgtgaccgactgggccgagggctcgacccagctgatcagcgcggaatgctggtcgcgggtggcaccgtgggacgagtcgtacttcctctactcggaggagaccgacttcgcgctgcgcgcccgggatctcggcctgcgcacccgctacgtgccggacgcgcacgccgtgcacctggagggcgactcgcgggtctccccgggtctgtgggcgctgctcaccctcaaccgggtgcggctgttcggccggcggcacgggccggtgcggacggcggcgtactgggccgccctgctgctgcgcgaaagcagtcgcgccgccctgggccggaaaccgagccgcgccgccacccgcgacctgctcaccccgtcccgcctccgggagacccccggcccggccagcgtcgcccgggtccgggcgagctga

SEQ ID NO: 8009 - DNA, 1068 bp, Actinoplanes utahensis
gtgaaagtctccgtggtacgcccggatgaactcggacccggcgagctggccgcgtggcgccagttccagaaggaccagcccggactgcagagccccttcctggccccggagttcaccctcgcggtcgcacggcagcggcccaccgcccgggtcgcggtgctggaggactccgacgggatcgccggcttcttcgcgtacgaggtacgcaaccgcgtgatcggcgtcccggtcgggttcggcatcacggactgtcagggcgtcgtacaccggcaggggtgggacttcgatccgactgccctgctcagggcgtgcaagctgccggtctgggagtatgaccacctgatggccgggcagttcgggcggttccacacggcggtcgccgggtcgccgctgatgaacctcaccgacggctacgcggcgtatgtggaggatcgcaaccgggccggtgacgtggtcaagcagaccctgcgcaagcagcggaagatggcccgcgaggtcggcgacgagcggttcgtctgggacgaccgcgacccggtggcgctggccgcgctgcgcgagtggaagtcggcgcagtaccggcgcacccagcagtacgaccgcttcgccaccccctggatcgagggcgtcctcgacgagttgcgggcgtcggacgcggacggctgccgcgcggtggtctccacggtgtacgccggggaccgcccggtcgccgcgcacctcggcctgcgcagcgagaacgtgctcgcctactggttcccctcctacgaccaggagctgtcgaagtactcggccggcattctgctctgcctgcggatggccgaggccggcgcggccgacggcatccggctgatcgatctcggcaagtccgaggcgctgtacaagacccggctgaagaacgacgagaccccggtcgccgccggccgggccggtcgcggtgcggtcgcgaccgcgcggcgcgcgcagacggcgctgacccgcacggtcaagcagggcgcgctgggggagaagctcaagagcggccgcaccggcagggtgctgcgcggactgaaggcgaggctggcgtcgcgatga

SEQ ID NO: 8010 - DNA, 1350 bp, Actinoplanes utahensis
atgaccgcacgtccccgtctcaccgtcatcgggaccgggtacctcggcgccacccacgcgatctgcatggcggtgatgggcttcgaggtgctcggcgtcgacgtcgactcccgcaagatcgagcggctggcggccggcgaggtcccgttcttcgagcccggtctgccggagctgctcaccaaggccctcgagtccggccggctgcggttcaccaccgacttcgccgaggccggcgccttcggtgacgtgcacttcgtctgcgtcggcaccccgcagcaggcgggttccgaggcggccgacctgacccatgtcgacgccgcggtgaccgcgctcgccgcgcacctgacccgccgtaccctggtggtcggcaagtccaccgtcccggtcggcaccgccgcccggctggccggtccgctgcgcgagctggccccggccggcgatcaggtggagctcgcctggaacccggagttcctccgcgagggcttcgcggtcgacgacacgatgagacccgaccggctggtcttcggtgtcaccagcgcgtgggccgaggaccggctgcgcgaggcgttccagccggtgctcgcccaggacgtgccggtcaaggtcaccgacctgcagaccgccgagctggtcaaggttgcggcgaactcgtttctggccaccaagatctcctacatcaacgcgatggccgaggtgtgtgaggcgaccggcgccgacgtgcacgacctcgccgaggccctcgcctacgacgagcggatcggcggccggttcctgcgccccggcctcggtttcggcggcggctgcctgcccaaggacatccgggcgttcgcgcaccgggccgaggagctcggcgtcggccaggccgtcggcttcctgcgcgagatcgacgggatcaaccgccgacgccgcgcccgtaccgtcgatctggtcgtggaactctgcggcgggcacgtcgccggtaagcgggtcgccgcgctcggcgccgccttcaagcccaactccgacgacatccgggacgcgccggccctcgacgtggcggccaccctgcaccggatgggcgccggcgtggtcgtctacgacccggctgcgatggacaacgcgaaacgggtgcacccggagctgacgtacgccacgaacgcgctggacgccgcgcgcgacgccgacgtcgtggtgctgctcaccgagtggaacgagttccgcgacatcgaaccgtccgcgatggccgccgtggtccgcggccgccgcatcgtcgacggccgacacgccctggtcccggcccactggaccgccgccggctgggaataccgtgccctcggccgccccaccttcgcaggaacgagcaacgcgtga

SEQ ID NO: 8011 - DNA, 1497 bp, Actinoplanes utahensis
gtgcagacaatcgaatcgctggccaccgtcgacctgagcgaacgcgcttcgcaggtccggcggggtaaacgggccggcgagacgcgggcgggctggcagaaccggtacgcccggatgctgtacctcatcgactatgtcgtcgggctgggcgccgcgtgctgggcgctcgtcctgcgcttcggcccggacgggtcggagccgaacatgaagggctacgtcctgctgacggccctgctgccgatcgcctggatcgtctgcctgtcggcgaaccgggcgtacgagccgcgccacctgttcgtcggcaccgacgagtacgcccgggtgttccgggccgggctggccctgaccgccgcgctggccatcgtctcgttcgccttcgacctgcggctggcccgcggctacgtgagcatcgcgctgccgctggcgatcgtcgtcgacctgggcgcccgctacctgtaccggcagcgcctgcaccgctcctggggccgcggcaaccggctgcaccgggtgctgctggtcggccacgagaaggcggtctccgacatgacccgccggttgcgccgcgagcggtaccacgggctcggcgtgatcggcgcggtgctgccggccaccccgaccccgaagacgttcgccaagggcatgccgccggtctacggcaccttcgacgcggtcgactcggcggtcacccgggccgacgcggacaccgtcatcgtgctggcctgcccggagatcgacggcccggccctgcgccggctcgcctggcagctggaacgcgacgagatcgacctgatcgtggccagcaccctggtcgacgtggccggcgaccggaccaccatccgcccggtggacggcctgccgatgctgcacgtcgagcaccccaagctcaagggcagcgcccggttcctcaaggccaccttcgaccgggtcggcgcgatcgcgctgctcggcctgctctcgccgatcctcctggtggtctccgcgctggtccggtggggccggggcggccgcgggccggtgatcttcaaacaggagcgggtcggcaaggacggccgcaccttcatgctgtacaagttccgcaccatggtggtcgacgccgaggcgcggctggccgagctcaaggagctcaacgagcacgacggcgaactcttcaagatccgcaacgatccgcgggtcaccccgatcggccagtggctgcgccgcttctcggtggacgaactgccccagctgctgaacgtggtgaagggtgacatgtcgctggtcggaccgcgcccgccgctggccgccgaggtggccggctacccggcggacatgctgcgccggctcgtcgtcaaacccggcctgaccggcctgtggcaggtctccggccgctccgacctgtcctgggaggagtcgatccggctcgacctcagctatgtggagaactggtcgctcgccatggacctggccattctgttccgcaccgtcagcgccgtcgtgcgcagctcgggagcctactga

SEQ ID NO: 8012 - DNA, 612 bp, Actinoplanes utahensis
gtgaaggtccggccgttgagcatcgagggtgcctgggaggtcacgccggcccggttcggcgacgatcgcggcaccttcctggagtggtaccgcttcgaccatctgagcgcggcggtcgggcatcggctggacctggcccaggcgaacctgtccacctcggcccggggggtggtgcgcggggtgcatttcgccgacgtgccaccgggccaggcgaagtatgtgacgtgtgtgtccggcgcggtcctcgatgtggtggtggacgtccgggccggctcgccgaccttcgggcggtgggaggcggtgaccctggacgacaccgaccggcgcgcggtctatctggccgagggtctcgggcacgcgttctgcgcgctgaccgagggcgccgtggtcgcctacctctgctcggccacctaccggccggggcacgagcacggcgtccacccgctcgatcccgagctgggcatcgcctggccggccgggacgccgctgctgtcgccgaaggacgcggccgcgccgtcgctgtccgaggcccttgcggccgggctgctgccacggtatgacacatgccgtgactacgtcgaaacaatgcgtcgcgatgacgacagtgaatag

SEQ ID NO: 8013 - DNA, 1203 bp, Actinoplanes utahensis
atggggccggtcctcgggtgtggtgatgaccaggatctcccgaattccggcggagaccagtgtggtcaacgggtagtacaccatcggtttgtcaaaaattggcatcagctgtttcgacatggccatggtgatgggccacaaccgggagccggtgccaccggccagcaggattccgcgcaccgacgaagactaaacacagtggaggcggtagtacactcggccgctgtgcagattcttgtgaccggaggcgccggtttcatcggttcggcctatgtgcgagcggtactaaaggatgaattcgcaggtgcggtcggcgcccgggtgaccgtcctggacctgttgtcctattcgggcaaccgcgcgaatctaccggtgacggattcccgactgaccttcgtgcagggcgacatcaccgacgccgatctgctgcgtgacctgcttcccgggcacgacgcggtggtccacttcgccgccgagtcgcacgtggaccggtcgatcagcggcgccgtgcccttcgtcaccaccaacgtcctcgggacccagatcctgctcgacgccgcccgatcggccggggtgggacggttcctgcacgtctcgacggacgaggtgtacgggtcgatcgacgacggatcgtggaccgagacgtggccgctggcgccgaactcgccgtacgccgcctccaaggcctcctcggacctgctggccctcgccgcgcaccggacccacgggatggacgtggtcgtcacccggtgctccaacaactacggaacacaccagttcccggagaaggtcatcccgctcttcgtgaccaacctgctggacggcaagccggtgccgctctacggcgacggcgggaacatccgggactggctgcacgtcaccgatcatgtgcgggggatccagctggccctggagaaggggcgggccggcgaggtctacaacatcggcggcgggaccgagctgagcaaccgggagctgaccgggatgctgctggaggcctgcggggccggctgggagcgggtgacccgggtggcggaccgcaaggggcacgaccgtcgctactcgctggacatcaccaagatcaaagatgaactggggtacgaaccgcaggtcaccctgcacgacggactcgccgcgacggtcgcctggtatcgggagaaccgtgcctggtgggagccgctgaaggcgaaggccgggctctga

SEQ ID NO: 8014 - DNA, 864 bp, Actinoplanes utahensis
gtgggagccgctgaaggcgaaggccgggctctgatgcggtggttgatcaccggggccggggggatgctcggccgggacctgcaggccgtgctcgacggcgcggacgtcatcgcggccacccgggccgacctcgacatcacctcgcccgaccaggtgcgcgacgcggtggccggggtcgacgtggtgatcaacgcggcggcctggaccgacgtggacggtgcggagaccgctaccgaagcggccaccgcgatcaacggccacggcgcggcccacctcgccgccgctgccggcagacgcctcatccacgtgtcgaccgactacgtcttcgacggaaccgccaccacgccgatcccggaagacgcgccgcgatccccgatcaacgcctacggccacggcaaagccatcggcgagcaggcggtcctcgccgccggcggatccgtggtccgcaccgcctggctgtacggccggcacggccccaacttcgtccgcaccatgctgcggctcgccgagacccgggacaccgtggacgtggtcgacgatcaggaaggaccaccgacctggtcgtacgccttggccacccaactggtcgcgctggcccgctccggcgccacccccggcatctaccacggcacggcggccggctcgacaacgtggttcggcctggcccgggcggccttcaccgcagccgggctggacccggcccgggtccgccccaccaccagcgcccggttcgtccgaccggcccgccgcccggcctacagcgtgctgggccacgcgggctggtccggcaccggcgtcgacccgctgccggactggcgcgacatgctcaccaccgccatgccggccctcctcaccagccgctga

SEQ ID NO: 8015 - DNA, 387 bp, Actinoplanes utahensis
atgctggcgatgagtgcggcgttcgtcggtgtctgggccgccggttttccggtctccttctaccgggactttccgtgggcgggggcgcactgggtctctgcgctcgggccgtacaacgagcacctggtcagggacgtcggtgggctctaccttgcgctgctcgtcgtttcggtcggcgtggtgcggcggccgacgctgcggcgggtggcgggtggggcgtggctggtcttcagcgccgaacacctgctctggcatgccttgcacctggacgccttctcccgggtgcaccaggtgacgagcatggtggcgctgtcggtcccactggccctgtccgccctgctgctgcgaccggaacgcggcgtctcagccggaccccgggacacctga

SEQ ID NO: 8016 - DNA, 753 bp, Actinoplanes utahensis
gtggacgtgatgcggatcgcggtggccggtgggaccggctggctgggcaaactggtggtcgcggaggcggaacgggccgggcacgaggtcgtggtcatcgcacgatcgcgcggggtggacctggtcagcggaaacgggctgacggacgcgctgcgcggggtcgacgtggtggtcgacgtgtcgaatgtgcagacgctcagcggcaggaaggccaccgagttcttcgagacggtgacccggaacctgctgaatgccgagcggcgggccggggtgcggcaccacgtcctcgtgtcgatcatcggggtggaccgggtcgagtggggttactaccaggcgaaactccatcaggagcagatcgccctgaacggcccggtgcccgccacggtgttgcgggcggcgcagttccacgagttcgccgagcaatcattgacccgcttcggcgggcccgtagcggtggtgccggccatgctgagccagccggtcgcggcccgcgaggtcgccgtcgaactggtccgcctagccgaaggcgaaccggccggcctggccccggagatcgccggcccggaacccctgcagatggccgacctggtccgcagggtcgcccgtacccggggcccgcgcaaatgggttctgaccgccaccatgcccggcaaggccggtagggccatggccaccggcggcaacctcccggccacccccggcctgcgcggcacccagaccttcgaccagtggctcaccgaatcccgtgcctga

SEQ ID NO: 8017 - DNA, 1203 bp, Actinoplanes utahensis
ttgcccagccagccggtcccaccggccaccgcgatccgcatcacgtccacctctctccgctgcgttcaccaggaggacagatccgggcgccgaaacgtgacagcttctgctgttactcagctcaccaccccggaaagcggcagcggcgtacgtcgaaatccctacatggccggccgtcgcggtggtgctgcggccgcgacccacccggtgagcccgcccagcgtcgttgccgacacgcggcggcagccagctgatcaggaacgctcgctggatgcggctcgcagaaccggtccacccgagaccctcgctcggcgaagccgaagcgaacgcggcccacctgcggccatcaggatcgaccggcggaggcgctggtggctgacggaccgggggccgaaggcgagtccgtactgccggcggcgaggccgggagcggggccgtactgccgggggcgaggccgggagcggggccgtactgccgggggcgaggccgggagcggggccgtactgccgggggcgggaggtccggtgggatggagggcggcgagggcggcgacggagagcaggccggccgcgcggcgtgcccatgtcgggacgatcacgccggtcgccgggacgtggaggccggaccgggtgcttcgatagccgggtggagatcacaacctggtacctggagcagaccgcacccgggccggcgacggcggccgcgccggccgtcccggtgcgggtcgagcgggccgagatcccgtcgccggagctgagccggttcctgtacaccgcggtcggcggtgactggaactggaccgaccggctggcctggacctggcagcagtggcacgaccatctggcgcggccgggcgtgcagacctgggtggcgtcggtgcgcggcaccccgtgcggctatttcgagctggacggcacccggcccggcagcgtggagatcgtctatttcgggttgctgccgagcttcaccgggcagcggatcggcggtttcctgctcgatgcggcgctggcgcgggcgtgggcgctgaatccgtcggtggcccgggtatgggtgcacacctgcagcctggacggcccggccgcgctgccgaactatcaggcgcgcgggatgagcctctaccgcaccgagacgacgaccgtgccggtgccggcggagccgcccgggccgtggccgggcgcccaccgcgaaaccgcagcgaaatag

SEQ ID NO: 8018 - DNA, 4815 bp, Actinoplanes utahensis
gtgagtgaggaggtggtgtaccggagtgaccggaccagggtcgtccggcggcactcccccgcgctgatcgccaagcaggccaccggcccgggcgcgcaccgccgcaccgaacacgagcgcgccgtgctgacccgactcgccggcctgcccggggtcccccggctcgccgccgggcagcagcgccagaccctgatgctgatcgacgacggcggcgccccgcccccgcccggcccgatgccggtccccgagctggtcgacatcgcgatcgcgctggccggcacgctcgccgcggtgcaccgggccggcgtcctgcaccgtgacatcaccccggccaacgtgatgctgacccgcggccggccggtgctgatcgactacgacctggcgctgaccggcccgccggagccggacgaggccccggtcggcacactcggcttcctgcctccggagcagaccggccggaccgcgctgccgatcgaccgacgggccgatctctacggtctgggcgccaccctgtacaccctggcgaccggcgccccgccgttcccgaccggcgatccgctcgccctgatccacgacaccctgatccggatcccggggccgcccgggctccccggccggctggacgcgatcctgctgcggctgctggccaaggacccggacgaccggtaccagagcgccgaggggctggcccacgacctggcccggttccgcgacgacccaaacggtcggtgggtgctcggcgaccgcgacttcccggcggtgctgtgcgccccggaggcgccgctgggccgggccgcggagatcggcgagctggccgccgcgctggaccggtcgagcgccgaaccgacaccggcggtgctgatcagcggccccgccgggatcggcaagagcgcgctgatccacaccctgcgcccgctgatcaccgcgcgcggcggctggttcgtgtcgggtcgctacgagcagtcgcggaccggcacggacaccggcggcatcgcccggatggtgcgcagtctgggccggatgctgctggccgagccggagtgggagctgaccgaggaccgccggcggatcctggccgcgctcggcccgaacgcctccgcgctggccgcggtggtcccggagatggcggcgttgctgcgcgtcgatgggctgccgtaccagggtgatccgctcaccacggcggcccggctggccaccacgatcgccggcctgctgcgtgcggtcgcggtccgccgccggctggtggtgctgatcgacgatctgcagtgggcgtctgcctcgtcgctgcggatcctggacggggtcctcgccgacgggccggtcgccgggctgctgatggtcgccgcctaccgcgacgagcaggcgggcgatgacgatccgctgggcgtgatggtgacgcgctggcagcgggacgggctggccggggcgccgctgcggctggacgggctggaccgggccggtcgggcggcgctgaccgggacgttgctgcggctgccgccggacgacgcgaccgagctggcggagctgctggccggggcggggggcggcaacccgtacgcgatcgtcgaattgctcaacgcgctgcgcgcggagaatctgctgacgccggccgcggccggctggcactacgacccggccgaggtccgctcgttcgtcgcgcgccatcggctgccgcaattgttggcggtacgcctgcgtcagcagcccgagtccacccgcctgctgctgaccgcgctcacctgcctgggcgccgacgtcaccgcggacctgctggccacggccaccggcatcccgccggagagtctgccggcccgcctcgccccggccgcggcggacgggctgatcgacgccgatgacccgatccggttccgccacgacctgctcctgcagaccgcccgggagctgctgccgccggccgcgcgggagcagctgcagctggccatggcgcgccggctggccggccgggcggagttcacccggcaggccgccgagcagtatctggcggtggccggcgcgatcaccggtgacgacgagcgccggtcggcggccgcactgctgcaccgggccgggcggcgcaccgcccggatcgccaaccacctggtggccgaggagctgttcgcggccgcggaccggctgctcgcaccgctgtccgggcggggcgaccgggcggcccgggacgcgctcgcgatcgaccggcacgcggcgctgtactacctggggcggcacgccgaggcggacgtgttctaccgggagctgaccgtccgctgccgggatccgctgccgctggccggggcgaccgccgtgcagatcaacgcgctgacccagcgcggcgagtgccgggccgccctcgccctcggcctggacgcactgcggcgcttcggcctggtgccgcccgccgacctggtcgccgacaaccggcgcgcgatcaccgagctgcgcgaccggatcgcggcgcacggcccggactacccggacaccgaggtgaccgacccgcggaccgtggcgatcgccgggatcgtggagcggatgctcctcccggcgttcctgatcgacccggaccggcacgcgtggctggtgctgcaggtgcacaccctgtggcaggagaacggggtgtgcgccgcactggccggggcggccggctcggtgagctgcctgacgatcgccatgctcgacgactaccggaccggcttcgtgctgaccgagcacgccctcaacgtcgcccggaaacaccagtatcagcaggaaagcgcgatcgcggcgcatctgcacctgatgatctcggcgcactggttcctgccgctggaggagctggtcgcgccggcccggcagacccgcctggatctgctggcggccggcgacgtgcagatggccggcgtgcaatgggcgcggttgctcagcctgctgttcgagaccgaggagtcactggacgcctcgggcgacgaggcggaggcggtgctggccttcgccgaccgcaccggcaaccggttcgcccggctgatcgcgatcggtcaccggcagatggtccgggatctgcgcggcgacccgccgggggacgacgcggactacctcgcggagatcgccgcgttcccgaccgcgatggccacccaccaccagcggcgggcgctcaccgctctgctcaacggcgatccggcggccgtggacgagcactcggcggtggcactggcgggagccgacacgatccgcggtctgtactcctgcgccctgatccggctgtgccgctgtctgagtgacccggcggccacctcggaccgggactggctggcccggcgggccgccgacgcgccgttcaacttccggccgctgctgctgctcgccgacgcggaacgggcccgggccgcgggcgatccgggcaccgcgatccggctgttcgacgaggcgctgctcagcgtcggcggccggccgtggcagcacgcgctgctcgccgagcggtccgcccggatccacctggagcagggcctgacgcacaccgggcgccggctgctcgccgaggcgtgcgacgcctaccggacgtggggcgccggcgggccggtcgcccgcctggaggccgaacacccgttcctacgcgggacccgttccgacggttccagcagcggtaccggcgccgaccggatcgatctgatggcgatcctgcgcgcctcccgggcgctgagctcgcagaccacggtgaccgggctggccgccgaggtcgccggggtgctcagcgcgatgaccggggccaccgacgtgcgcctgtcgctgcgcgaccggaccctgtccgggacggccgacaccgatctgccgctgtccgcggtccgctacgtgcggcgcacccggcagccgctgctggtcgccgacgccacccgcgacgaccggttcgccggcgacgcatacctgaccggcttgaccgcgtgcagcctgctggtgctgccggtcagctgccaccgcgccgaggacgcggtgctggtgctggccaaccgacgccagcgcggggtgttcgccaccggccgcctggagacggtcgagctgatcgccgggcagctcgccgtctcgctggacaacgcactggtgcacgactcgctggagagcgaggtgcgggcgcgaaccgccgagctcgccgaccgcaaccgtgacctggaagcggccaaccagctcaaggccgacctgatcgggatgctcggccacgagatcaacaatccgctcgccaccatcctcggctatctcgatctggtgctcaccggggacgacccgctgcccgacccggtggtcggcctgctcacccgcacgcacgccaccacccggcggctgaccggcatcgtcgaggaggtgctggcgctggtcagcatcgacgccgggcggctcaccgcggtaccccgcccggtccgggtggcgccgcacatccaggccgcgctcggcgtcgcgccggcgagcgtggactgcccggcggatctgacggcggcggcccagcccgggcacctcgaccagatcctcaccaatctggtcagcaacgcgaccaagtacggcggcggggtgaccgggatcgtcgcccggggcggccgcgacgaggtcaccatcgaggtccgcgaccagggtccgggtgtcccgccggagttccgggaccggctgttcgcccggttcgcccgcgccgaccggaccgcgggccaggtcgccgggaccgggttgggcctctacatcgtccgcgagctggcccgcgccaacggcggcgacgtccgctaccgccccggcagggtcggcggctcgcgcttcatcgtcaccctcccgccggccacgcgggaggcgcagccggacatgaggtga

SEQ ID NO: 8019 - DNA, 333 bp, Actinoplanes utahensis
atgtcagggtacatccttcgcggcgtcgcgtttccgttcccgggtgggcgctttcccgagcggctcggcgccgtcgttcagcgcaccgttctcaccggtgaggagccggcccgcgtcgtgatccacgacgaggagaacgactggctggtcggcgacggggtcaacgatccggatctgcccggcgccagcgtgatcgcctgcatcgccaccatcgccgacaccgatccgggcctcgccgagctggccaccctgccggtgggccggatcgcccgccgggacgaggccggcaagccgtggaccgtcgatccgcacacctggcccgacgatctctga

SEQ ID NO: 8020 - DNA, 207 bp, Actinoplanes utahensis
gtgccgaccgtgctgggcgtggaactcgccgcgtacacctccgcctggtacgtccgccatccggacggcgccctgagcgcgaagcgatcggacgcccccgcccccgcaccggccgagccggcggaatccgtcgcgggcagggccgccgcggctgcggcccccgagcgggccggcggcaggaaggtgctggtcgcagggccggaatag

SEQ ID NO: 8021 - DNA, 1086 bp, Actinoplanes utahensis
atggggtggagggggtgcgccatgcgctggtacgtcgtcgcggtgatggtgctcgccacggcctccggctgcagcagtgcggacgagacgaccgtcgagcagaaggatcggggcaccatcgggatcgccatgccgaccaccaagtcgatccgctgggtcggggacggcaagaacatcgcccagcagttccaggtgctcggctacaagaccgacctgcagtacgccgaggatgacatcgacaaacagatcagccagatcaaggcgatgctcgccgccggggagaaggccctggtggtcggtgcgatcgacggcaccgcgctgaaggacgtgctggccgccgcggcgaccgcgaaggttccggtgatctcctacgaccggctgatccgggacaccccgaacatcacctactacgccaccttcgacaacttccgggtcggcatcctgcaggggacgacgatcgtgaaggcactccacctggcgggttcgggcggcagccacaccatcgagctgttcgccgggtcggcggacgacaacaacgccacgttcttcttcaacggggcgatgagcgtgctccagccgtacctaaagtccggccggctgcgggtggtctccggtgagacctcgttccagcaggtcgcgacccagcgctgggacaacgcggtggccaagaagcggatgcagcggctgctcgccggcccgctgcgcggcacccgggtggacgcggtgctcgccccgaacgacggcctggcccggggcatcctcgaagccgtccaggaggccgggtacgccaaaccaccggtggtcacggggcaggacgcggaactcgactcggtcaaactgatcgccgccggcaaacagaccgagaccgtctacaaggacacccgggagttggccaaggtggccgtgcagatgaccaactcgctgctgctgggcggagtgcccgtggtcaacgacgagaaacagtacgacaacggtgtcaaggtggtcccgacgttcctgctgcagccggtgaacgtggaccgctccaactacaagcgggtgctggtcgacggcgggtactacaccgccgaccagctggcggggtga

SEQ ID NO: 8022 - DNA, 1572 bp, Actinoplanes utahensis
atgatccagcgcttcctcgacctgtcggtccggaccaaattgaccatcctggtcgccgccagcatcctggccctggccgtctgcctggtggtgaccacgatcaacggtcgtaccgccgacagcaccgcccgcgacctggagaacctgaacacggccagcgcgatggtgctgcagctcgaccgggaggccagcgagctgcgcgccaacggcatccagtcgatcgtccgcagcgacccggccaagcagagcgagctgctgaaggcccggatctccgaggtcgacgacctgctgaccaggctgcaggcgatcgacctgcccagcgggctggacgcggcggtcggccggatcaaggcggtcaccgacgactacaccatcacgctgaagcgcttcgtcgacgcggccgccgtcgaccaggccggcgcccggctcgcctgggagcaggtcgacgtcgacaactacctgatcagcgcggtgctggcgaacgagcgggcgctgttcctggacaccgtggcccgggccaaccagaacgccgcgcagagccgggccaccgccaaccacatcctgtggctggccgtcgcgatcgccgcgatcctggtctgcgtgctggcccggctggtcgtcctgtcgatcacccggccgctgcagcgggtccgcggcgcgctgcaggcgatggccgacggcgacctgaccgtcgccgccgaggtccgcggccaggacgaggtcggccagatggcccgcgccctggacgaggcgcaggccaacacccggcgggtggtgtcctcggtggccggctcggcgcaggccgtcgcggccgccgccgagcagctcaccgcgaccgcgagcaccatgtcccggtccgccgaccaggccgcctcgcaggcacagaccgcgtcgcaggccgccgagggcgtcaacgacaacgtcagcagcgtcgcgcagggcacccaccagatgggcgactcgatccgggacatcgcgcacaacgcgaccgaggccgcccgggtggccgagcaggcggtggcggtcgccgacgcgaccaccacccaggtcggcaagctgggcgagtcgtcccgcgagatcgccgaggtgatcaaagtgatcaccagcatcgccgagcagaccaacctgctcgcgctgaacgccaccatcgaggcggcccgggccggcgaactcggcaagggtttcgccgtggtcgccggcgaggtgaaggaactcgcccaggagaccgcccgggccaccgacgacatctcccgccgggtccaggccatccaggccgacacggccggagcggtcaccgcgatcggcgagatcacctcggtcatcgccagcatcaacgactaccaggccacgatcgccgcggcggtcgcccagcagaccgccaccaccgagcagatgagccacaacgtggccctggccgcttccggtgccggcgacatcgccgccaacatcaccggcctggcgaccgccacccaggtcagcaccgagggcatcgcgcagtcccagcaggcggtgaccgagctcagccagatggccaacaacctgcagaccctggtcagccacttccgctactga

SEQ ID NO: 8023 - DNA, 477 bp, Actinoplanes utahensis
gtgctgggccgaccgctggtgtttctcgacgtggacgggccgctgatcccgttccgcgcccggaccgtcggcgccgccccaccggctccggacggcggcaatccgctgctgcaccggatcgacccggaggacgggcggcggctgcggaaactcccggccgacctggtctgggccaccacctggatggacgaggcgaacgaggtggtcgccccgcggctcggcctgcccccgctcccggtcgtcgactggccggacgaggcgccgctgcccggcctgcactggaagacggcgttcctggtgacctgggcggccggccgcagcttcgtctggatcgacgacgagctgaccgacaacgatcgccgctgggtggccgcgcaccatccgggccgggccctgctgcaccgggtggacggcaaccgcggcctcaccgacgccgacttcttcaccgtcggcgcctggctgatgatccacgggtga

SEQ ID NO: 8024 - DNA, 1134 bp, Actinoplanes utahensis
ttgcgggacggggcggccgccacggtggcggtgttgcgtaccggcaaggaggctgtctcgcagcagccggccgtgaccgtgccgctgcccgcgcccggagcggccgtcgtgctcagcacgaccctggtggaacgggccgccgaaccggtcctgcggcgtctccccgagctggccgcggaggcgttgcgcgccgccgagctgggcaggaacgacatcgcggaggtgtacgcggtgggtgccgccgccgcgatgcccgccctgccgcgggtgctggaacgcgagctgggccggccggtccgggtcgccgccctgcccggggcggcggtggtgctcggtgtcgccgaagccgagggcgccgcggcgccggccggcgaaccggcccccgaggtcccccggctgaccgtgctccgggtgctgggcctgatcctgcccggggcggcttcggtggcgctgttcagccatttcgtgttcaccgcccgggggcggaccgcctcgagctggggtgagctggccatcgccggggtgctcgcgctgatgctgtgcctggccgccggcccgtggatcggcgcggcgctggcccgcgacgccggactgcgcgggcgctgggacgccgccgggcagatctccgccgggctgctcaccgcggacgcgttcggggtgaccgtcgccgcactgtacgcggtggcggccggcctctacctggtggcgccgttcggcgagccgctgcagtggtctttgctgccggtgctgcccgccgccctgctggccgcggccgtcgcagtgatcgtccggcggcggttgatcccgccggtgatcgtcgaatccccgctggtcgcgaccatcatcctgagcatcggcagcctgctgtacgcgctgacggtccgggccggcttcccgcccgcggccgcactgtggggtacggccgccacccgcaccggcggcgcgctgatcggcgtcggcgtcgcgctgctgctgttccggatcacggtgctgcgcggcatcaccgcggtcgtcctcggcgtcttcggcttcttcatcgcggatccccgcgcggtcggcgtcttcggcgtcggcatcggcatcgcggtcgccgtctggtggggccagcgcctgctcaccctggtccgcccctga

SEQ ID NO: 8025 - DNA, 222 bp, Actinoplanes utahensis
atgttaattctcgttgaccctgagcaggctgttgagccaggtgatttctgcatagccagacttgggggtgatgagtttaccttcaagaaactgatcagggatagcggtcaggtgtttttacaaccactaaacccacagtacccaatgatcccatgcaatgagagttgttccgttgtggggaaagttatcgctagtcagtggcctgaagagacgtttggctga

SEQ ID NO: 8026 - DNA, 1191 bp, Actinoplanes utahensis
atgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctga

SEQ ID NO: 8027 - protein, 387 aa, Actinoplanes utahensis
MRKALIALAAAGLLTSVTLTACDGGSNDGDASGSDAGLHSNATSSGEGRGGVGIVLPDTQSSTRWSNDDPKYLKAAFKSANVPYEIQNAEGNADAFKGIAKAMLDSGIKVLMIANLDSVSAKWVIDLAHSKKIPVIDYDRLTLNGGADYYVSFDNEKVGQFQATGLIQCLKDKGVSKPVIAELNGSPTDNNATLFKAGYDAVLQEKYDGGDFVKGPDQFVPQWDNNEGKAIFTQMLKQWPTINGVLAANDGLGNAAIEVLKKNGKTGIPVTGQDATVQGLQNILAGDQCMTVYKATKQEAQKAADLAIALVKSGKATARDKVKDPETGAYVPSELLTPTLVTAQNMVETVIKDQFVTSKELCTAKFLQACQQYGLAAKPGASSGTGS

SEQ ID NO: 8028 - protein, 159 aa, Actinoplanes utahensis
MAKENGTKLIASNKKARHDYAIIRTYEAGLVLAGTEVKTLRLGRASLVDAFAQEHEGELMLYNLHIAEYGFGSWTNHAPRRTRKLLLHKAEIIKILNTLNDGSGLTLVPLSLYFKDGWVKVELAIARGLKSYDKRQVLAERDAKKEIAKEMGRRLKGRR

SEQ ID NO: 8029 - protein, 118 aa, Actinoplanes utahensis
MVYDPGLTSRGVQYGRRGIRGTGIINRVTNWEYARLEYRAAGTLGTDRFMDWTATFHHPGGVLRWGTDERFDDLRHLNRAGAAGWQAYNRAVIHVKDEPHRLSSVTYSMRRPIPVDGP

SEQ ID NO: 8030 - protein, 702 aa, Actinoplanes utahensis
MTTGTVARLVCGRRSKWIVLALWIVVLVFAGGLAGKLGGVEKNDNASWLPGSAEATQVADLQKQFQPDDIVPAILVYERAGGTTPADLQKAAADARAIATVPGVTGQVIGPVPAPDRAALQVIAPIRVDAGGWDKITEAVDRIKTISGTGDGGLGVYLTGPAGVAADSASAFQGIDGTLLYTTLIVVAIILLVTYRSPVLWLLPIITAGVALTSAQAVIYLLAKHAGLVVNGQSAGILTVLVFGAGTDYALLLVARYREELRRHEDRHEAMMFALHRAGPAIIASAATVAIGMSCLMLAEVNATSGLGPVAALGIVVGLLAMMTLLPALLVICGRWLFWPVRPRFGTPEPTATGLWARMGGRIARRPRQVWLATALALGAMALGLLQLNANGLSQQDSFTSTQPSVTGLEVLSRHFPAGQGDPVVVITDPAHQDAVRAAFAGTAGISQVGEPAVKNNLVRFEGTLTSAPDGQAAEDTVRAVRTALAGTGAKVGGTTALKLDINQANKHDNRLILPLVLLVVLAILAILLRALIAPILLMATVVLSFAAALGVSALIFRHVFHFAGEDTAFPLFVFVFLVALGIDYNIFLMTRVREEARDHGTRRGALIGLGATGGVITSAGIVLAGTFAALGSLPLVAFAEIGFAVAFGVLLDTLIVRSVLVTALSLDLGRWMWWPSALFRHDPSVDAPVSPAPAILTHQTD

SEQ ID NO: 8031 - protein, 458 aa, Actinoplanes utahensis
MADVDATHGTGAVPPDALRAAETGSSGGAFDELHPPRADLVSDCVHCGFCLTTCPTYVLWGEEMDSPRGRIHLIAQGLEGEPLSESMVGHFDSCLGCMACVTACPSGVRYDRLIEDTRAQVERRHPRPARDRALRAAIFAVFPYPRRLRLLRGPLWAYRTSGLQRLVTRSGLLDRFAPTLATLESLAPGVRRVPRPPRRVAARGQRRAVVGMLTGCVQSAFFPEVNSATVRILAAEGCDVLIPAAQGCCGALSVHNGRRAEAEGFARRLIDTFERCGMDFFVVNAAGCGSSLKEYGELLAEDPAYAARAAAFAAKVRDLAELLAELGPVAPRHPLPLTVAYHDACHLGHAQGVRAQPRALLRGIPGLELREIADPEICCGSAGVWNVLNPEPAAELGDRKAAAVLDTGAALLVTANPGCLMQVAAAVRRRGGRIALAHTAQVLDASLRNLGAAALTDH

SEQ ID NO: 8032 - protein, 268 aa, Actinoplanes utahensis
MPARLVAAPRDTAEAAALITAARGLSVVIRGGGTKLDWGPPPRELDLIIDTRRLAGVVEHAAGDLITVVRAGTPMGDLHRLPGQQLALDAPPAATAGGTVAANASGPRRLRYGTARDLLIGITAVRPDGTVTRAGGRVVKNVAGYDLGKLYTGAFGTLGLITECVFRLHPVPGSHAFVRVSAPPGHAAKVLAGQFAASACEVNAAPGAEPELAVLLEGTAAGVRERAAAVAALLGGKVSAEAPEWWDVPPWPPGGVGLKLTGALSQAS

SEQ ID NO: 8033 - protein, 486 aa, Actinoplanes utahensis
MTDIDALAARLRAELGADRVLTDRQELRTYECDGLAHYKVIPALVALPRTAAQVAAVVRACADTGTPFVARGSGTGLSGGALPHADGVLIVTSQLRRIVEVRPEDERAVVEPGVINLQVTRAAAPHGYYYAPDPSSQQICSIGGNVAENSGGAHCLKYGFTTNHVTGLEVVTPDGERVRLGGPAPDTPGYDLLGAFVGSEGTLGVATEVTVRLTRLPETVRTLLAGFGSTDQAGAATSAIIAAGVLPAAIEMMDELAIAAAEAAVQCSYPAGAGAVLIVELDGPAAEVAAQFDEVSALCESNGAFETRIAADDQERALIWRGRKSAFAAVGRISPDYIVQDGVIPRMSLPVVLRRIGEVAAEHGVRVANVFHAGDGNLHPLVLFDAQIPGQAERAETVSGAILDLCIEHGGSITGEHGVGVDKARYMPRMFSDADLETMQLLRCAFDPDGIANPGKVFPTPRLCGERPGRRSGAHPLHTAGVAEIF

SEQ ID NO: 8034 - protein, 906 aa, Actinoplanes utahensis
MACSRGFLGGGGCGMKFVYDFHEGNKDLKDLLGGKGANLAEMTNLGLPVPPGFTITTEACQEYLRAGTHVDGLAGEIDTHLATLEQAMGRRLGDPADPLLVSVRSGAKFSMPGMMETVLNVGLNDESVAGLSRQAGGNDRFAWDSYRRLIQMFGKTVCDVPGAEFEDALHQAKVAKGVKDDVQLDAEDLRALVTAYKKVFVKHTGHEFPQDPREQLDLAVEAVFRSWNADRAVLYRRQERIPADLGTAVNVVAMVFGNLGDDSGTGVAFTRNPASGEQGIYGDYLANAQGEDVVAGIRNTLPLAELENLDKRSYDELLRIMAILEGHYRDLCDIEFTIERGKLWMLQTRVGKRTAAAAFTIAAQLVDEGVIDLDEALTRVTGSQLGQLMFPRFDLSGSPESVTRGVGASPGAAAGEVVFTSAHAVAAAAEGKSVILVRRETNPDDLPGMIAAKGILTSRGGKTSHAAVVARGMGKTCVCGADEIEVGRDTVTIGAHTIREGDVVSIDGTTGRVYLGEVPVRPSEVVQYFEGDLDPTQANDPLVAAVHRIITHADQKRRLSVRTNADTGTDAARARRFGAQGIGLCRTEHMFLGDRRELVERLILARTDTDRTDALAALQPLQRADFLQILREMNGLPVTIRLIDPPLHEFLPSLEELAVKVAVAHEQGQRLEHDEKMLAAVRKMHEQNPMLGLRGVRLGLVIPGLFAMQVRAIAEAAVALAAEGGNPRPEIMVPLVGAVQELETVRAEAEKIIAEVIGDSGVTVLIGTMIEVPRAALTAGQIAEAAEFFSFGTNDLTQMGWGFSRDDVEGAFFWRYLELGIFGISPFESIDTEGVGRLVRIAAEEGRAARPGLKLGVCGEHGGDPDSVHFFHEVGLDYVSCSPFRVPIARLEAGRAAVESEGSDHR

SEQ ID NO: 8035 - protein, 134 aa, Actinoplanes utahensis
MASRLNPYLTFDGNAREAMETYQRIFGGDLKVTTFGEFGVPDESIKDKVMHAMLDTPQGYTLMASDTAPGMPFTPGNANSVSISGDASDNLRAFWDKLADGATISLPLEKQMWGDEFGQLVDRYGVPWMVNITA

SEQ ID NO: 8036 - protein, 426 aa, Actinoplanes utahensis
MTIADFAVVAASAVLVLARWLPTAARRRTALSAAAVTIVGAAFTVPGTRWPVLLVLGTDLLVVAATVAVWLRKRRIALSASDGRSAEVRRATKARSGGALRASGGGSAEVSDASDRRSAARRAAEAGSGESPRGSGGRGGEVSGASGGGSGAALQAADVGSREALRASDGRSEGAAGGGEEDRRVRRSMALPGSVVALGLVIGAGAAAWALPVPVFPALSGASAVGTTVLQWTDPARGEAATPDAGDRRAVVVQLWYPAQRVAPDAVRAQYLGRNRREAEIVADGVADYLGVPGFLLDGPTRARTHAVVGAQPATGRFPVVLFSPGLGGVRTQNTAWAEELASRGYVVAGVDHPYDSAAVVLADGSTVRTRIAASGDRTEDNRRRISWTSVRAADLSFVLTQLGRLDKGDPAGRGEEGDAAGRGED

SEQ ID NO: 8037 - protein, 219 aa, Actinoplanes utahensis
MGDPAGRGGMGEPAGRGGMGEPAGRGGKAAFDHRAPADGGEPGRAGGGVGGGEEGVAGELAGRLDVGRAAVTGHSLGGAAAVRAAQGDPRFKAVIDLDGGLDTDQKAVRQPVLVVTHEIRDRADADYVARVMTVLEGGGAGGYRLTVPGSAHLTFTDAPLYLPPVPSLVGSLGGNGSVRMTVETSAAFLDATLGGRTVDLSAALAKYGELSVRQPAAVR

SEQ ID NO: 8038 - protein, 775 aa, Actinoplanes utahensis
MTSAPAIPVSSATDALNRIFGYPDFRGRQREIVEHVIDGGDALVLMPTGGGKSLCYQIPALVRPGTGVVISPLIALMQDQVDALRTLGVRAGFLNSTQDLDERRLVEAEFVAGELDLLYVAPEGLGTAGVQRLLDRGQISLFAIDEAHCVSQWGHDFRPDYLSLSMLHERWPDVPRIALTATATTATRDEIARRLQLTDARHFTASFDRPNIQYRIVPKNDPKRQLLDLLRTEHPGEAGIVYCLSRASVEKHAEYLSANGVPALPYHAGLDARTRAEHQSRFLREDGLVMVATIAFGMGIDKPDVRFVAHLDLPKSVEGYYQETGRAGRDGLPSTAWLAYGLQDVVQLRKMIDGSEGDANFRRNANRHLDAMLALCETVSCRRVQLLAYFDQEAASSSCGNCDTCLTPPESWDGTVPAQKLLSTVLRLHRERNQKFGAGQSIDILLGRKTDKVAQFRHDQLKVFGIGADLREAEWRGVVRQLLAGGYLAVEGEYGTLVLTDRSAAVLRGEVTLMMRRELARPRSASSARSSSGSGSSSSRSAAPAPADFPAEAEPLFERLRAWRAGIARDQAIPPYVIFHDKTLRAIAVLAPATLDQLATVSGVGQSKLTKFGDDVLAVIRGETPSPTPPPGDSPVPGTLPVTTTGPAHGGLPGTATAAARGALHAAEPAPDTLPVSEPARGTLPAAGARPVPEPARGTLPAADARPVPEPARGTLHPADARPVPEPARGTLHPADARPVSEPARGTLPSAGPTASFEDDFPRYEYTDEDEPFFD

SEQ ID NO: 8039 - protein, 633 aa, Actinoplanes utahensis
MDIPAGGDLRAMLSAVDQLPFIVAVFEGPELLLVGANAATRAVLPGRDIIGRPCREVLSDLAGQQFVDAYYQVYRTGEPIAGQQWRAHLDMPDGSVHEMFATFTIVPWRDPDGTLRGVIGAAFDVTEIARTRQAAEAEAARLRQRYEQGRDVITELQRELLPPGLPVLPGLQVAASYLLADADTAAGGDWFDAVARPDGRVALVVGDVVGHGITASGAMGQLRAVLRERLDSGAPIEEALAAADRFAGRMQAAHAATVCLVLLDPAGGALDYCTAGHPPPLVSGPDGTTRYLAASGGSPLGTGGVFPIRHDRLATGDLLLLYTDGIVERPQAGGPQPAELAKVVADATAGRALREPGSTAADRVCGQAIELLVRAGGHADDITLLAAQRVPVVPELALDLPAKPTELRGVRARLGRWLAELGASAQDVFVLQHALGELTTNAIEHGGGRTVTVRAVLTAAGRVEAVVTDHGGWRAPSRQPIRGRGLALTAQLVESLHVEPGPHGTVATVRHPLSRPARLLTRFDDAPRRAEPPAAMTVTELPGGDEARVRVDGPVDSTSAVALRQELLRRSRGGNVPMTVDLTGVDHLASAGVSALYLIAEQHHDRKAPLTLIAAPDSPSRHILDLVGLPVTP

SEQ ID NO: 8040 - protein, 213 aa, Actinoplanes utahensis
MVKASIRRQVTVPLRFSDGYATTAQVMTFDGLADGREHLALGLGDWRRALTKSAAGGRAPLVRPHSECLTGDVFGSQRCDCGPQLREAAERITEQGGFLLYLRQEGRGIGLYAKLDAYALQDDGLDTYEANLALGRGEDERDYTAAAQMLQAVGVDRIRLLSNNPDKALQLEGLGVAVTQRIPTGVHVSAANVRYLRAKASHTSHTIELPLAE

SEQ ID NO: 8041 - protein, 228 aa, Actinoplanes utahensis
MDERPYILLSCGMSIDGYLDDTSADRLLLSNDADFDRVDEVRAGCDAILVGASTIRQDNPRLLIRSAQRRARRLVRGKPANPVKVTVTGRGDLDPEAAFFTAGESAKLVYCATGALAATRDRLGAAATVVDGGDPVDVRRVSADLARRGVRRLMVEGGGTMHTQFLTGDLADELQLVIAPFFVGDSRAPRFVHDGDFPAGPKNRARLAEVRQIGDVVLLRYALSDRFS

SEQ ID NO: 8042 - protein, 361 aa, Actinoplanes utahensis
MTTRSFWAWVRLLGGAGIIVLVLWRLGTGAFLDGLRVLDAGTLALAFGIGVVTTVLSAWRWCLVARGLGLKLSLRDATADYYQALFLNAALPGGVLGDVGRAVSHGREEGDVGRGVRAVVLERTAGQLVLLVVGGAVLFTVPSPVLTVLGEHGETVAVVAGTVAVVALLTVGVLRRARRGSVKLAGATRTGAAEIRSGLLARRNWPGVLFASAMVLAGHLATFLVAARVAGNGASLLRLAPMLLLALLAMGIPLNVGGWGPREGVLAWAFGAAGLSAEQGVTIAVAYGICAFVAAAPGAIVVAVRAARKLRRPVAARPDSRVRSTTPAAPLVTAEPLPAGPVRVRRATTVRQPAYSSGVGV

SEQ ID NO: 8043 - protein, 250 aa, Actinoplanes utahensis
MTGEFSADWLALREPADADARAADLAGLLPHPVKVIRDLGCGTGSMGRWLAPRLPMPQFWILTDRDHDLLEIAADRMPDGVNVAIDERDVTALTRDDLTGADLVTCSALLDVLTAAEVDRLVEVCAQARANVLFTLSVTGVVRLTPPDPRDDDVRQAFNDHQRRDARLGPEAGDYAAAAFAKAGARILTRESPWRLGAARPELTAEWLRGWVGAAAEQRPDLRFDDYLAERAAALPEISVGHKDVLAIFD

SEQ ID NO: 8044 - protein, 359 aa, Actinoplanes utahensis
MNTPLHVVLPGGIDDPAAPSGGNRYDRRVLREITANRARGTQREPAAAPLDHPAVRETALPGSWPRPAADARRRLSRTMAAIPDGHTVLLDGLVACGVPELLAPHARRLRLVILVHLPLSDETGLSPTAAAELKALEGRALHLAAGVIATSDQAAAHVAGMHGIARVHVAAPGVDPAPPSTGSPSGRHLLCVASLTHRKGQDVLLRALGTLTDLDWECTFAGAGPIPAHSGNVRFTGPLAGADLEAAYANADLFVLPSRAETYGMVITEALAHALPVVATHVGGVPQALGGTPDGVPGKLLAPDDPDGLADVLRAWLTDSDLRARWRRRAVARRATLTGWDETARRLTTILRIIEEGTP

SEQ ID NO: 8045 - protein, 133 aa, Actinoplanes utahensis
MFSVTVRDHIMIAHSFSGEVFGPAQRLHGATFVVDATFRRPELDEDNIVVDIGLASEKLHTICSGLSYRNLDEDPEFTGVNTSTEFLAKVIADRLAVRISAGELGPGATGLTGLQVTLHESHIAWASYERTLR

SEQ ID NO: 8046 - protein, 324 aa, Actinoplanes utahensis
MFDARAFWLACPGSGEIRTESVRDPGPGEVLVRTLHSGVSRGTETLVFQGRVPENQWSAMRAPFQEGDFPAPVKYGYLNVGTVEEGPASLKNRTVFCLFPHQTRYVVGHREITVVPDGVPPERAVLAGTVETAVNAVWDANPQLGDRITIVGGGMVGSSVAAILAAYPAAEIQLVDADPGRRTVADALGVDFALPDDAADGRDLVIHASANPAGLARSLELAAPEKTVVELSWYGDREVPLRLGEFFHSRRLTIRGSQVGGILPQRGRTYAQRLDLALNLLRDDRFDALLTGRSAFDELPEVMPRLADGSLPALCHVIDYPTGN

SEQ ID NO: 8047 - protein, 248 aa, Actinoplanes utahensis
MTITTATTTPSRAPFAGFAAQLALIALLAATTGLTLAGGLAGIAYGAVLCGLLGMALDRAGLSFLGWANLVTFGRAILTGGVAAMVTGTVLGHPAPVWPLVTIAAVALAMDGVDGQVARRTGTSSSLGARFDMEVDAFLILVLSGYAAVSHGWWALAIGGFRYAFVAASWAYPWLNGALPARFSRKVVAAQQGVLLAVVATGLLPEWAAVGTLAFALASLTWSFGRDIRWLHRESAVQRQFDLITGRV

SEQ ID NO: 8048 - protein, 415 aa, Actinoplanes utahensis
MARRAQRQIAAPGRFRELSRGTHPGQHRSGVGPGFLPCGQVVGDGPHEFVARAGWQILARGPQLGQVFEHERVGVGQRCCRHLGSPSRSCCPASIGASAGHIGPGWYSATPESDFRPMVTGMRLVSLLPSATEIVYALGLGDNLVGVTFECDEPAEARSSKTVVVGGRDTHGMSPVEIDDYVRTQMAAGGDLYTLHADALAGLSPDLILTQDLCRVCALPSGHVDDALTHLGCRAEVLSLDPYSLPDVLASFVEVATAAGVPDRGRELRAGLERRLDAVAAAVAGRPRPRVAIVEWVDPPFTGGHWVPDLIVAAGGEPVAARAGKRSVQVSWAELTAAQPEIVLVTPCGYHLDGAVRQAESVLPHFPDAQVWAIDGDGLVVRPGPRLVDGVEAIATILHPDAVPAARQGAVRRVQ

SEQ ID NO: 8049 - protein, 285 aa, Actinoplanes utahensis
MMPVNGIQVCLETFGERTDPPLLLLAGEASSMDWWDDEFCRRLAAGGRFVIRYDHRDTGRSTAFPPGAAYSGTDLMHDALGVLDALGAPAAHLVGLSLGGALAQRIAVEHPRRALTLTLIATSAGLPPDAIPVLAGAPTLPLRTSAGTSVAVRTAPDDVNWSNRRAAVAGLIAEALARGGPFTPDEQQLRRLAERVFDRSCDLGTARRNHQRAGYGPPIHDRLPTITTPTLILHGTLDQRVPAHHPRELARLIPQARLIWLDGVGHEPPPRALWPQILPEILRTP

SEQ ID NO: 8050 - protein, 110 aa, Actinoplanes utahensis
MSEFELHRTEEQASLDGQRVPGLRAEFFRRADGDRVASVGRYSLGGRELLLAWGYVDEEHCRHNAVRAKSGSWFPAEAGCPDVRLIKDGQAVIGLAVRASTGEWMREECG

SEQ ID NO: 8051 - protein, 123 aa, Actinoplanes utahensis
MRRAAVVLALVVAGLWIASPAQAFAHNNVHNVYFHAVLDALTLLVVASPVWTAMLWSGRRRWLMAALIAVVQIPVAVIGFVPIINPYLHLALFLLAIGLTATSLRIVRNRSRAAAGVPAPKPR

SEQ ID NO: 8052 - protein, 56 aa, Actinoplanes utahensis
MVADRATCRTVESAIVAYIAVHDADPTSIRQLTPYVDGDIAKYRIVRGRAAGPGCR

SEQ ID NO: 8053 - protein, 614 aa, Actinoplanes utahensis
MTMETLEFQAEARQLLQLMVHSIYSNKDIFLRELISNASDALDKLRLAKLQDGLEADTSDLHIEIEADAEARTLTVRDNGIGMTREEVVALIGTIAKSGTADLLAKLKEASESKGDAELIGQFGVGFYSTFMVADKVSLVTRKAGTEGHGTRWESAGEGTYTIEDAPDAPTGTTVTLQLRPKDEEDALFDYADEWRIKQIVKRYSDFISFPIRMGDETLNSMKALWARPRSEVSDDEYHQFYRHISHDWSDPLEIINMKAEGTFEYEALLFIPSRAPHDLFQRDARRGLQLYVKRVFIMDDSKELIPDYLRFVKGVVDAADLSLNISREILQQDRHIQMIRRRLVKKVLSTIKDLMANEPEKYATFWREFGRAVKEGLLSEPDNHKPILDIASFATTAGAEPTTLAAYVERMKEDQEEIYYLTGESRSQVENSPHMEAFREQGYEVLILTDPVDEIWVDAVPDFEGRKLRSIARGSVDLKKDEPEKEPEGDFGPLLGFLKDRLDEQVKEVRLSHRLTTSAACLVSDADDITPALEKMYRAMGQDGPRVKRILELNPHHPLVAGLRSAHERGAEDPALPETAELLYGTALLAEGGDLEDPARFAKLLADRLARTV

SEQ ID NO: 8054 - protein, 312 aa, Actinoplanes utahensis
MRCQACGLDNDPALDYCDSCEHPLRDSTAVVSVPPPPIPRPRPAPAVEFDDAGTAADPGFRDTLVEPRPPARPVLVGVAVLALAGAVGGYLLAQDRGDKSGKPDSGAVTSAAARPVGGGTDAARGGATGADDGDGGPGSGDGGPGSGDGGPSSGNGGPSSAAADPQAQGAALDKLLDRSRASRDKLNQAIKSVDGCSGVYAAIGRMREAGDERAAERDTLATLDLSAFPNGESLRSALTSAFEHSLAADQNYVKWAQEKQANDCRNTPATRAYDADGDRESDSAGRAKEQFLGLWNPIAGQLGLQTRDRQGI

SEQ ID NO: 8055 - protein, 110 aa, Actinoplanes utahensis
MPDSNTFNIGGVNGGQNNFGGDHNTFNQQVYGVDAAAVAQLLGRVREHLADFPDPVAAGHAVSELQAAPAAELAHPGRLRSLLEDLHRYAPDGTAALAAVAALVAAVHGG

SEQ ID NO: 8056 - protein, 582 aa, Actinoplanes utahensis
MTTLPSPPLAAPLTMPRYARTSDRLSNTTRYLCTAAFLVRGFADQVVDELIGEMRRSVPPSHGYDLDPIVRQCFRVRRRHLYQQLCATVLYLAALLLSPPLTLTVTGLGLIVRLARSVRLRAFLARHRLGFLRWWVAWFLAGMLVGLPLTLLFSLQNLFRQYLDENTDTTGSAAAAAATGGGGSSLLALLCLLAIVGVTYAFRRDAYRVVTTEFAPDVAHARTRLRDTLVEDRLAMIAAAQRGNVVVHHDDPFLGCGAVEQGWSFSMTLRPRDPSGIRPEEPVPIDPVALNRRLKRAIETMRADWLDEGQRVTGLSVRPYVVADGIRDEHDPVIDPETGMPYTMADDPTVDAIVASPQGGLRQYLRVVIPVRGKAIRDEHGQVILGAQALGISVSAFVHVAVEGGMLYAEFLGTVLPPLRAECQVADTLRPEKVGSYAVGGVLRGAIVDVAAGPYRLARALGRVARLRWRMHTSIRRSQEFRTHDYGARISVRDLASAPEAESYLQRLDGIKYVKLVDRIVGEAIIDHLIENGVDPLEFRQAVNQITLQNSSLVQVGTIQGGQNNFGGDGNVFTTTVGAARA

SEQ ID NO: 8057 - protein, 52 aa, Actinoplanes utahensis
MKKILGWVLLFLLVFWIGTNPGPAADVARSIGDGVATIFTNIGTFFVNLAKG

SEQ ID NO: 8058 - protein, 473 aa, Actinoplanes utahensis
MLSVALPTLAHDLHATTGDLQWFTTSYLLVLAAALLPAGMLGDRFGRKRFLLGALALFGVASAWCAWAGSTGQLIAARSVLGLAAAVIMPLIGAVLTVVFDEQTRPRALSIWVTANALGIPLGPLLGGWLLDHFWWGSVFLINLPIVAFGLLAVVAWVPGSHGDRTRRVDLPGVALSAIGLVGVTYGIIEAGERGFGDPRSLLTVAAGLASLIALAIWQRRAGSPLVDLDLFASRGFTGGAVLATVASFAFFGLLFALPQLFQAVGGQDAFGTGIRLLPVIGGLLVGARLADRLVARLGPRIVVATGLTLMALALLTGARTGVTTGYGYVAAWVAVAGLGLGFVMPPSMNAALGALTPQRSGVGSGLLQAMRQVGSAIGVAVLGTVLNTGYRDGIDAAGLPAAARDSAAAGVAVARRAGDPGMLDTIRRAFTHGMDTALVATGVVAALGVLLVVILPRHAPAADPALLAESGV

SEQ ID NO: 8059 - protein, 198 aa, Actinoplanes utahensis
MTASLRERKKARTRATIREQAMRLFEEQGYAATTVDQIAEAAEVSPSTFFRYFPAKEDVILVDDYDPLVVAAVRAQPPEVPPIEAIRRALRDVFGRVSPELWELERRRQKLFAEVPELRARALHQMTEAIELIAEVIGERAGLPPDDLRVRAMGGAIAGVVLAVLPPGRMIGQTALDPADFERLSDALDLLQQGLPLG

SEQ ID NO: 8060 - protein, 337 aa, Actinoplanes utahensis
MLHGEVRTDEVRRPARCAQSRGLLGESVRDRLGDQCVLRRELFVEAAVGEPGGRADVGHADPGDAPVPEEGGGRGDDPLPVLPGLCLRYPSHAPSIDDVCHLLPCGLLDDARNLSRMELHNAVALVTGANRGFGRHLAAQLLERGAKVYAAARRPESVDLPGSIPLRLDVTDPTSIAAAVAAAPDVTLLINNAGAASGQPLLGGDLDLVRAEMETNYFGPLAVTRAVAPVIEANGGGAVLNVLSVLSWLHPAGLGSYAATKAAAWALTNATREQLAPAGITVTGLHVGYMDTDMAAGVPAEQKADPAGVAKLALDAVAAGAPEVLGDDLTRTVKASL

SEQ ID NO: 8061 - protein, 205 aa, Actinoplanes utahensis
MKLLHIAASPRGGKSESLALAATFLTAAAEAHPGLQIEEWNLWDGTLPEFGPDAAAAKMAVFAGEQPQSPAWDAAVAAFHRFDAADRYLFSVPMWNAGVPYILKQFIDVVSQPGLVFGFDPAAGYTGLLRGKKAAVVYTSAVYGPDRPPAFGSDFQSRYFADWLHWAGVTDQTEIHFRPNLVTADAGTARKAAHAEAREQGRLFL

SEQ ID NO: 8062 - protein, 144 aa, Actinoplanes utahensis
MSDTETAAWAALLRVHAAVVPVLDRTLQSACGLPLTWYDVLLELRHAPDGRLSMGELGERAVVSRTRVSRVVDQLVAAGLATRETNPDDRRSAHAAITDAGRQRLREAAPIYLDGIRRHFTGLMSTDEARVVARALDGVLRKQA

SEQ ID NO: 8063 - protein, 459 aa, Actinoplanes utahensis
MSTITDAGTGQLIVAAVLGIAAVVLLIAGAKWHPFLALIVGTGVLGLVAGADPAKIVTSFTTGLGSTVGSVGVLIALGSMIGALLTESGGADGIVHRLVTGVSGTVLPWAMAGVAALVGLPLFFEIGVVLLVPIVLLVARRTDVGLLRIGIPALAGLSVLHGLVPPHPGPLVAIDSLHADLGLTLIFGLICAIPTVIVAGPLFGNLIAARVPVDVPRRPDVDLDADGAAEREPEAVRRNPGFWPAVLTVLLPVVLMLARAVAELTLPDDNSVRKVLDVLGTPIVALLFGVLLAMWSLGHRAGFDRRETSGIVGGALPPIAGILLIVAAGGGFKQVLVDSGVGRVIADAAKDASINALLLGFLVAVGIRVATGSATVATITAAGIVTPLAATLDRPTLSLLVLAIGCGSLFFSHVNDAGFWLVKEYFGMTVGQTVKTWSVMETIISVVGFGCVMLLSLVV

SEQ ID NO: 8064 - protein, 141 aa, Actinoplanes utahensis
MRIAVPVALIATLALAAGCEVKVNPASMPAPFSVAPVPSASAGQPKYVCTAVYKILTDGAVKLAGFAAGSDDTATEGLQKTFGDMATQVHAAGAKSDDAAQRAAVDEVAAALTRGSRSDDPKAFLNGEFSTVGQKIDGTCG

SEQ ID NO: 8065 - protein, 613 aa, Actinoplanes utahensis
MRRDTFCAVGKLATNVAKFPKNAFIVGTTVVVLAAGGTAFADLVSPSPVTSPSFNGSVYAVAYRGSTVYVGGNFTRAIVGGRTVPRTRLAAFDSRTGALLDWKPGADATVRALAVDSDTVYAAGDFDQINGVKRDAIAGLGATDGALTPMRHTVLGQPAALAAGHGKVYLGGRITAVDGVPRANLAAFDTGTGALDPWAPTTDDTVRAIAAAADRIYLGGSFHRTDGARYTLRLSAVDPVTGVLDPTFLPKPVSQVFALAAAADGVYAALGGQGGRAVSYTRTGATRWTRVFDGDAQAITVLGGTVYVGGHFDKACTTTNNGAKGSCTDGSVPRGKLAAVDPQGNLLDWAPQANGVAGTRSMAANPEISSVSAVGDFTTVGGLPRKRYAEFGAIGPRLEDAPATADYVASYNFDSTVADGTYDDGSGHGHLLRAVTRHGGTTTAVPHGNGQALRFPARCTGPTCPRLVLETASGPDLNPGTRPIRYGAGVQLAPAETSSGENILQKGYSTGGGQYKLQVDGISGKPSCGLGDQVVYLARSRVSIADGGWHSLECRRTGPTLSLLVDDVLQASVAVPPTVAVDTTSPLTVGGKGAGPNNDQFNGTLDDVWVHIG

SEQ ID NO: 8066 - protein, 209 aa, Actinoplanes utahensis
MSDLDRLLEAGSRHVQDDVTYVVEPHPAGSLVLPTGQLAAFDPGVTDEDEEPFTVPVTPGTHPVTAWVAILEKEGREWQRRVAALQVTVRPGVVMSWELALVASDEPADLAPGEFFGYGVETGAGGFADLSVSRILAGWDTEEFEETFDPDEFPEEPIPGHFDHVIDPDTGANLIMAESGWGDGFYPTYVGRTADGEVACFVTDFLVVP

SEQ ID NO: 8067 - protein, 169 aa, Actinoplanes utahensis
MTLRAVAHPARLHILSLLTGAPMTAAEVARELGMNSANAAYHLRTLYTAGVIELAGAERIRGGLAKRYRYDATLHAARASAGGGAPEPDRAVYAAISGELGRRAQHAEPGGVNALADAELWVDPRVWRAARDRINEVVRGLHEAAQKPRTPGALRTSTTVALFTMKATA

SEQ ID NO: 8068 - protein, 430 aa, Actinoplanes utahensis
MRVHGPLAHAPFRFLLSGRLVSSLGNAMAPIALAFAVLDLTDSPGALGLVIGSRTIANVVFLLFGGVLADRLPRHLVMVGTSVAAGVTQAAIAATLSTGTATLTVLTTLSALNGVFSALAMPASAALLPQTVPAEERQQANAWSRLFLNGVAIVGAAAGGVLVAAVGPSWGIACDAATFFLAALLFVFVRTMPTEPIGAHPLPDPPETGVVPPDEAPGGGGIVTDLRTGWAEFSSRTWLWVVVAGFALINACIGGLTTLGPVVANTTFGRATWGFVLAAETVGMIVGGLVALRLRVSRLLLFGVVCAAFQLLPLLTLGLAPRPGFLLGAAFIAGVGVEQFGIAWETTMQEHVPAERLARVYSYDMLGSFIAIPIGQLLAGPIAQAVGVRRTLVGAALLIAVAVVGMLCSRDVRHLRHRLGSPADAQPIEA

SEQ ID NO: 8069 - protein, 183 aa, Actinoplanes utahensis
MSRIRLTAAERQEQIVAAALQAFAQGGYVGTSTDEVARLSGVSQPYVIRIFGSKQELFLATVRYAGQRIEATWRAAADREPTLASLGSAYTDLLAERELLAVLLHGFAASADPVVGDAVRACYGNMYQTVRDLTGATPEEARDFFAMGMLITVLGTMRILGPGAVPPQPWMTSLLSTFPDHTA

SEQ ID NO: 8070 - protein, 462 aa, Actinoplanes utahensis
MTTLASRAPAKTRPLAAVLAAVGIPTFMVSLDNLVVSTALPVIRTELHASITDLQWFVNAYTLPFAAFLLTAAALGDRLGRRRMFLGGIVVFTLASAAAALSTEAWQLTASRAVQGLGGAAITPLALTLLARAVPAHLRNAAVGIWGGITGLGVAVGPVVGGAVVDGLHWSWIFWLNVPVGVVAVVLAATTLDESRGDGRRLDPIGLILSAGGMLLLIWGVVDGPDRGWTSGRVPVMLGAAVVMLTGFLFWQARNRTPMLPLRLFRSRGFSLVNAVTLTFSAGAFGSVFLLSQFFQVVQGASPLQSGLRTLPWTAAPMIVAPLAGMLAGRIGQRILIVAGQVFLAAGLLWMALGLSVTASYTSLIGAFVLAGIGMGLTFAPVSTMVLASVDVNEQGVASGTNNTIREFGVAAGVAALSSIFSSLGGFSSFDAFIDGTRPAVLTGAAVIAVGAVVGLWLPRKA

SEQ ID NO: 8071 - protein, 342 aa, Actinoplanes utahensis
MANRPSVTLSRATTSTANMIFIPTLRSDSSLTESHSHRSRCPGRRLPRCVGSPVVSDLSSIRVIGGRTYDFSRQAVVMAIVNRTPDSFHDKGRTFALEKATEAVRHAAAEGADWIDIGGVPFAPGPEVTAAEELDRVLPVVEAARDLAVVSVDTFRPEVAAEVIRHGAAVVNDTSGLRDPAMADAVAGTDAQLVICHSLAAPRTLYPSPRYRDVTAEVGDFLRQKVALALSRGVRPDQIIIDPGHDLNKNTLHSLEITRRLDEIAAIGYPMLAALSNKDFIGETLDRPQQERLAGTLATVVFSLLRGARIMRVHDVRAASDAIRMTEAILGWREPAYLKHNI

SEQ ID NO: 8072 - protein, 528 aa, Actinoplanes utahensis
MRLLSDRRVGMKIMFAVLVVALLSVTDGLFAMDSLGTTNNMVKAGYQNSLELETIGNLRSAVNRTWLAASDDLLASDATARQAATGAPTDAQNQVDQYAQGYQGYPTGSDEGAALQAFRMAWASYADVLSGTLLPLAAAGDRAKIDAVRTRQIVPLMTEVRGQLARLSDLTVAETAAQETAAESRYQGTRWRVLLMLTFSAGIGVVLALGASRMIVRPLSRCVTVLDRIRTGDLTARAEVTGRDEVGRMADALNHTAQAMSDMVGRVRTSADVLASAAEELSTVSSELSVSAEETSAQVGTVSASAGRVSEGVQAVSAGAEEMGVSIREIANSANEAAGVAAEAARTAEHTNTSVSRLGEASAQISTVVALITSIAEQTNLLALNATIEAARAGEMGKGFAVVAAEVKDLAQETARATQEITAQVAAIQTESDGAVHAIRQIAAVIATINDYATTIAAAVEEQTATTAEIARSVGQAAEGSSAIAGTIAGVAQAAQQVTSGATETQQTAAELARTAAELQATAATYRT

SEQ ID NO: 8073 - protein, 196 aa, Actinoplanes utahensis
MSVWTDQSANLGTMARTPVPGTRDTILTAAAGLFYRYGVRAVGMAQVVEVAGCGKNLLYRHFPSKAQLAAAYLRLSRREREQAAAEALRWAHGPAGQLIALVAEIAESTRRPGWRGCAFRNYLTEFPGATDEPAQLARAYLADSRAVVDRLVTELGGDALLADRIWLIVDALHSSPPDQARVAVDWVTELIRDTTA

SEQ ID NO: 8074 - protein, 165 aa, Actinoplanes utahensis
MLGGLLRPRSGEVRVGGRAVLVSDETGHVFASDVRENLRLAAPAASDGEVVAALRRVGLGPWLDGLAAGLDTWLGTGGSTMSGGQRRRLATARALLADPALLILDEPTEGIDEAGARELMADLLDAASGRTVLVFAHRAEGLDLVDQIYELSNGRLNVGLDRSVR

SEQ ID NO: 8075 - protein, 1300 aa, Actinoplanes utahensis
MAGRRDRRHLRRLPVLVRGPALGPLPADGRHPAAARGPRRRAGIPRQARLPRLAPPLRPAPGGFVGGRRPALGRPARHLRARPGPRPGRRGHRARPEPQPGPAVLGAGRPRRPRRPARHDPARRHLPGAAHHRPGPPPRRRAVPARRQRRHRPAAARRPRHRFPAHPGRRGPLLHHRYARPPGPRSARLHHHRAHGHRRDRRRLHRPRRGRAAQHPVAAVVAHPRIRRRRPVGAATDHRRRRAHPARRRRLPGVVLLGVPPPHRQRADPVMTAARSSVAVAAGSGRSTPIDGTSSAPSASPHPPTAGRPPRGPIDPRLLRHARTARAGIALQSLIGIGQAAATLAIAVALTRLIAPSRPHSLLFGGSRGTAVALLAAAFTTRALLAWAEQVTARRTAAKVTDELRRRLLGTVVRRGPAWVASFGAGRLTTILGTGLDSLRPWFAGYLPSLILGVTLPPVVLTVMFLADPASAVIALLTLPLVPILGALIGWATQARAEQRWAADARLAGHFLDVVQGLGTLRMYGRADRQTTVIADLTDRHRRATLRVLRVAFLSSTALDLVGTLSVGLIAVQAGIRVAGGSMPLAPALLAILLAPEAYRPLREMAARYHAATDATAVITDVTDILTPPAAPLAASRTGSLPDTALSQEWLALTHRIRSCPVPSPSPLSDLAAPPPAFPAATAGLSPALPAAATPTPALPAATAGLPPALPAAATPTPALPAATAPGPSAAATPRWGVLASGVRASYPGSRGEALSLPELAVQAGEFVALRGPSGAGKSTLLRVLAGLHPADRGALAVGRTFHLSQRPALPHARTIGEAFPAGATDDEIRSALHLVGLDTEVTPQTPLGEHGRGISAGQRQRLALAALLHRATHLRRGEPAASRHPGPVVTLLLDEPTAHLDPAAERLVITHLQDFARRGCAVLVVAHRPALLAAADRIVDLTAPPGITTTPADSPACDAPGEASREHPASAPRPAEIAAEGSWWRRPWVAVALGAAAVLGGLTLTGSAAWLLVRAATLPPVLTLSAAVVLVRGSAVARPLLRYLERLVAHDVAFARLGRRRAAVYAELIPRVPGPRLHRRGDLLTRLVDDVDARVDGLLRGWFPILTAAVTVAVAGAAALTIAMSGDAAATIAVSGDAASTGLAARAAGVAPAVLATRIAGVLALGIVITGVVAPLLAWWQADRQEAATGSARAALRDAMVETVDGVEELGTGAARSGVPENRSRTLAVLEARAARTAGLAAAVAHLGWAVAAAGTAIVLGRAGLSAEWSAVLLLGVIALGEPLVALPEAAIARRHATS

SEQ ID NO: 8076 - protein, 467 aa, Actinoplanes utahensis
MDVLDLTRLQFAVVTIYHYLFVPLSICLSATAAGLHLTWLRTRTEKYRNLTKFVGKLLIVTFAVGVVTGLVQEFQFGLGWSAFAKFYGDVFGPTLAVEGMLAFFLEATFLALWYFGWERLPRRIHAATIVVVAIGTLLSAYIILAGNSFMQNPVAYALDPVTGRARLTSFTGLLTNEVVLAAFPHTMAGAAMAGGGLLLALGVWRLAVHDEFRTLARLGAWLMLTGGALTAITGDRLGKVMTSVQPMKMAAAEALYSTTTGAPFSVFALGRLGHEKPFLTVEIPRLLSFLGTGSFDGTVQGIDDLQAQYAAQYGPGSYIPMIPVAFWTFRLMIGAGVAGMALAAYYLWASSARTGRLLPGFLRFADDEVPGWVKRILLLSPLLPAAANTFGWVFTETARQPWLAFGISKVADGISPGLTSAEVIASLAGFTLIYGLLAIAWYRLVLHIAAKPMTPEVSVTENKALAY

SEQ ID NO: 8077 - protein, 116 aa, Actinoplanes utahensis
MALGDLEREVMTQLWDASEPLTVRQVHERLSADRDLAYTTVMTVLDRLAKKELVVQQRADRAYRYAPAQTREEMTAGLMLDALSATPDRDAALAYFLGQLPPGAIQAALNATPKET

SEQ ID NO: 8078 - protein, 305 aa, Actinoplanes utahensis
MTALLLGALGLTLSLVVPGILAGARWPDRAPVAAVLLWQALTLTAVLCALGVVLAAPEELTRAAGAGHPWAVAALVFSLAVAATIVTRLLISLIRVTARARARRERHRTLADLLDRVERHRELGGPEVRVLDAPLPLAYCVPGREPRVVLSDAVLRVLDRAQVDAVLAHEQAHLRHRHELVMESFTAFYQAVPAPLRSRAPLDAVHLLLEMVSDDAARRRTGAAPLRAALSRLSDAVPLAEEAPADPAGESRRRRLDRLAGPEVTSRGLSVLAGLAAASLIVLPTVILIVPWLGQALDAWPFRSL

SEQ ID NO: 8079 - protein, 357 aa, Actinoplanes utahensis
MGCSRSRPGVLPARTRQLTRSAAEWKKGQRTYVKRIGARGVLRSLLCAAVAAGLVLTGPVVAHATPSPSSVEDQIDKQWNELEPVIEDFNDVHGKLIKLQKQQKQLNATLDPLQKKVDVAMKDVRGLASDAYMQGPPTAVAAILSGSPTSLTEKLSLLEQLAANRQDSISEVVKLRDKYAADKAKVDALASEISARDADLNQKKTAIEKEITSLQKLRLQAYGKTDDGPFKTGPCPVDYTNDIGGRAAQKACDLIGKPYVFGSEGPNSYDCSGLTKAAWASVGVHLEHYTKDQWTEGRAVSRSELKPGDLVFYYSDVHHVSIYIGGGMVVHAPHTGDHVRMATIDRGPIAGYRRPSG

SEQ ID NO: 8080 - protein, 402 aa, Actinoplanes utahensis
MSDALIDSLTAAVQARPDDLPLRLHLAELLVTAGRGAEAIEHAAQVLSRDPANETARGLMTSALGGPAPAAAPASGVDWGAMEQQFGDVVPPRFARAGDEPEPVTGDADRAFDVERSTVTLADVGGMAEVKKRLEVSFLGPLRNPKLRSLFGKSLRGGLLLYGPPGCGKTFLARAVAGEMGAAFLSLSITDVLNMWIGSSERNLHDLFESARGHAPCVLFLDEIDALGHKRSQLHSSAMRTVVNQLLTELDGVQGGNEGVFVLAATNAPWDVDAALRRPGRLDRTVLVLPPDGAARAAIVEYHLRDRPVAGVDLAAVAAATEHFSGADLAHLCETAAEYAMRDSIATGEIRMINQGDMLAAAREVRPSTDAWFTTARNVAMFANESGEYDDLAAYLRKRKGR

SEQ ID NO: 8081 - protein, 263 aa, Actinoplanes utahensis
MSVAAPPRAARSQWISALRELGLVAVLFTIYKIGRIAATGHVVEAYDNARRVWDLERWMHLPGELSLQHRLLSWHWLVETANCYYAYVHFPATVACLIWLYVRRPAHYRWTRNVLALLTGAALVVHFGFPLAPPRMLTATGMLDLGRIYGPAVYGAPEHDQLSNQYAAMPSLHVGWAVVVAVALIAATGSRWRGLWLLHPMITLLVVVGTGNHYWLDAVAALALLAAAYLLVRPQFSATLKPPALPAMVPLPRLPLEEPALRR

SEQ ID NO: 8082 - protein, 177 aa, Actinoplanes utahensis
MRDCGALDHRWRVKCPRMPGVTVEEMAEHVRLVAGLGAGGQIVYESVLTRPLDDDLRMVLGTPAFVEGLAAGDQIRIRAGGGFEVVRHGGNLCLLVVPESPPAGDDLGPLRDAFDELGGIVELPPDRRFIVITVPAAAGFDAVEAAINAWTGPRGDHWEYGNVYDVDGNPLNWWESA

SEQ ID NO: 8083 - protein, 130 aa, Actinoplanes utahensis
MSLEVSTELLERAERGEVTDAEFVACVRGSLPYAWEVVSSVMTDLQANGEQFADHEVPPPSESERGQLLRALASDAIRGGLERHFGAKLAFQNCHRVAAFAFSAVGGERYQRFVSPRGQLLNQSPELRNC

SEQ ID NO: 8084 - protein, 205 aa, Actinoplanes utahensis
MILDWPHCENARDLGGTPTMTGGQIRPGALIRSDSHSRLTPAAAEAVRSQPIARILDLRWSRELAADPSPFFADPFYRHVPLLNDPMGYDPPLDTYAPMLDHNTTRIARAFHEIATAPPGTVVIHCRGGRDRTGALTALLLAVAEVSPAEIAADFARTPGTSPEAMHNTLTHATTRYGGVPNYLTHCGVAPTALAAIRHRLTITA
